United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 7

SEQ ID NO: 265402 - RNA, 22 nt, Human
caggaggaaaugugacccugcu

SEQ ID NO: 265403 - RNA, 22 nt, Human
gggcugccaagccugccugccu

SEQ ID NO: 265404 - RNA, 22 nt, Human
uauauguagauuguaccaaugu

SEQ ID NO: 265405 - RNA, 22 nt, Human
ucacuugacuuuccagucuugg

SEQ ID NO: 265406 - RNA, 22 nt, Human
ucagaauaaguuaugaaaugaa

SEQ ID NO: 265407 - RNA, 22 nt, Human
agccugauuuugauaauuauau

SEQ ID NO: 265408 - RNA, 22 nt, Human
aucuguguaugugaccuuaucu

SEQ ID NO: 265409 - RNA, 22 nt, Human
ccccuccuggccacacugucag

SEQ ID NO: 265410 - RNA, 22 nt, Human
uauacacauguguguauucaua

SEQ ID NO: 265411 - RNA, 21 nt, Human
agcaacucugacuagaugagg

SEQ ID NO: 265412 - RNA, 23 nt, Human
uguguccuuaacuguauauacua

SEQ ID NO: 265413 - RNA, 22 nt, Human
ggagaggaaaugccagcacuuc

SEQ ID NO: 265414 - RNA, 22 nt, Human
acugucuguacuucuugcaagg

SEQ ID NO: 265415 - RNA, 22 nt, Human
uguuucuuauccaaguggucug

SEQ ID NO: 265416 - RNA, 22 nt, Human
uucaacucuucaagaucacauc

SEQ ID NO: 265417 - RNA, 22 nt, Human
cacuugaauggcauuguuccuu

SEQ ID NO: 265418 - RNA, 22 nt, Human
guccuuggagucaggcaaggcu

SEQ ID NO: 265419 - RNA, 21 nt, Human
aacugcaaaucuuagacugca

SEQ ID NO: 265420 - RNA, 22 nt, Human
gaugauuccuuuguucauugug

SEQ ID NO: 265421 - RNA, 22 nt, Human
ucugcccuuggcucucuuguug

SEQ ID NO: 265422 - RNA, 22 nt, Human
gaagauuaccugagaccacuug

SEQ ID NO: 265423 - RNA, 22 nt, Human
cccugggacccgcugcagaggc

SEQ ID NO: 265424 - RNA, 22 nt, Human
gggcacagcugcuacccagugc

SEQ ID NO: 265425 - RNA, 22 nt, Human
ugugccugugacagcgaccugg

SEQ ID NO: 265426 - RNA, 22 nt, Human
ucugcugcugcagcuacacuau

SEQ ID NO: 265427 - RNA, 22 nt, Human
uggagcugggaguccugggcug

SEQ ID NO: 265428 - RNA, 22 nt, Human
cagaucaagcuguauggucaga

SEQ ID NO: 265429 - RNA, 21 nt, Human
ucuggcagcaguuuguugagu

SEQ ID NO: 265430 - RNA, 22 nt, Human
acaguuuauguaaagcugccaa

SEQ ID NO: 265431 - RNA, 22 nt, Human
ugaugacaguguuacagcucca

SEQ ID NO: 265432 - RNA, 22 nt, Human
uagaaaugauugguugagcucu

SEQ ID NO: 265433 - RNA, 22 nt, Human
gaggagagaacauuccuccaua

SEQ ID NO: 265434 - RNA, 18 nt, Human
gagcccugagucugcaca

SEQ ID NO: 265435 - RNA, 22 nt, Human
agccaaagaucagugugcaagu

SEQ ID NO: 265436 - RNA, 22 nt, Human
ccaggugugauuucaucugagg

SEQ ID NO: 265437 - RNA, 22 nt, Human
cuguguguccucggacgaguuu

SEQ ID NO: 265438 - RNA, 22 nt, Human
augaguacauugggaucaaaga

SEQ ID NO: 265439 - RNA, 22 nt, Human
agguggggaggagugucucuuu

SEQ ID NO: 265440 - RNA, 22 nt, Human
ucagcuggagauccuuguugug

SEQ ID NO: 265441 - RNA, 22 nt, Human
auauguauugagugccaacugu

SEQ ID NO: 265442 - RNA, 22 nt, Human
agccagucggggccaugcuggg

SEQ ID NO: 265443 - RNA, 22 nt, Human
ggguccaggcguggcccagaug

SEQ ID NO: 265444 - RNA, 22 nt, Human
ucagagcuccuaagggcugauu

SEQ ID NO: 265445 - RNA, 22 nt, Human
cucucagguagagcccaagaau

SEQ ID NO: 265446 - RNA, 22 nt, Human
ucuuugauuuuguuacuaagac

SEQ ID NO: 265447 - RNA, 22 nt, Human
guugaugaaaaugaauugcaug

SEQ ID NO: 265448 - RNA, 22 nt, Human
auguccuguuuuggcuugcucu

SEQ ID NO: 265449 - RNA, 22 nt, Human
cuccugccugugggacugagga

SEQ ID NO: 265450 - RNA, 22 nt, Human
cccagacagugauuuacuuaau

SEQ ID NO: 265451 - RNA, 22 nt, Human
gcaaggagacuguagggccaag

SEQ ID NO: 265452 - RNA, 22 nt, Human
cucugcccgcggaugccacguc

SEQ ID NO: 265453 - RNA, 22 nt, Human
cauuacaaaguuauaaacaguu

SEQ ID NO: 265454 - RNA, 23 nt, Human
agagagaguuugugucagguacc

SEQ ID NO: 265455 - RNA, 22 nt, Human
auaacacuaaauguauguaaca

SEQ ID NO: 265456 - RNA, 22 nt, Human
aaucuaagggaaauuggagaug

SEQ ID NO: 265457 - RNA, 22 nt, Human
uucagccuguucaugcuguugc

SEQ ID NO: 265458 - RNA, 22 nt, Human
ugccagaagugcuuuauaagug

SEQ ID NO: 265459 - RNA, 22 nt, Human
auugcuuuucagacaaugaggc

SEQ ID NO: 265460 - RNA, 22 nt, Human
cugcacagcuggccagggagag

SEQ ID NO: 265461 - RNA, 22 nt, Human
cuagagaaaauguuaauacagu

SEQ ID NO: 265462 - RNA, 22 nt, Human
acaaaaaccguggauucagcau

SEQ ID NO: 265463 - RNA, 22 nt, Human
agaaucauuagagagaaaacuu

SEQ ID NO: 265464 - RNA, 22 nt, Human
ucugggcacugcugagccugua

SEQ ID NO: 265465 - RNA, 22 nt, Human
agacccugucaguguuaggaaa

SEQ ID NO: 265466 - RNA, 22 nt, Human
agaaaguuuggggcugggcacg

SEQ ID NO: 265467 - RNA, 22 nt, Human
cucccugaguuuguggcuaagu

SEQ ID NO: 265468 - RNA, 22 nt, Human
ugagacagucccaugaucugca

SEQ ID NO: 265469 - RNA, 22 nt, Human
gauucuuugacaggguguuggg

SEQ ID NO: 265470 - RNA, 22 nt, Human
ugcugcagcagugcgggcagcu

SEQ ID NO: 265471 - RNA, 22 nt, Human
cauugaaaccuaacauaggcug

SEQ ID NO: 265472 - RNA, 19 nt, Human
ugcauaaauuauauacuuu

SEQ ID NO: 265473 - RNA, 22 nt, Human
ccggucccaggugccccgguga

SEQ ID NO: 265474 - RNA, 17 nt, Human
acagagguuauacagac

SEQ ID NO: 265475 - RNA, 21 nt, Human
aggaaaggaaguccccagggu

SEQ ID NO: 265476 - RNA, 22 nt, Human
cacacaggaaaauuggaauuaa

SEQ ID NO: 265477 - RNA, 22 nt, Human
acagggccauuggaggauuaua

SEQ ID NO: 265478 - RNA, 22 nt, Human
ggcagcaacucggagagaagag

SEQ ID NO: 265479 - RNA, 22 nt, Human
ggggcaggagcccuucuucagc

SEQ ID NO: 265480 - RNA, 22 nt, Human
caggagcccagaguccucagcu

SEQ ID NO: 265481 - RNA, 22 nt, Human
caugaauuuuaagacuguuuuu

SEQ ID NO: 265482 - RNA, 22 nt, Human
acccggagucggagguugcagu

SEQ ID NO: 265483 - RNA, 22 nt, Human
uaaaguguccuagcuaggaggc

SEQ ID NO: 265484 - RNA, 22 nt, Human
cugccagaagguuccugcugca

SEQ ID NO: 265485 - RNA, 22 nt, Human
ggccaugccugugggugcaggc

SEQ ID NO: 265486 - RNA, 22 nt, Human
uuggaaaggagauucuauugug

SEQ ID NO: 265487 - RNA, 22 nt, Human
ucuguucauacagaguauagua

SEQ ID NO: 265488 - RNA, 22 nt, Human
cagcagguccugggcguggccu

SEQ ID NO: 265489 - RNA, 22 nt, Human
cuggaggcuggcuuccccuggc

SEQ ID NO: 265490 - RNA, 18 nt, Human
acaggccucaguccugca

SEQ ID NO: 265491 - RNA, 22 nt, Human
acauuucucauucuccccuaac

SEQ ID NO: 265492 - RNA, 22 nt, Human
cuggcuggaggugagucacuga

SEQ ID NO: 265493 - RNA, 22 nt, Human
gcgguccaggagcgcagguccu

SEQ ID NO: 265494 - RNA, 21 nt, Human
caugugucuuguguuacugcu

SEQ ID NO: 265495 - RNA, 22 nt, Human
cugggccucauccccagaguuu

SEQ ID NO: 265496 - RNA, 22 nt, Human
gaggacacggccuuuuggaaaa

SEQ ID NO: 265497 - RNA, 18 nt, Human
agguucugacaguccaaa

SEQ ID NO: 265498 - RNA, 22 nt, Human
aucauacagaaccugagcacuu

SEQ ID NO: 265499 - RNA, 22 nt, Human
acucuuuacuuaaacucuaagu

SEQ ID NO: 265500 - RNA, 22 nt, Human
gauggcagcagcagccagggau

SEQ ID NO: 265501 - RNA, 22 nt, Human
augcugggaaguccuaaccaca

SEQ ID NO: 265502 - RNA, 22 nt, Human
uuucuaagaugugguuucaagg

SEQ ID NO: 265503 - RNA, 22 nt, Human
acuagaaugcaagcuccacaag

SEQ ID NO: 265504 - RNA, 22 nt, Human
uaauuaguguccagcuucugcu

SEQ ID NO: 265505 - RNA, 22 nt, Human
cucugccaucuuggagcucaag

SEQ ID NO: 265506 - RNA, 22 nt, Human
ggccagaggccauccuccugcu

SEQ ID NO: 265507 - RNA, 22 nt, Human
uuuggacaaacagaauagagcu

SEQ ID NO: 265508 - RNA, 21 nt, Human
ucuagaagagguugagaauau

SEQ ID NO: 265509 - RNA, 22 nt, Human
ucaaugaggugauugcuguccu

SEQ ID NO: 265510 - RNA, 22 nt, Human
agugugagauuaaaccgaauca

SEQ ID NO: 265511 - RNA, 22 nt, Human
acagcacagagugguauggcug

SEQ ID NO: 265512 - RNA, 22 nt, Human
uuugcuuucuguugaacagagu

SEQ ID NO: 265513 - RNA, 22 nt, Human
aagcaggcgagggccuggagca

SEQ ID NO: 265514 - RNA, 22 nt, Human
acuuugaaggggaacauuuuaa

SEQ ID NO: 265515 - RNA, 22 nt, Human
gcaagaacgaauccuacuugcu

SEQ ID NO: 265516 - RNA, 22 nt, Human
aggaauguuaguucuguauaca

SEQ ID NO: 265517 - RNA, 22 nt, Human
uguguacagcaggauuucucaa

SEQ ID NO: 265518 - RNA, 22 nt, Human
uuccugaauauaaagacacuag

SEQ ID NO: 265519 - RNA, 22 nt, Human
gcucaaagaggccuccaaaucc

SEQ ID NO: 265520 - RNA, 22 nt, Human
uccugcagccaagggucaucga

SEQ ID NO: 265521 - RNA, 22 nt, Human
uguuagaaauuauuaguaauau

SEQ ID NO: 265522 - RNA, 22 nt, Human
ggauuaagaccugucaguacac

SEQ ID NO: 265523 - RNA, 22 nt, Human
uccaaacgggagccaaaugagc

SEQ ID NO: 265524 - RNA, 22 nt, Human
acaggugucugcaaguuacugg

SEQ ID NO: 265525 - RNA, 20 nt, Human
cucucuggaaggugggagcc

SEQ ID NO: 265526 - RNA, 22 nt, Human
uggcaggcagugugggagcugg

SEQ ID NO: 265527 - RNA, 18 nt, Human
cuucucccaucuuggcca

SEQ ID NO: 265528 - RNA, 22 nt, Human
aaaguaucugaccgauuauaaa

SEQ ID NO: 265529 - RNA, 22 nt, Human
cucugugguaaaauagcaguau

SEQ ID NO: 265530 - RNA, 22 nt, Human
agaguuacugcagagaugaaua

SEQ ID NO: 265531 - RNA, 22 nt, Human
ugcaggaaacagaggcucaaau

SEQ ID NO: 265532 - RNA, 22 nt, Human
gaagcagagccuaaggcagaca

SEQ ID NO: 265533 - RNA, 22 nt, Human
uauugguauaggcauugaaacu

SEQ ID NO: 265534 - RNA, 22 nt, Human
cucagagauauagucccugcuu

SEQ ID NO: 265535 - RNA, 22 nt, Human
ugagccguggucucugagggug

SEQ ID NO: 265536 - RNA, 22 nt, Human
ucucugggaucagguggcccag

SEQ ID NO: 265537 - RNA, 21 nt, Human
ugaggccucuccugggcuggc

SEQ ID NO: 265538 - RNA, 22 nt, Human
ugauugacuuuagaauagcacu

SEQ ID NO: 265539 - RNA, 22 nt, Human
cuagaaauacaggcacgugcca

SEQ ID NO: 265540 - RNA, 22 nt, Human
gagugaguagcuacaguuuuua

SEQ ID NO: 265541 - RNA, 22 nt, Human
cuagagcuuucugcugguguug

SEQ ID NO: 265542 - RNA, 22 nt, Human
cugagguggcgccucucuuuaa

SEQ ID NO: 265543 - RNA, 22 nt, Human
cuggcaggagcuguggccguag

SEQ ID NO: 265544 - RNA, 22 nt, Human
acuacauuucucaguaccugaa

SEQ ID NO: 265545 - RNA, 18 nt, Human
uucauguuggcuuaggga

SEQ ID NO: 265546 - RNA, 22 nt, Human
acagauggcaccuuuuugcugu

SEQ ID NO: 265547 - RNA, 22 nt, Human
cuguccucuguccucagcagga

SEQ ID NO: 265548 - RNA, 20 nt, Human
gggaggccccagaguccagg

SEQ ID NO: 265549 - RNA, 22 nt, Human
caggcccugggcaggaucagcc

SEQ ID NO: 265550 - RNA, 22 nt, Human
augucuuuauaaauguauaaug

SEQ ID NO: 265551 - RNA, 23 nt, Human
uccuccuggauacaaagggaaca

SEQ ID NO: 265552 - RNA, 22 nt, Human
acaucucuuauaaacucucuga

SEQ ID NO: 265553 - RNA, 22 nt, Human
acuagaaagcacuaagcuaggc

SEQ ID NO: 265554 - RNA, 22 nt, Human
uggaaagacauucagccgcugg

SEQ ID NO: 265555 - RNA, 22 nt, Human
agcacuuuccuggcaaaugugg

SEQ ID NO: 265556 - RNA, 22 nt, Human
ugugucagcauccuuugggaca

SEQ ID NO: 265557 - RNA, 22 nt, Human
aagcacuuuaugucaauguccu

SEQ ID NO: 265558 - RNA, 22 nt, Human
agccaggaucacccggggcugu

SEQ ID NO: 265559 - RNA, 22 nt, Human
gcuggcuccucuguccucacgg

SEQ ID NO: 265560 - RNA, 22 nt, Human
caaagccauagaguagauaaga

SEQ ID NO: 265561 - RNA, 22 nt, Human
guaaacaucagccacucuauuu

SEQ ID NO: 265562 - RNA, 22 nt, Human
auccuggcaagcagaggagaac

SEQ ID NO: 265563 - RNA, 20 nt, Human
gaaauucucguauuaguuua

SEQ ID NO: 265564 - RNA, 23 nt, Human
ccagcucauccauuaccucucuu

SEQ ID NO: 265565 - RNA, 22 nt, Human
agcagcagggcucugcccgugc

SEQ ID NO: 265566 - RNA, 22 nt, Human
uuagacauuaaaugccauuuaa

SEQ ID NO: 265567 - RNA, 22 nt, Human
acccagggccacagcccgcagu

SEQ ID NO: 265568 - RNA, 22 nt, Human
gccagucuucauauucauggug

SEQ ID NO: 265569 - RNA, 22 nt, Human
gugcauuugugcaugcacaugu

SEQ ID NO: 265570 - RNA, 22 nt, Human
uggucaggcugcucugcggcgu

SEQ ID NO: 265571 - RNA, 21 nt, Human
gauuaaauuuaagcuacaugc

SEQ ID NO: 265572 - RNA, 22 nt, Human
ugcccuggaaccaucuacaguc

SEQ ID NO: 265573 - RNA, 22 nt, Human
gaauagcuguaggcuagugucu

SEQ ID NO: 265574 - RNA, 22 nt, Human
gaaaguuacagaaaccauuagu

SEQ ID NO: 265575 - RNA, 22 nt, Human
cagcuguguaugagagcaugcu

SEQ ID NO: 265576 - RNA, 22 nt, Human
cagcaaucgggugauaugcaau

SEQ ID NO: 265577 - RNA, 21 nt, Human
aaaggccauaaucacggagca

SEQ ID NO: 265578 - RNA, 22 nt, Human
uuucccaguucccugcucuaua

SEQ ID NO: 265579 - RNA, 22 nt, Human
ugcccugaggcacuccauccau

SEQ ID NO: 265580 - RNA, 22 nt, Human
uccuggcaaagauguugguguu

SEQ ID NO: 265581 - RNA, 22 nt, Human
acaggccuuaggagagaugggg

SEQ ID NO: 265582 - RNA, 22 nt, Human
uucacauucagaaaaagcccgu

SEQ ID NO: 265583 - RNA, 22 nt, Human
ugugucaauuuucauuccuacu

SEQ ID NO: 265584 - RNA, 19 nt, Human
agcccccagacagcaggcc

SEQ ID NO: 265585 - RNA, 22 nt, Human
ccugcucuccauacacuuucua

SEQ ID NO: 265586 - RNA, 22 nt, Human
ucacaaauagcuauauuaagga

SEQ ID NO: 265587 - RNA, 22 nt, Human
ggcauguuucaucacaucaaga

SEQ ID NO: 265588 - RNA, 22 nt, Human
uugaaaggugcugugugcugau

SEQ ID NO: 265589 - RNA, 19 nt, Human
aggcacagguugucuggac

SEQ ID NO: 265590 - RNA, 22 nt, Human
cagcauuucaggaggcugaggu

SEQ ID NO: 265591 - RNA, 22 nt, Human
ccacugucagaggggcugugcc

SEQ ID NO: 265592 - RNA, 22 nt, Human
gcauggccuugcuguaguggua

SEQ ID NO: 265593 - RNA, 22 nt, Human
cagaggccaggcugccugacug

SEQ ID NO: 265594 - RNA, 22 nt, Human
cuacagcuguguguuuaugugc

SEQ ID NO: 265595 - RNA, 22 nt, Human
cugggcccaggcggcucucgga

SEQ ID NO: 265596 - RNA, 22 nt, Human
caugccauuugguggauugaga

SEQ ID NO: 265597 - RNA, 22 nt, Human
uggcugagaaguucugguggga

SEQ ID NO: 265598 - RNA, 22 nt, Human
guguuacuuaccugggacagca

SEQ ID NO: 265599 - RNA, 22 nt, Human
aaucuuuuaggggauccugagg

SEQ ID NO: 265600 - RNA, 22 nt, Human
agcuuacaguucaaugacaaag

SEQ ID NO: 265601 - RNA, 22 nt, Human
uauaauuuuagaagagauggaa

SEQ ID NO: 265602 - RNA, 22 nt, Human
gaggcauaaguagaagagauug

SEQ ID NO: 265603 - RNA, 22 nt, Human
cucucugucuuggcauuugguc

SEQ ID NO: 265604 - RNA, 22 nt, Human
gccuguguggaugggccccugg

SEQ ID NO: 265605 - RNA, 22 nt, Human
ccuccugucuccuuccuauauu

SEQ ID NO: 265606 - RNA, 22 nt, Human
uucauguuggauucacugugag

SEQ ID NO: 265607 - RNA, 22 nt, Human
auaaaaaggacagauguggucu

SEQ ID NO: 265608 - RNA, 22 nt, Human
gccaggcuccccggaucccugg

SEQ ID NO: 265609 - RNA, 22 nt, Human
aggguccaucaaggacugcaca

SEQ ID NO: 265610 - RNA, 22 nt, Human
gcugggcuggaaggccaaggca

SEQ ID NO: 265611 - RNA, 22 nt, Human
uacauguaauuuucauaguaag

SEQ ID NO: 265612 - RNA, 22 nt, Human
agccagagcagggaauuggaca

SEQ ID NO: 265613 - RNA, 22 nt, Human
agcuaaaugugaaaugucaacc

SEQ ID NO: 265614 - RNA, 22 nt, Human
ugggggugugccagggaccucc

SEQ ID NO: 265615 - RNA, 22 nt, Human
aggaaacucugagcggaccagc

SEQ ID NO: 265616 - RNA, 22 nt, Human
ugccgugucccauugugcucug

SEQ ID NO: 265617 - RNA, 21 nt, Human
ugucacauugucccugcugcu

SEQ ID NO: 265618 - RNA, 21 nt, Human
ugagucuuuugcacaaggaau

SEQ ID NO: 265619 - RNA, 22 nt, Human
guccugggcaugcagggcuuuc

SEQ ID NO: 265620 - RNA, 22 nt, Human
aguccaggccuccucuuuuccu

SEQ ID NO: 265621 - RNA, 22 nt, Human
uaaauuauggcuggcagagcag

SEQ ID NO: 265622 - RNA, 22 nt, Human
gagaaugggaaugaaaguagca

SEQ ID NO: 265623 - RNA, 22 nt, Human
cuggagugacuuuguuccuuuu

SEQ ID NO: 265624 - RNA, 22 nt, Human
uauguuacaaaguuuuucuaaa

SEQ ID NO: 265625 - RNA, 22 nt, Human
uaaaucuuuaggaagcucaaac

SEQ ID NO: 265626 - RNA, 22 nt, Human
uaggaaauggcucaguuacugc

SEQ ID NO: 265627 - RNA, 22 nt, Human
aaggcugaggcagugaggcaga

SEQ ID NO: 265628 - RNA, 21 nt, Human
ccugggccaaauucccuggac

SEQ ID NO: 265629 - RNA, 17 nt, Human
uccuggccuggugugug

SEQ ID NO: 265630 - RNA, 22 nt, Human
uuccuggggacuuaccgucauu

SEQ ID NO: 265631 - RNA, 22 nt, Human
ccuucucccucugagaggaacc

SEQ ID NO: 265632 - RNA, 22 nt, Human
agggcagacuaggauggaagug

SEQ ID NO: 265633 - RNA, 22 nt, Human
cugugggcugaaagugcucccg

SEQ ID NO: 265634 - RNA, 22 nt, Human
uauuucccagggagcaacaagc

SEQ ID NO: 265635 - RNA, 22 nt, Human
ccagaauagaaggcagcuguca

SEQ ID NO: 265636 - RNA, 22 nt, Human
acaggcugacuuccugccaugu

SEQ ID NO: 265637 - RNA, 22 nt, Human
auggcuuuucacagaggguucu

SEQ ID NO: 265638 - RNA, 22 nt, Human
aaaugcagauuuugaugcagca

SEQ ID NO: 265639 - RNA, 22 nt, Human
acuguaagguaaggauaaaacc

SEQ ID NO: 265640 - RNA, 22 nt, Human
uuuaccuggauucuuacuuccu

SEQ ID NO: 265641 - RNA, 22 nt, Human
agucccagaucuacaggaggga

SEQ ID NO: 265642 - RNA, 21 nt, Human
aggagccagccugucagucua

SEQ ID NO: 265643 - RNA, 22 nt, Human
augcccugugacucuccuggac

SEQ ID NO: 265644 - RNA, 22 nt, Human
uauacuuaugcuaaaaaauguu

SEQ ID NO: 265645 - RNA, 22 nt, Human
acuucccacacccuguuuucuc

SEQ ID NO: 265646 - RNA, 22 nt, Human
uuuacaggguucaagaaugaaa

SEQ ID NO: 265647 - RNA, 22 nt, Human
gcugccaggcccuggggcuaug

SEQ ID NO: 265648 - RNA, 22 nt, Human
ccuguauuugcaacuuuucuua

SEQ ID NO: 265649 - RNA, 22 nt, Human
agucauuucccauucuucauau

SEQ ID NO: 265650 - RNA, 22 nt, Human
uggccucugugggagcugagca

SEQ ID NO: 265651 - RNA, 22 nt, Human
uuugcauuaguuuagauuucaa

SEQ ID NO: 265652 - RNA, 22 nt, Human
cacagagaucggaacagaagua

SEQ ID NO: 265653 - RNA, 22 nt, Human
uauuugcaggcuuuugucaugg

SEQ ID NO: 265654 - RNA, 22 nt, Human
agacuccaggagggaggcugcu

SEQ ID NO: 265655 - RNA, 22 nt, Human
cagucccaucucccagguggcu

SEQ ID NO: 265656 - RNA, 22 nt, Human
ccauaaucuggcuuugagagag

SEQ ID NO: 265657 - RNA, 22 nt, Human
aggcagcugaccacaguaugau

SEQ ID NO: 265658 - RNA, 22 nt, Human
cuucuguggauguuggaugcau

SEQ ID NO: 265659 - RNA, 22 nt, Human
uaaaugacauucuuaagucuug

SEQ ID NO: 265660 - RNA, 22 nt, Human
agccacugugugaccagcuguc

SEQ ID NO: 265661 - RNA, 22 nt, Human
caggcuuggguucucugaguua

SEQ ID NO: 265662 - RNA, 22 nt, Human
gaggcaggguguugauuacaga

SEQ ID NO: 265663 - RNA, 22 nt, Human
aggcaugacuuuggcugaagaa

SEQ ID NO: 265664 - RNA, 22 nt, Human
uacuuucauggguuuucuuuau

SEQ ID NO: 265665 - RNA, 17 nt, Human
uuugauagaaucagagu

SEQ ID NO: 265666 - RNA, 19 nt, Human
auucagcauucugcacuuc

SEQ ID NO: 265667 - RNA, 22 nt, Human
ccugucuggccaccagggcgau

SEQ ID NO: 265668 - RNA, 22 nt, Human
acauuucuaucauccuguaaug

SEQ ID NO: 265669 - RNA, 22 nt, Human
gcugcagcucgccuuccggccu

SEQ ID NO: 265670 - RNA, 22 nt, Human
acugucugugccagaugcuggg

SEQ ID NO: 265671 - RNA, 22 nt, Human
uaacugaacaucucaaaucaag

SEQ ID NO: 265672 - RNA, 22 nt, Human
cuugugcaauugacauugaauc

SEQ ID NO: 265673 - RNA, 22 nt, Human
acaugcauacacguacauaccu

SEQ ID NO: 265674 - RNA, 22 nt, Human
gaggccagugaaauguuauaaa

SEQ ID NO: 265675 - RNA, 22 nt, Human
agagcaauggcauccagcugau

SEQ ID NO: 265676 - RNA, 22 nt, Human
aaugacagagcacugaacuugg

SEQ ID NO: 265677 - RNA, 22 nt, Human
acacaggacagggauguguuuu

SEQ ID NO: 265678 - RNA, 20 nt, Human
ugcauuaaguggcauugagc

SEQ ID NO: 265679 - RNA, 22 nt, Human
uaguuuccauguuauacaguuu

SEQ ID NO: 265680 - RNA, 22 nt, Human
auuauuaaagcuuaggucuuau

SEQ ID NO: 265681 - RNA, 22 nt, Human
uuaaauuagucaagcuucucug

SEQ ID NO: 265682 - RNA, 22 nt, Human
ccaguccauggauucccaaggu

SEQ ID NO: 265683 - RNA, 22 nt, Human
cccaggucucccugcagcccug

SEQ ID NO: 265684 - RNA, 22 nt, Human
uuacaguuguucuaucagcaug

SEQ ID NO: 265685 - RNA, 22 nt, Human
gagacacaagacgcaacucugu

SEQ ID NO: 265686 - RNA, 22 nt, Human
acagccagaagucaggguggga

SEQ ID NO: 265687 - RNA, 22 nt, Human
ugcauuaugcuacccagaagcu

SEQ ID NO: 265688 - RNA, 22 nt, Human
gagagggguuugccauccuaug

SEQ ID NO: 265689 - RNA, 22 nt, Human
aggcaacaaggguagucaguga

SEQ ID NO: 265690 - RNA, 22 nt, Human
caguugauguuuagacucugca

SEQ ID NO: 265691 - RNA, 22 nt, Human
cagguuggggacuuaggaugac

SEQ ID NO: 265692 - RNA, 22 nt, Human
agcuggggcauuuauccacuaa

SEQ ID NO: 265693 - RNA, 22 nt, Human
cugaggcuuguccucucagcuu

SEQ ID NO: 265694 - RNA, 22 nt, Human
cucugggcugaauggcugaacc

SEQ ID NO: 265695 - RNA, 22 nt, Human
aacacucaauuuacaaacucug

SEQ ID NO: 265696 - RNA, 22 nt, Human
gacacaguucuguucuaguagg

SEQ ID NO: 265697 - RNA, 22 nt, Human
gcucuagcccauuuccugcuug

SEQ ID NO: 265698 - RNA, 22 nt, Human
caugugucuuuauggagccaca

SEQ ID NO: 265699 - RNA, 22 nt, Human
aggccucagccugccaggccug

SEQ ID NO: 265700 - RNA, 22 nt, Human
uagcuuaacagcaaaacuguug

SEQ ID NO: 265701 - RNA, 22 nt, Human
ggggaacaccgggcagaggcgc

SEQ ID NO: 265702 - RNA, 22 nt, Human
cucauuuauccaaaagccaguu

SEQ ID NO: 265703 - RNA, 21 nt, Human
gcagaugggagucaucaggcu

SEQ ID NO: 265704 - RNA, 22 nt, Human
aaaucucauuauuuauaccaua

SEQ ID NO: 265705 - RNA, 22 nt, Human
uagggaugaagaugguauuucu

SEQ ID NO: 265706 - RNA, 22 nt, Human
ggggcccagggcagcagugcag

SEQ ID NO: 265707 - RNA, 22 nt, Human
uauguacaugauuucauuugcu

SEQ ID NO: 265708 - RNA, 22 nt, Human
uuauuaggaacucaggauuuuu

SEQ ID NO: 265709 - RNA, 22 nt, Human
acauucuaacauuguacagaua

SEQ ID NO: 265710 - RNA, 22 nt, Human
cuacaucucaccuuccaggaca

SEQ ID NO: 265711 - RNA, 22 nt, Human
uuuuggaaucauuuacagagca

SEQ ID NO: 265712 - RNA, 22 nt, Human
aacagucuaaauuauacccuuu

SEQ ID NO: 265713 - RNA, 22 nt, Human
uaguuaaaauaauggagauguu

SEQ ID NO: 265714 - RNA, 22 nt, Human
uccugccagcuggggcugcuuc

SEQ ID NO: 265715 - RNA, 22 nt, Human
uucuuucucaacaugaauguuu

SEQ ID NO: 265716 - RNA, 22 nt, Human
gcacuucuggccuggccugugu

SEQ ID NO: 265717 - RNA, 21 nt, Human
cugcaucugagucauuaugcc

SEQ ID NO: 265718 - RNA, 22 nt, Human
cacuucucugauaaucucaguu

SEQ ID NO: 265719 - RNA, 20 nt, Human
ucccaagggcugagaggauc

SEQ ID NO: 265720 - RNA, 22 nt, Human
gcuuuacaaguggugcagauua

SEQ ID NO: 265721 - RNA, 22 nt, Human
ccuguccuccggagcgggcugu

SEQ ID NO: 265722 - RNA, 22 nt, Human
uaguaguaauuguuaucuuauu

SEQ ID NO: 265723 - RNA, 22 nt, Human
cccagccuuugcuuccugguuc

SEQ ID NO: 265724 - RNA, 22 nt, Human
aguaacaagugccaacguuaga

SEQ ID NO: 265725 - RNA, 23 nt, Human
agcaccaggaacagugugguccu

SEQ ID NO: 265726 - RNA, 23 nt, Human
ucugagaagguuucagccagacu

SEQ ID NO: 265727 - RNA, 22 nt, Human
caggcagcucgaugccuuguug

SEQ ID NO: 265728 - RNA, 22 nt, Human
uuuaacuuaaucugcuugauga

SEQ ID NO: 265729 - RNA, 22 nt, Human
ugaaggcugguaguuugggcug

SEQ ID NO: 265730 - RNA, 22 nt, Human
cauacuuuugcccugacauucu

SEQ ID NO: 265731 - RNA, 22 nt, Human
caauuucaugccauguauugcu

SEQ ID NO: 265732 - RNA, 22 nt, Human
uccugggaugacuuuugaaaug

SEQ ID NO: 265733 - RNA, 22 nt, Human
augggacacacaaggaaguaaa

SEQ ID NO: 265734 - RNA, 18 nt, Human
uccaggcuccaggcuaac

SEQ ID NO: 265735 - RNA, 22 nt, Human
ccucccugucuaccuguugugg

SEQ ID NO: 265736 - RNA, 22 nt, Human
agacauuuugcauucccugaag

SEQ ID NO: 265737 - RNA, 22 nt, Human
cacacaugucucuccaugcucu

SEQ ID NO: 265738 - RNA, 22 nt, Human
auuucugauaaacguaagcugc

SEQ ID NO: 265739 - RNA, 22 nt, Human
agagcuggguggacuuguaguu

SEQ ID NO: 265740 - RNA, 22 nt, Human
ggccuuccuggcggcucagggu

SEQ ID NO: 265741 - RNA, 22 nt, Human
caaggaaaagaaguauuucaga

SEQ ID NO: 265742 - RNA, 19 nt, Human
auguucuauccuccaaguu

SEQ ID NO: 265743 - RNA, 22 nt, Human
ggcccugggacacaacaccgaa

SEQ ID NO: 265744 - RNA, 22 nt, Human
acuguccucgaaguaccugugc

SEQ ID NO: 265745 - RNA, 22 nt, Human
uggagcugguucuggggaagcu

SEQ ID NO: 265746 - RNA, 22 nt, Human
uggcuucuaaaguuucuuuuag

SEQ ID NO: 265747 - RNA, 22 nt, Human
gaaagugcuuagagugugguau

SEQ ID NO: 265748 - RNA, 22 nt, Human
agugcaugccuuccuguggaug

SEQ ID NO: 265749 - RNA, 22 nt, Human
aguaauaauuuauauuagggag

SEQ ID NO: 265750 - RNA, 22 nt, Human
ucuccagguggggucaccuuuu

SEQ ID NO: 265751 - RNA, 22 nt, Human
aggaagugcagggggaaguacu

SEQ ID NO: 265752 - RNA, 22 nt, Human
gaaaugugugacaaguuucaau

SEQ ID NO: 265753 - RNA, 22 nt, Human
agcagcaggcuagggaacugcu

SEQ ID NO: 265754 - RNA, 17 nt, Human
uucaaugauuaaugcau

SEQ ID NO: 265755 - RNA, 19 nt, Human
gacaggacgaagggaaguu

SEQ ID NO: 265756 - RNA, 22 nt, Human
gaggugucugcuguguucaaag

SEQ ID NO: 265757 - RNA, 19 nt, Human
gagcaacauauguaaacuc

SEQ ID NO: 265758 - RNA, 22 nt, Human
ucuuccagcaaugugaaaucac

SEQ ID NO: 265759 - RNA, 22 nt, Human
uuuggaaugguaccuucaguug

SEQ ID NO: 265760 - RNA, 22 nt, Human
gauggaggaaaaguuggaaugc

SEQ ID NO: 265761 - RNA, 22 nt, Human
ugauuuacuucuggauaaaucc

SEQ ID NO: 265762 - RNA, 22 nt, Human
uuagaaacuuuggaggauagau

SEQ ID NO: 265763 - RNA, 23 nt, Human
acagugugguggacaaggagcag

SEQ ID NO: 265764 - RNA, 22 nt, Human
ccagagggccuuuggaguuauc

SEQ ID NO: 265765 - RNA, 22 nt, Human
ggaggcacuucccgucucagcc

SEQ ID NO: 265766 - RNA, 22 nt, Human
cagaaagcaagccauucacugu

SEQ ID NO: 265767 - RNA, 22 nt, Human
uuagauaauguuauuguaauuu

SEQ ID NO: 265768 - RNA, 22 nt, Human
uguucuuugcuguugauguaga

SEQ ID NO: 265769 - RNA, 22 nt, Human
cuaggcagacugagcucuaggg

SEQ ID NO: 265770 - RNA, 22 nt, Human
uuucuauuggcgucacuguugu

SEQ ID NO: 265771 - RNA, 22 nt, Human
aggaauguaacaggaguaaaaa

SEQ ID NO: 265772 - RNA, 22 nt, Human
uaguuugucaaccacugucaca

SEQ ID NO: 265773 - RNA, 22 nt, Human
auuguacagaugagguaaguga

SEQ ID NO: 265774 - RNA, 22 nt, Human
ucugugucugcagaaguucagc

SEQ ID NO: 265775 - RNA, 22 nt, Human
uaaugcacagaauugacauggg

SEQ ID NO: 265776 - RNA, 22 nt, Human
caccagcgacugugaccagcaa

SEQ ID NO: 265777 - RNA, 22 nt, Human
uauauugucucugccuugucug

SEQ ID NO: 265778 - RNA, 22 nt, Human
uaaggcauucucaugcugugaa

SEQ ID NO: 265779 - RNA, 19 nt, Human
caacugcccccucaaacau

SEQ ID NO: 265780 - RNA, 22 nt, Human
acuguucuucccauuuauauug

SEQ ID NO: 265781 - RNA, 22 nt, Human
ccuagaacacaaccuauauuag

SEQ ID NO: 265782 - RNA, 22 nt, Human
caggucugcagacagggccaug

SEQ ID NO: 265783 - RNA, 22 nt, Human
ggucagcaucugguugagggca

SEQ ID NO: 265784 - RNA, 22 nt, Human
uuuaguuauugcacagaauuag

SEQ ID NO: 265785 - RNA, 20 nt, Human
acauguacagacagguuucu

SEQ ID NO: 265786 - RNA, 22 nt, Human
ucugagagagcaccuauccacu

SEQ ID NO: 265787 - RNA, 18 nt, Human
uccugcagcuucuaugua

SEQ ID NO: 265788 - RNA, 21 nt, Human
cuggcccagggaucugcauuu

SEQ ID NO: 265789 - RNA, 22 nt, Human
cuuccuggcaaagcaaucagag

SEQ ID NO: 265790 - RNA, 22 nt, Human
caggccugugacaccgugucug

SEQ ID NO: 265791 - RNA, 22 nt, Human
ugcagggccuucuagaccaugg

SEQ ID NO: 265792 - RNA, 21 nt, Human
uauacaugugugcauacgugu

SEQ ID NO: 265793 - RNA, 22 nt, Human
uuacaguguuacuugaugucca

SEQ ID NO: 265794 - RNA, 22 nt, Human
ugugccauuucuauucugcagc

SEQ ID NO: 265795 - RNA, 22 nt, Human
agacauagaaaaucauuaggaa

SEQ ID NO: 265796 - RNA, 22 nt, Human
ucacaacaggaaggaccagcug

SEQ ID NO: 265797 - RNA, 22 nt, Human
caggcucagcaggagccugacc

SEQ ID NO: 265798 - RNA, 22 nt, Human
acagccaggaggaacucaguga

SEQ ID NO: 265799 - RNA, 23 nt, Human
auaaauuacuaucucccuagagc

SEQ ID NO: 265800 - RNA, 20 nt, Human
uggcuccuggcuccucccuc

SEQ ID NO: 265801 - RNA, 22 nt, Human
uguuggggucaggagcuagccu

SEQ ID NO: 265802 - RNA, 16 nt, Human
ccucugggauguuugc

SEQ ID NO: 265803 - RNA, 22 nt, Human
gcaggugguggggcuaugaucu

SEQ ID NO: 265804 - RNA, 22 nt, Human
gcuggaggauggacuggaagaa

SEQ ID NO: 265805 - RNA, 22 nt, Human
ucuccaaaucaaucaauaugaa

SEQ ID NO: 265806 - RNA, 19 nt, Human
uguguucauucaucagagg

SEQ ID NO: 265807 - RNA, 22 nt, Human
aggaaugucgucauaaacauga

SEQ ID NO: 265808 - RNA, 22 nt, Human
uccuuauaguugucuuugaacc

SEQ ID NO: 265809 - RNA, 22 nt, Human
gaacaaauucucaucaacuugu

SEQ ID NO: 265810 - RNA, 17 nt, Human
uccuggcaguccccugg

SEQ ID NO: 265811 - RNA, 22 nt, Human
auaguacaaucaguuaauuagu

SEQ ID NO: 265812 - RNA, 22 nt, Human
uccaggcugggcugaagggugc

SEQ ID NO: 265813 - RNA, 22 nt, Human
acauguaagacuagcuuaaagu

SEQ ID NO: 265814 - RNA, 22 nt, Human
aagacagaagugauuugaugug

SEQ ID NO: 265815 - RNA, 22 nt, Human
aggugucuggauggguguccuu

SEQ ID NO: 265816 - RNA, 22 nt, Human
aaugugaaaccgcacagaauaa

SEQ ID NO: 265817 - RNA, 22 nt, Human
agauggcaggcccugugggggu

SEQ ID NO: 265818 - RNA, 22 nt, Human
uuagaaagaacuuuagauauca

SEQ ID NO: 265819 - RNA, 22 nt, Human
uaacacugcuucauuuuggaga

SEQ ID NO: 265820 - RNA, 22 nt, Human
acucuuauaguauugguuauua

SEQ ID NO: 265821 - RNA, 22 nt, Human
ggagcccucaccggcgagugcc

SEQ ID NO: 265822 - RNA, 22 nt, Human
gggcucugggucgugucuccau

SEQ ID NO: 265823 - RNA, 22 nt, Human
ggcccaguguaccccaggcagu

SEQ ID NO: 265824 - RNA, 22 nt, Human
uccaagaagucaucuaaacugu

SEQ ID NO: 265825 - RNA, 22 nt, Human
aagauuuucagugccuaaaaca

SEQ ID NO: 265826 - RNA, 22 nt, Human
ggcaggcaucaucaguugauca

SEQ ID NO: 265827 - RNA, 22 nt, Human
gagcaguggugguguguuagag

SEQ ID NO: 265828 - RNA, 22 nt, Human
gagaaggccaggaacccagugu

SEQ ID NO: 265829 - RNA, 22 nt, Human
cucucugaugucaggucgcuga

SEQ ID NO: 265830 - RNA, 22 nt, Human
ugucauuuccugaaugcugagu

SEQ ID NO: 265831 - RNA, 22 nt, Human
gaggaagaagggauuagaacuc

SEQ ID NO: 265832 - RNA, 22 nt, Human
gucuuuauuacaaauccuuuuc

SEQ ID NO: 265833 - RNA, 22 nt, Human
ucaggcuugcgauggaagucac

SEQ ID NO: 265834 - RNA, 22 nt, Human
agacucuuggucauuggcauua

SEQ ID NO: 265835 - RNA, 22 nt, Human
ugcuuaaacauccagacaguau

SEQ ID NO: 265836 - RNA, 22 nt, Human
ggcuuguccuucugguugucuu

SEQ ID NO: 265837 - RNA, 22 nt, Human
caauacacuaaacuucucugaa

SEQ ID NO: 265838 - RNA, 17 nt, Human
gccucugcuugugucau

SEQ ID NO: 265839 - RNA, 22 nt, Human
ccaggagcaccaggccugugcc

SEQ ID NO: 265840 - RNA, 22 nt, Human
aaauggcaguagaaaagaaucc

SEQ ID NO: 265841 - RNA, 22 nt, Human
aagccaaaggcuccagugaccu

SEQ ID NO: 265842 - RNA, 22 nt, Human
cuucccuucugugcagggcaga

SEQ ID NO: 265843 - RNA, 22 nt, Human
gcucagcuggaccaucguguuu

SEQ ID NO: 265844 - RNA, 22 nt, Human
ucauauuuauauguuggcacag

SEQ ID NO: 265845 - RNA, 22 nt, Human
gaggaagcagggcuuggcugag

SEQ ID NO: 265846 - RNA, 22 nt, Human
aggcugcucugcgaagucagcu

SEQ ID NO: 265847 - RNA, 22 nt, Human
gaaguugauagaguacaugauu

SEQ ID NO: 265848 - RNA, 22 nt, Human
guggcagaacuaugugauugcu

SEQ ID NO: 265849 - RNA, 22 nt, Human
acagcuggcaggggggcaugaa

SEQ ID NO: 265850 - RNA, 22 nt, Human
cccugcagagagugcuuuugug

SEQ ID NO: 265851 - RNA, 22 nt, Human
ugccacagaggugaagcccacu

SEQ ID NO: 265852 - RNA, 21 nt, Human
gaagagaguccucauccugag

SEQ ID NO: 265853 - RNA, 22 nt, Human
agaaguauuuggcuaaaagaca

SEQ ID NO: 265854 - RNA, 22 nt, Human
cucccuggugacucccaaagcu

SEQ ID NO: 265855 - RNA, 21 nt, Human
ugaauuucgguauggcuauaa

SEQ ID NO: 265856 - RNA, 22 nt, Human
uguccucacaggaaugaacuuu

SEQ ID NO: 265857 - RNA, 22 nt, Human
cguggcuggggaggucagccag

SEQ ID NO: 265858 - RNA, 23 nt, Human
uccuccaaucucauggcccuuaa

SEQ ID NO: 265859 - RNA, 22 nt, Human
cuggcagggugggcuuugcuuu

SEQ ID NO: 265860 - RNA, 22 nt, Human
caucaaagggccuguggugcag

SEQ ID NO: 265861 - RNA, 22 nt, Human
gucuggagagcugagcagaguu

SEQ ID NO: 265862 - RNA, 22 nt, Human
aauggcuucugaagcacacuuu

SEQ ID NO: 265863 - RNA, 22 nt, Human
aaggccagacaggaccacaucu

SEQ ID NO: 265864 - RNA, 21 nt, Human
aaagugguaaggauuauuuug

SEQ ID NO: 265865 - RNA, 22 nt, Human
ugagcaccuacuguauuccagg

SEQ ID NO: 265866 - RNA, 22 nt, Human
gcuuucugaagcaguguuucuc

SEQ ID NO: 265867 - RNA, 22 nt, Human
uuccaggauggcaauaaugaau

SEQ ID NO: 265868 - RNA, 22 nt, Human
ucaugaauauugaaugcuucau

SEQ ID NO: 265869 - RNA, 22 nt, Human
ucuuccugcuuuggugaggcuu

SEQ ID NO: 265870 - RNA, 22 nt, Human
uauuuuagguaauauccauugu

SEQ ID NO: 265871 - RNA, 22 nt, Human
ccaggaucuguacaccucugag

SEQ ID NO: 265872 - RNA, 22 nt, Human
aauaagauuacugguugucuga

SEQ ID NO: 265873 - RNA, 22 nt, Human
cauuuucaugaguuucuguuca

SEQ ID NO: 265874 - RNA, 22 nt, Human
ccagcaucagcacccaaggagc

SEQ ID NO: 265875 - RNA, 22 nt, Human
ucucaggcugacauugggacuc

SEQ ID NO: 265876 - RNA, 22 nt, Human
ucugggcccugagauguucuuc

SEQ ID NO: 265877 - RNA, 22 nt, Human
cugugccuggggggcagagcug

SEQ ID NO: 265878 - RNA, 22 nt, Human
ggcugggagcuggacaggccgg

SEQ ID NO: 265879 - RNA, 22 nt, Human
acaguuaaggaaauggagguuc

SEQ ID NO: 265880 - RNA, 22 nt, Human
ugaggcaguauucuccauucca

SEQ ID NO: 265881 - RNA, 22 nt, Human
ggugcugccuauagucugaaac

SEQ ID NO: 265882 - RNA, 22 nt, Human
ugcagcagguauggcaagcucc

SEQ ID NO: 265883 - RNA, 22 nt, Human
ugggcaaagucacauacaugau

SEQ ID NO: 265884 - RNA, 22 nt, Human
acaggucugugugcacagugcu

SEQ ID NO: 265885 - RNA, 22 nt, Human
cauuucagugucuugugaugaa

SEQ ID NO: 265886 - RNA, 22 nt, Human
aggccaggcgagacacccggcu

SEQ ID NO: 265887 - RNA, 22 nt, Human
cauugcaacuucaaacuccugg

SEQ ID NO: 265888 - RNA, 22 nt, Human
ucaggaaacuacaguugaacua

SEQ ID NO: 265889 - RNA, 22 nt, Human
ugaaaucaugaacaagguaggu

SEQ ID NO: 265890 - RNA, 23 nt, Human
ucacaggggccagcgcucugugg

SEQ ID NO: 265891 - RNA, 22 nt, Human
cagcaggucaugaaagaaaacc

SEQ ID NO: 265892 - RNA, 23 nt, Human
aaggcauuggcuucucucauuuc

SEQ ID NO: 265893 - RNA, 22 nt, Human
ucugagcuauguaagacuugga

SEQ ID NO: 265894 - RNA, 22 nt, Human
agaugaagauaucugcaggggc

SEQ ID NO: 265895 - RNA, 22 nt, Human
cuaccugguacauagaaauguu

SEQ ID NO: 265896 - RNA, 22 nt, Human
uuaguguuuaaagguuucagag

SEQ ID NO: 265897 - RNA, 22 nt, Human
aauaguuugaauuuaucagaug

SEQ ID NO: 265898 - RNA, 22 nt, Human
ggcacagagaggcccuggaagg

SEQ ID NO: 265899 - RNA, 22 nt, Human
acucagagauauggugguugau

SEQ ID NO: 265900 - RNA, 22 nt, Human
gggcuucuauucaagucuguuu

SEQ ID NO: 265901 - RNA, 22 nt, Human
cagccugggcuccagagucccu

SEQ ID NO: 265902 - RNA, 22 nt, Human
ggugcugaggccuuggcaggga

SEQ ID NO: 265903 - RNA, 22 nt, Human
uucuggaaaagaaaguuaagau

SEQ ID NO: 265904 - RNA, 22 nt, Human
caacugguaaucuccacgguca

SEQ ID NO: 265905 - RNA, 22 nt, Human
ucaugccaaacugaacacaguu

SEQ ID NO: 265906 - RNA, 22 nt, Human
acccaggcuggagugcaguguc

SEQ ID NO: 265907 - RNA, 22 nt, Human
ucagguguguggcucuggacca

SEQ ID NO: 265908 - RNA, 22 nt, Human
cagcaagagacuguucucuaag

SEQ ID NO: 265909 - RNA, 22 nt, Human
uaaauuguuuucuagaaguugu

SEQ ID NO: 265910 - RNA, 22 nt, Human
gugcuggcugccaggaggcugc

SEQ ID NO: 265911 - RNA, 22 nt, Human
uacaagcuuuuguguauaaaug

SEQ ID NO: 265912 - RNA, 22 nt, Human
agcuggugccugcuuuugugug

SEQ ID NO: 265913 - RNA, 22 nt, Human
gaaugcaugugaagcaaagaau

SEQ ID NO: 265914 - RNA, 22 nt, Human
ccuggcaagugggcucccagau

SEQ ID NO: 265915 - RNA, 22 nt, Human
ucagcaggugcuuuguuuacuc

SEQ ID NO: 265916 - RNA, 22 nt, Human
caccuacuuugugcagauuuua

SEQ ID NO: 265917 - RNA, 22 nt, Human
ucccaaggccaggcaucuagaa

SEQ ID NO: 265918 - RNA, 22 nt, Human
uggguaaacugggucuggagag

SEQ ID NO: 265919 - RNA, 22 nt, Human
gaggaagcuuuugaucgcccag

SEQ ID NO: 265920 - RNA, 22 nt, Human
uuucuccacuucucuugccaac

SEQ ID NO: 265921 - RNA, 22 nt, Human
cagcuacaggacgggcaucugc

SEQ ID NO: 265922 - RNA, 22 nt, Human
ucaggccugcaaggagaguccc

SEQ ID NO: 265923 - RNA, 22 nt, Human
acugccuucaaacagcgccacc

SEQ ID NO: 265924 - RNA, 22 nt, Human
uaauuuacuugcaaauaacaau

SEQ ID NO: 265925 - RNA, 22 nt, Human
ugcaauuuucagaaauuccaaa

SEQ ID NO: 265926 - RNA, 22 nt, Human
agcuccugccaacacugauggg

SEQ ID NO: 265927 - RNA, 22 nt, Human
cuccaugaauuugagcuuugug

SEQ ID NO: 265928 - RNA, 22 nt, Human
aguuuuucugggaggcacugcu

SEQ ID NO: 265929 - RNA, 22 nt, Human
uuauuguuagugagacuguaga

SEQ ID NO: 265930 - RNA, 22 nt, Human
augcauucagcggaaugcuuag

SEQ ID NO: 265931 - RNA, 22 nt, Human
gcacagccagcaucugagggau

SEQ ID NO: 265932 - RNA, 22 nt, Human
ucaaucacguguuccauguucu

SEQ ID NO: 265933 - RNA, 22 nt, Human
caguagacacauuaauauggaa

SEQ ID NO: 265934 - RNA, 22 nt, Human
cuuugcauacaauuuuuagaaa

SEQ ID NO: 265935 - RNA, 22 nt, Human
uucucuggggacuugguuggag

SEQ ID NO: 265936 - RNA, 22 nt, Human
uuccuuguugaaaaugucugca

SEQ ID NO: 265937 - RNA, 22 nt, Human
cggcuucucgggucggauuccg

SEQ ID NO: 265938 - RNA, 22 nt, Human
auaaaacuuauuagaauugugu

SEQ ID NO: 265939 - RNA, 22 nt, Human
uucccuuuguuaaauuggaaga

SEQ ID NO: 265940 - RNA, 22 nt, Human
agccuugccugggaaacugggu

SEQ ID NO: 265941 - RNA, 22 nt, Human
gucuuauaguacaauuugaagu

SEQ ID NO: 265942 - RNA, 22 nt, Human
ugagcagggagcugggcugagc

SEQ ID NO: 265943 - RNA, 17 nt, Human
gcaaggaaguucuuugc

SEQ ID NO: 265944 - RNA, 22 nt, Human
cuugcuuuccaaaugacucacu

SEQ ID NO: 265945 - RNA, 22 nt, Human
gauccacaggaaccaaaacgca

SEQ ID NO: 265946 - RNA, 22 nt, Human
gaggccuggugcuguguccaca

SEQ ID NO: 265947 - RNA, 22 nt, Human
uauucacauguacauaugcuca

SEQ ID NO: 265948 - RNA, 22 nt, Human
ggaggccaugggcagaaucuuu

SEQ ID NO: 265949 - RNA, 19 nt, Human
cucagcaagauagaaaugg

SEQ ID NO: 265950 - RNA, 22 nt, Human
ugagcaggauucgccucuugca

SEQ ID NO: 265951 - RNA, 20 nt, Human
cacugcccuccagccugagc

SEQ ID NO: 265952 - RNA, 22 nt, Human
accauucugguccauacuguuc

SEQ ID NO: 265953 - RNA, 22 nt, Human
cucucugcuguauccuuaggcu

SEQ ID NO: 265954 - RNA, 22 nt, Human
acagccuggacuggcucucugc

SEQ ID NO: 265955 - RNA, 22 nt, Human
auccuacaaagcagggcuaugg

SEQ ID NO: 265956 - RNA, 22 nt, Human
uuggauguuugaaaucacguac

SEQ ID NO: 265957 - RNA, 22 nt, Human
uucuccagcacauuuucuuuga

SEQ ID NO: 265958 - RNA, 22 nt, Human
gauuuauuuuuaaucagcaggg

SEQ ID NO: 265959 - RNA, 17 nt, Human
uuucuggaaugggcaaa

SEQ ID NO: 265960 - RNA, 22 nt, Human
ugggugggagcacccugucugg

SEQ ID NO: 265961 - RNA, 22 nt, Human
cuaagaaauguugugaaugcca

SEQ ID NO: 265962 - RNA, 22 nt, Human
guucacaauuuuuacugauugg

SEQ ID NO: 265963 - RNA, 22 nt, Human
gucucucugcuaggccuccagu

SEQ ID NO: 265964 - RNA, 22 nt, Human
cuggcucugagcccaccuccag

SEQ ID NO: 265965 - RNA, 22 nt, Human
aggagaccuucaccacuuccac

SEQ ID NO: 265966 - RNA, 22 nt, Human
agcucaggucucaggagguguc

SEQ ID NO: 265967 - RNA, 22 nt, Human
guuuccuauguccauugaggga

SEQ ID NO: 265968 - RNA, 22 nt, Human
aggcuccacccuacagagcucc

SEQ ID NO: 265969 - RNA, 22 nt, Human
gcauuuuagaauauuggagcaa

SEQ ID NO: 265970 - RNA, 22 nt, Human
ucagacagggcuucucaaacuu

SEQ ID NO: 265971 - RNA, 22 nt, Human
uacccaggggcugagcagaggu

SEQ ID NO: 265972 - RNA, 22 nt, Human
ugagacagcagauuagcaauga

SEQ ID NO: 265973 - RNA, 22 nt, Human
cagaagcagauucuaaagcaag

SEQ ID NO: 265974 - RNA, 22 nt, Human
cagcccuggaacagcugacuca

SEQ ID NO: 265975 - RNA, 22 nt, Human
cacaaauguaguagcuuaaaac

SEQ ID NO: 265976 - RNA, 21 nt, Human
gagugggacaugggagugguu

SEQ ID NO: 265977 - RNA, 22 nt, Human
ccugccagcaucuucagccccu

SEQ ID NO: 265978 - RNA, 22 nt, Human
cugacucccuccccaaagcugg

SEQ ID NO: 265979 - RNA, 22 nt, Human
uagauacauacauuuuaaaaug

SEQ ID NO: 265980 - RNA, 22 nt, Human
cacaagacuuauuuguguagaa

SEQ ID NO: 265981 - RNA, 22 nt, Human
ggcaggaggaagaguuagcacc

SEQ ID NO: 265982 - RNA, 22 nt, Human
ugauaaacauuuuaggaacuaa

SEQ ID NO: 265983 - RNA, 22 nt, Human
ugguccugcaguaauagacauc

SEQ ID NO: 265984 - RNA, 22 nt, Human
uuagaaaauggaggugggaggg

SEQ ID NO: 265985 - RNA, 22 nt, Human
auguacaggauggugcucaucu

SEQ ID NO: 265986 - RNA, 22 nt, Human
cagauuaguugugcuauggccu

SEQ ID NO: 265987 - RNA, 22 nt, Human
ugcauucaauacaguaagaaua

SEQ ID NO: 265988 - RNA, 22 nt, Human
guguccuuaugcauaccagagu

SEQ ID NO: 265989 - RNA, 22 nt, Human
gggccucaggccuugcucugug

SEQ ID NO: 265990 - RNA, 22 nt, Human
uaacacauaagcugagaccaug

SEQ ID NO: 265991 - RNA, 22 nt, Human
uauuaauaagugacuacuagcu

SEQ ID NO: 265992 - RNA, 22 nt, Human
agggccagcugaugagaaugag

SEQ ID NO: 265993 - RNA, 22 nt, Human
ccagcagaggggcggagugcag

SEQ ID NO: 265994 - RNA, 22 nt, Human
cagcuguuugggcauggccaga

SEQ ID NO: 265995 - RNA, 22 nt, Human
ugccuggcaagaggggcuggcu

SEQ ID NO: 265996 - RNA, 22 nt, Human
gugcucuguggauugaguugaa

SEQ ID NO: 265997 - RNA, 22 nt, Human
uucuguguucugugcaaugagc

SEQ ID NO: 265998 - RNA, 22 nt, Human
uuucucaguaauguccuggaau

SEQ ID NO: 265999 - RNA, 22 nt, Human
ucagcuguagguauggaugucc

SEQ ID NO: 266000 - RNA, 22 nt, Human
acacacuucacccuugagcuaa

SEQ ID NO: 266001 - RNA, 22 nt, Human
guguauguucuacuuaauauua

SEQ ID NO: 266002 - RNA, 20 nt, Human
acagaugaggaaaaugaagu

SEQ ID NO: 266003 - RNA, 22 nt, Human
agggagcugcucugcuuccgug

SEQ ID NO: 266004 - RNA, 22 nt, Human
uauuucugauugcucaugaggc

SEQ ID NO: 266005 - RNA, 22 nt, Human
uaugcuaaauauguucacauug

SEQ ID NO: 266006 - RNA, 22 nt, Human
uguggggcugugguguucuucu

SEQ ID NO: 266007 - RNA, 22 nt, Human
ucuccuggucaccucagaaguc

SEQ ID NO: 266008 - RNA, 22 nt, Human
cuagcaucagaugagaagcugu

SEQ ID NO: 266009 - RNA, 22 nt, Human
uaacaguaccauuaacuuugau

SEQ ID NO: 266010 - RNA, 22 nt, Human
uaggaaauacuguaaguuuggg

SEQ ID NO: 266011 - RNA, 22 nt, Human
gcaggagagccagcaggcuucc

SEQ ID NO: 266012 - RNA, 22 nt, Human
cuggcucaauuuguacugcugu

SEQ ID NO: 266013 - RNA, 22 nt, Human
auaaagcaucuagucugucacu

SEQ ID NO: 266014 - RNA, 22 nt, Human
cuucuuguaucugccgccgagc

SEQ ID NO: 266015 - RNA, 22 nt, Human
cucugccacucgaagucaagga

SEQ ID NO: 266016 - RNA, 22 nt, Human
acagagagcugugauugaguua

SEQ ID NO: 266017 - RNA, 22 nt, Human
uccuccuuguuuugucucugcu

SEQ ID NO: 266018 - RNA, 22 nt, Human
ugaaaucuacccuauucagggu

SEQ ID NO: 266019 - RNA, 22 nt, Human
uggcuccagcguccacguccug

SEQ ID NO: 266020 - RNA, 22 nt, Human
aagucaagauaaaggugcuggc

SEQ ID NO: 266021 - RNA, 22 nt, Human
ucucuguagaccugaccagcac

SEQ ID NO: 266022 - RNA, 22 nt, Human
cagggaugguaaauauguaaag

SEQ ID NO: 266023 - RNA, 22 nt, Human
uuaaauagucaaaucaguggca

SEQ ID NO: 266024 - RNA, 20 nt, Human
ucauuccaaauaguucagca

SEQ ID NO: 266025 - RNA, 22 nt, Human
aagaaugagcucaaagaucuua

SEQ ID NO: 266026 - RNA, 22 nt, Human
ccucccugguggcucuggucua

SEQ ID NO: 266027 - RNA, 19 nt, Human
cuuauacagauuuucucau

SEQ ID NO: 266028 - RNA, 22 nt, Human
agcuccuguggcagcucuucug

SEQ ID NO: 266029 - RNA, 22 nt, Human
uccugagcuuuacaguaaggac

SEQ ID NO: 266030 - RNA, 22 nt, Human
ucagagagguuaaauaucuugu

SEQ ID NO: 266031 - RNA, 19 nt, Human
ugagauuucuuaggugauu

SEQ ID NO: 266032 - RNA, 22 nt, Human
cugaggcagagggcagaccaga

SEQ ID NO: 266033 - RNA, 22 nt, Human
gcccugcugucuucagaguaua

SEQ ID NO: 266034 - RNA, 22 nt, Human
gccagggagucugggccacaga

SEQ ID NO: 266035 - RNA, 22 nt, Human
auuaagacuauugauauuuaca

SEQ ID NO: 266036 - RNA, 22 nt, Human
gggccacuucuagugccucaga

SEQ ID NO: 266037 - RNA, 22 nt, Human
caaggcugcugcgggucgcacc

SEQ ID NO: 266038 - RNA, 19 nt, Human
ccaggccuccugggagguc

SEQ ID NO: 266039 - RNA, 22 nt, Human
guuguauucuucaauaucagag

SEQ ID NO: 266040 - RNA, 21 nt, Human
caaaugcuggcuggaugagga

SEQ ID NO: 266041 - RNA, 23 nt, Human
uauuagggccaggacuggcaaau

SEQ ID NO: 266042 - RNA, 22 nt, Human
ggucccaggaaucuguguucua

SEQ ID NO: 266043 - RNA, 22 nt, Human
gcugagccccccugcguggguc

SEQ ID NO: 266044 - RNA, 22 nt, Human
auaucauucugauguauaucuu

SEQ ID NO: 266045 - RNA, 22 nt, Human
gcacagccuugcccugugcccu

SEQ ID NO: 266046 - RNA, 22 nt, Human
uaggacaugcuacauaaauagg

SEQ ID NO: 266047 - RNA, 22 nt, Human
ucuucacaggagccugccugcc

SEQ ID NO: 266048 - RNA, 22 nt, Human
ugaagguaauggaaucuccuga

SEQ ID NO: 266049 - RNA, 23 nt, Human
auguuuuaugucucuagcugcca

SEQ ID NO: 266050 - RNA, 22 nt, Human
uccugagguggauugagcagag

SEQ ID NO: 266051 - RNA, 22 nt, Human
aaagagucuggcacuguaccag

SEQ ID NO: 266052 - RNA, 22 nt, Human
aagggcagccugacucacgguc

SEQ ID NO: 266053 - RNA, 22 nt, Human
gugaaaaaucaucaugacuuga

SEQ ID NO: 266054 - RNA, 22 nt, Human
caggagcuucugcccauggcca

SEQ ID NO: 266055 - RNA, 22 nt, Human
uaucuagaguccugcugagaac

SEQ ID NO: 266056 - RNA, 22 nt, Human
guccugagaccauggccuuagu

SEQ ID NO: 266057 - RNA, 22 nt, Human
ccuggcacaugauagaugcuca

SEQ ID NO: 266058 - RNA, 22 nt, Human
cacacaugacccacuuuuaccg

SEQ ID NO: 266059 - RNA, 22 nt, Human
uccugcagcucugagaagcauc

SEQ ID NO: 266060 - RNA, 22 nt, Human
uguuaaaugcucagcucgggga

SEQ ID NO: 266061 - RNA, 22 nt, Human
ugaggcaggaggauugcaggau

SEQ ID NO: 266062 - RNA, 22 nt, Human
agggacaguauccaucucacag

SEQ ID NO: 266063 - RNA, 22 nt, Human
agacagacauucuagagccacc

SEQ ID NO: 266064 - RNA, 22 nt, Human
uucaaaguccugucagguagcc

SEQ ID NO: 266065 - RNA, 21 nt, Human
gccagcugggucuugcaggag

SEQ ID NO: 266066 - RNA, 22 nt, Human
uggagaaaagguugaauccauc

SEQ ID NO: 266067 - RNA, 21 nt, Human
guuauugaccuccaggcuggc

SEQ ID NO: 266068 - RNA, 22 nt, Human
aacagaaaucauuuagggcucu

SEQ ID NO: 266069 - RNA, 22 nt, Human
aaacaugagcauuucuguuuaa

SEQ ID NO: 266070 - RNA, 22 nt, Human
augagcagauauggauuuuaga

SEQ ID NO: 266071 - RNA, 22 nt, Human
gggcuccugccuccuggcaccu

SEQ ID NO: 266072 - RNA, 22 nt, Human
aagaacugaguacguuaauaaa

SEQ ID NO: 266073 - RNA, 22 nt, Human
uacaggagcacaaaagaguuga

SEQ ID NO: 266074 - RNA, 22 nt, Human
uguacacaguaugaggcaucuu

SEQ ID NO: 266075 - RNA, 22 nt, Human
uacagaggaggugguugggagu

SEQ ID NO: 266076 - RNA, 22 nt, Human
caaaucuauauguugauauucu

SEQ ID NO: 266077 - RNA, 22 nt, Human
uggggagagaccggaauguuuc

SEQ ID NO: 266078 - RNA, 22 nt, Human
gggcucuguuuagaucagagau

SEQ ID NO: 266079 - RNA, 22 nt, Human
ucugcuggugaugaccucauaa

SEQ ID NO: 266080 - RNA, 22 nt, Human
caggcauagguaggauguuucu

SEQ ID NO: 266081 - RNA, 22 nt, Human
acagucaaucagaacagcaugu

SEQ ID NO: 266082 - RNA, 22 nt, Human
gugaagaucugagcccucaggu

SEQ ID NO: 266083 - RNA, 21 nt, Human
auauuuuuguuuggacuguca

SEQ ID NO: 266084 - RNA, 22 nt, Human
augcacuucaagcaucucucug

SEQ ID NO: 266085 - RNA, 22 nt, Human
cacagugcgaaagaaacccagc

SEQ ID NO: 266086 - RNA, 22 nt, Human
aaucucagagauaucugugucc

SEQ ID NO: 266087 - RNA, 22 nt, Human
cugagcugcggcaggcaccugg

SEQ ID NO: 266088 - RNA, 22 nt, Human
acaagcucagaucccugucucu

SEQ ID NO: 266089 - RNA, 22 nt, Human
ugcauccuuaaccagcaucacu

SEQ ID NO: 266090 - RNA, 22 nt, Human
cuggauuuaauuaacuguugcu

SEQ ID NO: 266091 - RNA, 22 nt, Human
uugcaaagagauaauccuaggc

SEQ ID NO: 266092 - RNA, 22 nt, Human
cucaguuugugugauauugucu

SEQ ID NO: 266093 - RNA, 22 nt, Human
uugaaugaauuugagcagagau

SEQ ID NO: 266094 - RNA, 22 nt, Human
uauacacaggaaucugugaaaa

SEQ ID NO: 266095 - RNA, 22 nt, Human
aggcucugggaacagacgggug

SEQ ID NO: 266096 - RNA, 22 nt, Human
cagcagcuccaaagaauagcca

SEQ ID NO: 266097 - RNA, 22 nt, Human
ccucagaguuauuugaagugaa

SEQ ID NO: 266098 - RNA, 22 nt, Human
uuuacagcuacuguccuauuuc

SEQ ID NO: 266099 - RNA, 20 nt, Human
ucagugucaguagccacuac

SEQ ID NO: 266100 - RNA, 19 nt, Human
cucuccaccuaacagguau

SEQ ID NO: 266101 - RNA, 22 nt, Human
cugcaggagcaaagccucugcu

SEQ ID NO: 266102 - RNA, 18 nt, Human
caggcccugucuggccuc

SEQ ID NO: 266103 - RNA, 22 nt, Human
aauuaacaaauguagcugugau

SEQ ID NO: 266104 - RNA, 22 nt, Human
uggaaacugggaguuaaaugua

SEQ ID NO: 266105 - RNA, 22 nt, Human
aggucucugcccacacaggcuu

SEQ ID NO: 266106 - RNA, 19 nt, Human
ggcugcugaagagaauuac

SEQ ID NO: 266107 - RNA, 19 nt, Human
cuacuuuauaauaugccuc

SEQ ID NO: 266108 - RNA, 22 nt, Human
uaauuucuagggacuaaggugc

SEQ ID NO: 266109 - RNA, 22 nt, Human
agguccaggccucaugauggcc

SEQ ID NO: 266110 - RNA, 22 nt, Human
acuuggcaaguaucuauaaagu

SEQ ID NO: 266111 - RNA, 22 nt, Human
aauucuauaggcaagcuauuuu

SEQ ID NO: 266112 - RNA, 22 nt, Human
ugucacaaacauacauuauaga

SEQ ID NO: 266113 - RNA, 22 nt, Human
uuuuuuauagcaaugaacccac

SEQ ID NO: 266114 - RNA, 22 nt, Human
gagccuggacaucucaggccca

SEQ ID NO: 266115 - RNA, 22 nt, Human
uguccuggagacacaagguggu

SEQ ID NO: 266116 - RNA, 21 nt, Human
ggcugagauggcagaaucacc

SEQ ID NO: 266117 - RNA, 22 nt, Human
cucuguuucucagccuauuucc

SEQ ID NO: 266118 - RNA, 22 nt, Human
uuuuauucauagggauggagag

SEQ ID NO: 266119 - RNA, 22 nt, Human
uccagcagugcucaggacucac

SEQ ID NO: 266120 - RNA, 22 nt, Human
cuaucuuucgauucuagcuuaa

SEQ ID NO: 266121 - RNA, 22 nt, Human
uuuugccugcacuguauauaua

SEQ ID NO: 266122 - RNA, 22 nt, Human
gugggugugauaagaccaaggg

SEQ ID NO: 266123 - RNA, 22 nt, Human
gucaggaaguggcauuggagaa

SEQ ID NO: 266124 - RNA, 22 nt, Human
ccagaaguuccuaagcaucauu

SEQ ID NO: 266125 - RNA, 22 nt, Human
gggagagaauuauugccagacc

SEQ ID NO: 266126 - RNA, 22 nt, Human
aaaaggcuaauccagagcaacu

SEQ ID NO: 266127 - RNA, 22 nt, Human
gcacuucaugacuuugucaaau

SEQ ID NO: 266128 - RNA, 22 nt, Human
agagaacaaauuaaaggugguu

SEQ ID NO: 266129 - RNA, 22 nt, Human
gaccaggagauuugagcuaggc

SEQ ID NO: 266130 - RNA, 22 nt, Human
gagucuggacuauucuggucuu

SEQ ID NO: 266131 - RNA, 22 nt, Human
uaaauguguuguggaugaaguu

SEQ ID NO: 266132 - RNA, 22 nt, Human
gacaggugugaugauuuaggcu

SEQ ID NO: 266133 - RNA, 22 nt, Human
gccuggcaggccuguuggggcu

SEQ ID NO: 266134 - RNA, 22 nt, Human
acaguacucuaaugaaaagugc

SEQ ID NO: 266135 - RNA, 22 nt, Human
uggccugucuuguugugcuaga

SEQ ID NO: 266136 - RNA, 22 nt, Human
agggacagaugaaugacugagu

SEQ ID NO: 266137 - RNA, 22 nt, Human
gauagaaagagugguucuuuuu

SEQ ID NO: 266138 - RNA, 22 nt, Human
aaaaguuaacuguguucaugca

SEQ ID NO: 266139 - RNA, 20 nt, Human
uauaaauucagagcuuuggu

SEQ ID NO: 266140 - RNA, 22 nt, Human
aguguauuacagaacugacauu

SEQ ID NO: 266141 - RNA, 17 nt, Human
ggaggcaacagacaggg

SEQ ID NO: 266142 - RNA, 20 nt, Human
ccucuguguccugugucaua

SEQ ID NO: 266143 - RNA, 23 nt, Human
ccuggcacacaaggggugcugca

SEQ ID NO: 266144 - RNA, 22 nt, Human
agggugccugcugcagguucag

SEQ ID NO: 266145 - RNA, 22 nt, Human
cuguggcuuugcagggcuuguu

SEQ ID NO: 266146 - RNA, 22 nt, Human
ccagggaugcagagguugcagu

SEQ ID NO: 266147 - RNA, 22 nt, Human
cuauuaaauacucuucaaauug

SEQ ID NO: 266148 - RNA, 22 nt, Human
uuuccagguauuaauacuguau

SEQ ID NO: 266149 - RNA, 22 nt, Human
agcagcagcucuguugcccuac

SEQ ID NO: 266150 - RNA, 22 nt, Human
uauuucacuauucucuguaacu

SEQ ID NO: 266151 - RNA, 22 nt, Human
auucucugugcagauuuaagac

SEQ ID NO: 266152 - RNA, 22 nt, Human
guacuuuaaaucaauguagauu

SEQ ID NO: 266153 - RNA, 22 nt, Human
caguggcucaugccuauaaucc

SEQ ID NO: 266154 - RNA, 22 nt, Human
gacagacacagggccaugauug

SEQ ID NO: 266155 - RNA, 19 nt, Human
ucaaaugccaaugucacag

SEQ ID NO: 266156 - RNA, 19 nt, Human
agaagcccagaucccagcc

SEQ ID NO: 266157 - RNA, 22 nt, Human
aagcagacaucccauacuuuug

SEQ ID NO: 266158 - RNA, 22 nt, Human
uguaaguuuugugaaacaaaca

SEQ ID NO: 266159 - RNA, 22 nt, Human
ugcaauuuuuaucaauucagca

SEQ ID NO: 266160 - RNA, 23 nt, Human
caccccacccugaggaggaggga

SEQ ID NO: 266161 - RNA, 22 nt, Human
uggcagccugcgugaaggagcu

SEQ ID NO: 266162 - RNA, 22 nt, Human
gucagagcugugcaaggcugag

SEQ ID NO: 266163 - RNA, 22 nt, Human
uucagaaauaaaauaucccaac

SEQ ID NO: 266164 - RNA, 22 nt, Human
ucaauguuuguucaugaaaaua

SEQ ID NO: 266165 - RNA, 22 nt, Human
uucagauaucauuaauuuagua

SEQ ID NO: 266166 - RNA, 22 nt, Human
ucaggcuuccaggcucugcuga

SEQ ID NO: 266167 - RNA, 22 nt, Human
auggaauugaagacagcauagg

SEQ ID NO: 266168 - RNA, 22 nt, Human
uaaccagacagaaacagcuaga

SEQ ID NO: 266169 - RNA, 22 nt, Human
gaaagugcuuuugagugugugc

SEQ ID NO: 266170 - RNA, 22 nt, Human
cauuaauaaacauuucagaaga

SEQ ID NO: 266171 - RNA, 22 nt, Human
uggacauguaaaggcucaaggu

SEQ ID NO: 266172 - RNA, 22 nt, Human
aagauuauuuaagacaggaacc

SEQ ID NO: 266173 - RNA, 22 nt, Human
gucagacacauuucuuucagug

SEQ ID NO: 266174 - RNA, 22 nt, Human
ccagccucaucgccugccuguc

SEQ ID NO: 266175 - RNA, 22 nt, Human
ucugauuucucuuguggaugcu

SEQ ID NO: 266176 - RNA, 22 nt, Human
uucccuccgaaccucagugcug

SEQ ID NO: 266177 - RNA, 22 nt, Human
aacugucugaaacugggguuuc

SEQ ID NO: 266178 - RNA, 22 nt, Human
cagagccagcccacuguucccg

SEQ ID NO: 266179 - RNA, 21 nt, Human
ucuuuuccuuucugugugcaa

SEQ ID NO: 266180 - RNA, 22 nt, Human
aaacucuaguaaaauguauuca

SEQ ID NO: 266181 - RNA, 22 nt, Human
acacacaugguauuguucagaa

SEQ ID NO: 266182 - RNA, 22 nt, Human
aaggacaggcuaaccugacauu

SEQ ID NO: 266183 - RNA, 22 nt, Human
cgcaacagcguggcgcccagcu

SEQ ID NO: 266184 - RNA, 22 nt, Human
aggagcugggagaaggacuaaa

SEQ ID NO: 266185 - RNA, 22 nt, Human
cagcucugugcaggccugggga

SEQ ID NO: 266186 - RNA, 22 nt, Human
acaagauuuaaugcaacccaag

SEQ ID NO: 266187 - RNA, 22 nt, Human
aaucucuucccaguaaaaaugg

SEQ ID NO: 266188 - RNA, 22 nt, Human
uaagaacagugucugucucaca

SEQ ID NO: 266189 - RNA, 22 nt, Human
gcugaggaaaggcuggaaggga

SEQ ID NO: 266190 - RNA, 23 nt, Human
aacaggaugugcuucaucuuuug

SEQ ID NO: 266191 - RNA, 22 nt, Human
uggcucuguucgccaucaggag

SEQ ID NO: 266192 - RNA, 22 nt, Human
ggaaagcuacugguguccucug

SEQ ID NO: 266193 - RNA, 22 nt, Human
cugccugcucuauccaggccug

SEQ ID NO: 266194 - RNA, 22 nt, Human
ggcugaaauuggauccuugggc

SEQ ID NO: 266195 - RNA, 22 nt, Human
ggcugccaggagaagcucagug

SEQ ID NO: 266196 - RNA, 22 nt, Human
cugccucuugacagaucguggc

SEQ ID NO: 266197 - RNA, 22 nt, Human
gcaggcuggaggcuguucuggg

SEQ ID NO: 266198 - RNA, 22 nt, Human
augucauuuaaauguuuguaua

SEQ ID NO: 266199 - RNA, 23 nt, Human
ucagggacaugaugugucauauc

SEQ ID NO: 266200 - RNA, 22 nt, Human
uugugaucuguguugauggccu

SEQ ID NO: 266201 - RNA, 19 nt, Human
cuuccccuguuaccucacu

SEQ ID NO: 266202 - RNA, 22 nt, Human
gacgccucuucccugcugcacu

SEQ ID NO: 266203 - RNA, 22 nt, Human
aucuacccacugaacacaauau

SEQ ID NO: 266204 - RNA, 22 nt, Human
cgcaggugaacuguucugcagu

SEQ ID NO: 266205 - RNA, 22 nt, Human
aucuuguuaaagugcagauucu

SEQ ID NO: 266206 - RNA, 22 nt, Human
gccaggcuggugucacaacucu

SEQ ID NO: 266207 - RNA, 22 nt, Human
aacacugucuuauacuucaaug

SEQ ID NO: 266208 - RNA, 22 nt, Human
auucagcaaugagcuuggauuu

SEQ ID NO: 266209 - RNA, 22 nt, Human
ugcuucuggaguaacaggguga

SEQ ID NO: 266210 - RNA, 22 nt, Human
aggcacaguuucauccccgggc

SEQ ID NO: 266211 - RNA, 22 nt, Human
gcagcccacagcuggaggccua

SEQ ID NO: 266212 - RNA, 22 nt, Human
ucucccagugucuggcagucag

SEQ ID NO: 266213 - RNA, 22 nt, Human
agagagaggggcgagcaaacac

SEQ ID NO: 266214 - RNA, 22 nt, Human
caggcagcauuuacucugauga

SEQ ID NO: 266215 - RNA, 22 nt, Human
agggcccuagggaaugagacau

SEQ ID NO: 266216 - RNA, 22 nt, Human
gcacacagauuaggaaacagaa

SEQ ID NO: 266217 - RNA, 22 nt, Human
augagcagaugcuccugccucu

SEQ ID NO: 266218 - RNA, 22 nt, Human
gaagauuaaugagaaaccugcu

SEQ ID NO: 266219 - RNA, 22 nt, Human
cucagcauucaauguccagucc

SEQ ID NO: 266220 - RNA, 22 nt, Human
agcccaagaagagcuuucuugc

SEQ ID NO: 266221 - RNA, 21 nt, Human
cugugaccuuucuuuccuccu

SEQ ID NO: 266222 - RNA, 22 nt, Human
ccaguccauauuuauacugccg

SEQ ID NO: 266223 - RNA, 22 nt, Human
ugucagcagaaguggugcacuc

SEQ ID NO: 266224 - RNA, 22 nt, Human
ucucucagaggaagaggcagug

SEQ ID NO: 266225 - RNA, 22 nt, Human
ucugaaauccuuuaucuuggcu

SEQ ID NO: 266226 - RNA, 22 nt, Human
aggaaacugauguuuuuuacaa

SEQ ID NO: 266227 - RNA, 22 nt, Human
auauucuuccaaaacaucauuu

SEQ ID NO: 266228 - RNA, 22 nt, Human
acugucuuguguuaaagaacca

SEQ ID NO: 266229 - RNA, 22 nt, Human
cucugcaggccuugaguguggu

SEQ ID NO: 266230 - RNA, 22 nt, Human
ucacacagggucggaaagagug

SEQ ID NO: 266231 - RNA, 22 nt, Human
agcuguggaguaggggguugga

SEQ ID NO: 266232 - RNA, 22 nt, Human
gcaaagcagucuucugugccua

SEQ ID NO: 266233 - RNA, 18 nt, Human
uccucucuuuccccaggg

SEQ ID NO: 266234 - RNA, 22 nt, Human
gagcuggggcggauacucagcu

SEQ ID NO: 266235 - RNA, 23 nt, Human
uggcuggcgccugccucacccug

SEQ ID NO: 266236 - RNA, 20 nt, Human
uucuggcaaacagaguucuu

SEQ ID NO: 266237 - RNA, 23 nt, Human
aaagcaaggaauuggcaacagag

SEQ ID NO: 266238 - RNA, 22 nt, Human
acauauugagcucuaaaaguac

SEQ ID NO: 266239 - RNA, 22 nt, Human
auagaagaggaaacugagguug

SEQ ID NO: 266240 - RNA, 22 nt, Human
agggcucagcaucucauucugu

SEQ ID NO: 266241 - RNA, 22 nt, Human
cuucuucaucuguaaaacuugg

SEQ ID NO: 266242 - RNA, 22 nt, Human
ggcuccaagucucagagugaag

SEQ ID NO: 266243 - RNA, 22 nt, Human
uguacaaagccagaacucccaa

SEQ ID NO: 266244 - RNA, 22 nt, Human
guaauagaugaaacaaugugga

SEQ ID NO: 266245 - RNA, 22 nt, Human
ggguccagagccucagcccaga

SEQ ID NO: 266246 - RNA, 22 nt, Human
uggcuucuuugugacagcucuu

SEQ ID NO: 266247 - RNA, 22 nt, Human
gcagcugucgcuaggagcugug

SEQ ID NO: 266248 - RNA, 22 nt, Human
aaggagagagcuuugcuggaac

SEQ ID NO: 266249 - RNA, 22 nt, Human
uuucuuuugcccuguggguuag

SEQ ID NO: 266250 - RNA, 22 nt, Human
ucaggagcucaggcugauggaa

SEQ ID NO: 266251 - RNA, 22 nt, Human
aacuggaaagaucaguaggaag

SEQ ID NO: 266252 - RNA, 22 nt, Human
acaugugcagacagcaagcagg

SEQ ID NO: 266253 - RNA, 22 nt, Human
aaggacaggcacagugguggag

SEQ ID NO: 266254 - RNA, 22 nt, Human
ggcccagacccaagaguggugg

SEQ ID NO: 266255 - RNA, 22 nt, Human
cucccagccuucgccagucuga

SEQ ID NO: 266256 - RNA, 22 nt, Human
caggaagagaacauggaggcug

SEQ ID NO: 266257 - RNA, 22 nt, Human
ugaguggagacuguguguagag

SEQ ID NO: 266258 - RNA, 22 nt, Human
uaaacaaggguuacugagcaug

SEQ ID NO: 266259 - RNA, 22 nt, Human
cuggcugggagcucgccugcgg

SEQ ID NO: 266260 - RNA, 22 nt, Human
accauauaacaaguuuaggaga

SEQ ID NO: 266261 - RNA, 22 nt, Human
ggaagccccagcauggccuugg

SEQ ID NO: 266262 - RNA, 19 nt, Human
auucuucagcagugagacc

SEQ ID NO: 266263 - RNA, 22 nt, Human
uuaaaugucaauagauugcuug

SEQ ID NO: 266264 - RNA, 22 nt, Human
ucuacccagagcuaugaccuga

SEQ ID NO: 266265 - RNA, 21 nt, Human
ugggcaccaaaaccuaggagu

SEQ ID NO: 266266 - RNA, 22 nt, Human
uaggaauccagaucuagacugu

SEQ ID NO: 266267 - RNA, 22 nt, Human
acaaaauuuuuagacaaggcuu

SEQ ID NO: 266268 - RNA, 18 nt, Human
acauacauucugucugca

SEQ ID NO: 266269 - RNA, 22 nt, Human
aguccuuuuguuuugagaugag

SEQ ID NO: 266270 - RNA, 21 nt, Human
gaucuagacuugggcccagua

SEQ ID NO: 266271 - RNA, 22 nt, Human
acuuccaggaggugucacugaa

SEQ ID NO: 266272 - RNA, 22 nt, Human
uagcuuuagaaauauucucaga

SEQ ID NO: 266273 - RNA, 22 nt, Human
aucagagcaauggauaaaauca

SEQ ID NO: 266274 - RNA, 22 nt, Human
aacucacacaaguauugccugc

SEQ ID NO: 266275 - RNA, 22 nt, Human
gugagagaucccccacucaucu

SEQ ID NO: 266276 - RNA, 23 nt, Human
aggaagaggcaauuucucuuaga

SEQ ID NO: 266277 - RNA, 22 nt, Human
uucuucuucauuucugacgaug

SEQ ID NO: 266278 - RNA, 22 nt, Human
gaggcagcagggcugguuccuu

SEQ ID NO: 266279 - RNA, 22 nt, Human
ggcugccuagacuuggaauuuc

SEQ ID NO: 266280 - RNA, 22 nt, Human
ucagugcugaguagcgugcacc

SEQ ID NO: 266281 - RNA, 22 nt, Human
agucuccacacuggcagaugcc

SEQ ID NO: 266282 - RNA, 20 nt, Human
ugccaggcugcacgccugcc

SEQ ID NO: 266283 - RNA, 22 nt, Human
agcuggcucagccggguggucu

SEQ ID NO: 266284 - RNA, 22 nt, Human
uagcuucagggaaaccacugcu

SEQ ID NO: 266285 - RNA, 22 nt, Human
ucuggguccgggacuguggaug

SEQ ID NO: 266286 - RNA, 22 nt, Human
caaggccauaagagauacaaaa

SEQ ID NO: 266287 - RNA, 18 nt, Human
cgcccugcuauaaaugac

SEQ ID NO: 266288 - RNA, 22 nt, Human
uguccuggugcuucuugggauu

SEQ ID NO: 266289 - RNA, 22 nt, Human
ugcagagggaaaaggugcuccu

SEQ ID NO: 266290 - RNA, 22 nt, Human
guuaaaagaacaacucggaggu

SEQ ID NO: 266291 - RNA, 22 nt, Human
auagacaaucccccauccuacc

SEQ ID NO: 266292 - RNA, 22 nt, Human
aaagcacuucaggagcaguuug

SEQ ID NO: 266293 - RNA, 22 nt, Human
uuugcaaagaaauuauugcugu

SEQ ID NO: 266294 - RNA, 22 nt, Human
uacaaacuccgaaguuuguacc

SEQ ID NO: 266295 - RNA, 22 nt, Human
ucagugcuuuugagaagcuccu

SEQ ID NO: 266296 - RNA, 22 nt, Human
gcagggcugauguuauugacga

SEQ ID NO: 266297 - RNA, 22 nt, Human
ccuggcuguggcggugcucuca

SEQ ID NO: 266298 - RNA, 22 nt, Human
aucuuguuaaaaugcagauucu

SEQ ID NO: 266299 - RNA, 22 nt, Human
cuggcugguccucggggacagc

SEQ ID NO: 266300 - RNA, 22 nt, Human
cuuugguggaggggugcaggca

SEQ ID NO: 266301 - RNA, 22 nt, Human
agaucugaguggcugcauguaa

SEQ ID NO: 266302 - RNA, 22 nt, Human
ggcaggugcuaagagagguaaa

SEQ ID NO: 266303 - RNA, 22 nt, Human
caaagcugugaauuccuacaaa

SEQ ID NO: 266304 - RNA, 22 nt, Human
aaguuacaguuauuauuuaaaa

SEQ ID NO: 266305 - RNA, 22 nt, Human
auaugcuuaugaugguuaauuu

SEQ ID NO: 266306 - RNA, 22 nt, Human
aaacaguagaaguguauuuuau

SEQ ID NO: 266307 - RNA, 22 nt, Human
uugcuuuaaugagauuuugcca

SEQ ID NO: 266308 - RNA, 22 nt, Human
ugcugccagggcucugcccaca

SEQ ID NO: 266309 - RNA, 22 nt, Human
auucuucugccuacuuucaucc

SEQ ID NO: 266310 - RNA, 22 nt, Human
guuauuguccagcacaguuggg

SEQ ID NO: 266311 - RNA, 22 nt, Human
augcaacagaaaauugccuggg

SEQ ID NO: 266312 - RNA, 22 nt, Human
acugggccaggggcuuuggagc

SEQ ID NO: 266313 - RNA, 22 nt, Human
ccucaaauaaguuuuauuuauc

SEQ ID NO: 266314 - RNA, 22 nt, Human
cuggaaugccucccugucagag

SEQ ID NO: 266315 - RNA, 22 nt, Human
uugcuuuacauguucugguaaa

SEQ ID NO: 266316 - RNA, 20 nt, Human
uccagcccugcuucucucuu

SEQ ID NO: 266317 - RNA, 22 nt, Human
uucaggcccaacgcacagcuuc

SEQ ID NO: 266318 - RNA, 22 nt, Human
cccuccaccaagcagggcgcca

SEQ ID NO: 266319 - RNA, 22 nt, Human
uggcucagcgguggcagcagac

SEQ ID NO: 266320 - RNA, 22 nt, Human
agucacuucuauucuauuaagu

SEQ ID NO: 266321 - RNA, 22 nt, Human
gggcccuggccgaaucccucug

SEQ ID NO: 266322 - RNA, 19 nt, Human
gcuccugggccucacucau

SEQ ID NO: 266323 - RNA, 17 nt, Human
uguccauuugccuggag

SEQ ID NO: 266324 - RNA, 22 nt, Human
ugaaggaggaauguggccucca

SEQ ID NO: 266325 - RNA, 23 nt, Human
uugagucuuauaggauugaggug

SEQ ID NO: 266326 - RNA, 22 nt, Human
gucugggacaggacuggggaac

SEQ ID NO: 266327 - RNA, 22 nt, Human
agaauuguucuguagcuuggcu

SEQ ID NO: 266328 - RNA, 19 nt, Human
auauauguauacaaugugg

SEQ ID NO: 266329 - RNA, 22 nt, Human
aauugcuuaugccaggugagag

SEQ ID NO: 266330 - RNA, 22 nt, Human
aauucauauggauaugcuagua

SEQ ID NO: 266331 - RNA, 19 nt, Human
agagaggcugugugaggga

SEQ ID NO: 266332 - RNA, 22 nt, Human
ugaggggauacgguacacauug

SEQ ID NO: 266333 - RNA, 22 nt, Human
caucuuuguaacuuccacauaa

SEQ ID NO: 266334 - RNA, 21 nt, Human
agguccaguucugucuuggac

SEQ ID NO: 266335 - RNA, 22 nt, Human
gcugggagccguaccugucacg

SEQ ID NO: 266336 - RNA, 22 nt, Human
ggcuuucucacagcauggcagc

SEQ ID NO: 266337 - RNA, 22 nt, Human
caggucugugugccauuuccaa

SEQ ID NO: 266338 - RNA, 22 nt, Human
acuguuuucuguaaagggccag

SEQ ID NO: 266339 - RNA, 22 nt, Human
ugcaggcauaaccgauguugau

SEQ ID NO: 266340 - RNA, 22 nt, Human
uaaugcuucaauuuccuugauu

SEQ ID NO: 266341 - RNA, 22 nt, Human
gccagcauaguaagcagucauc

SEQ ID NO: 266342 - RNA, 22 nt, Human
caaaugcuacuaauaggcaagu

SEQ ID NO: 266343 - RNA, 22 nt, Human
agugugagugcucauguccauc

SEQ ID NO: 266344 - RNA, 22 nt, Human
agagccacaguggauaggagcc

SEQ ID NO: 266345 - RNA, 22 nt, Human
aggucugucuggccccaugaau

SEQ ID NO: 266346 - RNA, 22 nt, Human
auggaacaggcucagagaugcu

SEQ ID NO: 266347 - RNA, 22 nt, Human
auacacauuugcuagagauggg

SEQ ID NO: 266348 - RNA, 22 nt, Human
gaggaagccccauugaagccag

SEQ ID NO: 266349 - RNA, 22 nt, Human
cauuugaaauaguucauucuug

SEQ ID NO: 266350 - RNA, 22 nt, Human
ccaggacuucgaggcuacagug

SEQ ID NO: 266351 - RNA, 22 nt, Human
cugggccuuggauugacacugu

SEQ ID NO: 266352 - RNA, 18 nt, Human
aaugcacacauuuacucc

SEQ ID NO: 266353 - RNA, 20 nt, Human
aucuuuggcucagaagccuu

SEQ ID NO: 266354 - RNA, 19 nt, Human
cugagcagcggcagcacuu

SEQ ID NO: 266355 - RNA, 22 nt, Human
agaaaacauuacauaggugugu

SEQ ID NO: 266356 - RNA, 22 nt, Human
aucagagaaguuucacuggcau

SEQ ID NO: 266357 - RNA, 22 nt, Human
cuagaaucuaugucaggaacuc

SEQ ID NO: 266358 - RNA, 22 nt, Human
gugcacagaaauugguaagacu

SEQ ID NO: 266359 - RNA, 22 nt, Human
uuguauuuggguaguauagaga

SEQ ID NO: 266360 - RNA, 22 nt, Human
uuaguuguaaaauggaauuugu

SEQ ID NO: 266361 - RNA, 22 nt, Human
agaaggcucacuaagagugacu

SEQ ID NO: 266362 - RNA, 22 nt, Human
gccagcugguaggcaccuagcc

SEQ ID NO: 266363 - RNA, 22 nt, Human
gagcuuggcagugucacuaggg

SEQ ID NO: 266364 - RNA, 20 nt, Human
cuuucucuaauuuauaagua

SEQ ID NO: 266365 - RNA, 22 nt, Human
caggcuucagggaacgcagucu

SEQ ID NO: 266366 - RNA, 22 nt, Human
ugaugagggagauuugagccca

SEQ ID NO: 266367 - RNA, 22 nt, Human
gccauauauauuuugcacuagg

SEQ ID NO: 266368 - RNA, 22 nt, Human
aaaugugugcacaaagacagcu

SEQ ID NO: 266369 - RNA, 22 nt, Human
acagcuuuucaauucugcugag

SEQ ID NO: 266370 - RNA, 22 nt, Human
agcccuccaaagguugggggag

SEQ ID NO: 266371 - RNA, 22 nt, Human
auccaguuccaaagaucauuua

SEQ ID NO: 266372 - RNA, 22 nt, Human
guacauuuaggauucauugaaa

SEQ ID NO: 266373 - RNA, 22 nt, Human
ggaggaaauccuuaguaaggca

SEQ ID NO: 266374 - RNA, 22 nt, Human
uugagacuccugguguagaaua

SEQ ID NO: 266375 - RNA, 22 nt, Human
gccagucagcuggccaggcugg

SEQ ID NO: 266376 - RNA, 22 nt, Human
caggagccacauuccaccuuga

SEQ ID NO: 266377 - RNA, 22 nt, Human
cagcuguucggggcuggcaugu

SEQ ID NO: 266378 - RNA, 22 nt, Human
uagaaacagaauaugagugaga

SEQ ID NO: 266379 - RNA, 22 nt, Human
agggccaggaacaccugaaggg

SEQ ID NO: 266380 - RNA, 22 nt, Human
cugcaaucuccaugcuugauuu

SEQ ID NO: 266381 - RNA, 22 nt, Human
acauucaugcaccuuccuaucc

SEQ ID NO: 266382 - RNA, 22 nt, Human
caguuuuaaauuuugaaugucu

SEQ ID NO: 266383 - RNA, 22 nt, Human
uuagucaauagugaauauagag

SEQ ID NO: 266384 - RNA, 22 nt, Human
agcucuggaauaaugaugugau

SEQ ID NO: 266385 - RNA, 22 nt, Human
cuucaaauccuguguagggcua

SEQ ID NO: 266386 - RNA, 22 nt, Human
agccaacucccucucauugagc

SEQ ID NO: 266387 - RNA, 22 nt, Human
gucagagcacugaguugugggc

SEQ ID NO: 266388 - RNA, 22 nt, Human
guaaaauugcaauuacuuuugc

SEQ ID NO: 266389 - RNA, 19 nt, Human
ugcagaggguaggaaggcc

SEQ ID NO: 266390 - RNA, 22 nt, Human
gcccugagaagaagucggaggg

SEQ ID NO: 266391 - RNA, 22 nt, Human
ggcaucaggaucugucuugcuu

SEQ ID NO: 266392 - RNA, 22 nt, Human
cacaugcauaccuauguguaua

SEQ ID NO: 266393 - RNA, 22 nt, Human
acauuucucauaggagagccac

SEQ ID NO: 266394 - RNA, 22 nt, Human
ccagagcugaugggcccagggu

SEQ ID NO: 266395 - RNA, 22 nt, Human
cccuagggcuaagcaggacugc

SEQ ID NO: 266396 - RNA, 21 nt, Human
aaucugcuucccugugacuug

SEQ ID NO: 266397 - RNA, 22 nt, Human
gcuguauuuauuuucuaggguu

SEQ ID NO: 266398 - RNA, 17 nt, Human
cucagcagggcucacuu

SEQ ID NO: 266399 - RNA, 22 nt, Human
cucugcacccccggcuccucgu

SEQ ID NO: 266400 - RNA, 22 nt, Human
agagcuggcagcagcuucuccu

SEQ ID NO: 266401 - RNA, 22 nt, Human
ugcuuuaguucaacaugccaaa

SEQ ID NO: 266402 - RNA, 22 nt, Human
auggcuugguugguuaaagcac

SEQ ID NO: 266403 - RNA, 22 nt, Human
acagaagcucaagagagcagug

SEQ ID NO: 266404 - RNA, 22 nt, Human
gacagcugugcaggagaagggg

SEQ ID NO: 266405 - RNA, 22 nt, Human
aaagagcucuuacucuagugua

SEQ ID NO: 266406 - RNA, 21 nt, Human
uuucuuucuggcucucacagu

SEQ ID NO: 266407 - RNA, 22 nt, Human
gaggggucuuuuguugucaggg

SEQ ID NO: 266408 - RNA, 22 nt, Human
uagaaccucauaagaaucgaaa

SEQ ID NO: 266409 - RNA, 22 nt, Human
aaaucuuucccuuuacuaucca

SEQ ID NO: 266410 - RNA, 22 nt, Human
uuacagaguggucuggcuaugu

SEQ ID NO: 266411 - RNA, 22 nt, Human
cugcucuucccacucacuccca

SEQ ID NO: 266412 - RNA, 22 nt, Human
aaaguucucuaugguguaaaaa

SEQ ID NO: 266413 - RNA, 22 nt, Human
ugaggcaggaugcuugcacagg

SEQ ID NO: 266414 - RNA, 22 nt, Human
agccacagcaacaagugcaauu

SEQ ID NO: 266415 - RNA, 22 nt, Human
cacuuagauacuagaucacaaa

SEQ ID NO: 266416 - RNA, 22 nt, Human
gguccaugauaggaaguuccga

SEQ ID NO: 266417 - RNA, 22 nt, Human
aggcucaggaggagcugccgga

SEQ ID NO: 266418 - RNA, 22 nt, Human
cagcuggaucccugcagaacuu

SEQ ID NO: 266419 - RNA, 22 nt, Human
ugggggcauggaccagccuggc

SEQ ID NO: 266420 - RNA, 22 nt, Human
ccaggaggcucuugucccuggu

SEQ ID NO: 266421 - RNA, 22 nt, Human
uuuuaaucaugcuucuaugucc

SEQ ID NO: 266422 - RNA, 19 nt, Human
ggcagaagguguaggggga

SEQ ID NO: 266423 - RNA, 19 nt, Human
gaggugucuuuccugagua

SEQ ID NO: 266424 - RNA, 22 nt, Human
aacuuucuuugcaucuaaguuu

SEQ ID NO: 266425 - RNA, 22 nt, Human
uccccccagccuuucacaugag

SEQ ID NO: 266426 - RNA, 22 nt, Human
cgacccuacagacagugcugag

SEQ ID NO: 266427 - RNA, 22 nt, Human
agauaaguacuguuauuauugc

SEQ ID NO: 266428 - RNA, 22 nt, Human
aggacaagacaaggaccagaga

SEQ ID NO: 266429 - RNA, 22 nt, Human
gucugcugcagagcauggcuuu

SEQ ID NO: 266430 - RNA, 22 nt, Human
aucccuggacggcgccucccca

SEQ ID NO: 266431 - RNA, 22 nt, Human
cuguccccugugcuuucacuug

SEQ ID NO: 266432 - RNA, 22 nt, Human
uggggacccggacuccuggguc

SEQ ID NO: 266433 - RNA, 22 nt, Human
uucugagaugaggaggaaaaag

SEQ ID NO: 266434 - RNA, 22 nt, Human
ugccuuuaacuuaaagcaugac

SEQ ID NO: 266435 - RNA, 22 nt, Human
acaugacagugcuuagcaaacu

SEQ ID NO: 266436 - RNA, 22 nt, Human
aguaaaauuguauuggaaaaca

SEQ ID NO: 266437 - RNA, 22 nt, Human
acauaauaaaaauaacagcuca

SEQ ID NO: 266438 - RNA, 22 nt, Human
ucuuccagucuguaggacuagg

SEQ ID NO: 266439 - RNA, 23 nt, Human
uaggaagacagcaaaagaaugga

SEQ ID NO: 266440 - RNA, 22 nt, Human
gccaggugcauauuagaagcau

SEQ ID NO: 266441 - RNA, 22 nt, Human
accuucaacucaaaguguccca

SEQ ID NO: 266442 - RNA, 22 nt, Human
ugcacuguugcuuuauaugauu

SEQ ID NO: 266443 - RNA, 22 nt, Human
caacaaguguucguaaagugcc

SEQ ID NO: 266444 - RNA, 22 nt, Human
acccaggguagaaccucagagc

SEQ ID NO: 266445 - RNA, 19 nt, Human
aggcuaaagagucuugcgu

SEQ ID NO: 266446 - RNA, 22 nt, Human
guucucagggauaacuuccccc

SEQ ID NO: 266447 - RNA, 22 nt, Human
ugucuucaucuccaugcacaga

SEQ ID NO: 266448 - RNA, 17 nt, Human
aaacugaaaaauucacu

SEQ ID NO: 266449 - RNA, 22 nt, Human
ggaaauacaaagauacaccacu

SEQ ID NO: 266450 - RNA, 22 nt, Human
cuugaaaauaagaaagacuuuc

SEQ ID NO: 266451 - RNA, 16 nt, Human
uguuugcaaagcaauc

SEQ ID NO: 266452 - RNA, 22 nt, Human
uacuucauuccuuuguaaaaug

SEQ ID NO: 266453 - RNA, 21 nt, Human
ugccuggccuuugcuuuuccu

SEQ ID NO: 266454 - RNA, 22 nt, Human
aaacauagauaauagauagaug

SEQ ID NO: 266455 - RNA, 22 nt, Human
ggccucuggucaagacaagcau

SEQ ID NO: 266456 - RNA, 22 nt, Human
gagccuggggacccuccugagu

SEQ ID NO: 266457 - RNA, 20 nt, Human
uuucuuguacuuggagaagg

SEQ ID NO: 266458 - RNA, 18 nt, Human
ucucugaauauuuuaugu

SEQ ID NO: 266459 - RNA, 22 nt, Human
uggggcaguggcuuuucacccu

SEQ ID NO: 266460 - RNA, 22 nt, Human
aauguucagggcagcccugcua

SEQ ID NO: 266461 - RNA, 22 nt, Human
aaaacuuucagggauacagaaa

SEQ ID NO: 266462 - RNA, 22 nt, Human
augcaucuguaguguuauauga

SEQ ID NO: 266463 - RNA, 22 nt, Human
uucauacuaaaguguaagaugu

SEQ ID NO: 266464 - RNA, 22 nt, Human
gccuguuuggcaucauugguug

SEQ ID NO: 266465 - RNA, 22 nt, Human
guagucugaacaguaauuuugu

SEQ ID NO: 266466 - RNA, 22 nt, Human
agggccaccagggagucucagg

SEQ ID NO: 266467 - RNA, 18 nt, Human
gccagagguacuacugau

SEQ ID NO: 266468 - RNA, 22 nt, Human
cauaauccauuugcacugcaga

SEQ ID NO: 266469 - RNA, 22 nt, Human
auaguacagagggcuacugguu

SEQ ID NO: 266470 - RNA, 22 nt, Human
gaaaggaagaaaggucauuuua

SEQ ID NO: 266471 - RNA, 22 nt, Human
augcaauuuacuguacauaaau

SEQ ID NO: 266472 - RNA, 22 nt, Human
cagcugcaggaacaaaaaugug

SEQ ID NO: 266473 - RNA, 22 nt, Human
uacuaucucuucuaacuucaga

SEQ ID NO: 266474 - RNA, 22 nt, Human
uuacauguacaaacaauucuua

SEQ ID NO: 266475 - RNA, 22 nt, Human
auggccaaauaacagcuugcau

SEQ ID NO: 266476 - RNA, 22 nt, Human
uggagagaaaguugaauggagg

SEQ ID NO: 266477 - RNA, 22 nt, Human
uguuuagcauaaagauuuucca

SEQ ID NO: 266478 - RNA, 22 nt, Human
ccacagagacaggguccuugcu

SEQ ID NO: 266479 - RNA, 22 nt, Human
uccacagugguugaacuaguuu

SEQ ID NO: 266480 - RNA, 18 nt, Human
ucaugaggaaggagaaga

SEQ ID NO: 266481 - RNA, 22 nt, Human
uguggcugcaggcgauggagga

SEQ ID NO: 266482 - RNA, 22 nt, Human
cugggccuggggcuguugagag

SEQ ID NO: 266483 - RNA, 22 nt, Human
ccugcaguuuguugugaccccg

SEQ ID NO: 266484 - RNA, 22 nt, Human
ggaggcacaccucagacuggga

SEQ ID NO: 266485 - RNA, 22 nt, Human
aggcugaggcuggcagcuccag

SEQ ID NO: 266486 - RNA, 22 nt, Human
aguccaguguguucuggcagca

SEQ ID NO: 266487 - RNA, 21 nt, Human
agccauccugaauggugccau

SEQ ID NO: 266488 - RNA, 23 nt, Human
cuagaugcaagcuccaugaggga

SEQ ID NO: 266489 - RNA, 22 nt, Human
gagcccugaacaacagcaggaa

SEQ ID NO: 266490 - RNA, 22 nt, Human
cuaaagaauuuugcuugaccag

SEQ ID NO: 266491 - RNA, 22 nt, Human
uagcuuggaauaaaaugagaau

SEQ ID NO: 266492 - RNA, 22 nt, Human
uuguuaaagaugcagauuccau

SEQ ID NO: 266493 - RNA, 22 nt, Human
cuuuacauuaauuucuacugau

SEQ ID NO: 266494 - RNA, 22 nt, Human
gauuacauucuccuuguauuag

SEQ ID NO: 266495 - RNA, 22 nt, Human
uacaccagauuauuuauaacau

SEQ ID NO: 266496 - RNA, 22 nt, Human
ccuggcacaugcaguacucaag

SEQ ID NO: 266497 - RNA, 22 nt, Human
guucuuuaaguggagaaggaaa

SEQ ID NO: 266498 - RNA, 21 nt, Human
uuagcuuucuagaaucuuugu

SEQ ID NO: 266499 - RNA, 22 nt, Human
agcagagcaaagcucagaaaug

SEQ ID NO: 266500 - RNA, 23 nt, Human
uuuauccaacucuguaaucucuc

SEQ ID NO: 266501 - RNA, 22 nt, Human
gggagggccagugcucucuaga

SEQ ID NO: 266502 - RNA, 22 nt, Human
uuucugcagcagacucagugug

SEQ ID NO: 266503 - RNA, 22 nt, Human
gccuggagggucccucucugga

SEQ ID NO: 266504 - RNA, 22 nt, Human
caggcacuguguuaggcacugu

SEQ ID NO: 266505 - RNA, 22 nt, Human
cucagcaagacccccaccgugu

SEQ ID NO: 266506 - RNA, 22 nt, Human
uccuuuguugagauaaauuggg

SEQ ID NO: 266507 - RNA, 22 nt, Human
auguagaauuccuucuacuuug

SEQ ID NO: 266508 - RNA, 22 nt, Human
guauuagggccaaaggcaggaa

SEQ ID NO: 266509 - RNA, 22 nt, Human
gacauucauugaugucuuccuc

SEQ ID NO: 266510 - RNA, 22 nt, Human
aucugguauuuccuuugauagc

SEQ ID NO: 266511 - RNA, 21 nt, Human
acacugcuguagcauauuggg

SEQ ID NO: 266512 - RNA, 22 nt, Human
aggauuuaaucaguuggcauuu

SEQ ID NO: 266513 - RNA, 22 nt, Human
cagccccuuccuggcaucugga

SEQ ID NO: 266514 - RNA, 22 nt, Human
uuggcugcauuuuggguucguu

SEQ ID NO: 266515 - RNA, 22 nt, Human
gcccuccagcuguugcgcgucg

SEQ ID NO: 266516 - RNA, 17 nt, Human
uuuucucucuuggauuc

SEQ ID NO: 266517 - RNA, 22 nt, Human
cagcaggacauggaggaguaaa

SEQ ID NO: 266518 - RNA, 22 nt, Human
uucuagaagcugaaaaggggga

SEQ ID NO: 266519 - RNA, 23 nt, Human
acacuuucaaauaugcacagagc

SEQ ID NO: 266520 - RNA, 22 nt, Human
ggccucucagggcagagacccu

SEQ ID NO: 266521 - RNA, 22 nt, Human
cagcagguguccuuuuggugga

SEQ ID NO: 266522 - RNA, 22 nt, Human
auggcccaggcaggcugguacu

SEQ ID NO: 266523 - RNA, 22 nt, Human
auucacaaauaacaggugcaga

SEQ ID NO: 266524 - RNA, 19 nt, Human
ccagguggaacugagguag

SEQ ID NO: 266525 - RNA, 22 nt, Human
uacgaauccuguggaugaaugu

SEQ ID NO: 266526 - RNA, 22 nt, Human
gaaaggcugggauuuagcgcug

SEQ ID NO: 266527 - RNA, 22 nt, Human
auaucaguaucuauguauuugu

SEQ ID NO: 266528 - RNA, 22 nt, Human
acacaggaagagagauaauaau

SEQ ID NO: 266529 - RNA, 22 nt, Human
uccagcagaccaucaaggcuca

SEQ ID NO: 266530 - RNA, 22 nt, Human
agccagcaggaacgucuagguu

SEQ ID NO: 266531 - RNA, 23 nt, Human
acagaaaucauuuguaagguacc

SEQ ID NO: 266532 - RNA, 22 nt, Human
cauuaauuguauuuuucaaagu

SEQ ID NO: 266533 - RNA, 22 nt, Human
agugagcaucuucaggagccaa

SEQ ID NO: 266534 - RNA, 22 nt, Human
cccccaccugaggacagucuua

SEQ ID NO: 266535 - RNA, 22 nt, Human
ggccuaguuuuuucugguaggu

SEQ ID NO: 266536 - RNA, 22 nt, Human
uucucuggagaguaucuucuua

SEQ ID NO: 266537 - RNA, 17 nt, Human
ugccuccagcaggguga

SEQ ID NO: 266538 - RNA, 22 nt, Human
uuacaaagcguugagacaagua

SEQ ID NO: 266539 - RNA, 22 nt, Human
gcugcucacugaaggacccugu

SEQ ID NO: 266540 - RNA, 22 nt, Human
acucaagauagggaaaguacaa

SEQ ID NO: 266541 - RNA, 22 nt, Human
caguuacuguaugucaaagacu

SEQ ID NO: 266542 - RNA, 22 nt, Human
uggaugagucugagauugggca

SEQ ID NO: 266543 - RNA, 22 nt, Human
ucugagguguagcugggcuuca

SEQ ID NO: 266544 - RNA, 22 nt, Human
uaacuacaagggcggucucugu

SEQ ID NO: 266545 - RNA, 21 nt, Human
caaauacuuagaaacuuaaga

SEQ ID NO: 266546 - RNA, 22 nt, Human
ucauggcuuuuucacuguucgc

SEQ ID NO: 266547 - RNA, 23 nt, Human
aaagagacugauacggaaguucc

SEQ ID NO: 266548 - RNA, 22 nt, Human
uucuuagaugauuaaugauggg

SEQ ID NO: 266549 - RNA, 22 nt, Human
caggagcuacucagguuggguu

SEQ ID NO: 266550 - RNA, 22 nt, Human
uaaauuaaagauuggagaagga

SEQ ID NO: 266551 - RNA, 22 nt, Human
aauucaaucuguagauugugau

SEQ ID NO: 266552 - RNA, 22 nt, Human
gagcugaauuacggugagucau

SEQ ID NO: 266553 - RNA, 22 nt, Human
ccaggcccuugcaagucccacc

SEQ ID NO: 266554 - RNA, 22 nt, Human
cugccugcuuaccaugcaucag

SEQ ID NO: 266555 - RNA, 22 nt, Human
agaaggggagaagcuaccagga

SEQ ID NO: 266556 - RNA, 22 nt, Human
aagguguuauagcugaggaaua

SEQ ID NO: 266557 - RNA, 22 nt, Human
acugggccuggauuggcguguc

SEQ ID NO: 266558 - RNA, 22 nt, Human
agaugugacugggcaaguuacu

SEQ ID NO: 266559 - RNA, 22 nt, Human
augaggugauggacauauuaac

SEQ ID NO: 266560 - RNA, 22 nt, Human
aacuuuuagacuuggguauaaa

SEQ ID NO: 266561 - RNA, 22 nt, Human
agauacaaaagauaagauuuag

SEQ ID NO: 266562 - RNA, 22 nt, Human
gaggaaggucccaucagaauuu

SEQ ID NO: 266563 - RNA, 22 nt, Human
ggcucugccugcccagcagcac

SEQ ID NO: 266564 - RNA, 22 nt, Human
gaauuuuaucuuauuacuugca

SEQ ID NO: 266565 - RNA, 22 nt, Human
auucucagaucuuagaggaaua

SEQ ID NO: 266566 - RNA, 22 nt, Human
aaggcuggagaugguuggaaug

SEQ ID NO: 266567 - RNA, 22 nt, Human
caggguuauacagcugaacaaa

SEQ ID NO: 266568 - RNA, 22 nt, Human
uguggggcagcuagccggccug

SEQ ID NO: 266569 - RNA, 22 nt, Human
ugccugggaucugugcccuuug

SEQ ID NO: 266570 - RNA, 22 nt, Human
ugucacauugaauaugauuuau

SEQ ID NO: 266571 - RNA, 22 nt, Human
cuuuacagauggauaauuguuu

SEQ ID NO: 266572 - RNA, 20 nt, Human
cauauauaccuagaagugga

SEQ ID NO: 266573 - RNA, 22 nt, Human
uugagucugcccaaauuaagaa

SEQ ID NO: 266574 - RNA, 22 nt, Human
uccucuggauauaagccucacc

SEQ ID NO: 266575 - RNA, 22 nt, Human
agggaagggaaaaacacucguc

SEQ ID NO: 266576 - RNA, 22 nt, Human
cagcuccuagaucggcgaagug

SEQ ID NO: 266577 - RNA, 22 nt, Human
uccucaguuuucuaguauggca

SEQ ID NO: 266578 - RNA, 22 nt, Human
cauccgcaugcaagugcugucc

SEQ ID NO: 266579 - RNA, 22 nt, Human
aacuuaggaaaauaaggcauga

SEQ ID NO: 266580 - RNA, 22 nt, Human
caggagcucacagucuuugggu

SEQ ID NO: 266581 - RNA, 22 nt, Human
ucugaaaguaucuggaucuuuu

SEQ ID NO: 266582 - RNA, 19 nt, Human
ugggagaggcaacagagua

SEQ ID NO: 266583 - RNA, 22 nt, Human
gggggcuggaauauccaucaac

SEQ ID NO: 266584 - RNA, 22 nt, Human
uacauguuugguaaaugauggc

SEQ ID NO: 266585 - RNA, 23 nt, Human
ucagugucuaguuguggaauuga

SEQ ID NO: 266586 - RNA, 22 nt, Human
ggcuuccagcugggccuuggag

SEQ ID NO: 266587 - RNA, 22 nt, Human
uuaugugcuucaacugagccua

SEQ ID NO: 266588 - RNA, 22 nt, Human
gcacuggagauacagagaugaa

SEQ ID NO: 266589 - RNA, 22 nt, Human
gcaucuaaacuugcaucauugu

SEQ ID NO: 266590 - RNA, 20 nt, Human
gugccuggagaagaggcugu

SEQ ID NO: 266591 - RNA, 22 nt, Human
uuucauguuuucuuaaauggca

SEQ ID NO: 266592 - RNA, 22 nt, Human
uucacauuucucugcuguuuga

SEQ ID NO: 266593 - RNA, 22 nt, Human
guuagaaacgcaggcucuccgg

SEQ ID NO: 266594 - RNA, 22 nt, Human
uaagaaucgauguuuauuuaga

SEQ ID NO: 266595 - RNA, 22 nt, Human
agggaccugucaaugacaguua

SEQ ID NO: 266596 - RNA, 19 nt, Human
aaggugucccaacugcguu

SEQ ID NO: 266597 - RNA, 22 nt, Human
ugaugagggcaguucuuguugc

SEQ ID NO: 266598 - RNA, 22 nt, Human
gucuccugagacugcagucacc

SEQ ID NO: 266599 - RNA, 22 nt, Human
gggcccucugcagcugcccagg

SEQ ID NO: 266600 - RNA, 22 nt, Human
aucucccaaauuagccucuuga

SEQ ID NO: 266601 - RNA, 22 nt, Human
gggugggaacaggaugccagga

SEQ ID NO: 266602 - RNA, 22 nt, Human
aaauacaauuucaggcuguaau

SEQ ID NO: 266603 - RNA, 22 nt, Human
agugugcauuccucuccucagg

SEQ ID NO: 266604 - RNA, 22 nt, Human
aaucagcaaaugcuuacucagg

SEQ ID NO: 266605 - RNA, 19 nt, Human
uuagguauuauugcuuucc

SEQ ID NO: 266606 - RNA, 22 nt, Human
caggaaaugcguaguugaacuu

SEQ ID NO: 266607 - RNA, 22 nt, Human
ggcaggcaggucuucauggccc

SEQ ID NO: 266608 - RNA, 22 nt, Human
ccucaggccugccagagcccca

SEQ ID NO: 266609 - RNA, 22 nt, Human
uuuauuggauauuuacaagaua

SEQ ID NO: 266610 - RNA, 22 nt, Human
cagagggcccccuggccacagu

SEQ ID NO: 266611 - RNA, 22 nt, Human
gaaggcuugauugaggaaugcc

SEQ ID NO: 266612 - RNA, 22 nt, Human
uccugaggaaugugaagagaac

SEQ ID NO: 266613 - RNA, 22 nt, Human
uuugacaugaaguagcuuauaa

SEQ ID NO: 266614 - RNA, 22 nt, Human
cacagccuuuaggguacacaca

SEQ ID NO: 266615 - RNA, 22 nt, Human
gaaaacuaacggaaaaguuagg

SEQ ID NO: 266616 - RNA, 22 nt, Human
cugggcucuggggucccggugc

SEQ ID NO: 266617 - RNA, 21 nt, Human
ucagagaacccggcaggcaag

SEQ ID NO: 266618 - RNA, 22 nt, Human
ggccuggcauggggacuaaggg

SEQ ID NO: 266619 - RNA, 22 nt, Human
accuugaacccagcuugcugca

SEQ ID NO: 266620 - RNA, 22 nt, Human
augcccuggggcuaccucugag

SEQ ID NO: 266621 - RNA, 22 nt, Human
uucuucuugaaacuuuagguug

SEQ ID NO: 266622 - RNA, 23 nt, Human
uugcugccugagccuuccucugg

SEQ ID NO: 266623 - RNA, 22 nt, Human
aacuucaccuuuuugccacacu

SEQ ID NO: 266624 - RNA, 22 nt, Human
acagacugugagucucauuuuc

SEQ ID NO: 266625 - RNA, 22 nt, Human
ucccugggacucagacauggaa

SEQ ID NO: 266626 - RNA, 22 nt, Human
ggcaacucuucuugcaaugggg

SEQ ID NO: 266627 - RNA, 21 nt, Human
caguuacacaaguguuaccag

SEQ ID NO: 266628 - RNA, 18 nt, Human
cccagcuuagcgccccuc

SEQ ID NO: 266629 - RNA, 22 nt, Human
uguucuuugccagugauuuaau

SEQ ID NO: 266630 - RNA, 22 nt, Human
gaggcuccuugaaagggggacu

SEQ ID NO: 266631 - RNA, 22 nt, Human
ugaggccuuaguaacccugcac

SEQ ID NO: 266632 - RNA, 22 nt, Human
cagcuccugccugggcagcugu

SEQ ID NO: 266633 - RNA, 22 nt, Human
gucuagaaauguucucaggggu

SEQ ID NO: 266634 - RNA, 22 nt, Human
acugagcauaaauaugugucca

SEQ ID NO: 266635 - RNA, 22 nt, Human
gugagggauaauaugcgggguu

SEQ ID NO: 266636 - RNA, 22 nt, Human
acuuuagaaguaaggaugaguu

SEQ ID NO: 266637 - RNA, 22 nt, Human
ugucugucuguccuucucauua

SEQ ID NO: 266638 - RNA, 19 nt, Human
aggcuuggaacagccuuau

SEQ ID NO: 266639 - RNA, 22 nt, Human
ccuccuggccugugcagagccc

SEQ ID NO: 266640 - RNA, 22 nt, Human
ggaagugguagagccaugagug

SEQ ID NO: 266641 - RNA, 22 nt, Human
aguaggcauugugaaacugcau

SEQ ID NO: 266642 - RNA, 22 nt, Human
caucaaaauuagacauuguuga

SEQ ID NO: 266643 - RNA, 22 nt, Human
aauguucagaggacaauauaaa

SEQ ID NO: 266644 - RNA, 22 nt, Human
acaacacauguguauaugugug

SEQ ID NO: 266645 - RNA, 22 nt, Human
cagagccaacgccaccugccca

SEQ ID NO: 266646 - RNA, 21 nt, Human
gcuuuagauuuagugagccag

SEQ ID NO: 266647 - RNA, 22 nt, Human
guccucagcaccagaacuaggg

SEQ ID NO: 266648 - RNA, 22 nt, Human
uucauugauuuccuuggaauaa

SEQ ID NO: 266649 - RNA, 22 nt, Human
uguacacaaccuacagucugcu

SEQ ID NO: 266650 - RNA, 22 nt, Human
gagcuggucaguuucaggagag

SEQ ID NO: 266651 - RNA, 22 nt, Human
uuuccagugauugcugcucuca

SEQ ID NO: 266652 - RNA, 22 nt, Human
cuuaggauuuaauuucagacuc

SEQ ID NO: 266653 - RNA, 22 nt, Human
gagaggccauggggugggaugc

SEQ ID NO: 266654 - RNA, 19 nt, Human
uaugacaaguacuaguucu

SEQ ID NO: 266655 - RNA, 22 nt, Human
ugccaaauugcccuauaaauga

SEQ ID NO: 266656 - RNA, 22 nt, Human
uucucuggagggcugcccggcc

SEQ ID NO: 266657 - RNA, 22 nt, Human
uuccaggagccacacaggggcg

SEQ ID NO: 266658 - RNA, 22 nt, Human
ucugagcuguggccauucuucc

SEQ ID NO: 266659 - RNA, 22 nt, Human
cuggaaggcagagguugcagug

SEQ ID NO: 266660 - RNA, 22 nt, Human
uucauucauguauugucuaugg

SEQ ID NO: 266661 - RNA, 22 nt, Human
ugagccagucucucagaacccu

SEQ ID NO: 266662 - RNA, 19 nt, Human
gaugcucauucagguggaa

SEQ ID NO: 266663 - RNA, 22 nt, Human
cugaaagcaaaguaauucuuaa

SEQ ID NO: 266664 - RNA, 22 nt, Human
ugugacuggaguccagcccacu

SEQ ID NO: 266665 - RNA, 22 nt, Human
auuucucaguuccuacuguuua

SEQ ID NO: 266666 - RNA, 22 nt, Human
ccuaagaauuaaugaauacacc

SEQ ID NO: 266667 - RNA, 22 nt, Human
uacacauguccaaggugucacc

SEQ ID NO: 266668 - RNA, 22 nt, Human
gccucaggccuauagcugcugu

SEQ ID NO: 266669 - RNA, 22 nt, Human
uuuguguuuucccauacuauug

SEQ ID NO: 266670 - RNA, 22 nt, Human
ugcucuggaauaguccuaggca

SEQ ID NO: 266671 - RNA, 21 nt, Human
aggcaauucgaaguugcagac

SEQ ID NO: 266672 - RNA, 22 nt, Human
aaaggcaucuagccaaguugag

SEQ ID NO: 266673 - RNA, 22 nt, Human
ugggaacaccugcugcccagug

SEQ ID NO: 266674 - RNA, 22 nt, Human
aguuuaacuuuguaaacgugag

SEQ ID NO: 266675 - RNA, 22 nt, Human
uugcagcuucaagcagguugac

SEQ ID NO: 266676 - RNA, 22 nt, Human
auuugcuuaucuccacaguugu

SEQ ID NO: 266677 - RNA, 22 nt, Human
cccagcccagcguucgaggggu

SEQ ID NO: 266678 - RNA, 22 nt, Human
gcucccugcauuucccacccuu

SEQ ID NO: 266679 - RNA, 19 nt, Human
ugccaggaauacuccagaa

SEQ ID NO: 266680 - RNA, 22 nt, Human
cuguuauuuagaacauggaauc

SEQ ID NO: 266681 - RNA, 22 nt, Human
uuccuggcuggcgguuuuggug

SEQ ID NO: 266682 - RNA, 22 nt, Human
uaccaugucaagcgagacaugu

SEQ ID NO: 266683 - RNA, 22 nt, Human
acaguacaaaacccaccagagg

SEQ ID NO: 266684 - RNA, 22 nt, Human
uaaaugugcacagguuagaagg

SEQ ID NO: 266685 - RNA, 22 nt, Human
ccaugcugugacacaguaguua

SEQ ID NO: 266686 - RNA, 20 nt, Human
ggggcugcaugcagagaaga

SEQ ID NO: 266687 - RNA, 22 nt, Human
ucuuggcaguggaauaccagga

SEQ ID NO: 266688 - RNA, 21 nt, Human
ugcaugcuauguuuuuauuuc

SEQ ID NO: 266689 - RNA, 22 nt, Human
ucuggcuucaacuuuacugaaa

SEQ ID NO: 266690 - RNA, 22 nt, Human
aucuucuucaaggaucuggagc

SEQ ID NO: 266691 - RNA, 22 nt, Human
uguaaugggcuacuaggaagag

SEQ ID NO: 266692 - RNA, 22 nt, Human
ucaguuacucugauguccugug

SEQ ID NO: 266693 - RNA, 20 nt, Human
guucaugucucaaauagaaa

SEQ ID NO: 266694 - RNA, 22 nt, Human
uuguuacacauaauaacauuuu

SEQ ID NO: 266695 - RNA, 22 nt, Human
cauguuaacuaagauuaacuau

SEQ ID NO: 266696 - RNA, 22 nt, Human
gcagcaggauggccaauugcca

SEQ ID NO: 266697 - RNA, 22 nt, Human
guucuucacauuucauugagga

SEQ ID NO: 266698 - RNA, 22 nt, Human
agagaucugucuacuauuuaag

SEQ ID NO: 266699 - RNA, 23 nt, Human
aguggcuggacagacuuuccugg

SEQ ID NO: 266700 - RNA, 22 nt, Human
ucuccaggugacucugauguau

SEQ ID NO: 266701 - RNA, 21 nt, Human
ggagcugcaggagccgaaggc

SEQ ID NO: 266702 - RNA, 22 nt, Human
acaacaguccaguauagacugu

SEQ ID NO: 266703 - RNA, 22 nt, Human
ucagugcaggaauuuccuuaga

SEQ ID NO: 266704 - RNA, 22 nt, Human
aaagcaauuacaaaagggauaa

SEQ ID NO: 266705 - RNA, 22 nt, Human
cuuccuuccacaccuucagaau

SEQ ID NO: 266706 - RNA, 22 nt, Human
aauguuuucucugugaacacau

SEQ ID NO: 266707 - RNA, 22 nt, Human
guauucaguuugauugucuaca

SEQ ID NO: 266708 - RNA, 22 nt, Human
ugugagaauuccugaucacagg

SEQ ID NO: 266709 - RNA, 22 nt, Human
auacagaagccuguauuucugg

SEQ ID NO: 266710 - RNA, 22 nt, Human
ucucccaggcugcccuguggac

SEQ ID NO: 266711 - RNA, 22 nt, Human
cagagacaggaaucagcugcag

SEQ ID NO: 266712 - RNA, 22 nt, Human
uacuucuguuagcucugagagu

SEQ ID NO: 266713 - RNA, 22 nt, Human
uaugucuuuugcuugcaaauag

SEQ ID NO: 266714 - RNA, 22 nt, Human
agcuaagaacuugagcucugga

SEQ ID NO: 266715 - RNA, 23 nt, Human
cagcucagcacauaggagguacu

SEQ ID NO: 266716 - RNA, 22 nt, Human
ggagcagaugucuucauggccu

SEQ ID NO: 266717 - RNA, 20 nt, Human
aggagucccugugcucucuc

SEQ ID NO: 266718 - RNA, 22 nt, Human
uggguccucugagagggcagcg

SEQ ID NO: 266719 - RNA, 22 nt, Human
ggccuuagagaccaccuagucu

SEQ ID NO: 266720 - RNA, 22 nt, Human
ccaggucuuggcccccggaccu

SEQ ID NO: 266721 - RNA, 22 nt, Human
cugacuguuugcugaaaggucu

SEQ ID NO: 266722 - RNA, 22 nt, Human
gcacuggaaauaccuagaugaa

SEQ ID NO: 266723 - RNA, 22 nt, Human
uuugcugaacuaaaauucugaa

SEQ ID NO: 266724 - RNA, 22 nt, Human
agaagccagucgcucucccgca

SEQ ID NO: 266725 - RNA, 22 nt, Human
ugcaaggauauuuagucuagug

SEQ ID NO: 266726 - RNA, 22 nt, Human
ucugugcaccuucuaaugagua

SEQ ID NO: 266727 - RNA, 22 nt, Human
guggcagugccguuugguucag

SEQ ID NO: 266728 - RNA, 22 nt, Human
gggacccugggaggcuggcgca

SEQ ID NO: 266729 - RNA, 22 nt, Human
auguaucaacaaauuguacagu

SEQ ID NO: 266730 - RNA, 22 nt, Human
auuucuguaguccacauucuuu

SEQ ID NO: 266731 - RNA, 22 nt, Human
gugcaaaaguaauugcuguuuu

SEQ ID NO: 266732 - RNA, 22 nt, Human
ugcugggggcuuucuggauacc

SEQ ID NO: 266733 - RNA, 22 nt, Human
ccaguguucugguguucauuuc

SEQ ID NO: 266734 - RNA, 22 nt, Human
uggagcugucacucagaaccaa

SEQ ID NO: 266735 - RNA, 22 nt, Human
uggcaaaggaaccuauuuuaaa

SEQ ID NO: 266736 - RNA, 22 nt, Human
agugaugugggagaguauagcu

SEQ ID NO: 266737 - RNA, 22 nt, Human
cuuccuucugaagcauagaagc

SEQ ID NO: 266738 - RNA, 22 nt, Human
uuuagauaaugcucaagcaauu

SEQ ID NO: 266739 - RNA, 22 nt, Human
gccugcugccacccuggcuccg

SEQ ID NO: 266740 - RNA, 22 nt, Human
auccugggaaguggccuccucc

SEQ ID NO: 266741 - RNA, 23 nt, Human
uaucuuuuucaauguuggaaaua

SEQ ID NO: 266742 - RNA, 22 nt, Human
cuccccaaagauaacggcuucu

SEQ ID NO: 266743 - RNA, 22 nt, Human
gggcugcugccaccagguggau

SEQ ID NO: 266744 - RNA, 22 nt, Human
ucaggggcuugaggugcauguc

SEQ ID NO: 266745 - RNA, 22 nt, Human
ggcacgugccuaaggagcaggc

SEQ ID NO: 266746 - RNA, 22 nt, Human
uuugcugugggauauccaugug

SEQ ID NO: 266747 - RNA, 21 nt, Human
cuacacagcuuucuauaggaa

SEQ ID NO: 266748 - RNA, 22 nt, Human
ucccugaguuuucuuucugacu

SEQ ID NO: 266749 - RNA, 22 nt, Human
ccagcugugccggggaccuggg

SEQ ID NO: 266750 - RNA, 22 nt, Human
cuguccuguacuuugaggcccu

SEQ ID NO: 266751 - RNA, 22 nt, Human
uagggcugcagaacaauggccu

SEQ ID NO: 266752 - RNA, 22 nt, Human
ccagacaggaacacacaucucc

SEQ ID NO: 266753 - RNA, 22 nt, Human
augucuuuggcuuugacauggc

SEQ ID NO: 266754 - RNA, 22 nt, Human
uacaugcucaguaacuuucagu

SEQ ID NO: 266755 - RNA, 22 nt, Human
gcugcucucagagcucaugcug

SEQ ID NO: 266756 - RNA, 22 nt, Human
uccaggaggccucauuuccugu

SEQ ID NO: 266757 - RNA, 22 nt, Human
ucugccuggauuccauucucca

SEQ ID NO: 266758 - RNA, 22 nt, Human
guaacuuaccauuguagcauca

SEQ ID NO: 266759 - RNA, 22 nt, Human
cccacucccugcacgccugccg

SEQ ID NO: 266760 - RNA, 22 nt, Human
uguggaugaauaaagugcagac

SEQ ID NO: 266761 - RNA, 22 nt, Human
uuuuauagcugaauaguauucc

SEQ ID NO: 266762 - RNA, 22 nt, Human
ccucugagugacagccuccucu

SEQ ID NO: 266763 - RNA, 22 nt, Human
aagucuaguauccuucuugacu

SEQ ID NO: 266764 - RNA, 22 nt, Human
cauaucuggagacuccuggucu

SEQ ID NO: 266765 - RNA, 22 nt, Human
gaugaauuguuauggcuacgag

SEQ ID NO: 266766 - RNA, 21 nt, Human
uccugcagaaugccuuccuac

SEQ ID NO: 266767 - RNA, 22 nt, Human
aauguuaguaacuugaguauuu

SEQ ID NO: 266768 - RNA, 19 nt, Human
cucucuccaguggcuggcu

SEQ ID NO: 266769 - RNA, 22 nt, Human
ccagagcugaggagaugggcuu

SEQ ID NO: 266770 - RNA, 22 nt, Human
gaggcucagagggagcaugguc

SEQ ID NO: 266771 - RNA, 22 nt, Human
gcugcagggggugggcgucucc

SEQ ID NO: 266772 - RNA, 22 nt, Human
gagaaggaguagcugaccuggg

SEQ ID NO: 266773 - RNA, 22 nt, Human
gagcacaggcuuugguggacac

SEQ ID NO: 266774 - RNA, 22 nt, Human
ggcuuugcuucuccagaugcuu

SEQ ID NO: 266775 - RNA, 19 nt, Human
uccugcagguggcuugcag

SEQ ID NO: 266776 - RNA, 22 nt, Human
ucuauguuagagauacauccua

SEQ ID NO: 266777 - RNA, 22 nt, Human
caguuuuaugucgaauguauac

SEQ ID NO: 266778 - RNA, 22 nt, Human
ucaaaggaaacacaagcuucug

SEQ ID NO: 266779 - RNA, 22 nt, Human
uguguucuccaacuguagauuu

SEQ ID NO: 266780 - RNA, 22 nt, Human
gagggcagagucuaaugaugca

SEQ ID NO: 266781 - RNA, 22 nt, Human
cccacaggcaggugcaugggcu

SEQ ID NO: 266782 - RNA, 22 nt, Human
uuguuucuccagucuaggaaaa

SEQ ID NO: 266783 - RNA, 22 nt, Human
ucuggcuguguaugagaguuuu

SEQ ID NO: 266784 - RNA, 22 nt, Human
uuacuuuccagcucuagcuuca

SEQ ID NO: 266785 - RNA, 22 nt, Human
uuccaggaacagaugaagguug

SEQ ID NO: 266786 - RNA, 22 nt, Human
uagaaaagauaacauucugugc

SEQ ID NO: 266787 - RNA, 19 nt, Human
agucucacccaagcagucu

SEQ ID NO: 266788 - RNA, 22 nt, Human
ccccacagccgccagcagggag

SEQ ID NO: 266789 - RNA, 22 nt, Human
cagcaagacuucagggcuuggu

SEQ ID NO: 266790 - RNA, 22 nt, Human
ucuccagggacugaggcuggag

SEQ ID NO: 266791 - RNA, 19 nt, Human
ggggccugugauggucaca

SEQ ID NO: 266792 - RNA, 22 nt, Human
gacagaguuguugauguaugcu

SEQ ID NO: 266793 - RNA, 22 nt, Human
cacauucuugaguuacagucua

SEQ ID NO: 266794 - RNA, 22 nt, Human
uuuauucagcagcagcaguggu

SEQ ID NO: 266795 - RNA, 22 nt, Human
cugggagagaagcgaagcuggg

SEQ ID NO: 266796 - RNA, 22 nt, Human
uggcccugcuaugauccugcaa

SEQ ID NO: 266797 - RNA, 22 nt, Human
ucaggcugggcuccucucccca

SEQ ID NO: 266798 - RNA, 22 nt, Human
aaugaucacugcaguugaugag

SEQ ID NO: 266799 - RNA, 22 nt, Human
augcagaagacugaaaagcuga

SEQ ID NO: 266800 - RNA, 22 nt, Human
ggcagugaaucugagagccugg

SEQ ID NO: 266801 - RNA, 22 nt, Human
uguggcaggaagagcuucugag

SEQ ID NO: 266802 - RNA, 22 nt, Human
ucuagagccaaagucuuggggg

SEQ ID NO: 266803 - RNA, 22 nt, Human
gcagggcagcucacugugguuc

SEQ ID NO: 266804 - RNA, 22 nt, Human
ccccagcagacucagggcaggu

SEQ ID NO: 266805 - RNA, 22 nt, Human
auuccucaaagguagcccauua

SEQ ID NO: 266806 - RNA, 22 nt, Human
ucuggcaggguguguauuuaca

SEQ ID NO: 266807 - RNA, 22 nt, Human
gagcccucuugucuauauggua

SEQ ID NO: 266808 - RNA, 22 nt, Human
ggcaaaaaccacaauuacuuuu

SEQ ID NO: 266809 - RNA, 22 nt, Human
uccucagauaccuggcagauca

SEQ ID NO: 266810 - RNA, 22 nt, Human
gcagccaggaagccuuucccuc

SEQ ID NO: 266811 - RNA, 23 nt, Human
acaguuauagcugugaauaacau

SEQ ID NO: 266812 - RNA, 22 nt, Human
ggaagaugagaaguggggcucc

SEQ ID NO: 266813 - RNA, 22 nt, Human
ugaauagagcugcaguggacau

SEQ ID NO: 266814 - RNA, 22 nt, Human
uggcaugaagucagcagcuggg

SEQ ID NO: 266815 - RNA, 22 nt, Human
caaauuuagguaacagucugua

SEQ ID NO: 266816 - RNA, 22 nt, Human
uaaguuuuaagcaaucugauaa

SEQ ID NO: 266817 - RNA, 22 nt, Human
acagaugaauuuuaauuguguu

SEQ ID NO: 266818 - RNA, 22 nt, Human
gagggccacguucagggcucuc

SEQ ID NO: 266819 - RNA, 22 nt, Human
gaagguucuguguacacuacuu

SEQ ID NO: 266820 - RNA, 17 nt, Human
acagggcagaaacagcu

SEQ ID NO: 266821 - RNA, 22 nt, Human
gagucagacagggucacccaga

SEQ ID NO: 266822 - RNA, 22 nt, Human
gaacaaacagaagaggcggaac

SEQ ID NO: 266823 - RNA, 22 nt, Human
gacagagauugaaucaggaaau

SEQ ID NO: 266824 - RNA, 22 nt, Human
uucacagugccagggggcaggc

SEQ ID NO: 266825 - RNA, 22 nt, Human
uguucauugcccccuguguaaa

SEQ ID NO: 266826 - RNA, 22 nt, Human
aggucacacaacugucagaggc

SEQ ID NO: 266827 - RNA, 22 nt, Human
guacacagaugcuugagaaucu

SEQ ID NO: 266828 - RNA, 23 nt, Human
uuucuguuggguauauauccaag

SEQ ID NO: 266829 - RNA, 22 nt, Human
auaauuaucucagacacuuguu

SEQ ID NO: 266830 - RNA, 22 nt, Human
uuucuuguuucauggugucuca

SEQ ID NO: 266831 - RNA, 22 nt, Human
ucagagcacuggugcuaccuug

SEQ ID NO: 266832 - RNA, 22 nt, Human
cacugaaauauuaauaucuuau

SEQ ID NO: 266833 - RNA, 22 nt, Human
uuagggcaggcaugagagaacu

SEQ ID NO: 266834 - RNA, 22 nt, Human
cucccagguugauucuuucccu

SEQ ID NO: 266835 - RNA, 22 nt, Human
aggcucugaggcagauuuucgu

SEQ ID NO: 266836 - RNA, 22 nt, Human
uuuaaugaauaauucaaaucug

SEQ ID NO: 266837 - RNA, 22 nt, Human
aauaggaaaauauuuaacaaga

SEQ ID NO: 266838 - RNA, 20 nt, Human
ggcauccuucugacccagag

SEQ ID NO: 266839 - RNA, 22 nt, Human
acagaagugucuuuuucauuca

SEQ ID NO: 266840 - RNA, 23 nt, Human
uuaaggagcuugcacucugggug

SEQ ID NO: 266841 - RNA, 22 nt, Human
gcagacaucaccucagugcuau

SEQ ID NO: 266842 - RNA, 22 nt, Human
ucuguagcaagugagaggcauu

SEQ ID NO: 266843 - RNA, 22 nt, Human
uaagacacauugagaaacacaa

SEQ ID NO: 266844 - RNA, 22 nt, Human
gcagagcacccugcagugguau

SEQ ID NO: 266845 - RNA, 22 nt, Human
gguguccuuagaaagcagaccu

SEQ ID NO: 266846 - RNA, 22 nt, Human
acaauuccacauggcaugcagg

SEQ ID NO: 266847 - RNA, 22 nt, Human
ucuuuccaaggacucuguagca

SEQ ID NO: 266848 - RNA, 22 nt, Human
ggcuucugguaaagaccacacc

SEQ ID NO: 266849 - RNA, 22 nt, Human
agagccagcaacucuagcccug

SEQ ID NO: 266850 - RNA, 22 nt, Human
uccugugaagaauagcacucaa

SEQ ID NO: 266851 - RNA, 22 nt, Human
auggcagcagggcuugauuaug

SEQ ID NO: 266852 - RNA, 22 nt, Human
cagccagggucaggcagcuucu

SEQ ID NO: 266853 - RNA, 22 nt, Human
aaucugguuugacaacuuuugu

SEQ ID NO: 266854 - RNA, 22 nt, Human
aaaguccuuuuugccaugcaag

SEQ ID NO: 266855 - RNA, 22 nt, Human
uugcaggguugacacugccugc

SEQ ID NO: 266856 - RNA, 21 nt, Human
agagacugucacugcaguacc

SEQ ID NO: 266857 - RNA, 22 nt, Human
gugcaggguagcgacggcagga

SEQ ID NO: 266858 - RNA, 22 nt, Human
acagcaggcacacaaggauaga

SEQ ID NO: 266859 - RNA, 22 nt, Human
caccauuuucuaaaaauaugac

SEQ ID NO: 266860 - RNA, 22 nt, Human
agcuuccacaucugucuucagu

SEQ ID NO: 266861 - RNA, 22 nt, Human
cagcccugaguuagcccacgga

SEQ ID NO: 266862 - RNA, 22 nt, Human
auacuuaugauaaauaauugcu

SEQ ID NO: 266863 - RNA, 22 nt, Human
ccuuucuguguugcccuauuug

SEQ ID NO: 266864 - RNA, 22 nt, Human
ugcaugugucgggccugugcua

SEQ ID NO: 266865 - RNA, 22 nt, Human
auuacugaggcaaaguaguuuu

SEQ ID NO: 266866 - RNA, 22 nt, Human
uccaggcccacucgguggggcu

SEQ ID NO: 266867 - RNA, 22 nt, Human
ggcaccaggcugggcauaggcc

SEQ ID NO: 266868 - RNA, 18 nt, Human
cuccucccuaagggcuca

SEQ ID NO: 266869 - RNA, 19 nt, Human
ugugaccccagacaagcug

SEQ ID NO: 266870 - RNA, 23 nt, Human
ugagagccuggcagccuggguuc

SEQ ID NO: 266871 - RNA, 22 nt, Human
aucugcuugaaugagcaacagg

SEQ ID NO: 266872 - RNA, 22 nt, Human
uaagcaaaggauuuugaucuuu

SEQ ID NO: 266873 - RNA, 21 nt, Human
agcgucaauaucgucaacagg

SEQ ID NO: 266874 - RNA, 22 nt, Human
uuuuauucucagcuccagagag

SEQ ID NO: 266875 - RNA, 22 nt, Human
uuaauagauuugauuuuaaagg

SEQ ID NO: 266876 - RNA, 22 nt, Human
uggaauuaauaggggauauaca

SEQ ID NO: 266877 - RNA, 22 nt, Human
augcaauaguaauucuagucug

SEQ ID NO: 266878 - RNA, 22 nt, Human
ucuccacaagcuuucuccuuuu

SEQ ID NO: 266879 - RNA, 22 nt, Human
uuucugaauaacucuaugauau

SEQ ID NO: 266880 - RNA, 19 nt, Human
gccaggccuggaccugcag

SEQ ID NO: 266881 - RNA, 22 nt, Human
cauguguguggcugacaauuuu

SEQ ID NO: 266882 - RNA, 22 nt, Human
aggcugccucugcaggaucccu

SEQ ID NO: 266883 - RNA, 22 nt, Human
uagcaacagcaauagugguauu

SEQ ID NO: 266884 - RNA, 22 nt, Human
uagcaaaaacugcaguuacuuu

SEQ ID NO: 266885 - RNA, 20 nt, Human
ccuccuggucaggugugcag

SEQ ID NO: 266886 - RNA, 22 nt, Human
ggucuggccuccgggcaggugg

SEQ ID NO: 266887 - RNA, 22 nt, Human
uaguguuccagaagcaaacaag

SEQ ID NO: 266888 - RNA, 22 nt, Human
cagagcucugacagcuacagcc

SEQ ID NO: 266889 - RNA, 22 nt, Human
auuuucaucgcuagguuggccu

SEQ ID NO: 266890 - RNA, 22 nt, Human
cugccagcaaugugaccaugcu

SEQ ID NO: 266891 - RNA, 22 nt, Human
aaagugauuuaaguaccucagg

SEQ ID NO: 266892 - RNA, 22 nt, Human
aaaggcuucuauuggacguugc

SEQ ID NO: 266893 - RNA, 22 nt, Human
uuccugaaugcuguugugcugu

SEQ ID NO: 266894 - RNA, 22 nt, Human
ugcugguaccgcgccuccgcca

SEQ ID NO: 266895 - RNA, 22 nt, Human
cuaaauuaucaugagaauuaug

SEQ ID NO: 266896 - RNA, 22 nt, Human
ggcuuuguggggugaaguaaag

SEQ ID NO: 266897 - RNA, 22 nt, Human
auuaaaauuccaagguaugcca

SEQ ID NO: 266898 - RNA, 22 nt, Human
uucugggcaccaccacagacuu

SEQ ID NO: 266899 - RNA, 22 nt, Human
ccaggaaggaagcagggguuuc

SEQ ID NO: 266900 - RNA, 22 nt, Human
ugaggccucauuuagggagagg

SEQ ID NO: 266901 - RNA, 22 nt, Human
ugaaggagcucaggagauaguc

SEQ ID NO: 266902 - RNA, 21 nt, Human
gagagggcauuauaggaagug

SEQ ID NO: 266903 - RNA, 22 nt, Human
gaagaaucugaggacagucauu

SEQ ID NO: 266904 - RNA, 22 nt, Human
uggcagauaaacaugugauaaa

SEQ ID NO: 266905 - RNA, 21 nt, Human
aacuuuagaaagacugggaag

SEQ ID NO: 266906 - RNA, 22 nt, Human
ccugcuguuuucuucacuucag

SEQ ID NO: 266907 - RNA, 22 nt, Human
cggcuucuuuuaagguugcuga

SEQ ID NO: 266908 - RNA, 16 nt, Human
gaggcuggcagauguc

SEQ ID NO: 266909 - RNA, 22 nt, Human
gauaauuugauaccucaaucag

SEQ ID NO: 266910 - RNA, 21 nt, Human
ccugugcuaucagcuuggguu

SEQ ID NO: 266911 - RNA, 22 nt, Human
uuacacuuguaaauggcaugua

SEQ ID NO: 266912 - RNA, 23 nt, Human
gguccacccgagccugcagcuuc

SEQ ID NO: 266913 - RNA, 17 nt, Human
gagcagggaugcgguuc

SEQ ID NO: 266914 - RNA, 22 nt, Human
agaggaguauuuucuaagggaa

SEQ ID NO: 266915 - RNA, 22 nt, Human
ccccuuggcugcucucaagucc

SEQ ID NO: 266916 - RNA, 22 nt, Human
cuggacacacuggagucuggca

SEQ ID NO: 266917 - RNA, 22 nt, Human
ggcaugcaugcaagguggugua

SEQ ID NO: 266918 - RNA, 22 nt, Human
ccucacccagucaccuaggugg

SEQ ID NO: 266919 - RNA, 22 nt, Human
auccagagacuggggcugggau

SEQ ID NO: 266920 - RNA, 22 nt, Human
gcugugugacugagagccuggc

SEQ ID NO: 266921 - RNA, 22 nt, Human
ccuguaggcgagggauggacag

SEQ ID NO: 266922 - RNA, 22 nt, Human
gaaguuccucguaggagucucu

SEQ ID NO: 266923 - RNA, 21 nt, Human
ggcuccugcuuugugaggggc

SEQ ID NO: 266924 - RNA, 22 nt, Human
gagccaggaggcagagacugca

SEQ ID NO: 266925 - RNA, 22 nt, Human
gugccugggacuugcuccggau

SEQ ID NO: 266926 - RNA, 22 nt, Human
ugggacaguuguccuccacucu

SEQ ID NO: 266927 - RNA, 22 nt, Human
aagcaauagcaacaacuuuaca

SEQ ID NO: 266928 - RNA, 19 nt, Human
ccuugccugucccugcagc

SEQ ID NO: 266929 - RNA, 22 nt, Human
cuggcuugcagcucaucauaaa

SEQ ID NO: 266930 - RNA, 22 nt, Human
uccugccuuagagcaaggaaaa

SEQ ID NO: 266931 - RNA, 22 nt, Human
ugggaaagacucaggacaggag

SEQ ID NO: 266932 - RNA, 22 nt, Human
uuucucauuuagaguggcaggg

SEQ ID NO: 266933 - RNA, 22 nt, Human
ggaugagguagaugaacaaggg

SEQ ID NO: 266934 - RNA, 22 nt, Human
aagugaauaaaauuguguucuu

SEQ ID NO: 266935 - RNA, 22 nt, Human
ggcccagcacagugcuuggggg

SEQ ID NO: 266936 - RNA, 23 nt, Human
ccagugauugccuggaaggaggu

SEQ ID NO: 266937 - RNA, 21 nt, Human
ugauuucugccaaguucacua

SEQ ID NO: 266938 - RNA, 21 nt, Human
ugcauaaagaaauacaaauac

SEQ ID NO: 266939 - RNA, 22 nt, Human
uggccaggggaguuccccucca

SEQ ID NO: 266940 - RNA, 22 nt, Human
cucuggaagaauacacuuagaa

SEQ ID NO: 266941 - RNA, 22 nt, Human
gcagggcugaaggucccaggcc

SEQ ID NO: 266942 - RNA, 22 nt, Human
ccaggaggcucugacuggaccc

SEQ ID NO: 266943 - RNA, 22 nt, Human
cucuggccuggggccugcuccc

SEQ ID NO: 266944 - RNA, 22 nt, Human
gccagcaaggaggggaaaaaug

SEQ ID NO: 266945 - RNA, 22 nt, Human
guuuccaaccccaccaaagugc

SEQ ID NO: 266946 - RNA, 22 nt, Human
uuguacuuaaauaugcaaauag

SEQ ID NO: 266947 - RNA, 22 nt, Human
cuuuauguuggggugucuuagu

SEQ ID NO: 266948 - RNA, 22 nt, Human
uuagauaaauugcaacuugauu

SEQ ID NO: 266949 - RNA, 22 nt, Human
ucugcagguagagcucaggaau

SEQ ID NO: 266950 - RNA, 15 nt, Human
gcagguggaucacuu

SEQ ID NO: 266951 - RNA, 22 nt, Human
agaccugugaucacauggaaug

SEQ ID NO: 266952 - RNA, 22 nt, Human
uuauuacacugaaagaauugcg

SEQ ID NO: 266953 - RNA, 19 nt, Human
acacaugaggagggacccc

SEQ ID NO: 266954 - RNA, 22 nt, Human
cacauuccccagagcuggggcu

SEQ ID NO: 266955 - RNA, 22 nt, Human
ccagaggugccacagaaagagc

SEQ ID NO: 266956 - RNA, 20 nt, Human
cuccacaccuguucgcaggc

SEQ ID NO: 266957 - RNA, 19 nt, Human
gcccucaggcagcuccauc

SEQ ID NO: 266958 - RNA, 22 nt, Human
aagcacauugccuggcacauag

SEQ ID NO: 266959 - RNA, 18 nt, Human
uacaaacuccuugaaggc

SEQ ID NO: 266960 - RNA, 22 nt, Human
ucugagcuuuagcugggauuuu

SEQ ID NO: 266961 - RNA, 22 nt, Human
ccagagccucaacacagguccu

SEQ ID NO: 266962 - RNA, 22 nt, Human
gaaacccaaacuaagacaguag

SEQ ID NO: 266963 - RNA, 20 nt, Human
acucuguagguaaugagacu

SEQ ID NO: 266964 - RNA, 22 nt, Human
uacgugcaaggucccugccccu

SEQ ID NO: 266965 - RNA, 22 nt, Human
uccuccacgauggcacaccugg

SEQ ID NO: 266966 - RNA, 22 nt, Human
uucuccuuuguaauucucaucc

SEQ ID NO: 266967 - RNA, 22 nt, Human
cugcgugucucugucucauggc

SEQ ID NO: 266968 - RNA, 22 nt, Human
cacuggaauguugaggagacaa

SEQ ID NO: 266969 - RNA, 22 nt, Human
aggagacccaaugccagaaaga

SEQ ID NO: 266970 - RNA, 22 nt, Human
uugauucauggacaggccaggu

SEQ ID NO: 266971 - RNA, 22 nt, Human
gugggcuccccuggcaugucca

SEQ ID NO: 266972 - RNA, 19 nt, Human
acaaaugauguugcacuga

SEQ ID NO: 266973 - RNA, 23 nt, Human
cacaacuaaucagaaucucuagg

SEQ ID NO: 266974 - RNA, 22 nt, Human
uaacagcaggguuacaggcauu

SEQ ID NO: 266975 - RNA, 22 nt, Human
caugagagauccuucaugagag

SEQ ID NO: 266976 - RNA, 22 nt, Human
uuuauaguuauauacagauguu

SEQ ID NO: 266977 - RNA, 22 nt, Human
uacaccagcuugccugggcucu

SEQ ID NO: 266978 - RNA, 23 nt, Human
agagcaucaugaugcuaagucug

SEQ ID NO: 266979 - RNA, 23 nt, Human
gcagacagagcagacuaagacaa

SEQ ID NO: 266980 - RNA, 22 nt, Human
caaugcaagcaagauggucaca

SEQ ID NO: 266981 - RNA, 22 nt, Human
ucguuaaaugcuaaaacugaca

SEQ ID NO: 266982 - RNA, 22 nt, Human
uaaacagcuacugugucaaagg

SEQ ID NO: 266983 - RNA, 22 nt, Human
caaaagcaguucuaucugaguu

SEQ ID NO: 266984 - RNA, 22 nt, Human
gcauccaaaccauucaucagcc

SEQ ID NO: 266985 - RNA, 22 nt, Human
aggaggcccuagagcucuagag

SEQ ID NO: 266986 - RNA, 22 nt, Human
uggcugggagcuggaacugggc

SEQ ID NO: 266987 - RNA, 17 nt, Human
agcugaaauugcugaag

SEQ ID NO: 266988 - RNA, 22 nt, Human
gcacuuaggguauguacugggc

SEQ ID NO: 266989 - RNA, 22 nt, Human
uuuacauguaauguuauacaaa

SEQ ID NO: 266990 - RNA, 22 nt, Human
cugagcugcucccgcugcagcg

SEQ ID NO: 266991 - RNA, 22 nt, Human
uauuucacauaccacagagugu

SEQ ID NO: 266992 - RNA, 22 nt, Human
cugauguucauuucuuuuguac

SEQ ID NO: 266993 - RNA, 22 nt, Human
guuacaauguucuucaguucug

SEQ ID NO: 266994 - RNA, 22 nt, Human
cugaaaggcaguggguagugug

SEQ ID NO: 266995 - RNA, 22 nt, Human
auuguauaacagcauguauuuu

SEQ ID NO: 266996 - RNA, 22 nt, Human
ggucuccaaagcuuaggacuac

SEQ ID NO: 266997 - RNA, 21 nt, Human
aagagacauuucucaucagca

SEQ ID NO: 266998 - RNA, 20 nt, Human
gcuuggaccuucugcucugu

SEQ ID NO: 266999 - RNA, 22 nt, Human
aagggcuccauccuuauaaaug

SEQ ID NO: 267000 - RNA, 22 nt, Human
auguccucuucugccucaggcc

SEQ ID NO: 267001 - RNA, 23 nt, Human
auucuucauuaucuucuagaaaa

SEQ ID NO: 267002 - RNA, 22 nt, Human
ggcagacuuuuucucugaaggg

SEQ ID NO: 267003 - RNA, 20 nt, Human
guagaaccaugugugcuggg

SEQ ID NO: 267004 - RNA, 22 nt, Human
agaaacuauuaugguaaacaaa

SEQ ID NO: 267005 - RNA, 22 nt, Human
aaacaguaaguucuaguauuau

SEQ ID NO: 267006 - RNA, 22 nt, Human
ucauaugauuguaaugagaaua

SEQ ID NO: 267007 - RNA, 22 nt, Human
aagggcuggagacugggucuuc

SEQ ID NO: 267008 - RNA, 22 nt, Human
aggguccauguuuccaguuaau

SEQ ID NO: 267009 - RNA, 22 nt, Human
uguguccugcaggugcugccug

SEQ ID NO: 267010 - RNA, 22 nt, Human
aucaauuuugaggauacaagaa

SEQ ID NO: 267011 - RNA, 22 nt, Human
guuuacauguaauguguuauug

SEQ ID NO: 267012 - RNA, 22 nt, Human
gguggcugcacccuggcuaacu

SEQ ID NO: 267013 - RNA, 22 nt, Human
gcaagauguuaacauagggaga

SEQ ID NO: 267014 - RNA, 22 nt, Human
acauucaaaauugugguuuaga

SEQ ID NO: 267015 - RNA, 22 nt, Human
gaggaacaagcugcuuuaucuu

SEQ ID NO: 267016 - RNA, 22 nt, Human
ccugaggagauuguggcugggg

SEQ ID NO: 267017 - RNA, 22 nt, Human
gcuuuagaaaugaguaaauuag

SEQ ID NO: 267018 - RNA, 22 nt, Human
ccaauucaccuccuaugcacau

SEQ ID NO: 267019 - RNA, 22 nt, Human
uaacuuuaggaauagguaaucu

SEQ ID NO: 267020 - RNA, 22 nt, Human
agaggacaaaaugagaagugcu

SEQ ID NO: 267021 - RNA, 22 nt, Human
cacaaugcguacauauaucaaa

SEQ ID NO: 267022 - RNA, 22 nt, Human
uguccugggaggcgggguccag

SEQ ID NO: 267023 - RNA, 22 nt, Human
ugcagggaggccccgcagcccu

SEQ ID NO: 267024 - RNA, 22 nt, Human
uuagcauucucugugugcauaa

SEQ ID NO: 267025 - RNA, 22 nt, Human
uuacauguuuaugugguacaug

SEQ ID NO: 267026 - RNA, 22 nt, Human
gaaccauuucugaauaguuugu

SEQ ID NO: 267027 - RNA, 22 nt, Human
ggcaugugccugaggucacaca

SEQ ID NO: 267028 - RNA, 22 nt, Human
agccuucuaggaugucaucugc

SEQ ID NO: 267029 - RNA, 22 nt, Human
gggcuuggcuggggccaccaga

SEQ ID NO: 267030 - RNA, 22 nt, Human
agguagggaagaaggcaugaaa

SEQ ID NO: 267031 - RNA, 22 nt, Human
ggggccuuggaucugugccccg

SEQ ID NO: 267032 - RNA, 22 nt, Human
gcucaggccuccagaggggcaa

SEQ ID NO: 267033 - RNA, 22 nt, Human
uguuuugguagauugauuaugg

SEQ ID NO: 267034 - RNA, 22 nt, Human
uuacuguucauguuguacacuu

SEQ ID NO: 267035 - RNA, 22 nt, Human
aggcacaggaaugucauccagu

SEQ ID NO: 267036 - RNA, 22 nt, Human
gcuuugcuuccuguucuagccu

SEQ ID NO: 267037 - RNA, 22 nt, Human
auggcccagacucagacuggug

SEQ ID NO: 267038 - RNA, 22 nt, Human
agguuugggaguagaaaucaga

SEQ ID NO: 267039 - RNA, 20 nt, Human
gcauuagaguacuauaugcu

SEQ ID NO: 267040 - RNA, 22 nt, Human
ucugaggaagcagcaggaagug

SEQ ID NO: 267041 - RNA, 22 nt, Human
ucugaggggguguuuauaagcu

SEQ ID NO: 267042 - RNA, 21 nt, Human
agucuuugauaaagacaaagu

SEQ ID NO: 267043 - RNA, 22 nt, Human
aaggcaguaggaucuuccacag

SEQ ID NO: 267044 - RNA, 22 nt, Human
cauguuguaucauucuguuccu

SEQ ID NO: 267045 - RNA, 22 nt, Human
ccuggcugcccauggacccucu

SEQ ID NO: 267046 - RNA, 22 nt, Human
ggcagagaaucuggcuguuuac

SEQ ID NO: 267047 - RNA, 22 nt, Human
ugccuggcaucuagcccuggga

SEQ ID NO: 267048 - RNA, 22 nt, Human
ccuguucaauauucuuccuugu

SEQ ID NO: 267049 - RNA, 19 nt, Human
gugucaggaugugcagggg

SEQ ID NO: 267050 - RNA, 22 nt, Human
ggcugugguggcaucccugagc

SEQ ID NO: 267051 - RNA, 22 nt, Human
aacaguaaugugguguuggguu

SEQ ID NO: 267052 - RNA, 22 nt, Human
uuauuuacuggauggccuuggg

SEQ ID NO: 267053 - RNA, 22 nt, Human
gguccuugggucuccuguguuu

SEQ ID NO: 267054 - RNA, 22 nt, Human
acauuucugcuagaauagguga

SEQ ID NO: 267055 - RNA, 19 nt, Human
uuugucucugaauaauauu

SEQ ID NO: 267056 - RNA, 22 nt, Human
gggaaacuggggacugaaucug

SEQ ID NO: 267057 - RNA, 22 nt, Human
gcugcagcccugcggaucacuu

SEQ ID NO: 267058 - RNA, 22 nt, Human
aguguugggucuuuagaauuua

SEQ ID NO: 267059 - RNA, 22 nt, Human
gcugagguccagcauucgccua

SEQ ID NO: 267060 - RNA, 23 nt, Human
gcccacauuggugcaugaauguu

SEQ ID NO: 267061 - RNA, 22 nt, Human
gaaaugugggucaugacccauu

SEQ ID NO: 267062 - RNA, 22 nt, Human
uggcuaugguauugauggguuu

SEQ ID NO: 267063 - RNA, 22 nt, Human
ucaggagcagccuuggagagcg

SEQ ID NO: 267064 - RNA, 22 nt, Human
ggagaccagaaggaagcuucga

SEQ ID NO: 267065 - RNA, 20 nt, Human
aauuuuacuguccuauagag

SEQ ID NO: 267066 - RNA, 19 nt, Human
aaagcagaggagcaucuga

SEQ ID NO: 267067 - RNA, 22 nt, Human
uguaaagagaagaaacgugagc

SEQ ID NO: 267068 - RNA, 22 nt, Human
gcaggccaagcccucgcagaga

SEQ ID NO: 267069 - RNA, 22 nt, Human
uaaacaagaaacauuuucuguu

SEQ ID NO: 267070 - RNA, 22 nt, Human
agagcugaauuuggguggugga

SEQ ID NO: 267071 - RNA, 22 nt, Human
uucuguuacauggggcacagug

SEQ ID NO: 267072 - RNA, 22 nt, Human
cuuauuaauggaauccuaauga

SEQ ID NO: 267073 - RNA, 22 nt, Human
cugcuggggaggcgccucgacg

SEQ ID NO: 267074 - RNA, 22 nt, Human
ccuuccuggcuguccgccugau

SEQ ID NO: 267075 - RNA, 22 nt, Human
aagcauucugcauuuucaaaga

SEQ ID NO: 267076 - RNA, 22 nt, Human
ugucugagugcauaugugcugg

SEQ ID NO: 267077 - RNA, 22 nt, Human
cugaggaccccacaggaggccc

SEQ ID NO: 267078 - RNA, 22 nt, Human
ggcuuuauuugcagccauuguu

SEQ ID NO: 267079 - RNA, 22 nt, Human
uuguucagaaauuuggacuccu

SEQ ID NO: 267080 - RNA, 22 nt, Human
acacccagauuaugcacacaaa

SEQ ID NO: 267081 - RNA, 22 nt, Human
ugaugaggaccuggucucugcu

SEQ ID NO: 267082 - RNA, 22 nt, Human
aacagcagcaaguaagcagguc

SEQ ID NO: 267083 - RNA, 22 nt, Human
guccaggaaucaaaagauggaa

SEQ ID NO: 267084 - RNA, 22 nt, Human
uccagccccgggauguucuuca

SEQ ID NO: 267085 - RNA, 22 nt, Human
acaauacucaugcucuuuuucu

SEQ ID NO: 267086 - RNA, 22 nt, Human
cauaauauacuacauugaugaa

SEQ ID NO: 267087 - RNA, 22 nt, Human
caauucuuuguagaagcucucc

SEQ ID NO: 267088 - RNA, 22 nt, Human
uggcugaguuccuggcacacgg

SEQ ID NO: 267089 - RNA, 22 nt, Human
ucucuguagagacagcacugug

SEQ ID NO: 267090 - RNA, 22 nt, Human
uggaaauacaagaaguauguca

SEQ ID NO: 267091 - RNA, 21 nt, Human
guacagggauaguagugucaa

SEQ ID NO: 267092 - RNA, 22 nt, Human
acagcuguggccacuugcaucc

SEQ ID NO: 267093 - RNA, 22 nt, Human
aaagaccauguuuacagcuagg

SEQ ID NO: 267094 - RNA, 22 nt, Human
ugaagaaacgcagagagguagg

SEQ ID NO: 267095 - RNA, 23 nt, Human
cuguggcccugcuucaugcagcc

SEQ ID NO: 267096 - RNA, 22 nt, Human
ggaccuggcaauuugcaucucu

SEQ ID NO: 267097 - RNA, 22 nt, Human
gagcuguuaagagggagugaca

SEQ ID NO: 267098 - RNA, 22 nt, Human
uguguauagaugcaugcauaua

SEQ ID NO: 267099 - RNA, 22 nt, Human
ggaggccaccugaccugcuguu

SEQ ID NO: 267100 - RNA, 22 nt, Human
gagucuaaggaaaaauagagua

SEQ ID NO: 267101 - RNA, 22 nt, Human
agcuugauaguggcuaucaagc

SEQ ID NO: 267102 - RNA, 22 nt, Human
agcagcuguacuuucaucuguu

SEQ ID NO: 267103 - RNA, 22 nt, Human
guauucuugguuaucaaaauac

SEQ ID NO: 267104 - RNA, 18 nt, Human
uaacugguuucuucccau

SEQ ID NO: 267105 - RNA, 22 nt, Human
caacagucucuauagcuccuug

SEQ ID NO: 267106 - RNA, 22 nt, Human
uuacagcacagugcuuuuacug

SEQ ID NO: 267107 - RNA, 22 nt, Human
uagcugcccaucuuuccuuuag

SEQ ID NO: 267108 - RNA, 21 nt, Human
gauuugcagaaacuagacagg

SEQ ID NO: 267109 - RNA, 19 nt, Human
aggccugggguuuugcacu

SEQ ID NO: 267110 - RNA, 22 nt, Human
uuccucagcacaaagccaagau

SEQ ID NO: 267111 - RNA, 22 nt, Human
uuauacuuuauacuacaucauu

SEQ ID NO: 267112 - RNA, 22 nt, Human
cacuugaaugagaauuuccugg

SEQ ID NO: 267113 - RNA, 22 nt, Human
caagaacaguuugccaaauugg

SEQ ID NO: 267114 - RNA, 22 nt, Human
uuucucaaguucagauauuuga

SEQ ID NO: 267115 - RNA, 22 nt, Human
acaguaaaaagccuuagaauuu

SEQ ID NO: 267116 - RNA, 22 nt, Human
ucagggcagaauccaaagaauu

SEQ ID NO: 267117 - RNA, 22 nt, Human
uggaccagcagccccagugccu

SEQ ID NO: 267118 - RNA, 22 nt, Human
gcucgcagaucaccugggggcg

SEQ ID NO: 267119 - RNA, 22 nt, Human
gugcuacuaguuucauuuuuca

SEQ ID NO: 267120 - RNA, 22 nt, Human
aaggcagcccuggcucagccug

SEQ ID NO: 267121 - RNA, 22 nt, Human
ugagucucccagcguuaaaccu

SEQ ID NO: 267122 - RNA, 22 nt, Human
agaggggagagcuaagcaauuc

SEQ ID NO: 267123 - RNA, 22 nt, Human
acagacauuuuaagacacuuua

SEQ ID NO: 267124 - RNA, 22 nt, Human
uggaaaaacugagacuuagaca

SEQ ID NO: 267125 - RNA, 23 nt, Human
uucagaagaaaugaguacaggag

SEQ ID NO: 267126 - RNA, 22 nt, Human
ugacagggucagagcugagcug

SEQ ID NO: 267127 - RNA, 22 nt, Human
uuuccagggcucuguagaagaa

SEQ ID NO: 267128 - RNA, 22 nt, Human
ugggucccaaacuccuagaggu

SEQ ID NO: 267129 - RNA, 22 nt, Human
agaagcuugaaggagcagugac

SEQ ID NO: 267130 - RNA, 22 nt, Human
caaauacuguacugaacacugu

SEQ ID NO: 267131 - RNA, 22 nt, Human
uaagauuacagugagaaauaaa

SEQ ID NO: 267132 - RNA, 22 nt, Human
cccuuccuugauuuuaacugga

SEQ ID NO: 267133 - RNA, 22 nt, Human
uguugcuguaugaauaggaagg

SEQ ID NO: 267134 - RNA, 22 nt, Human
cagggacaugacuggucucugu

SEQ ID NO: 267135 - RNA, 22 nt, Human
uacauucagaagaauggacacg

SEQ ID NO: 267136 - RNA, 22 nt, Human
aaguguuauguaggauuucaga

SEQ ID NO: 267137 - RNA, 22 nt, Human
cugggccuugagaaucauguuu

SEQ ID NO: 267138 - RNA, 22 nt, Human
gcacagaggaugaggcagcucu

SEQ ID NO: 267139 - RNA, 22 nt, Human
cuacauaaauauuuaugugucu

SEQ ID NO: 267140 - RNA, 22 nt, Human
auguuagugauaguaaauagug

SEQ ID NO: 267141 - RNA, 22 nt, Human
ccccagggaagcuuugcuuacu

SEQ ID NO: 267142 - RNA, 22 nt, Human
ucauguaaaguguagguuuaga

SEQ ID NO: 267143 - RNA, 22 nt, Human
gaguccuguaacuuucuuccua

SEQ ID NO: 267144 - RNA, 22 nt, Human
uggcagaguucgcugugccuuu

SEQ ID NO: 267145 - RNA, 22 nt, Human
auucaguguuugcagcaacuuu

SEQ ID NO: 267146 - RNA, 22 nt, Human
aacauacuuauacuaaauaaug

SEQ ID NO: 267147 - RNA, 22 nt, Human
aauccauucagaaauugggaau

SEQ ID NO: 267148 - RNA, 22 nt, Human
agcuccuggggguuccaagcag

SEQ ID NO: 267149 - RNA, 22 nt, Human
gguuccaccuggcgagggguau

SEQ ID NO: 267150 - RNA, 22 nt, Human
aagcagaauuucccacuaguug

SEQ ID NO: 267151 - RNA, 22 nt, Human
aaauggauggaauugacauuua

SEQ ID NO: 267152 - RNA, 22 nt, Human
aauccaggguguggccuuucca

SEQ ID NO: 267153 - RNA, 22 nt, Human
aagugaugcuacgacuuugaca

SEQ ID NO: 267154 - RNA, 22 nt, Human
agcaggcaagguccgugccucg

SEQ ID NO: 267155 - RNA, 22 nt, Human
uacaguuacgcugagaaacgaa

SEQ ID NO: 267156 - RNA, 22 nt, Human
cagagcagggguuucccagguu

SEQ ID NO: 267157 - RNA, 22 nt, Human
ugucaucagcauauaagacagu

SEQ ID NO: 267158 - RNA, 22 nt, Human
gcugggccagagcagcagcacu

SEQ ID NO: 267159 - RNA, 22 nt, Human
cagaagcaagagccggagcuag

SEQ ID NO: 267160 - RNA, 22 nt, Human
aucuccucgcaggccagaacac

SEQ ID NO: 267161 - RNA, 22 nt, Human
agcuuccugacuggugcucuua

SEQ ID NO: 267162 - RNA, 22 nt, Human
cuggggcccugggucugcccuc

SEQ ID NO: 267163 - RNA, 22 nt, Human
gaugugaggacucauguggagg

SEQ ID NO: 267164 - RNA, 22 nt, Human
cagagcccauccuauacucucc

SEQ ID NO: 267165 - RNA, 22 nt, Human
auacuguaauaccuaaaugaac

SEQ ID NO: 267166 - RNA, 22 nt, Human
cugccucuggccucaggcccag

SEQ ID NO: 267167 - RNA, 22 nt, Human
augauggagguguccuggauuu

SEQ ID NO: 267168 - RNA, 22 nt, Human
auccugggaaugggagggucau

SEQ ID NO: 267169 - RNA, 22 nt, Human
gcaugaaaugagcgaauauaau

SEQ ID NO: 267170 - RNA, 22 nt, Human
uacuuacagagcuuauaaguua

SEQ ID NO: 267171 - RNA, 19 nt, Human
auugcagcuauagacugcc

SEQ ID NO: 267172 - RNA, 20 nt, Human
ggcccagugaaccaggacgg

SEQ ID NO: 267173 - RNA, 22 nt, Human
guuuacauuaaguauuagcauc

SEQ ID NO: 267174 - RNA, 22 nt, Human
ucagaaucugcauuuaacaaaa

SEQ ID NO: 267175 - RNA, 22 nt, Human
uggcucuggauuaaucuaggaa

SEQ ID NO: 267176 - RNA, 19 nt, Human
agcagcagcaccagggauu

SEQ ID NO: 267177 - RNA, 22 nt, Human
acccaggccugagagacaggag

SEQ ID NO: 267178 - RNA, 19 nt, Human
ugccugcuccuggcuucca

SEQ ID NO: 267179 - RNA, 22 nt, Human
aaagcaaucagauucagauguc

SEQ ID NO: 267180 - RNA, 22 nt, Human
uauuuaaaauaagccccagugg

SEQ ID NO: 267181 - RNA, 22 nt, Human
agauuugaaacuugcuucauaa

SEQ ID NO: 267182 - RNA, 22 nt, Human
uccucagcaaacacuucacucu

SEQ ID NO: 267183 - RNA, 22 nt, Human
gugacguuuaauagugacaugg

SEQ ID NO: 267184 - RNA, 22 nt, Human
acaggcacuuugacaugccauc

SEQ ID NO: 267185 - RNA, 22 nt, Human
agccaguggaauucccaggggu

SEQ ID NO: 267186 - RNA, 19 nt, Human
uccagcccuguucccuuuu

SEQ ID NO: 267187 - RNA, 22 nt, Human
cuucagagcuuguuaaaacugu

SEQ ID NO: 267188 - RNA, 22 nt, Human
aagucagaaaucaucuagugua

SEQ ID NO: 267189 - RNA, 22 nt, Human
aaaugugaguuauagcaauaga

SEQ ID NO: 267190 - RNA, 22 nt, Human
aggcccugggagcagagaugca

SEQ ID NO: 267191 - RNA, 22 nt, Human
cccaaggcagggauuuucugcu

SEQ ID NO: 267192 - RNA, 22 nt, Human
cugagggaugggcugggccgcc

SEQ ID NO: 267193 - RNA, 22 nt, Human
augauuuucugauaaagaacug

SEQ ID NO: 267194 - RNA, 22 nt, Human
cuguggcuucuagguccccgau

SEQ ID NO: 267195 - RNA, 22 nt, Human
auguauuugcuuguuauggauu

SEQ ID NO: 267196 - RNA, 22 nt, Human
agcauuuucugagaguauagau

SEQ ID NO: 267197 - RNA, 22 nt, Human
ggugcagagcagugucagagca

SEQ ID NO: 267198 - RNA, 22 nt, Human
gggaaacuuucacaauguccag

SEQ ID NO: 267199 - RNA, 22 nt, Human
gugcccagugcaggcccgcagg

SEQ ID NO: 267200 - RNA, 22 nt, Human
gaagcagcucagauugacugaa

SEQ ID NO: 267201 - RNA, 22 nt, Human
uccugaagucacaggcucugag

SEQ ID NO: 267202 - RNA, 22 nt, Human
aacaaggcugguaucuuaaaga

SEQ ID NO: 267203 - RNA, 22 nt, Human
uuacaggggacauuggggacau

SEQ ID NO: 267204 - RNA, 22 nt, Human
ccgaggcuggccucagggcugu

SEQ ID NO: 267205 - RNA, 22 nt, Human
gccuggcuccuaaggacuggcu

SEQ ID NO: 267206 - RNA, 21 nt, Human
uggacuggugaguuuaggcug

SEQ ID NO: 267207 - RNA, 22 nt, Human
cccaggacccuucaauggcucc

SEQ ID NO: 267208 - RNA, 22 nt, Human
auuuuuuagccaagacucugca

SEQ ID NO: 267209 - RNA, 20 nt, Human
ucugugcaguggaggggcag

SEQ ID NO: 267210 - RNA, 22 nt, Human
cagcagguggacacacucaccu

SEQ ID NO: 267211 - RNA, 23 nt, Human
uggcugagauccuacuguuugcu

SEQ ID NO: 267212 - RNA, 22 nt, Human
aggcuggagugugcaguggcgc

SEQ ID NO: 267213 - RNA, 19 nt, Human
agagaaggauccuaugguu

SEQ ID NO: 267214 - RNA, 22 nt, Human
cagagcccugggcacaugguag

SEQ ID NO: 267215 - RNA, 22 nt, Human
uccaggcuagagugcaguggcc

SEQ ID NO: 267216 - RNA, 22 nt, Human
aagacauuuuagagauagggaa

SEQ ID NO: 267217 - RNA, 22 nt, Human
gucuguggaguugcuugcugga

SEQ ID NO: 267218 - RNA, 22 nt, Human
ugcucugugugugguuauuucc

SEQ ID NO: 267219 - RNA, 22 nt, Human
cacaucuacugaaugagcagug

SEQ ID NO: 267220 - RNA, 22 nt, Human
ggcagguggaaggucuccauuc

SEQ ID NO: 267221 - RNA, 19 nt, Human
gagaaucucuuugauguuu

SEQ ID NO: 267222 - RNA, 22 nt, Human
uggccuuuucuuucacaggcaa

SEQ ID NO: 267223 - RNA, 23 nt, Human
ucugagagaacaaugccuccuau

SEQ ID NO: 267224 - RNA, 22 nt, Human
gugcuggcuggggcaucaggca

SEQ ID NO: 267225 - RNA, 22 nt, Human
gacuuucuugcagaaauauucc

SEQ ID NO: 267226 - RNA, 23 nt, Human
ggucccugacagcgggcaaguug

SEQ ID NO: 267227 - RNA, 22 nt, Human
cagggccacccucugcugggug

SEQ ID NO: 267228 - RNA, 22 nt, Human
cccaggcucccaggugggacaa

SEQ ID NO: 267229 - RNA, 22 nt, Human
ugaggccucugugccauccagg

SEQ ID NO: 267230 - RNA, 22 nt, Human
gccaggcaggugucggagcccu

SEQ ID NO: 267231 - RNA, 19 nt, Human
ccuaggcauuguccaaggg

SEQ ID NO: 267232 - RNA, 22 nt, Human
aaaugcaggaaauuaugcuuuu

SEQ ID NO: 267233 - RNA, 22 nt, Human
cucaggagagucuuauaucucc

SEQ ID NO: 267234 - RNA, 22 nt, Human
aaacuuuaggaaggaauuuaca

SEQ ID NO: 267235 - RNA, 22 nt, Human
auuuauauuuugggagcuccug

SEQ ID NO: 267236 - RNA, 22 nt, Human
acuucaugaacauguggccugu

SEQ ID NO: 267237 - RNA, 22 nt, Human
ucacaacuugaagcugauuuaa

SEQ ID NO: 267238 - RNA, 22 nt, Human
agaugaaagauuuuuauagaga

SEQ ID NO: 267239 - RNA, 22 nt, Human
uccuggaguuuguggugauaug

SEQ ID NO: 267240 - RNA, 21 nt, Human
ccaggggcaaauugucguuuc

SEQ ID NO: 267241 - RNA, 22 nt, Human
guuuuugucgaguuccuugacc

SEQ ID NO: 267242 - RNA, 22 nt, Human
uuaguuaauaggucuucagcuu

SEQ ID NO: 267243 - RNA, 22 nt, Human
auaacuuaaugggucaugcucu

SEQ ID NO: 267244 - RNA, 22 nt, Human
gaggcuggucagcccuaagauc

SEQ ID NO: 267245 - RNA, 16 nt, Human
uccuggccuuuggaag

SEQ ID NO: 267246 - RNA, 22 nt, Human
auucuuuaguuggcuucuugcc

SEQ ID NO: 267247 - RNA, 22 nt, Human
guugggccccagagguccaggc

SEQ ID NO: 267248 - RNA, 20 nt, Human
cacagaugggacaggaaagg

SEQ ID NO: 267249 - RNA, 22 nt, Human
ggcaggguaugauuaccucuga

SEQ ID NO: 267250 - RNA, 22 nt, Human
uucaaacaguugcacaacuuau

SEQ ID NO: 267251 - RNA, 22 nt, Human
ucuucaaaaaauauccaucagu

SEQ ID NO: 267252 - RNA, 22 nt, Human
uacacauuacauaauacuaucu

SEQ ID NO: 267253 - RNA, 22 nt, Human
aauuccauccauuuguuucaac

SEQ ID NO: 267254 - RNA, 22 nt, Human
auugucagugggauuugucaac

SEQ ID NO: 267255 - RNA, 22 nt, Human
ggugagcagcugucuguaugga

SEQ ID NO: 267256 - RNA, 17 nt, Human
uuuacauugcucgcagu

SEQ ID NO: 267257 - RNA, 22 nt, Human
uuugucauauagacuauuguga

SEQ ID NO: 267258 - RNA, 22 nt, Human
aauccagaugagcaaucauacu

SEQ ID NO: 267259 - RNA, 22 nt, Human
aacuuucaggcaaugaauauuu

SEQ ID NO: 267260 - RNA, 22 nt, Human
gaugaggcauaaacacagucac

SEQ ID NO: 267261 - RNA, 22 nt, Human
ugggcuccuugggagcaaguga

SEQ ID NO: 267262 - RNA, 20 nt, Human
gaagcagcuucauguagaca

SEQ ID NO: 267263 - RNA, 23 nt, Human
ucucugggugggcugugucuaua

SEQ ID NO: 267264 - RNA, 21 nt, Human
aaggcuccuccucuaggccuc

SEQ ID NO: 267265 - RNA, 21 nt, Human
cagugcucaggaauagagaga

SEQ ID NO: 267266 - RNA, 22 nt, Human
uaugauaugcacuuuaucagaa

SEQ ID NO: 267267 - RNA, 22 nt, Human
aucauucuagcuguuguguuga

SEQ ID NO: 267268 - RNA, 20 nt, Human
gcauguguauggaaggggga

SEQ ID NO: 267269 - RNA, 22 nt, Human
uucuuggaaauacauucaauaa

SEQ ID NO: 267270 - RNA, 22 nt, Human
ugcuuugcuggcacuccuggcu

SEQ ID NO: 267271 - RNA, 22 nt, Human
guuuggugguagcauuggcuau

SEQ ID NO: 267272 - RNA, 22 nt, Human
cuacucugaaaacccagaaacu

SEQ ID NO: 267273 - RNA, 18 nt, Human
gcuuuauuucuuggggaa

SEQ ID NO: 267274 - RNA, 22 nt, Human
agggccaccagagcagggcagu

SEQ ID NO: 267275 - RNA, 22 nt, Human
ucacagcuuucagauuguuccc

SEQ ID NO: 267276 - RNA, 22 nt, Human
uauuccuauggccacugcuacu

SEQ ID NO: 267277 - RNA, 22 nt, Human
auaguuuuaaaaccucaggaag

SEQ ID NO: 267278 - RNA, 22 nt, Human
ugagcuuuguggguaaagagag

SEQ ID NO: 267279 - RNA, 22 nt, Human
cuuauucagaaggagaaaugga

SEQ ID NO: 267280 - RNA, 22 nt, Human
aggagcugauaaaaggggguca

SEQ ID NO: 267281 - RNA, 22 nt, Human
caaacauuugacuucucucagg

SEQ ID NO: 267282 - RNA, 22 nt, Human
uagaacuugagaucaggucuuc

SEQ ID NO: 267283 - RNA, 22 nt, Human
ucuauauuauacauccaggauu

SEQ ID NO: 267284 - RNA, 22 nt, Human
cuacuguaguggccuauuuacc

SEQ ID NO: 267285 - RNA, 22 nt, Human
uguuugaguucuagcgcauuua

SEQ ID NO: 267286 - RNA, 22 nt, Human
gcagcagagcuuuguccuggcu

SEQ ID NO: 267287 - RNA, 21 nt, Human
uuacaaagcuacagauguugc

SEQ ID NO: 267288 - RNA, 22 nt, Human
acauucuagauauguuauauuu

SEQ ID NO: 267289 - RNA, 22 nt, Human
uccuggcagugcuuguuuugga

SEQ ID NO: 267290 - RNA, 23 nt, Human
agcccuugauaauaaagcaccag

SEQ ID NO: 267291 - RNA, 22 nt, Human
ugagaacauugggaaagcuaug

SEQ ID NO: 267292 - RNA, 22 nt, Human
gcagggcugauggcuucccuca

SEQ ID NO: 267293 - RNA, 22 nt, Human
aacugcaagcucuuuacugcua

SEQ ID NO: 267294 - RNA, 22 nt, Human
ugcuucucaaagaagcauaaug

SEQ ID NO: 267295 - RNA, 22 nt, Human
uauuuuacaugacagguguuua

SEQ ID NO: 267296 - RNA, 22 nt, Human
caggcacaaugagcgccaucuu

SEQ ID NO: 267297 - RNA, 22 nt, Human
cagucucucuuguagugcagcu

SEQ ID NO: 267298 - RNA, 22 nt, Human
accugccucagugcagcuggau

SEQ ID NO: 267299 - RNA, 22 nt, Human
caugagucauagugaagcagga

SEQ ID NO: 267300 - RNA, 22 nt, Human
uagccauugacuuaaagcuuau

SEQ ID NO: 267301 - RNA, 22 nt, Human
auauuugucaauucacuguuca

SEQ ID NO: 267302 - RNA, 22 nt, Human
uaugaacugcucuuguguuuug

SEQ ID NO: 267303 - RNA, 22 nt, Human
aguuuagaguucaaauuaguuc

SEQ ID NO: 267304 - RNA, 19 nt, Human
cacagugcagccauuucuc

SEQ ID NO: 267305 - RNA, 20 nt, Human
ucagacccuacauuccucag

SEQ ID NO: 267306 - RNA, 22 nt, Human
agcacuguggggaacucacaga

SEQ ID NO: 267307 - RNA, 22 nt, Human
ugcaaauaggggacaacucuuu

SEQ ID NO: 267308 - RNA, 22 nt, Human
augaggcaggagugcaguggca

SEQ ID NO: 267309 - RNA, 22 nt, Human
uauuauuauauuggaugagacu

SEQ ID NO: 267310 - RNA, 22 nt, Human
aagcucagaguagcucagcguc

SEQ ID NO: 267311 - RNA, 22 nt, Human
cagccccuuguccgguagccac

SEQ ID NO: 267312 - RNA, 22 nt, Human
gccuggcugcucagccacucac

SEQ ID NO: 267313 - RNA, 22 nt, Human
ugacauuuaucuucuacaauga

SEQ ID NO: 267314 - RNA, 19 nt, Human
uuuacagggaauggagacc

SEQ ID NO: 267315 - RNA, 22 nt, Human
cuguccucaccuuggcaggggg

SEQ ID NO: 267316 - RNA, 22 nt, Human
cuuagaaagaguuuucuccccu

SEQ ID NO: 267317 - RNA, 22 nt, Human
uccagcuuuggcucuagcuaca

SEQ ID NO: 267318 - RNA, 22 nt, Human
auacagguucucuagggaacag

SEQ ID NO: 267319 - RNA, 22 nt, Human
cgcaggugccggcagauggggu

SEQ ID NO: 267320 - RNA, 22 nt, Human
caggaaguagaguuggccagcc

SEQ ID NO: 267321 - RNA, 22 nt, Human
aggaaacuaauuaguagaauaa

SEQ ID NO: 267322 - RNA, 22 nt, Human
cuccaggacccaguggcuccag

SEQ ID NO: 267323 - RNA, 22 nt, Human
gaaacuguauguaguuuuuggg

SEQ ID NO: 267324 - RNA, 22 nt, Human
caggcagcugcuggguucagcc

SEQ ID NO: 267325 - RNA, 22 nt, Human
acugaauuacagucugcauuuu

SEQ ID NO: 267326 - RNA, 22 nt, Human
caaggcuucagugugacaaaac

SEQ ID NO: 267327 - RNA, 22 nt, Human
ugagccaggcucaagugauccu

SEQ ID NO: 267328 - RNA, 22 nt, Human
gaaggcaucacagaggcuguga

SEQ ID NO: 267329 - RNA, 22 nt, Human
auguccaagucacagauuuuca

SEQ ID NO: 267330 - RNA, 22 nt, Human
ucuuaagaaagugacaaauagg

SEQ ID NO: 267331 - RNA, 22 nt, Human
acauucuauuucaucaugucua

SEQ ID NO: 267332 - RNA, 22 nt, Human
uaaaagauaucuuagggauuug

SEQ ID NO: 267333 - RNA, 22 nt, Human
uccuuucuccgggggacuguug

SEQ ID NO: 267334 - RNA, 22 nt, Human
cccuggccuccaggcaguccug

SEQ ID NO: 267335 - RNA, 21 nt, Human
acacacuacacauuccuaguu

SEQ ID NO: 267336 - RNA, 22 nt, Human
gcugcccaauuacagggccgug

SEQ ID NO: 267337 - RNA, 21 nt, Human
gccuugccacaugugccacag

SEQ ID NO: 267338 - RNA, 22 nt, Human
aggggagccccugguccuggug

SEQ ID NO: 267339 - RNA, 22 nt, Human
uuuagcaacgaagcacucgaca

SEQ ID NO: 267340 - RNA, 22 nt, Human
auauuuguuagagucuaugugu

SEQ ID NO: 267341 - RNA, 17 nt, Human
uagcacaaagcaggauu

SEQ ID NO: 267342 - RNA, 22 nt, Human
uggucagguaccucuggcuguc

SEQ ID NO: 267343 - RNA, 22 nt, Human
acacaaugauucacaagcagca

SEQ ID NO: 267344 - RNA, 22 nt, Human
aucuuguuaaaaagcagauucu

SEQ ID NO: 267345 - RNA, 19 nt, Human
aggugcuggugaggguguu

SEQ ID NO: 267346 - RNA, 22 nt, Human
uccaggcaugucccaagccgga

SEQ ID NO: 267347 - RNA, 22 nt, Human
ucuggcugaaaggggcugugcc

SEQ ID NO: 267348 - RNA, 23 nt, Human
agagccuuuucacacuucaaugu

SEQ ID NO: 267349 - RNA, 22 nt, Human
caaugguugaacccugucauga

SEQ ID NO: 267350 - RNA, 22 nt, Human
gaagccagauuaucacaagcca

SEQ ID NO: 267351 - RNA, 22 nt, Human
gugaaauauuuuguuuauguca

SEQ ID NO: 267352 - RNA, 22 nt, Human
gcauuucugugcauacacauga

SEQ ID NO: 267353 - RNA, 22 nt, Human
uucagaaaucgaguuucauguc

SEQ ID NO: 267354 - RNA, 22 nt, Human
cagcuaggaaaccagagggcag

SEQ ID NO: 267355 - RNA, 22 nt, Human
cauucauuuacuuucaacagcu

SEQ ID NO: 267356 - RNA, 18 nt, Human
uccugccugugccccagg

SEQ ID NO: 267357 - RNA, 22 nt, Human
aggaagaguguuaccuaugggu

SEQ ID NO: 267358 - RNA, 22 nt, Human
guuucuguaagacugaauugac

SEQ ID NO: 267359 - RNA, 22 nt, Human
ucagggcaaugucccucagaag

SEQ ID NO: 267360 - RNA, 22 nt, Human
gccagccuucuguggccugcaa

SEQ ID NO: 267361 - RNA, 22 nt, Human
uguuaagaagaggcaguacuua

SEQ ID NO: 267362 - RNA, 22 nt, Human
aacucaguuacauauuagaaua

SEQ ID NO: 267363 - RNA, 22 nt, Human
uaauaguugugacuuuguaaag

SEQ ID NO: 267364 - RNA, 22 nt, Human
gccccagcccuguggaccaugg

SEQ ID NO: 267365 - RNA, 22 nt, Human
acagaggucauggagaguucuc

SEQ ID NO: 267366 - RNA, 22 nt, Human
ccccagccagcuuguaguagaa

SEQ ID NO: 267367 - RNA, 22 nt, Human
cugggucuaaaaauucucagau

SEQ ID NO: 267368 - RNA, 22 nt, Human
caguuucuucuauuuugaacua

SEQ ID NO: 267369 - RNA, 22 nt, Human
uccagcccgggggcaggugacc

SEQ ID NO: 267370 - RNA, 22 nt, Human
gggcuccaaggaggccagccug

SEQ ID NO: 267371 - RNA, 22 nt, Human
auacauuagcucauaugauuaa

SEQ ID NO: 267372 - RNA, 22 nt, Human
uuuuacaggugaaaaaugaaga

SEQ ID NO: 267373 - RNA, 23 nt, Human
ucuuuagaagaacaucagaaaug

SEQ ID NO: 267374 - RNA, 22 nt, Human
agcuggagaguuuccaggaagg

SEQ ID NO: 267375 - RNA, 20 nt, Human
gcaggcccucucucuagucu

SEQ ID NO: 267376 - RNA, 22 nt, Human
accagcucagagcaggcuccug

SEQ ID NO: 267377 - RNA, 22 nt, Human
ucuggcucuaacuaggcaucag

SEQ ID NO: 267378 - RNA, 23 nt, Human
uggcacagcaggugugcuuuguu

SEQ ID NO: 267379 - RNA, 22 nt, Human
ucaaugcaaucauuggacaagu

SEQ ID NO: 267380 - RNA, 22 nt, Human
agaaggcuaaaguaacuuagua

SEQ ID NO: 267381 - RNA, 22 nt, Human
uaagagaacuggauagauagga

SEQ ID NO: 267382 - RNA, 22 nt, Human
uugggggcauauugaguagugg

SEQ ID NO: 267383 - RNA, 22 nt, Human
acuuuacaauauccugugacuu

SEQ ID NO: 267384 - RNA, 22 nt, Human
aacaaacaaacauuuugucauc

SEQ ID NO: 267385 - RNA, 22 nt, Human
acaguguucacuuaacaaugga

SEQ ID NO: 267386 - RNA, 20 nt, Human
ugcugaggccugaggccugg

SEQ ID NO: 267387 - RNA, 22 nt, Human
ugcaggugcuccgggggugccc

SEQ ID NO: 267388 - RNA, 22 nt, Human
aaauuauucucauguguuucuu

SEQ ID NO: 267389 - RNA, 22 nt, Human
ggugccagaguggcccaggggc

SEQ ID NO: 267390 - RNA, 22 nt, Human
acugagggcauaaaaguacugu

SEQ ID NO: 267391 - RNA, 22 nt, Human
auuaagugacuaaaguaaugcu

SEQ ID NO: 267392 - RNA, 22 nt, Human
cccaaggacacgggcagggaca

SEQ ID NO: 267393 - RNA, 22 nt, Human
acaguguccccagcucugugag

SEQ ID NO: 267394 - RNA, 21 nt, Human
aggguggcucugggucagaac

SEQ ID NO: 267395 - RNA, 22 nt, Human
uggauuuauuagguuggugaaa

SEQ ID NO: 267396 - RNA, 22 nt, Human
uucugugaaucuuuuuucccac

SEQ ID NO: 267397 - RNA, 22 nt, Human
gcaggcugaguauuacccuagu

SEQ ID NO: 267398 - RNA, 22 nt, Human
uuuuauuaguggcuagaugggg

SEQ ID NO: 267399 - RNA, 22 nt, Human
uccuucugaaaaaugcacacga

SEQ ID NO: 267400 - RNA, 22 nt, Human
aaugcagaccaguaugaaaaac

SEQ ID NO: 267401 - RNA, 22 nt, Human
cagagggcucggcggccgcucc

SEQ ID NO: 267402 - RNA, 22 nt, Human
acuguguuaaauacagagaugg

SEQ ID NO: 267403 - RNA, 22 nt, Human
agccacagucugaugccugaga

SEQ ID NO: 267404 - RNA, 22 nt, Human
ucagggggaggagacugccagu

SEQ ID NO: 267405 - RNA, 22 nt, Human
augugaaauagcuggauaugaa

SEQ ID NO: 267406 - RNA, 22 nt, Human
ucucuggggaugcuuauucuug

SEQ ID NO: 267407 - RNA, 22 nt, Human
ucauguguuaaacuccaagaua

SEQ ID NO: 267408 - RNA, 22 nt, Human
uagcaacauaagaaacauuuug

SEQ ID NO: 267409 - RNA, 22 nt, Human
ccagcccugccagagagagcug

SEQ ID NO: 267410 - RNA, 22 nt, Human
ucuccuggaagugauuccccug

SEQ ID NO: 267411 - RNA, 22 nt, Human
ucccucaggugguucuuguuuc

SEQ ID NO: 267412 - RNA, 22 nt, Human
uccuggcuuagguuuccagaac

SEQ ID NO: 267413 - RNA, 22 nt, Human
ucuguuuugugucucucuggug

SEQ ID NO: 267414 - RNA, 19 nt, Human
uuacacuucugcuuuguga

SEQ ID NO: 267415 - RNA, 16 nt, Human
cucuuugggcuuccag

SEQ ID NO: 267416 - RNA, 22 nt, Human
ugcauaaacuucucugguguga

SEQ ID NO: 267417 - RNA, 22 nt, Human
cuuccagguucugguugggaag

SEQ ID NO: 267418 - RNA, 22 nt, Human
agacaacaccaaaugcuagugu

SEQ ID NO: 267419 - RNA, 22 nt, Human
uauacacuguuguugggagucu

SEQ ID NO: 267420 - RNA, 22 nt, Human
augggcuugacccuacagaaag

SEQ ID NO: 267421 - RNA, 22 nt, Human
agccagagagccccagguucua

SEQ ID NO: 267422 - RNA, 22 nt, Human
gaauacaugcacgacacggggg

SEQ ID NO: 267423 - RNA, 22 nt, Human
agucagguacuccgagggcaug

SEQ ID NO: 267424 - RNA, 20 nt, Human
aaaauauguauaacucuucu

SEQ ID NO: 267425 - RNA, 22 nt, Human
cacaaaauaucaagcacuuuua

SEQ ID NO: 267426 - RNA, 22 nt, Human
cucuggguccuggggcuacaag

SEQ ID NO: 267427 - RNA, 22 nt, Human
ucagaaguauuaugcuaaagga

SEQ ID NO: 267428 - RNA, 17 nt, Human
ucuguucaugcauaccu

SEQ ID NO: 267429 - RNA, 22 nt, Human
accaauuuuuacagcugugguu

SEQ ID NO: 267430 - RNA, 22 nt, Human
uuaguacauugauucauuaugu

SEQ ID NO: 267431 - RNA, 22 nt, Human
gaggcaagaaaggacuuucuag

SEQ ID NO: 267432 - RNA, 18 nt, Human
ccugcagcccaggaggcc

SEQ ID NO: 267433 - RNA, 22 nt, Human
aagcagaauuuaauagaaaggu

SEQ ID NO: 267434 - RNA, 22 nt, Human
gaagcagcuuucuggugaggag

SEQ ID NO: 267435 - RNA, 22 nt, Human
gcuaggcucuuccaucagggca

SEQ ID NO: 267436 - RNA, 21 nt, Human
agcugcagccauguacauggc

SEQ ID NO: 267437 - RNA, 20 nt, Human
acagaaagagagaaugucag

SEQ ID NO: 267438 - RNA, 22 nt, Human
cccagugugaugagguugcuaa

SEQ ID NO: 267439 - RNA, 22 nt, Human
uagggauggcagcauguagcuu

SEQ ID NO: 267440 - RNA, 21 nt, Human
ugcagcugacacccuuuggga

SEQ ID NO: 267441 - RNA, 22 nt, Human
cagaagcuagcaggaaaguuuu

SEQ ID NO: 267442 - RNA, 20 nt, Human
uccugaggcuucgccagugu

SEQ ID NO: 267443 - RNA, 22 nt, Human
aggaacaggccucguuuucuau

SEQ ID NO: 267444 - RNA, 22 nt, Human
uugaaugaauaaaagaguaagg

SEQ ID NO: 267445 - RNA, 22 nt, Human
uauuucugaauccaaaagguca

SEQ ID NO: 267446 - RNA, 22 nt, Human
accugcagccacuucucuccuu

SEQ ID NO: 267447 - RNA, 22 nt, Human
ccuccugggagagcacggaggg

SEQ ID NO: 267448 - RNA, 22 nt, Human
uuuuuucagccugucugugcca

SEQ ID NO: 267449 - RNA, 19 nt, Human
ugcugggucauauggaaac

SEQ ID NO: 267450 - RNA, 22 nt, Human
uagaaagcaugcaaguuugaug

SEQ ID NO: 267451 - RNA, 22 nt, Human
ucauucccccauaaugguauuu

SEQ ID NO: 267452 - RNA, 22 nt, Human
uggcucugagcugcaaagcugc

SEQ ID NO: 267453 - RNA, 22 nt, Human
cuucuaauucuuauguaagcuu

SEQ ID NO: 267454 - RNA, 22 nt, Human
cagcccacuucccagcaccuac

SEQ ID NO: 267455 - RNA, 22 nt, Human
gcuccaggaagggaaaucucca

SEQ ID NO: 267456 - RNA, 22 nt, Human
gcaugugucccucagucugugc

SEQ ID NO: 267457 - RNA, 22 nt, Human
uguggcugcaaaggaaggcugc

SEQ ID NO: 267458 - RNA, 21 nt, Human
gugcccuguucccacaugccc

SEQ ID NO: 267459 - RNA, 22 nt, Human
acagaugaguuaaagcagagug

SEQ ID NO: 267460 - RNA, 22 nt, Human
agcaacaggcauaauguguuga

SEQ ID NO: 267461 - RNA, 22 nt, Human
aaaugucuaucuggcauauucc

SEQ ID NO: 267462 - RNA, 22 nt, Human
gcacagcucagcaugggaggac

SEQ ID NO: 267463 - RNA, 22 nt, Human
uccuccugucuaccaguuccug

SEQ ID NO: 267464 - RNA, 22 nt, Human
cuuaggaagcgggaccugugca

SEQ ID NO: 267465 - RNA, 22 nt, Human
uggucaaggcuuggagauagua

SEQ ID NO: 267466 - RNA, 22 nt, Human
uugcaauuaacauaugucaacu

SEQ ID NO: 267467 - RNA, 22 nt, Human
aaccauuugcaguuacugagac

SEQ ID NO: 267468 - RNA, 22 nt, Human
ucaauuacuaaccaaauaaugu

SEQ ID NO: 267469 - RNA, 22 nt, Human
aagcugcaaaaaauuucugucu

SEQ ID NO: 267470 - RNA, 22 nt, Human
uuucuaguaaucaauauaaagu

SEQ ID NO: 267471 - RNA, 22 nt, Human
gcauucugugcuacagccauuc

SEQ ID NO: 267472 - RNA, 22 nt, Human
cauaguuuuagguagaaacugg

SEQ ID NO: 267473 - RNA, 19 nt, Human
uccaggcauccuucaggcu

SEQ ID NO: 267474 - RNA, 22 nt, Human
augcacccuuaugaauaugauc

SEQ ID NO: 267475 - RNA, 22 nt, Human
auuucucaguaggugcacagug

SEQ ID NO: 267476 - RNA, 22 nt, Human
gcacagaaccagacaugaggca

SEQ ID NO: 267477 - RNA, 21 nt, Human
ugggcucuuuaacccaggcac

SEQ ID NO: 267478 - RNA, 22 nt, Human
agacagguguuuuacaacuucg

SEQ ID NO: 267479 - RNA, 22 nt, Human
ccuggcagccucagccaauucu

SEQ ID NO: 267480 - RNA, 22 nt, Human
ccagggccucguguucugagug

SEQ ID NO: 267481 - RNA, 18 nt, Human
cccagcuggugggucagu

SEQ ID NO: 267482 - RNA, 22 nt, Human
uuguauuuauauugaauagcuu

SEQ ID NO: 267483 - RNA, 22 nt, Human
agguggagaagagaugggcagu

SEQ ID NO: 267484 - RNA, 19 nt, Human
uggcuuccaucucucucau

SEQ ID NO: 267485 - RNA, 22 nt, Human
cugcaggggaccaaagucugac

SEQ ID NO: 267486 - RNA, 22 nt, Human
uccccuccucuccugauauggg

SEQ ID NO: 267487 - RNA, 22 nt, Human
ugaggccuaccccccuguguuu

SEQ ID NO: 267488 - RNA, 22 nt, Human
uucucuucccacuuucuguauu

SEQ ID NO: 267489 - RNA, 22 nt, Human
gauguccagcgucuggcugccu

SEQ ID NO: 267490 - RNA, 22 nt, Human
agagacaggaauggcauuaaga

SEQ ID NO: 267491 - RNA, 22 nt, Human
caguuuuaggacauguggaugu

SEQ ID NO: 267492 - RNA, 19 nt, Human
gggcucuggccucaguggg

SEQ ID NO: 267493 - RNA, 22 nt, Human
cugucugucaaguucaucucca

SEQ ID NO: 267494 - RNA, 22 nt, Human
ccuugccucauugugcuucucc

SEQ ID NO: 267495 - RNA, 21 nt, Human
aggaugccgcaggcggagaag

SEQ ID NO: 267496 - RNA, 22 nt, Human
uuucucgcguuugagcucucag

SEQ ID NO: 267497 - RNA, 22 nt, Human
caagagcuucugcucuucaugg

SEQ ID NO: 267498 - RNA, 22 nt, Human
gagaagcaauuuccaacugugc

SEQ ID NO: 267499 - RNA, 22 nt, Human
cagucucugccacuucuaagcu

SEQ ID NO: 267500 - RNA, 22 nt, Human
uccagguccuacuggcccauag

SEQ ID NO: 267501 - RNA, 19 nt, Human
acagcagguguggggauaa

SEQ ID NO: 267502 - RNA, 23 nt, Human
acacagaagaagacccaaggaag

SEQ ID NO: 267503 - RNA, 22 nt, Human
uagaggaaauuuccaaggugag

SEQ ID NO: 267504 - RNA, 22 nt, Human
cagggcugaagaaauucaaaag

SEQ ID NO: 267505 - RNA, 22 nt, Human
ugagaaucauccagaggcuucu

SEQ ID NO: 267506 - RNA, 19 nt, Human
acaaauuguccucaucaag

SEQ ID NO: 267507 - RNA, 22 nt, Human
cccagccucagcuuuacuucca

SEQ ID NO: 267508 - RNA, 22 nt, Human
gcagcuuccugaguguggacag

SEQ ID NO: 267509 - RNA, 22 nt, Human
uccugcagaucaaagccuuuga

SEQ ID NO: 267510 - RNA, 22 nt, Human
cugggccuagcaacagaggagu

SEQ ID NO: 267511 - RNA, 22 nt, Human
gcagggcuagauauuugcaagu

SEQ ID NO: 267512 - RNA, 22 nt, Human
aaccagagugacacucuacaga

SEQ ID NO: 267513 - RNA, 22 nt, Human
auucucugugucugcuuuccca

SEQ ID NO: 267514 - RNA, 22 nt, Human
auuacaauaagguuuauuugua

SEQ ID NO: 267515 - RNA, 22 nt, Human
cccagcucaagcagagagcuaa

SEQ ID NO: 267516 - RNA, 22 nt, Human
cuuaauuacccaaugugguagg

SEQ ID NO: 267517 - RNA, 22 nt, Human
guccuggguccccgcaggucag

SEQ ID NO: 267518 - RNA, 22 nt, Human
uuguuuuccugggauaccaacc

SEQ ID NO: 267519 - RNA, 22 nt, Human
agcuaggccauuuguucaguga

SEQ ID NO: 267520 - RNA, 22 nt, Human
cagguccugccuugguuacccu

SEQ ID NO: 267521 - RNA, 22 nt, Human
agugugaccuuauuuggaaaca

SEQ ID NO: 267522 - RNA, 22 nt, Human
gucccagggaugcagacaugag

SEQ ID NO: 267523 - RNA, 22 nt, Human
cggggcuguagcacagcugagc

SEQ ID NO: 267524 - RNA, 22 nt, Human
gccaggaaauucaugccagauc

SEQ ID NO: 267525 - RNA, 22 nt, Human
ucagaaauagucuuuaaaauga

SEQ ID NO: 267526 - RNA, 22 nt, Human
gcucagagcuugaaguuccacu

SEQ ID NO: 267527 - RNA, 22 nt, Human
uccagcagguccgagacaaguu

SEQ ID NO: 267528 - RNA, 22 nt, Human
ucaguggaacugucugggugag

SEQ ID NO: 267529 - RNA, 22 nt, Human
ucagaauaugcuaaugacauuu

SEQ ID NO: 267530 - RNA, 21 nt, Human
uuuauuuauauaggacacaug

SEQ ID NO: 267531 - RNA, 22 nt, Human
uccagaaaaaguaauuuauuug

SEQ ID NO: 267532 - RNA, 22 nt, Human
ucacaggcuugugaacauugca

SEQ ID NO: 267533 - RNA, 22 nt, Human
auuaauuuuucugacagccaca

SEQ ID NO: 267534 - RNA, 22 nt, Human
gggacaugaggccauagugauu

SEQ ID NO: 267535 - RNA, 22 nt, Human
aggccugccuggaucacacaga

SEQ ID NO: 267536 - RNA, 22 nt, Human
uuguggcagaccaugagucuaa

SEQ ID NO: 267537 - RNA, 22 nt, Human
gcaggccugcagguauggccgg

SEQ ID NO: 267538 - RNA, 22 nt, Human
ugcauugaucauauccuuccug

SEQ ID NO: 267539 - RNA, 22 nt, Human
uagaaaucauuuagaaguauug

SEQ ID NO: 267540 - RNA, 22 nt, Human
gcccagucucuucuggcccugu

SEQ ID NO: 267541 - RNA, 22 nt, Human
acugucuuccaggucuggaggu

SEQ ID NO: 267542 - RNA, 22 nt, Human
uugacagggccaagaauggacc

SEQ ID NO: 267543 - RNA, 22 nt, Human
aggaauguguguccaccgggga

SEQ ID NO: 267544 - RNA, 22 nt, Human
uugacaggaaaaaguuuaggau

SEQ ID NO: 267545 - RNA, 22 nt, Human
uauguauagagucuuuuaaauu

SEQ ID NO: 267546 - RNA, 18 nt, Human
aggcaugguggugcgcac

SEQ ID NO: 267547 - RNA, 22 nt, Human
cagguacauucguagacccauu

SEQ ID NO: 267548 - RNA, 22 nt, Human
auguuacaauccaacaaaauua

SEQ ID NO: 267549 - RNA, 19 nt, Human
cacgaguucucuuagcaaa

SEQ ID NO: 267550 - RNA, 22 nt, Human
agggccuggugaccuggguccu

SEQ ID NO: 267551 - RNA, 22 nt, Human
agacaauuaaaaaauuaugcuu

SEQ ID NO: 267552 - RNA, 22 nt, Human
cuggauguaaagggugaagaaa

SEQ ID NO: 267553 - RNA, 22 nt, Human
agagcugggugaagugccauca

SEQ ID NO: 267554 - RNA, 22 nt, Human
ucugucuuggccagccaucugg

SEQ ID NO: 267555 - RNA, 22 nt, Human
aaaugucagaagcuuuacuucu

SEQ ID NO: 267556 - RNA, 18 nt, Human
acuguuaucugauaaggc

SEQ ID NO: 267557 - RNA, 22 nt, Human
acagagacucaugaaagaugac

SEQ ID NO: 267558 - RNA, 19 nt, Human
ugucccagacuccgugucu

SEQ ID NO: 267559 - RNA, 22 nt, Human
ucugaggaucugaagggaacag

SEQ ID NO: 267560 - RNA, 22 nt, Human
gcugccacauuuucaggacuaa

SEQ ID NO: 267561 - RNA, 22 nt, Human
ucuccaggagcaagucacccag

SEQ ID NO: 267562 - RNA, 22 nt, Human
aagcacaugaaaaugugaagcu

SEQ ID NO: 267563 - RNA, 22 nt, Human
agcugccucagucacucauggc

SEQ ID NO: 267564 - RNA, 22 nt, Human
acagacauucauauccucggua

SEQ ID NO: 267565 - RNA, 22 nt, Human
cggcuggugucgggcacagcaa

SEQ ID NO: 267566 - RNA, 22 nt, Human
ggccagagguguccucaguucu

SEQ ID NO: 267567 - RNA, 22 nt, Human
ucccugaaacauaauagaugcc

SEQ ID NO: 267568 - RNA, 22 nt, Human
ucccucaggacccaacuuguaa

SEQ ID NO: 267569 - RNA, 22 nt, Human
ucacaugaguauuauuuuccaa

SEQ ID NO: 267570 - RNA, 22 nt, Human
gucuagaauugcuuggcagaug

SEQ ID NO: 267571 - RNA, 22 nt, Human
guuggcagagagaagccuagca

SEQ ID NO: 267572 - RNA, 22 nt, Human
ugguggagccuaggcuaagucu

SEQ ID NO: 267573 - RNA, 22 nt, Human
ugugaccauaauuuguaaauaa

SEQ ID NO: 267574 - RNA, 22 nt, Human
agggagcucuuuggucuugccg

SEQ ID NO: 267575 - RNA, 22 nt, Human
uaugcuccuauuggaaugauag

SEQ ID NO: 267576 - RNA, 22 nt, Human
uggcaguucuaauugaccauuu

SEQ ID NO: 267577 - RNA, 22 nt, Human
uacagaaauugccaccagcucu

SEQ ID NO: 267578 - RNA, 22 nt, Human
uuggcaguagugguaguacauu

SEQ ID NO: 267579 - RNA, 22 nt, Human
acuaccuuauacaaaauguagg

SEQ ID NO: 267580 - RNA, 22 nt, Human
cuguuacugcuggagccauuga

SEQ ID NO: 267581 - RNA, 22 nt, Human
uaggcucagggcugggugacgg

SEQ ID NO: 267582 - RNA, 22 nt, Human
gaggggaagacuucuggacagu

SEQ ID NO: 267583 - RNA, 22 nt, Human
ggaggcaucucuguggcugucu

SEQ ID NO: 267584 - RNA, 20 nt, Human
ccucucugaagaggucaucu

SEQ ID NO: 267585 - RNA, 22 nt, Human
agucugguguaugaaagugaau

SEQ ID NO: 267586 - RNA, 22 nt, Human
ucugugcuuucccugccuucuu

SEQ ID NO: 267587 - RNA, 22 nt, Human
ggacuucuggggacuguagauu

SEQ ID NO: 267588 - RNA, 22 nt, Human
agugcuauaaagguagaccaca

SEQ ID NO: 267589 - RNA, 22 nt, Human
auacaucuaugccuuucugaca

SEQ ID NO: 267590 - RNA, 23 nt, Human
aggucaaccacaagcugacaaac

SEQ ID NO: 267591 - RNA, 22 nt, Human
ggcaagagugaggagugucucu

SEQ ID NO: 267592 - RNA, 22 nt, Human
gcugccuugccaggggcagaaa

SEQ ID NO: 267593 - RNA, 22 nt, Human
gugcucuguguauuaggauguc

SEQ ID NO: 267594 - RNA, 22 nt, Human
cuuuaugaaccuguucagcuug

SEQ ID NO: 267595 - RNA, 20 nt, Human
aggaagccaaaggcugucuu

SEQ ID NO: 267596 - RNA, 22 nt, Human
cagccacucucagacaguccca

SEQ ID NO: 267597 - RNA, 19 nt, Human
uagaaccuggauuucagga

SEQ ID NO: 267598 - RNA, 22 nt, Human
cucagaagaacaaaggcucuac

SEQ ID NO: 267599 - RNA, 22 nt, Human
agcuguauuugugaauauuuaa

SEQ ID NO: 267600 - RNA, 22 nt, Human
gaacagcaugcaugcaagacua

SEQ ID NO: 267601 - RNA, 22 nt, Human
cagaugaacucuauccuguggc

SEQ ID NO: 267602 - RNA, 22 nt, Human
gggugguggccagcagugggca

SEQ ID NO: 267603 - RNA, 22 nt, Human
gcagcagaguagacagagcccu

SEQ ID NO: 267604 - RNA, 22 nt, Human
cugccugcuuuucugggagccg

SEQ ID NO: 267605 - RNA, 22 nt, Human
gaaagacauaguugcaagaugg

SEQ ID NO: 267606 - RNA, 22 nt, Human
acccaggcuggagugcaguggu

SEQ ID NO: 267607 - RNA, 22 nt, Human
cugggcaggagaggugguugga

SEQ ID NO: 267608 - RNA, 22 nt, Human
acucagaguuugcguuccauac

SEQ ID NO: 267609 - RNA, 23 nt, Human
ucucccugagguuguuagcauua

SEQ ID NO: 267610 - RNA, 22 nt, Human
ugccaggcaacugcccagccau

SEQ ID NO: 267611 - RNA, 22 nt, Human
gcagaagcagggcaggggcaaa

SEQ ID NO: 267612 - RNA, 22 nt, Human
uccaguggcaccuuggcccuca

SEQ ID NO: 267613 - RNA, 22 nt, Human
gcuuuucuucagcagccugaug

SEQ ID NO: 267614 - RNA, 22 nt, Human
aguuaggaguauaggaaugccu

SEQ ID NO: 267615 - RNA, 22 nt, Human
cuggagagggagcccuggcagu

SEQ ID NO: 267616 - RNA, 22 nt, Human
auaaacaguagagaaagguggu

SEQ ID NO: 267617 - RNA, 22 nt, Human
ugaggccaacuagggagaugga

SEQ ID NO: 267618 - RNA, 20 nt, Human
aggaaggaaguuugcaugga

SEQ ID NO: 267619 - RNA, 22 nt, Human
ucccaggcuaccagugagguca

SEQ ID NO: 267620 - RNA, 20 nt, Human
ucuguucaaaucuuaguucc

SEQ ID NO: 267621 - RNA, 19 nt, Human
acagcagggauuuuuggag

SEQ ID NO: 267622 - RNA, 22 nt, Human
aggcugcuucaauggauaagau

SEQ ID NO: 267623 - RNA, 22 nt, Human
uguuuuccuccugguuucugcc

SEQ ID NO: 267624 - RNA, 22 nt, Human
uggguccaguguccuggcuaug

SEQ ID NO: 267625 - RNA, 21 nt, Human
gagauuuagaaggaucaauuu

SEQ ID NO: 267626 - RNA, 22 nt, Human
guacauaagaaauuacuacaga

SEQ ID NO: 267627 - RNA, 22 nt, Human
cgcccagggcaggaggccgcuc

SEQ ID NO: 267628 - RNA, 22 nt, Human
ucucugcacuugcacauaagcu

SEQ ID NO: 267629 - RNA, 21 nt, Human
guugaauauccauguaugugu

SEQ ID NO: 267630 - RNA, 22 nt, Human
uauuaauaaauauguaggggcc

SEQ ID NO: 267631 - RNA, 22 nt, Human
agaaucuuggaacucagaucac

SEQ ID NO: 267632 - RNA, 22 nt, Human
uacaguguauguauuuguaggu

SEQ ID NO: 267633 - RNA, 22 nt, Human
ucugacccguggcucugccucc

SEQ ID NO: 267634 - RNA, 22 nt, Human
gaauguuaaugcacuucuagcu

SEQ ID NO: 267635 - RNA, 22 nt, Human
uagaaucugaaaguggcuguga

SEQ ID NO: 267636 - RNA, 17 nt, Human
aggagggaaauagcuug

SEQ ID NO: 267637 - RNA, 22 nt, Human
gaggcucaacccacagggguug

SEQ ID NO: 267638 - RNA, 22 nt, Human
agaggcaaguucagagcuagga

SEQ ID NO: 267639 - RNA, 22 nt, Human
acucugaaugugcauguaaauc

SEQ ID NO: 267640 - RNA, 22 nt, Human
acaaggcaauggcaggauuuca

SEQ ID NO: 267641 - RNA, 22 nt, Human
uucuuaacuggaaaaugucaga

SEQ ID NO: 267642 - RNA, 17 nt, Human
uuucaaagcagucagga

SEQ ID NO: 267643 - RNA, 22 nt, Human
cagucccaaggaggaagcaguc

SEQ ID NO: 267644 - RNA, 22 nt, Human
cugccugccuuggccuccagga

SEQ ID NO: 267645 - RNA, 22 nt, Human
ggaacuugaaaaucaagguggu

SEQ ID NO: 267646 - RNA, 22 nt, Human
auuugaagaaaguuuucuagau

SEQ ID NO: 267647 - RNA, 22 nt, Human
guuuuauaggugaaauauuacu

SEQ ID NO: 267648 - RNA, 22 nt, Human
uuauuagguuuacauaaagguu

SEQ ID NO: 267649 - RNA, 22 nt, Human
ggcagccucagguuuucuuuga

SEQ ID NO: 267650 - RNA, 22 nt, Human
cugagcccucuguuuucccucu

SEQ ID NO: 267651 - RNA, 22 nt, Human
gcagcuuucugggacagaaagg

SEQ ID NO: 267652 - RNA, 22 nt, Human
aucaguuuggaacauucaggcc

SEQ ID NO: 267653 - RNA, 22 nt, Human
agcaacagcagguuugcacucc

SEQ ID NO: 267654 - RNA, 22 nt, Human
ugucuguacaaauuuucugugu

SEQ ID NO: 267655 - RNA, 22 nt, Human
uggaccugggguggccuccucu

SEQ ID NO: 267656 - RNA, 22 nt, Human
ugcccugcuguggcucugccca

SEQ ID NO: 267657 - RNA, 22 nt, Human
augagcaguuuuuaaguagcaa

SEQ ID NO: 267658 - RNA, 22 nt, Human
gcuguucacaucuggaccauuu

SEQ ID NO: 267659 - RNA, 22 nt, Human
agggucuguuguuuguucugga

SEQ ID NO: 267660 - RNA, 22 nt, Human
aauggcuggguuucauuuugua

SEQ ID NO: 267661 - RNA, 22 nt, Human
aaguuacacauuuucauuguaa

SEQ ID NO: 267662 - RNA, 22 nt, Human
cugagcagauguugcccagaag

SEQ ID NO: 267663 - RNA, 22 nt, Human
gcccaugggccugaggcccuag

SEQ ID NO: 267664 - RNA, 22 nt, Human
gcccugguuuuagaggagcagg

SEQ ID NO: 267665 - RNA, 22 nt, Human
agggauggaucuuggcccugga

SEQ ID NO: 267666 - RNA, 22 nt, Human
aaauguuccggguaaggagaaa

SEQ ID NO: 267667 - RNA, 22 nt, Human
gacuucugccucaggggaaggu

SEQ ID NO: 267668 - RNA, 22 nt, Human
gaaaggagggaaacagagcggu

SEQ ID NO: 267669 - RNA, 22 nt, Human
ugcagggccuugggucuuucuu

SEQ ID NO: 267670 - RNA, 20 nt, Human
aggaggaagaaagcacacug

SEQ ID NO: 267671 - RNA, 22 nt, Human
gauaacccccaagaaggucuuu

SEQ ID NO: 267672 - RNA, 22 nt, Human
acaguaauuuauugaacaccuu

SEQ ID NO: 267673 - RNA, 22 nt, Human
aaacaucuuucuauugcaaguu

SEQ ID NO: 267674 - RNA, 22 nt, Human
gcaagcaauggacggugacuuu

SEQ ID NO: 267675 - RNA, 19 nt, Human
gggguggcuggggcuccag

SEQ ID NO: 267676 - RNA, 22 nt, Human
cuucucagcuuagguaugguuu

SEQ ID NO: 267677 - RNA, 22 nt, Human
augagaaagaguuguaucuaga

SEQ ID NO: 267678 - RNA, 22 nt, Human
aaggaggacacccaggacuggg

SEQ ID NO: 267679 - RNA, 22 nt, Human
aggagagagguuuuaaaugggg

SEQ ID NO: 267680 - RNA, 22 nt, Human
agccuggcuuagcucucucacu

SEQ ID NO: 267681 - RNA, 22 nt, Human
aagaaagugaugagcuacagau

SEQ ID NO: 267682 - RNA, 22 nt, Human
aguuuauguaaaauuaguaaug

SEQ ID NO: 267683 - RNA, 22 nt, Human
ggcuucccuguuugcugugccu

SEQ ID NO: 267684 - RNA, 22 nt, Human
ucaggucuuuugucuccuagaa

SEQ ID NO: 267685 - RNA, 22 nt, Human
aguuuccaaagcauguucacac

SEQ ID NO: 267686 - RNA, 22 nt, Human
agguucuugacucuaccuucca

SEQ ID NO: 267687 - RNA, 23 nt, Human
aggcaagaacggguuguucaccc

SEQ ID NO: 267688 - RNA, 22 nt, Human
caauucaugggcugaggaaggg

SEQ ID NO: 267689 - RNA, 19 nt, Human
ccagagucaugucuccccc

SEQ ID NO: 267690 - RNA, 22 nt, Human
gggaccuggcgagggucacaca

SEQ ID NO: 267691 - RNA, 22 nt, Human
ucagugucugugggcaggaugg

SEQ ID NO: 267692 - RNA, 22 nt, Human
cuuaauuuaaaauaguucaggc

SEQ ID NO: 267693 - RNA, 22 nt, Human
cagccuggagccacagcccagg

SEQ ID NO: 267694 - RNA, 22 nt, Human
cuccagaauuguccauuggaaa

SEQ ID NO: 267695 - RNA, 22 nt, Human
ucugacuuccuuuucugaucca

SEQ ID NO: 267696 - RNA, 22 nt, Human
auccaggcugcuuucuaugccc

SEQ ID NO: 267697 - RNA, 22 nt, Human
uaggucugauuuccauucaguc

SEQ ID NO: 267698 - RNA, 22 nt, Human
gcucugccaaggacccauucuc

SEQ ID NO: 267699 - RNA, 22 nt, Human
uucuucaugcuguugcugcuug

SEQ ID NO: 267700 - RNA, 22 nt, Human
gaaggcagggaauguggugcua

SEQ ID NO: 267701 - RNA, 22 nt, Human
cguccaggaagaucggccgaug

SEQ ID NO: 267702 - RNA, 22 nt, Human
uaguaaucagagguaaacuuua

SEQ ID NO: 267703 - RNA, 22 nt, Human
uagguucaugaaauuuucagga

SEQ ID NO: 267704 - RNA, 22 nt, Human
uuucuuuccaugagccuaugua

SEQ ID NO: 267705 - RNA, 22 nt, Human
guuuaagaggguuucauuccca

SEQ ID NO: 267706 - RNA, 22 nt, Human
ugaggccugacagaccaagccu

SEQ ID NO: 267707 - RNA, 22 nt, Human
ucaugauuuccugguuaaggac

SEQ ID NO: 267708 - RNA, 22 nt, Human
ugucuuuaaaauuaaacacauc

SEQ ID NO: 267709 - RNA, 22 nt, Human
agugcccucgugcccagggccu

SEQ ID NO: 267710 - RNA, 22 nt, Human
aagcuccuuuggcucgagaucu

SEQ ID NO: 267711 - RNA, 22 nt, Human
agucuucuugaucuuuucagug

SEQ ID NO: 267712 - RNA, 22 nt, Human
ucuuucugaauauuugaccuca

SEQ ID NO: 267713 - RNA, 22 nt, Human
acaggccuggguucaaauuugg

SEQ ID NO: 267714 - RNA, 22 nt, Human
aucugaauaaauuucuuuuagu

SEQ ID NO: 267715 - RNA, 22 nt, Human
uccuagagaguaauacaguuuu

SEQ ID NO: 267716 - RNA, 22 nt, Human
acugaugaucugggaguagagu

SEQ ID NO: 267717 - RNA, 22 nt, Human
ugcauuaaaaugugccucucuu

SEQ ID NO: 267718 - RNA, 22 nt, Human
agcagagacaugaaauaugcuu

SEQ ID NO: 267719 - RNA, 23 nt, Human
agucugugcuuggugggagggcc

SEQ ID NO: 267720 - RNA, 22 nt, Human
aagccaguaaguuuuugucauu

SEQ ID NO: 267721 - RNA, 22 nt, Human
aagaauuauugcaauacuagau

SEQ ID NO: 267722 - RNA, 22 nt, Human
ggaagaaagguggacaacaggu

SEQ ID NO: 267723 - RNA, 22 nt, Human
ggcacagggggcugaggacuag

SEQ ID NO: 267724 - RNA, 22 nt, Human
aaguggggccuggugguacagu

SEQ ID NO: 267725 - RNA, 22 nt, Human
acuguaaagagguguaucuuua

SEQ ID NO: 267726 - RNA, 22 nt, Human
gagccagcuauguagcaagagg

SEQ ID NO: 267727 - RNA, 22 nt, Human
cagcccuggugccaagguuccc

SEQ ID NO: 267728 - RNA, 22 nt, Human
ucaggaagcauccugagguguc

SEQ ID NO: 267729 - RNA, 22 nt, Human
agagguuguuagaauaguggag

SEQ ID NO: 267730 - RNA, 22 nt, Human
uauagcaagcaggacagucuca

SEQ ID NO: 267731 - RNA, 22 nt, Human
cagugccacuuaaugaggcugc

SEQ ID NO: 267732 - RNA, 22 nt, Human
aauaaugagacagcuuauuuaa

SEQ ID NO: 267733 - RNA, 22 nt, Human
agcugcagauucucuacuucau

SEQ ID NO: 267734 - RNA, 22 nt, Human
cuuagggagaaugccucugcag

SEQ ID NO: 267735 - RNA, 22 nt, Human
ccacagagacucugcaggacug

SEQ ID NO: 267736 - RNA, 22 nt, Human
aaagguuaguucuuagaagugc

SEQ ID NO: 267737 - RNA, 20 nt, Human
agcagcauuguucuagagca

SEQ ID NO: 267738 - RNA, 19 nt, Human
auacacauacguaaacuga

SEQ ID NO: 267739 - RNA, 22 nt, Human
aagacagccagcuccaugggau

SEQ ID NO: 267740 - RNA, 22 nt, Human
ucaggaacccuggucuccugcu

SEQ ID NO: 267741 - RNA, 22 nt, Human
ucucugaguucuccuccagccc

SEQ ID NO: 267742 - RNA, 19 nt, Human
uagcugauagcuacuuuau

SEQ ID NO: 267743 - RNA, 22 nt, Human
ccucagagcagcacccagauga

SEQ ID NO: 267744 - RNA, 22 nt, Human
agcugcacugugaaguucauag

SEQ ID NO: 267745 - RNA, 19 nt, Human
ucuuauugagcagcugagg

SEQ ID NO: 267746 - RNA, 22 nt, Human
ccuggcugugugaccuuggcaa

SEQ ID NO: 267747 - RNA, 20 nt, Human
cguguccuuggcgggagagc

SEQ ID NO: 267748 - RNA, 22 nt, Human
augaguucaauuguuucaguca

SEQ ID NO: 267749 - RNA, 22 nt, Human
agaaucugcauuuuuaauaaca

SEQ ID NO: 267750 - RNA, 22 nt, Human
ucagagguggagauaguuggga

SEQ ID NO: 267751 - RNA, 22 nt, Human
augcauugucaggcaauuucau

SEQ ID NO: 267752 - RNA, 22 nt, Human
agagcugagcaccaagcauggu

SEQ ID NO: 267753 - RNA, 22 nt, Human
agauaacuuuuggguauucaug

SEQ ID NO: 267754 - RNA, 22 nt, Human
ccagaagcaaaacagacaguuu

SEQ ID NO: 267755 - RNA, 22 nt, Human
ucaugucaguuucuucuauaaa

SEQ ID NO: 267756 - RNA, 22 nt, Human
ggcaggcuagcacugauguccu

SEQ ID NO: 267757 - RNA, 22 nt, Human
ucugaaaugaccuuuccccacu

SEQ ID NO: 267758 - RNA, 22 nt, Human
cuuaauaauaggugaggcuaug

SEQ ID NO: 267759 - RNA, 22 nt, Human
uauccaaagagauucauguucu

SEQ ID NO: 267760 - RNA, 22 nt, Human
uccaggccauugacugcauccu

SEQ ID NO: 267761 - RNA, 21 nt, Human
accaaaaccuauacuuucugu

SEQ ID NO: 267762 - RNA, 22 nt, Human
uggaauuuuguauuagcuuuga

SEQ ID NO: 267763 - RNA, 22 nt, Human
cagagccucagaauccugugga

SEQ ID NO: 267764 - RNA, 16 nt, Human
ucccaggccaggugga

SEQ ID NO: 267765 - RNA, 22 nt, Human
ggcaggugaguucauuaucugc

SEQ ID NO: 267766 - RNA, 22 nt, Human
agaguacacuguacacacaauu

SEQ ID NO: 267767 - RNA, 20 nt, Human
cugggaggucuuccaaauca

SEQ ID NO: 267768 - RNA, 22 nt, Human
uaggaaaagucuagauugauga

SEQ ID NO: 267769 - RNA, 22 nt, Human
acucagagaauaucuagaagga

SEQ ID NO: 267770 - RNA, 22 nt, Human
uguaaagaaagacgcagaguua

SEQ ID NO: 267771 - RNA, 22 nt, Human
cuucugugcuucacaguugcca

SEQ ID NO: 267772 - RNA, 22 nt, Human
agcaucagccucuguccuggag

SEQ ID NO: 267773 - RNA, 22 nt, Human
guagaauuuuaauaauggagau

SEQ ID NO: 267774 - RNA, 22 nt, Human
ucuccccuguuggccagguuuu

SEQ ID NO: 267775 - RNA, 22 nt, Human
cuccacagguguacuguaccuu

SEQ ID NO: 267776 - RNA, 22 nt, Human
gugcaaaagcaguuggauuuuu

SEQ ID NO: 267777 - RNA, 22 nt, Human
caaaggcaguuacugaaugaag

SEQ ID NO: 267778 - RNA, 22 nt, Human
cuuuguuuauauuucuccucga

SEQ ID NO: 267779 - RNA, 22 nt, Human
uacaaguagcucagguuuucug

SEQ ID NO: 267780 - RNA, 22 nt, Human
aaaccuuugugugucugugccu

SEQ ID NO: 267781 - RNA, 22 nt, Human
gccuuggacuaccacucccaca

SEQ ID NO: 267782 - RNA, 22 nt, Human
uucaguuccauuucaggugggu

SEQ ID NO: 267783 - RNA, 22 nt, Human
cugugggccuagucuggccuag

SEQ ID NO: 267784 - RNA, 22 nt, Human
ggagcccaagucugcacucggc

SEQ ID NO: 267785 - RNA, 22 nt, Human
acagccugauuuauggagcagu

SEQ ID NO: 267786 - RNA, 22 nt, Human
uggcuguggacucagauggcuc

SEQ ID NO: 267787 - RNA, 22 nt, Human
ugaagccaucaggaagccagca

SEQ ID NO: 267788 - RNA, 22 nt, Human
acagccaagucuucuauuucag

SEQ ID NO: 267789 - RNA, 22 nt, Human
auuucucagcacuuccuaucuc

SEQ ID NO: 267790 - RNA, 22 nt, Human
uaaggccaaggggccauagucu

SEQ ID NO: 267791 - RNA, 23 nt, Human
agucacaucuuagcagccagguc

SEQ ID NO: 267792 - RNA, 22 nt, Human
aaagacauggcaagagaugggg

SEQ ID NO: 267793 - RNA, 22 nt, Human
accaggcccaccgcaugcuccu

SEQ ID NO: 267794 - RNA, 22 nt, Human
agaaucaauucacugcugcagc

SEQ ID NO: 267795 - RNA, 22 nt, Human
gaggagugccagccguggaguc

SEQ ID NO: 267796 - RNA, 17 nt, Human
aggcaccucuuccugcu

SEQ ID NO: 267797 - RNA, 22 nt, Human
ucacagaagcccucgcaaacua

SEQ ID NO: 267798 - RNA, 22 nt, Human
aggcuggagugcuggagugcug

SEQ ID NO: 267799 - RNA, 22 nt, Human
caggacaggcccuguggggucu

SEQ ID NO: 267800 - RNA, 22 nt, Human
ugaugacaugugggcuguggcu

SEQ ID NO: 267801 - RNA, 22 nt, Human
aaaguguuuacauugcuauaag

SEQ ID NO: 267802 - RNA, 22 nt, Human
aguuuguaaaauguggccugga

SEQ ID NO: 267803 - RNA, 22 nt, Human
agggaggaguccucaaagucau

SEQ ID NO: 267804 - RNA, 22 nt, Human
agcuuuauggugccucacuuga

SEQ ID NO: 267805 - RNA, 22 nt, Human
uuuauacauggagaauuuuugc

SEQ ID NO: 267806 - RNA, 22 nt, Human
auucucagcuuucaaauagaca

SEQ ID NO: 267807 - RNA, 22 nt, Human
aagccaguguccagaaugggca

SEQ ID NO: 267808 - RNA, 22 nt, Human
gcguggcuccuaacagaucuga

SEQ ID NO: 267809 - RNA, 22 nt, Human
gcuucccaaugugcuaguuucu

SEQ ID NO: 267810 - RNA, 22 nt, Human
cugaaacuccaugagaaauugc

SEQ ID NO: 267811 - RNA, 22 nt, Human
uucuuuauaucugcuagugggu

SEQ ID NO: 267812 - RNA, 21 nt, Human
gagugcagcaagguagagucu

SEQ ID NO: 267813 - RNA, 22 nt, Human
cuccuggcaguuccccuuguca

SEQ ID NO: 267814 - RNA, 22 nt, Human
uuccagccaugguuucccuaug

SEQ ID NO: 267815 - RNA, 22 nt, Human
ccaggacacgauuuuuagucug

SEQ ID NO: 267816 - RNA, 22 nt, Human
gaaggccuagggaugcucugcg

SEQ ID NO: 267817 - RNA, 21 nt, Human
ccagcuccaggaccuuggauc

SEQ ID NO: 267818 - RNA, 22 nt, Human
cuucuucccagcuucccucacc

SEQ ID NO: 267819 - RNA, 22 nt, Human
gcagauggacuguaugaccuga

SEQ ID NO: 267820 - RNA, 22 nt, Human
gcuccuggcaggcagugugugu

SEQ ID NO: 267821 - RNA, 22 nt, Human
agauggccccaggugcccaggg

SEQ ID NO: 267822 - RNA, 21 nt, Human
agaaaaguauuugaaucaaga

SEQ ID NO: 267823 - RNA, 22 nt, Human
uugguguacaucuccccuucau

SEQ ID NO: 267824 - RNA, 22 nt, Human
agcaggcuacuccuguguucgu

SEQ ID NO: 267825 - RNA, 22 nt, Human
cugccugggccggccacccucu

SEQ ID NO: 267826 - RNA, 22 nt, Human
agagcagucaggcuaggacacu

SEQ ID NO: 267827 - RNA, 20 nt, Human
cugugccuccugcuaguccu

SEQ ID NO: 267828 - RNA, 22 nt, Human
cagcuucuuacgagcugguacu

SEQ ID NO: 267829 - RNA, 22 nt, Human
ucaggcuucacuccuguccaag

SEQ ID NO: 267830 - RNA, 22 nt, Human
acagugcauaaaaacaacuuuu

SEQ ID NO: 267831 - RNA, 22 nt, Human
gcaaaguauuaaccaacaggau

SEQ ID NO: 267832 - RNA, 22 nt, Human
uauuuauuggacaguguugcug

SEQ ID NO: 267833 - RNA, 22 nt, Human
agggggcucagcaggcucugga

SEQ ID NO: 267834 - RNA, 22 nt, Human
uggcuucucccuacaacaugcc

SEQ ID NO: 267835 - RNA, 22 nt, Human
uauaaagagucucaaagaaguu

SEQ ID NO: 267836 - RNA, 22 nt, Human
agacaggccacucuggucuggu

SEQ ID NO: 267837 - RNA, 22 nt, Human
uuuguagauucauugaacuuuu

SEQ ID NO: 267838 - RNA, 20 nt, Human
aaguuacauuguauuguacc

SEQ ID NO: 267839 - RNA, 23 nt, Human
ucccugagcuggagagacugcac

SEQ ID NO: 267840 - RNA, 22 nt, Human
auaaggaaaugaaacucuaaua

SEQ ID NO: 267841 - RNA, 22 nt, Human
ccaaggagcaaggcucaacaag

SEQ ID NO: 267842 - RNA, 22 nt, Human
ccuggcugcauuuugcuggaug

SEQ ID NO: 267843 - RNA, 22 nt, Human
gcucuagcaaggcuggccuggg

SEQ ID NO: 267844 - RNA, 19 nt, Human
ggcaagcacaaaagcuuug

SEQ ID NO: 267845 - RNA, 22 nt, Human
agagucugauauuuguaccaga

SEQ ID NO: 267846 - RNA, 22 nt, Human
caaugacaucucccugcucuaa

SEQ ID NO: 267847 - RNA, 22 nt, Human
auagauauuugaguuguuucca

SEQ ID NO: 267848 - RNA, 22 nt, Human
gggacaucuuucuagucagggu

SEQ ID NO: 267849 - RNA, 22 nt, Human
cagugggggggccaugcugcag

SEQ ID NO: 267850 - RNA, 22 nt, Human
cugggacaugauagaaacagau

SEQ ID NO: 267851 - RNA, 22 nt, Human
ccucagucuauuuccagcaggu

SEQ ID NO: 267852 - RNA, 17 nt, Human
aguguggcccugguuaa

SEQ ID NO: 267853 - RNA, 22 nt, Human
cggcuucuauuaggucggugca

SEQ ID NO: 267854 - RNA, 22 nt, Human
guucucugcgcucccggcccgg

SEQ ID NO: 267855 - RNA, 22 nt, Human
acagacauuuaauaaaugcuga

SEQ ID NO: 267856 - RNA, 22 nt, Human
uggagcaggugccaggugugug

SEQ ID NO: 267857 - RNA, 22 nt, Human
gcuccugucagucaucaggugc

SEQ ID NO: 267858 - RNA, 22 nt, Human
caguuacauaaaugauaaaaug

SEQ ID NO: 267859 - RNA, 22 nt, Human
ugacauguuagggaaaugugau

SEQ ID NO: 267860 - RNA, 22 nt, Human
ugaaugaugguguguucuugcc

SEQ ID NO: 267861 - RNA, 22 nt, Human
ucagggcaggacaguguaggcc

SEQ ID NO: 267862 - RNA, 22 nt, Human
uuccagccacuuuauacugcua

SEQ ID NO: 267863 - RNA, 22 nt, Human
ucacagaaugucagaguugggg

SEQ ID NO: 267864 - RNA, 22 nt, Human
ggcugccugugcccaggcacac

SEQ ID NO: 267865 - RNA, 22 nt, Human
cuggaaagugcauguaaugagg

SEQ ID NO: 267866 - RNA, 22 nt, Human
aaggcugaguaaaacagagaac

SEQ ID NO: 267867 - RNA, 22 nt, Human
gcugcccuacccgaggcacucu

SEQ ID NO: 267868 - RNA, 22 nt, Human
agugaauguccccgcgggucag

SEQ ID NO: 267869 - RNA, 22 nt, Human
agcucagggcgaucugucucgg

SEQ ID NO: 267870 - RNA, 22 nt, Human
gcuccuggcauccugcuuuuaa

SEQ ID NO: 267871 - RNA, 22 nt, Human
cuucuguagccaguaacauaua

SEQ ID NO: 267872 - RNA, 22 nt, Human
cagugauauuuauccuacucac

SEQ ID NO: 267873 - RNA, 22 nt, Human
ccacaggcggaguggcgggcag

SEQ ID NO: 267874 - RNA, 22 nt, Human
ucaaacuguuuacagugagaua

SEQ ID NO: 267875 - RNA, 21 nt, Human
uccacccucucugcucccagu

SEQ ID NO: 267876 - RNA, 22 nt, Human
cagaacuggccuuucaucaguc

SEQ ID NO: 267877 - RNA, 22 nt, Human
uggaaccuggccugagcuacca

SEQ ID NO: 267878 - RNA, 22 nt, Human
uuacaguuuauccaggaagagc

SEQ ID NO: 267879 - RNA, 22 nt, Human
uccaggcuagaagucacaggcc

SEQ ID NO: 267880 - RNA, 22 nt, Human
aguggcuagaucaugagugagc

SEQ ID NO: 267881 - RNA, 22 nt, Human
guggcuuggaccagucacagug

SEQ ID NO: 267882 - RNA, 22 nt, Human
ugggaguacuaugugauaggau

SEQ ID NO: 267883 - RNA, 22 nt, Human
ucuucaaauccuacagugucug

SEQ ID NO: 267884 - RNA, 22 nt, Human
gguggcagcauggucccagugu

SEQ ID NO: 267885 - RNA, 17 nt, Human
cagcugugagagccuua

SEQ ID NO: 267886 - RNA, 22 nt, Human
ucugggauagggccagaacaug

SEQ ID NO: 267887 - RNA, 22 nt, Human
aggccucugggccugcggguuu

SEQ ID NO: 267888 - RNA, 22 nt, Human
uaacaugauuugcuauuuagau

SEQ ID NO: 267889 - RNA, 22 nt, Human
ggcacagagcuccagccuuggc

SEQ ID NO: 267890 - RNA, 21 nt, Human
agcuggcucucucuggagaga

SEQ ID NO: 267891 - RNA, 22 nt, Human
cagugucuuucagacucagaaa

SEQ ID NO: 267892 - RNA, 22 nt, Human
cagcauauuacuuuaaaaaauc

SEQ ID NO: 267893 - RNA, 22 nt, Human
agguccagcuguugcagccucc

SEQ ID NO: 267894 - RNA, 17 nt, Human
ucccaggaacagggaau

SEQ ID NO: 267895 - RNA, 22 nt, Human
aaggguccagcaccucggcucc

SEQ ID NO: 267896 - RNA, 22 nt, Human
uccccaccccagaacuacuagg

SEQ ID NO: 267897 - RNA, 22 nt, Human
agacacaggauucugcauuucu

SEQ ID NO: 267898 - RNA, 22 nt, Human
uugcucugcaguccagacagua

SEQ ID NO: 267899 - RNA, 22 nt, Human
cuggcaggcagacuucugcaag

SEQ ID NO: 267900 - RNA, 22 nt, Human
gaaggaaaacagaucugccuga

SEQ ID NO: 267901 - RNA, 22 nt, Human
ucuagagcuuuuuccucuugua

SEQ ID NO: 267902 - RNA, 21 nt, Human
cagaaguaaggguaacuucuc

SEQ ID NO: 267903 - RNA, 22 nt, Human
cauuccuauuaugucccuagug

SEQ ID NO: 267904 - RNA, 22 nt, Human
gauauauuuuccauggucugca

SEQ ID NO: 267905 - RNA, 22 nt, Human
ucuggcaguugccgcuucaguc

SEQ ID NO: 267906 - RNA, 22 nt, Human
ucaucugucauccacaaagcug

SEQ ID NO: 267907 - RNA, 22 nt, Human
agcagagugccccaucacaagg

SEQ ID NO: 267908 - RNA, 22 nt, Human
aauguuuucauuauccuaacug

SEQ ID NO: 267909 - RNA, 22 nt, Human
ccagagggcaaaaugaagcuua

SEQ ID NO: 267910 - RNA, 22 nt, Human
uaggugucuuguguaugguaca

SEQ ID NO: 267911 - RNA, 22 nt, Human
uuucaguuguccuguuaauagc

SEQ ID NO: 267912 - RNA, 19 nt, Human
agaaaucucgagauuuguu

SEQ ID NO: 267913 - RNA, 22 nt, Human
auucuuuccagacacugauugc

SEQ ID NO: 267914 - RNA, 18 nt, Human
agugcaugcuaggggaag

SEQ ID NO: 267915 - RNA, 22 nt, Human
gcuucuccucccgcucccaggc

SEQ ID NO: 267916 - RNA, 22 nt, Human
cagaggcuguguaggcagacug

SEQ ID NO: 267917 - RNA, 22 nt, Human
augaaacaugagaaauggagag

SEQ ID NO: 267918 - RNA, 22 nt, Human
auaauauaauccuacuucccau

SEQ ID NO: 267919 - RNA, 22 nt, Human
ggcagugagaggucuccugguc

SEQ ID NO: 267920 - RNA, 22 nt, Human
aagaggaagucuccauggagag

SEQ ID NO: 267921 - RNA, 22 nt, Human
aaugucucaccguaaauguaac

SEQ ID NO: 267922 - RNA, 22 nt, Human
cuggauguuuaugaaggaccca

SEQ ID NO: 267923 - RNA, 21 nt, Human
uuucucaguugugugagcagc

SEQ ID NO: 267924 - RNA, 22 nt, Human
ucuuagaaaaaugguauguuuu

SEQ ID NO: 267925 - RNA, 19 nt, Human
augaauguguucuuaccuc

SEQ ID NO: 267926 - RNA, 22 nt, Human
caggugaguaacaaugggugau

SEQ ID NO: 267927 - RNA, 22 nt, Human
gagcucaggagcaucagaagaa

SEQ ID NO: 267928 - RNA, 22 nt, Human
uugggagauauuguucuuuaca

SEQ ID NO: 267929 - RNA, 22 nt, Human
uccugggagagugggacuguau

SEQ ID NO: 267930 - RNA, 22 nt, Human
gcagcuguagaggggagaaaga

SEQ ID NO: 267931 - RNA, 22 nt, Human
ucucuuugucugcucuuaguug

SEQ ID NO: 267932 - RNA, 22 nt, Human
gaagagaaaggcaaggaguuuu

SEQ ID NO: 267933 - RNA, 22 nt, Human
ugcuggcacguggaccaggaga

SEQ ID NO: 267934 - RNA, 22 nt, Human
uuuacuacuugugauaacugaa

SEQ ID NO: 267935 - RNA, 22 nt, Human
ccccaccuugcaauuguucccu

SEQ ID NO: 267936 - RNA, 22 nt, Human
ugucauuuucagcuuaugcuuc

SEQ ID NO: 267937 - RNA, 22 nt, Human
auggcugccuuaauucuucagc

SEQ ID NO: 267938 - RNA, 22 nt, Human
gcugggcucugucaugccuucc

SEQ ID NO: 267939 - RNA, 22 nt, Human
aucuuauugcuguugccagaua

SEQ ID NO: 267940 - RNA, 22 nt, Human
ccaggcucugcaaaaucaggcu

SEQ ID NO: 267941 - RNA, 22 nt, Human
uucugggcucucuuucugugug

SEQ ID NO: 267942 - RNA, 22 nt, Human
auggcugcagccggcccugcgc

SEQ ID NO: 267943 - RNA, 22 nt, Human
gcuguccucgucucucacgcaa

SEQ ID NO: 267944 - RNA, 22 nt, Human
auuuggaaaugcaucucuugag

SEQ ID NO: 267945 - RNA, 22 nt, Human
acagucuuucuacauucugugc

SEQ ID NO: 267946 - RNA, 22 nt, Human
acuguucauccuuuuugaacaa

SEQ ID NO: 267947 - RNA, 22 nt, Human
ucauucaagauuucaauagauu

SEQ ID NO: 267948 - RNA, 22 nt, Human
gcuguccaggagugcagagauu

SEQ ID NO: 267949 - RNA, 21 nt, Human
acagcaagccuuccuuucagg

SEQ ID NO: 267950 - RNA, 22 nt, Human
aggccuccagccacaugccagu

SEQ ID NO: 267951 - RNA, 22 nt, Human
ccugcccacuccaggagcaacu

SEQ ID NO: 267952 - RNA, 22 nt, Human
cuguuuucuagggcugagguga

SEQ ID NO: 267953 - RNA, 22 nt, Human
ggcacuggaaggaucaugugag

SEQ ID NO: 267954 - RNA, 22 nt, Human
cuucugaggcagcuauucaguu

SEQ ID NO: 267955 - RNA, 22 nt, Human
cugagcugguucucuugugaaa

SEQ ID NO: 267956 - RNA, 22 nt, Human
gcucugagaucauucacuguaa

SEQ ID NO: 267957 - RNA, 22 nt, Human
gccaguuuccaccuaggcaauu

SEQ ID NO: 267958 - RNA, 22 nt, Human
gggaacagagugccagacugac

SEQ ID NO: 267959 - RNA, 22 nt, Human
gccucugggguggagcccagca

SEQ ID NO: 267960 - RNA, 22 nt, Human
caggugcugugaaucuucauaa

SEQ ID NO: 267961 - RNA, 20 nt, Human
ccagaagcacucuucauguu

SEQ ID NO: 267962 - RNA, 22 nt, Human
ugggagcagcugggaacacagc

SEQ ID NO: 267963 - RNA, 20 nt, Human
ugcaggaauuugcauuccuu

SEQ ID NO: 267964 - RNA, 22 nt, Human
gugugcaguagagaaagagcag

SEQ ID NO: 267965 - RNA, 22 nt, Human
cauucuuacacaauauuuuaau

SEQ ID NO: 267966 - RNA, 19 nt, Human
guggcugccgaucgcggcu

SEQ ID NO: 267967 - RNA, 22 nt, Human
cugcuuuaauguaagauauacc

SEQ ID NO: 267968 - RNA, 22 nt, Human
aguggcugcuggaguggagaug

SEQ ID NO: 267969 - RNA, 19 nt, Human
caggaaugagguaauggcu

SEQ ID NO: 267970 - RNA, 22 nt, Human
uccuggaggggacagcaugggc

SEQ ID NO: 267971 - RNA, 19 nt, Human
uugcuucaugucuuuugcu

SEQ ID NO: 267972 - RNA, 22 nt, Human
uaaaguguggauaugauuagua

SEQ ID NO: 267973 - RNA, 20 nt, Human
ggcagcucuagucgaggccc

SEQ ID NO: 267974 - RNA, 22 nt, Human
gaggggaugcagagaggcuuau

SEQ ID NO: 267975 - RNA, 22 nt, Human
caucagaauagcucuguggaua

SEQ ID NO: 267976 - RNA, 22 nt, Human
agaggccagcaaccacaguaaa

SEQ ID NO: 267977 - RNA, 22 nt, Human
uaguuuacucaucuauaaaaug

SEQ ID NO: 267978 - RNA, 21 nt, Human
aagaaguuuggauuuuguccu

SEQ ID NO: 267979 - RNA, 22 nt, Human
uccaggagguugagugaguucc

SEQ ID NO: 267980 - RNA, 22 nt, Human
uuuacauguccuucaagagcag

SEQ ID NO: 267981 - RNA, 22 nt, Human
gagcccuuuuccuagauacugu

SEQ ID NO: 267982 - RNA, 22 nt, Human
uucaguuuguuugacuguuaga

SEQ ID NO: 267983 - RNA, 22 nt, Human
uuauuucauauaauguuaucaa

SEQ ID NO: 267984 - RNA, 22 nt, Human
cuggcucuuuccuagcuaggcu

SEQ ID NO: 267985 - RNA, 22 nt, Human
uaacucugcuuguucucugagu

SEQ ID NO: 267986 - RNA, 18 nt, Human
ucaggcucucuggcuaga

SEQ ID NO: 267987 - RNA, 22 nt, Human
ucuggcuugucucagggucuga

SEQ ID NO: 267988 - RNA, 22 nt, Human
aacauuuguuucguuaugugaa

SEQ ID NO: 267989 - RNA, 22 nt, Human
gggaagggagggccuccaguca

SEQ ID NO: 267990 - RNA, 20 nt, Human
gcuguggccgugccagacuc

SEQ ID NO: 267991 - RNA, 22 nt, Human
aaaugccaaggagagacuguua

SEQ ID NO: 267992 - RNA, 22 nt, Human
aggcagguguugggagacacca

SEQ ID NO: 267993 - RNA, 22 nt, Human
ucagaagucuggacugcuucuc

SEQ ID NO: 267994 - RNA, 22 nt, Human
ggcuuucuuguuaaauguccau

SEQ ID NO: 267995 - RNA, 22 nt, Human
augccuuucuuuggugcagguu

SEQ ID NO: 267996 - RNA, 22 nt, Human
cugaaggcauuuuugcugauuu

SEQ ID NO: 267997 - RNA, 22 nt, Human
caugaaacuuccaaagcugacc

SEQ ID NO: 267998 - RNA, 22 nt, Human
uuggcuucugauguauuccuga

SEQ ID NO: 267999 - RNA, 22 nt, Human
gagguucaggaaaugggcaaag

SEQ ID NO: 268000 - RNA, 22 nt, Human
gaacauuuggcaugagaauuug

SEQ ID NO: 268001 - RNA, 22 nt, Human
ggcucugguugaccaugauggc

SEQ ID NO: 268002 - RNA, 22 nt, Human
gcccagggcgauggucggggcc

SEQ ID NO: 268003 - RNA, 23 nt, Human
ucucuuucaagagcuuaaugugc

SEQ ID NO: 268004 - RNA, 22 nt, Human
acagggcauuuccucuaugugu

SEQ ID NO: 268005 - RNA, 22 nt, Human
aacuucauggguucaaagcugg

SEQ ID NO: 268006 - RNA, 22 nt, Human
agagcuggaagcugcucuuaga

SEQ ID NO: 268007 - RNA, 22 nt, Human
cacaggccugggguugagcggg

SEQ ID NO: 268008 - RNA, 22 nt, Human
acuagaaacuaauggauuauua

SEQ ID NO: 268009 - RNA, 22 nt, Human
cucucuguauguguauauuuau

SEQ ID NO: 268010 - RNA, 22 nt, Human
aaugccuugccugcuacaacuu

SEQ ID NO: 268011 - RNA, 22 nt, Human
uauucagaaaauaaauuggauu

SEQ ID NO: 268012 - RNA, 22 nt, Human
caggaaggcccaccuguccugu

SEQ ID NO: 268013 - RNA, 22 nt, Human
ggcccagccuugggguuucuuu

SEQ ID NO: 268014 - RNA, 22 nt, Human
acuuuaucaggaaucacacagc

SEQ ID NO: 268015 - RNA, 22 nt, Human
ggcagggaagcuggcaucacgg

SEQ ID NO: 268016 - RNA, 22 nt, Human
uagaccugaaauauggaccugg

SEQ ID NO: 268017 - RNA, 19 nt, Human
gaaaacaugggugaggguc

SEQ ID NO: 268018 - RNA, 22 nt, Human
ucuuugaaagcuguucuagagu

SEQ ID NO: 268019 - RNA, 22 nt, Human
cauauuuaguguuuggagaucg

SEQ ID NO: 268020 - RNA, 22 nt, Human
uacaagcugacccugaagauga

SEQ ID NO: 268021 - RNA, 22 nt, Human
agggagcuuucagguagcuuaa

SEQ ID NO: 268022 - RNA, 22 nt, Human
acagaggccaugagcugccacc

SEQ ID NO: 268023 - RNA, 22 nt, Human
uuccaaagaaguucacauuuac

SEQ ID NO: 268024 - RNA, 22 nt, Human
uccaugcagcagccucccagcc

SEQ ID NO: 268025 - RNA, 22 nt, Human
guugcucaggcaggaguacagu

SEQ ID NO: 268026 - RNA, 22 nt, Human
gagauggggucagcugggacau

SEQ ID NO: 268027 - RNA, 22 nt, Human
augaccaagaguccaggucaag

SEQ ID NO: 268028 - RNA, 22 nt, Human
augagguuuugauuggcacagg

SEQ ID NO: 268029 - RNA, 22 nt, Human
ucugccugcggcugcagguggc

SEQ ID NO: 268030 - RNA, 22 nt, Human
uauuucagcaagaagaaugugg

SEQ ID NO: 268031 - RNA, 22 nt, Human
uguaggcacauguauauauccc

SEQ ID NO: 268032 - RNA, 22 nt, Human
acguagcacugagagaugcagg

SEQ ID NO: 268033 - RNA, 22 nt, Human
uccugggcugcagggaagagca

SEQ ID NO: 268034 - RNA, 22 nt, Human
aguguuucaccguauguucuca

SEQ ID NO: 268035 - RNA, 22 nt, Human
caugaauuuuucuguggguuaa

SEQ ID NO: 268036 - RNA, 22 nt, Human
agcaaagcuaucucuauggaga

SEQ ID NO: 268037 - RNA, 22 nt, Human
uccuuggaucuuuccuaugauu

SEQ ID NO: 268038 - RNA, 22 nt, Human
ccuggcuuccuggagcucacaa

SEQ ID NO: 268039 - RNA, 22 nt, Human
cagccagguaugggcgugcggg

SEQ ID NO: 268040 - RNA, 22 nt, Human
gaaguucaacugccaugcuugg

SEQ ID NO: 268041 - RNA, 22 nt, Human
gggagcugcggucuugcgaaga

SEQ ID NO: 268042 - RNA, 22 nt, Human
uccaugagcuagggauucauca

SEQ ID NO: 268043 - RNA, 22 nt, Human
agcacaguggcuucuaugucua

SEQ ID NO: 268044 - RNA, 22 nt, Human
auuauucuuaugucaucauggc

SEQ ID NO: 268045 - RNA, 22 nt, Human
ugggacagauuauaagucugca

SEQ ID NO: 268046 - RNA, 20 nt, Human
acuuggaacucauuuuucuu

SEQ ID NO: 268047 - RNA, 22 nt, Human
gcagaauaauagaaaggcacac

SEQ ID NO: 268048 - RNA, 22 nt, Human
guauuuuucaguuaggagcuua

SEQ ID NO: 268049 - RNA, 22 nt, Human
aaggaacuaacuauguagagau

SEQ ID NO: 268050 - RNA, 22 nt, Human
aggccacaguugaggccagcaa

SEQ ID NO: 268051 - RNA, 22 nt, Human
ucuuggacucaaaauugccuua

SEQ ID NO: 268052 - RNA, 22 nt, Human
gugagggcagaacccccaggcc

SEQ ID NO: 268053 - RNA, 21 nt, Human
ucagaacuggugcagaugaau

SEQ ID NO: 268054 - RNA, 22 nt, Human
ugagaaaauuacuauaauuguc

SEQ ID NO: 268055 - RNA, 18 nt, Human
aggcaggcggaucacaag

SEQ ID NO: 268056 - RNA, 22 nt, Human
aggccucaguucuugccaggug

SEQ ID NO: 268057 - RNA, 22 nt, Human
uacaaggaaaauuuuauaguaa

SEQ ID NO: 268058 - RNA, 22 nt, Human
ccugagugccaugagagcaccc

SEQ ID NO: 268059 - RNA, 22 nt, Human
cuuaaacaggaaagagccaggu

SEQ ID NO: 268060 - RNA, 22 nt, Human
agaggcugauggaguagugucu

SEQ ID NO: 268061 - RNA, 22 nt, Human
acacuguuccacacuaagaagg

SEQ ID NO: 268062 - RNA, 22 nt, Human
uuucucuuaaugucucugugcu

SEQ ID NO: 268063 - RNA, 22 nt, Human
ugucaguucaauuauaguaauu

SEQ ID NO: 268064 - RNA, 22 nt, Human
ucugugcuagaggaguuggcca

SEQ ID NO: 268065 - RNA, 22 nt, Human
aaauucuaugucaauguuuauu

SEQ ID NO: 268066 - RNA, 22 nt, Human
cuucagaaauaacaacaauuac

SEQ ID NO: 268067 - RNA, 22 nt, Human
gggcacaugcuuagggaggaaa

SEQ ID NO: 268068 - RNA, 22 nt, Human
aguuucaguguugacagauggu

SEQ ID NO: 268069 - RNA, 22 nt, Human
agaacaauugccccaaagcuug

SEQ ID NO: 268070 - RNA, 22 nt, Human
uuuuauugggaguccucuacug

SEQ ID NO: 268071 - RNA, 22 nt, Human
acugcccauuaaaggugcuuug

SEQ ID NO: 268072 - RNA, 22 nt, Human
ccucugggccuggaagggcagu

SEQ ID NO: 268073 - RNA, 22 nt, Human
aacauuucauuggaagcuaugu

SEQ ID NO: 268074 - RNA, 22 nt, Human
uuccuggggcuccagcuaccag

SEQ ID NO: 268075 - RNA, 22 nt, Human
ugaccugcagucaagaggggaa

SEQ ID NO: 268076 - RNA, 22 nt, Human
uacaggcaugaaugaaaucugu

SEQ ID NO: 268077 - RNA, 22 nt, Human
gcuggccauggggagugaggag

SEQ ID NO: 268078 - RNA, 22 nt, Human
cacuuagaaaacuugagcaagu

SEQ ID NO: 268079 - RNA, 22 nt, Human
ggggugugucugacaaugguau

SEQ ID NO: 268080 - RNA, 22 nt, Human
uuucucugggcacucuccaaac

SEQ ID NO: 268081 - RNA, 22 nt, Human
caagagcacgugcccuccauaa

SEQ ID NO: 268082 - RNA, 22 nt, Human
accagcagguggcaguauguau

SEQ ID NO: 268083 - RNA, 22 nt, Human
ccaucagauuagcaaaauccag

SEQ ID NO: 268084 - RNA, 22 nt, Human
uuuguguggcguuggccggcgg

SEQ ID NO: 268085 - RNA, 20 nt, Human
guaacucuggcuaaguaaau

SEQ ID NO: 268086 - RNA, 22 nt, Human
acuuaaaaacagauccagcagg

SEQ ID NO: 268087 - RNA, 22 nt, Human
aggcccuggucaggucuggcug

SEQ ID NO: 268088 - RNA, 22 nt, Human
agggccugugcuuccugagaua

SEQ ID NO: 268089 - RNA, 22 nt, Human
ucagagucuuaacuauucagag

SEQ ID NO: 268090 - RNA, 22 nt, Human
cuguggcuggccugucugacau

SEQ ID NO: 268091 - RNA, 22 nt, Human
cugggucucaggaguucugagg

SEQ ID NO: 268092 - RNA, 22 nt, Human
gcuccuguuuucuuccagaaau

SEQ ID NO: 268093 - RNA, 22 nt, Human
gggaguggagagcaauggauga

SEQ ID NO: 268094 - RNA, 19 nt, Human
guccugcaacuggcucucc

SEQ ID NO: 268095 - RNA, 22 nt, Human
agugauuugaggauuauugcuc

SEQ ID NO: 268096 - RNA, 22 nt, Human
cugccucugcgucccacagagu

SEQ ID NO: 268097 - RNA, 22 nt, Human
uccaagaauacagauuugugaa

SEQ ID NO: 268098 - RNA, 22 nt, Human
agacaccuaauagaugaauuca

SEQ ID NO: 268099 - RNA, 22 nt, Human
cauccagaguccaaggcugggc

SEQ ID NO: 268100 - RNA, 22 nt, Human
cagaggcauacucccagucuug

SEQ ID NO: 268101 - RNA, 20 nt, Human
uacagaaugcaauaaaaugg

SEQ ID NO: 268102 - RNA, 22 nt, Human
acucacugcacuuugaaaugug

SEQ ID NO: 268103 - RNA, 22 nt, Human
agcagggcaaagucaggcuaac

SEQ ID NO: 268104 - RNA, 20 nt, Human
uuguuuauuauguucugauc

SEQ ID NO: 268105 - RNA, 22 nt, Human
cagcuccugggccaucuccuag

SEQ ID NO: 268106 - RNA, 22 nt, Human
guagaaucccaguggcuauauu

SEQ ID NO: 268107 - RNA, 22 nt, Human
cagauaugauaggauuagcaca

SEQ ID NO: 268108 - RNA, 22 nt, Human
gcccagagugaguccugggccc

SEQ ID NO: 268109 - RNA, 22 nt, Human
ccagcaggcagucauauccuuu

SEQ ID NO: 268110 - RNA, 22 nt, Human
ugggaaggcguggaaguagaag

SEQ ID NO: 268111 - RNA, 23 nt, Human
ucaggugugcggacugcugaguc

SEQ ID NO: 268112 - RNA, 22 nt, Human
ucuggcuuuauuuucaucaucu

SEQ ID NO: 268113 - RNA, 22 nt, Human
uaggaaugauuggaauuccagg

SEQ ID NO: 268114 - RNA, 22 nt, Human
guggggagggagaugcugaagu

SEQ ID NO: 268115 - RNA, 22 nt, Human
gagcuacaggcagcugagcccu

SEQ ID NO: 268116 - RNA, 22 nt, Human
ucuggcaguuccuuguugauau

SEQ ID NO: 268117 - RNA, 22 nt, Human
uguguauguaagcaugugcaua

SEQ ID NO: 268118 - RNA, 22 nt, Human
cuuccaaauguaaauaaguuuc

SEQ ID NO: 268119 - RNA, 22 nt, Human
aggcugagcugguagugaguac

SEQ ID NO: 268120 - RNA, 21 nt, Human
gccuggcagguggaagggcuc

SEQ ID NO: 268121 - RNA, 22 nt, Human
uaggcugcucaccaggcucaga

SEQ ID NO: 268122 - RNA, 22 nt, Human
gcucuugucaaaaauuaguuga

SEQ ID NO: 268123 - RNA, 22 nt, Human
uagugccaccuuccaaguauca

SEQ ID NO: 268124 - RNA, 22 nt, Human
cuccagccagagugccucuguu

SEQ ID NO: 268125 - RNA, 22 nt, Human
ucugcucuguggcuucagcuaa

SEQ ID NO: 268126 - RNA, 22 nt, Human
uuauuccagcuaagaguccugg

SEQ ID NO: 268127 - RNA, 21 nt, Human
aggcagcaggauccagggaca

SEQ ID NO: 268128 - RNA, 22 nt, Human
aauaugcacucugauuuagcag

SEQ ID NO: 268129 - RNA, 20 nt, Human
gcuuagcaggcauaguagcu

SEQ ID NO: 268130 - RNA, 22 nt, Human
ucucuagacauggggaauguca

SEQ ID NO: 268131 - RNA, 22 nt, Human
aauauuuuugaggcccuguuau

SEQ ID NO: 268132 - RNA, 22 nt, Human
cagggccaggcugauggccugg

SEQ ID NO: 268133 - RNA, 22 nt, Human
agcagguugugauacacucaga

SEQ ID NO: 268134 - RNA, 22 nt, Human
ccagcaggacuuuggaaauaug

SEQ ID NO: 268135 - RNA, 22 nt, Human
aggaagcccaagucucaucuuc

SEQ ID NO: 268136 - RNA, 22 nt, Human
aggcccagcugggccaggaaca

SEQ ID NO: 268137 - RNA, 22 nt, Human
aggaggugagcggucauguggu

SEQ ID NO: 268138 - RNA, 22 nt, Human
uuuguuaaaaugcagauucugu

SEQ ID NO: 268139 - RNA, 22 nt, Human
ucuuccagagccuccaucccua

SEQ ID NO: 268140 - RNA, 19 nt, Human
aggcuggagacaccaggcc

SEQ ID NO: 268141 - RNA, 20 nt, Human
ucucuggccagaaacaacag

SEQ ID NO: 268142 - RNA, 22 nt, Human
uauuccaacuucacuauugucu

SEQ ID NO: 268143 - RNA, 22 nt, Human
gagagacagcagaacgugcagc

SEQ ID NO: 268144 - RNA, 22 nt, Human
uguaaaaggaaaucaaagcacu

SEQ ID NO: 268145 - RNA, 22 nt, Human
agaaugcaagauaaacuuuauu

SEQ ID NO: 268146 - RNA, 22 nt, Human
gcucagagauaaaacugaucag

SEQ ID NO: 268147 - RNA, 22 nt, Human
ucaucaguuuagaaaaaauaug

SEQ ID NO: 268148 - RNA, 22 nt, Human
gauucuuacuucuaagcaagcu

SEQ ID NO: 268149 - RNA, 22 nt, Human
caugagaaugaagaagacuuaa

SEQ ID NO: 268150 - RNA, 22 nt, Human
ugucaagucucugaaugaaaug

SEQ ID NO: 268151 - RNA, 22 nt, Human
uucuuguauguaugcaaaauca

SEQ ID NO: 268152 - RNA, 22 nt, Human
auuaguaaaacauuguauaugu

SEQ ID NO: 268153 - RNA, 22 nt, Human
acaaaugaaucauacauaaugu

SEQ ID NO: 268154 - RNA, 22 nt, Human
ugugggagaaggaagcaagcug

SEQ ID NO: 268155 - RNA, 22 nt, Human
gaggaggaaaggaguugaaaug

SEQ ID NO: 268156 - RNA, 23 nt, Human
uguaaaagcauuugucagccugg

SEQ ID NO: 268157 - RNA, 22 nt, Human
cagugcaguugguggcaggggu

SEQ ID NO: 268158 - RNA, 22 nt, Human
cuccuccuaaaugauucuuccu

SEQ ID NO: 268159 - RNA, 22 nt, Human
cagcagagaugagauuccuaua

SEQ ID NO: 268160 - RNA, 22 nt, Human
aggcccugcccagagcuccucg

SEQ ID NO: 268161 - RNA, 22 nt, Human
gcugccucaggcaccuccuggc

SEQ ID NO: 268162 - RNA, 22 nt, Human
uaggccuaugcagaaggugguu

SEQ ID NO: 268163 - RNA, 22 nt, Human
gaggcuggcagaaaagcacagg

SEQ ID NO: 268164 - RNA, 22 nt, Human
aaagugcauuguuuguguuccu

SEQ ID NO: 268165 - RNA, 22 nt, Human
auguagcagaagauguuuuccu

SEQ ID NO: 268166 - RNA, 22 nt, Human
ucugcccaaggcugucacuaga

SEQ ID NO: 268167 - RNA, 22 nt, Human
agagucuuuugucaguaauguu

SEQ ID NO: 268168 - RNA, 23 nt, Human
acagacuguauucaaaguaggac

SEQ ID NO: 268169 - RNA, 22 nt, Human
gacaacugagcagaggaaauga

SEQ ID NO: 268170 - RNA, 22 nt, Human
uguuuuguccuuuucuauauac

SEQ ID NO: 268171 - RNA, 22 nt, Human
cuucaugcucccauuuccuaca

SEQ ID NO: 268172 - RNA, 22 nt, Human
ccugccugacagagaagguuca

SEQ ID NO: 268173 - RNA, 22 nt, Human
ucaguuugaauguuagcacagu

SEQ ID NO: 268174 - RNA, 22 nt, Human
caagcuggagguuggagcuacu

SEQ ID NO: 268175 - RNA, 21 nt, Human
aaggagccuaggaggcucagg

SEQ ID NO: 268176 - RNA, 21 nt, Human
acucaggcaccaggggauggc

SEQ ID NO: 268177 - RNA, 22 nt, Human
auauuuuggggugaugugcauc

SEQ ID NO: 268178 - RNA, 19 nt, Human
uccuuccaguuccuggggu

SEQ ID NO: 268179 - RNA, 22 nt, Human
ugaggccuggacucugcaugga

SEQ ID NO: 268180 - RNA, 22 nt, Human
aucuuugaucuuuauugcuaag

SEQ ID NO: 268181 - RNA, 22 nt, Human
auuucuacauugaguuuuagca

SEQ ID NO: 268182 - RNA, 18 nt, Human
cagccucugauugguugc

SEQ ID NO: 268183 - RNA, 22 nt, Human
uggaugagggcugagcacuggg

SEQ ID NO: 268184 - RNA, 22 nt, Human
uucucccaucucagucuuacau

SEQ ID NO: 268185 - RNA, 21 nt, Human
ccagcugucuguccuuaggca

SEQ ID NO: 268186 - RNA, 22 nt, Human
uguuuuaaagccauugccuuuc

SEQ ID NO: 268187 - RNA, 22 nt, Human
gcugaagagagaugcguccagc

SEQ ID NO: 268188 - RNA, 21 nt, Human
aggcucagagaucaaacagua

SEQ ID NO: 268189 - RNA, 22 nt, Human
gucaaauauuaugcagcuugga

SEQ ID NO: 268190 - RNA, 22 nt, Human
uggcauguuuaauguacuguau

SEQ ID NO: 268191 - RNA, 22 nt, Human
aaauuuuagacuccugggucua

SEQ ID NO: 268192 - RNA, 22 nt, Human
ucagaacaauugggaaccauua

SEQ ID NO: 268193 - RNA, 22 nt, Human
uggcagaaagaaccaugugcaa

SEQ ID NO: 268194 - RNA, 22 nt, Human
uuggaauuugagaccaagaaaa

SEQ ID NO: 268195 - RNA, 22 nt, Human
cugggggcaauggucagagugu

SEQ ID NO: 268196 - RNA, 23 nt, Human
auguccaguuuacuucaggauga

SEQ ID NO: 268197 - RNA, 22 nt, Human
uauauucaaugauuaguaucag

SEQ ID NO: 268198 - RNA, 23 nt, Human
aguuuuuaauggucauagcugag

SEQ ID NO: 268199 - RNA, 22 nt, Human
uaacaagguaagccuggccaug

SEQ ID NO: 268200 - RNA, 17 nt, Human
ugguggcuggagucagg

SEQ ID NO: 268201 - RNA, 22 nt, Human
gagcuggggcagcuuaggagug

SEQ ID NO: 268202 - RNA, 22 nt, Human
uggaaagcaguucuuagaaucg

SEQ ID NO: 268203 - RNA, 22 nt, Human
gcauuagacccaagguauuuug

SEQ ID NO: 268204 - RNA, 22 nt, Human
ccuggguacgcagggcuccucu

SEQ ID NO: 268205 - RNA, 22 nt, Human
acauuuuacaguugucuggcua

SEQ ID NO: 268206 - RNA, 21 nt, Human
ucauauuucucuugcuauugu

SEQ ID NO: 268207 - RNA, 22 nt, Human
ggcccugggaugcucagcagug

SEQ ID NO: 268208 - RNA, 22 nt, Human
uuuauugaauuguaacccuauu

SEQ ID NO: 268209 - RNA, 22 nt, Human
guuuuccuacuguaucaucaaa

SEQ ID NO: 268210 - RNA, 22 nt, Human
gcgagccucuggaguccucugg

SEQ ID NO: 268211 - RNA, 22 nt, Human
aucuaaacccuacuuucuuucu

SEQ ID NO: 268212 - RNA, 20 nt, Human
aggguucccuuguucagcag

SEQ ID NO: 268213 - RNA, 22 nt, Human
gauuucuugauaauucaaaucc

SEQ ID NO: 268214 - RNA, 22 nt, Human
uccugaagaugaaaagagaggu

SEQ ID NO: 268215 - RNA, 22 nt, Human
auuauaaagaacaugugugugg

SEQ ID NO: 268216 - RNA, 22 nt, Human
gcaggccugguuuacaugguag

SEQ ID NO: 268217 - RNA, 22 nt, Human
aggcccagcuugaagugggaag

SEQ ID NO: 268218 - RNA, 22 nt, Human
uggcagccaucagagcaggggu

SEQ ID NO: 268219 - RNA, 22 nt, Human
cugggccucucagcucccgcgg

SEQ ID NO: 268220 - RNA, 22 nt, Human
cagucuggcucagcacaaaggg

SEQ ID NO: 268221 - RNA, 20 nt, Human
ggagcuggcauccagccucu

SEQ ID NO: 268222 - RNA, 22 nt, Human
gucucagggcagcuggaggagg

SEQ ID NO: 268223 - RNA, 22 nt, Human
caagaaauguuuacugagcauc

SEQ ID NO: 268224 - RNA, 22 nt, Human
agucacaucgauuauaaaauuu

SEQ ID NO: 268225 - RNA, 22 nt, Human
gcaagcaaaaugggagauuccc

SEQ ID NO: 268226 - RNA, 22 nt, Human
acugcccuguaacugccaggua

SEQ ID NO: 268227 - RNA, 22 nt, Human
cuucagcaacuuuggaauguuu

SEQ ID NO: 268228 - RNA, 22 nt, Human
auaaccuguuucagacauuugu

SEQ ID NO: 268229 - RNA, 22 nt, Human
ccagguguaggacaccaaggga

SEQ ID NO: 268230 - RNA, 22 nt, Human
ugagaggcagaauggugccugc

SEQ ID NO: 268231 - RNA, 22 nt, Human
uuugcagcaaggagagagcauu

SEQ ID NO: 268232 - RNA, 18 nt, Human
gucucaggaguggcacgu

SEQ ID NO: 268233 - RNA, 22 nt, Human
aacugucuugccuacucagcau

SEQ ID NO: 268234 - RNA, 22 nt, Human
cgcagguguucaguaaauguau

SEQ ID NO: 268235 - RNA, 22 nt, Human
acacagaagcuuuuucuauucc

SEQ ID NO: 268236 - RNA, 22 nt, Human
cucuccagaucugcugagccag

SEQ ID NO: 268237 - RNA, 22 nt, Human
ucaagcuuucugucucuuaugg

SEQ ID NO: 268238 - RNA, 22 nt, Human
cccagugugccccuccugcagc

SEQ ID NO: 268239 - RNA, 22 nt, Human
agugugacuacauuacaagagu

SEQ ID NO: 268240 - RNA, 22 nt, Human
uccaugagggacacuggaugcu

SEQ ID NO: 268241 - RNA, 22 nt, Human
aaauagacaggcuuaaauagga

SEQ ID NO: 268242 - RNA, 22 nt, Human
uacaaagaggcagcuccauuuu

SEQ ID NO: 268243 - RNA, 22 nt, Human
gcauucuuugaaugcuucuaau

SEQ ID NO: 268244 - RNA, 22 nt, Human
uaugcacauucacacaaaaaug

SEQ ID NO: 268245 - RNA, 22 nt, Human
cugggcccuauggaagaaaggg

SEQ ID NO: 268246 - RNA, 22 nt, Human
cuggcagauauuugcagacaug

SEQ ID NO: 268247 - RNA, 22 nt, Human
uuuucaaagacuggaggcugau

SEQ ID NO: 268248 - RNA, 22 nt, Human
gaguuacuggguggaaggcacu

SEQ ID NO: 268249 - RNA, 22 nt, Human
aaguacauuauaugagcagaau

SEQ ID NO: 268250 - RNA, 22 nt, Human
aaagacuaaccaguugucaaaa

SEQ ID NO: 268251 - RNA, 22 nt, Human
uuggaaggcccugccuagcagg

SEQ ID NO: 268252 - RNA, 22 nt, Human
uguccugggccggcgacugguc

SEQ ID NO: 268253 - RNA, 22 nt, Human
ucugggagggagccucagaauc

SEQ ID NO: 268254 - RNA, 22 nt, Human
ugccaggaguguagagugguuu

SEQ ID NO: 268255 - RNA, 22 nt, Human
ccaggugugccagcagggacug

SEQ ID NO: 268256 - RNA, 22 nt, Human
auauuauucuaguaacagugau

SEQ ID NO: 268257 - RNA, 22 nt, Human
uggcuucucugugguggcuccc

SEQ ID NO: 268258 - RNA, 22 nt, Human
aaguuuuaugggaagaugugca

SEQ ID NO: 268259 - RNA, 22 nt, Human
aggcucagccugggccuagagc

SEQ ID NO: 268260 - RNA, 22 nt, Human
uuucuuaugugcagagugagua

SEQ ID NO: 268261 - RNA, 21 nt, Human
acacaaaccuccucagccugg

SEQ ID NO: 268262 - RNA, 18 nt, Human
ccugccagucuggagcag

SEQ ID NO: 268263 - RNA, 22 nt, Human
uaaauguguuagucaugguuuu

SEQ ID NO: 268264 - RNA, 22 nt, Human
cagugagagagaacgcauucau

SEQ ID NO: 268265 - RNA, 22 nt, Human
augugcauuaaaugucaauguu

SEQ ID NO: 268266 - RNA, 21 nt, Human
cuccugggcuaagauauagug

SEQ ID NO: 268267 - RNA, 22 nt, Human
ggagcugaguggguuuauugau

SEQ ID NO: 268268 - RNA, 22 nt, Human
aguguuugucccguuagaaaug

SEQ ID NO: 268269 - RNA, 22 nt, Human
aauauguuccacuuaaagcugg

SEQ ID NO: 268270 - RNA, 20 nt, Human
aggcacaguuccuaguuggg

SEQ ID NO: 268271 - RNA, 22 nt, Human
uuguuuaucgcuugcucacaua

SEQ ID NO: 268272 - RNA, 22 nt, Human
cuuuggaacuguaaggagaugg

SEQ ID NO: 268273 - RNA, 22 nt, Human
ggcaggaggugaguggcgggug

SEQ ID NO: 268274 - RNA, 22 nt, Human
gcacaguauugcacaacucuag

SEQ ID NO: 268275 - RNA, 22 nt, Human
aauucuuggaaacauuacugga

SEQ ID NO: 268276 - RNA, 22 nt, Human
guagucuuggauuuuaaaaagu

SEQ ID NO: 268277 - RNA, 22 nt, Human
ccaggccugcauucccucucag

SEQ ID NO: 268278 - RNA, 22 nt, Human
ucauauuuaggccuuuaauuca

SEQ ID NO: 268279 - RNA, 22 nt, Human
aagaguuaugaaagcaaggcau

SEQ ID NO: 268280 - RNA, 22 nt, Human
aaucauucuuauuucacagcaa

SEQ ID NO: 268281 - RNA, 22 nt, Human
ucugacagguguucuuccaggc

SEQ ID NO: 268282 - RNA, 22 nt, Human
ucccaggcuggggccaggugac

SEQ ID NO: 268283 - RNA, 22 nt, Human
uucagugucaauuuuuaaauau

SEQ ID NO: 268284 - RNA, 22 nt, Human
gaggagcccagcaccaucacuu

SEQ ID NO: 268285 - RNA, 22 nt, Human
uaggaaaugcuccauugcauaa

SEQ ID NO: 268286 - RNA, 22 nt, Human
aagaacuuuaaagcacuuauga

SEQ ID NO: 268287 - RNA, 22 nt, Human
cuucagagugcagaagauuggg

SEQ ID NO: 268288 - RNA, 22 nt, Human
uuauaacaacaguuuacuuuaa

SEQ ID NO: 268289 - RNA, 22 nt, Human
gcugggcaccggagagacccca

SEQ ID NO: 268290 - RNA, 23 nt, Human
uauuagcaauucccacagagcag

SEQ ID NO: 268291 - RNA, 22 nt, Human
uauuagguagauuuuacugauu

SEQ ID NO: 268292 - RNA, 22 nt, Human
uacaagaaaguccaguggguuu

SEQ ID NO: 268293 - RNA, 22 nt, Human
cauaauccugguguagcccucu

SEQ ID NO: 268294 - RNA, 22 nt, Human
uccaaacacccuccaugcugca

SEQ ID NO: 268295 - RNA, 22 nt, Human
cagcucagugaugccuucacag

SEQ ID NO: 268296 - RNA, 23 nt, Human
gagaccagggccagcugugucau

SEQ ID NO: 268297 - RNA, 18 nt, Human
uggcagcaggaagccauu

SEQ ID NO: 268298 - RNA, 22 nt, Human
ggcccaguguggguggauguug

SEQ ID NO: 268299 - RNA, 22 nt, Human
cuuuuauuuugaauuaagggcu

SEQ ID NO: 268300 - RNA, 22 nt, Human
uccugguguaaugguaagcaug

SEQ ID NO: 268301 - RNA, 22 nt, Human
aaagagcccuuccaugacucuu

SEQ ID NO: 268302 - RNA, 20 nt, Human
agcccuguuuccuggagaga

SEQ ID NO: 268303 - RNA, 22 nt, Human
ucagcauaucuugagcuucaug

SEQ ID NO: 268304 - RNA, 22 nt, Human
uuucuuauauucugucauuguu

SEQ ID NO: 268305 - RNA, 22 nt, Human
gccuggaggggccaggguggua

SEQ ID NO: 268306 - RNA, 22 nt, Human
uauauguuucuuacaaaauauu

SEQ ID NO: 268307 - RNA, 16 nt, Human
uaucuagaguugaggu

SEQ ID NO: 268308 - RNA, 20 nt, Human
acagugcauggggggacagc

SEQ ID NO: 268309 - RNA, 22 nt, Human
cagaaccugugaauguguuauc

SEQ ID NO: 268310 - RNA, 22 nt, Human
gcugagacuggcagcaggaagu

SEQ ID NO: 268311 - RNA, 22 nt, Human
uucaauguuucuuaucaaguug

SEQ ID NO: 268312 - RNA, 22 nt, Human
cugggcucccucaugugucugc

SEQ ID NO: 268313 - RNA, 21 nt, Human
ucugacuugaucuauucuccc

SEQ ID NO: 268314 - RNA, 22 nt, Human
aagcuggccuguaccugcugag

SEQ ID NO: 268315 - RNA, 22 nt, Human
uucaacuuuggagauuuaauaa

SEQ ID NO: 268316 - RNA, 22 nt, Human
cagaggcugccagccaugugca

SEQ ID NO: 268317 - RNA, 22 nt, Human
uagcaacaugguuaucacauua

SEQ ID NO: 268318 - RNA, 22 nt, Human
aagggcauugaggcugagagac

SEQ ID NO: 268319 - RNA, 22 nt, Human
cccaggaggcagagcuugcagu

SEQ ID NO: 268320 - RNA, 22 nt, Human
aaagaguucuuguagcuuugag

SEQ ID NO: 268321 - RNA, 22 nt, Human
uuggccuugucuggucuucucc

SEQ ID NO: 268322 - RNA, 22 nt, Human
ggcccagccggcgagucucgcg

SEQ ID NO: 268323 - RNA, 18 nt, Human
cucuuucuuuggcacaaa

SEQ ID NO: 268324 - RNA, 22 nt, Human
gcaugcagagucccucugcauu

SEQ ID NO: 268325 - RNA, 22 nt, Human
gcuggagaaacugcagcugagg

SEQ ID NO: 268326 - RNA, 22 nt, Human
aggggagaaaaaugccuucugu

SEQ ID NO: 268327 - RNA, 22 nt, Human
ugcaggugucuccagggcaggu

SEQ ID NO: 268328 - RNA, 22 nt, Human
ccaagcaaggcuaauucacuug

SEQ ID NO: 268329 - RNA, 22 nt, Human
auaaacaagacuggccaacuuu

SEQ ID NO: 268330 - RNA, 22 nt, Human
cuccagcugaguaagaacacua

SEQ ID NO: 268331 - RNA, 22 nt, Human
uugcauguuauuuaaucuguau

SEQ ID NO: 268332 - RNA, 22 nt, Human
aacaguaggcaucacauaauga

SEQ ID NO: 268333 - RNA, 22 nt, Human
ggaugugaaucugggcugagac

SEQ ID NO: 268334 - RNA, 22 nt, Human
uccucagaugcucuuggacgcc

SEQ ID NO: 268335 - RNA, 22 nt, Human
uauggaaaguguuuucuucugu

SEQ ID NO: 268336 - RNA, 22 nt, Human
aaggaaaggaugagcaugcauu

SEQ ID NO: 268337 - RNA, 22 nt, Human
agcagcaggaggcuguccacca

SEQ ID NO: 268338 - RNA, 22 nt, Human
auggcuucuagcauugucacaa

SEQ ID NO: 268339 - RNA, 22 nt, Human
aaucaaaaccuacagagguaau

SEQ ID NO: 268340 - RNA, 22 nt, Human
agcugguucauggacugccugg

SEQ ID NO: 268341 - RNA, 22 nt, Human
uacuuucuuucugauccuuaug

SEQ ID NO: 268342 - RNA, 22 nt, Human
cuuuccaaugucacuaugaauc

SEQ ID NO: 268343 - RNA, 22 nt, Human
gcaaggaagagcagguggugcu

SEQ ID NO: 268344 - RNA, 22 nt, Human
ccuuuagaauucugccccuccu

SEQ ID NO: 268345 - RNA, 22 nt, Human
auuugcuggugaaauagugaca

SEQ ID NO: 268346 - RNA, 22 nt, Human
ggcuuccuaauacucccuacac

SEQ ID NO: 268347 - RNA, 22 nt, Human
uuaacauuguccuuagcagauu

SEQ ID NO: 268348 - RNA, 23 nt, Human
agaagcugggagccuggggaugg

SEQ ID NO: 268349 - RNA, 22 nt, Human
ucugcaggaugcaaaguguaca

SEQ ID NO: 268350 - RNA, 22 nt, Human
aaagucauguuuuuguuuagca

SEQ ID NO: 268351 - RNA, 22 nt, Human
aauggcacuuuauaaauguuaa

SEQ ID NO: 268352 - RNA, 22 nt, Human
gggcuucucuuuagugagcuga

SEQ ID NO: 268353 - RNA, 22 nt, Human
uucuggaaaugcacaacuaauu

SEQ ID NO: 268354 - RNA, 22 nt, Human
acugggaaggaaaggaauguaa

SEQ ID NO: 268355 - RNA, 22 nt, Human
ccugaaaugaguucugcucacu

SEQ ID NO: 268356 - RNA, 22 nt, Human
ccuggcuggacuggaccguggc

SEQ ID NO: 268357 - RNA, 22 nt, Human
acuuucugucaucuagacaagu

SEQ ID NO: 268358 - RNA, 22 nt, Human
auacauucagcagugcucauga

SEQ ID NO: 268359 - RNA, 22 nt, Human
uguaaccaugaugagcagguau

SEQ ID NO: 268360 - RNA, 22 nt, Human
auuucccagcuuugaucaguuu

SEQ ID NO: 268361 - RNA, 22 nt, Human
uccuggcuaaugcugcugaugg

SEQ ID NO: 268362 - RNA, 22 nt, Human
uuuucuaaaagaagucacugau

SEQ ID NO: 268363 - RNA, 22 nt, Human
cuuccuggaugaacaguagaaa

SEQ ID NO: 268364 - RNA, 22 nt, Human
auauaaagaaguggaaaaugag

SEQ ID NO: 268365 - RNA, 22 nt, Human
uggcuggcaguaggcuaguggc

SEQ ID NO: 268366 - RNA, 22 nt, Human
ugcuccaggugugccucucaug

SEQ ID NO: 268367 - RNA, 22 nt, Human
uccuggguccugggaagcccug

SEQ ID NO: 268368 - RNA, 22 nt, Human
accagcucucuagcccuggucc

SEQ ID NO: 268369 - RNA, 22 nt, Human
ggguggagcuuggacaccagua

SEQ ID NO: 268370 - RNA, 22 nt, Human
cucugugaaccccuccuuucuu

SEQ ID NO: 268371 - RNA, 22 nt, Human
uuacaagcagcuacauaucaca

SEQ ID NO: 268372 - RNA, 22 nt, Human
cugccaccaaauagcugcauga

SEQ ID NO: 268373 - RNA, 22 nt, Human
agcaggugcguuacuucacucu

SEQ ID NO: 268374 - RNA, 22 nt, Human
ucuggaugaagacccagaggcu

SEQ ID NO: 268375 - RNA, 22 nt, Human
uguagaaaauuggagcauucau

SEQ ID NO: 268376 - RNA, 22 nt, Human
caucauuguuagggacucuaac

SEQ ID NO: 268377 - RNA, 22 nt, Human
agcccagagacaaugcucagua

SEQ ID NO: 268378 - RNA, 22 nt, Human
cucugaaagcaaaacuagagaa

SEQ ID NO: 268379 - RNA, 22 nt, Human
aaggaaaugugccugacacugc

SEQ ID NO: 268380 - RNA, 22 nt, Human
ucaagauguccagugccuauaa

SEQ ID NO: 268381 - RNA, 22 nt, Human
uucaauaucucuaagaaugagg

SEQ ID NO: 268382 - RNA, 22 nt, Human
ugcuggggucucuccggugccc

SEQ ID NO: 268383 - RNA, 22 nt, Human
agugaaggaaguuugucuuggg

SEQ ID NO: 268384 - RNA, 22 nt, Human
ugaggaaagaaaggcaugcaug

SEQ ID NO: 268385 - RNA, 22 nt, Human
ugcaggucauguggcgggacug

SEQ ID NO: 268386 - RNA, 22 nt, Human
cuccccugagcauagacucugu

SEQ ID NO: 268387 - RNA, 22 nt, Human
caggcaccaacuuccuggggag

SEQ ID NO: 268388 - RNA, 22 nt, Human
acauugugauccgacugauuaa

SEQ ID NO: 268389 - RNA, 22 nt, Human
aacaggcuccaugaacaacgug

SEQ ID NO: 268390 - RNA, 22 nt, Human
uggcuggggagccccgacuccc

SEQ ID NO: 268391 - RNA, 22 nt, Human
aaaugcauugguuucuacuugu

SEQ ID NO: 268392 - RNA, 22 nt, Human
ucuauauuccagauacagauua

SEQ ID NO: 268393 - RNA, 22 nt, Human
guaggcagucucucaggugauc

SEQ ID NO: 268394 - RNA, 22 nt, Human
acaggcuuagggcuugggcccg

SEQ ID NO: 268395 - RNA, 22 nt, Human
cccucugccugcgcccuggugu

SEQ ID NO: 268396 - RNA, 22 nt, Human
ucuagaaugacaugcaagagua

SEQ ID NO: 268397 - RNA, 22 nt, Human
cccuggcucuucaccaccugcc

SEQ ID NO: 268398 - RNA, 22 nt, Human
gucccuggggaaucagcuggag

SEQ ID NO: 268399 - RNA, 22 nt, Human
gggcacaggaauuugggaugug

SEQ ID NO: 268400 - RNA, 22 nt, Human
cucuccugguguggaggacagg

SEQ ID NO: 268401 - RNA, 22 nt, Human
aauaugcagcaugaugaaguaa

SEQ ID NO: 268402 - RNA, 22 nt, Human
gcagggcugggacuuacuggua

SEQ ID NO: 268403 - RNA, 22 nt, Human
aaguuucucaauggcaacuggg

SEQ ID NO: 268404 - RNA, 22 nt, Human
ugaggcaggaguucaggcugcg

SEQ ID NO: 268405 - RNA, 22 nt, Human
aggucugagcuccuuccucuga

SEQ ID NO: 268406 - RNA, 22 nt, Human
aaauaguucagcuuguaaaccc

SEQ ID NO: 268407 - RNA, 22 nt, Human
auucuucaucacuaccuuguga

SEQ ID NO: 268408 - RNA, 22 nt, Human
aucuggagcucugcacaccugg

SEQ ID NO: 268409 - RNA, 22 nt, Human
agaguguguuccccaagaaaga

SEQ ID NO: 268410 - RNA, 22 nt, Human
aacaucuccaaccuacauccac

SEQ ID NO: 268411 - RNA, 20 nt, Human
ucaggcuccgcauuaacuua

SEQ ID NO: 268412 - RNA, 22 nt, Human
aaguguguuuucaguguacuua

SEQ ID NO: 268413 - RNA, 22 nt, Human
uucuccagacaggcagagggaa

SEQ ID NO: 268414 - RNA, 22 nt, Human
cauuacaaccccaaauuacaaa

SEQ ID NO: 268415 - RNA, 22 nt, Human
gauuuacaaagcucucuagugu

SEQ ID NO: 268416 - RNA, 22 nt, Human
gcaggagccaggccgagcuggu

SEQ ID NO: 268417 - RNA, 22 nt, Human
gagacacagcagauauucaauc

SEQ ID NO: 268418 - RNA, 22 nt, Human
acaggcaagaggaaagcaagua

SEQ ID NO: 268419 - RNA, 22 nt, Human
gcuccaguggauacagcagugg

SEQ ID NO: 268420 - RNA, 22 nt, Human
caggaggcagcgcucucaggac

SEQ ID NO: 268421 - RNA, 22 nt, Human
uguuugaaaaguggagauuuau

SEQ ID NO: 268422 - RNA, 22 nt, Human
caagauuuaagagucagccuug

SEQ ID NO: 268423 - RNA, 22 nt, Human
ucagggagaggugagagccugu

SEQ ID NO: 268424 - RNA, 22 nt, Human
agucacauagcucugguuucuu

SEQ ID NO: 268425 - RNA, 22 nt, Human
agagcccaggcaggcauccagg

SEQ ID NO: 268426 - RNA, 22 nt, Human
acaggcacugucaagucaugaa

SEQ ID NO: 268427 - RNA, 22 nt, Human
guuagagggcugccuuuuguuu

SEQ ID NO: 268428 - RNA, 22 nt, Human
aucugagguauaugacuggcua

SEQ ID NO: 268429 - RNA, 22 nt, Human
gugaauuacauguauuuuuaag

SEQ ID NO: 268430 - RNA, 22 nt, Human
uugagcaaugcugcaaagagau

SEQ ID NO: 268431 - RNA, 22 nt, Human
caaguuuacaauguguaugugu

SEQ ID NO: 268432 - RNA, 22 nt, Human
gacacagacaguuagagguaau

SEQ ID NO: 268433 - RNA, 22 nt, Human
gugggcuuguuuugaugagauc

SEQ ID NO: 268434 - RNA, 22 nt, Human
cagcaucucauucauucauguu

SEQ ID NO: 268435 - RNA, 21 nt, Human
uucucagagucuauuacaguu

SEQ ID NO: 268436 - RNA, 22 nt, Human
aggcuggauuuauggggacuuc

SEQ ID NO: 268437 - RNA, 22 nt, Human
ccccacaggugucugaggcagg

SEQ ID NO: 268438 - RNA, 22 nt, Human
gaaggaagucauuagugcagac

SEQ ID NO: 268439 - RNA, 22 nt, Human
augagggaagcucacgugucca

SEQ ID NO: 268440 - RNA, 22 nt, Human
ucagugcugcuuuaugacaguu

SEQ ID NO: 268441 - RNA, 22 nt, Human
ucuggagaaaguugaguuugug

SEQ ID NO: 268442 - RNA, 23 nt, Human
agcuggguggccugcgugaagcu

SEQ ID NO: 268443 - RNA, 22 nt, Human
accugccuaucagcugccugcu

SEQ ID NO: 268444 - RNA, 23 nt, Human
ucagaguagcaauuuuucucucc

SEQ ID NO: 268445 - RNA, 22 nt, Human
agcuagcaaauagcauguagga

SEQ ID NO: 268446 - RNA, 22 nt, Human
uauagcaacuccaaagagacuu

SEQ ID NO: 268447 - RNA, 22 nt, Human
guuuuacaaaugacggcauuca

SEQ ID NO: 268448 - RNA, 22 nt, Human
guugaaaauacagauuccuagg

SEQ ID NO: 268449 - RNA, 22 nt, Human
ggcucaggccuguaauccuagc

SEQ ID NO: 268450 - RNA, 22 nt, Human
ucuguucaguugauuagacaga

SEQ ID NO: 268451 - RNA, 22 nt, Human
ucagcuggugaguggauagaca

SEQ ID NO: 268452 - RNA, 22 nt, Human
cugccagcaagcuacccuggca

SEQ ID NO: 268453 - RNA, 22 nt, Human
acuuguuuggucucauguuuaa

SEQ ID NO: 268454 - RNA, 22 nt, Human
gcacagagccugguaccgagaa

SEQ ID NO: 268455 - RNA, 22 nt, Human
ugcccagccuaaacuuggcaag

SEQ ID NO: 268456 - RNA, 22 nt, Human
uagcuacaaucacuguccuuug

SEQ ID NO: 268457 - RNA, 22 nt, Human
guggcugcugguacucugggaa

SEQ ID NO: 268458 - RNA, 22 nt, Human
auguguccugcugugucacaca

SEQ ID NO: 268459 - RNA, 22 nt, Human
aguguagacauaggucuggucu

SEQ ID NO: 268460 - RNA, 22 nt, Human
auucuuauuauaguaaaacagu

SEQ ID NO: 268461 - RNA, 22 nt, Human
gccagccagggaagggagagac

SEQ ID NO: 268462 - RNA, 22 nt, Human
gaugguccuccugcugccucuc

SEQ ID NO: 268463 - RNA, 22 nt, Human
agagugagggggcacugagacg

SEQ ID NO: 268464 - RNA, 20 nt, Human
cuguggcucaugcaucugcc

SEQ ID NO: 268465 - RNA, 22 nt, Human
cuggcuggucaucagcaguacg

SEQ ID NO: 268466 - RNA, 22 nt, Human
ucaaaauuuuauuucucaagga

SEQ ID NO: 268467 - RNA, 18 nt, Human
uugauucauauuaaccau

SEQ ID NO: 268468 - RNA, 22 nt, Human
acaggcucgugcgcgcacgugu

SEQ ID NO: 268469 - RNA, 22 nt, Human
gcccacauccacuagacaugca

SEQ ID NO: 268470 - RNA, 21 nt, Human
cccaggagaagaaaagaugca

SEQ ID NO: 268471 - RNA, 22 nt, Human
gcaagacaugucuaagguuuaa

SEQ ID NO: 268472 - RNA, 22 nt, Human
gugcugacaggagccuggcggu

SEQ ID NO: 268473 - RNA, 19 nt, Human
cugggccugcaugguuguu

SEQ ID NO: 268474 - RNA, 22 nt, Human
gcugucuuuccccugcuccaga

SEQ ID NO: 268475 - RNA, 22 nt, Human
ccagggcagcagaauuggggca

SEQ ID NO: 268476 - RNA, 22 nt, Human
cucagucugucuugucuguguu

SEQ ID NO: 268477 - RNA, 22 nt, Human
uuugguaaguacccaccugggu

SEQ ID NO: 268478 - RNA, 22 nt, Human
cacucugauuccacaaggcucc

SEQ ID NO: 268479 - RNA, 22 nt, Human
gcagggcagcugaagcuaggug

SEQ ID NO: 268480 - RNA, 22 nt, Human
gagugcaguaugagaggcugcu

SEQ ID NO: 268481 - RNA, 22 nt, Human
gguggagagcuggaugagaggu

SEQ ID NO: 268482 - RNA, 22 nt, Human
uauuggucaaguugaggacccu

SEQ ID NO: 268483 - RNA, 22 nt, Human
aggaggccccuccuggguugcu

SEQ ID NO: 268484 - RNA, 22 nt, Human
cugcagugaggauucuuaggug

SEQ ID NO: 268485 - RNA, 22 nt, Human
ucaucuuuguaucccuaacaca

SEQ ID NO: 268486 - RNA, 22 nt, Human
aaaguuagaaugauaucaacga

SEQ ID NO: 268487 - RNA, 22 nt, Human
uugagggaaauaacugaugcuu

SEQ ID NO: 268488 - RNA, 22 nt, Human
gcagagcugucuaagucacuuc

SEQ ID NO: 268489 - RNA, 22 nt, Human
guggcccaggcuuggcgcuggc

SEQ ID NO: 268490 - RNA, 22 nt, Human
uuggccuuguacaucauauuaa

SEQ ID NO: 268491 - RNA, 19 nt, Human
accugccaugacagccuga

SEQ ID NO: 268492 - RNA, 22 nt, Human
aagucagagaucaaggugucua

SEQ ID NO: 268493 - RNA, 22 nt, Human
ugcccagccaguuuaugguaau

SEQ ID NO: 268494 - RNA, 22 nt, Human
augcaauauguguuucuguuua

SEQ ID NO: 268495 - RNA, 21 nt, Human
cuacccucacucccauuccuc

SEQ ID NO: 268496 - RNA, 21 nt, Human
gggccuggcugcgcaggacgg

SEQ ID NO: 268497 - RNA, 22 nt, Human
agaggcccucucucuccugaug

SEQ ID NO: 268498 - RNA, 21 nt, Human
gggcaggucucugaugucaac

SEQ ID NO: 268499 - RNA, 22 nt, Human
aggcucagggacggggccccuu

SEQ ID NO: 268500 - RNA, 22 nt, Human
gugugcagaacagggagugggu

SEQ ID NO: 268501 - RNA, 22 nt, Human
gagucagaccgacugggcucau

SEQ ID NO: 268502 - RNA, 22 nt, Human
cauagugacucaugccuauaau

SEQ ID NO: 268503 - RNA, 22 nt, Human
cacacagggagaaagaaagccu

SEQ ID NO: 268504 - RNA, 20 nt, Human
caggucuucauguggcuguc

SEQ ID NO: 268505 - RNA, 22 nt, Human
uacaggcucuugucagacguau

SEQ ID NO: 268506 - RNA, 22 nt, Human
ggccccagcagacccuccucug

SEQ ID NO: 268507 - RNA, 22 nt, Human
aaguacuucuagauggauaauc

SEQ ID NO: 268508 - RNA, 22 nt, Human
ucuggaugauaugugaacuuga

SEQ ID NO: 268509 - RNA, 22 nt, Human
cagccuggccugggacugcuga

SEQ ID NO: 268510 - RNA, 22 nt, Human
agacugaauaacaagcaaauaa

SEQ ID NO: 268511 - RNA, 22 nt, Human
guuagggaagcgcuguguucuu

SEQ ID NO: 268512 - RNA, 22 nt, Human
cagcacuuggugccauugagug

SEQ ID NO: 268513 - RNA, 22 nt, Human
acuugcaagguugcaguuagaa

SEQ ID NO: 268514 - RNA, 22 nt, Human
aguguuugggggccuuguaaca

SEQ ID NO: 268515 - RNA, 22 nt, Human
gauauugugaugaugucuuugg

SEQ ID NO: 268516 - RNA, 22 nt, Human
ucuaagaggcaucaagacaagc

SEQ ID NO: 268517 - RNA, 22 nt, Human
uuugagguuagcuagcagauca

SEQ ID NO: 268518 - RNA, 22 nt, Human
uuccaggauagcuuucaggaau

SEQ ID NO: 268519 - RNA, 22 nt, Human
cacaucagggcugcuugggggu

SEQ ID NO: 268520 - RNA, 22 nt, Human
aggcugagccugggcguggugg

SEQ ID NO: 268521 - RNA, 22 nt, Human
aagagacaagaauuccaacgcu

SEQ ID NO: 268522 - RNA, 22 nt, Human
acaaaugucuccucuuuuguua

SEQ ID NO: 268523 - RNA, 22 nt, Human
gcaucucuuacccacgagccag

SEQ ID NO: 268524 - RNA, 19 nt, Human
cuccaggauggcugggcga

SEQ ID NO: 268525 - RNA, 22 nt, Human
caugcaaacacguaaacauuca

SEQ ID NO: 268526 - RNA, 22 nt, Human
aacugcaauuacuuuugcgcca

SEQ ID NO: 268527 - RNA, 22 nt, Human
uccuggccgccgcguggggccg

SEQ ID NO: 268528 - RNA, 22 nt, Human
uuaauaugcugcuucuugaaaa

SEQ ID NO: 268529 - RNA, 22 nt, Human
ccuggcagcagcacaugccuuc

SEQ ID NO: 268530 - RNA, 22 nt, Human
caaagucagccagcuaguaggu

SEQ ID NO: 268531 - RNA, 22 nt, Human
caguauaugcucuuucaucaaa

SEQ ID NO: 268532 - RNA, 22 nt, Human
agugaauuuaaaacacugagga

SEQ ID NO: 268533 - RNA, 22 nt, Human
auucuuuuaaauggcaguagua

SEQ ID NO: 268534 - RNA, 23 nt, Human
ccuggcuucauucucuuagggug

SEQ ID NO: 268535 - RNA, 22 nt, Human
cuccuccagcuuccaguggcuc

SEQ ID NO: 268536 - RNA, 22 nt, Human
acauuucuauagugcaucuguu

SEQ ID NO: 268537 - RNA, 22 nt, Human
uggagcuccacuggaaaaaugu

SEQ ID NO: 268538 - RNA, 22 nt, Human
uggcuggggccugaauccugca

SEQ ID NO: 268539 - RNA, 22 nt, Human
cagaaugcagaauguucauuuu

SEQ ID NO: 268540 - RNA, 22 nt, Human
agagcccagugacaucagcaca

SEQ ID NO: 268541 - RNA, 22 nt, Human
ucacaucuaauucgguuagguu

SEQ ID NO: 268542 - RNA, 22 nt, Human
caggagcucaagaccacccugg

SEQ ID NO: 268543 - RNA, 22 nt, Human
ccaucuugggucacugcccccc

SEQ ID NO: 268544 - RNA, 22 nt, Human
aggaaugugacuauuuuuucag

SEQ ID NO: 268545 - RNA, 22 nt, Human
gagaaucuggguuuuggcuauc

SEQ ID NO: 268546 - RNA, 22 nt, Human
uuugcaaauauguguuucuauu

SEQ ID NO: 268547 - RNA, 22 nt, Human
aaagguaucauguccauacagu

SEQ ID NO: 268548 - RNA, 22 nt, Human
ugaaacaguagucuguggguuu

SEQ ID NO: 268549 - RNA, 19 nt, Human
guucaaacacugauucagc

SEQ ID NO: 268550 - RNA, 22 nt, Human
aacagcaugcuggguaacauug

SEQ ID NO: 268551 - RNA, 22 nt, Human
ccugguggcuucuggguggacg

SEQ ID NO: 268552 - RNA, 22 nt, Human
cauagaaucauagcacauuuga

SEQ ID NO: 268553 - RNA, 22 nt, Human
uaaguguugaucugagugcuaa

SEQ ID NO: 268554 - RNA, 22 nt, Human
ccucugccaccucccacgaggc

SEQ ID NO: 268555 - RNA, 22 nt, Human
gcccaggaguucaaggcugcag

SEQ ID NO: 268556 - RNA, 22 nt, Human
ucaggaaagaguaauguauaca

SEQ ID NO: 268557 - RNA, 22 nt, Human
aaauggauguugaguuaaaugu

SEQ ID NO: 268558 - RNA, 21 nt, Human
uaagacaguaugaauacuuuc

SEQ ID NO: 268559 - RNA, 22 nt, Human
gugaggcuacucagcuguccga

SEQ ID NO: 268560 - RNA, 22 nt, Human
auuucuguggcuucauucuccu

SEQ ID NO: 268561 - RNA, 18 nt, Human
caggccucuugaucuucc

SEQ ID NO: 268562 - RNA, 22 nt, Human
uuuggaguuuaacaacuugaag

SEQ ID NO: 268563 - RNA, 22 nt, Human
gggcagugucggggcccaggga

SEQ ID NO: 268564 - RNA, 22 nt, Human
cauagacaaagaucagaagagu

SEQ ID NO: 268565 - RNA, 22 nt, Human
cagaggggcugacacccuuggc

SEQ ID NO: 268566 - RNA, 21 nt, Human
ugcuggaaaaagugguucuag

SEQ ID NO: 268567 - RNA, 22 nt, Human
gucaggacaggcucuggacuga

SEQ ID NO: 268568 - RNA, 22 nt, Human
acaugcaaaaauauauuuauga

SEQ ID NO: 268569 - RNA, 22 nt, Human
acggugcuggguauugggguuc

SEQ ID NO: 268570 - RNA, 22 nt, Human
uagugcauaccuaacauuuuug

SEQ ID NO: 268571 - RNA, 22 nt, Human
ggcacagcacagagcacaugua

SEQ ID NO: 268572 - RNA, 22 nt, Human
aaacucuggagauguuuaugca

SEQ ID NO: 268573 - RNA, 22 nt, Human
ucccuccuuaauaagaggucug

SEQ ID NO: 268574 - RNA, 21 nt, Human
gcaaccagaccacagggcagu

SEQ ID NO: 268575 - RNA, 22 nt, Human
gauugcugugcgccccaggugu

SEQ ID NO: 268576 - RNA, 22 nt, Human
gcuuucugguucucaaagcacu

SEQ ID NO: 268577 - RNA, 22 nt, Human
uugcuuuauuggguuuacugcc

SEQ ID NO: 268578 - RNA, 22 nt, Human
ugucaucuggccugauuggugu

SEQ ID NO: 268579 - RNA, 22 nt, Human
aaugguaucaccucacagaauu

SEQ ID NO: 268580 - RNA, 22 nt, Human
gaauucugucgcuuacuagaug

SEQ ID NO: 268581 - RNA, 22 nt, Human
uggcaagaaacugaggccugcu

SEQ ID NO: 268582 - RNA, 22 nt, Human
caaaagcaaagucccugaaugu

SEQ ID NO: 268583 - RNA, 22 nt, Human
uuacuucuuacaaaagaaauau

SEQ ID NO: 268584 - RNA, 22 nt, Human
gagcaagauccuguuuuucuau

SEQ ID NO: 268585 - RNA, 21 nt, Human
ugguggagugugcugagcaug

SEQ ID NO: 268586 - RNA, 20 nt, Human
ugccagggccagcagaggcu

SEQ ID NO: 268587 - RNA, 22 nt, Human
uucuaaacugaaguauuuuaaa

SEQ ID NO: 268588 - RNA, 22 nt, Human
aggugcugggcagcagucauug

SEQ ID NO: 268589 - RNA, 22 nt, Human
uggagcagagaugguggccuuc

SEQ ID NO: 268590 - RNA, 22 nt, Human
gucuccagagguuacauccugu

SEQ ID NO: 268591 - RNA, 22 nt, Human
aagauacaaaugucaauauugg

SEQ ID NO: 268592 - RNA, 22 nt, Human
cuuguauuaagcuuagagaggc

SEQ ID NO: 268593 - RNA, 22 nt, Human
gcugcaggcuguggcaggggag

SEQ ID NO: 268594 - RNA, 22 nt, Human
auuuccuauccuggucuuaaaa

SEQ ID NO: 268595 - RNA, 22 nt, Human
ugguaaagaaggcuagaucuga

SEQ ID NO: 268596 - RNA, 22 nt, Human
ugggcacuccuggggacagcug

SEQ ID NO: 268597 - RNA, 22 nt, Human
gggccugcagguucugagaggc

SEQ ID NO: 268598 - RNA, 22 nt, Human
aggaaagacuggggccccagaa

SEQ ID NO: 268599 - RNA, 22 nt, Human
gcuggcuuaauguagcuaaaaa

SEQ ID NO: 268600 - RNA, 22 nt, Human
uuuuaaaggauacucuugucua

SEQ ID NO: 268601 - RNA, 19 nt, Human
guucuuuucaccucugugc

SEQ ID NO: 268602 - RNA, 22 nt, Human
ucaggagcucuucccuggugug

SEQ ID NO: 268603 - RNA, 22 nt, Human
acagcuuuucugauagauccug

SEQ ID NO: 268604 - RNA, 22 nt, Human
ccacagagucuuccuucucuuc

SEQ ID NO: 268605 - RNA, 22 nt, Human
agugcuuuccuucuugugacau

SEQ ID NO: 268606 - RNA, 22 nt, Human
auggcugcuuacaaaaacugug

SEQ ID NO: 268607 - RNA, 22 nt, Human
ccuguccccucacaaugccacu

SEQ ID NO: 268608 - RNA, 22 nt, Human
uuuauaaacaguaccacggugc

SEQ ID NO: 268609 - RNA, 21 nt, Human
cuguccucagauguggacgag

SEQ ID NO: 268610 - RNA, 22 nt, Human
gucaacaagguuugcuuaucuu

SEQ ID NO: 268611 - RNA, 22 nt, Human
caccagggccccaggcugugcc

SEQ ID NO: 268612 - RNA, 22 nt, Human
ucugcaccuccugcuugcuaga

SEQ ID NO: 268613 - RNA, 21 nt, Human
uuugacuccucauuuuuauau

SEQ ID NO: 268614 - RNA, 22 nt, Human
aaggugucggguuagcucagcc

SEQ ID NO: 268615 - RNA, 23 nt, Human
cagugcagggcaacucagacucc

SEQ ID NO: 268616 - RNA, 22 nt, Human
aaauacauaaagguuguaccag

SEQ ID NO: 268617 - RNA, 22 nt, Human
aaggcuuuugggaauuuucaac

SEQ ID NO: 268618 - RNA, 22 nt, Human
cugggcucagugucucacuccu

SEQ ID NO: 268619 - RNA, 22 nt, Human
gccucccuccaccacugcaggu

SEQ ID NO: 268620 - RNA, 22 nt, Human
acagcuuuguguuaaugggaag

SEQ ID NO: 268621 - RNA, 22 nt, Human
ucacagagagguuaagcaguug

SEQ ID NO: 268622 - RNA, 22 nt, Human
ucauuagaaaugcagauucuca

SEQ ID NO: 268623 - RNA, 22 nt, Human
cagugguuauacuuacuguuuc

SEQ ID NO: 268624 - RNA, 22 nt, Human
uaaaacuuaacuauccagauua

SEQ ID NO: 268625 - RNA, 22 nt, Human
ccugaggggcugcaggccagcu

SEQ ID NO: 268626 - RNA, 22 nt, Human
ggcagcuccucaaaaaauuaaa

SEQ ID NO: 268627 - RNA, 22 nt, Human
aacagccucagugagauuagga

SEQ ID NO: 268628 - RNA, 22 nt, Human
uggagccaggguagaagcagag

SEQ ID NO: 268629 - RNA, 22 nt, Human
acaguucugcaagauauuuuuu

SEQ ID NO: 268630 - RNA, 22 nt, Human
aagcaugggaaucccacagggu

SEQ ID NO: 268631 - RNA, 19 nt, Human
guccaguguuuuccaguca

SEQ ID NO: 268632 - RNA, 22 nt, Human
accugggaggcagagguugcag

SEQ ID NO: 268633 - RNA, 22 nt, Human
ccuggaaucuggaguuggaauc

SEQ ID NO: 268634 - RNA, 22 nt, Human
cacaugcaucugucauguuugg

SEQ ID NO: 268635 - RNA, 22 nt, Human
uggguccacuucugcacugugg

SEQ ID NO: 268636 - RNA, 22 nt, Human
cacagcccugcgccccaguuug

SEQ ID NO: 268637 - RNA, 22 nt, Human
uuuggucaaauauuauccugag

SEQ ID NO: 268638 - RNA, 22 nt, Human
uaguaacugguugaacaacugu

SEQ ID NO: 268639 - RNA, 22 nt, Human
acacaaugucaucauaauguca

SEQ ID NO: 268640 - RNA, 22 nt, Human
aagaauguggguggauaugaug

SEQ ID NO: 268641 - RNA, 22 nt, Human
uugaaugaauucuacuuccaga

SEQ ID NO: 268642 - RNA, 22 nt, Human
gcauggcugguguccugaggga

SEQ ID NO: 268643 - RNA, 22 nt, Human
aggcuucuaggaaacuuucugg

SEQ ID NO: 268644 - RNA, 22 nt, Human
uuagagcugauaguacacuggu

SEQ ID NO: 268645 - RNA, 19 nt, Human
uggcuuccugacucucauc

SEQ ID NO: 268646 - RNA, 22 nt, Human
ggcugccacgucgaggguccaa

SEQ ID NO: 268647 - RNA, 22 nt, Human
gagaacacaugcagacugggua

SEQ ID NO: 268648 - RNA, 22 nt, Human
ccucaggcugcucacacuuguc

SEQ ID NO: 268649 - RNA, 22 nt, Human
gaggcugguaggaaaggaaaca

SEQ ID NO: 268650 - RNA, 22 nt, Human
agaaucuucgguaacuggaaga

SEQ ID NO: 268651 - RNA, 22 nt, Human
augcaggguuauuucaaaaaua

SEQ ID NO: 268652 - RNA, 22 nt, Human
gagcuacacugauucauuuguu

SEQ ID NO: 268653 - RNA, 22 nt, Human
aaggccagagcagacuggaguu

SEQ ID NO: 268654 - RNA, 22 nt, Human
ggcagggcuugucucugugaug

SEQ ID NO: 268655 - RNA, 22 nt, Human
ugcaaaaagagcgaggagcccu

SEQ ID NO: 268656 - RNA, 22 nt, Human
ugucacagagcaacuauuucuu

SEQ ID NO: 268657 - RNA, 22 nt, Human
gaaugauuugguuguuuagauu

SEQ ID NO: 268658 - RNA, 22 nt, Human
agauaacugguuuacauuauug

SEQ ID NO: 268659 - RNA, 22 nt, Human
aagccagaucaaaguguccagg

SEQ ID NO: 268660 - RNA, 22 nt, Human
augacaaaggcugaaagggaaa

SEQ ID NO: 268661 - RNA, 22 nt, Human
uacugaaagacugaauauuuag

SEQ ID NO: 268662 - RNA, 22 nt, Human
aagaaugauuacaaagcaacga

SEQ ID NO: 268663 - RNA, 22 nt, Human
uuucauaauacuguacaugaaa

SEQ ID NO: 268664 - RNA, 22 nt, Human
ucagcagaccuguuauuuggau

SEQ ID NO: 268665 - RNA, 22 nt, Human
cugaggugagaggaggccaugu

SEQ ID NO: 268666 - RNA, 23 nt, Human
ccauggccaaugucaagcuacua

SEQ ID NO: 268667 - RNA, 22 nt, Human
gggcuuggaguaggcugaugaa

SEQ ID NO: 268668 - RNA, 23 nt, Human
gauugcuguaugcaggagcauuc

SEQ ID NO: 268669 - RNA, 22 nt, Human
auuugggaauuauuugccuaau

SEQ ID NO: 268670 - RNA, 22 nt, Human
uccuuggcuuucuggagcuucu

SEQ ID NO: 268671 - RNA, 22 nt, Human
cagggucuuauaaggccaauuu

SEQ ID NO: 268672 - RNA, 22 nt, Human
gccugcugaaccucaugcaguc

SEQ ID NO: 268673 - RNA, 22 nt, Human
agccuggccugggcaggcacau

SEQ ID NO: 268674 - RNA, 22 nt, Human
guugacagaaaaauaacauagc

SEQ ID NO: 268675 - RNA, 22 nt, Human
cacauuuacauauaaaacuuuc

SEQ ID NO: 268676 - RNA, 22 nt, Human
auuugcaaagguuaacagcagu

SEQ ID NO: 268677 - RNA, 22 nt, Human
guguaaagaugccaggaaucuu

SEQ ID NO: 268678 - RNA, 21 nt, Human
ucuaaugacauccucugacaa

SEQ ID NO: 268679 - RNA, 22 nt, Human
uugcauuacauuugcucagucu

SEQ ID NO: 268680 - RNA, 22 nt, Human
ccagggcaggagaaagacucac

SEQ ID NO: 268681 - RNA, 23 nt, Human
ccaguagcacaguuacccagugg

SEQ ID NO: 268682 - RNA, 22 nt, Human
cagccacuugugaugcugggga

SEQ ID NO: 268683 - RNA, 19 nt, Human
gacuccaacuuuaagcaug

SEQ ID NO: 268684 - RNA, 22 nt, Human
agucacaugagcacuaauuagg

SEQ ID NO: 268685 - RNA, 18 nt, Human
aguuuuuaggaagaaaug

SEQ ID NO: 268686 - RNA, 22 nt, Human
cagcugaaucagugaguggaaa

SEQ ID NO: 268687 - RNA, 22 nt, Human
gggcacaguacuccaaucaacu

SEQ ID NO: 268688 - RNA, 22 nt, Human
cuggaaggagcccgggcggauc

SEQ ID NO: 268689 - RNA, 22 nt, Human
aucauaaaauugcaccauuucu

SEQ ID NO: 268690 - RNA, 22 nt, Human
auuaggucauggggaggcccua

SEQ ID NO: 268691 - RNA, 22 nt, Human
uggggcagccacauagacaaca

SEQ ID NO: 268692 - RNA, 19 nt, Human
ucaggaaguugaugaggug

SEQ ID NO: 268693 - RNA, 22 nt, Human
gggcagaggggcgcuucccucu

SEQ ID NO: 268694 - RNA, 17 nt, Human
guccugggaggagagag

SEQ ID NO: 268695 - RNA, 19 nt, Human
ucaugcauuucuaagugca

SEQ ID NO: 268696 - RNA, 23 nt, Human
aguuggaccuggguaagaaaaug

SEQ ID NO: 268697 - RNA, 22 nt, Human
uugggggguugaggaguagaua

SEQ ID NO: 268698 - RNA, 22 nt, Human
cagcccugcugacacugucuga

SEQ ID NO: 268699 - RNA, 22 nt, Human
cuccaggagggcuuccugugau

SEQ ID NO: 268700 - RNA, 22 nt, Human
uucauguucauauguguauauc

SEQ ID NO: 268701 - RNA, 22 nt, Human
cccacauuuuugagucuucauc

SEQ ID NO: 268702 - RNA, 22 nt, Human
uaaaguuuauuggcaccaccau

SEQ ID NO: 268703 - RNA, 20 nt, Human
uucuucucuaguuaucuuca

SEQ ID NO: 268704 - RNA, 23 nt, Human
uggcacagaggaccaugcuuugc

SEQ ID NO: 268705 - RNA, 22 nt, Human
uggacccaccccagggccugcu

SEQ ID NO: 268706 - RNA, 22 nt, Human
ccugcucuuauagcuguuucca

SEQ ID NO: 268707 - RNA, 20 nt, Human
ucuaaaguacaguuugugug

SEQ ID NO: 268708 - RNA, 22 nt, Human
aauugcuuuugggggcaguuac

SEQ ID NO: 268709 - RNA, 22 nt, Human
ccaggagguggcaggacuugcc

SEQ ID NO: 268710 - RNA, 22 nt, Human
ccugcacccaggccgcaccucu

SEQ ID NO: 268711 - RNA, 18 nt, Human
ugggcacaaugaacagca

SEQ ID NO: 268712 - RNA, 22 nt, Human
aauuuuacauaggggauauggg

SEQ ID NO: 268713 - RNA, 20 nt, Human
ucacagaaacaaauagagaa

SEQ ID NO: 268714 - RNA, 22 nt, Human
gcaugugucuuuauagcagcau

SEQ ID NO: 268715 - RNA, 23 nt, Human
gcacaagaccuggcagcuuccau

SEQ ID NO: 268716 - RNA, 22 nt, Human
aaaugccuauuuguuccuucag

SEQ ID NO: 268717 - RNA, 22 nt, Human
gcaguaucuaugugauggguug

SEQ ID NO: 268718 - RNA, 22 nt, Human
gaaugaauuuuggauggugaag

SEQ ID NO: 268719 - RNA, 21 nt, Human
gaagacacauaaccucucucc

SEQ ID NO: 268720 - RNA, 22 nt, Human
auucagacucuugagcaguccc

SEQ ID NO: 268721 - RNA, 22 nt, Human
ugcauuaagaauuucugaggau

SEQ ID NO: 268722 - RNA, 22 nt, Human
ugaggccauggaacuagcuugg

SEQ ID NO: 268723 - RNA, 23 nt, Human
ccucagagaggcagagccacaug

SEQ ID NO: 268724 - RNA, 22 nt, Human
aacugaaacguauuuuugagau

SEQ ID NO: 268725 - RNA, 22 nt, Human
aauaaauguuuguuggauguuu

SEQ ID NO: 268726 - RNA, 22 nt, Human
uuagcaauaugaaugcauuugc

SEQ ID NO: 268727 - RNA, 22 nt, Human
ggacauuucuauugagcuaaga

SEQ ID NO: 268728 - RNA, 22 nt, Human
gauaauauuagaagauacaaau

SEQ ID NO: 268729 - RNA, 22 nt, Human
uuacuguugguguauccauagc

SEQ ID NO: 268730 - RNA, 22 nt, Human
gccuggagggauagaaugcaag

SEQ ID NO: 268731 - RNA, 22 nt, Human
gcugaggauugaagaguugcca

SEQ ID NO: 268732 - RNA, 22 nt, Human
aaggucuguauuagaguuucau

SEQ ID NO: 268733 - RNA, 22 nt, Human
gucuagaaaugccauacgugcc

SEQ ID NO: 268734 - RNA, 22 nt, Human
aggcugcuuucauggccgcccc

SEQ ID NO: 268735 - RNA, 22 nt, Human
uuaguguuagggccuguuaccu

SEQ ID NO: 268736 - RNA, 22 nt, Human
uugaaauauggauugaccuuga

SEQ ID NO: 268737 - RNA, 22 nt, Human
aaaaugcuauuucauggaggag

SEQ ID NO: 268738 - RNA, 22 nt, Human
uccaggcuagccugguagagaa

SEQ ID NO: 268739 - RNA, 22 nt, Human
auugggaugccggcugauaaga

SEQ ID NO: 268740 - RNA, 22 nt, Human
ccucaggugugggccagcuguc

SEQ ID NO: 268741 - RNA, 22 nt, Human
aaacaugcauucaagaaaaucu

SEQ ID NO: 268742 - RNA, 22 nt, Human
uuucauguuacauuuaaaaugu

SEQ ID NO: 268743 - RNA, 22 nt, Human
uuuuagaaguucacuuggguuu

SEQ ID NO: 268744 - RNA, 22 nt, Human
augugaaaaauuucuuauuaca

SEQ ID NO: 268745 - RNA, 22 nt, Human
auugaagaucagggaaagauuc

SEQ ID NO: 268746 - RNA, 22 nt, Human
gucucuggguuaagcagugcau

SEQ ID NO: 268747 - RNA, 22 nt, Human
uccuggagagugggcgagcaca

SEQ ID NO: 268748 - RNA, 22 nt, Human
ggcugcucaaggacucugaucg

SEQ ID NO: 268749 - RNA, 22 nt, Human
gucaggggaugugcugguggcc

SEQ ID NO: 268750 - RNA, 22 nt, Human
cagggcuggcuguggcaaucuc

SEQ ID NO: 268751 - RNA, 22 nt, Human
accugggaguaugcagugguga

SEQ ID NO: 268752 - RNA, 22 nt, Human
agaugggugccuucuuucuuua

SEQ ID NO: 268753 - RNA, 22 nt, Human
gcugugugaccugggcaagucu

SEQ ID NO: 268754 - RNA, 22 nt, Human
uuuccaaauaaggucacauucu

SEQ ID NO: 268755 - RNA, 19 nt, Human
cuucugugauacaucaguc

SEQ ID NO: 268756 - RNA, 22 nt, Human
aguggcaucaacuuuaucugua

SEQ ID NO: 268757 - RNA, 22 nt, Human
ccaggacacugcuucacagcag

SEQ ID NO: 268758 - RNA, 22 nt, Human
auuauguagguuaggugguugu

SEQ ID NO: 268759 - RNA, 22 nt, Human
aaggcuucuuaugcaauuguuu

SEQ ID NO: 268760 - RNA, 22 nt, Human
auuuaacaagacagagaacugg

SEQ ID NO: 268761 - RNA, 22 nt, Human
ccugagcucaaagggugccugg

SEQ ID NO: 268762 - RNA, 22 nt, Human
gcccaggaguugguggcugcag

SEQ ID NO: 268763 - RNA, 22 nt, Human
gagggcuccauuccccgugccc

SEQ ID NO: 268764 - RNA, 22 nt, Human
uuuguucagcucucauugauua

SEQ ID NO: 268765 - RNA, 22 nt, Human
aguucuuuugugaacauaugcu

SEQ ID NO: 268766 - RNA, 22 nt, Human
ccuaggcuggcugucuucaggu

SEQ ID NO: 268767 - RNA, 22 nt, Human
caugcacacugcaacaaggacu

SEQ ID NO: 268768 - RNA, 22 nt, Human
aacagaacccgagugugaaucu

SEQ ID NO: 268769 - RNA, 20 nt, Human
agcccaggccugugugaguc

SEQ ID NO: 268770 - RNA, 19 nt, Human
ucugagcugauaugacauu

SEQ ID NO: 268771 - RNA, 22 nt, Human
cagagugggcugucagccacca

SEQ ID NO: 268772 - RNA, 22 nt, Human
gcuccccuugguccuccuggga

SEQ ID NO: 268773 - RNA, 22 nt, Human
augagcagguuuaagagaggcc

SEQ ID NO: 268774 - RNA, 22 nt, Human
uccaucauguucacagcuauau

SEQ ID NO: 268775 - RNA, 22 nt, Human
agccagcugccuuucacaucug

SEQ ID NO: 268776 - RNA, 22 nt, Human
uuuucaauuuugaggcaguggu

SEQ ID NO: 268777 - RNA, 22 nt, Human
ggguccaggucuucaggcagag

SEQ ID NO: 268778 - RNA, 22 nt, Human
acauguguggacaugaaucuac

SEQ ID NO: 268779 - RNA, 22 nt, Human
gagaauuagggcguaauucaga

SEQ ID NO: 268780 - RNA, 22 nt, Human
uggcagccucccagcugcauuc

SEQ ID NO: 268781 - RNA, 19 nt, Human
gacauuccugacacuggcu

SEQ ID NO: 268782 - RNA, 22 nt, Human
ucugugcugucucagauaagca

SEQ ID NO: 268783 - RNA, 18 nt, Human
ucugcaggaccucagggc

SEQ ID NO: 268784 - RNA, 22 nt, Human
aaggaaauuagguuauuuugcu

SEQ ID NO: 268785 - RNA, 22 nt, Human
caccugggucauugcugguguu

SEQ ID NO: 268786 - RNA, 22 nt, Human
guucaaauugagaugguauaaa

SEQ ID NO: 268787 - RNA, 22 nt, Human
acuggcagaacgugaugcgggu

SEQ ID NO: 268788 - RNA, 22 nt, Human
cucuggaguggguggccgggag

SEQ ID NO: 268789 - RNA, 22 nt, Human
augcccugccaagcaggcuaaa

SEQ ID NO: 268790 - RNA, 22 nt, Human
guucucugaguccuggcaaaau

SEQ ID NO: 268791 - RNA, 22 nt, Human
aauauccacuucaauacaggca

SEQ ID NO: 268792 - RNA, 22 nt, Human
uguacauagaaaggauacagcu

SEQ ID NO: 268793 - RNA, 22 nt, Human
gcuuuuacaagagccagagagg

SEQ ID NO: 268794 - RNA, 22 nt, Human
ccagggcaaaugagaucauagc

SEQ ID NO: 268795 - RNA, 17 nt, Human
uauguaguacuuauaaa

SEQ ID NO: 268796 - RNA, 22 nt, Human
uaaagacaauuucgagcuguag

SEQ ID NO: 268797 - RNA, 22 nt, Human
ugggaaaguaauugucauccuu

SEQ ID NO: 268798 - RNA, 22 nt, Human
gucuuauuuaaggacaagaaga

SEQ ID NO: 268799 - RNA, 20 nt, Human
acagagacugagacacuugc

SEQ ID NO: 268800 - RNA, 22 nt, Human
ggauguagugcaaggagugaau

SEQ ID NO: 268801 - RNA, 19 nt, Human
ggaaggccacggcaggcuu

SEQ ID NO: 268802 - RNA, 22 nt, Human
uaauaauuggcaauguugagca

SEQ ID NO: 268803 - RNA, 22 nt, Human
uauguuuuuaagagaaugcauu

SEQ ID NO: 268804 - RNA, 22 nt, Human
aggaggcuguggagcacuccau

SEQ ID NO: 268805 - RNA, 22 nt, Human
ccugggcuuucggcggcuuccu

SEQ ID NO: 268806 - RNA, 22 nt, Human
acucaggcuacaggggcagaag

SEQ ID NO: 268807 - RNA, 22 nt, Human
ucaggccccaucccagacuuau

SEQ ID NO: 268808 - RNA, 22 nt, Human
auccuguggcuccagggagccg

SEQ ID NO: 268809 - RNA, 22 nt, Human
auuguauaauuguauugccaaa

SEQ ID NO: 268810 - RNA, 22 nt, Human
agugaggggcagcugagugggc

SEQ ID NO: 268811 - RNA, 22 nt, Human
uggaaagagguagaggaucugg

SEQ ID NO: 268812 - RNA, 22 nt, Human
cccagccuacucugccauagca

SEQ ID NO: 268813 - RNA, 22 nt, Human
aggggagcuugccuggucaccc

SEQ ID NO: 268814 - RNA, 22 nt, Human
ugcaucaaccuaauaucagcuc

SEQ ID NO: 268815 - RNA, 22 nt, Human
gcccucuguguaacaauccaga

SEQ ID NO: 268816 - RNA, 20 nt, Human
gccugccucagcuagcugag

SEQ ID NO: 268817 - RNA, 22 nt, Human
ccagagacgucggucagggcgc

SEQ ID NO: 268818 - RNA, 22 nt, Human
acaagauuuugucugguagggu

SEQ ID NO: 268819 - RNA, 22 nt, Human
gaagccccaaacccucgccauc

SEQ ID NO: 268820 - RNA, 22 nt, Human
uuggcugaugcaagagcuuccu

SEQ ID NO: 268821 - RNA, 22 nt, Human
agagccugugggagaugcagcu

SEQ ID NO: 268822 - RNA, 22 nt, Human
uuugucagucaugucugcuuuu

SEQ ID NO: 268823 - RNA, 22 nt, Human
cagggcagagccaggauuucaa

SEQ ID NO: 268824 - RNA, 22 nt, Human
aacaugauuucaugcauuuaga

SEQ ID NO: 268825 - RNA, 22 nt, Human
aagcaucuccucaucauuuggg

SEQ ID NO: 268826 - RNA, 22 nt, Human
acauguuugccugcaggcuuag

SEQ ID NO: 268827 - RNA, 22 nt, Human
agaggaauaaauuucuguagug

SEQ ID NO: 268828 - RNA, 22 nt, Human
gaggaagaugguugaguggucc

SEQ ID NO: 268829 - RNA, 22 nt, Human
aggcagguccccuggaaggcac

SEQ ID NO: 268830 - RNA, 19 nt, Human
uuucauguuuuuggugaga

SEQ ID NO: 268831 - RNA, 16 nt, Human
uccuggccccuaugga

SEQ ID NO: 268832 - RNA, 22 nt, Human
ggagcuccuggcagugacagag

SEQ ID NO: 268833 - RNA, 18 nt, Human
ugaggccucugcugggcc

SEQ ID NO: 268834 - RNA, 22 nt, Human
gcccugccugucugcugggagg

SEQ ID NO: 268835 - RNA, 22 nt, Human
uaggaaaagcacaggauguucu

SEQ ID NO: 268836 - RNA, 22 nt, Human
acagauauaugauuguguaaau

SEQ ID NO: 268837 - RNA, 22 nt, Human
gccccuggcuggccagcuccuc

SEQ ID NO: 268838 - RNA, 22 nt, Human
uaaaccaaguguccauauuagu

SEQ ID NO: 268839 - RNA, 19 nt, Human
aaugaguuccaugaaaaga

SEQ ID NO: 268840 - RNA, 22 nt, Human
guacacauuaugcuucucuaaa

SEQ ID NO: 268841 - RNA, 22 nt, Human
cagcccugggaguuggggccga

SEQ ID NO: 268842 - RNA, 22 nt, Human
aaguuacauaaauguccucuag

SEQ ID NO: 268843 - RNA, 22 nt, Human
cuggcuggccggagcgaggcgg

SEQ ID NO: 268844 - RNA, 22 nt, Human
ugcuuugcucucacuguaaggu

SEQ ID NO: 268845 - RNA, 21 nt, Human
gccuggcuucacaggcacuga

SEQ ID NO: 268846 - RNA, 22 nt, Human
agcagggcuccauuucacugcc

SEQ ID NO: 268847 - RNA, 22 nt, Human
agagaaggaaagcugacauggg

SEQ ID NO: 268848 - RNA, 22 nt, Human
uucacaauagcuggcaucaucu

SEQ ID NO: 268849 - RNA, 22 nt, Human
aauagcaaacagacaugcacaa

SEQ ID NO: 268850 - RNA, 22 nt, Human
uucauaaugagguccuagaggc

SEQ ID NO: 268851 - RNA, 22 nt, Human
auuucuagguagagaagcuuag

SEQ ID NO: 268852 - RNA, 22 nt, Human
aauggcaacaugguauagugag

SEQ ID NO: 268853 - RNA, 22 nt, Human
ucaggcuggagugcaguggcgc

SEQ ID NO: 268854 - RNA, 22 nt, Human
gucuuacccacagcaucuagaa

SEQ ID NO: 268855 - RNA, 22 nt, Human
uaggcaaguggaccagagguuu

SEQ ID NO: 268856 - RNA, 22 nt, Human
gcugcccagcaggccccagggg

SEQ ID NO: 268857 - RNA, 22 nt, Human
agugugagcccuggaguggugc

SEQ ID NO: 268858 - RNA, 22 nt, Human
aacaggcaacaguugacucuga

SEQ ID NO: 268859 - RNA, 22 nt, Human
uucaaaggcaggauagcagcug

SEQ ID NO: 268860 - RNA, 22 nt, Human
ucagaacagugccuggcacuaa

SEQ ID NO: 268861 - RNA, 22 nt, Human
gcauggccaggaaagguagaaa

SEQ ID NO: 268862 - RNA, 22 nt, Human
ugcuggaguaacaagacacuca

SEQ ID NO: 268863 - RNA, 22 nt, Human
auccaugaagguacuucucagg

SEQ ID NO: 268864 - RNA, 22 nt, Human
acuuccagaggguguggaaaua

SEQ ID NO: 268865 - RNA, 22 nt, Human
uggcacagugcuggauggugcu

SEQ ID NO: 268866 - RNA, 22 nt, Human
aguacaaaaugcagcaucauca

SEQ ID NO: 268867 - RNA, 22 nt, Human
gcugcugcaagagccagcucuu

SEQ ID NO: 268868 - RNA, 20 nt, Human
gccaggcacuguucucaaua

SEQ ID NO: 268869 - RNA, 22 nt, Human
cucagcagguaccacaugaucu

SEQ ID NO: 268870 - RNA, 22 nt, Human
gagcuacaagggagacuuuuuu

SEQ ID NO: 268871 - RNA, 22 nt, Human
agcugaaauuuuacugaguaua

SEQ ID NO: 268872 - RNA, 22 nt, Human
uucauguuguaguauguaucag

SEQ ID NO: 268873 - RNA, 22 nt, Human
auucagugugagguuuucaagu

SEQ ID NO: 268874 - RNA, 22 nt, Human
agagacagaggcaauauagcuu

SEQ ID NO: 268875 - RNA, 22 nt, Human
uaggguggagacuggaagcagg

SEQ ID NO: 268876 - RNA, 22 nt, Human
agcacagagaaacuaagacauu

SEQ ID NO: 268877 - RNA, 22 nt, Human
ucuuaaagagcgcaauuugagg

SEQ ID NO: 268878 - RNA, 22 nt, Human
guuauugacauguauuaagcac

SEQ ID NO: 268879 - RNA, 22 nt, Human
aucuguuauuuacccaucucug

SEQ ID NO: 268880 - RNA, 22 nt, Human
agcagguggccuccugucuguc

SEQ ID NO: 268881 - RNA, 22 nt, Human
aggaauguuuagaaugucagaa

SEQ ID NO: 268882 - RNA, 22 nt, Human
gcucaggcucucccaggggaau

SEQ ID NO: 268883 - RNA, 22 nt, Human
gcaagcugugccuucucaggau

SEQ ID NO: 268884 - RNA, 21 nt, Human
agaauuaaauuggauuugugu

SEQ ID NO: 268885 - RNA, 22 nt, Human
uuggcuucccagagcuuacgcu

SEQ ID NO: 268886 - RNA, 22 nt, Human
aacauguaccuacaaucagaau

SEQ ID NO: 268887 - RNA, 20 nt, Human
uccagagaguggcaaagcuc

SEQ ID NO: 268888 - RNA, 22 nt, Human
cagaguggagaaagcauuuagu

SEQ ID NO: 268889 - RNA, 22 nt, Human
uuuuuacagucauggucacuca

SEQ ID NO: 268890 - RNA, 22 nt, Human
aacaaaugauaccaguucucaa

SEQ ID NO: 268891 - RNA, 22 nt, Human
uugagggagaaaguuggaguag

SEQ ID NO: 268892 - RNA, 22 nt, Human
augaggcagauguugcaugagg

SEQ ID NO: 268893 - RNA, 22 nt, Human
uuucuucauagaccuugucuug

SEQ ID NO: 268894 - RNA, 20 nt, Human
gcugaggggucuauggcaua

SEQ ID NO: 268895 - RNA, 22 nt, Human
acccugggucauauacagugug

SEQ ID NO: 268896 - RNA, 22 nt, Human
aaggauuuuuggaaugagaugg

SEQ ID NO: 268897 - RNA, 22 nt, Human
gagggagagugauggaccauug

SEQ ID NO: 268898 - RNA, 22 nt, Human
uucacaauaggagcaugcaaau

SEQ ID NO: 268899 - RNA, 22 nt, Human
caaagggcauggccugagcacu

SEQ ID NO: 268900 - RNA, 22 nt, Human
ggugggagggcugcguuccucu

SEQ ID NO: 268901 - RNA, 22 nt, Human
gugcauauuuugcacacagaug

SEQ ID NO: 268902 - RNA, 22 nt, Human
gugaaauauuuaacguccaggu

SEQ ID NO: 268903 - RNA, 22 nt, Human
uccccucuggaggcugcagggg

SEQ ID NO: 268904 - RNA, 22 nt, Human
guucagcagcagugauuuugug

SEQ ID NO: 268905 - RNA, 22 nt, Human
gaaggcuugguuuuuucaacac

SEQ ID NO: 268906 - RNA, 22 nt, Human
ucaaauaguugacauuaacuug

SEQ ID NO: 268907 - RNA, 22 nt, Human
agguccugucuaucacccucgc

SEQ ID NO: 268908 - RNA, 22 nt, Human
ucucagagaccugaacucccug

SEQ ID NO: 268909 - RNA, 22 nt, Human
ccucaggccagggggcggccag

SEQ ID NO: 268910 - RNA, 22 nt, Human
uaucagauuuagaggagucaua

SEQ ID NO: 268911 - RNA, 22 nt, Human
gcaaaugcucuccuuggucagg

SEQ ID NO: 268912 - RNA, 22 nt, Human
uguuaaauguuuugcuaguguc

SEQ ID NO: 268913 - RNA, 22 nt, Human
acauguuuugugccuugacuag

SEQ ID NO: 268914 - RNA, 22 nt, Human
uuagggaagcauggaggagaug

SEQ ID NO: 268915 - RNA, 22 nt, Human
ucugucucuuuguucugugagu

SEQ ID NO: 268916 - RNA, 22 nt, Human
gcagggccagugcagagaggaa

SEQ ID NO: 268917 - RNA, 22 nt, Human
aggaggugcuguuuguccugga

SEQ ID NO: 268918 - RNA, 22 nt, Human
cuuuauguccaccagacugcaa

SEQ ID NO: 268919 - RNA, 22 nt, Human
ucucagaggucuucagccucug

SEQ ID NO: 268920 - RNA, 22 nt, Human
ccuucuucuguguggcccaaga

SEQ ID NO: 268921 - RNA, 22 nt, Human
gaaggagcuaccaagacugaau

SEQ ID NO: 268922 - RNA, 22 nt, Human
ggggccacuggcaggaccuugg

SEQ ID NO: 268923 - RNA, 22 nt, Human
ugcccugcuaaccuugguucca

SEQ ID NO: 268924 - RNA, 22 nt, Human
agaugaauccacacauggcaaa

SEQ ID NO: 268925 - RNA, 23 nt, Human
ucugggccacuugucugcacuuc

SEQ ID NO: 268926 - RNA, 22 nt, Human
uuugauagggaaguaagaauga

SEQ ID NO: 268927 - RNA, 22 nt, Human
cugcccugcccaggccuugggc

SEQ ID NO: 268928 - RNA, 21 nt, Human
cucugcccagggccuccugcc

SEQ ID NO: 268929 - RNA, 22 nt, Human
gcuggcccagggucaccuagga

SEQ ID NO: 268930 - RNA, 22 nt, Human
gggaucugacuugcuggugggu

SEQ ID NO: 268931 - RNA, 22 nt, Human
acaggaaguuuggaaagccuca

SEQ ID NO: 268932 - RNA, 22 nt, Human
uaagaacagugacagccaacau

SEQ ID NO: 268933 - RNA, 22 nt, Human
aaggugcucguuauggccagug

SEQ ID NO: 268934 - RNA, 22 nt, Human
auuauuagauucuuaauuguaa

SEQ ID NO: 268935 - RNA, 22 nt, Human
gcacccagcccagggcgugaug

SEQ ID NO: 268936 - RNA, 22 nt, Human
ggcacagcccucucuguggaca

SEQ ID NO: 268937 - RNA, 22 nt, Human
acauucaaguuucugcucaugg

SEQ ID NO: 268938 - RNA, 22 nt, Human
gcuggaggaucacuugagccca

SEQ ID NO: 268939 - RNA, 21 nt, Human
agaauaaugguaucauuugcu

SEQ ID NO: 268940 - RNA, 20 nt, Human
uuggcucagauuuuuauggg

SEQ ID NO: 268941 - RNA, 22 nt, Human
gggagcugcugaacacaagggu

SEQ ID NO: 268942 - RNA, 22 nt, Human
aaugcacaaaaauuguauguaa

SEQ ID NO: 268943 - RNA, 22 nt, Human
uugggccucucaaagugcuggg

SEQ ID NO: 268944 - RNA, 22 nt, Human
gcugcagugagccaagaucgug

SEQ ID NO: 268945 - RNA, 22 nt, Human
ccacauggagcaggaggugggg

SEQ ID NO: 268946 - RNA, 22 nt, Human
ugccccagaccuacugaauggg

SEQ ID NO: 268947 - RNA, 22 nt, Human
uaccaggaauggggucaccguc

SEQ ID NO: 268948 - RNA, 22 nt, Human
acgucuucguuggcagagauuu

SEQ ID NO: 268949 - RNA, 22 nt, Human
ugaggugguucaagagccuugu

SEQ ID NO: 268950 - RNA, 22 nt, Human
cucuggaccucagcuacagacu

SEQ ID NO: 268951 - RNA, 20 nt, Human
cucuuaaauguaaaguaggc

SEQ ID NO: 268952 - RNA, 22 nt, Human
agagcagcugugacauggacag

SEQ ID NO: 268953 - RNA, 22 nt, Human
aaugacaugcuuuuuaauuaua

SEQ ID NO: 268954 - RNA, 22 nt, Human
agcacacaggacuugauucaug

SEQ ID NO: 268955 - RNA, 22 nt, Human
ggguaccaagcugcuugggggc

SEQ ID NO: 268956 - RNA, 22 nt, Human
ugugacccucuccgaugggcag

SEQ ID NO: 268957 - RNA, 22 nt, Human
uuuguucugcaucacagaaaaa

SEQ ID NO: 268958 - RNA, 22 nt, Human
uggcacagaaaaaugcuccauu

SEQ ID NO: 268959 - RNA, 22 nt, Human
auucugaugccuggguacugcc

SEQ ID NO: 268960 - RNA, 17 nt, Human
ucugucuugacugucac

SEQ ID NO: 268961 - RNA, 22 nt, Human
agggccagucguguauuacugu

SEQ ID NO: 268962 - RNA, 22 nt, Human
caugcagccugugaacaguguc

SEQ ID NO: 268963 - RNA, 22 nt, Human
uguauauucugccuaaaagcuu

SEQ ID NO: 268964 - RNA, 22 nt, Human
uugaaaagcaaaugauggguag

SEQ ID NO: 268965 - RNA, 22 nt, Human
cugagcccaggcgggagcugag

SEQ ID NO: 268966 - RNA, 22 nt, Human
uauccauaguuuauagaucaag

SEQ ID NO: 268967 - RNA, 22 nt, Human
gggcagggguagcauuccaagu

SEQ ID NO: 268968 - RNA, 22 nt, Human
ugagccaggucucacucaccuu

SEQ ID NO: 268969 - RNA, 22 nt, Human
gcuagaauauuggguaggcaag

SEQ ID NO: 268970 - RNA, 22 nt, Human
uguguccuccagggagauguaa

SEQ ID NO: 268971 - RNA, 22 nt, Human
caacagagagaccagaaacagg

SEQ ID NO: 268972 - RNA, 22 nt, Human
ggccugcuguguacugauguca

SEQ ID NO: 268973 - RNA, 22 nt, Human
ugcagaggagucagccugggca

SEQ ID NO: 268974 - RNA, 22 nt, Human
agucuagggugggguccacagg

SEQ ID NO: 268975 - RNA, 20 nt, Human
uuucaaaggcaccuaugaag

SEQ ID NO: 268976 - RNA, 20 nt, Human
uccagccccugcauguugcu

SEQ ID NO: 268977 - RNA, 22 nt, Human
uugaagauucuuuuuguuagua

SEQ ID NO: 268978 - RNA, 22 nt, Human
caauaagauguauugagcagag

SEQ ID NO: 268979 - RNA, 22 nt, Human
gugcaauauugccauguucuug

SEQ ID NO: 268980 - RNA, 22 nt, Human
uugagaacuacuuuauuauucu

SEQ ID NO: 268981 - RNA, 22 nt, Human
uaaagcuuguauugcaauauuu

SEQ ID NO: 268982 - RNA, 22 nt, Human
agcugguggaagggagcccaaa

SEQ ID NO: 268983 - RNA, 22 nt, Human
uugcagggaaaucagugaggau

SEQ ID NO: 268984 - RNA, 22 nt, Human
aaaccaacccuggcuggccuag

SEQ ID NO: 268985 - RNA, 22 nt, Human
cagaugcuuggaggacacuugg

SEQ ID NO: 268986 - RNA, 22 nt, Human
ugaaugaucuaguuuuguagac

SEQ ID NO: 268987 - RNA, 22 nt, Human
uuuuauuggagugauaccaagc

SEQ ID NO: 268988 - RNA, 22 nt, Human
ugggagcucagaaagggagguc

SEQ ID NO: 268989 - RNA, 22 nt, Human
cuuagaaauaaugguuucaguu

SEQ ID NO: 268990 - RNA, 22 nt, Human
aaaguacaugcaauucuucuga

SEQ ID NO: 268991 - RNA, 22 nt, Human
acaagauucaaugaauugauug

SEQ ID NO: 268992 - RNA, 22 nt, Human
augaaggcaguuaaacgucauc

SEQ ID NO: 268993 - RNA, 22 nt, Human
ccaggacuuuaaguccagcacu

SEQ ID NO: 268994 - RNA, 20 nt, Human
caacagaggggucuggagua

SEQ ID NO: 268995 - RNA, 22 nt, Human
uccaggccccccacgcuaaugg

SEQ ID NO: 268996 - RNA, 22 nt, Human
aaagaacaaauuagcuguuuua

SEQ ID NO: 268997 - RNA, 22 nt, Human
gccuccaguuuuuuucugaacu

SEQ ID NO: 268998 - RNA, 22 nt, Human
gagggcagagacagugauucac

SEQ ID NO: 268999 - RNA, 22 nt, Human
ucaggcaaggcccuuagagugu

SEQ ID NO: 269000 - RNA, 22 nt, Human
gaggaacagagggcaaggccag

SEQ ID NO: 269001 - RNA, 22 nt, Human
ccugcugcuaugaaggugacag

SEQ ID NO: 269002 - RNA, 22 nt, Human
gugcugagugcagagugcagag

SEQ ID NO: 269003 - RNA, 22 nt, Human
aaggcuccacccucauggaugc

SEQ ID NO: 269004 - RNA, 22 nt, Human
cacuuucucaugaauuuggccc

SEQ ID NO: 269005 - RNA, 22 nt, Human
ucuauaaauuaugcagucucag

SEQ ID NO: 269006 - RNA, 22 nt, Human
cagcaagauuaagggcagaaaa

SEQ ID NO: 269007 - RNA, 20 nt, Human
uaugaguauuacuuucagga

SEQ ID NO: 269008 - RNA, 22 nt, Human
gcuggcagcuggaaguugggcu

SEQ ID NO: 269009 - RNA, 22 nt, Human
ugcaguuuuggccauugaaggc

SEQ ID NO: 269010 - RNA, 22 nt, Human
cgaggcagggaagcugcaaaag

SEQ ID NO: 269011 - RNA, 22 nt, Human
uaagaguuagggcuagcaauau

SEQ ID NO: 269012 - RNA, 19 nt, Human
gcucugugaugcugagggg

SEQ ID NO: 269013 - RNA, 20 nt, Human
aucaucuuuacaaugucagu

SEQ ID NO: 269014 - RNA, 22 nt, Human
gucuggagccugggucccugcu

SEQ ID NO: 269015 - RNA, 22 nt, Human
aguguacauguuuacagcaucu

SEQ ID NO: 269016 - RNA, 23 nt, Human
ugucuucgacuccugcgugcuuc

SEQ ID NO: 269017 - RNA, 22 nt, Human
agaggccaccacugucagggac

SEQ ID NO: 269018 - RNA, 22 nt, Human
ugagccaggcuccaugccaccu

SEQ ID NO: 269019 - RNA, 22 nt, Human
cuaaauuauuugcacauuagag

SEQ ID NO: 269020 - RNA, 22 nt, Human
agucaguguagaaagcccaggc

SEQ ID NO: 269021 - RNA, 23 nt, Human
ucccagggaaggugagcgaggcu

SEQ ID NO: 269022 - RNA, 22 nt, Human
ugaggcaaagacaaagcagcau

SEQ ID NO: 269023 - RNA, 22 nt, Human
cagccucuugcacuuugaaggc

SEQ ID NO: 269024 - RNA, 22 nt, Human
uggcagauuuugaagacagaga

SEQ ID NO: 269025 - RNA, 22 nt, Human
aggcagguagaaggaucuuuau

SEQ ID NO: 269026 - RNA, 17 nt, Human
gauuuccugaaguucuu

SEQ ID NO: 269027 - RNA, 22 nt, Human
uuauuucuacuauuuugccuga

SEQ ID NO: 269028 - RNA, 22 nt, Human
uggacacaguggugaagguaca

SEQ ID NO: 269029 - RNA, 22 nt, Human
cggcuccuccgcccuugcucac

SEQ ID NO: 269030 - RNA, 22 nt, Human
ugaaagcaugcuugccaagcuu

SEQ ID NO: 269031 - RNA, 22 nt, Human
gucuggccugccagcucuggug

SEQ ID NO: 269032 - RNA, 22 nt, Human
uuucagacuccaaauucauaag

SEQ ID NO: 269033 - RNA, 22 nt, Human
ccagcuggagcucgcagauagg

SEQ ID NO: 269034 - RNA, 22 nt, Human
acagacuggaggagaauaguuu

SEQ ID NO: 269035 - RNA, 22 nt, Human
auucauguagugauugagucac

SEQ ID NO: 269036 - RNA, 22 nt, Human
uacagaauaaagcgugaagcuu

SEQ ID NO: 269037 - RNA, 19 nt, Human
cugugcaggccgggcugag

SEQ ID NO: 269038 - RNA, 22 nt, Human
cagagguauugcaaaagccuag

SEQ ID NO: 269039 - RNA, 23 nt, Human
ccucagaggccucauagucuggc

SEQ ID NO: 269040 - RNA, 22 nt, Human
cucugagaggugagaagcagca

SEQ ID NO: 269041 - RNA, 19 nt, Human
ccugagauuccuccuuuuc

SEQ ID NO: 269042 - RNA, 22 nt, Human
ucaccaggcuccuguuaagaug

SEQ ID NO: 269043 - RNA, 22 nt, Human
auaguucacuaauagcaaaagc

SEQ ID NO: 269044 - RNA, 22 nt, Human
uuccuucuggagcccggggagc

SEQ ID NO: 269045 - RNA, 22 nt, Human
uaggaaauauuugaacauagga

SEQ ID NO: 269046 - RNA, 23 nt, Human
auuuacagcugugugagcaaguu

SEQ ID NO: 269047 - RNA, 22 nt, Human
ggcucaggacacagugguuuag

SEQ ID NO: 269048 - RNA, 22 nt, Human
acaacacagcuuuccucaaguu

SEQ ID NO: 269049 - RNA, 22 nt, Human
cagcaugacagucugcagcaga

SEQ ID NO: 269050 - RNA, 22 nt, Human
ugauggucaacaauuuugagug

SEQ ID NO: 269051 - RNA, 23 nt, Human
gcaugaagugcuacgucuacagc

SEQ ID NO: 269052 - RNA, 22 nt, Human
caggguccccgggucuccugug

SEQ ID NO: 269053 - RNA, 20 nt, Human
agcuaggagaaagcauggag

SEQ ID NO: 269054 - RNA, 22 nt, Human
agagaaugcagggcuucggaca

SEQ ID NO: 269055 - RNA, 22 nt, Human
uagaaucugccugcagcaaaga

SEQ ID NO: 269056 - RNA, 22 nt, Human
caggcaggugcagauuccucuu

SEQ ID NO: 269057 - RNA, 22 nt, Human
gauucugaucuauaguguuaua

SEQ ID NO: 269058 - RNA, 22 nt, Human
aggcaagcccccagugaggcuc

SEQ ID NO: 269059 - RNA, 22 nt, Human
gugucacuggaauacugucugu

SEQ ID NO: 269060 - RNA, 20 nt, Human
ucugggcuucccccagcucc

SEQ ID NO: 269061 - RNA, 22 nt, Human
ucaggaagccgguuaaauagau

SEQ ID NO: 269062 - RNA, 22 nt, Human
augugcuugcagaugagccuca

SEQ ID NO: 269063 - RNA, 22 nt, Human
auuagaaaaacucaagggcucu

SEQ ID NO: 269064 - RNA, 23 nt, Human
ucaggcagcugggguaguuggag

SEQ ID NO: 269065 - RNA, 22 nt, Human
cauguuaaaauauacauucuga

SEQ ID NO: 269066 - RNA, 22 nt, Human
ugccucuuggagccuuuccucu

SEQ ID NO: 269067 - RNA, 22 nt, Human
aaggccagauucacuuuacaau

SEQ ID NO: 269068 - RNA, 22 nt, Human
uaucuauuauguucuauguguc

SEQ ID NO: 269069 - RNA, 20 nt, Human
uggcaggaggcagcagugga

SEQ ID NO: 269070 - RNA, 19 nt, Human
uaaaaggauguggaaggau

SEQ ID NO: 269071 - RNA, 22 nt, Human
agcagugggggaguguuaguuu

SEQ ID NO: 269072 - RNA, 22 nt, Human
ugggcucugaagucagucugcu

SEQ ID NO: 269073 - RNA, 19 nt, Human
ggccuugcucuguggcagc

SEQ ID NO: 269074 - RNA, 22 nt, Human
uuucucagccuccuugcuggag

SEQ ID NO: 269075 - RNA, 22 nt, Human
cuuuccaaugcauuuccaaugu

SEQ ID NO: 269076 - RNA, 22 nt, Human
acaucucuggguccuccaugca

SEQ ID NO: 269077 - RNA, 22 nt, Human
uuucugaaacauggucuuugua

SEQ ID NO: 269078 - RNA, 22 nt, Human
ggaggccaugaggcucuaggug

SEQ ID NO: 269079 - RNA, 22 nt, Human
gaggacugaaacuuacaggaaa

SEQ ID NO: 269080 - RNA, 22 nt, Human
cagacaggcaggugagagcucc

SEQ ID NO: 269081 - RNA, 22 nt, Human
agagccuguaacaucuuucuua

SEQ ID NO: 269082 - RNA, 23 nt, Human
aaguucuuuuagaugucuucgug

SEQ ID NO: 269083 - RNA, 22 nt, Human
aaauauguaaccaaggugaagu

SEQ ID NO: 269084 - RNA, 22 nt, Human
uucagauguggcuuugucaggc

SEQ ID NO: 269085 - RNA, 23 nt, Human
uguguucucacacagaugcagua

SEQ ID NO: 269086 - RNA, 22 nt, Human
ccacugccuauuugcagggccc

SEQ ID NO: 269087 - RNA, 22 nt, Human
uuagcauucugccuccuauauc

SEQ ID NO: 269088 - RNA, 22 nt, Human
gacaccagcaaggcugugagga

SEQ ID NO: 269089 - RNA, 22 nt, Human
aaaauagaugaaaggaagucug

SEQ ID NO: 269090 - RNA, 20 nt, Human
agcagcagauguuggaggug

SEQ ID NO: 269091 - RNA, 22 nt, Human
uggucugauucuugcuccccaa

SEQ ID NO: 269092 - RNA, 22 nt, Human
cugcacaggggaugagggcagu

SEQ ID NO: 269093 - RNA, 19 nt, Human
aauguuuaagagaaaaagg

SEQ ID NO: 269094 - RNA, 22 nt, Human
gcucagagagauuaaauaauuu

SEQ ID NO: 269095 - RNA, 22 nt, Human
acagcuuuuuacuaauagauug

SEQ ID NO: 269096 - RNA, 22 nt, Human
ucagaaguacugugcuacaaua

SEQ ID NO: 269097 - RNA, 23 nt, Human
ccaagcuucuaaugcugcugagc

SEQ ID NO: 269098 - RNA, 22 nt, Human
gaggucuuagaagaaaaaucau

SEQ ID NO: 269099 - RNA, 22 nt, Human
aauaagagcacuggcuuuggag

SEQ ID NO: 269100 - RNA, 22 nt, Human
ugguaaaguguacugaauauga

SEQ ID NO: 269101 - RNA, 22 nt, Human
auccacaggaggguuuggaaaa

SEQ ID NO: 269102 - RNA, 22 nt, Human
aagucuuuugcugucauaggug

SEQ ID NO: 269103 - RNA, 22 nt, Human
agccagucccuugagcgugccc

SEQ ID NO: 269104 - RNA, 22 nt, Human
ugcagggauuauguagggguug

SEQ ID NO: 269105 - RNA, 19 nt, Human
gcuggcagauguggccgug

SEQ ID NO: 269106 - RNA, 22 nt, Human
acagaauugaagcugaguaaau

SEQ ID NO: 269107 - RNA, 23 nt, Human
aagaggaggcccugcucccgucc

SEQ ID NO: 269108 - RNA, 22 nt, Human
ggauagugggagaaugcuaugu

SEQ ID NO: 269109 - RNA, 22 nt, Human
uuucucaguugugcgagcagca

SEQ ID NO: 269110 - RNA, 22 nt, Human
caguuuaaagaaggaugggagu

SEQ ID NO: 269111 - RNA, 22 nt, Human
ugacagggacaguggagaugga

SEQ ID NO: 269112 - RNA, 22 nt, Human
ucacacaugaguaaauacaggg

SEQ ID NO: 269113 - RNA, 22 nt, Human
gcagaggugagaagggccuccc

SEQ ID NO: 269114 - RNA, 22 nt, Human
acuuccagcaccucaagcggaa

SEQ ID NO: 269115 - RNA, 22 nt, Human
uccuggcccacuccuagcuucu

SEQ ID NO: 269116 - RNA, 22 nt, Human
uuuaacuugaucaguagagcau

SEQ ID NO: 269117 - RNA, 22 nt, Human
gcuuugugugaaguccauggcg

SEQ ID NO: 269118 - RNA, 22 nt, Human
cuccucccucuuugccacacau

SEQ ID NO: 269119 - RNA, 22 nt, Human
agaauccuggccaggucagagc

SEQ ID NO: 269120 - RNA, 22 nt, Human
caacaccuugaucuuggacuuc

SEQ ID NO: 269121 - RNA, 22 nt, Human
aucaguauacaggggacauuca

SEQ ID NO: 269122 - RNA, 22 nt, Human
agguagaaggaccagaauuuau

SEQ ID NO: 269123 - RNA, 18 nt, Human
gcagaugaguaguguacc

SEQ ID NO: 269124 - RNA, 22 nt, Human
uccacagggauguugaguucuu

SEQ ID NO: 269125 - RNA, 22 nt, Human
acagaugaggaagagucagcca

SEQ ID NO: 269126 - RNA, 22 nt, Human
gacuccuggcuuucccucuuag

SEQ ID NO: 269127 - RNA, 14 nt, Human
agcugcaagcaucc

SEQ ID NO: 269128 - RNA, 22 nt, Human
uauguguccuaagcaaucaucc

SEQ ID NO: 269129 - RNA, 22 nt, Human
uucucaaagaaagcugucauua

SEQ ID NO: 269130 - RNA, 22 nt, Human
uugcacuccagcccgagcaaca

SEQ ID NO: 269131 - RNA, 22 nt, Human
aguguuaguggcugcagcuggu

SEQ ID NO: 269132 - RNA, 22 nt, Human
ucuuccugaaacccuguuccag

SEQ ID NO: 269133 - RNA, 22 nt, Human
cacugguacguagguuggggca

SEQ ID NO: 269134 - RNA, 22 nt, Human
ccuuuguucacuggagagugga

SEQ ID NO: 269135 - RNA, 22 nt, Human
ugguucaguugcacaggcuguu

SEQ ID NO: 269136 - RNA, 22 nt, Human
guccagcccucugccuccaggu

SEQ ID NO: 269137 - RNA, 22 nt, Human
auuggucucugcuaaagggagg

SEQ ID NO: 269138 - RNA, 22 nt, Human
cucugggucucccugaggcuaa

SEQ ID NO: 269139 - RNA, 22 nt, Human
gcuucuguggugaggucaccuu

SEQ ID NO: 269140 - RNA, 22 nt, Human
gagaggggcccaagccacauag

SEQ ID NO: 269141 - RNA, 22 nt, Human
ugugugcaagugacauuagaaa

SEQ ID NO: 269142 - RNA, 22 nt, Human
ccuuucagaugggcauggaccg

SEQ ID NO: 269143 - RNA, 22 nt, Human
ggcugcagcggauuggggauug

SEQ ID NO: 269144 - RNA, 22 nt, Human
uccuuugguuguagacaggaau

SEQ ID NO: 269145 - RNA, 22 nt, Human
ccugagggaggguauaggcugu

SEQ ID NO: 269146 - RNA, 22 nt, Human
aauuuguuagcauacucuaguu

SEQ ID NO: 269147 - RNA, 22 nt, Human
ccuuuagaauacagacuuucua

SEQ ID NO: 269148 - RNA, 22 nt, Human
accaggcccgcugcuauggugg

SEQ ID NO: 269149 - RNA, 22 nt, Human
augucuguucauuauuaacugc

SEQ ID NO: 269150 - RNA, 22 nt, Human
ucacauguguuuucucaccaac

SEQ ID NO: 269151 - RNA, 22 nt, Human
gcuccagguauuugcccuuuua

SEQ ID NO: 269152 - RNA, 21 nt, Human
agauguuucccccuuggcuuc

SEQ ID NO: 269153 - RNA, 22 nt, Human
uaaaguucuuagaacaaggccu

SEQ ID NO: 269154 - RNA, 22 nt, Human
auacagaugggucagauuucau

SEQ ID NO: 269155 - RNA, 22 nt, Human
uaggacaguggagauaaccaga

SEQ ID NO: 269156 - RNA, 22 nt, Human
ucucagcucauggcagccuuga

SEQ ID NO: 269157 - RNA, 22 nt, Human
uucugagagcugaagaaauguu

SEQ ID NO: 269158 - RNA, 20 nt, Human
uccuggaggcuucauccaua

SEQ ID NO: 269159 - RNA, 23 nt, Human
acagaauaccauugacuaggugu

SEQ ID NO: 269160 - RNA, 22 nt, Human
ggccagcagucacagggucaga

SEQ ID NO: 269161 - RNA, 22 nt, Human
cagcuucuguuucuagccccug

SEQ ID NO: 269162 - RNA, 22 nt, Human
ccaggaggucugaguguggaca

SEQ ID NO: 269163 - RNA, 22 nt, Human
guggcugcagcucugaacggac

SEQ ID NO: 269164 - RNA, 22 nt, Human
aaaauuauucauggcuuuugga

SEQ ID NO: 269165 - RNA, 22 nt, Human
uauuugaagauucuucugaugu

SEQ ID NO: 269166 - RNA, 22 nt, Human
auagaaacagggaagcaaagca

SEQ ID NO: 269167 - RNA, 22 nt, Human
uuccaggaagacaucucaggaa

SEQ ID NO: 269168 - RNA, 22 nt, Human
cagggcuagugacaccccaguc

SEQ ID NO: 269169 - RNA, 23 nt, Human
uuugcaaauuuuccugacuacuc

SEQ ID NO: 269170 - RNA, 20 nt, Human
ccagaggguagggccgcccc

SEQ ID NO: 269171 - RNA, 22 nt, Human
uccacgugagcuucgugugcag

SEQ ID NO: 269172 - RNA, 22 nt, Human
gccugagaaggauaggaagcga

SEQ ID NO: 269173 - RNA, 22 nt, Human
uucuuuagguagauccaguuuu

SEQ ID NO: 269174 - RNA, 22 nt, Human
cuggucacuccuccaccugcuu

SEQ ID NO: 269175 - RNA, 23 nt, Human
gcugccuccuacaaaagcccagc

SEQ ID NO: 269176 - RNA, 22 nt, Human
aauauaugugguauugaccagc

SEQ ID NO: 269177 - RNA, 22 nt, Human
aguacaauuuaaugaagauagc

SEQ ID NO: 269178 - RNA, 22 nt, Human
gugcccuccugaagccaucaca

SEQ ID NO: 269179 - RNA, 22 nt, Human
aaguuugagagccuuuaguaua

SEQ ID NO: 269180 - RNA, 22 nt, Human
gaauucuagucacacacauuca

SEQ ID NO: 269181 - RNA, 22 nt, Human
acuggcagggggagccccgaga

SEQ ID NO: 269182 - RNA, 19 nt, Human
gguuauuugaggguuaaga

SEQ ID NO: 269183 - RNA, 22 nt, Human
gccuccccaggggugucaugag

SEQ ID NO: 269184 - RNA, 22 nt, Human
auauacacauuugcuuaugugu

SEQ ID NO: 269185 - RNA, 22 nt, Human
aggccaggguagggcccauugu

SEQ ID NO: 269186 - RNA, 22 nt, Human
ggagcugcucagagccaguccc

SEQ ID NO: 269187 - RNA, 22 nt, Human
agagacaagaaauaccugggac

SEQ ID NO: 269188 - RNA, 22 nt, Human
cacagcugcccuacuccaugug

SEQ ID NO: 269189 - RNA, 22 nt, Human
aacuuucagaauccuaugcauu

SEQ ID NO: 269190 - RNA, 22 nt, Human
agcacaaugugaaaagagcucu

SEQ ID NO: 269191 - RNA, 21 nt, Human
agacacagggguugcuggggu

SEQ ID NO: 269192 - RNA, 22 nt, Human
cucucuggguccucuuuuauag

SEQ ID NO: 269193 - RNA, 22 nt, Human
aagguggugaucaucuugaagg

SEQ ID NO: 269194 - RNA, 23 nt, Human
ugacaacagcucucagccauguc

SEQ ID NO: 269195 - RNA, 22 nt, Human
uaagaaucaguagauauagauu

SEQ ID NO: 269196 - RNA, 22 nt, Human
ucugcaggcucuagaugagguu

SEQ ID NO: 269197 - RNA, 22 nt, Human
agucucugcaugaugcagcaca

SEQ ID NO: 269198 - RNA, 22 nt, Human
agggcuccaggggcugggugac

SEQ ID NO: 269199 - RNA, 23 nt, Human
augcaggguuacagggcugacuu

SEQ ID NO: 269200 - RNA, 22 nt, Human
ugcaaacaucaauggccugagc

SEQ ID NO: 269201 - RNA, 22 nt, Human
gcuuuagaucugacuuucugug

SEQ ID NO: 269202 - RNA, 22 nt, Human
aagucagauaggugaguccaaa

SEQ ID NO: 269203 - RNA, 22 nt, Human
auucucugcugcacugauaaca

SEQ ID NO: 269204 - RNA, 22 nt, Human
gccugggagagggauagugcag

SEQ ID NO: 269205 - RNA, 22 nt, Human
ucaggcugcaguggcaaaagac

SEQ ID NO: 269206 - RNA, 22 nt, Human
agcagcuguuagaaacaggaag

SEQ ID NO: 269207 - RNA, 22 nt, Human
gcucccagggcagcgcagaaga

SEQ ID NO: 269208 - RNA, 22 nt, Human
aggcuggagggcaauggcaaga

SEQ ID NO: 269209 - RNA, 22 nt, Human
ccucugggcuggaaaauuaaug

SEQ ID NO: 269210 - RNA, 22 nt, Human
aaggaaaucuuuguaacaucuu

SEQ ID NO: 269211 - RNA, 22 nt, Human
ugacauuuuuaaaaccacuagu

SEQ ID NO: 269212 - RNA, 20 nt, Human
cugacagaaaauauuucauc

SEQ ID NO: 269213 - RNA, 22 nt, Human
auauuauucuagcucuugugug

SEQ ID NO: 269214 - RNA, 22 nt, Human
uaagauguacaaccacuucucu

SEQ ID NO: 269215 - RNA, 22 nt, Human
gaugcauuacaaaagugauuau

SEQ ID NO: 269216 - RNA, 22 nt, Human
aggggagacuggaaucuaacau

SEQ ID NO: 269217 - RNA, 22 nt, Human
auguuuguguuacacucugcag

SEQ ID NO: 269218 - RNA, 22 nt, Human
auacaacugcucucagauaagu

SEQ ID NO: 269219 - RNA, 17 nt, Human
acauuuccuaacugaag

SEQ ID NO: 269220 - RNA, 22 nt, Human
uucacauugaaggugcuuucuu

SEQ ID NO: 269221 - RNA, 22 nt, Human
aucuuugggauauuugugauua

SEQ ID NO: 269222 - RNA, 22 nt, Human
gaguccuugacacauaguaggu

SEQ ID NO: 269223 - RNA, 22 nt, Human
ugagggucuggaaucugggcuu

SEQ ID NO: 269224 - RNA, 23 nt, Human
agcuccagaacauagcacaggaa

SEQ ID NO: 269225 - RNA, 22 nt, Human
ucuccauacuugccuuuggccu

SEQ ID NO: 269226 - RNA, 22 nt, Human
uacaagaaggaaaacuagcaau

SEQ ID NO: 269227 - RNA, 22 nt, Human
cugggccuccucugcccaagcu

SEQ ID NO: 269228 - RNA, 22 nt, Human
gaaauauacaugaagucggcug

SEQ ID NO: 269229 - RNA, 22 nt, Human
ggaauucaguggccagacauga

SEQ ID NO: 269230 - RNA, 22 nt, Human
ucuuagaaaugaaguucuuucu

SEQ ID NO: 269231 - RNA, 22 nt, Human
gggacagaaggaagugagcaca

SEQ ID NO: 269232 - RNA, 22 nt, Human
cuguggcuucugggucaguuca

SEQ ID NO: 269233 - RNA, 22 nt, Human
uggagagcagggcuggaguuca

SEQ ID NO: 269234 - RNA, 22 nt, Human
gggcccuggauuuaagcaugga

SEQ ID NO: 269235 - RNA, 22 nt, Human
cuguggcucaauugccuacuga

SEQ ID NO: 269236 - RNA, 22 nt, Human
cucaacauuuaacagugaaaaa

SEQ ID NO: 269237 - RNA, 22 nt, Human
gggagggucugagagcugcacc

SEQ ID NO: 269238 - RNA, 22 nt, Human
cacuuuaugggaagcaaaaauu

SEQ ID NO: 269239 - RNA, 22 nt, Human
caagaaguugacagccagguga

SEQ ID NO: 269240 - RNA, 22 nt, Human
ucauuguaauuaucugugguau

SEQ ID NO: 269241 - RNA, 22 nt, Human
gaagaauauucuugaucuuaga

SEQ ID NO: 269242 - RNA, 22 nt, Human
ucuucucccaucuccaggcagg

SEQ ID NO: 269243 - RNA, 22 nt, Human
ccaguguucauaauuuuacacu

SEQ ID NO: 269244 - RNA, 22 nt, Human
cugaggagggaaguccccaaag

SEQ ID NO: 269245 - RNA, 22 nt, Human
ccagcuuuaucaagucugagcu

SEQ ID NO: 269246 - RNA, 22 nt, Human
ucacagcauugaguguacuaga

SEQ ID NO: 269247 - RNA, 22 nt, Human
ggagagucugccgagccagccc

SEQ ID NO: 269248 - RNA, 22 nt, Human
aucuguggauaugcacagagca

SEQ ID NO: 269249 - RNA, 22 nt, Human
cagucuuuuguauauuagcaga

SEQ ID NO: 269250 - RNA, 22 nt, Human
gggaucuguguugcgauggauu

SEQ ID NO: 269251 - RNA, 22 nt, Human
gcuggcagcauuagacccuggg

SEQ ID NO: 269252 - RNA, 21 nt, Human
agucacauuggggguuuaggg

SEQ ID NO: 269253 - RNA, 22 nt, Human
aauucaacagucaguuaucuca

SEQ ID NO: 269254 - RNA, 22 nt, Human
gccugagaaggacacagcaggu

SEQ ID NO: 269255 - RNA, 17 nt, Human
gaggacagggaaguagg

SEQ ID NO: 269256 - RNA, 22 nt, Human
cuucaugcugauauccucgaug

SEQ ID NO: 269257 - RNA, 22 nt, Human
cuggagcucagcccagguucca

SEQ ID NO: 269258 - RNA, 22 nt, Human
gccaggcucuugguuauguuuu

SEQ ID NO: 269259 - RNA, 22 nt, Human
auauagcacuuguuuugcaugu

SEQ ID NO: 269260 - RNA, 22 nt, Human
uggccuugauaacuggggagag

SEQ ID NO: 269261 - RNA, 22 nt, Human
uggcccaguauguauaaucuua

SEQ ID NO: 269262 - RNA, 22 nt, Human
ugugcucuucuguuacuuguag

SEQ ID NO: 269263 - RNA, 22 nt, Human
cagggagccugaauguuccagg

SEQ ID NO: 269264 - RNA, 22 nt, Human
ucugucaucuguaacaggaggg

SEQ ID NO: 269265 - RNA, 22 nt, Human
auuugcaugaccuuugcaagug

SEQ ID NO: 269266 - RNA, 22 nt, Human
ccaggagagcaggcgugcagcu

SEQ ID NO: 269267 - RNA, 22 nt, Human
agaugguugucgcaaaugaaug

SEQ ID NO: 269268 - RNA, 22 nt, Human
aagccaguauucaauggggcua

SEQ ID NO: 269269 - RNA, 19 nt, Human
gcacacguugugcuugagc

SEQ ID NO: 269270 - RNA, 22 nt, Human
cuuuccuaguaguuacagaaug

SEQ ID NO: 269271 - RNA, 22 nt, Human
gaauacauguguguauagaggu

SEQ ID NO: 269272 - RNA, 22 nt, Human
uguccagcugaaggcagccuca

SEQ ID NO: 269273 - RNA, 20 nt, Human
uauuggaucuaagaaauggg

SEQ ID NO: 269274 - RNA, 18 nt, Human
cugaggcuuagagagguu

SEQ ID NO: 269275 - RNA, 22 nt, Human
cugugcaagacuuacuuuaaua

SEQ ID NO: 269276 - RNA, 22 nt, Human
agaggccuaauugcuacccuuu

SEQ ID NO: 269277 - RNA, 22 nt, Human
uaggauaugguagaaaucauuc

SEQ ID NO: 269278 - RNA, 22 nt, Human
gccagccccuccauccuguuca

SEQ ID NO: 269279 - RNA, 22 nt, Human
uugaggaguugugacagauacu

SEQ ID NO: 269280 - RNA, 22 nt, Human
uacaacagacaggaauaagauu

SEQ ID NO: 269281 - RNA, 22 nt, Human
augcccugagcaggccuucaag

SEQ ID NO: 269282 - RNA, 22 nt, Human
auguuuacugaaaagauuucaa

SEQ ID NO: 269283 - RNA, 22 nt, Human
aaauacagaguugcuuaaaagc

SEQ ID NO: 269284 - RNA, 22 nt, Human
agcuccugcuugacagaagagg

SEQ ID NO: 269285 - RNA, 22 nt, Human
uccagugguacauggagacacu

SEQ ID NO: 269286 - RNA, 22 nt, Human
ugcuuuauucaggguuuacccc

SEQ ID NO: 269287 - RNA, 19 nt, Human
ugcuuccucaccaucuccc

SEQ ID NO: 269288 - RNA, 22 nt, Human
ccagugucagaaagauuauccu

SEQ ID NO: 269289 - RNA, 22 nt, Human
uggguggcacuucuggggucca

SEQ ID NO: 269290 - RNA, 22 nt, Human
augcccugcugcuggggcagug

SEQ ID NO: 269291 - RNA, 22 nt, Human
auagcuuucuuaaauauauaaa

SEQ ID NO: 269292 - RNA, 22 nt, Human
uuuacuuguucugcugaauucu

SEQ ID NO: 269293 - RNA, 21 nt, Human
gcucccugcucagcuccuggg

SEQ ID NO: 269294 - RNA, 22 nt, Human
agaggugaaagaauuuggcucu

SEQ ID NO: 269295 - RNA, 22 nt, Human
gggagggccaggcucacccagg

SEQ ID NO: 269296 - RNA, 22 nt, Human
gcauguguucuugaaaggccac

SEQ ID NO: 269297 - RNA, 22 nt, Human
ggcucagaccucccagcuccag

SEQ ID NO: 269298 - RNA, 22 nt, Human
ucugggagaagcugaugugaag

SEQ ID NO: 269299 - RNA, 22 nt, Human
agaaggcuuuaaguacuggcau

SEQ ID NO: 269300 - RNA, 22 nt, Human
uauuccaccagagaugugaauu

SEQ ID NO: 269301 - RNA, 22 nt, Human
ugcugcacaauuggaaaguauc

SEQ ID NO: 269302 - RNA, 22 nt, Human
aacaaguaaguuuauauauauu

SEQ ID NO: 269303 - RNA, 22 nt, Human
uucagagaguuugugaguccuu

SEQ ID NO: 269304 - RNA, 22 nt, Human
aagucacauucugagguauugg

SEQ ID NO: 269305 - RNA, 22 nt, Human
cagggcagugaagaacacacgu

SEQ ID NO: 269306 - RNA, 22 nt, Human
ugauagaaaggaaauuaauugg

SEQ ID NO: 269307 - RNA, 22 nt, Human
uuuaauacagaacuugucaggg

SEQ ID NO: 269308 - RNA, 22 nt, Human
uucugggcccaacccuagagug

SEQ ID NO: 269309 - RNA, 22 nt, Human
ggccaggcacugugugagauau

SEQ ID NO: 269310 - RNA, 22 nt, Human
uccuccuguuucucaggccugg

SEQ ID NO: 269311 - RNA, 22 nt, Human
accuuauuuugaaauagauugu

SEQ ID NO: 269312 - RNA, 22 nt, Human
auucucaauggcuacuuucaua

SEQ ID NO: 269313 - RNA, 22 nt, Human
uggcaucuccgacagucuugau

SEQ ID NO: 269314 - RNA, 22 nt, Human
gggagcuguaagggacagguag

SEQ ID NO: 269315 - RNA, 22 nt, Human
uccaggcauuccagccauucca

SEQ ID NO: 269316 - RNA, 22 nt, Human
ucugcccuaauucagugcuuag

SEQ ID NO: 269317 - RNA, 22 nt, Human
aggaggaauacaauccagcagc

SEQ ID NO: 269318 - RNA, 22 nt, Human
cuguacauauacauuuuuuucc

SEQ ID NO: 269319 - RNA, 22 nt, Human
gcacagaagagcuuuggaauga

SEQ ID NO: 269320 - RNA, 22 nt, Human
cuugaauguaaauaauguacag

SEQ ID NO: 269321 - RNA, 22 nt, Human
ccugcagggugcugccacagau

SEQ ID NO: 269322 - RNA, 22 nt, Human
uugcauuugcucauuugauaug

SEQ ID NO: 269323 - RNA, 22 nt, Human
agagaucugugcuuacuacaag

SEQ ID NO: 269324 - RNA, 22 nt, Human
uuuugcuguuauaugcuauuau

SEQ ID NO: 269325 - RNA, 22 nt, Human
guccagcugggccagggcacuc

SEQ ID NO: 269326 - RNA, 22 nt, Human
uauuucaggggguacaagaaga

SEQ ID NO: 269327 - RNA, 22 nt, Human
guccucugcuucaugcccugau

SEQ ID NO: 269328 - RNA, 22 nt, Human
auuugcuaguggaauuuuccug

SEQ ID NO: 269329 - RNA, 22 nt, Human
ugcauucaaauccugauccugc

SEQ ID NO: 269330 - RNA, 22 nt, Human
ggcccagcaucuugugaaguuu

SEQ ID NO: 269331 - RNA, 22 nt, Human
aacaguuuggguagguauguag

SEQ ID NO: 269332 - RNA, 22 nt, Human
ugacacaaaggaaagcauaauc

SEQ ID NO: 269333 - RNA, 22 nt, Human
aggguaggaacugaguggaagg

SEQ ID NO: 269334 - RNA, 22 nt, Human
uucagggcagagaguucaggga

SEQ ID NO: 269335 - RNA, 22 nt, Human
ucccuggccauuccucuaggcc

SEQ ID NO: 269336 - RNA, 22 nt, Human
cugaggcaguuuaauuuuugaa

SEQ ID NO: 269337 - RNA, 22 nt, Human
cauuagggacugaggaauaagg

SEQ ID NO: 269338 - RNA, 22 nt, Human
cagguccagucacuggucugca

SEQ ID NO: 269339 - RNA, 22 nt, Human
cugggccugguagggcuugaaa

SEQ ID NO: 269340 - RNA, 22 nt, Human
augcaccccagaagcugcagug

SEQ ID NO: 269341 - RNA, 22 nt, Human
gucucugggugugugaugccaa

SEQ ID NO: 269342 - RNA, 22 nt, Human
caagggaaggcuaagggcaaca

SEQ ID NO: 269343 - RNA, 22 nt, Human
ggaaggaggggcaaagcaguuc

SEQ ID NO: 269344 - RNA, 22 nt, Human
cuuuuucuucuaggugugccug

SEQ ID NO: 269345 - RNA, 22 nt, Human
ucuuccucaugaauucucguau

SEQ ID NO: 269346 - RNA, 22 nt, Human
caggaaauaucuccuggcagag

SEQ ID NO: 269347 - RNA, 22 nt, Human
acagucauagcagccuuuguua

SEQ ID NO: 269348 - RNA, 22 nt, Human
ugcaaacacuucaacgugcauc

SEQ ID NO: 269349 - RNA, 22 nt, Human
auggcccagaaguuuggaaagg

SEQ ID NO: 269350 - RNA, 22 nt, Human
ucuggggagucaaagagaccug

SEQ ID NO: 269351 - RNA, 22 nt, Human
cagauggauuuuguaggcugau

SEQ ID NO: 269352 - RNA, 22 nt, Human
ucacagaaguugaauuugcaug

SEQ ID NO: 269353 - RNA, 22 nt, Human
cgugagcaaaauggacacuccc

SEQ ID NO: 269354 - RNA, 22 nt, Human
gauuccacagcuucgaggucuu

SEQ ID NO: 269355 - RNA, 17 nt, Human
cucuggaauuggugaag

SEQ ID NO: 269356 - RNA, 22 nt, Human
ccaggugugagcauucugucuu

SEQ ID NO: 269357 - RNA, 22 nt, Human
ggcaggcuugauauggggggac

SEQ ID NO: 269358 - RNA, 22 nt, Human
ggcaggugcaccugagccaucu

SEQ ID NO: 269359 - RNA, 22 nt, Human
cagcuucucgggagcgcaugug

SEQ ID NO: 269360 - RNA, 22 nt, Human
acagggagucugaggggauagu

SEQ ID NO: 269361 - RNA, 22 nt, Human
uuccuacaauuagagccucuuu

SEQ ID NO: 269362 - RNA, 22 nt, Human
acaagaauuauuucuaguuaac

SEQ ID NO: 269363 - RNA, 19 nt, Human
uagaaagaugauggguggg

SEQ ID NO: 269364 - RNA, 22 nt, Human
ggccacugaccuacaucugggg

SEQ ID NO: 269365 - RNA, 22 nt, Human
uuccaggcaugucagacauagg

SEQ ID NO: 269366 - RNA, 22 nt, Human
uuccugugugaccgagacagug

SEQ ID NO: 269367 - RNA, 22 nt, Human
uaguucaggaagagaaacaaca

SEQ ID NO: 269368 - RNA, 22 nt, Human
uuuauaugugaagguuugcaga

SEQ ID NO: 269369 - RNA, 22 nt, Human
gaccauuucaggggcagggacu

SEQ ID NO: 269370 - RNA, 22 nt, Human
aagcagagguagggugugcagu

SEQ ID NO: 269371 - RNA, 19 nt, Human
uucuuuggugguggugacc

SEQ ID NO: 269372 - RNA, 22 nt, Human
auguuaacagcugcuucuggug

SEQ ID NO: 269373 - RNA, 22 nt, Human
cuugauuuauuacccacuauau

SEQ ID NO: 269374 - RNA, 23 nt, Human
ggcagagagcauggcuggggccc

SEQ ID NO: 269375 - RNA, 22 nt, Human
gccucaggacuggcauacucau

SEQ ID NO: 269376 - RNA, 22 nt, Human
gccuguggcccaacugucuguc

SEQ ID NO: 269377 - RNA, 22 nt, Human
uuaacauuaaaagcagcauuuu

SEQ ID NO: 269378 - RNA, 20 nt, Human
gcuucccaauucuugaucug

SEQ ID NO: 269379 - RNA, 22 nt, Human
ugucucugccagcuagcagaau

SEQ ID NO: 269380 - RNA, 22 nt, Human
uccaggaguuugagacugcagu

SEQ ID NO: 269381 - RNA, 22 nt, Human
ugggcucuggagggccuaggau

SEQ ID NO: 269382 - RNA, 22 nt, Human
acacaggaacucaagcucgcuu

SEQ ID NO: 269383 - RNA, 22 nt, Human
acaaaugcuuaguucaccaaaa

SEQ ID NO: 269384 - RNA, 22 nt, Human
auggcugcucuggauggagucc

SEQ ID NO: 269385 - RNA, 18 nt, Human
uuugcugaugagcaucau

SEQ ID NO: 269386 - RNA, 22 nt, Human
aagcccagaugugagaacugag

SEQ ID NO: 269387 - RNA, 22 nt, Human
cuacuguugggagcccuggaag

SEQ ID NO: 269388 - RNA, 22 nt, Human
ggcuuuugcuguguuuuccaga

SEQ ID NO: 269389 - RNA, 22 nt, Human
uucaaacaaaacuguucccaua

SEQ ID NO: 269390 - RNA, 22 nt, Human
ucccaguggcuucauaaggcag

SEQ ID NO: 269391 - RNA, 22 nt, Human
aagacagagacucugcaacagg

SEQ ID NO: 269392 - RNA, 22 nt, Human
cugcuuuaaucccugccuggaa

SEQ ID NO: 269393 - RNA, 22 nt, Human
ccuugcucggggagcugcagga

SEQ ID NO: 269394 - RNA, 22 nt, Human
uaacagaaauuuuaguuagggg

SEQ ID NO: 269395 - RNA, 22 nt, Human
ccucaggguggcaucagaucuu

SEQ ID NO: 269396 - RNA, 21 nt, Human
acacguguguguaaacacaca

SEQ ID NO: 269397 - RNA, 22 nt, Human
ccucagagccaugccugaguuc

SEQ ID NO: 269398 - RNA, 22 nt, Human
caaaaguaauguaugcucaucg

SEQ ID NO: 269399 - RNA, 17 nt, Human
uuuguacaacauuuuaa

SEQ ID NO: 269400 - RNA, 22 nt, Human
uugggaagaaacauguccauca

SEQ ID NO: 269401 - RNA, 22 nt, Human
augucagaaucuacauucuacu

SEQ ID NO: 269402 - RNA, 22 nt, Human
cuggugacauuuccggcugcca

SEQ ID NO: 269403 - RNA, 22 nt, Human
aucuccaggcauuucaagagac

SEQ ID NO: 269404 - RNA, 22 nt, Human
cugcacugagcucucccagccc

SEQ ID NO: 269405 - RNA, 22 nt, Human
aacgaagcuuaacuuuucugag

SEQ ID NO: 269406 - RNA, 21 nt, Human
ggcaggugggucucuguugcu

SEQ ID NO: 269407 - RNA, 22 nt, Human
uaaaggcaaauguguguuugug

SEQ ID NO: 269408 - RNA, 22 nt, Human
caguuucugagcccugucauuu

SEQ ID NO: 269409 - RNA, 22 nt, Human
uauguuaaauguuugauguuua

SEQ ID NO: 269410 - RNA, 21 nt, Human
ugacuaauugugauaaagugc

SEQ ID NO: 269411 - RNA, 21 nt, Human
ccuggcuccagaacuuccggu

SEQ ID NO: 269412 - RNA, 22 nt, Human
ggcaggcaucauguggucauua

SEQ ID NO: 269413 - RNA, 22 nt, Human
ucaaagagcuauucaguugugg

SEQ ID NO: 269414 - RNA, 22 nt, Human
gaagcuucguggcucuucaaau

SEQ ID NO: 269415 - RNA, 22 nt, Human
caguuuuauugguugaaaucug

SEQ ID NO: 269416 - RNA, 22 nt, Human
ccucuccaguuuuaacgugacc

SEQ ID NO: 269417 - RNA, 22 nt, Human
auggcugccccaaauuguugcu

SEQ ID NO: 269418 - RNA, 22 nt, Human
ccugggagccaagccucugugu

SEQ ID NO: 269419 - RNA, 22 nt, Human
aggaauguuaaagauuaagagc

SEQ ID NO: 269420 - RNA, 22 nt, Human
auuggaauggcuuugcaugucc

SEQ ID NO: 269421 - RNA, 22 nt, Human
cugagcagcacagggcgccagg

SEQ ID NO: 269422 - RNA, 22 nt, Human
aagguccuguagccacagagcc

SEQ ID NO: 269423 - RNA, 21 nt, Human
aagcaggcuguaaucaugugg

SEQ ID NO: 269424 - RNA, 22 nt, Human
aguccaggaguugggugacauu

SEQ ID NO: 269425 - RNA, 21 nt, Human
aggugcuggcgccccaggaga

SEQ ID NO: 269426 - RNA, 22 nt, Human
ggaagagggaaccacgacugua

SEQ ID NO: 269427 - RNA, 22 nt, Human
aaaaugagauacaguuugaaag

SEQ ID NO: 269428 - RNA, 20 nt, Human
auguccucagccacugcccu

SEQ ID NO: 269429 - RNA, 22 nt, Human
caauucuuucagcugcauuugu

SEQ ID NO: 269430 - RNA, 22 nt, Human
auuuggcuaccaugaggauggg

SEQ ID NO: 269431 - RNA, 22 nt, Human
ucacaucuuggauuacaauuuu

SEQ ID NO: 269432 - RNA, 19 nt, Human
ccucagagcuagugaacau

SEQ ID NO: 269433 - RNA, 22 nt, Human
gcacacaguacuauaugcuaca

SEQ ID NO: 269434 - RNA, 22 nt, Human
ccagcugagguugaagaaagag

SEQ ID NO: 269435 - RNA, 22 nt, Human
gcaggagcucguuuccaggcug

SEQ ID NO: 269436 - RNA, 20 nt, Human
uccaguuuuggagacauucu

SEQ ID NO: 269437 - RNA, 22 nt, Human
cugcagugaaaucaggaagcaa

SEQ ID NO: 269438 - RNA, 22 nt, Human
agauuacagcaugggaauggga

SEQ ID NO: 269439 - RNA, 22 nt, Human
uucucuguuuuccccucgaugu

SEQ ID NO: 269440 - RNA, 22 nt, Human
cagaaaggacagagugagggug

SEQ ID NO: 269441 - RNA, 22 nt, Human
augaggcacuuaaaagugaaga

SEQ ID NO: 269442 - RNA, 22 nt, Human
ccugggugcccggcccuucucu

SEQ ID NO: 269443 - RNA, 22 nt, Human
aaaaaucuaugacugcuucucc

SEQ ID NO: 269444 - RNA, 22 nt, Human
cagaugcuucgugggugagcac

SEQ ID NO: 269445 - RNA, 22 nt, Human
aaguuccuaaagucagggguca

SEQ ID NO: 269446 - RNA, 22 nt, Human
cacugguguauuagagcuagaa

SEQ ID NO: 269447 - RNA, 22 nt, Human
caaacauuuuaaauaagggaua

SEQ ID NO: 269448 - RNA, 22 nt, Human
uucagaauauuuguuuuacaug

SEQ ID NO: 269449 - RNA, 22 nt, Human
cacaggugcuccucggggagcu

SEQ ID NO: 269450 - RNA, 22 nt, Human
gggggugguucuaaguccuaua

SEQ ID NO: 269451 - RNA, 22 nt, Human
agaugaguagguagcauuagua

SEQ ID NO: 269452 - RNA, 22 nt, Human
uucaguuucuaaaugcuccucu

SEQ ID NO: 269453 - RNA, 21 nt, Human
ucuuugcaucaguuguuuucu

SEQ ID NO: 269454 - RNA, 22 nt, Human
ugaggcaaaaacacugauuagg

SEQ ID NO: 269455 - RNA, 19 nt, Human
acaguccagcuguuuguac

SEQ ID NO: 269456 - RNA, 22 nt, Human
ccugucaguugcugucagggau

SEQ ID NO: 269457 - RNA, 22 nt, Human
uaaaguuuggcagacaauaaca

SEQ ID NO: 269458 - RNA, 22 nt, Human
caggaaaaucugcccacacaag

SEQ ID NO: 269459 - RNA, 22 nt, Human
cauggaggacccucagggagcu

SEQ ID NO: 269460 - RNA, 20 nt, Human
uuguuagaggaaugccauag

SEQ ID NO: 269461 - RNA, 22 nt, Human
agggcuccuaugaugcucugcc

SEQ ID NO: 269462 - RNA, 22 nt, Human
guauauaagguaaagcgauugu

SEQ ID NO: 269463 - RNA, 22 nt, Human
uauguacaaucagcaguucaua

SEQ ID NO: 269464 - RNA, 22 nt, Human
caggugguuccauguuucauga

SEQ ID NO: 269465 - RNA, 22 nt, Human
ccaggaccuggagcucuaugaa

SEQ ID NO: 269466 - RNA, 22 nt, Human
auucaacuuauaagauauuaau

SEQ ID NO: 269467 - RNA, 22 nt, Human
ugcucccagcuguaggaauguu

SEQ ID NO: 269468 - RNA, 22 nt, Human
cagugcauaaucuaaauggggg

SEQ ID NO: 269469 - RNA, 22 nt, Human
caacuguuauaaaucaacagag

SEQ ID NO: 269470 - RNA, 22 nt, Human
aagagacaugaauacucgaagg

SEQ ID NO: 269471 - RNA, 22 nt, Human
auuuuccucaagccucuggaag

SEQ ID NO: 269472 - RNA, 22 nt, Human
agacagacuuugaucuggaugu

SEQ ID NO: 269473 - RNA, 20 nt, Human
acguggccaccaguggcuua

SEQ ID NO: 269474 - RNA, 18 nt, Human
ugagacagcuaccacuug

SEQ ID NO: 269475 - RNA, 22 nt, Human
uuaaugaccuagagcaguaauu

SEQ ID NO: 269476 - RNA, 22 nt, Human
uagggucccagauaggagccag

SEQ ID NO: 269477 - RNA, 22 nt, Human
cugcucuugagggacugcgguc

SEQ ID NO: 269478 - RNA, 23 nt, Human
ggucagugaguucguuucucugg

SEQ ID NO: 269479 - RNA, 22 nt, Human
aaggccagggaugccagcucgg

SEQ ID NO: 269480 - RNA, 22 nt, Human
gcucaaauuucagacucaugaa

SEQ ID NO: 269481 - RNA, 22 nt, Human
aaacaucuauuaugugcugagc

SEQ ID NO: 269482 - RNA, 22 nt, Human
ucacagaacaauguuuaguucu

SEQ ID NO: 269483 - RNA, 21 nt, Human
ggccccagcccauggguucuc

SEQ ID NO: 269484 - RNA, 22 nt, Human
aaguaaaauguuuccuuuauua

SEQ ID NO: 269485 - RNA, 22 nt, Human
gcagagguccuagccaggaguc

SEQ ID NO: 269486 - RNA, 22 nt, Human
acagggcuuuuaaucaguaguu

SEQ ID NO: 269487 - RNA, 22 nt, Human
uauuuagaaugcguguacgugu

SEQ ID NO: 269488 - RNA, 22 nt, Human
guggcagagaacaaggagaggu

SEQ ID NO: 269489 - RNA, 22 nt, Human
ugccucagcugaggccgcucca

SEQ ID NO: 269490 - RNA, 22 nt, Human
uccauuuagcuggcaaacaaug

SEQ ID NO: 269491 - RNA, 22 nt, Human
uggcucugagucugcccuuggc

SEQ ID NO: 269492 - RNA, 22 nt, Human
gacaugggaugagaugaagcau

SEQ ID NO: 269493 - RNA, 22 nt, Human
ugggcagagucauacaggagac

SEQ ID NO: 269494 - RNA, 22 nt, Human
cacaugagugagaacaugcagu

SEQ ID NO: 269495 - RNA, 22 nt, Human
aggcaggagugacccugacagg

SEQ ID NO: 269496 - RNA, 22 nt, Human
cuggcuuccucaggagcagugg

SEQ ID NO: 269497 - RNA, 22 nt, Human
aaaggccaauaaagacaagcug

SEQ ID NO: 269498 - RNA, 22 nt, Human
ggucucuguugccuccaucaag

SEQ ID NO: 269499 - RNA, 22 nt, Human
augccauuguauauucauugau

SEQ ID NO: 269500 - RNA, 22 nt, Human
uucaugaaagacagcaacugug

SEQ ID NO: 269501 - RNA, 17 nt, Human
cagugaggccuuuccuc

SEQ ID NO: 269502 - RNA, 16 nt, Human
agugggaggagaaaga

SEQ ID NO: 269503 - RNA, 22 nt, Human
gcuuugcuaugacucaccagca

SEQ ID NO: 269504 - RNA, 22 nt, Human
ccagucagggcaggagccuggu

SEQ ID NO: 269505 - RNA, 22 nt, Human
caggaaaugcuaucauagcuga

SEQ ID NO: 269506 - RNA, 22 nt, Human
cagcugagaaaggcaggcucac

SEQ ID NO: 269507 - RNA, 22 nt, Human
uggcuuuuguugguaccaccuu

SEQ ID NO: 269508 - RNA, 22 nt, Human
uuagaacugaagaagauuaagg

SEQ ID NO: 269509 - RNA, 22 nt, Human
aggagccauuuuccaagggcga

SEQ ID NO: 269510 - RNA, 22 nt, Human
aggacuggcagugugagggguc

SEQ ID NO: 269511 - RNA, 22 nt, Human
gaggcugcuuuccuccuauccu

SEQ ID NO: 269512 - RNA, 22 nt, Human
gccugcuggacauuggccggcc

SEQ ID NO: 269513 - RNA, 22 nt, Human
gaaggaggcguuagcccuagga

SEQ ID NO: 269514 - RNA, 20 nt, Human
cugugcuuuggaaccuggaa

SEQ ID NO: 269515 - RNA, 22 nt, Human
aauuacagucggagcagcacug

SEQ ID NO: 269516 - RNA, 22 nt, Human
gcacccagaggucagcagugcu

SEQ ID NO: 269517 - RNA, 22 nt, Human
agcagaaucuguccuuggaaga

SEQ ID NO: 269518 - RNA, 22 nt, Human
gaauuuacaaguugaauaacaa

SEQ ID NO: 269519 - RNA, 22 nt, Human
ccagggccugagggcgacgccc

SEQ ID NO: 269520 - RNA, 20 nt, Human
auuagagcuacauggcuaca

SEQ ID NO: 269521 - RNA, 22 nt, Human
uccuucucugguuuuuacugua

SEQ ID NO: 269522 - RNA, 22 nt, Human
cguagcucacgcccccucuccc

SEQ ID NO: 269523 - RNA, 21 nt, Human
cugcuguggcccccgacaugc

SEQ ID NO: 269524 - RNA, 22 nt, Human
agcauccuccuucccagagaug

SEQ ID NO: 269525 - RNA, 22 nt, Human
uucuauuaauauguuaauucug

SEQ ID NO: 269526 - RNA, 22 nt, Human
ccaagguugagaaacuguagga

SEQ ID NO: 269527 - RNA, 22 nt, Human
aagcugccuugcugaggagaaa

SEQ ID NO: 269528 - RNA, 22 nt, Human
uucccaggcugugcuaccagag

SEQ ID NO: 269529 - RNA, 22 nt, Human
ccuggagcuuuuccauccugga

SEQ ID NO: 269530 - RNA, 23 nt, Human
gaagugucugagcuguauuuuuc

SEQ ID NO: 269531 - RNA, 22 nt, Human
ucugcugcuacagacucucuag

SEQ ID NO: 269532 - RNA, 22 nt, Human
uuuauacuccacucugcaagcg

SEQ ID NO: 269533 - RNA, 22 nt, Human
aacagcauauuucauauauuga

SEQ ID NO: 269534 - RNA, 22 nt, Human
gguuagagggcaugcgaucuuu

SEQ ID NO: 269535 - RNA, 22 nt, Human
ccugggaaucugcauugucagc

SEQ ID NO: 269536 - RNA, 22 nt, Human
gagaaucuccagaugaaguccu

SEQ ID NO: 269537 - RNA, 22 nt, Human
ggggcagcucccgagggcagga

SEQ ID NO: 269538 - RNA, 22 nt, Human
ugcccugcagugagugcgucug

SEQ ID NO: 269539 - RNA, 22 nt, Human
cuguaaaacugcuuaaguaugc

SEQ ID NO: 269540 - RNA, 17 nt, Human
gcccacccuuaggagcu

SEQ ID NO: 269541 - RNA, 22 nt, Human
uucuaguuaaaguauguauuag

SEQ ID NO: 269542 - RNA, 22 nt, Human
gaacagcauguaagaagcuacu

SEQ ID NO: 269543 - RNA, 22 nt, Human
ugccuggguucccaccccaaag

SEQ ID NO: 269544 - RNA, 22 nt, Human
ccagcucuagccccauguggcu

SEQ ID NO: 269545 - RNA, 22 nt, Human
uuagcauuucuggaaucacaag

SEQ ID NO: 269546 - RNA, 18 nt, Human
ucucucagggaaacagaa

SEQ ID NO: 269547 - RNA, 22 nt, Human
ugcaggcugcuggcaguagcuu

SEQ ID NO: 269548 - RNA, 22 nt, Human
uuuccaaauaaggucacacuca

SEQ ID NO: 269549 - RNA, 22 nt, Human
ucuuucuugguauucugagcua

SEQ ID NO: 269550 - RNA, 21 nt, Human
cagcuucugaagguguaggaa

SEQ ID NO: 269551 - RNA, 17 nt, Human
ggacacagcucauggcu

SEQ ID NO: 269552 - RNA, 22 nt, Human
cacagugcucaaacacaagugc

SEQ ID NO: 269553 - RNA, 22 nt, Human
ggagugaggcauuuguagcuga

SEQ ID NO: 269554 - RNA, 22 nt, Human
gaauacaugauacaugaacugc

SEQ ID NO: 269555 - RNA, 22 nt, Human
ugucacagagcgugcaacagaa

SEQ ID NO: 269556 - RNA, 23 nt, Human
ggcagccucugacucugcuuugc

SEQ ID NO: 269557 - RNA, 22 nt, Human
uacacacaugcauuugccuuau

SEQ ID NO: 269558 - RNA, 22 nt, Human
ugguggcuaccagguccugggg

SEQ ID NO: 269559 - RNA, 22 nt, Human
ugacauguauaucuuacgcuau

SEQ ID NO: 269560 - RNA, 22 nt, Human
ugcccagcacugugccagucac

SEQ ID NO: 269561 - RNA, 22 nt, Human
ccaggcuggauuuugcaguuca

SEQ ID NO: 269562 - RNA, 22 nt, Human
cccaggagagaggggauaaagc

SEQ ID NO: 269563 - RNA, 22 nt, Human
ccagggagccuggugugucagc

SEQ ID NO: 269564 - RNA, 22 nt, Human
uaauuauuugaagacauuagag

SEQ ID NO: 269565 - RNA, 22 nt, Human
uccagcccugcuuccugccuca

SEQ ID NO: 269566 - RNA, 22 nt, Human
ucucaguguuuaaaaagauuuc

SEQ ID NO: 269567 - RNA, 22 nt, Human
ucccagagccaagcuauggaug

SEQ ID NO: 269568 - RNA, 22 nt, Human
gcuuucaauuaugucagccugu

SEQ ID NO: 269569 - RNA, 22 nt, Human
uuacagagcucauuucuaaggg

SEQ ID NO: 269570 - RNA, 22 nt, Human
cagggacagcacuaaacucuug

SEQ ID NO: 269571 - RNA, 22 nt, Human
aagagguugucugugaugaguu

SEQ ID NO: 269572 - RNA, 22 nt, Human
agagggcuggacgcagguugga

SEQ ID NO: 269573 - RNA, 22 nt, Human
ccaggcagcucugauuuauguc

SEQ ID NO: 269574 - RNA, 22 nt, Human
acuuuaaggaggcacucaucuc

SEQ ID NO: 269575 - RNA, 22 nt, Human
aaacagaguuugguaaauagcc

SEQ ID NO: 269576 - RNA, 22 nt, Human
cugagcugugcuaagugaaaug

SEQ ID NO: 269577 - RNA, 22 nt, Human
agcaaagucaguggaaccaucc

SEQ ID NO: 269578 - RNA, 22 nt, Human
ggcagggacuuugcaaaucuuu

SEQ ID NO: 269579 - RNA, 20 nt, Human
agguguccuguagcuugagu

SEQ ID NO: 269580 - RNA, 22 nt, Human
cuguuuauagcagagcaagccu

SEQ ID NO: 269581 - RNA, 22 nt, Human
ucuuuauacaaacugggaaaca

SEQ ID NO: 269582 - RNA, 21 nt, Human
aaauuucugcaagccucaacu

SEQ ID NO: 269583 - RNA, 22 nt, Human
uucaacuauuaugaauaaaauu

SEQ ID NO: 269584 - RNA, 22 nt, Human
uuccucucaacaugccugccgg

SEQ ID NO: 269585 - RNA, 22 nt, Human
ucagggcccagucugugcaucu

SEQ ID NO: 269586 - RNA, 22 nt, Human
ucaucaaagucaaagaaugacu

SEQ ID NO: 269587 - RNA, 19 nt, Human
aggcugccucacccucccu

SEQ ID NO: 269588 - RNA, 22 nt, Human
ugcauauugugaaaauguagau

SEQ ID NO: 269589 - RNA, 22 nt, Human
ucucgacagccuggcacagugg

SEQ ID NO: 269590 - RNA, 22 nt, Human
gcucagaggguuuuggccaagu

SEQ ID NO: 269591 - RNA, 22 nt, Human
ugacaaagcaugauggugacag

SEQ ID NO: 269592 - RNA, 22 nt, Human
ucucugaaagcagcugcucauc

SEQ ID NO: 269593 - RNA, 22 nt, Human
uaaacauggcuguuucaguuau

SEQ ID NO: 269594 - RNA, 22 nt, Human
uuuauuggaugggucagcucua

SEQ ID NO: 269595 - RNA, 22 nt, Human
uggauugauaaaaugggauguu

SEQ ID NO: 269596 - RNA, 22 nt, Human
ggcaucuggaucugcuucuccc

SEQ ID NO: 269597 - RNA, 22 nt, Human
gagauauguuagaaagcuauug

SEQ ID NO: 269598 - RNA, 22 nt, Human
cccaggaacagcacagaacagc

SEQ ID NO: 269599 - RNA, 22 nt, Human
aaaugaacucuuccugcauccc

SEQ ID NO: 269600 - RNA, 22 nt, Human
caauucauuacauugcaaagac

SEQ ID NO: 269601 - RNA, 22 nt, Human
gagcuccugaaacguuccugcc

SEQ ID NO: 269602 - RNA, 22 nt, Human
acaggcuggugguccuggccau

SEQ ID NO: 269603 - RNA, 22 nt, Human
aggcugcuucuuguccuuggca

SEQ ID NO: 269604 - RNA, 19 nt, Human
ucucuggcauagacucaau

SEQ ID NO: 269605 - RNA, 22 nt, Human
cucacagcaaggagguaaggua

SEQ ID NO: 269606 - RNA, 22 nt, Human
gucaccucgcugucuuccugag

SEQ ID NO: 269607 - RNA, 22 nt, Human
acucuguagauguggaaaugcg

SEQ ID NO: 269608 - RNA, 22 nt, Human
cagcccuggugagguuggcuau

SEQ ID NO: 269609 - RNA, 22 nt, Human
agggcucccgugaggugacugc

SEQ ID NO: 269610 - RNA, 22 nt, Human
ccauguguugagauuccagccu

SEQ ID NO: 269611 - RNA, 22 nt, Human
ccagcuuucucagaggcuucua

SEQ ID NO: 269612 - RNA, 22 nt, Human
gaauuaacuggcaguuagugcu

SEQ ID NO: 269613 - RNA, 20 nt, Human
ggugcugauaagaaagaagu

SEQ ID NO: 269614 - RNA, 22 nt, Human
uccuggagcuggugucuuuccc

SEQ ID NO: 269615 - RNA, 22 nt, Human
acaugcauucucuaaaagcaaa

SEQ ID NO: 269616 - RNA, 21 nt, Human
ggccucugucauccugggaag

SEQ ID NO: 269617 - RNA, 22 nt, Human
auuugcuugugcuaugaaaguu

SEQ ID NO: 269618 - RNA, 22 nt, Human
cugcagcugggccagggccacc

SEQ ID NO: 269619 - RNA, 22 nt, Human
agacuucuugagcuggcacuuc

SEQ ID NO: 269620 - RNA, 22 nt, Human
ccccaggcagggccuaacagag

SEQ ID NO: 269621 - RNA, 22 nt, Human
agagacaggguuuugucguguu

SEQ ID NO: 269622 - RNA, 18 nt, Human
gccugggaggaggaaaug

SEQ ID NO: 269623 - RNA, 22 nt, Human
ggccuguguccuccuugcccug

SEQ ID NO: 269624 - RNA, 22 nt, Human
acugagagcguguacaaacuua

SEQ ID NO: 269625 - RNA, 22 nt, Human
ccauuggagccaagaguuuuac

SEQ ID NO: 269626 - RNA, 22 nt, Human
cuggaaagucaggucagaaacu

SEQ ID NO: 269627 - RNA, 22 nt, Human
gccaccaguagcuaacaacagu

SEQ ID NO: 269628 - RNA, 22 nt, Human
gagaagcucuagagguguuuuu

SEQ ID NO: 269629 - RNA, 22 nt, Human
agacagggucuugaucagagcu

SEQ ID NO: 269630 - RNA, 22 nt, Human
gaguccaguaguuaggacagag

SEQ ID NO: 269631 - RNA, 22 nt, Human
cccaggucugccagccuguggg

SEQ ID NO: 269632 - RNA, 22 nt, Human
agaaaguucugugaguuguuca

SEQ ID NO: 269633 - RNA, 22 nt, Human
uuccaggaggucaaaggccugu

SEQ ID NO: 269634 - RNA, 22 nt, Human
aaauuugauaagccauuguuac

SEQ ID NO: 269635 - RNA, 22 nt, Human
uggggaagggcacccuggagac

SEQ ID NO: 269636 - RNA, 21 nt, Human
agacaguaacucuucuacucc

SEQ ID NO: 269637 - RNA, 22 nt, Human
ugaaggagaauuaauaggcauu

SEQ ID NO: 269638 - RNA, 20 nt, Human
cugggcagguguuugaucuc

SEQ ID NO: 269639 - RNA, 22 nt, Human
ucaaacuagccugacugguauu

SEQ ID NO: 269640 - RNA, 22 nt, Human
acacagaguccuuacugaggua

SEQ ID NO: 269641 - RNA, 22 nt, Human
cuagggcagggaguguuugcgc

SEQ ID NO: 269642 - RNA, 22 nt, Human
acaauaugggauauacauuuua

SEQ ID NO: 269643 - RNA, 22 nt, Human
agugaaaacacuaguucuugcc

SEQ ID NO: 269644 - RNA, 22 nt, Human
gggccaaggggagcuggaaggg

SEQ ID NO: 269645 - RNA, 22 nt, Human
cuccagugcugucaucccuucc

SEQ ID NO: 269646 - RNA, 22 nt, Human
aggacacacugcaagagccugg

SEQ ID NO: 269647 - RNA, 22 nt, Human
cccaggcuggagugcaauggca

SEQ ID NO: 269648 - RNA, 22 nt, Human
acaugauuaaaagauuuuaaag

SEQ ID NO: 269649 - RNA, 21 nt, Human
uggcugcaagcagcugccucc

SEQ ID NO: 269650 - RNA, 22 nt, Human
cacauguucuugaagccaacuc

SEQ ID NO: 269651 - RNA, 21 nt, Human
aggcucagcagguguauaaag

SEQ ID NO: 269652 - RNA, 22 nt, Human
ugcugucuuccaggauggugaa

SEQ ID NO: 269653 - RNA, 22 nt, Human
uggcucagagcagggacucugg

SEQ ID NO: 269654 - RNA, 22 nt, Human
auucugggagguagaacugaaa

SEQ ID NO: 269655 - RNA, 22 nt, Human
acuuucuucuuaugcauuaagg

SEQ ID NO: 269656 - RNA, 22 nt, Human
gggaugagagcugggacagaag

SEQ ID NO: 269657 - RNA, 22 nt, Human
ugggcugcagagcccggccuuc

SEQ ID NO: 269658 - RNA, 22 nt, Human
uucaguguuaaauucaaagagu

SEQ ID NO: 269659 - RNA, 19 nt, Human
uugugacuggcucugcaua

SEQ ID NO: 269660 - RNA, 22 nt, Human
augaggaugggaagggagccaa

SEQ ID NO: 269661 - RNA, 22 nt, Human
ccucagcauccuccugcucagu

SEQ ID NO: 269662 - RNA, 22 nt, Human
ggcaccagccaccuauuucuag

SEQ ID NO: 269663 - RNA, 21 nt, Human
gcuggcucucugacgugcuuu

SEQ ID NO: 269664 - RNA, 22 nt, Human
aguucacauuccgagguacugg

SEQ ID NO: 269665 - RNA, 22 nt, Human
uauaagcaugcuucauauggau

SEQ ID NO: 269666 - RNA, 22 nt, Human
gcccaggaaaugccccguggug

SEQ ID NO: 269667 - RNA, 22 nt, Human
aacacagguugcugggccucac

SEQ ID NO: 269668 - RNA, 22 nt, Human
uugcuuuucccugucucugauu

SEQ ID NO: 269669 - RNA, 22 nt, Human
auuaguguucuuaucuucuagg

SEQ ID NO: 269670 - RNA, 22 nt, Human
aaaagguaguugccaaauaagg

SEQ ID NO: 269671 - RNA, 22 nt, Human
aaaugacacucauucaguguca

SEQ ID NO: 269672 - RNA, 22 nt, Human
acugccuuagaacaaagcagga

SEQ ID NO: 269673 - RNA, 19 nt, Human
agugcagggagcacccuca

SEQ ID NO: 269674 - RNA, 22 nt, Human
accaggcagcugggggugaugu

SEQ ID NO: 269675 - RNA, 18 nt, Human
gaguccaggcucuucacc

SEQ ID NO: 269676 - RNA, 22 nt, Human
caggugaguuuuccuccuuggu

SEQ ID NO: 269677 - RNA, 21 nt, Human
uuucuguccuuuccaucagcu

SEQ ID NO: 269678 - RNA, 22 nt, Human
cuucaggauuuaggaagaugaa

SEQ ID NO: 269679 - RNA, 19 nt, Human
caggacagacuucaaagcc

SEQ ID NO: 269680 - RNA, 22 nt, Human
auagaacagaaacagaugcaca

SEQ ID NO: 269681 - RNA, 23 nt, Human
agaaaaacaggauuguguuccua

SEQ ID NO: 269682 - RNA, 22 nt, Human
uaauuauaacaugcuuucuggc

SEQ ID NO: 269683 - RNA, 22 nt, Human
gcuagagaccagaggccuugaa

SEQ ID NO: 269684 - RNA, 22 nt, Human
cacuguacugugaauaaggagg

SEQ ID NO: 269685 - RNA, 22 nt, Human
cugcggugggcugggcuguccc

SEQ ID NO: 269686 - RNA, 22 nt, Human
aaguuuuauuggcuauagcacu

SEQ ID NO: 269687 - RNA, 22 nt, Human
caggcacuggccagucagcaca

SEQ ID NO: 269688 - RNA, 22 nt, Human
acaguauaccauugugacuuug

SEQ ID NO: 269689 - RNA, 22 nt, Human
gaugaauugaaaucauugggca

SEQ ID NO: 269690 - RNA, 22 nt, Human
ucccacccccuccaaggaggaa

SEQ ID NO: 269691 - RNA, 22 nt, Human
gcauguguugguuuaugcaugu

SEQ ID NO: 269692 - RNA, 22 nt, Human
augcaacaggguugggaggcgg

SEQ ID NO: 269693 - RNA, 22 nt, Human
uggcucugcgucuguucguggg

SEQ ID NO: 269694 - RNA, 22 nt, Human
aaaugccucuggguuauucuag

SEQ ID NO: 269695 - RNA, 22 nt, Human
gaguaguugcugcagagaauac

SEQ ID NO: 269696 - RNA, 22 nt, Human
aggcaaauuauuguaugcaguu

SEQ ID NO: 269697 - RNA, 22 nt, Human
auagcaaagaugucaauucccc

SEQ ID NO: 269698 - RNA, 22 nt, Human
ucuguaucacccguucccagaa

SEQ ID NO: 269699 - RNA, 22 nt, Human
ucuggaggccauagggaaggau

SEQ ID NO: 269700 - RNA, 22 nt, Human
uugcauuccaguccccacugug

SEQ ID NO: 269701 - RNA, 22 nt, Human
cuuguccccagcagguugguuu

SEQ ID NO: 269702 - RNA, 22 nt, Human
uuccugagggacuuuugagauu

SEQ ID NO: 269703 - RNA, 22 nt, Human
uuugcaaagugcuugcagagua

SEQ ID NO: 269704 - RNA, 22 nt, Human
uucagagcagauauugaagggu

SEQ ID NO: 269705 - RNA, 22 nt, Human
uugaggaguggcgcuggacuua

SEQ ID NO: 269706 - RNA, 21 nt, Human
agaugaggauacugaggccua

SEQ ID NO: 269707 - RNA, 22 nt, Human
ucagcagguggugggcagguga

SEQ ID NO: 269708 - RNA, 22 nt, Human
ggacugggcaugggugcucugc

SEQ ID NO: 269709 - RNA, 19 nt, Human
gcgaggaagucacuguggu

SEQ ID NO: 269710 - RNA, 22 nt, Human
acauucuuucaccuugugucca

SEQ ID NO: 269711 - RNA, 22 nt, Human
agaaggaaggcugagugcugau

SEQ ID NO: 269712 - RNA, 22 nt, Human
agagcccugccaauggaugagg

SEQ ID NO: 269713 - RNA, 22 nt, Human
agccucccuaugcaccuucagg

SEQ ID NO: 269714 - RNA, 22 nt, Human
ggcugccugaggcugaggcccg

SEQ ID NO: 269715 - RNA, 22 nt, Human
aaugaguuauuagguguaagug

SEQ ID NO: 269716 - RNA, 19 nt, Human
cagggauggguagggacuc

SEQ ID NO: 269717 - RNA, 20 nt, Human
ucuuauugucuugaggaguu

SEQ ID NO: 269718 - RNA, 22 nt, Human
gucugaggucauuagcucucuu

SEQ ID NO: 269719 - RNA, 18 nt, Human
cagucuaauucccuuccc

SEQ ID NO: 269720 - RNA, 22 nt, Human
uucugcuuuuagcuaaacuaua

SEQ ID NO: 269721 - RNA, 22 nt, Human
agcugucuuucugccuccugau

SEQ ID NO: 269722 - RNA, 22 nt, Human
agcaggugucggcgagggucuu

SEQ ID NO: 269723 - RNA, 22 nt, Human
uucagugugcuucaggacguua

SEQ ID NO: 269724 - RNA, 22 nt, Human
ugucuucaugccugaaagaaga

SEQ ID NO: 269725 - RNA, 20 nt, Human
ccccuucaucuacagccuga

SEQ ID NO: 269726 - RNA, 22 nt, Human
uuuuaucauuacccagcugaaa

SEQ ID NO: 269727 - RNA, 22 nt, Human
uccuuuaucugcucagaaagua

SEQ ID NO: 269728 - RNA, 22 nt, Human
auauaguuggguuucauucuac

SEQ ID NO: 269729 - RNA, 22 nt, Human
aucagcaaggcaaucacugcag

SEQ ID NO: 269730 - RNA, 22 nt, Human
gcagagcugcagcgaggccugg

SEQ ID NO: 269731 - RNA, 22 nt, Human
ucagcugugauccaucuaucua

SEQ ID NO: 269732 - RNA, 21 nt, Human
auucucugugaugggauuagg

SEQ ID NO: 269733 - RNA, 22 nt, Human
cugcuguccaaccugcacucgc

SEQ ID NO: 269734 - RNA, 19 nt, Human
gauuucuacaaaugucaga

SEQ ID NO: 269735 - RNA, 17 nt, Human
ggcucucuuccagacuu

SEQ ID NO: 269736 - RNA, 20 nt, Human
guauuaggagguaaauguaa

SEQ ID NO: 269737 - RNA, 21 nt, Human
uguuuuccaccuugaggcaag

SEQ ID NO: 269738 - RNA, 22 nt, Human
agcugagauuaugcucuucuca

SEQ ID NO: 269739 - RNA, 22 nt, Human
cugcagggcccgccugagcccu

SEQ ID NO: 269740 - RNA, 22 nt, Human
augaagcaacagcccuccuauu

SEQ ID NO: 269741 - RNA, 18 nt, Human
ccuucagcucugccagua

SEQ ID NO: 269742 - RNA, 22 nt, Human
ggaucuguuuugccucugaggg

SEQ ID NO: 269743 - RNA, 22 nt, Human
acuccagggcuccaccccagau

SEQ ID NO: 269744 - RNA, 22 nt, Human
ugagcccaggaguuggaggcug

SEQ ID NO: 269745 - RNA, 22 nt, Human
auaguguuacccuucuuaaagu

SEQ ID NO: 269746 - RNA, 22 nt, Human
ugucagcagaucuccugcagcc

SEQ ID NO: 269747 - RNA, 22 nt, Human
acuuuagauauuccucuguaca

SEQ ID NO: 269748 - RNA, 23 nt, Human
ggcuccuggauucaaauccugcc

SEQ ID NO: 269749 - RNA, 22 nt, Human
auuuucuucucucccuggcugc

SEQ ID NO: 269750 - RNA, 22 nt, Human
ucuuauacagaagauguuuaau

SEQ ID NO: 269751 - RNA, 22 nt, Human
cuccuggcuuucccagaccagg

SEQ ID NO: 269752 - RNA, 22 nt, Human
ugcauuucagaagaaaauucgg

SEQ ID NO: 269753 - RNA, 22 nt, Human
auaucacaaacaagucuguacu

SEQ ID NO: 269754 - RNA, 20 nt, Human
cugggcucgguggcccuggc

SEQ ID NO: 269755 - RNA, 18 nt, Human
ucccugggauauaauuac

SEQ ID NO: 269756 - RNA, 19 nt, Human
uccuggggauguggucacc

SEQ ID NO: 269757 - RNA, 22 nt, Human
auguuauuuuggaaaauacaaa

SEQ ID NO: 269758 - RNA, 22 nt, Human
uagggauggaugaugccuggca

SEQ ID NO: 269759 - RNA, 22 nt, Human
agcccagagccucuccuaaagg

SEQ ID NO: 269760 - RNA, 22 nt, Human
agagcuuuuacuuacauucuau

SEQ ID NO: 269761 - RNA, 22 nt, Human
agagcccuaaacccugccuugg

SEQ ID NO: 269762 - RNA, 22 nt, Human
gugggcagagcaagggaacuca

SEQ ID NO: 269763 - RNA, 22 nt, Human
guggucagaauggagcccagga

SEQ ID NO: 269764 - RNA, 22 nt, Human
gcuucugaggaaggcucagccu

SEQ ID NO: 269765 - RNA, 18 nt, Human
uggcagguagacucaggu

SEQ ID NO: 269766 - RNA, 22 nt, Human
cagggaugagaaagcucucuaa

SEQ ID NO: 269767 - RNA, 22 nt, Human
ugugguggcuauucuggucuca

SEQ ID NO: 269768 - RNA, 22 nt, Human
uuaaaaccaucagcuguaagau

SEQ ID NO: 269769 - RNA, 22 nt, Human
aagauaacaggaggaguuugua

SEQ ID NO: 269770 - RNA, 22 nt, Human
accaggcaaaaccacaggagca

SEQ ID NO: 269771 - RNA, 22 nt, Human
gccugcucuccggaucccugau

SEQ ID NO: 269772 - RNA, 22 nt, Human
guucuuaagaccacaauaaaaa

SEQ ID NO: 269773 - RNA, 20 nt, Human
uuccuguauacaaagaguuc

SEQ ID NO: 269774 - RNA, 22 nt, Human
uguuacagcagaauugaaagag

SEQ ID NO: 269775 - RNA, 22 nt, Human
uuagguuuaagugacuggaauc

SEQ ID NO: 269776 - RNA, 22 nt, Human
cagggccucauccucagagauu

SEQ ID NO: 269777 - RNA, 22 nt, Human
cugagaauggacagcagggcag

SEQ ID NO: 269778 - RNA, 21 nt, Human
ugucagcucccuguccugugu

SEQ ID NO: 269779 - RNA, 22 nt, Human
gcugcucucauagauggcuuca

SEQ ID NO: 269780 - RNA, 22 nt, Human
uaaguucauaagcuuauucuua

SEQ ID NO: 269781 - RNA, 22 nt, Human
aacacaggccagccugugcagu

SEQ ID NO: 269782 - RNA, 22 nt, Human
agcugaggacgugaagggcggc

SEQ ID NO: 269783 - RNA, 22 nt, Human
cagcaccauuugcagccucuuu

SEQ ID NO: 269784 - RNA, 22 nt, Human
gcuuuauuuugugagggauuac

SEQ ID NO: 269785 - RNA, 18 nt, Human
cccucuccugcuaguggg

SEQ ID NO: 269786 - RNA, 22 nt, Human
augucuguacgaguuacaaugg

SEQ ID NO: 269787 - RNA, 22 nt, Human
aaagcugcccagcugccuguuu

SEQ ID NO: 269788 - RNA, 22 nt, Human
gcagcaggaauaggauaagcaa

SEQ ID NO: 269789 - RNA, 22 nt, Human
uuacauucaaggaacucauucu

SEQ ID NO: 269790 - RNA, 22 nt, Human
cugagggccugaggaccuagau

SEQ ID NO: 269791 - RNA, 22 nt, Human
ugccuggauucgguuguuguca

SEQ ID NO: 269792 - RNA, 16 nt, Human
gcuguaaaaggauuca

SEQ ID NO: 269793 - RNA, 22 nt, Human
ucagaaggaugugcagguggca

SEQ ID NO: 269794 - RNA, 22 nt, Human
gcagacaggggcuuaggaaagg

SEQ ID NO: 269795 - RNA, 22 nt, Human
cacugcccaggaccugccaccc

SEQ ID NO: 269796 - RNA, 20 nt, Human
agcaguccaaaagggcagac

SEQ ID NO: 269797 - RNA, 22 nt, Human
acacaucuccagccagcaggag

SEQ ID NO: 269798 - RNA, 22 nt, Human
ucucugcaacuacaucuuaggg

SEQ ID NO: 269799 - RNA, 22 nt, Human
ggugggaggcaggcugcuccca

SEQ ID NO: 269800 - RNA, 22 nt, Human
cuagauuugcaugccuacacca

SEQ ID NO: 269801 - RNA, 22 nt, Human
cagcugagaaggucugaucagg

SEQ ID NO: 269802 - RNA, 22 nt, Human
cacaugugggaaauggugcuua

SEQ ID NO: 269803 - RNA, 20 nt, Human
gggaggccagccucagagaa

SEQ ID NO: 269804 - RNA, 22 nt, Human
aaaagucucucugaguaaaagu

SEQ ID NO: 269805 - RNA, 22 nt, Human
uaacuguaguuauaaagcuauc

SEQ ID NO: 269806 - RNA, 22 nt, Human
caggagaagguuuggagugcag

SEQ ID NO: 269807 - RNA, 22 nt, Human
uauuucuaagagauaucuguac

SEQ ID NO: 269808 - RNA, 22 nt, Human
auaaggcaucucucaguuagca

SEQ ID NO: 269809 - RNA, 22 nt, Human
ccuugguuuccaggaugaggcu

SEQ ID NO: 269810 - RNA, 22 nt, Human
aaggcuugauauuuacagucuu

SEQ ID NO: 269811 - RNA, 22 nt, Human
uggcuggaugugagaucaagag

SEQ ID NO: 269812 - RNA, 22 nt, Human
gagggcuguggggcaugaccag

SEQ ID NO: 269813 - RNA, 23 nt, Human
uccaaauaccugucaccuugucu

SEQ ID NO: 269814 - RNA, 22 nt, Human
cgccugcucucacuggacagcu

SEQ ID NO: 269815 - RNA, 22 nt, Human
ucuggccacuaauaggucucac

SEQ ID NO: 269816 - RNA, 22 nt, Human
ucauggcucuaaagacauagau

SEQ ID NO: 269817 - RNA, 18 nt, Human
guuaacaauuacuaacgc

SEQ ID NO: 269818 - RNA, 22 nt, Human
aagccaguccucuacugggcac

SEQ ID NO: 269819 - RNA, 22 nt, Human
auuccaaacuuaccccagagga

SEQ ID NO: 269820 - RNA, 22 nt, Human
ucaagaugaaagauguagccau

SEQ ID NO: 269821 - RNA, 20 nt, Human
uuggaaucaccuggagaggu

SEQ ID NO: 269822 - RNA, 22 nt, Human
ugucuccacaggugucagcuca

SEQ ID NO: 269823 - RNA, 22 nt, Human
uuugcugaauaaaugugugacu

SEQ ID NO: 269824 - RNA, 19 nt, Human
aucugagauuauaaacaga

SEQ ID NO: 269825 - RNA, 22 nt, Human
caugcuguccugccagggaugg

SEQ ID NO: 269826 - RNA, 22 nt, Human
acacuugagguuuuuaggugcg

SEQ ID NO: 269827 - RNA, 22 nt, Human
ccagggaaggcucugccugcuu

SEQ ID NO: 269828 - RNA, 22 nt, Human
uuucaaagaguuguaaauuacu

SEQ ID NO: 269829 - RNA, 22 nt, Human
ccugucucuuucaaucugagag

SEQ ID NO: 269830 - RNA, 22 nt, Human
uggagcagggcaucacugugcg

SEQ ID NO: 269831 - RNA, 22 nt, Human
cuggagcucuccagagccccgu

SEQ ID NO: 269832 - RNA, 22 nt, Human
guccaggucuggacccugagcc

SEQ ID NO: 269833 - RNA, 22 nt, Human
uggcagggaguucguucacaac

SEQ ID NO: 269834 - RNA, 22 nt, Human
gacuuucugcuauacuuucugu

SEQ ID NO: 269835 - RNA, 22 nt, Human
ugggcucuggguggccugagca

SEQ ID NO: 269836 - RNA, 22 nt, Human
ccaggcucugugugggcuagag

SEQ ID NO: 269837 - RNA, 22 nt, Human
guauacauagaugaugaacaag

SEQ ID NO: 269838 - RNA, 22 nt, Human
ccuccagcgcgauccacuccgg

SEQ ID NO: 269839 - RNA, 22 nt, Human
uacaacauuguguugcuucaua

SEQ ID NO: 269840 - RNA, 22 nt, Human
auuacaguggguaaacagaauu

SEQ ID NO: 269841 - RNA, 22 nt, Human
uugcugaucugugaaucagcca

SEQ ID NO: 269842 - RNA, 23 nt, Human
uugcuuucaucaugagaugcucc

SEQ ID NO: 269843 - RNA, 22 nt, Human
aucauuaguuguggaauucuug

SEQ ID NO: 269844 - RNA, 22 nt, Human
gaggccagaugucaugucuuau

SEQ ID NO: 269845 - RNA, 22 nt, Human
agcagguggccacgaggaggag

SEQ ID NO: 269846 - RNA, 22 nt, Human
acccagagccagggucaggagc

SEQ ID NO: 269847 - RNA, 22 nt, Human
cugggcucaccuguggcuggca

SEQ ID NO: 269848 - RNA, 22 nt, Human
caaagcccuggaaagaugaaga

SEQ ID NO: 269849 - RNA, 22 nt, Human
ucagcuuugccaccagcuguaa

SEQ ID NO: 269850 - RNA, 22 nt, Human
ggcucuuguucguaccauggcu

SEQ ID NO: 269851 - RNA, 22 nt, Human
gagcagugaugggaggacguca

SEQ ID NO: 269852 - RNA, 22 nt, Human
agacugaaguaagaaugcagcu

SEQ ID NO: 269853 - RNA, 22 nt, Human
guggcagguuccguagacagca

SEQ ID NO: 269854 - RNA, 22 nt, Human
cagugcccuuccaggacugcag

SEQ ID NO: 269855 - RNA, 22 nt, Human
caccucaugucaucaguaaaau

SEQ ID NO: 269856 - RNA, 22 nt, Human
acagauggaauguguuauggga

SEQ ID NO: 269857 - RNA, 22 nt, Human
uugaggagguaguacagaguau

SEQ ID NO: 269858 - RNA, 22 nt, Human
uaguuuugaggauuauauguga

SEQ ID NO: 269859 - RNA, 22 nt, Human
uacacaccugccugcagacucu

SEQ ID NO: 269860 - RNA, 22 nt, Human
uccaggaggguuuucugccuuc

SEQ ID NO: 269861 - RNA, 22 nt, Human
cccuuccucccaggcuucugug

SEQ ID NO: 269862 - RNA, 22 nt, Human
aagaugugcugucuugccacuc

SEQ ID NO: 269863 - RNA, 22 nt, Human
aguucccaaauuacaggccaca

SEQ ID NO: 269864 - RNA, 22 nt, Human
aagucacugugaaaggugaagc

SEQ ID NO: 269865 - RNA, 22 nt, Human
agcugccuguccuaggccauca

SEQ ID NO: 269866 - RNA, 22 nt, Human
agggcugacagugaggagucaa

SEQ ID NO: 269867 - RNA, 22 nt, Human
gcugccaucuccugaggacagg

SEQ ID NO: 269868 - RNA, 22 nt, Human
ccaggaccacacgacaggagag

SEQ ID NO: 269869 - RNA, 22 nt, Human
ggguuccagucugaaacuacag

SEQ ID NO: 269870 - RNA, 20 nt, Human
uuucucagaacaguggcugc

SEQ ID NO: 269871 - RNA, 22 nt, Human
uccaggcacuauauauacuuuu

SEQ ID NO: 269872 - RNA, 22 nt, Human
gaaacauauuaauccagugaaa

SEQ ID NO: 269873 - RNA, 22 nt, Human
uccaugcagaguccaggccuca

SEQ ID NO: 269874 - RNA, 22 nt, Human
uuucucaaauugcaugaguagc

SEQ ID NO: 269875 - RNA, 21 nt, Human
gucuuucuaccucuauguggc

SEQ ID NO: 269876 - RNA, 22 nt, Human
ccaugugucgggccugcagugg

SEQ ID NO: 269877 - RNA, 22 nt, Human
uauaauccauucauugauuucu

SEQ ID NO: 269878 - RNA, 22 nt, Human
uuugacuccacuccuaacuccu

SEQ ID NO: 269879 - RNA, 22 nt, Human
aaccuuugaggggagcucuuuc

SEQ ID NO: 269880 - RNA, 22 nt, Human
ccauuacuuuccaauauaucag

SEQ ID NO: 269881 - RNA, 22 nt, Human
ugauagagcacuaaguagugua

SEQ ID NO: 269882 - RNA, 22 nt, Human
uuaggaaaauggaguccuuuua

SEQ ID NO: 269883 - RNA, 22 nt, Human
caaauucagaaaauugguagag

SEQ ID NO: 269884 - RNA, 22 nt, Human
auuucuagccucugaaguagga

SEQ ID NO: 269885 - RNA, 22 nt, Human
acccagagcugggcuuggcaaa

SEQ ID NO: 269886 - RNA, 22 nt, Human
aauuauacaauugucaaguucu

SEQ ID NO: 269887 - RNA, 22 nt, Human
cagggagaucuuggcuccuggu

SEQ ID NO: 269888 - RNA, 22 nt, Human
uaauacuugucauaaaggcauu

SEQ ID NO: 269889 - RNA, 22 nt, Human
ccaggugugcucugcaguggau

SEQ ID NO: 269890 - RNA, 23 nt, Human
ucuccagugucucuucauugagu

SEQ ID NO: 269891 - RNA, 22 nt, Human
gaguguguucuuuaugcuguga

SEQ ID NO: 269892 - RNA, 22 nt, Human
gaggcugggaaguccaagauca

SEQ ID NO: 269893 - RNA, 22 nt, Human
uaguaacucuacacacgacacu

SEQ ID NO: 269894 - RNA, 22 nt, Human
auuaacaugaguuggagauagg

SEQ ID NO: 269895 - RNA, 22 nt, Human
gcaggcuaugucagggccgcuc

SEQ ID NO: 269896 - RNA, 22 nt, Human
gcccugcucauuucacguguuu

SEQ ID NO: 269897 - RNA, 23 nt, Human
cuucagcagaaacauaaauucuc

SEQ ID NO: 269898 - RNA, 22 nt, Human
auuaaauuagcaaacugugaaa

SEQ ID NO: 269899 - RNA, 22 nt, Human
ucccagaggcaguugguaacuu

SEQ ID NO: 269900 - RNA, 22 nt, Human
gaggcuuuuggcuaauaacugu

SEQ ID NO: 269901 - RNA, 22 nt, Human
uggcacagccacugaaucggga

SEQ ID NO: 269902 - RNA, 22 nt, Human
acauaagugcacaauaaauauu

SEQ ID NO: 269903 - RNA, 22 nt, Human
auuagggaaggauuuggccuga

SEQ ID NO: 269904 - RNA, 22 nt, Human
uccacacacauuucuaugugca

SEQ ID NO: 269905 - RNA, 22 nt, Human
uccugaggaugguugaagugca

SEQ ID NO: 269906 - RNA, 22 nt, Human
auacaucuugucagauucaugu

SEQ ID NO: 269907 - RNA, 22 nt, Human
gugcaggagcaggagccauguc

SEQ ID NO: 269908 - RNA, 22 nt, Human
uccaggagggggagccgugccg

SEQ ID NO: 269909 - RNA, 22 nt, Human
ccugugacccuuccagucuacu

SEQ ID NO: 269910 - RNA, 22 nt, Human
agacagaaauaggagaaaccag

SEQ ID NO: 269911 - RNA, 22 nt, Human
cagcuuggauuuuggcacgugu

SEQ ID NO: 269912 - RNA, 22 nt, Human
aaaugucuuugaguauuucugc

SEQ ID NO: 269913 - RNA, 22 nt, Human
uccuccagcccucuaggaaaau

SEQ ID NO: 269914 - RNA, 22 nt, Human
cacaggaaucgucacuuagcgc

SEQ ID NO: 269915 - RNA, 20 nt, Human
agggugugggccuuagccau

SEQ ID NO: 269916 - RNA, 22 nt, Human
ggcccagauuagaagcugaaug

SEQ ID NO: 269917 - RNA, 22 nt, Human
uucuaaguguugacaaagucua

SEQ ID NO: 269918 - RNA, 22 nt, Human
gccacugucaucuugugaagca

SEQ ID NO: 269919 - RNA, 22 nt, Human
ccuuggcuugugggcugcagcc

SEQ ID NO: 269920 - RNA, 22 nt, Human
cccaggcauuuucaacuuuagu

SEQ ID NO: 269921 - RNA, 22 nt, Human
uucaacaugcuuuauuucuaaa

SEQ ID NO: 269922 - RNA, 22 nt, Human
auaaacuggguaucaagaggcc

SEQ ID NO: 269923 - RNA, 22 nt, Human
ucccaggugaugcugaggccac

SEQ ID NO: 269924 - RNA, 22 nt, Human
gcacagccacguaaugugguca

SEQ ID NO: 269925 - RNA, 22 nt, Human
gucuucuuguguugccugucuu

SEQ ID NO: 269926 - RNA, 22 nt, Human
cccaggcugggaacgauucuag

SEQ ID NO: 269927 - RNA, 22 nt, Human
cagggccucuccuccaggaacu

SEQ ID NO: 269928 - RNA, 22 nt, Human
acacacaauuaguuuuaugcuu

SEQ ID NO: 269929 - RNA, 22 nt, Human
gugguccuggcaaccaugguga

SEQ ID NO: 269930 - RNA, 22 nt, Human
gagcaguucuccuugguagggg

SEQ ID NO: 269931 - RNA, 22 nt, Human
uuuacugaauuugguauauucc

SEQ ID NO: 269932 - RNA, 22 nt, Human
gcuggagauaguaggauccaua

SEQ ID NO: 269933 - RNA, 22 nt, Human
agagagagggaaacugcuaaac

SEQ ID NO: 269934 - RNA, 22 nt, Human
acuuggcuucaagguuaagguc

SEQ ID NO: 269935 - RNA, 22 nt, Human
ugcuuggcuagcuuggcagcuc

SEQ ID NO: 269936 - RNA, 22 nt, Human
aggaagaauguuuacauaucaa

SEQ ID NO: 269937 - RNA, 22 nt, Human
gagcugaaguuuccauuuguac

SEQ ID NO: 269938 - RNA, 22 nt, Human
ugaguuaaaugagaacaugaaa

SEQ ID NO: 269939 - RNA, 22 nt, Human
ugaaucauggauaaauagcuua

SEQ ID NO: 269940 - RNA, 20 nt, Human
aauuauauaacuccaacauu

SEQ ID NO: 269941 - RNA, 19 nt, Human
ccugggagucagcugaagg

SEQ ID NO: 269942 - RNA, 22 nt, Human
cagcaucucuuuuugcauuccu

SEQ ID NO: 269943 - RNA, 22 nt, Human
uucacauuacaaggccauauuu

SEQ ID NO: 269944 - RNA, 22 nt, Human
guucaaauugauuuugguaaag

SEQ ID NO: 269945 - RNA, 22 nt, Human
uuucacauguggaaugccaggu

SEQ ID NO: 269946 - RNA, 22 nt, Human
augcaaaugcuagagaauguug

SEQ ID NO: 269947 - RNA, 22 nt, Human
ccacccagcagaggaggcaaga

SEQ ID NO: 269948 - RNA, 22 nt, Human
uguccuuuuucuuaggaaauau

SEQ ID NO: 269949 - RNA, 22 nt, Human
guauuuucaugauuucagacca

SEQ ID NO: 269950 - RNA, 22 nt, Human
uccugagacaucucugcugguc

SEQ ID NO: 269951 - RNA, 22 nt, Human
uguccucaaggagcuucagucu

SEQ ID NO: 269952 - RNA, 22 nt, Human
cugccuggugcggugcccaccc

SEQ ID NO: 269953 - RNA, 22 nt, Human
aaguacuguaucacuuacuccu

SEQ ID NO: 269954 - RNA, 22 nt, Human
gggacacagagaaacuggagaa

SEQ ID NO: 269955 - RNA, 22 nt, Human
gacccaggagagaggguugcau

SEQ ID NO: 269956 - RNA, 21 nt, Human
cacaccaggcaugucuugagc

SEQ ID NO: 269957 - RNA, 22 nt, Human
uuauuugugaaucauuuaucua

SEQ ID NO: 269958 - RNA, 22 nt, Human
cucuaaaggcuuguuauugcau

SEQ ID NO: 269959 - RNA, 22 nt, Human
gagaggggcgcgcagcucgcga

SEQ ID NO: 269960 - RNA, 22 nt, Human
ucucuggguuuuuguccuguac

SEQ ID NO: 269961 - RNA, 22 nt, Human
cuggcacucauaggccaguuca

SEQ ID NO: 269962 - RNA, 23 nt, Human
agucaagaugcaucugugaggaa

SEQ ID NO: 269963 - RNA, 22 nt, Human
cauguacacucauguaacuaua

SEQ ID NO: 269964 - RNA, 22 nt, Human
cucucuguucauugagucaaaa

SEQ ID NO: 269965 - RNA, 18 nt, Human
uccagggcuuccuccucu

SEQ ID NO: 269966 - RNA, 22 nt, Human
gcuguccacgggguugguagag

SEQ ID NO: 269967 - RNA, 22 nt, Human
gcuccugggcucuaccuugcua

SEQ ID NO: 269968 - RNA, 22 nt, Human
gucucacacagaguagauuuug

SEQ ID NO: 269969 - RNA, 22 nt, Human
cgcagagggcaggcagugcugg

SEQ ID NO: 269970 - RNA, 22 nt, Human
aggacucacauagcuucagaug

SEQ ID NO: 269971 - RNA, 22 nt, Human
uccagccccuuuuacucauuca

SEQ ID NO: 269972 - RNA, 22 nt, Human
ccaaggacuggacacacagguu

SEQ ID NO: 269973 - RNA, 22 nt, Human
cuuguauuaggaagaaugcuuu

SEQ ID NO: 269974 - RNA, 22 nt, Human
uagaaaguaaaucaguuuuauu

SEQ ID NO: 269975 - RNA, 21 nt, Human
aguguuaauggaaauuauauu

SEQ ID NO: 269976 - RNA, 20 nt, Human
gacacaggcaguccucagag

SEQ ID NO: 269977 - RNA, 22 nt, Human
ugaggccuggagggaggaguuu

SEQ ID NO: 269978 - RNA, 22 nt, Human
ugggccagagaguaagaaaggu

SEQ ID NO: 269979 - RNA, 22 nt, Human
uccuggccuuauccccaaacug

SEQ ID NO: 269980 - RNA, 22 nt, Human
uagaacaguauaggcuaaacau

SEQ ID NO: 269981 - RNA, 22 nt, Human
cugggcaaauugugccagcuau

SEQ ID NO: 269982 - RNA, 22 nt, Human
uagaaucuaguucauucauuug

SEQ ID NO: 269983 - RNA, 22 nt, Human
ccugggucuccuccugcuggcu

SEQ ID NO: 269984 - RNA, 21 nt, Human
gccugcugccuguggccgguc

SEQ ID NO: 269985 - RNA, 22 nt, Human
cagaaaauagaguuucucugag

SEQ ID NO: 269986 - RNA, 22 nt, Human
ucauuacaguguuuauaugucu

SEQ ID NO: 269987 - RNA, 22 nt, Human
uuuauuauccaguguugucaug

SEQ ID NO: 269988 - RNA, 19 nt, Human
aaugacugaguacauuguc

SEQ ID NO: 269989 - RNA, 22 nt, Human
gaggccuccucugagacaucug

SEQ ID NO: 269990 - RNA, 22 nt, Human
uaguuacaauuaugcauggaaa

SEQ ID NO: 269991 - RNA, 22 nt, Human
gagggaagaaagaauugaugcg

SEQ ID NO: 269992 - RNA, 22 nt, Human
aaucacagaguccagcagauga

SEQ ID NO: 269993 - RNA, 22 nt, Human
gcagccuuccguggaccuggac

SEQ ID NO: 269994 - RNA, 22 nt, Human
guccuucagcuuuaucugaaca

SEQ ID NO: 269995 - RNA, 22 nt, Human
uacuuuuuagcacagugugugc

SEQ ID NO: 269996 - RNA, 22 nt, Human
gaggcuccccaugaggccccag

SEQ ID NO: 269997 - RNA, 22 nt, Human
agcaguguucuaaucuggcuag

SEQ ID NO: 269998 - RNA, 22 nt, Human
cuucccugagcuuucucaggcu

SEQ ID NO: 269999 - RNA, 19 nt, Human
uguuucuuccuccaucuga

SEQ ID NO: 270000 - RNA, 22 nt, Human
cuggccuggcagggagggcaug

SEQ ID NO: 270001 - RNA, 22 nt, Human
ucagaaaagguagcugugacaa

SEQ ID NO: 270002 - RNA, 19 nt, Human
ugucagugauacaugcuuu

SEQ ID NO: 270003 - RNA, 19 nt, Human
acauauguggauauacaug

SEQ ID NO: 270004 - RNA, 22 nt, Human
agcucagcacugucagcacucc

SEQ ID NO: 270005 - RNA, 22 nt, Human
gagaaucucaggcacccagaag

SEQ ID NO: 270006 - RNA, 22 nt, Human
accauacauuaaaugacuuuca

SEQ ID NO: 270007 - RNA, 17 nt, Human
caucuuuaaaauccuga

SEQ ID NO: 270008 - RNA, 22 nt, Human
ugcagggccuuguugaugugcu

SEQ ID NO: 270009 - RNA, 22 nt, Human
gcucugggcugaaucauuuauc

SEQ ID NO: 270010 - RNA, 22 nt, Human
uguacagucugcagcuugcugu

SEQ ID NO: 270011 - RNA, 20 nt, Human
cagaguaauuauuacccuuu

SEQ ID NO: 270012 - RNA, 22 nt, Human
ucccugcccucagugcacccgg

SEQ ID NO: 270013 - RNA, 22 nt, Human
aaaaacacaaguggcuuggucu

SEQ ID NO: 270014 - RNA, 20 nt, Human
acacagacucagcuuggaug

SEQ ID NO: 270015 - RNA, 22 nt, Human
caggcaagauccagaggcugcu

SEQ ID NO: 270016 - RNA, 22 nt, Human
acagaaaaguuuacuuuugcuc

SEQ ID NO: 270017 - RNA, 22 nt, Human
acagggcugaggcuggcuucuu

SEQ ID NO: 270018 - RNA, 22 nt, Human
uagcaacaccaucuggugagaa

SEQ ID NO: 270019 - RNA, 22 nt, Human
ucuccuggcccugucgccaucu

SEQ ID NO: 270020 - RNA, 22 nt, Human
agucaaagaugaccgaguuccu

SEQ ID NO: 270021 - RNA, 22 nt, Human
ccagcaggguugguuucuucug

SEQ ID NO: 270022 - RNA, 22 nt, Human
uaacaguacauccuuuucucuu

SEQ ID NO: 270023 - RNA, 22 nt, Human
gcaaagaaaugucagugagagg

SEQ ID NO: 270024 - RNA, 22 nt, Human
cagagcuggacuuaaauauauu

SEQ ID NO: 270025 - RNA, 22 nt, Human
ccuuagaucaggcugucuaggg

SEQ ID NO: 270026 - RNA, 22 nt, Human
agguggcagaggacuccuccug

SEQ ID NO: 270027 - RNA, 22 nt, Human
acauguguuaaaauucucacca

SEQ ID NO: 270028 - RNA, 22 nt, Human
cugaggccucuguucaccagaa

SEQ ID NO: 270029 - RNA, 22 nt, Human
ucugggaugcaaacagaaucug

SEQ ID NO: 270030 - RNA, 21 nt, Human
uucuccuguuuugcaccacag

SEQ ID NO: 270031 - RNA, 22 nt, Human
aggaaugugccuagccucccug

SEQ ID NO: 270032 - RNA, 22 nt, Human
auacagguaggggacauacauc

SEQ ID NO: 270033 - RNA, 23 nt, Human
ucagagagcuguugagagcugcc

SEQ ID NO: 270034 - RNA, 22 nt, Human
cucaggcucauaucccaucagc

SEQ ID NO: 270035 - RNA, 22 nt, Human
cuucugugaccaccagcagccc

SEQ ID NO: 270036 - RNA, 22 nt, Human
cuggcccucagacucaugggca

SEQ ID NO: 270037 - RNA, 19 nt, Human
uuuuggcuggagugaucug

SEQ ID NO: 270038 - RNA, 22 nt, Human
uaaguucaaugaacucaguucu

SEQ ID NO: 270039 - RNA, 21 nt, Human
uagggcaggcauuggaagaga

SEQ ID NO: 270040 - RNA, 22 nt, Human
cggcugcuucugagccccggcg

SEQ ID NO: 270041 - RNA, 22 nt, Human
ucacaucugaaaaaauauugag

SEQ ID NO: 270042 - RNA, 22 nt, Human
aggcucauccccacaaagcaaa

SEQ ID NO: 270043 - RNA, 20 nt, Human
caccuucaaauuuccuggca

SEQ ID NO: 270044 - RNA, 22 nt, Human
agguucaaaugcaagagaugcu

SEQ ID NO: 270045 - RNA, 22 nt, Human
uuugagaaaaccagaaagaucu

SEQ ID NO: 270046 - RNA, 22 nt, Human
uaaggccaaguucauauacaac

SEQ ID NO: 270047 - RNA, 22 nt, Human
ggcagggagagcaugcugauaa

SEQ ID NO: 270048 - RNA, 22 nt, Human
uggaaagacauguccuucauua

SEQ ID NO: 270049 - RNA, 21 nt, Human
aguuuugagaguggguagugu

SEQ ID NO: 270050 - RNA, 22 nt, Human
ugcccucccuguacugucagga

SEQ ID NO: 270051 - RNA, 22 nt, Human
ggccagcuguaagcugcugaau

SEQ ID NO: 270052 - RNA, 22 nt, Human
aggaccuacugauaucuuagca

SEQ ID NO: 270053 - RNA, 22 nt, Human
uugaaugaagggaugaccgaag

SEQ ID NO: 270054 - RNA, 22 nt, Human
cugcaggguucggagaguuccc

SEQ ID NO: 270055 - RNA, 22 nt, Human
aauguguauaugaacauacagg

SEQ ID NO: 270056 - RNA, 22 nt, Human
ugacaagaaagcgucuucuuuu

SEQ ID NO: 270057 - RNA, 22 nt, Human
uccucuggaaccucacccuugc

SEQ ID NO: 270058 - RNA, 22 nt, Human
caacaauaugcugaguuuuuca

SEQ ID NO: 270059 - RNA, 20 nt, Human
aacagggggcugcagagggc

SEQ ID NO: 270060 - RNA, 22 nt, Human
guauuuuuagguaaggaaagua

SEQ ID NO: 270061 - RNA, 22 nt, Human
gucuuucucuggaacaguaaaa

SEQ ID NO: 270062 - RNA, 22 nt, Human
augucuguuuucauaucagaua

SEQ ID NO: 270063 - RNA, 22 nt, Human
aagauuuuuuuccacagacuca

SEQ ID NO: 270064 - RNA, 17 nt, Human
cucugcagugcauggcu

SEQ ID NO: 270065 - RNA, 22 nt, Human
uuaaaugaggcugauguagauu

SEQ ID NO: 270066 - RNA, 22 nt, Human
uccuccaggauaaaauguguug

SEQ ID NO: 270067 - RNA, 22 nt, Human
uaaggcuuauauacuuagacau

SEQ ID NO: 270068 - RNA, 20 nt, Human
aaagugcacagauacagcuc

SEQ ID NO: 270069 - RNA, 22 nt, Human
cugaauuacuuauuagugggga

SEQ ID NO: 270070 - RNA, 22 nt, Human
guguauaacuaucuaucuagua

SEQ ID NO: 270071 - RNA, 22 nt, Human
acaucccucagucagacuguaa

SEQ ID NO: 270072 - RNA, 22 nt, Human
gcagagcuccccaagacaccaa

SEQ ID NO: 270073 - RNA, 17 nt, Human
ggccauggugcaagguu

SEQ ID NO: 270074 - RNA, 22 nt, Human
agagcagcugacagccugccau

SEQ ID NO: 270075 - RNA, 22 nt, Human
aggccagaaaugucagggagug

SEQ ID NO: 270076 - RNA, 22 nt, Human
gucagagcccccagcggcgcgg

SEQ ID NO: 270077 - RNA, 22 nt, Human
ggcccagagcucugggggagcu

SEQ ID NO: 270078 - RNA, 22 nt, Human
cuguauuucuuggacaguugcu

SEQ ID NO: 270079 - RNA, 22 nt, Human
uauucagaguguagcaaauaga

SEQ ID NO: 270080 - RNA, 23 nt, Human
cacuuccccuguggcgagccugc

SEQ ID NO: 270081 - RNA, 22 nt, Human
gauacaaauucaugucugaauu

SEQ ID NO: 270082 - RNA, 22 nt, Human
cauucaaaggcauguccuauuu

SEQ ID NO: 270083 - RNA, 22 nt, Human
uaagaacaguguuucaucucua

SEQ ID NO: 270084 - RNA, 22 nt, Human
auucuggguuugcuguacaaag

SEQ ID NO: 270085 - RNA, 22 nt, Human
ucugggcagccgccccauagga

SEQ ID NO: 270086 - RNA, 23 nt, Human
gcagagcugcccuauugccuugg

SEQ ID NO: 270087 - RNA, 22 nt, Human
uagcccucaucugcucaaaagg

SEQ ID NO: 270088 - RNA, 22 nt, Human
acuucccauuucucugcuuuag

SEQ ID NO: 270089 - RNA, 22 nt, Human
cagaggaaaugggaaggagaua

SEQ ID NO: 270090 - RNA, 22 nt, Human
cacagaaucugugacuccaaga

SEQ ID NO: 270091 - RNA, 22 nt, Human
auucagacuaugaacacgucag

SEQ ID NO: 270092 - RNA, 22 nt, Human
gcuggcucccauugguccuucc

SEQ ID NO: 270093 - RNA, 22 nt, Human
ccagagccagagaggugccugc

SEQ ID NO: 270094 - RNA, 22 nt, Human
aauuagaguagagccuaagaau

SEQ ID NO: 270095 - RNA, 22 nt, Human
ggccucagagaaggcugugcgg

SEQ ID NO: 270096 - RNA, 22 nt, Human
uuacagaacugucuugaaauuu

SEQ ID NO: 270097 - RNA, 22 nt, Human
cugcaggauuucaugggcugac

SEQ ID NO: 270098 - RNA, 22 nt, Human
uccagggaccucccugagagcu

SEQ ID NO: 270099 - RNA, 22 nt, Human
ccaggcucugccaggcccuuga

SEQ ID NO: 270100 - RNA, 22 nt, Human
aaccaaagaaaacuguggugag

SEQ ID NO: 270101 - RNA, 22 nt, Human
aagaacugguuauguuaucuug

SEQ ID NO: 270102 - RNA, 22 nt, Human
uuccaggaggcacugacagagg

SEQ ID NO: 270103 - RNA, 22 nt, Human
agacucuaacucaugccauugc

SEQ ID NO: 270104 - RNA, 22 nt, Human
aaagccaguuugucucuuuaaa

SEQ ID NO: 270105 - RNA, 22 nt, Human
auuuccuauuucuuguccccua

SEQ ID NO: 270106 - RNA, 22 nt, Human
aucuguacaagauuuuaugcgu

SEQ ID NO: 270107 - RNA, 23 nt, Human
agucuucauuguauuuccagacc

SEQ ID NO: 270108 - RNA, 22 nt, Human
aauaacaggguugauuugcaau

SEQ ID NO: 270109 - RNA, 22 nt, Human
ugguacugagaauagcgucuac

SEQ ID NO: 270110 - RNA, 22 nt, Human
uuuacaguauaguaggacucau

SEQ ID NO: 270111 - RNA, 22 nt, Human
cagagugaaaacugagcucaaa

SEQ ID NO: 270112 - RNA, 22 nt, Human
ccacugaggccugggcccaggg

SEQ ID NO: 270113 - RNA, 22 nt, Human
aguguuacugguucaugaaucu

SEQ ID NO: 270114 - RNA, 22 nt, Human
ugggcagggucucuguuaucag

SEQ ID NO: 270115 - RNA, 22 nt, Human
guguuacucaagagauagcuuu

SEQ ID NO: 270116 - RNA, 22 nt, Human
uucagcaaugggauggugcagg

SEQ ID NO: 270117 - RNA, 22 nt, Human
caacauuugaguaaagaaaugg

SEQ ID NO: 270118 - RNA, 22 nt, Human
cauuugaaccuggauguucuua

SEQ ID NO: 270119 - RNA, 22 nt, Human
cagagccucucagccccuuggg

SEQ ID NO: 270120 - RNA, 22 nt, Human
aaggccauuauucugauauauu

SEQ ID NO: 270121 - RNA, 22 nt, Human
uaacaucuugcaguagcagaac

SEQ ID NO: 270122 - RNA, 22 nt, Human
auuagcaugccaagcuuuuaga

SEQ ID NO: 270123 - RNA, 22 nt, Human
cucugggucuauaaugcagcug

SEQ ID NO: 270124 - RNA, 22 nt, Human
uguggcuuuugcuagcuuugca

SEQ ID NO: 270125 - RNA, 22 nt, Human
gucuuucuaugcauagagcaga

SEQ ID NO: 270126 - RNA, 14 nt, Human
gcaggcagaucacu

SEQ ID NO: 270127 - RNA, 22 nt, Human
aucugggcucgaauccuagcuc

SEQ ID NO: 270128 - RNA, 22 nt, Human
aauguuacgaucaacaacacau

SEQ ID NO: 270129 - RNA, 22 nt, Human
uucuaauuaaaucuacgcuagg

SEQ ID NO: 270130 - RNA, 22 nt, Human
ucauuuugccugccauuugagu

SEQ ID NO: 270131 - RNA, 22 nt, Human
aggaggaaggcuucauuagguu

SEQ ID NO: 270132 - RNA, 22 nt, Human
aauuuuacaaaauaccuccgau

SEQ ID NO: 270133 - RNA, 22 nt, Human
ugcuggcugucccuaccuggcu

SEQ ID NO: 270134 - RNA, 21 nt, Human
ugccagggauuuacagagccu

SEQ ID NO: 270135 - RNA, 22 nt, Human
uaaugcuuaauuuucacaagcc

SEQ ID NO: 270136 - RNA, 22 nt, Human
cuccuggggccauggaaggaac

SEQ ID NO: 270137 - RNA, 22 nt, Human
gaugaguucuuucuauucuauu

SEQ ID NO: 270138 - RNA, 22 nt, Human
ucuaggaaagccuuucacaacu

SEQ ID NO: 270139 - RNA, 22 nt, Human
acaguguccuuguggucccugu

SEQ ID NO: 270140 - RNA, 22 nt, Human
gguggcacucaaccuuuuauua

SEQ ID NO: 270141 - RNA, 22 nt, Human
aacaugaugugaagcaugaacu

SEQ ID NO: 270142 - RNA, 22 nt, Human
ucuggcagagauauccauccca

SEQ ID NO: 270143 - RNA, 22 nt, Human
aaugauauuuauugaauagaug

SEQ ID NO: 270144 - RNA, 22 nt, Human
uucucagauauuuacugagcau

SEQ ID NO: 270145 - RNA, 22 nt, Human
ccagaggcuggcaagggcuccu

SEQ ID NO: 270146 - RNA, 22 nt, Human
agaagccucauccucucuagug

SEQ ID NO: 270147 - RNA, 21 nt, Human
aagagcucuuuuguuaugguc

SEQ ID NO: 270148 - RNA, 20 nt, Human
uaaaugcaugaauguaaggc

SEQ ID NO: 270149 - RNA, 22 nt, Human
acccucaggcagaauguauucu

SEQ ID NO: 270150 - RNA, 22 nt, Human
gagcccagggcaggcaaggcag

SEQ ID NO: 270151 - RNA, 22 nt, Human
ccaggugucugucucuuuuuca

SEQ ID NO: 270152 - RNA, 22 nt, Human
aauagaucugugugcacauuug

SEQ ID NO: 270153 - RNA, 22 nt, Human
gacugucucugugaaugguagg

SEQ ID NO: 270154 - RNA, 20 nt, Human
uaaaggcugugagguggccc

SEQ ID NO: 270155 - RNA, 22 nt, Human
agcuucugcaucuuuucuuccc

SEQ ID NO: 270156 - RNA, 22 nt, Human
cagcuuuccccgugccucagcc

SEQ ID NO: 270157 - RNA, 22 nt, Human
cugaagaggacgcagcagcaag

SEQ ID NO: 270158 - RNA, 22 nt, Human
auugauucuaccagcuacuuug

SEQ ID NO: 270159 - RNA, 22 nt, Human
agaggccagggacacugcucaa

SEQ ID NO: 270160 - RNA, 22 nt, Human
cagcuucucagaaagcugaggu

SEQ ID NO: 270161 - RNA, 22 nt, Human
agcccugcgugccaggggacug

SEQ ID NO: 270162 - RNA, 22 nt, Human
uaucacugaccuguaucaguug

SEQ ID NO: 270163 - RNA, 22 nt, Human
aaugcacaugccacauguggua

SEQ ID NO: 270164 - RNA, 22 nt, Human
ugacaguuaagguauacauuca

SEQ ID NO: 270165 - RNA, 22 nt, Human
ugggcuccaauuuguccuuuca

SEQ ID NO: 270166 - RNA, 21 nt, Human
agcagacagaugcacgcacac

SEQ ID NO: 270167 - RNA, 20 nt, Human
ucagaacaguagaggagcua

SEQ ID NO: 270168 - RNA, 22 nt, Human
ugcagggauuguuggcauccau

SEQ ID NO: 270169 - RNA, 22 nt, Human
cacgugcaggucuuaggagaca

SEQ ID NO: 270170 - RNA, 22 nt, Human
cacuugaaauauuaggggugau

SEQ ID NO: 270171 - RNA, 22 nt, Human
gccagagccacuuuugggugau

SEQ ID NO: 270172 - RNA, 22 nt, Human
ugucagagcaaggccaggccag

SEQ ID NO: 270173 - RNA, 22 nt, Human
guggcuucuucuugggagcugc

SEQ ID NO: 270174 - RNA, 22 nt, Human
aagcuguugcccugcucuuucu

SEQ ID NO: 270175 - RNA, 22 nt, Human
uacuuuaucagcgucaaaggua

SEQ ID NO: 270176 - RNA, 22 nt, Human
acacagcuuuguguugcuccac

SEQ ID NO: 270177 - RNA, 22 nt, Human
caggccagcuuccugacauccu

SEQ ID NO: 270178 - RNA, 22 nt, Human
ccugggccugaaaacauuucuc

SEQ ID NO: 270179 - RNA, 22 nt, Human
agccauguaugaggguuuccag

SEQ ID NO: 270180 - RNA, 22 nt, Human
ccuggcugcugucacugaccau

SEQ ID NO: 270181 - RNA, 22 nt, Human
gggcagugguccaggcuacagc

SEQ ID NO: 270182 - RNA, 23 nt, Human
gggaucuguaaguugaagacaaa

SEQ ID NO: 270183 - RNA, 22 nt, Human
ugcuggguagaaguauuagucu

SEQ ID NO: 270184 - RNA, 22 nt, Human
gugcaguggcagauccuagcuc

SEQ ID NO: 270185 - RNA, 22 nt, Human
ggguccagaguuuucccgcccu

SEQ ID NO: 270186 - RNA, 22 nt, Human
auaagaugagaucagcuuucug

SEQ ID NO: 270187 - RNA, 22 nt, Human
caauuucucuuuauaucucaca

SEQ ID NO: 270188 - RNA, 22 nt, Human
uuugcaaaauuauucccagcau

SEQ ID NO: 270189 - RNA, 22 nt, Human
caggcucacuguaaggucagcu

SEQ ID NO: 270190 - RNA, 22 nt, Human
acugggcuguuuuuugagugga

SEQ ID NO: 270191 - RNA, 22 nt, Human
auggagccauuccugaagacuu

SEQ ID NO: 270192 - RNA, 22 nt, Human
ccugaguagcuggaauuaaagg

SEQ ID NO: 270193 - RNA, 19 nt, Human
uccugcccaccagccaggg

SEQ ID NO: 270194 - RNA, 22 nt, Human
uguacaaagaguauagcuuuga

SEQ ID NO: 270195 - RNA, 21 nt, Human
uagaaagucaaagcuaucagc

SEQ ID NO: 270196 - RNA, 23 nt, Human
aagcaucuuuuccuagcuccauc

SEQ ID NO: 270197 - RNA, 22 nt, Human
aggcagugguguuugcuggugg

SEQ ID NO: 270198 - RNA, 22 nt, Human
aagcaucuuaaaaaguaucaga

SEQ ID NO: 270199 - RNA, 22 nt, Human
cuuggcauguucaucugcuugg

SEQ ID NO: 270200 - RNA, 19 nt, Human
guuucauuaagauaggaaa

SEQ ID NO: 270201 - RNA, 22 nt, Human
agcccagcuuucaccccucugg

SEQ ID NO: 270202 - RNA, 22 nt, Human
aggcuucuguuucuuaaaggug

SEQ ID NO: 270203 - RNA, 22 nt, Human
auguucuuggauguuguguaua

SEQ ID NO: 270204 - RNA, 22 nt, Human
ucagcagggccuccuugugcag

SEQ ID NO: 270205 - RNA, 22 nt, Human
gcuuagaagauugacccugguu

SEQ ID NO: 270206 - RNA, 19 nt, Human
cauuuucucauugugcccc

SEQ ID NO: 270207 - RNA, 22 nt, Human
cacagggcuuugauggcugagu

SEQ ID NO: 270208 - RNA, 20 nt, Human
auguccagugacuggaccau

SEQ ID NO: 270209 - RNA, 22 nt, Human
cugcccuggccacugugcccag

SEQ ID NO: 270210 - RNA, 22 nt, Human
ucuuuguaguuauaaacgacuu

SEQ ID NO: 270211 - RNA, 22 nt, Human
uucaguuugcuacaagcaacau

SEQ ID NO: 270212 - RNA, 22 nt, Human
aauuuggagcuuuguuucuaga

SEQ ID NO: 270213 - RNA, 22 nt, Human
agaaggccuaacuugggggcaa

SEQ ID NO: 270214 - RNA, 22 nt, Human
guccuggcccacuggcaggcug

SEQ ID NO: 270215 - RNA, 20 nt, Human
ccuuuagaaacucauaugua

SEQ ID NO: 270216 - RNA, 19 nt, Human
ugagucacucuuacaguca

SEQ ID NO: 270217 - RNA, 22 nt, Human
uugaagagaaucagaagguuga

SEQ ID NO: 270218 - RNA, 22 nt, Human
uagaaacucucaaucugggaug

SEQ ID NO: 270219 - RNA, 22 nt, Human
ucucugucugagccuggcagac

SEQ ID NO: 270220 - RNA, 22 nt, Human
auagggcauccuuuauugagau

SEQ ID NO: 270221 - RNA, 22 nt, Human
gaggcagcaauaaaaagaauuu

SEQ ID NO: 270222 - RNA, 22 nt, Human
cagcuguggcugccacugcucc

SEQ ID NO: 270223 - RNA, 22 nt, Human
gagcugcacuggggguggaaug

SEQ ID NO: 270224 - RNA, 22 nt, Human
ccucagagucuaguaaauaaua

SEQ ID NO: 270225 - RNA, 22 nt, Human
ugauuacauugguaauguuuau

SEQ ID NO: 270226 - RNA, 22 nt, Human
gagcucuuccuuucaggaggcc

SEQ ID NO: 270227 - RNA, 22 nt, Human
augauacauugcaaaauuuuaa

SEQ ID NO: 270228 - RNA, 22 nt, Human
ucuagggaacaugggucaagcu

SEQ ID NO: 270229 - RNA, 22 nt, Human
agaaauguggaucguuuuaaaa

SEQ ID NO: 270230 - RNA, 22 nt, Human
agcugagacacuugagagacua

SEQ ID NO: 270231 - RNA, 22 nt, Human
uaugcacacaggcuuaauucau

SEQ ID NO: 270232 - RNA, 22 nt, Human
guauaaaguauaagcuuguuuu

SEQ ID NO: 270233 - RNA, 22 nt, Human
caggaggccaacugugggacuu

SEQ ID NO: 270234 - RNA, 22 nt, Human
ugggaccugcuccuggaaugag

SEQ ID NO: 270235 - RNA, 22 nt, Human
ccagugugaaaggucauuuauc

SEQ ID NO: 270236 - RNA, 18 nt, Human
gggaggccccagcaggag

SEQ ID NO: 270237 - RNA, 22 nt, Human
ucucaaacuacaguauggcugu

SEQ ID NO: 270238 - RNA, 22 nt, Human
auuauuuuaugugcggccugau

SEQ ID NO: 270239 - RNA, 22 nt, Human
uaugagaaaauaaauaucuguu

SEQ ID NO: 270240 - RNA, 22 nt, Human
gccagguggucuggcuccagag

SEQ ID NO: 270241 - RNA, 22 nt, Human
uuuccucuccggggccuccagg

SEQ ID NO: 270242 - RNA, 22 nt, Human
ucaauucaguccaacaguaauu

SEQ ID NO: 270243 - RNA, 22 nt, Human
gaguuugauagagaggaaccgg

SEQ ID NO: 270244 - RNA, 22 nt, Human
ggcugggccgcggcuacccaga

SEQ ID NO: 270245 - RNA, 22 nt, Human
cuggcuguggucacagguaacu

SEQ ID NO: 270246 - RNA, 22 nt, Human
aaggcaugauguaaucaaugau

SEQ ID NO: 270247 - RNA, 23 nt, Human
ucuggaauccucccccuugguuc

SEQ ID NO: 270248 - RNA, 22 nt, Human
aaaguuuucugccuucauuaga

SEQ ID NO: 270249 - RNA, 22 nt, Human
ugcaagagcccaccacacacuu

SEQ ID NO: 270250 - RNA, 22 nt, Human
gcacacguagaagaacuugacu

SEQ ID NO: 270251 - RNA, 22 nt, Human
auuagaagaggcugacgaaugu

SEQ ID NO: 270252 - RNA, 22 nt, Human
cuccuggaccagggcuauuggg

SEQ ID NO: 270253 - RNA, 22 nt, Human
uuacagguggagaaguaaggcu

SEQ ID NO: 270254 - RNA, 22 nt, Human
agggagccaggaacgcaggucg

SEQ ID NO: 270255 - RNA, 22 nt, Human
uuggaauuaaaaggagaacuuc

SEQ ID NO: 270256 - RNA, 22 nt, Human
ucucagagugacaaugagaauu

SEQ ID NO: 270257 - RNA, 19 nt, Human
ucccaggcaaaggcuucuc

SEQ ID NO: 270258 - RNA, 22 nt, Human
agagacugcgugucagcgcugg

SEQ ID NO: 270259 - RNA, 22 nt, Human
gagguguccucagccaacucug

SEQ ID NO: 270260 - RNA, 22 nt, Human
gaggggcagagguagagaacaa

SEQ ID NO: 270261 - RNA, 22 nt, Human
augaggcacguguuacuggccu

SEQ ID NO: 270262 - RNA, 22 nt, Human
caggcagcugcgacaagagagc

SEQ ID NO: 270263 - RNA, 22 nt, Human
agcagggccuggcacuccuggg

SEQ ID NO: 270264 - RNA, 22 nt, Human
ugagucuccagcgaaguaggau

SEQ ID NO: 270265 - RNA, 22 nt, Human
cagacaggguuuuggucuuugg

SEQ ID NO: 270266 - RNA, 22 nt, Human
aacaucuaguuccuauauaaua

SEQ ID NO: 270267 - RNA, 22 nt, Human
uaacugguuaagggugaaaucc

SEQ ID NO: 270268 - RNA, 22 nt, Human
agcagcauuuaaggauccaagu

SEQ ID NO: 270269 - RNA, 22 nt, Human
ugccucagagaccugacaguac

SEQ ID NO: 270270 - RNA, 22 nt, Human
ggcaucaggagcuucuucaggu

SEQ ID NO: 270271 - RNA, 16 nt, Human
aggaauguggcggaac

SEQ ID NO: 270272 - RNA, 22 nt, Human
gggcgcagccaauccuggcccu

SEQ ID NO: 270273 - RNA, 22 nt, Human
aggagaggcucuaacucugugu

SEQ ID NO: 270274 - RNA, 22 nt, Human
guacuacaguuucucauuaaau

SEQ ID NO: 270275 - RNA, 20 nt, Human
aggguggggacguucugacu

SEQ ID NO: 270276 - RNA, 22 nt, Human
agaugagaauuuuuagagugcu

SEQ ID NO: 270277 - RNA, 22 nt, Human
acaucugacaugaucuucagua

SEQ ID NO: 270278 - RNA, 22 nt, Human
uuucaacaccagagaccaugcg

SEQ ID NO: 270279 - RNA, 22 nt, Human
agaaaugaagagagucaagguu

SEQ ID NO: 270280 - RNA, 22 nt, Human
gaaaugcagauucugauucugu

SEQ ID NO: 270281 - RNA, 22 nt, Human
ggcaggcagaaaaauagaauau

SEQ ID NO: 270282 - RNA, 22 nt, Human
ggcucagguuaccagucccucc

SEQ ID NO: 270283 - RNA, 22 nt, Human
cgcaggugggcccuucauugau

SEQ ID NO: 270284 - RNA, 22 nt, Human
uucacaacugccauagccagug

SEQ ID NO: 270285 - RNA, 22 nt, Human
cacuggcauuagucacgaggca

SEQ ID NO: 270286 - RNA, 20 nt, Human
uaguccaguaggggggcuuu

SEQ ID NO: 270287 - RNA, 18 nt, Human
ucacagaauauugagugg

SEQ ID NO: 270288 - RNA, 22 nt, Human
uuuuaaaucuccaguugacccc

SEQ ID NO: 270289 - RNA, 23 nt, Human
acucaucuucugguauccacagu

SEQ ID NO: 270290 - RNA, 22 nt, Human
caaggcuacccuuucaccaaaa

SEQ ID NO: 270291 - RNA, 22 nt, Human
acaggagaaaucuggucaaaag

SEQ ID NO: 270292 - RNA, 22 nt, Human
cauuucacacauaaacuugggu

SEQ ID NO: 270293 - RNA, 22 nt, Human
cacaaaaguaggaggcaggcgg

SEQ ID NO: 270294 - RNA, 22 nt, Human
cauaacuagagugaaauguuga

SEQ ID NO: 270295 - RNA, 22 nt, Human
cuccugaggaaaagcuugguca

SEQ ID NO: 270296 - RNA, 22 nt, Human
ggucucuggccuuggagauuga

SEQ ID NO: 270297 - RNA, 22 nt, Human
ugccaggguccugagggccuug

SEQ ID NO: 270298 - RNA, 22 nt, Human
uugcagaacuuaaagacagagu

SEQ ID NO: 270299 - RNA, 22 nt, Human
cugagcagugcuuugcaguggg

SEQ ID NO: 270300 - RNA, 21 nt, Human
ccucuguaguuaaguuuccua

SEQ ID NO: 270301 - RNA, 22 nt, Human
aguuaaaugucaguagcuuaac

SEQ ID NO: 270302 - RNA, 22 nt, Human
caggaggaggguacaccaucag

SEQ ID NO: 270303 - RNA, 20 nt, Human
ccuuucuggagugcuguuca

SEQ ID NO: 270304 - RNA, 22 nt, Human
gcaugugucaucugccuuucgu

SEQ ID NO: 270305 - RNA, 22 nt, Human
ggcugcucuccaucccaggccu

SEQ ID NO: 270306 - RNA, 22 nt, Human
acagaaauauucguggugcuug

SEQ ID NO: 270307 - RNA, 22 nt, Human
cguguaaccccugaacucgcau

SEQ ID NO: 270308 - RNA, 22 nt, Human
ccugagggcguaauuaacagug

SEQ ID NO: 270309 - RNA, 22 nt, Human
agcuccuugaagggcucuggga

SEQ ID NO: 270310 - RNA, 22 nt, Human
acagcauucaauaaauaauaac

SEQ ID NO: 270311 - RNA, 22 nt, Human
aauauaaauuccugggcccagc

SEQ ID NO: 270312 - RNA, 22 nt, Human
uuucuacauuuguaaccagauu

SEQ ID NO: 270313 - RNA, 22 nt, Human
ucuguacaacaaagggaugaga

SEQ ID NO: 270314 - RNA, 22 nt, Human
gugacaggccacugcggcucug

SEQ ID NO: 270315 - RNA, 22 nt, Human
aauguccuaggcaugauuuugu

SEQ ID NO: 270316 - RNA, 22 nt, Human
cugugggaugggaccucagcug

SEQ ID NO: 270317 - RNA, 22 nt, Human
cugccuucuuucaaggguaagc

SEQ ID NO: 270318 - RNA, 23 nt, Human
cuggcucuguagguggcauccuu

SEQ ID NO: 270319 - RNA, 22 nt, Human
auuagguuagugugcaagagaa

SEQ ID NO: 270320 - RNA, 20 nt, Human
ugccaggcacggagugcaug

SEQ ID NO: 270321 - RNA, 22 nt, Human
uucuacaugagaaaauguauuu

SEQ ID NO: 270322 - RNA, 22 nt, Human
auccacagagaggaagaauagu

SEQ ID NO: 270323 - RNA, 22 nt, Human
cugcucuggcguacucggcauc

SEQ ID NO: 270324 - RNA, 21 nt, Human
ucuucccucaggauguccugc

SEQ ID NO: 270325 - RNA, 22 nt, Human
uacaauguugguaaaguaucau

SEQ ID NO: 270326 - RNA, 22 nt, Human
gacaagacaccucucuccaucc

SEQ ID NO: 270327 - RNA, 22 nt, Human
uaucacaucaauguuuuaaaau

SEQ ID NO: 270328 - RNA, 22 nt, Human
gcagcuccuucaaucucaccau

SEQ ID NO: 270329 - RNA, 22 nt, Human
uagggcucgggcacaggacagg

SEQ ID NO: 270330 - RNA, 22 nt, Human
uacagcuggacugguagcugug

SEQ ID NO: 270331 - RNA, 22 nt, Human
cugcaaaaguaauuggggcuuu

SEQ ID NO: 270332 - RNA, 22 nt, Human
cauggccucaaaggacugcaga

SEQ ID NO: 270333 - RNA, 22 nt, Human
ucuggcucauacaagccugcaa

SEQ ID NO: 270334 - RNA, 19 nt, Human
ggcucaagcauccagguag

SEQ ID NO: 270335 - RNA, 22 nt, Human
ucagcagacauuauuuucuggc

SEQ ID NO: 270336 - RNA, 21 nt, Human
auacacauacacauaaaugug

SEQ ID NO: 270337 - RNA, 22 nt, Human
ugagcccuggcucuuucacuua

SEQ ID NO: 270338 - RNA, 22 nt, Human
ccgggccucgggacaccgggua

SEQ ID NO: 270339 - RNA, 22 nt, Human
uugauuuauagaauguucaagc

SEQ ID NO: 270340 - RNA, 22 nt, Human
aggaagccacugaaugaaaguu

SEQ ID NO: 270341 - RNA, 22 nt, Human
cacccccagcagggaaaggagg

SEQ ID NO: 270342 - RNA, 22 nt, Human
aucuuuggaaagccaagcacag

SEQ ID NO: 270343 - RNA, 22 nt, Human
augaggcaugugaggagaaggg

SEQ ID NO: 270344 - RNA, 22 nt, Human
uggcuucuugacuucuuggcug

SEQ ID NO: 270345 - RNA, 22 nt, Human
ugcguacuguuuauacaugugu

SEQ ID NO: 270346 - RNA, 21 nt, Human
agaaacaugaucaaaggaacc

SEQ ID NO: 270347 - RNA, 22 nt, Human
agcuguuccaggccucauugcu

SEQ ID NO: 270348 - RNA, 20 nt, Human
ugggccuguggcagaagucu

SEQ ID NO: 270349 - RNA, 19 nt, Human
ugacaagauaauagccuug

SEQ ID NO: 270350 - RNA, 23 nt, Human
uguuuuucauucacaugggcugu

SEQ ID NO: 270351 - RNA, 20 nt, Human
uccuccaaccagcugcuaau

SEQ ID NO: 270352 - RNA, 22 nt, Human
uugucuuuggaaauuuaauguu

SEQ ID NO: 270353 - RNA, 22 nt, Human
auuaguguggacccuaauuuaa

SEQ ID NO: 270354 - RNA, 22 nt, Human
gcaggggcuacucugagcuucc

SEQ ID NO: 270355 - RNA, 22 nt, Human
ccuuggcugaggagggagcuga

SEQ ID NO: 270356 - RNA, 22 nt, Human
uuguuacuugcauguagacuaa

SEQ ID NO: 270357 - RNA, 22 nt, Human
acugccuguagcccugagaugu

SEQ ID NO: 270358 - RNA, 22 nt, Human
caggcccacgaggcacacagag

SEQ ID NO: 270359 - RNA, 22 nt, Human
aagucagaaauaucugccauca

SEQ ID NO: 270360 - RNA, 22 nt, Human
cccaggcuggcacugcugaagu

SEQ ID NO: 270361 - RNA, 22 nt, Human
guccugugcucagacauggggg

SEQ ID NO: 270362 - RNA, 22 nt, Human
cucagcaacccacacacggucu

SEQ ID NO: 270363 - RNA, 22 nt, Human
gacagacacaauugauccauga

SEQ ID NO: 270364 - RNA, 22 nt, Human
gccagcuguucagacauucuuu

SEQ ID NO: 270365 - RNA, 22 nt, Human
cucuccagguuagagcacuuau

SEQ ID NO: 270366 - RNA, 22 nt, Human
guuuacuggagaagaugaccug

SEQ ID NO: 270367 - RNA, 22 nt, Human
auucugggcgccuauggcugca

SEQ ID NO: 270368 - RNA, 22 nt, Human
aggaggugcguggugauccccu

SEQ ID NO: 270369 - RNA, 18 nt, Human
gaauaucuagcacauagu

SEQ ID NO: 270370 - RNA, 22 nt, Human
cgcaggcucgguucacagagca

SEQ ID NO: 270371 - RNA, 22 nt, Human
auucagugaccuaauuacuuac

SEQ ID NO: 270372 - RNA, 22 nt, Human
ugucuuuaguugcuuagauuug

SEQ ID NO: 270373 - RNA, 22 nt, Human
cugcugucuuuauuucacugcu

SEQ ID NO: 270374 - RNA, 22 nt, Human
auagaguccaaaguaugaauau

SEQ ID NO: 270375 - RNA, 22 nt, Human
aucaacaugaauuucucugaag

SEQ ID NO: 270376 - RNA, 22 nt, Human
acuccccagacugccaugcugg

SEQ ID NO: 270377 - RNA, 20 nt, Human
aagcuggcaggucauagcuu

SEQ ID NO: 270378 - RNA, 21 nt, Human
uggaacuggugaaaaccuccu

SEQ ID NO: 270379 - RNA, 22 nt, Human
aguuaaaucauuacugacagag

SEQ ID NO: 270380 - RNA, 22 nt, Human
caggcagcguccugcuuccugu

SEQ ID NO: 270381 - RNA, 23 nt, Human
acugggcugaaauuuuucauggc

SEQ ID NO: 270382 - RNA, 23 nt, Human
aguuaggucaaguuaggucaauu

SEQ ID NO: 270383 - RNA, 22 nt, Human
cagguucuuaaguaacagcaca

SEQ ID NO: 270384 - RNA, 22 nt, Human
caguucuuauuuggccaguguc

SEQ ID NO: 270385 - RNA, 22 nt, Human
acucaucagccucuaggaaaga

SEQ ID NO: 270386 - RNA, 22 nt, Human
ucugaccaggcucagccaaggc

SEQ ID NO: 270387 - RNA, 17 nt, Human
auuuacauugucaccga

SEQ ID NO: 270388 - RNA, 22 nt, Human
cccucagcuucucccugcagcu

SEQ ID NO: 270389 - RNA, 22 nt, Human
acagcaugagaguagcaaaagg

SEQ ID NO: 270390 - RNA, 20 nt, Human
gucuuuauguuuuaugaccu

SEQ ID NO: 270391 - RNA, 22 nt, Human
uagaagauaagacaagugcugc

SEQ ID NO: 270392 - RNA, 22 nt, Human
ucaggcagaugcagggauggau

SEQ ID NO: 270393 - RNA, 22 nt, Human
cugucuccuccacugcauggga

SEQ ID NO: 270394 - RNA, 22 nt, Human
uucaguguggaaugugaacugc

SEQ ID NO: 270395 - RNA, 22 nt, Human
uuacacagaaauuuuauugccu

SEQ ID NO: 270396 - RNA, 22 nt, Human
ugcuuccuugagcucuccaauc

SEQ ID NO: 270397 - RNA, 22 nt, Human
aaaggacuggauauuaaagagu

SEQ ID NO: 270398 - RNA, 22 nt, Human
guugggaagcagauggaugagc

SEQ ID NO: 270399 - RNA, 22 nt, Human
ucagcuuugggggucucaggag

SEQ ID NO: 270400 - RNA, 22 nt, Human
caucugucugcuguuagcugca

SEQ ID NO: 270401 - RNA, 22 nt, Human
acagcauuuaaagaaaaugaac

SEQ ID NO: 270402 - RNA, 22 nt, Human
uaaggcaaagugauuucuuaaa

SEQ ID NO: 270403 - RNA, 22 nt, Human
augcaaagcaccacacuaagau

SEQ ID NO: 270404 - RNA, 22 nt, Human
aaaaaccuuucccauacuaaga

SEQ ID NO: 270405 - RNA, 22 nt, Human
uccaucuacggcuauaccaccc

SEQ ID NO: 270406 - RNA, 22 nt, Human
ucugucuuugucaggaccagag

SEQ ID NO: 270407 - RNA, 22 nt, Human
ucgagcucuggagccaaggaug

SEQ ID NO: 270408 - RNA, 22 nt, Human
uuuuucagccaugaauuacacu

SEQ ID NO: 270409 - RNA, 22 nt, Human
agcuuuaugaggagaccuuagu

SEQ ID NO: 270410 - RNA, 22 nt, Human
aauguguagcauuuaaugcagu

SEQ ID NO: 270411 - RNA, 22 nt, Human
cccuggcucugccucagagccc

SEQ ID NO: 270412 - RNA, 17 nt, Human
ccagagaguaguuagga

SEQ ID NO: 270413 - RNA, 22 nt, Human
aaggccagcaguuugagaccag

SEQ ID NO: 270414 - RNA, 22 nt, Human
acuugguguauuagcucucacu

SEQ ID NO: 270415 - RNA, 22 nt, Human
cuggcccaggcuccuggggcac

SEQ ID NO: 270416 - RNA, 22 nt, Human
auccauuugccgugcuaugugc

SEQ ID NO: 270417 - RNA, 22 nt, Human
cagaaccuuggugguagggaca

SEQ ID NO: 270418 - RNA, 22 nt, Human
ccuggggaagucacuucucuuu

SEQ ID NO: 270419 - RNA, 21 nt, Human
cacuugaaugguguuuuacaa

SEQ ID NO: 270420 - RNA, 21 nt, Human
agcagcaaccacauaguuuuu

SEQ ID NO: 270421 - RNA, 22 nt, Human
ugggaaccaggacuggcugagg

SEQ ID NO: 270422 - RNA, 22 nt, Human
uuccucuuucucugugcuaugu

SEQ ID NO: 270423 - RNA, 22 nt, Human
uucccucuuuuccaacaguugu

SEQ ID NO: 270424 - RNA, 22 nt, Human
acucugaggaauguacaggacc

SEQ ID NO: 270425 - RNA, 23 nt, Human
ucuuuuuaagagaucuagugacg

SEQ ID NO: 270426 - RNA, 22 nt, Human
aaaugcauuuuuaauuagaccc

SEQ ID NO: 270427 - RNA, 22 nt, Human
ggcugccucccaggagaaucug

SEQ ID NO: 270428 - RNA, 22 nt, Human
uggcagguuucguuaaaaaugg

SEQ ID NO: 270429 - RNA, 22 nt, Human
gcaguuuuauuaugauggaaau

SEQ ID NO: 270430 - RNA, 22 nt, Human
uaaugugugucaucaguagagu

SEQ ID NO: 270431 - RNA, 22 nt, Human
gcugggucucuggguguaacaa

SEQ ID NO: 270432 - RNA, 22 nt, Human
ucuccuugugcuggguccuucc

SEQ ID NO: 270433 - RNA, 22 nt, Human
uacagggacucccgcagagaua

SEQ ID NO: 270434 - RNA, 22 nt, Human
guucaguuugacaaccuuuaua

SEQ ID NO: 270435 - RNA, 19 nt, Human
ugagggacauugggagcag

SEQ ID NO: 270436 - RNA, 22 nt, Human
cugcccagauuuuaccaccugc

SEQ ID NO: 270437 - RNA, 22 nt, Human
ugggagcaggaagcaggaagua

SEQ ID NO: 270438 - RNA, 20 nt, Human
cauuuguuagcuuucuacug

SEQ ID NO: 270439 - RNA, 22 nt, Human
gcagacagaugagggugcuggg

SEQ ID NO: 270440 - RNA, 23 nt, Human
acugggcuuaugaggaggcuugu

SEQ ID NO: 270441 - RNA, 22 nt, Human
aacuucuaaucuguacaguuuu

SEQ ID NO: 270442 - RNA, 22 nt, Human
caugacaauauguucuuucauu

SEQ ID NO: 270443 - RNA, 22 nt, Human
gcccaggcuggagugcaguagc

SEQ ID NO: 270444 - RNA, 22 nt, Human
aggugacugguuuaucuggcag

SEQ ID NO: 270445 - RNA, 22 nt, Human
uauuuagcuggagucagugcuu

SEQ ID NO: 270446 - RNA, 22 nt, Human
caacagagggaauggaucucau

SEQ ID NO: 270447 - RNA, 20 nt, Human
ucagacccggggaagggagc

SEQ ID NO: 270448 - RNA, 22 nt, Human
ucuccagucccuucucuguuag

SEQ ID NO: 270449 - RNA, 22 nt, Human
uauugacaauaggcaacugagg

SEQ ID NO: 270450 - RNA, 22 nt, Human
uuucacauuuaggcgugaauug

SEQ ID NO: 270451 - RNA, 22 nt, Human
gcuccugucuuggggcacuggc

SEQ ID NO: 270452 - RNA, 22 nt, Human
gguucacacuuucaugauuuca

SEQ ID NO: 270453 - RNA, 22 nt, Human
ucccuguccaaagucuuccuau

SEQ ID NO: 270454 - RNA, 22 nt, Human
uacaguuccucucguggaggug

SEQ ID NO: 270455 - RNA, 22 nt, Human
ucuucauguauacucaugguac

SEQ ID NO: 270456 - RNA, 22 nt, Human
ucccagagugagccaggggcag

SEQ ID NO: 270457 - RNA, 22 nt, Human
uucaaucauugcaaaguaaugg

SEQ ID NO: 270458 - RNA, 22 nt, Human
ucaaaugcacguagagaaaaua

SEQ ID NO: 270459 - RNA, 22 nt, Human
ugggagcagcuuugcgagggag

SEQ ID NO: 270460 - RNA, 22 nt, Human
gcaucuaaauaaacgugggagu

SEQ ID NO: 270461 - RNA, 22 nt, Human
ccugggugaaugauauucuaaa

SEQ ID NO: 270462 - RNA, 22 nt, Human
caggcucuuccauccugcugag

SEQ ID NO: 270463 - RNA, 22 nt, Human
guuuagaauggcaaaauuaagu

SEQ ID NO: 270464 - RNA, 22 nt, Human
guauacacugguaagauuuguc

SEQ ID NO: 270465 - RNA, 22 nt, Human
guccugugcccuggguggcgcu

SEQ ID NO: 270466 - RNA, 22 nt, Human
caaaauguucuggcaccuuuaa

SEQ ID NO: 270467 - RNA, 22 nt, Human
cuuggcccaguugccaaggaaa

SEQ ID NO: 270468 - RNA, 22 nt, Human
caaaggcuuugcuaugaugcau

SEQ ID NO: 270469 - RNA, 22 nt, Human
agcaacuagccaggaugcagag

SEQ ID NO: 270470 - RNA, 22 nt, Human
ugggaggaucucuugaggccag

SEQ ID NO: 270471 - RNA, 22 nt, Human
ugaguuuugucuugcuagaagu

SEQ ID NO: 270472 - RNA, 22 nt, Human
uuugaaaccuaguuauaugacu

SEQ ID NO: 270473 - RNA, 20 nt, Human
uccugugugucucaucaacc

SEQ ID NO: 270474 - RNA, 22 nt, Human
aaggcacagccacuugaucauc

SEQ ID NO: 270475 - RNA, 20 nt, Human
caaugcacacagcugcuucu

SEQ ID NO: 270476 - RNA, 20 nt, Human
aaugaggucccacugaggag

SEQ ID NO: 270477 - RNA, 22 nt, Human
cucuuuuacaccaaaaggccua

SEQ ID NO: 270478 - RNA, 22 nt, Human
auuucagaguagaucguuauuu

SEQ ID NO: 270479 - RNA, 22 nt, Human
ugguuagacucaccuuauaguu

SEQ ID NO: 270480 - RNA, 22 nt, Human
ucaggcugcuggccagcaggcu

SEQ ID NO: 270481 - RNA, 22 nt, Human
ucucaggcacugggugccaacu

SEQ ID NO: 270482 - RNA, 22 nt, Human
aaacugccaaaagaccuuggau

SEQ ID NO: 270483 - RNA, 19 nt, Human
cagagccucagagcuagaa

SEQ ID NO: 270484 - RNA, 22 nt, Human
auuguauuuguacaagacaugu

SEQ ID NO: 270485 - RNA, 20 nt, Human
uuucaguugguuaauggcau

SEQ ID NO: 270486 - RNA, 22 nt, Human
cccaggcugccacgauuacugc

SEQ ID NO: 270487 - RNA, 22 nt, Human
aucuccaggaagugucauuuac

SEQ ID NO: 270488 - RNA, 22 nt, Human
uuuuacaggugugagccaccau

SEQ ID NO: 270489 - RNA, 22 nt, Human
aucaguaaauauucauugugca

SEQ ID NO: 270490 - RNA, 22 nt, Human
ucaaaccaccuuguuacugggg

SEQ ID NO: 270491 - RNA, 22 nt, Human
gagagccagcaguaaagacauu

SEQ ID NO: 270492 - RNA, 22 nt, Human
ggaguugauuuuggauauauua

SEQ ID NO: 270493 - RNA, 22 nt, Human
ggcucugcugguaagaugccuc

SEQ ID NO: 270494 - RNA, 22 nt, Human
cugggccuuugcuuauuaauuu

SEQ ID NO: 270495 - RNA, 22 nt, Human
cuggcuccaucacugggugaug

SEQ ID NO: 270496 - RNA, 22 nt, Human
uguuuuaagggucaacugucac

SEQ ID NO: 270497 - RNA, 22 nt, Human
agaaucuucagaugauuuguca

SEQ ID NO: 270498 - RNA, 22 nt, Human
uaagcaaucuaaaagccuuacc

SEQ ID NO: 270499 - RNA, 21 nt, Human
aaacaucucugcuuuuguguc

SEQ ID NO: 270500 - RNA, 22 nt, Human
cugcauaugagaauaggagaaa

SEQ ID NO: 270501 - RNA, 22 nt, Human
uauuacaguucgaguuucuagg

SEQ ID NO: 270502 - RNA, 22 nt, Human
gaaaggggcauguagggaucac

SEQ ID NO: 270503 - RNA, 22 nt, Human
agucucucuccucgugguaacc

SEQ ID NO: 270504 - RNA, 22 nt, Human
aggccagcacgacagccgcagg

SEQ ID NO: 270505 - RNA, 22 nt, Human
cugagcaccccaggaccugcgc

SEQ ID NO: 270506 - RNA, 22 nt, Human
auguccuugagacccuccucgg

SEQ ID NO: 270507 - RNA, 22 nt, Human
gaaagcugggaaauaaauauua

SEQ ID NO: 270508 - RNA, 22 nt, Human
uccugaugauauugcucuuucu

SEQ ID NO: 270509 - RNA, 22 nt, Human
agcagccagaaauccagaggug

SEQ ID NO: 270510 - RNA, 22 nt, Human
ucugaaaugcaaauuugacuga

SEQ ID NO: 270511 - RNA, 22 nt, Human
augguuuauaggacagcucugu

SEQ ID NO: 270512 - RNA, 22 nt, Human
uugagucugugcccuaugcugu

SEQ ID NO: 270513 - RNA, 22 nt, Human
ucuggcagcucuccucggcgga

SEQ ID NO: 270514 - RNA, 18 nt, Human
gcaggagauggguggggu

SEQ ID NO: 270515 - RNA, 22 nt, Human
ugaugaguuuacucuuuucuaa

SEQ ID NO: 270516 - RNA, 23 nt, Human
aggagccaggaaccagcuucccc

SEQ ID NO: 270517 - RNA, 22 nt, Human
aggcucugacccaugggaccca

SEQ ID NO: 270518 - RNA, 22 nt, Human
cucugggugugacagcaccugg

SEQ ID NO: 270519 - RNA, 19 nt, Human
agaaauagccuuccuuguc

SEQ ID NO: 270520 - RNA, 22 nt, Human
aaauugaauuugggaaacauug

SEQ ID NO: 270521 - RNA, 22 nt, Human
caggcucccacccuccugcagc

SEQ ID NO: 270522 - RNA, 22 nt, Human
gaggccuguagucauggaugua

SEQ ID NO: 270523 - RNA, 22 nt, Human
cuccccacacacuaggccugau

SEQ ID NO: 270524 - RNA, 20 nt, Human
agacaaaaugacuucaugca

SEQ ID NO: 270525 - RNA, 22 nt, Human
uccuccagcaggacugaggccc

SEQ ID NO: 270526 - RNA, 22 nt, Human
aagcugaggcuccccugaggga

SEQ ID NO: 270527 - RNA, 22 nt, Human
cuggccuuucgugagagcuggg

SEQ ID NO: 270528 - RNA, 22 nt, Human
cagggcugaacugagcuuguga

SEQ ID NO: 270529 - RNA, 22 nt, Human
aauacagaggggucacaauuca

SEQ ID NO: 270530 - RNA, 22 nt, Human
cggcuggggcuguccccaugac

SEQ ID NO: 270531 - RNA, 22 nt, Human
ugaugagggaacugguucauac

SEQ ID NO: 270532 - RNA, 22 nt, Human
uggcucagucauggaugaguaa

SEQ ID NO: 270533 - RNA, 21 nt, Human
ucuuccugcuccacacucccc

SEQ ID NO: 270534 - RNA, 18 nt, Human
cugccccuucucugagau

SEQ ID NO: 270535 - RNA, 22 nt, Human
uuucucugaguuguuacaaaac

SEQ ID NO: 270536 - RNA, 22 nt, Human
ugccugggggacuaaggccaaa

SEQ ID NO: 270537 - RNA, 22 nt, Human
guagcuacuuagagccguucuu

SEQ ID NO: 270538 - RNA, 22 nt, Human
aggggagaguuaaugugaaugu

SEQ ID NO: 270539 - RNA, 22 nt, Human
gccucagagggcccuagggaca

SEQ ID NO: 270540 - RNA, 22 nt, Human
ccagcugcugugcagggaggcu

SEQ ID NO: 270541 - RNA, 22 nt, Human
cagcccuguccagcagagggug

SEQ ID NO: 270542 - RNA, 22 nt, Human
agcaggcuaggaaccucacugc

SEQ ID NO: 270543 - RNA, 22 nt, Human
gagccucguggcggccacugcg

SEQ ID NO: 270544 - RNA, 22 nt, Human
gccugcugagggaaguugggca

SEQ ID NO: 270545 - RNA, 22 nt, Human
agccacaccuguccugccagcu

SEQ ID NO: 270546 - RNA, 22 nt, Human
gcuuugaagacuuuuccagggu

SEQ ID NO: 270547 - RNA, 22 nt, Human
acauuaaaauugggugggguaa

SEQ ID NO: 270548 - RNA, 22 nt, Human
cuaauuuaaugaaugagucuua

SEQ ID NO: 270549 - RNA, 22 nt, Human
ucuacauuccuuuuauaauauc

SEQ ID NO: 270550 - RNA, 22 nt, Human
ugugugcacaggaguguuugaa

SEQ ID NO: 270551 - RNA, 22 nt, Human
aucuuuagacaggaagcaauca

SEQ ID NO: 270552 - RNA, 22 nt, Human
cuucuggggauggagcccagaa

SEQ ID NO: 270553 - RNA, 20 nt, Human
ucccuccugcagauagagaa

SEQ ID NO: 270554 - RNA, 22 nt, Human
uggcccugcuguaucaucugcu

SEQ ID NO: 270555 - RNA, 22 nt, Human
augugguuuuggauuauucaug

SEQ ID NO: 270556 - RNA, 22 nt, Human
acaugauucuugauaggcauug

SEQ ID NO: 270557 - RNA, 22 nt, Human
uguauuuauauuagaaugguug

SEQ ID NO: 270558 - RNA, 21 nt, Human
cuuguuccaagcaugucugag

SEQ ID NO: 270559 - RNA, 22 nt, Human
ugagguggguggcuucuguuau

SEQ ID NO: 270560 - RNA, 22 nt, Human
gaggaaaagagacagguuauug

SEQ ID NO: 270561 - RNA, 22 nt, Human
uuuuuccuagcgauuugucagc

SEQ ID NO: 270562 - RNA, 22 nt, Human
uuaucacuuaugagcuuuuugc

SEQ ID NO: 270563 - RNA, 22 nt, Human
cuucaaaucccccugaguuuga

SEQ ID NO: 270564 - RNA, 22 nt, Human
cacugggcuuuguaguuagcau

SEQ ID NO: 270565 - RNA, 19 nt, Human
acuggcagcuguagucugu

SEQ ID NO: 270566 - RNA, 22 nt, Human
cuggggacucauucagagcaua

SEQ ID NO: 270567 - RNA, 22 nt, Human
agagucuuguuaacuugcuaag

SEQ ID NO: 270568 - RNA, 22 nt, Human
auugaugagcauuacucucuaa

SEQ ID NO: 270569 - RNA, 22 nt, Human
augagcaagagcuauguacaga

SEQ ID NO: 270570 - RNA, 22 nt, Human
ucuuucuucuuucauaguguga

SEQ ID NO: 270571 - RNA, 22 nt, Human
uggaaaacuuugguggugaggg

SEQ ID NO: 270572 - RNA, 22 nt, Human
ucauguuucucuuacagcagcu

SEQ ID NO: 270573 - RNA, 22 nt, Human
cagcaugaugagugcaguuugg

SEQ ID NO: 270574 - RNA, 22 nt, Human
cuccucuggguccugguggcca

SEQ ID NO: 270575 - RNA, 22 nt, Human
caggaugggugucggccagcac

SEQ ID NO: 270576 - RNA, 23 nt, Human
uggcaaagcauucuuauaacagu

SEQ ID NO: 270577 - RNA, 22 nt, Human
ugcccagggauaagccuagaga

SEQ ID NO: 270578 - RNA, 22 nt, Human
uguuaucugcacguagaguuuu

SEQ ID NO: 270579 - RNA, 22 nt, Human
gaguuaaauauuuucugaaguu

SEQ ID NO: 270580 - RNA, 22 nt, Human
cucucagaaguagcacgugggc

SEQ ID NO: 270581 - RNA, 22 nt, Human
agagccaggccaggccggggca

SEQ ID NO: 270582 - RNA, 22 nt, Human
aaaauguucaagcaugcugguu

SEQ ID NO: 270583 - RNA, 22 nt, Human
gggcuucucucaggggcaugag

SEQ ID NO: 270584 - RNA, 18 nt, Human
cagaaaguuauuuacucu

SEQ ID NO: 270585 - RNA, 23 nt, Human
gcugacugugaaauucuggagcu

SEQ ID NO: 270586 - RNA, 19 nt, Human
gcccaggggcccgaugcug

SEQ ID NO: 270587 - RNA, 22 nt, Human
cugaaggcaccaggggugccag

SEQ ID NO: 270588 - RNA, 22 nt, Human
aaucuuuuucacaagaaagcac

SEQ ID NO: 270589 - RNA, 22 nt, Human
aagccaguggcuucucccugcu

SEQ ID NO: 270590 - RNA, 22 nt, Human
cagcuggguggcucuucugcuc

SEQ ID NO: 270591 - RNA, 22 nt, Human
agaggucagaggucgccagguc

SEQ ID NO: 270592 - RNA, 22 nt, Human
aaauacuggcaagugcuaauuc

SEQ ID NO: 270593 - RNA, 22 nt, Human
gugaugucagcaagaauaggaa

SEQ ID NO: 270594 - RNA, 17 nt, Human
gucaauauuguugacag

SEQ ID NO: 270595 - RNA, 22 nt, Human
gcagcaggagaguaauagcggu

SEQ ID NO: 270596 - RNA, 22 nt, Human
gugcaggguccuaauuguuaag

SEQ ID NO: 270597 - RNA, 22 nt, Human
aggcuucuggaauccaguuucu

SEQ ID NO: 270598 - RNA, 22 nt, Human
uguuuucucuugaaaagcaguc

SEQ ID NO: 270599 - RNA, 22 nt, Human
cacaggcuccggccuugcagcc

SEQ ID NO: 270600 - RNA, 22 nt, Human
uggaggcaguuuaagucugaga

SEQ ID NO: 270601 - RNA, 22 nt, Human
aucuuuagcauuacuuuauuca

SEQ ID NO: 270602 - RNA, 22 nt, Human
gcuggggagggcgucaaggcca

SEQ ID NO: 270603 - RNA, 22 nt, Human
uuuagcaagaugcccuggcuuu

SEQ ID NO: 270604 - RNA, 22 nt, Human
auuuuucagcuucauugaggca

SEQ ID NO: 270605 - RNA, 22 nt, Human
ugucuuuauauauuuggaaaau

SEQ ID NO: 270606 - RNA, 22 nt, Human
ucugcacccugugguccucuag

SEQ ID NO: 270607 - RNA, 22 nt, Human
agaaaagaggcuuucuaagcau

SEQ ID NO: 270608 - RNA, 22 nt, Human
caaaggcugguagaaugagcca

SEQ ID NO: 270609 - RNA, 22 nt, Human
ccagcugugccuaggagcaggg

SEQ ID NO: 270610 - RNA, 22 nt, Human
cacacagguaagccucuuucaa

SEQ ID NO: 270611 - RNA, 21 nt, Human
aaguaaaucagagaaauaacc

SEQ ID NO: 270612 - RNA, 23 nt, Human
gccaggcuccggucuguggccac

SEQ ID NO: 270613 - RNA, 22 nt, Human
uacuggguauacaaagaugaau

SEQ ID NO: 270614 - RNA, 19 nt, Human
uaucacugggcacugagga

SEQ ID NO: 270615 - RNA, 22 nt, Human
auguuuaugcaaacaugugagu

SEQ ID NO: 270616 - RNA, 22 nt, Human
uguguccugcagacagacucag

SEQ ID NO: 270617 - RNA, 22 nt, Human
cagggguguuuuuggccaggag

SEQ ID NO: 270618 - RNA, 22 nt, Human
cuuugccuccuagagcacguuc

SEQ ID NO: 270619 - RNA, 22 nt, Human
ccagaccagacugacuugagcc

SEQ ID NO: 270620 - RNA, 22 nt, Human
uucugggcuguccagaggguga

SEQ ID NO: 270621 - RNA, 18 nt, Human
ugucuuuggaccacugaa

SEQ ID NO: 270622 - RNA, 22 nt, Human
cauauuuuaguugcugaacagc

SEQ ID NO: 270623 - RNA, 22 nt, Human
ucacucuguuuuacucacuguu

SEQ ID NO: 270624 - RNA, 22 nt, Human
ggagagcugguauaugaagaca

SEQ ID NO: 270625 - RNA, 22 nt, Human
cucugggaauucugagcaagca

SEQ ID NO: 270626 - RNA, 22 nt, Human
aaauguacaacauccauauaua

SEQ ID NO: 270627 - RNA, 22 nt, Human
uuccuguguacguguuucgcug

SEQ ID NO: 270628 - RNA, 22 nt, Human
agcugccucucuugagguuacg

SEQ ID NO: 270629 - RNA, 22 nt, Human
auguacuaugcagucaacuguu

SEQ ID NO: 270630 - RNA, 21 nt, Human
ggacagcugcgcgcagggcuc

SEQ ID NO: 270631 - RNA, 22 nt, Human
ucuguaaaauuaguauaauugu

SEQ ID NO: 270632 - RNA, 22 nt, Human
gcuggagguagggagguccugu

SEQ ID NO: 270633 - RNA, 21 nt, Human
ccaagagcaaugcuaaggaga

SEQ ID NO: 270634 - RNA, 22 nt, Human
gacagacacuauugguaugccu

SEQ ID NO: 270635 - RNA, 18 nt, Human
cugcccagagcacuugug

SEQ ID NO: 270636 - RNA, 22 nt, Human
agcugcagcguucauuuuucca

SEQ ID NO: 270637 - RNA, 22 nt, Human
agguccagaguugagauacaga

SEQ ID NO: 270638 - RNA, 22 nt, Human
gcugcugggucccucugugcca

SEQ ID NO: 270639 - RNA, 22 nt, Human
agauuuagugguggaauuuugg

SEQ ID NO: 270640 - RNA, 22 nt, Human
auucaguuagccacagcuauuc

SEQ ID NO: 270641 - RNA, 22 nt, Human
auuuucugguugagguuuaaca

SEQ ID NO: 270642 - RNA, 22 nt, Human
aaacaggcacauaguaacauuu

SEQ ID NO: 270643 - RNA, 22 nt, Human
auccaaaaccagugcauuuucc

SEQ ID NO: 270644 - RNA, 18 nt, Human
uggaggaaaaaucucaug

SEQ ID NO: 270645 - RNA, 22 nt, Human
gaagacauuaagucuaugucac

SEQ ID NO: 270646 - RNA, 22 nt, Human
ugcagggaaaacccaggaugcu

SEQ ID NO: 270647 - RNA, 22 nt, Human
gucucugucuuaggccaggccu

SEQ ID NO: 270648 - RNA, 22 nt, Human
caauaacuaguaauuauuccgg

SEQ ID NO: 270649 - RNA, 20 nt, Human
aguuuucagcagaacaccca

SEQ ID NO: 270650 - RNA, 22 nt, Human
acauacuuaacauuaaagucau

SEQ ID NO: 270651 - RNA, 22 nt, Human
agugugucuuauccugggagaa

SEQ ID NO: 270652 - RNA, 22 nt, Human
cucugugggccugugcuuuagu

SEQ ID NO: 270653 - RNA, 22 nt, Human
uggcucagcauucacuggucuu

SEQ ID NO: 270654 - RNA, 22 nt, Human
auucuucacaccuguuccuguu

SEQ ID NO: 270655 - RNA, 23 nt, Human
ucagagaacucgggcagaugacc

SEQ ID NO: 270656 - RNA, 22 nt, Human
gggcucucaaggcagggcccca

SEQ ID NO: 270657 - RNA, 22 nt, Human
uucuuuauuaguuuagugagcu

SEQ ID NO: 270658 - RNA, 22 nt, Human
uucuagucuauggcuagauagu

SEQ ID NO: 270659 - RNA, 22 nt, Human
aaagugcaucaaaugacuuccc

SEQ ID NO: 270660 - RNA, 22 nt, Human
aaugugcagaugaauaaacaaa

SEQ ID NO: 270661 - RNA, 22 nt, Human
ugcacagugaccacugagcaag

SEQ ID NO: 270662 - RNA, 22 nt, Human
uuuuuaucuuguaugugucucu

SEQ ID NO: 270663 - RNA, 22 nt, Human
uuccaggauggagacacuagua

SEQ ID NO: 270664 - RNA, 22 nt, Human
agccaggacaucucuagcugcu

SEQ ID NO: 270665 - RNA, 21 nt, Human
aggaagaaagguuggagguug

SEQ ID NO: 270666 - RNA, 22 nt, Human
cucaaauaccucuccaugugac

SEQ ID NO: 270667 - RNA, 22 nt, Human
cauucccuuggggaguucaugc

SEQ ID NO: 270668 - RNA, 22 nt, Human
augcaacaaauugugugcaaua

SEQ ID NO: 270669 - RNA, 22 nt, Human
cagggacauaagaggaacaugg

SEQ ID NO: 270670 - RNA, 22 nt, Human
uacauucagcaaaagaaugguu

SEQ ID NO: 270671 - RNA, 22 nt, Human
ggucacaucuaaauggagcauu

SEQ ID NO: 270672 - RNA, 22 nt, Human
cuguuauuucugccaggugagu

SEQ ID NO: 270673 - RNA, 22 nt, Human
auuauaaauauuuucuaggggu

SEQ ID NO: 270674 - RNA, 22 nt, Human
guagcugauccugaggacaggg

SEQ ID NO: 270675 - RNA, 22 nt, Human
ccuggcuuucucauuuacaggc

SEQ ID NO: 270676 - RNA, 19 nt, Human
uuugcugguucaggaaaga

SEQ ID NO: 270677 - RNA, 22 nt, Human
ugggaccuguuacauugaguua

SEQ ID NO: 270678 - RNA, 20 nt, Human
uucuuuguuccuuacauuug

SEQ ID NO: 270679 - RNA, 22 nt, Human
cucuuagaaagaaacacacugg

SEQ ID NO: 270680 - RNA, 22 nt, Human
ugcuggcuuuuccuucaggcag

SEQ ID NO: 270681 - RNA, 22 nt, Human
cucugccugugucgccaccaca

SEQ ID NO: 270682 - RNA, 22 nt, Human
accaggaguaacagugaguggu

SEQ ID NO: 270683 - RNA, 22 nt, Human
gucauucuuaacaacucaguag

SEQ ID NO: 270684 - RNA, 23 nt, Human
ugggcagcuucugcaugcccacc

SEQ ID NO: 270685 - RNA, 22 nt, Human
aaggcugaauucaaggguaggc

SEQ ID NO: 270686 - RNA, 22 nt, Human
gucagugcuugaagggcagaga

SEQ ID NO: 270687 - RNA, 18 nt, Human
ucuguggagagggcaguu

SEQ ID NO: 270688 - RNA, 22 nt, Human
gaggagagaugguagauugggu

SEQ ID NO: 270689 - RNA, 22 nt, Human
gaggcuguuagggccugaggua

SEQ ID NO: 270690 - RNA, 22 nt, Human
uacccagcccaugccuaccuca

SEQ ID NO: 270691 - RNA, 22 nt, Human
uuccaggccgggcaggaaacac

SEQ ID NO: 270692 - RNA, 22 nt, Human
agcuuguucucauccauucuuc

SEQ ID NO: 270693 - RNA, 22 nt, Human
acugagcucuagguuuugaacc

SEQ ID NO: 270694 - RNA, 22 nt, Human
auacagaaguuuuccacuuauu

SEQ ID NO: 270695 - RNA, 22 nt, Human
cuggagggcuucugcagguuac

SEQ ID NO: 270696 - RNA, 22 nt, Human
acaugcauaaacuacuucuuau

SEQ ID NO: 270697 - RNA, 22 nt, Human
augauguuauuuucagaaacau

SEQ ID NO: 270698 - RNA, 22 nt, Human
acuauauacacauuaucuuguu

SEQ ID NO: 270699 - RNA, 22 nt, Human
gaaggcauucuauucuacauau

SEQ ID NO: 270700 - RNA, 22 nt, Human
uggcucagauuuuuguaggcuu

SEQ ID NO: 270701 - RNA, 22 nt, Human
aaaaauaggucaaccguguaug

SEQ ID NO: 270702 - RNA, 22 nt, Human
cacagugcuuuaugagagaucu

SEQ ID NO: 270703 - RNA, 22 nt, Human
uuagaagugggccuauaguccu

SEQ ID NO: 270704 - RNA, 22 nt, Human
guccugaggcaggauggguuuc

SEQ ID NO: 270705 - RNA, 22 nt, Human
aggacacacuucugaggucuuu

SEQ ID NO: 270706 - RNA, 22 nt, Human
cugaggcacugguaaugggcau

SEQ ID NO: 270707 - RNA, 22 nt, Human
guccaaggauggggucucccag

SEQ ID NO: 270708 - RNA, 22 nt, Human
ugcaguggaaucuggagagcag

SEQ ID NO: 270709 - RNA, 22 nt, Human
ucagaggacagcagcuaaauaa

SEQ ID NO: 270710 - RNA, 22 nt, Human
uaggguccauauggaugaaugg

SEQ ID NO: 270711 - RNA, 22 nt, Human
caugugugugagggaaacaugu

SEQ ID NO: 270712 - RNA, 22 nt, Human
uauaaauuauuaggcugcuaaa

SEQ ID NO: 270713 - RNA, 22 nt, Human
agaaaucacuuagaggaaguga

SEQ ID NO: 270714 - RNA, 22 nt, Human
ugucuccaacucacuguauacu

SEQ ID NO: 270715 - RNA, 18 nt, Human
agauuuugagaaauacaa

SEQ ID NO: 270716 - RNA, 22 nt, Human
gucugucucccugugacugaga

SEQ ID NO: 270717 - RNA, 22 nt, Human
gaaaguauucacaaaguucuug

SEQ ID NO: 270718 - RNA, 22 nt, Human
ggcucagaaacuaaaggcgcug

SEQ ID NO: 270719 - RNA, 22 nt, Human
aucuagaaaaggugacuaaaau

SEQ ID NO: 270720 - RNA, 22 nt, Human
uaacaguauugaagauaaacua

SEQ ID NO: 270721 - RNA, 22 nt, Human
gcagcaggugugcuuuuaauga

SEQ ID NO: 270722 - RNA, 22 nt, Human
cuuugaaaacuuaaauaacagc

SEQ ID NO: 270723 - RNA, 22 nt, Human
ccuggcagcaggugggcccgug

SEQ ID NO: 270724 - RNA, 22 nt, Human
gcccagccagagcugugugaug

SEQ ID NO: 270725 - RNA, 22 nt, Human
uuagaaacccagacucuuaggu

SEQ ID NO: 270726 - RNA, 22 nt, Human
cugcucagaggaaggaaugucu

SEQ ID NO: 270727 - RNA, 22 nt, Human
uuaggaaaggaacauugaaacg

SEQ ID NO: 270728 - RNA, 22 nt, Human
acaagcaugggcuuugacauca

SEQ ID NO: 270729 - RNA, 22 nt, Human
ucacaugcuugaggaaagaaaa

SEQ ID NO: 270730 - RNA, 22 nt, Human
ugcagggcuaagucagagccug

SEQ ID NO: 270731 - RNA, 22 nt, Human
aggacagcccccaacagcaaca

SEQ ID NO: 270732 - RNA, 19 nt, Human
agcauuuggaauucuacac

SEQ ID NO: 270733 - RNA, 20 nt, Human
aaguuucugguuuauaucuu

SEQ ID NO: 270734 - RNA, 22 nt, Human
uuuuauaagcaagaaagggaaa

SEQ ID NO: 270735 - RNA, 22 nt, Human
ggcaggugaucuagagucaaua

SEQ ID NO: 270736 - RNA, 22 nt, Human
acuguauuccuacuagaaucua

SEQ ID NO: 270737 - RNA, 20 nt, Human
ccuccaggcacacccaugug

SEQ ID NO: 270738 - RNA, 19 nt, Human
ugcuauuuagaacgccugg

SEQ ID NO: 270739 - RNA, 22 nt, Human
cucuguccuaugcuugauagaa

SEQ ID NO: 270740 - RNA, 22 nt, Human
uaauaauagcaguagcugccac

SEQ ID NO: 270741 - RNA, 22 nt, Human
caggaaaugggucguuuuauaa

SEQ ID NO: 270742 - RNA, 22 nt, Human
gcauggcaagaucaggagacca

SEQ ID NO: 270743 - RNA, 22 nt, Human
caggcuuccgccagguuuccag

SEQ ID NO: 270744 - RNA, 22 nt, Human
agaucaaugugucagaagagau

SEQ ID NO: 270745 - RNA, 22 nt, Human
cccaugagauucugaauuuggc

SEQ ID NO: 270746 - RNA, 22 nt, Human
aggacacacccagcucacgggg

SEQ ID NO: 270747 - RNA, 22 nt, Human
aaaugugcuucuuacucucaau

SEQ ID NO: 270748 - RNA, 22 nt, Human
ccuguggcuggucaggccagca

SEQ ID NO: 270749 - RNA, 22 nt, Human
cccaccacgugcuuugcuggag

SEQ ID NO: 270750 - RNA, 22 nt, Human
aaaucacagggucucuaaguau

SEQ ID NO: 270751 - RNA, 22 nt, Human
caggaaaucagaacucaagugg

SEQ ID NO: 270752 - RNA, 22 nt, Human
aacaccagucccaagagaggcu

SEQ ID NO: 270753 - RNA, 22 nt, Human
cauauucuuuaagcaaugcucu

SEQ ID NO: 270754 - RNA, 22 nt, Human
cuaggcccaugagguuugcugg

SEQ ID NO: 270755 - RNA, 22 nt, Human
uuuauugcuggccaccuguagc

SEQ ID NO: 270756 - RNA, 22 nt, Human
aguggcugauguaggcaguggg

SEQ ID NO: 270757 - RNA, 20 nt, Human
aaaagagugcuucaacugcu

SEQ ID NO: 270758 - RNA, 22 nt, Human
aagauacugaugauguaggcua

SEQ ID NO: 270759 - RNA, 22 nt, Human
ucccuggggauguuggccugcc

SEQ ID NO: 270760 - RNA, 22 nt, Human
aguggcuguuuauaggugggua

SEQ ID NO: 270761 - RNA, 20 nt, Human
uuguuucugcuauuuucuaa

SEQ ID NO: 270762 - RNA, 22 nt, Human
agacuacagaauggcauuguuu

SEQ ID NO: 270763 - RNA, 22 nt, Human
guuccacauaacacaucuacaa

SEQ ID NO: 270764 - RNA, 22 nt, Human
cucucccuggccagcugugcag

SEQ ID NO: 270765 - RNA, 22 nt, Human
aucucuucuagcucugaaauua

SEQ ID NO: 270766 - RNA, 22 nt, Human
caggucuuuucuacugguggag

SEQ ID NO: 270767 - RNA, 20 nt, Human
uugcugggaccuuuuucaac

SEQ ID NO: 270768 - RNA, 22 nt, Human
aaugcuuauaacguuagaaugu

SEQ ID NO: 270769 - RNA, 23 nt, Human
uggcccugugcaugcugcuuccc

SEQ ID NO: 270770 - RNA, 22 nt, Human
gccugggaaaugguggggucag

SEQ ID NO: 270771 - RNA, 23 nt, Human
uuguaaaacagugugacgguucc

SEQ ID NO: 270772 - RNA, 22 nt, Human
auaauacaugguuaaccucuuu

SEQ ID NO: 270773 - RNA, 22 nt, Human
uuuacaauucucuaccaguguu

SEQ ID NO: 270774 - RNA, 22 nt, Human
aacauucaauugaggaaguuaa

SEQ ID NO: 270775 - RNA, 22 nt, Human
gagccagacugccugaagcuca

SEQ ID NO: 270776 - RNA, 22 nt, Human
cuaugaaaggauuuggaguugu

SEQ ID NO: 270777 - RNA, 22 nt, Human
aucuggcugagcgaggcccaca

SEQ ID NO: 270778 - RNA, 22 nt, Human
cacccagccuucacacaggagu

SEQ ID NO: 270779 - RNA, 22 nt, Human
ggccgcugcgccuccaaccgag

SEQ ID NO: 270780 - RNA, 22 nt, Human
auaugacauaaaaucauuuuug

SEQ ID NO: 270781 - RNA, 22 nt, Human
ugucauuuaugcuucuucagug

SEQ ID NO: 270782 - RNA, 22 nt, Human
uuucuguaaagaccaagccagc

SEQ ID NO: 270783 - RNA, 22 nt, Human
aaagcagauucugaugcaguag

SEQ ID NO: 270784 - RNA, 22 nt, Human
uuucauguuuauggaaaaugag

SEQ ID NO: 270785 - RNA, 20 nt, Human
caccuggcugacugucucca

SEQ ID NO: 270786 - RNA, 22 nt, Human
cugggcacagacccccugggcc

SEQ ID NO: 270787 - RNA, 22 nt, Human
cacaggagaacccacagauucu

SEQ ID NO: 270788 - RNA, 22 nt, Human
ucucuuaauuuuggaauagugu

SEQ ID NO: 270789 - RNA, 22 nt, Human
gcucucagaugcuccagcagcc

SEQ ID NO: 270790 - RNA, 22 nt, Human
aagcuuuaugaucucucagcua

SEQ ID NO: 270791 - RNA, 22 nt, Human
gcucagggaaagagcuccuguc

SEQ ID NO: 270792 - RNA, 22 nt, Human
caauaugcaagcuauuaaguau

SEQ ID NO: 270793 - RNA, 21 nt, Human
agaggcccucggacugggcgu

SEQ ID NO: 270794 - RNA, 22 nt, Human
aggcuuccucgugccuuagaua

SEQ ID NO: 270795 - RNA, 22 nt, Human
uauugcugaugcugaagggaag

SEQ ID NO: 270796 - RNA, 22 nt, Human
gcaggugguccccguggagugg

SEQ ID NO: 270797 - RNA, 22 nt, Human
cagccaucaguaaagacagcuu

SEQ ID NO: 270798 - RNA, 22 nt, Human
ugcucccugacccaggucuucu

SEQ ID NO: 270799 - RNA, 22 nt, Human
cucuccagccuuuagcccacgc

SEQ ID NO: 270800 - RNA, 22 nt, Human
ugcagaggaccauuguccugga

SEQ ID NO: 270801 - RNA, 22 nt, Human
uuccuggggugaagauauuuuu

SEQ ID NO: 270802 - RNA, 18 nt, Human
cuguucuagaacuccugu

SEQ ID NO: 270803 - RNA, 22 nt, Human
gaguccaggcuguugcucaucu

SEQ ID NO: 270804 - RNA, 22 nt, Human
ugggaggacuugugggcuucau

SEQ ID NO: 270805 - RNA, 22 nt, Human
cccugugccucaguuuccucau

SEQ ID NO: 270806 - RNA, 20 nt, Human
aggaggggauagaaucaaag

SEQ ID NO: 270807 - RNA, 22 nt, Human
ccugaaauccauaguuuacacu

SEQ ID NO: 270808 - RNA, 22 nt, Human
ccagagcagggcagcagggcuc

SEQ ID NO: 270809 - RNA, 22 nt, Human
auuaagcuccaaguugcucuga

SEQ ID NO: 270810 - RNA, 22 nt, Human
auuugcaagcaugcacaaaagc

SEQ ID NO: 270811 - RNA, 22 nt, Human
ucuuccuucgcccuugcuguuu

SEQ ID NO: 270812 - RNA, 22 nt, Human
ggggacaguuaaagaccaagac

SEQ ID NO: 270813 - RNA, 22 nt, Human
agcuggcccacuguguggucca

SEQ ID NO: 270814 - RNA, 22 nt, Human
ugaucaaauucaggagucugga

SEQ ID NO: 270815 - RNA, 22 nt, Human
cauguuuuguguacagaauauu

SEQ ID NO: 270816 - RNA, 22 nt, Human
cuugacacugucacucaggcca

SEQ ID NO: 270817 - RNA, 22 nt, Human
ugcucagaauugcgcuggugga

SEQ ID NO: 270818 - RNA, 22 nt, Human
caaauacugagcacgcaaucaa

SEQ ID NO: 270819 - RNA, 22 nt, Human
aggcuggccagugcugcagugg

SEQ ID NO: 270820 - RNA, 20 nt, Human
cucaaguaagguuauaaggu

SEQ ID NO: 270821 - RNA, 22 nt, Human
auuacacaggcuggcucuuuga

SEQ ID NO: 270822 - RNA, 16 nt, Human
caauacauggcauuuc

SEQ ID NO: 270823 - RNA, 18 nt, Human
acaaaggucugcaagacc

SEQ ID NO: 270824 - RNA, 22 nt, Human
acuuccuggauucccaagggcu

SEQ ID NO: 270825 - RNA, 21 nt, Human
acagggcaugcagcuggcugu

SEQ ID NO: 270826 - RNA, 22 nt, Human
aaguauucauaaggacauaugu

SEQ ID NO: 270827 - RNA, 20 nt, Human
uugaccugcaagucaucauu

SEQ ID NO: 270828 - RNA, 22 nt, Human
ucagaaucugaaaagcgcuugg

SEQ ID NO: 270829 - RNA, 22 nt, Human
aaagcauaguucaucuguccau

SEQ ID NO: 270830 - RNA, 22 nt, Human
acugucuccucaucaugccugg

SEQ ID NO: 270831 - RNA, 22 nt, Human
aaauaagugugggccagucaaa

SEQ ID NO: 270832 - RNA, 22 nt, Human
gcuguucacauuuugggccaaa

SEQ ID NO: 270833 - RNA, 22 nt, Human
aagucuaaguuuguaacuugga

SEQ ID NO: 270834 - RNA, 22 nt, Human
uuuuuguucccagagaauuugu

SEQ ID NO: 270835 - RNA, 22 nt, Human
agcaccaggccauggggucccu

SEQ ID NO: 270836 - RNA, 22 nt, Human
cccagccucuguuugcuccucu

SEQ ID NO: 270837 - RNA, 22 nt, Human
uuugcaguagacaucuuauuuu

SEQ ID NO: 270838 - RNA, 22 nt, Human
augugucuuggaguuuuaaugu

SEQ ID NO: 270839 - RNA, 22 nt, Human
cacguuaacagcuaacagauga

SEQ ID NO: 270840 - RNA, 16 nt, Human
cagaggcaccuggcuc

SEQ ID NO: 270841 - RNA, 21 nt, Human
aagagcuggaucaaggauaag

SEQ ID NO: 270842 - RNA, 22 nt, Human
auucucuguucaaggaugguga

SEQ ID NO: 270843 - RNA, 22 nt, Human
agggaugacucuuggcugauuc

SEQ ID NO: 270844 - RNA, 22 nt, Human
agcugcaggauuauggaaugga

SEQ ID NO: 270845 - RNA, 22 nt, Human
cucucuggcuuggcacggagau

SEQ ID NO: 270846 - RNA, 22 nt, Human
ggucacugucugagguacugga

SEQ ID NO: 270847 - RNA, 19 nt, Human
gaacaaacuuaaacuuuuc

SEQ ID NO: 270848 - RNA, 22 nt, Human
gcugaggacaucauggaaggaa

SEQ ID NO: 270849 - RNA, 22 nt, Human
acuguauuuggauauaagaucu

SEQ ID NO: 270850 - RNA, 22 nt, Human
cugguagcagugaagcuguuga

SEQ ID NO: 270851 - RNA, 22 nt, Human
gggcacugcuggaggcucccug

SEQ ID NO: 270852 - RNA, 19 nt, Human
aaacuaaggggaaauguuu

SEQ ID NO: 270853 - RNA, 22 nt, Human
cucuuuggcguuggcagagcca

SEQ ID NO: 270854 - RNA, 22 nt, Human
aggaaccuaagagccugcaguc

SEQ ID NO: 270855 - RNA, 23 nt, Human
ugaaugauggugcuccucaucuu

SEQ ID NO: 270856 - RNA, 18 nt, Human
auaugcuugagcuaagga

SEQ ID NO: 270857 - RNA, 22 nt, Human
gaccauuucuaggaaucagacu

SEQ ID NO: 270858 - RNA, 22 nt, Human
uuuauuuauccuucuggauugc

SEQ ID NO: 270859 - RNA, 22 nt, Human
ggcuccugggcagcugcucccu

SEQ ID NO: 270860 - RNA, 22 nt, Human
uucucugacccccuuaaauauu

SEQ ID NO: 270861 - RNA, 22 nt, Human
cccagaggaggcaaagcucugu

SEQ ID NO: 270862 - RNA, 22 nt, Human
ggugcucaaggugacaggacau

SEQ ID NO: 270863 - RNA, 22 nt, Human
cccucccaggaguggccagaga

SEQ ID NO: 270864 - RNA, 17 nt, Human
acaaugcagucucuagu

SEQ ID NO: 270865 - RNA, 22 nt, Human
agcuccugcccaggaaggcucu

SEQ ID NO: 270866 - RNA, 23 nt, Human
cuuauucauucauguagcccauu

SEQ ID NO: 270867 - RNA, 22 nt, Human
cauagaaaguauuauggaauuu

SEQ ID NO: 270868 - RNA, 22 nt, Human
uagcuuuaaugaguugguaaga

SEQ ID NO: 270869 - RNA, 22 nt, Human
ugucucaguucccuucucugga

SEQ ID NO: 270870 - RNA, 22 nt, Human
ggauguugauugaauggccauu

SEQ ID NO: 270871 - RNA, 22 nt, Human
caaugauagauuuuacaaauua

SEQ ID NO: 270872 - RNA, 22 nt, Human
uagaaaguagccacuuacagag

SEQ ID NO: 270873 - RNA, 22 nt, Human
uuucacuagaacguucuuguuu

SEQ ID NO: 270874 - RNA, 22 nt, Human
ugaacagaucaauagaacugac

SEQ ID NO: 270875 - RNA, 22 nt, Human
cagugcagucaaggaagaacca

SEQ ID NO: 270876 - RNA, 22 nt, Human
aacacaguuuuccaaaauagag

SEQ ID NO: 270877 - RNA, 22 nt, Human
cuaacugucaugcacauguguu

SEQ ID NO: 270878 - RNA, 22 nt, Human
guccaggcucaaaagguuguua

SEQ ID NO: 270879 - RNA, 22 nt, Human
uugcuggcaauuuagagauuuc

SEQ ID NO: 270880 - RNA, 22 nt, Human
cacauuuagagguuagcauggu

SEQ ID NO: 270881 - RNA, 22 nt, Human
cuuagaaauuguuacucauuca

SEQ ID NO: 270882 - RNA, 22 nt, Human
ugcaggcugccuucacagagcc

SEQ ID NO: 270883 - RNA, 22 nt, Human
aggcugcuucagcugcagggag

SEQ ID NO: 270884 - RNA, 22 nt, Human
cugcaagauuggaagaugcaau

SEQ ID NO: 270885 - RNA, 22 nt, Human
cauuuucucaaugaacccucuu

SEQ ID NO: 270886 - RNA, 22 nt, Human
agagaugcgguuccaugguuau

SEQ ID NO: 270887 - RNA, 22 nt, Human
aaaggcuugguauuuuggaguu

SEQ ID NO: 270888 - RNA, 22 nt, Human
agagacugcuuuauauuguacu

SEQ ID NO: 270889 - RNA, 19 nt, Human
cucucuggcggugucugcg

SEQ ID NO: 270890 - RNA, 22 nt, Human
acaguguuuggcaaugcaugca

SEQ ID NO: 270891 - RNA, 18 nt, Human
ucuuggaguaaugaucaa

SEQ ID NO: 270892 - RNA, 22 nt, Human
ucagggcugccgggcagaccgu

SEQ ID NO: 270893 - RNA, 22 nt, Human
gaaaugaaacaggcuuuuaagg

SEQ ID NO: 270894 - RNA, 22 nt, Human
ccaguguguuaguggauuuccc

SEQ ID NO: 270895 - RNA, 22 nt, Human
cauguacaugccuacuaucaau

SEQ ID NO: 270896 - RNA, 22 nt, Human
cuuguccuuuacuugagacuca

SEQ ID NO: 270897 - RNA, 22 nt, Human
agcagcaugaugacagagucuc

SEQ ID NO: 270898 - RNA, 22 nt, Human
augaggcauagcagggaucgga

SEQ ID NO: 270899 - RNA, 22 nt, Human
aaaguauuugugauuuuuacca

SEQ ID NO: 270900 - RNA, 22 nt, Human
guuuacaacaugccaacugggc

SEQ ID NO: 270901 - RNA, 22 nt, Human
aagauaaacucuugauuucuga

SEQ ID NO: 270902 - RNA, 22 nt, Human
ugagguggaaggauccuuugaa

SEQ ID NO: 270903 - RNA, 22 nt, Human
ucccaggauguuuauggcuggu

SEQ ID NO: 270904 - RNA, 22 nt, Human
caagaucaaggugucagcaggu

SEQ ID NO: 270905 - RNA, 22 nt, Human
caagaucaagguaucagcagau

SEQ ID NO: 270906 - RNA, 23 nt, Human
cuggcccaggugagagguuggug

SEQ ID NO: 270907 - RNA, 22 nt, Human
uuugguuuagggucauuuaaca

SEQ ID NO: 270908 - RNA, 22 nt, Human
uuuccucugcugccauugcccc

SEQ ID NO: 270909 - RNA, 22 nt, Human
uaugugcaaauuaauugcuaga

SEQ ID NO: 270910 - RNA, 22 nt, Human
uugcuuuaucucuuaugccuca

SEQ ID NO: 270911 - RNA, 22 nt, Human
ucucagagaagugaugagcaau

SEQ ID NO: 270912 - RNA, 23 nt, Human
cagugggcuucuaacugcuccug

SEQ ID NO: 270913 - RNA, 22 nt, Human
aucuucccaggcuggggagagg

SEQ ID NO: 270914 - RNA, 22 nt, Human
cucagcagcuacaggauucggg

SEQ ID NO: 270915 - RNA, 19 nt, Human
cuugaaacuacuguugaga

SEQ ID NO: 270916 - RNA, 22 nt, Human
ucucugggcccagaccuuccuu

SEQ ID NO: 270917 - RNA, 22 nt, Human
uucuauugggcagcauugcuuc

SEQ ID NO: 270918 - RNA, 23 nt, Human
uuucaguugagaaugcacggacc

SEQ ID NO: 270919 - RNA, 22 nt, Human
gacagacaccugggggguugcu

SEQ ID NO: 270920 - RNA, 22 nt, Human
uuuauugacccaaagcgagagu

SEQ ID NO: 270921 - RNA, 22 nt, Human
auauauuggugucagaaagagu

SEQ ID NO: 270922 - RNA, 22 nt, Human
agcugcuuagagucucuucuua

SEQ ID NO: 270923 - RNA, 22 nt, Human
cugccugaguacaagucccaga

SEQ ID NO: 270924 - RNA, 22 nt, Human
cuggccugcugggugagguccu

SEQ ID NO: 270925 - RNA, 22 nt, Human
aaaggcuuagacacagaacugu

SEQ ID NO: 270926 - RNA, 22 nt, Human
uaggaaaccaaucuuuugggag

SEQ ID NO: 270927 - RNA, 22 nt, Human
gccuguguggaugcgccggugc

SEQ ID NO: 270928 - RNA, 22 nt, Human
aaagccacguggccuggggagc

SEQ ID NO: 270929 - RNA, 22 nt, Human
gggagacaguucagauaguuuc

SEQ ID NO: 270930 - RNA, 22 nt, Human
caucuuuugguaggagccgggc

SEQ ID NO: 270931 - RNA, 22 nt, Human
ggagagagaccuccaugcccag

SEQ ID NO: 270932 - RNA, 22 nt, Human
ugaucauuaucaaacuggucau

SEQ ID NO: 270933 - RNA, 22 nt, Human
ugcagagagaccccugggccag

SEQ ID NO: 270934 - RNA, 22 nt, Human
acacauauucauauguacuuac

SEQ ID NO: 270935 - RNA, 22 nt, Human
uccagugccucacugaggauuc

SEQ ID NO: 270936 - RNA, 22 nt, Human
caguuucuuaucuucaaaauug

SEQ ID NO: 270937 - RNA, 22 nt, Human
uagaaccuccacaggaccucca

SEQ ID NO: 270938 - RNA, 17 nt, Human
ccaggagcgugggucuc

SEQ ID NO: 270939 - RNA, 22 nt, Human
uccagauggauuuaagaccuaa

SEQ ID NO: 270940 - RNA, 19 nt, Human
auuuacugccuaaaaucuc

SEQ ID NO: 270941 - RNA, 22 nt, Human
aaugaauugcaguacugacuug

SEQ ID NO: 270942 - RNA, 23 nt, Human
agcugaaagcuugcaacgaggca

SEQ ID NO: 270943 - RNA, 22 nt, Human
uugugaauagugccgcaauaaa

SEQ ID NO: 270944 - RNA, 22 nt, Human
cauggcugaacacucagugacu

SEQ ID NO: 270945 - RNA, 22 nt, Human
agggcugcuuaccuggaauggc

SEQ ID NO: 270946 - RNA, 22 nt, Human
cucaggaguuggaggcuacagu

SEQ ID NO: 270947 - RNA, 22 nt, Human
ucacaucuguugauacagcauc

SEQ ID NO: 270948 - RNA, 22 nt, Human
agucuggucaucugauucuuuu

SEQ ID NO: 270949 - RNA, 22 nt, Human
uucaguauacuucauaacauuu

SEQ ID NO: 270950 - RNA, 22 nt, Human
ggggagaccaucugaaggugau

SEQ ID NO: 270951 - RNA, 22 nt, Human
auuuauuaccucggaguuucug

SEQ ID NO: 270952 - RNA, 22 nt, Human
gauuagaaauguuaccauacag

SEQ ID NO: 270953 - RNA, 22 nt, Human
caggacagcugggccaccacca

SEQ ID NO: 270954 - RNA, 22 nt, Human
auuaauauugguucauuagcug

SEQ ID NO: 270955 - RNA, 22 nt, Human
auggcaauuguaaauggaaaga

SEQ ID NO: 270956 - RNA, 22 nt, Human
caggccuggcugcagcucgccu

SEQ ID NO: 270957 - RNA, 22 nt, Human
ugacacaguagaaagaugauga

SEQ ID NO: 270958 - RNA, 22 nt, Human
caaauucucaagguuuauccca

SEQ ID NO: 270959 - RNA, 22 nt, Human
agcaggcagccuaggaagugaa

SEQ ID NO: 270960 - RNA, 22 nt, Human
uggcacagccaucuucuccugc

SEQ ID NO: 270961 - RNA, 22 nt, Human
ccccagugguugcaacagcaga

SEQ ID NO: 270962 - RNA, 22 nt, Human
gucuggcauaugcaaagugcau

SEQ ID NO: 270963 - RNA, 22 nt, Human
ggcucaggggccaggccugucc

SEQ ID NO: 270964 - RNA, 22 nt, Human
auuguauuagcacaauacaauu

SEQ ID NO: 270965 - RNA, 22 nt, Human
caucacagaaauaaacauaccu

SEQ ID NO: 270966 - RNA, 22 nt, Human
auaaacugugcuggaugaugag

SEQ ID NO: 270967 - RNA, 22 nt, Human
gcagagaagaugcccaggcuuc

SEQ ID NO: 270968 - RNA, 22 nt, Human
aggaagccacgaguggcacggg

SEQ ID NO: 270969 - RNA, 22 nt, Human
ucucaguggacgugucugucuu

SEQ ID NO: 270970 - RNA, 22 nt, Human
gagagcuggguucaaguagcug

SEQ ID NO: 270971 - RNA, 22 nt, Human
aggccagguuccucaaucuuga

SEQ ID NO: 270972 - RNA, 22 nt, Human
auucagcaaacauuuauuaucu

SEQ ID NO: 270973 - RNA, 22 nt, Human
uauguagcaauagcaucauacu

SEQ ID NO: 270974 - RNA, 22 nt, Human
augaacaucucugauccaagca

SEQ ID NO: 270975 - RNA, 22 nt, Human
ucccaggccauaaaacucagag

SEQ ID NO: 270976 - RNA, 22 nt, Human
agcugcaggcgccggggccgau

SEQ ID NO: 270977 - RNA, 22 nt, Human
cugugggagcacuggggaccga

SEQ ID NO: 270978 - RNA, 22 nt, Human
ucagcagaguuucaucuuggga

SEQ ID NO: 270979 - RNA, 22 nt, Human
cucaggucgcuauuucucuuac

SEQ ID NO: 270980 - RNA, 22 nt, Human
ccugugcccucugcauagcagc

SEQ ID NO: 270981 - RNA, 22 nt, Human
cuuguauucuuccacuuaagau

SEQ ID NO: 270982 - RNA, 22 nt, Human
caguuuaaggcaggacauggga

SEQ ID NO: 270983 - RNA, 22 nt, Human
guccugugcaccgugggauguu

SEQ ID NO: 270984 - RNA, 22 nt, Human
ucacagugggacuuuuaucgcu

SEQ ID NO: 270985 - RNA, 22 nt, Human
uuauauuaguuagacuugcugu

SEQ ID NO: 270986 - RNA, 22 nt, Human
gaggccuggaauuccagccugg

SEQ ID NO: 270987 - RNA, 22 nt, Human
uuccugugugcucucauuuagu

SEQ ID NO: 270988 - RNA, 22 nt, Human
aacuuuggcaagucagacuucu

SEQ ID NO: 270989 - RNA, 22 nt, Human
uagcuccuacaaguacagcaaa

SEQ ID NO: 270990 - RNA, 22 nt, Human
agagccaggcaggcaauguuga

SEQ ID NO: 270991 - RNA, 22 nt, Human
cauuugucaucacugagcugcc

SEQ ID NO: 270992 - RNA, 20 nt, Human
gcuugcccacaucugcacug

SEQ ID NO: 270993 - RNA, 22 nt, Human
uagguauaauauuuugaagaaa

SEQ ID NO: 270994 - RNA, 22 nt, Human
ggucagugacuuuuuucugugg

SEQ ID NO: 270995 - RNA, 22 nt, Human
agugggaauuucagugcuaaaa

SEQ ID NO: 270996 - RNA, 22 nt, Human
ugaaagcagugccaugauuaug

SEQ ID NO: 270997 - RNA, 22 nt, Human
aguuguaagaggcacaaggaag

SEQ ID NO: 270998 - RNA, 22 nt, Human
agcaggcaggaaggcagcacug

SEQ ID NO: 270999 - RNA, 22 nt, Human
cacaggcuuccaguccccagcu

SEQ ID NO: 271000 - RNA, 22 nt, Human
uuuuuagaauuggcugagaauu

SEQ ID NO: 271001 - RNA, 22 nt, Human
uagugcaggguuuuaagcacug

SEQ ID NO: 271002 - RNA, 17 nt, Human
gaccaggagaaaccagg

SEQ ID NO: 271003 - RNA, 18 nt, Human
ugcugggguagaauccac

SEQ ID NO: 271004 - RNA, 22 nt, Human
caggaagucgcagagcuggggg

SEQ ID NO: 271005 - RNA, 22 nt, Human
uggaggaaguugcuggaaguca

SEQ ID NO: 271006 - RNA, 22 nt, Human
cucagagaaaugucacaacaau

SEQ ID NO: 271007 - RNA, 22 nt, Human
ggucuccugaggcugccacacc

SEQ ID NO: 271008 - RNA, 22 nt, Human
gaauauuuuuaaagggacuaau

SEQ ID NO: 271009 - RNA, 22 nt, Human
gccagaucugacauaguggaag

SEQ ID NO: 271010 - RNA, 22 nt, Human
auuugcugagcucaaagaaaag

SEQ ID NO: 271011 - RNA, 22 nt, Human
ugguggacaccgcagccaugaa

SEQ ID NO: 271012 - RNA, 22 nt, Human
cacagcugugagaagggagccu

SEQ ID NO: 271013 - RNA, 22 nt, Human
gggcugagucugcugccuguca

SEQ ID NO: 271014 - RNA, 22 nt, Human
agaaaugaaaccaaagccuaga

SEQ ID NO: 271015 - RNA, 20 nt, Human
gcaaggcacagugaggaggg

SEQ ID NO: 271016 - RNA, 22 nt, Human
caggcccacugcuugucuaguc

SEQ ID NO: 271017 - RNA, 22 nt, Human
cuggugcuguagccugauugag

SEQ ID NO: 271018 - RNA, 22 nt, Human
gaaaguuauucagccucucuga

SEQ ID NO: 271019 - RNA, 22 nt, Human
gacaguaacugagagauguaau

SEQ ID NO: 271020 - RNA, 22 nt, Human
guacaauagcaguuuucccuuu

SEQ ID NO: 271021 - RNA, 22 nt, Human
agaaggcacucacacuggcacg

SEQ ID NO: 271022 - RNA, 21 nt, Human
cuggaucugucaucgaguuuu

SEQ ID NO: 271023 - RNA, 22 nt, Human
agaguggggaagguguugagaa

SEQ ID NO: 271024 - RNA, 22 nt, Human
ccugccuggagcugagugugga

SEQ ID NO: 271025 - RNA, 22 nt, Human
ugcagggcuauaacuccauucu

SEQ ID NO: 271026 - RNA, 22 nt, Human
uguccuuuuggcugucuauggu

SEQ ID NO: 271027 - RNA, 22 nt, Human
augcagaaagcggcaaacaggu

SEQ ID NO: 271028 - RNA, 22 nt, Human
aucuccagcagugcuuuugagc

SEQ ID NO: 271029 - RNA, 22 nt, Human
uuucacaaguuucaggauucug

SEQ ID NO: 271030 - RNA, 22 nt, Human
uuccuggcuuuugggcuaauuc

SEQ ID NO: 271031 - RNA, 22 nt, Human
uuguagauggcuuauuucugug

SEQ ID NO: 271032 - RNA, 22 nt, Human
gggcacagccuaacuauggaga

SEQ ID NO: 271033 - RNA, 23 nt, Human
agcuucauugaccuccgcagggg

SEQ ID NO: 271034 - RNA, 22 nt, Human
uucugucauccuuucuagaugu

SEQ ID NO: 271035 - RNA, 23 nt, Human
cuggccaccaucuuucuggcuuc

SEQ ID NO: 271036 - RNA, 22 nt, Human
uaguuacagcaggcaggauaua

SEQ ID NO: 271037 - RNA, 22 nt, Human
aggcaaagcgauaccagagcua

SEQ ID NO: 271038 - RNA, 22 nt, Human
aaggccagacucuggaaugaca

SEQ ID NO: 271039 - RNA, 19 nt, Human
gauuuaaacguggcucuau

SEQ ID NO: 271040 - RNA, 22 nt, Human
agagcaucuaacacauaagccu

SEQ ID NO: 271041 - RNA, 22 nt, Human
auggaaauaucuuuagagcuua

SEQ ID NO: 271042 - RNA, 19 nt, Human
uaaaaugucuguggucagu

SEQ ID NO: 271043 - RNA, 22 nt, Human
gcugggaagagaugcacaugau

SEQ ID NO: 271044 - RNA, 21 nt, Human
cacaggcuucuauacacaaug

SEQ ID NO: 271045 - RNA, 22 nt, Human
uuauucacucugaagccauccu

SEQ ID NO: 271046 - RNA, 22 nt, Human
ucagggcuccggaaguggccuc

SEQ ID NO: 271047 - RNA, 22 nt, Human
acaaaguuugugguauuccaag

SEQ ID NO: 271048 - RNA, 19 nt, Human
caggcccuggacccaucug

SEQ ID NO: 271049 - RNA, 22 nt, Human
ucagcuuucucaaagaagcugg

SEQ ID NO: 271050 - RNA, 22 nt, Human
acuggcagccacaacuggcagg

SEQ ID NO: 271051 - RNA, 21 nt, Human
uugaaggaucacuucuguacc

SEQ ID NO: 271052 - RNA, 22 nt, Human
cagcaagaacagccugaugugc

SEQ ID NO: 271053 - RNA, 22 nt, Human
ugguuauaaaaguccucucauu

SEQ ID NO: 271054 - RNA, 22 nt, Human
ggccucucuccagucagugcag

SEQ ID NO: 271055 - RNA, 21 nt, Human
ugagcaggagucaugggaaug

SEQ ID NO: 271056 - RNA, 22 nt, Human
auuuacagugugccuacuauau

SEQ ID NO: 271057 - RNA, 20 nt, Human
agacagaaucagagauaaag

SEQ ID NO: 271058 - RNA, 19 nt, Human
gggagcugucugcccgugg

SEQ ID NO: 271059 - RNA, 22 nt, Human
acaaugcaccuauuuuaaaacu

SEQ ID NO: 271060 - RNA, 17 nt, Human
ggcugcaguccaggagg

SEQ ID NO: 271061 - RNA, 22 nt, Human
caguggcuucuuccuagagcca

SEQ ID NO: 271062 - RNA, 22 nt, Human
uuagcuuuucacuugcauuauc

SEQ ID NO: 271063 - RNA, 22 nt, Human
cauguguccacccuugaacaca

SEQ ID NO: 271064 - RNA, 22 nt, Human
ucauuuguucaucugcucuucu

SEQ ID NO: 271065 - RNA, 22 nt, Human
aguccacugccccagcuccucg

SEQ ID NO: 271066 - RNA, 22 nt, Human
agcuccagaggcagugaugaag

SEQ ID NO: 271067 - RNA, 20 nt, Human
caugccaugucuacugaggc

SEQ ID NO: 271068 - RNA, 22 nt, Human
gggcagcagaauuggacagaaa

SEQ ID NO: 271069 - RNA, 22 nt, Human
agaauuguaagcaauuugauua

SEQ ID NO: 271070 - RNA, 22 nt, Human
acugggcuaccccaccauuacc

SEQ ID NO: 271071 - RNA, 22 nt, Human
uuccagauguuuaaguucugcu

SEQ ID NO: 271072 - RNA, 22 nt, Human
ccugaguguaauaaugaaggca

SEQ ID NO: 271073 - RNA, 22 nt, Human
ucagagacaccagagagcugug

SEQ ID NO: 271074 - RNA, 22 nt, Human
aaaggcuuuugguauauaggag

SEQ ID NO: 271075 - RNA, 22 nt, Human
cacacaaauauucuggaggcaa

SEQ ID NO: 271076 - RNA, 17 nt, Human
acaggccugcuugcacu

SEQ ID NO: 271077 - RNA, 22 nt, Human
ccauguuguaucucuuaucggc

SEQ ID NO: 271078 - RNA, 22 nt, Human
ucaggucugaugccucauccau

SEQ ID NO: 271079 - RNA, 22 nt, Human
ucagucuuucgaauucagccag

SEQ ID NO: 271080 - RNA, 22 nt, Human
ggcacagagcaggccacuaauc

SEQ ID NO: 271081 - RNA, 22 nt, Human
cucagucucuugggcugugaag

SEQ ID NO: 271082 - RNA, 22 nt, Human
cuuuggaggaccuaugugcaau

SEQ ID NO: 271083 - RNA, 22 nt, Human
cuuccagguccuucuugagaag

SEQ ID NO: 271084 - RNA, 22 nt, Human
cuuagacauggcagcuccaagu

SEQ ID NO: 271085 - RNA, 19 nt, Human
gcagccaggugcucuaccu

SEQ ID NO: 271086 - RNA, 22 nt, Human
cagaagccugccucagaugcac

SEQ ID NO: 271087 - RNA, 22 nt, Human
ucacacagcuaguaagggccga

SEQ ID NO: 271088 - RNA, 22 nt, Human
guuggcuauagggagauggggc

SEQ ID NO: 271089 - RNA, 22 nt, Human
gaggccagcuaguccaggaagu

SEQ ID NO: 271090 - RNA, 18 nt, Human
gcagccccucuuccuucc

SEQ ID NO: 271091 - RNA, 22 nt, Human
uuuacucuugcuacacaacugu

SEQ ID NO: 271092 - RNA, 22 nt, Human
gggucgagggucucgcccuucc

SEQ ID NO: 271093 - RNA, 22 nt, Human
ugaccuauuagauuuccuugcc

SEQ ID NO: 271094 - RNA, 23 nt, Human
uggcauagugaggggcacagaga

SEQ ID NO: 271095 - RNA, 22 nt, Human
agcugcuguggggcucggccug

SEQ ID NO: 271096 - RNA, 22 nt, Human
augucuuucuaguuaagagcua

SEQ ID NO: 271097 - RNA, 22 nt, Human
aagcauuuuagauaaagcauca

SEQ ID NO: 271098 - RNA, 22 nt, Human
gucuguagucacacaggugaca

SEQ ID NO: 271099 - RNA, 22 nt, Human
gcaggucuaucaggcugcaggu

SEQ ID NO: 271100 - RNA, 22 nt, Human
gaugaggaaugcucagcucaau

SEQ ID NO: 271101 - RNA, 22 nt, Human
ggguaggcagugcguccugccu

SEQ ID NO: 271102 - RNA, 22 nt, Human
cuguacaggucaaugauaagau

SEQ ID NO: 271103 - RNA, 22 nt, Human
uuuaguaaguucacugcaaagc

SEQ ID NO: 271104 - RNA, 22 nt, Human
auaggcagacucuuuuuggagg

SEQ ID NO: 271105 - RNA, 22 nt, Human
gugucauuacugaaagauugaa

SEQ ID NO: 271106 - RNA, 22 nt, Human
gaggccacaguccugaggcauc

SEQ ID NO: 271107 - RNA, 22 nt, Human
auuagagcaguaauuguggcag

SEQ ID NO: 271108 - RNA, 22 nt, Human
caggacuggaagucucaagaga

SEQ ID NO: 271109 - RNA, 22 nt, Human
ccucugcagcagagagccagag

SEQ ID NO: 271110 - RNA, 22 nt, Human
uucaacaacuugguucaaaugg

SEQ ID NO: 271111 - RNA, 22 nt, Human
aggcagagaaaaaccagauaug

SEQ ID NO: 271112 - RNA, 22 nt, Human
augugugccccuuuuacucuuu

SEQ ID NO: 271113 - RNA, 22 nt, Human
acauuccaaaaacuagcagaua

SEQ ID NO: 271114 - RNA, 22 nt, Human
ucccaggccacacuuggggaac

SEQ ID NO: 271115 - RNA, 22 nt, Human
augagcugggccauccagugau

SEQ ID NO: 271116 - RNA, 22 nt, Human
aaugcuaacauugguuuauauc

SEQ ID NO: 271117 - RNA, 22 nt, Human
cuuauaguaugauguugagaau

SEQ ID NO: 271118 - RNA, 22 nt, Human
ggcuucccuaaaccuuuccacu

SEQ ID NO: 271119 - RNA, 22 nt, Human
ugcuuuauggagcccaucucau

SEQ ID NO: 271120 - RNA, 22 nt, Human
ucacagcauugucacaaggcug

SEQ ID NO: 271121 - RNA, 21 nt, Human
guggcucugccaggacugaaa

SEQ ID NO: 271122 - RNA, 22 nt, Human
augcacuuuguaaucuguucaa

SEQ ID NO: 271123 - RNA, 22 nt, Human
acaagguacaaaacagagcaca

SEQ ID NO: 271124 - RNA, 22 nt, Human
cuauauuucuuggcuuuaaaca

SEQ ID NO: 271125 - RNA, 23 nt, Human
ucucagacccgaagccagaggaa

SEQ ID NO: 271126 - RNA, 22 nt, Human
uuucacaaagcauagcacuuua

SEQ ID NO: 271127 - RNA, 22 nt, Human
uggacauguccggccagacaau

SEQ ID NO: 271128 - RNA, 22 nt, Human
acuaggaaggcauaugggcaga

SEQ ID NO: 271129 - RNA, 20 nt, Human
caggccagagguuugauggc

SEQ ID NO: 271130 - RNA, 22 nt, Human
augcaaacauucgcuugucucu

SEQ ID NO: 271131 - RNA, 22 nt, Human
agugauuugacucuuuuauugu

SEQ ID NO: 271132 - RNA, 22 nt, Human
aaagcagcaaauacuuuugcac

SEQ ID NO: 271133 - RNA, 22 nt, Human
agauggucuucauaaguuuuaa

SEQ ID NO: 271134 - RNA, 22 nt, Human
uugggcugaaguagagggcaga

SEQ ID NO: 271135 - RNA, 22 nt, Human
acuuuguuccuuucacaaagaa

SEQ ID NO: 271136 - RNA, 22 nt, Human
ggcugccuacuuucccagaguu

SEQ ID NO: 271137 - RNA, 22 nt, Human
uaagaacagauaaaguuucccc

SEQ ID NO: 271138 - RNA, 22 nt, Human
gcagugcaggaacauagcuucu

SEQ ID NO: 271139 - RNA, 22 nt, Human
agcagcagaucaaacaggcuug

SEQ ID NO: 271140 - RNA, 22 nt, Human
auacaaaauauauacuggagac

SEQ ID NO: 271141 - RNA, 22 nt, Human
gcacagcccuggucggggcccc

SEQ ID NO: 271142 - RNA, 23 nt, Human
uggcuacuuuaugagguugagga

SEQ ID NO: 271143 - RNA, 20 nt, Human
cuccugguccaggagccuga

SEQ ID NO: 271144 - RNA, 22 nt, Human
aggagguggcaacugucgacag

SEQ ID NO: 271145 - RNA, 22 nt, Human
acagguagugggcuagaucugg

SEQ ID NO: 271146 - RNA, 22 nt, Human
aggcuggcggugacugcucuga

SEQ ID NO: 271147 - RNA, 21 nt, Human
cugucaccugcucagagaggg

SEQ ID NO: 271148 - RNA, 22 nt, Human
augcagaauugcuaaguaucug

SEQ ID NO: 271149 - RNA, 22 nt, Human
uauuaggguuuugaagguuugu

SEQ ID NO: 271150 - RNA, 22 nt, Human
cuccuggcucgcccccagcuga

SEQ ID NO: 271151 - RNA, 22 nt, Human
gguggcacucauuaucaggugc

SEQ ID NO: 271152 - RNA, 17 nt, Human
uccaggcagcaacugag

SEQ ID NO: 271153 - RNA, 22 nt, Human
ucucaggcuuccuggugcugug

SEQ ID NO: 271154 - RNA, 22 nt, Human
cugaagcacagcauauaaauaa

SEQ ID NO: 271155 - RNA, 22 nt, Human
gcuuuuccugacuuuccauuag

SEQ ID NO: 271156 - RNA, 22 nt, Human
cacagguuagguauuauacuau

SEQ ID NO: 271157 - RNA, 18 nt, Human
uaauccauaugcuuugcc

SEQ ID NO: 271158 - RNA, 22 nt, Human
aagcuggcaugucaccugagaa

SEQ ID NO: 271159 - RNA, 22 nt, Human
gcuaaugacugaguuuuuagca

SEQ ID NO: 271160 - RNA, 22 nt, Human
ugacauaauaauccaaacauac

SEQ ID NO: 271161 - RNA, 22 nt, Human
ccaggcaguggaagcuaaaauu

SEQ ID NO: 271162 - RNA, 20 nt, Human
guauuagguguuccucuuuc

SEQ ID NO: 271163 - RNA, 22 nt, Human
uaauagaaagguauuuuuugca

SEQ ID NO: 271164 - RNA, 22 nt, Human
ggcuccugcuguccuuugaagc

SEQ ID NO: 271165 - RNA, 22 nt, Human
auauuacuuccugguauaaaau

SEQ ID NO: 271166 - RNA, 22 nt, Human
gagggaugucaggggaccuugg

SEQ ID NO: 271167 - RNA, 22 nt, Human
caggccugugaguugaggcccc

SEQ ID NO: 271168 - RNA, 22 nt, Human
cagggcugaggacacaaguaaa

SEQ ID NO: 271169 - RNA, 22 nt, Human
aagugauacaucuagucuauaa

SEQ ID NO: 271170 - RNA, 22 nt, Human
ggaaacagcaaauuauggcaau

SEQ ID NO: 271171 - RNA, 22 nt, Human
agaagcuuccuacauuguucuu

SEQ ID NO: 271172 - RNA, 22 nt, Human
aagcugucaauguaucuagucu

SEQ ID NO: 271173 - RNA, 18 nt, Human
cacaauuuacagaugaca

SEQ ID NO: 271174 - RNA, 20 nt, Human
gcugggcuuugacugacaca

SEQ ID NO: 271175 - RNA, 22 nt, Human
agaaggcaucagaaguguguag

SEQ ID NO: 271176 - RNA, 22 nt, Human
acacuuuacucuuacaccauug

SEQ ID NO: 271177 - RNA, 22 nt, Human
ucccucucccuauugccuggag

SEQ ID NO: 271178 - RNA, 22 nt, Human
ggugagagucuuguggucccag

SEQ ID NO: 271179 - RNA, 22 nt, Human
gcaggcaccggguugcuccccu

SEQ ID NO: 271180 - RNA, 22 nt, Human
aggcucaguauagcuggcaagu

SEQ ID NO: 271181 - RNA, 22 nt, Human
ccagccaggcuggcuguggagg

SEQ ID NO: 271182 - RNA, 22 nt, Human
ucugaaauaaaugcacuguuag

SEQ ID NO: 271183 - RNA, 22 nt, Human
aucucugguuguuuugcuccca

SEQ ID NO: 271184 - RNA, 22 nt, Human
uuguuuugcuaaagggucauca

SEQ ID NO: 271185 - RNA, 22 nt, Human
uuuaucuguuguaccugcauug

SEQ ID NO: 271186 - RNA, 22 nt, Human
ucuucuguauuguuaacucagg

SEQ ID NO: 271187 - RNA, 22 nt, Human
cacagcugaccacccugcuccc

SEQ ID NO: 271188 - RNA, 22 nt, Human
gaacuauaugucuuaaagcuuu

SEQ ID NO: 271189 - RNA, 22 nt, Human
ugcacccucaucagucaaaugg

SEQ ID NO: 271190 - RNA, 22 nt, Human
auaaacugaagggaacacugag

SEQ ID NO: 271191 - RNA, 22 nt, Human
ucugccaggcuuggugcuagau

SEQ ID NO: 271192 - RNA, 23 nt, Human
aauuaaauugcuagauccagggc

SEQ ID NO: 271193 - RNA, 22 nt, Human
aauccacacaucuggcauguga

SEQ ID NO: 271194 - RNA, 22 nt, Human
gccuggccugaacuaggaggug

SEQ ID NO: 271195 - RNA, 22 nt, Human
gggcaggugccagcucccuguc

SEQ ID NO: 271196 - RNA, 22 nt, Human
uguguaaaaucugauuaauacu

SEQ ID NO: 271197 - RNA, 22 nt, Human
auggggaagcaauuggauuucc

SEQ ID NO: 271198 - RNA, 22 nt, Human
ccugagagugcgugccuccuua

SEQ ID NO: 271199 - RNA, 22 nt, Human
uuuaaugugacaucuuuuagag

SEQ ID NO: 271200 - RNA, 22 nt, Human
ccucugggccagccuggacccu

SEQ ID NO: 271201 - RNA, 22 nt, Human
ccuggaaaacaugggaaucaca

SEQ ID NO: 271202 - RNA, 22 nt, Human
ugaaauguagauuaggcauucu

SEQ ID NO: 271203 - RNA, 22 nt, Human
aaaagaggagugguuuaugaca

SEQ ID NO: 271204 - RNA, 22 nt, Human
uucaauuuagugauguuguugg

SEQ ID NO: 271205 - RNA, 20 nt, Human
guccugggagccacagcaca

SEQ ID NO: 271206 - RNA, 22 nt, Human
cucuuagagaguuguugaucag

SEQ ID NO: 271207 - RNA, 22 nt, Human
acugccuuuuccauuacuuaau

SEQ ID NO: 271208 - RNA, 22 nt, Human
ucuccuguaugggacuggcgag

SEQ ID NO: 271209 - RNA, 22 nt, Human
ugagcauuggaucaaaugacuu

SEQ ID NO: 271210 - RNA, 18 nt, Human
gcugcaggcccuccgagg

SEQ ID NO: 271211 - RNA, 22 nt, Human
ucucugagcaccuaagauauau

SEQ ID NO: 271212 - RNA, 22 nt, Human
uucagucuuguugaaaacuugg

SEQ ID NO: 271213 - RNA, 22 nt, Human
ggcagcucaccucugguccagg

SEQ ID NO: 271214 - RNA, 22 nt, Human
acagaugguagcauuauguugg

SEQ ID NO: 271215 - RNA, 23 nt, Human
caugcaaacacuauugcauuugg

SEQ ID NO: 271216 - RNA, 22 nt, Human
acacagauaaugcucauauagg

SEQ ID NO: 271217 - RNA, 22 nt, Human
cagaauaugacaagauuuuccu

SEQ ID NO: 271218 - RNA, 22 nt, Human
cagagcacccaaggagcauuug

SEQ ID NO: 271219 - RNA, 22 nt, Human
uccaggagcucauccacgucaa

SEQ ID NO: 271220 - RNA, 22 nt, Human
auggcccaggccaggauccagc

SEQ ID NO: 271221 - RNA, 22 nt, Human
cugaggaaagcugcagcgguac

SEQ ID NO: 271222 - RNA, 22 nt, Human
augcuuccaaggcuaagacaag

SEQ ID NO: 271223 - RNA, 22 nt, Human
uaagacacaugcguacaagaua

SEQ ID NO: 271224 - RNA, 22 nt, Human
ucauccaguucacauggugagu

SEQ ID NO: 271225 - RNA, 22 nt, Human
ucugaagaacugucuagagaac

SEQ ID NO: 271226 - RNA, 22 nt, Human
uccucagagcagcccuccgcau

SEQ ID NO: 271227 - RNA, 22 nt, Human
cccuugagccuggaggagcucu

SEQ ID NO: 271228 - RNA, 22 nt, Human
ucccagcagaugagcugaccua

SEQ ID NO: 271229 - RNA, 22 nt, Human
agccuuagauuugggcaagaac

SEQ ID NO: 271230 - RNA, 22 nt, Human
aaauuagaccagggcuccugga

SEQ ID NO: 271231 - RNA, 22 nt, Human
auugcugaacuuauaaaugaau

SEQ ID NO: 271232 - RNA, 22 nt, Human
cauucauucacauuuugucuau

SEQ ID NO: 271233 - RNA, 22 nt, Human
aaugaaaauuggacccuagaac

SEQ ID NO: 271234 - RNA, 18 nt, Human
cacaggagaugaccugac

SEQ ID NO: 271235 - RNA, 22 nt, Human
uuucauguuaguugguucuugg

SEQ ID NO: 271236 - RNA, 22 nt, Human
cccaggguggaugcaagcagca

SEQ ID NO: 271237 - RNA, 22 nt, Human
cagcuccuauuagacacugaau

SEQ ID NO: 271238 - RNA, 22 nt, Human
gcccucaggacaagguuacgcu

SEQ ID NO: 271239 - RNA, 23 nt, Human
uucuuuguggauaaucuccagug

SEQ ID NO: 271240 - RNA, 22 nt, Human
cuggcuuuuggaggagggucag

SEQ ID NO: 271241 - RNA, 23 nt, Human
aaagacucuccagagggaaguag

SEQ ID NO: 271242 - RNA, 22 nt, Human
caggagugaguuggggucuaca

SEQ ID NO: 271243 - RNA, 20 nt, Human
uuauaucauaaugugccaau

SEQ ID NO: 271244 - RNA, 21 nt, Human
ggcugcagggagcccuggggu

SEQ ID NO: 271245 - RNA, 22 nt, Human
aggagagagcugagcuuugcug

SEQ ID NO: 271246 - RNA, 22 nt, Human
ccaggaagguaugggaagaaaa

SEQ ID NO: 271247 - RNA, 21 nt, Human
uuacaaagcaagugcuguguc

SEQ ID NO: 271248 - RNA, 22 nt, Human
acgguaacagauaccacagacu

SEQ ID NO: 271249 - RNA, 22 nt, Human
auucauguucggggccacguug

SEQ ID NO: 271250 - RNA, 22 nt, Human
auagggcaguggcaucucuuaa

SEQ ID NO: 271251 - RNA, 22 nt, Human
cuccuuccaacaagagaaagag

SEQ ID NO: 271252 - RNA, 22 nt, Human
aggucaagauucuacauuugua

SEQ ID NO: 271253 - RNA, 22 nt, Human
cagaagcaaaugccuugcugag

SEQ ID NO: 271254 - RNA, 21 nt, Human
cuuauucacuguuauuuauca

SEQ ID NO: 271255 - RNA, 22 nt, Human
auguucuuugaaauauuuuaga

SEQ ID NO: 271256 - RNA, 22 nt, Human
aaguacaugcuguaaugauugg

SEQ ID NO: 271257 - RNA, 22 nt, Human
ccugcccuagagaugacacaau

SEQ ID NO: 271258 - RNA, 22 nt, Human
aguaagugagucacugugcugg

SEQ ID NO: 271259 - RNA, 22 nt, Human
aaauauaguaaaugcauaguuc

SEQ ID NO: 271260 - RNA, 22 nt, Human
agggcuccugaggcccuucugg

SEQ ID NO: 271261 - RNA, 22 nt, Human
cacacauuagagccaaugucag

SEQ ID NO: 271262 - RNA, 22 nt, Human
uggcagugaugcuuaugguuug

SEQ ID NO: 271263 - RNA, 22 nt, Human
uguuuauugagugccuacuaua

SEQ ID NO: 271264 - RNA, 22 nt, Human
cugucuguuuuguauacaggcc

SEQ ID NO: 271265 - RNA, 22 nt, Human
caagcugcuauagguugcuggg

SEQ ID NO: 271266 - RNA, 22 nt, Human
uucuguacucuuugagaagaau

SEQ ID NO: 271267 - RNA, 22 nt, Human
agaaggcuccaaguagaguuug

SEQ ID NO: 271268 - RNA, 22 nt, Human
ucauggauuaaauuauuaaguu

SEQ ID NO: 271269 - RNA, 22 nt, Human
gccuccccugcaauuguccuug

SEQ ID NO: 271270 - RNA, 22 nt, Human
cccaugagaccugguuuaaggc

SEQ ID NO: 271271 - RNA, 22 nt, Human
uuguuucugaguuuucauguau

SEQ ID NO: 271272 - RNA, 22 nt, Human
aguguccugugucccagacugu

SEQ ID NO: 271273 - RNA, 21 nt, Human
uagaaaucagcuggugccucu

SEQ ID NO: 271274 - RNA, 22 nt, Human
auuuuagagcuccaaguacagc

SEQ ID NO: 271275 - RNA, 22 nt, Human
ugguccugcccacgcccaucug

SEQ ID NO: 271276 - RNA, 22 nt, Human
cagcaccuguuagcauuaaaua

SEQ ID NO: 271277 - RNA, 22 nt, Human
uccagcaguccaugugagacac

SEQ ID NO: 271278 - RNA, 22 nt, Human
aaggcacagaggcagggcacuu

SEQ ID NO: 271279 - RNA, 22 nt, Human
cagugugcugcagagaacauuu

SEQ ID NO: 271280 - RNA, 22 nt, Human
auagaaacagaggucaggcauu

SEQ ID NO: 271281 - RNA, 22 nt, Human
uggcuucuccagaaaucuuggu

SEQ ID NO: 271282 - RNA, 22 nt, Human
cuuuagaaaucuggauguauuu

SEQ ID NO: 271283 - RNA, 22 nt, Human
uccuccugccuuugcuucuugu

SEQ ID NO: 271284 - RNA, 22 nt, Human
agaauuacagcuuuuagaauag

SEQ ID NO: 271285 - RNA, 22 nt, Human
ugguacaauggcaucuaucuau

SEQ ID NO: 271286 - RNA, 22 nt, Human
ucuguccauucagaauggcccu

SEQ ID NO: 271287 - RNA, 21 nt, Human
cacacagugaucuauccacau

SEQ ID NO: 271288 - RNA, 22 nt, Human
augaaacaugcuuuguggauga

SEQ ID NO: 271289 - RNA, 20 nt, Human
gggugggagagucugagggu

SEQ ID NO: 271290 - RNA, 22 nt, Human
aagggcucuguugccauuucag

SEQ ID NO: 271291 - RNA, 22 nt, Human
gaauacauggcagggagucauc

SEQ ID NO: 271292 - RNA, 22 nt, Human
cugacugugagagcaggaaugg

SEQ ID NO: 271293 - RNA, 22 nt, Human
gcaggugucuucagcaggauga

SEQ ID NO: 271294 - RNA, 22 nt, Human
ccugggcuuugcuggcaaggcc

SEQ ID NO: 271295 - RNA, 22 nt, Human
agcauccugccucuccucccaa

SEQ ID NO: 271296 - RNA, 22 nt, Human
aacuguuuggaacucuuccaca

SEQ ID NO: 271297 - RNA, 22 nt, Human
uuucacauaaauauuaugccua

SEQ ID NO: 271298 - RNA, 22 nt, Human
uacagaggggacauggaagaca

SEQ ID NO: 271299 - RNA, 22 nt, Human
cuggccucagagggucauggug

SEQ ID NO: 271300 - RNA, 22 nt, Human
ggaagcugaggcccagugaagg

SEQ ID NO: 271301 - RNA, 22 nt, Human
ccugugcccuggaaggagagag

SEQ ID NO: 271302 - RNA, 22 nt, Human
uuuuggcuccagugguuugugc

SEQ ID NO: 271303 - RNA, 22 nt, Human
aggaaacauugauauugggaaa

SEQ ID NO: 271304 - RNA, 22 nt, Human
cucccugggcagauguggcucu

SEQ ID NO: 271305 - RNA, 22 nt, Human
aguguggguuuuauggagcccu

SEQ ID NO: 271306 - RNA, 22 nt, Human
agacacagauuuuggaaaagau

SEQ ID NO: 271307 - RNA, 22 nt, Human
uggccagcccucuucccacacu

SEQ ID NO: 271308 - RNA, 22 nt, Human
cuggccaagcuucucuaagcag

SEQ ID NO: 271309 - RNA, 22 nt, Human
cagucaaacuuauaggcacauu

SEQ ID NO: 271310 - RNA, 20 nt, Human
ucaaguuuugcuugacaaga

SEQ ID NO: 271311 - RNA, 22 nt, Human
cagcagcugggaaggaggcuga

SEQ ID NO: 271312 - RNA, 22 nt, Human
cuuguauuccccuaucucuaaa

SEQ ID NO: 271313 - RNA, 22 nt, Human
ccuuccucauccauuucucuug

SEQ ID NO: 271314 - RNA, 22 nt, Human
aacacuuucuauuauuaugguu

SEQ ID NO: 271315 - RNA, 22 nt, Human
gugaggugccuaauaccgugac

SEQ ID NO: 271316 - RNA, 22 nt, Human
uggcaguugugagguucauauu

SEQ ID NO: 271317 - RNA, 22 nt, Human
auuauucaacacuugagaaauu

SEQ ID NO: 271318 - RNA, 21 nt, Human
ucucugugguccaaucccagc

SEQ ID NO: 271319 - RNA, 22 nt, Human
agggccugucagcgguguccug

SEQ ID NO: 271320 - RNA, 22 nt, Human
uaagcaaugcuguaguucaguc

SEQ ID NO: 271321 - RNA, 22 nt, Human
ugacccuuagugaacauuagaa

SEQ ID NO: 271322 - RNA, 22 nt, Human
cuggggcauugggagaggccug

SEQ ID NO: 271323 - RNA, 20 nt, Human
ugcuggaggcgccggcgcuc

SEQ ID NO: 271324 - RNA, 22 nt, Human
gaugugucuccguuucaaggca

SEQ ID NO: 271325 - RNA, 22 nt, Human
cuucugagcagaccuccugggg

SEQ ID NO: 271326 - RNA, 21 nt, Human
acagaaguggcuuggucucag

SEQ ID NO: 271327 - RNA, 22 nt, Human
cugggccugucagggcuuuuug

SEQ ID NO: 271328 - RNA, 22 nt, Human
ugcgcccagccaagucuggcac

SEQ ID NO: 271329 - RNA, 22 nt, Human
ugagcuacacacuaggcauggg

SEQ ID NO: 271330 - RNA, 22 nt, Human
aguggcagacacaaugugggca

SEQ ID NO: 271331 - RNA, 22 nt, Human
cucuccccacacccucugcaug

SEQ ID NO: 271332 - RNA, 22 nt, Human
ucaucacauaugucaugauuug

SEQ ID NO: 271333 - RNA, 22 nt, Human
gcugaaaucccagcauucccca

SEQ ID NO: 271334 - RNA, 22 nt, Human
uaagacacaaauaucuuuuaca

SEQ ID NO: 271335 - RNA, 22 nt, Human
gcugauguuuaguugauguuac

SEQ ID NO: 271336 - RNA, 22 nt, Human
uugcacuaggaaaaggcagcca

SEQ ID NO: 271337 - RNA, 22 nt, Human
caggccuggggcuggcuuccag

SEQ ID NO: 271338 - RNA, 22 nt, Human
acacacagguaaaggagccugg

SEQ ID NO: 271339 - RNA, 22 nt, Human
ugcaaaguugcaucaaaaccca

SEQ ID NO: 271340 - RNA, 22 nt, Human
gcaaauagaagauucuguugac

SEQ ID NO: 271341 - RNA, 21 nt, Human
caucuuagguuguacauauau

SEQ ID NO: 271342 - RNA, 22 nt, Human
ugcccagcaauaaaccagaaga

SEQ ID NO: 271343 - RNA, 22 nt, Human
cgguccuggcacuugcggcucc

SEQ ID NO: 271344 - RNA, 22 nt, Human
guuaaugucacuuuauguggcu

SEQ ID NO: 271345 - RNA, 22 nt, Human
cuguggcugaguuccuuauguu

SEQ ID NO: 271346 - RNA, 22 nt, Human
uggcucugaccagguagaggag

SEQ ID NO: 271347 - RNA, 22 nt, Human
uccaggccccagcaccuuggga

SEQ ID NO: 271348 - RNA, 21 nt, Human
cauuagggcagaagcaggaag

SEQ ID NO: 271349 - RNA, 22 nt, Human
ugguucauagccucacaggaua

SEQ ID NO: 271350 - RNA, 22 nt, Human
aauaagaacuugucucuggcag

SEQ ID NO: 271351 - RNA, 21 nt, Human
uugcugcccucccuuuccuca

SEQ ID NO: 271352 - RNA, 22 nt, Human
gcugggccuuccgauucucaag

SEQ ID NO: 271353 - RNA, 22 nt, Human
acacauguuuccaaaagcaccc

SEQ ID NO: 271354 - RNA, 22 nt, Human
ccugccugauuccaggauggcu

SEQ ID NO: 271355 - RNA, 22 nt, Human
gccuguauuuauugagagugua

SEQ ID NO: 271356 - RNA, 22 nt, Human
uccugucuuaaugaucucgugc

SEQ ID NO: 271357 - RNA, 22 nt, Human
uuggaauccugccucugcuacu

SEQ ID NO: 271358 - RNA, 22 nt, Human
caaguuuugauuuugcaguaaa

SEQ ID NO: 271359 - RNA, 22 nt, Human
cugggccuugccaggggugucu

SEQ ID NO: 271360 - RNA, 22 nt, Human
ccugccagggccuuggaagaaa

SEQ ID NO: 271361 - RNA, 22 nt, Human
aacuucugccaaacagcuguua

SEQ ID NO: 271362 - RNA, 22 nt, Human
uuacaaggaggauagcauuucc

SEQ ID NO: 271363 - RNA, 22 nt, Human
ugacaggucauauaagcuugca

SEQ ID NO: 271364 - RNA, 22 nt, Human
uugguggaccucaucagaaccg

SEQ ID NO: 271365 - RNA, 22 nt, Human
auuuugaaaagcauuugaguaa

SEQ ID NO: 271366 - RNA, 23 nt, Human
agggucugcucagugucguucaa

SEQ ID NO: 271367 - RNA, 22 nt, Human
aaguugaaucaguaacacaguu

SEQ ID NO: 271368 - RNA, 22 nt, Human
gccuuuaucuugggccaaguuu

SEQ ID NO: 271369 - RNA, 22 nt, Human
gcuccuggcuucacugacauca

SEQ ID NO: 271370 - RNA, 22 nt, Human
uuguauuucuuccggucucauu

SEQ ID NO: 271371 - RNA, 22 nt, Human
acuaaguaguuucacauauaau

SEQ ID NO: 271372 - RNA, 22 nt, Human
gagagaagaaagccaugguccu

SEQ ID NO: 271373 - RNA, 22 nt, Human
caguuauaagacuaagcuauuc

SEQ ID NO: 271374 - RNA, 22 nt, Human
uacagacaaagagcaugcggua

SEQ ID NO: 271375 - RNA, 22 nt, Human
ggucuccagcugggacccugca

SEQ ID NO: 271376 - RNA, 20 nt, Human
uauucaacuuuaaaaacuua

SEQ ID NO: 271377 - RNA, 22 nt, Human
agccuagaagaaguggcuacuu

SEQ ID NO: 271378 - RNA, 22 nt, Human
agaaaugacacacaugagacau

SEQ ID NO: 271379 - RNA, 22 nt, Human
aagucccaaagucacucugcuu

SEQ ID NO: 271380 - RNA, 20 nt, Human
ccuuccccacccgcugaggu

SEQ ID NO: 271381 - RNA, 22 nt, Human
uuccuggccagcuguggugagu

SEQ ID NO: 271382 - RNA, 22 nt, Human
cauaauccuugauucaaauaau

SEQ ID NO: 271383 - RNA, 22 nt, Human
auaaaaaugagggcgguagcua

SEQ ID NO: 271384 - RNA, 23 nt, Human
uuacaaguucugaaauuuccuuc

SEQ ID NO: 271385 - RNA, 22 nt, Human
uggcaugaguauaggcuucuca

SEQ ID NO: 271386 - RNA, 22 nt, Human
ugaauaugauugcaaauuuggc

SEQ ID NO: 271387 - RNA, 22 nt, Human
uguuuugucuaaucuaaauucu

SEQ ID NO: 271388 - RNA, 22 nt, Human
aggccacaaccacccugugccc

SEQ ID NO: 271389 - RNA, 22 nt, Human
cauguguuucgagacuguugag

SEQ ID NO: 271390 - RNA, 22 nt, Human
aaccaccaccaucuaguuccaa

SEQ ID NO: 271391 - RNA, 22 nt, Human
ggcagggcccugauuccugggg

SEQ ID NO: 271392 - RNA, 22 nt, Human
acagaaagaagguguauuugag

SEQ ID NO: 271393 - RNA, 22 nt, Human
ccccaucuucccugagggauuu

SEQ ID NO: 271394 - RNA, 22 nt, Human
uauguacauacaugugcauacg

SEQ ID NO: 271395 - RNA, 22 nt, Human
auguacagugauaagagggcag

SEQ ID NO: 271396 - RNA, 22 nt, Human
ggaggccaaggaggagcuugcc

SEQ ID NO: 271397 - RNA, 22 nt, Human
agacuccuucucacugccugua

SEQ ID NO: 271398 - RNA, 22 nt, Human
gagaggcugugugccauuguug

SEQ ID NO: 271399 - RNA, 19 nt, Human
caugcugaccugcuguggu

SEQ ID NO: 271400 - RNA, 23 nt, Human
uucauugauugcaaggagauugg

SEQ ID NO: 271401 - RNA, 22 nt, Human
uaguucaccccucuuuauuuuc

SEQ ID NO: 271402 - RNA, 22 nt, Human
aaggugucauccaggauggugg

SEQ ID NO: 271403 - RNA, 22 nt, Human
gagucuuaggcaaaaauaaugg

SEQ ID NO: 271404 - RNA, 22 nt, Human
uuggcagacugacaaucuguuu

SEQ ID NO: 271405 - RNA, 22 nt, Human
ccuggcagguagcauugaggag

SEQ ID NO: 271406 - RNA, 23 nt, Human
ucauucaaggcugguaucuuuca

SEQ ID NO: 271407 - RNA, 22 nt, Human
cucugaagggagggccaagccc

SEQ ID NO: 271408 - RNA, 22 nt, Human
uaccagccucuguugggggugg

SEQ ID NO: 271409 - RNA, 22 nt, Human
ugccuugaacauaguggacagu

SEQ ID NO: 271410 - RNA, 22 nt, Human
ccugggcucaagugauccuccu

SEQ ID NO: 271411 - RNA, 22 nt, Human
uuaauuuauguccaaaccagau

SEQ ID NO: 271412 - RNA, 22 nt, Human
uuuucugugugucccucgacag

SEQ ID NO: 271413 - RNA, 22 nt, Human
auucuucauggcugugaguccu

SEQ ID NO: 271414 - RNA, 21 nt, Human
ucucuguauccauggguucca

SEQ ID NO: 271415 - RNA, 22 nt, Human
uugggcuggcagagguggucuu

SEQ ID NO: 271416 - RNA, 22 nt, Human
ggugcagugcaggguaauuaua

SEQ ID NO: 271417 - RNA, 22 nt, Human
guucuuaaagauucaucaagca

SEQ ID NO: 271418 - RNA, 22 nt, Human
uuugugaagggaacagaagugu

SEQ ID NO: 271419 - RNA, 22 nt, Human
aucuagaggcaaugaaggaggu

SEQ ID NO: 271420 - RNA, 21 nt, Human
gcuccuggugcugcguggcgc

SEQ ID NO: 271421 - RNA, 22 nt, Human
gccucugcaugcucagcaccca

SEQ ID NO: 271422 - RNA, 22 nt, Human
aagccuugauucacucugugga

SEQ ID NO: 271423 - RNA, 21 nt, Human
acaaugucaaggucagacauu

SEQ ID NO: 271424 - RNA, 22 nt, Human
agcuggcauuacaggagcaugc

SEQ ID NO: 271425 - RNA, 22 nt, Human
caggcucaauggccacuugggc

SEQ ID NO: 271426 - RNA, 22 nt, Human
agacuccaaaaguuugguggaa

SEQ ID NO: 271427 - RNA, 22 nt, Human
cuuucagaggggcguacacagc

SEQ ID NO: 271428 - RNA, 22 nt, Human
gccaggguggcagaaggcccca

SEQ ID NO: 271429 - RNA, 22 nt, Human
cagucagagucacaguaauuug

SEQ ID NO: 271430 - RNA, 22 nt, Human
aagcacaggaucuugaggagcg

SEQ ID NO: 271431 - RNA, 22 nt, Human
gccuacuuaguagcugggauua

SEQ ID NO: 271432 - RNA, 22 nt, Human
acagauaaagaaacaaucacag

SEQ ID NO: 271433 - RNA, 22 nt, Human
ugagaggugaggcaugaggcau

SEQ ID NO: 271434 - RNA, 22 nt, Human
ucaggcaggaagccccugcaca

SEQ ID NO: 271435 - RNA, 22 nt, Human
uuuauugagcacccguugugcg

SEQ ID NO: 271436 - RNA, 22 nt, Human
gguaacaguauguagaguaaga

SEQ ID NO: 271437 - RNA, 20 nt, Human
ccuguguggccagcugaggc

SEQ ID NO: 271438 - RNA, 22 nt, Human
aauuuuacuucccucaguguag

SEQ ID NO: 271439 - RNA, 22 nt, Human
aggcuggcagccaccucagcag

SEQ ID NO: 271440 - RNA, 22 nt, Human
uugagaacucuguauguccagc

SEQ ID NO: 271441 - RNA, 22 nt, Human
ugcaacuaggagguucuuagcu

SEQ ID NO: 271442 - RNA, 22 nt, Human
cccucccugugugccucauuug

SEQ ID NO: 271443 - RNA, 22 nt, Human
aaagaagacagacauuucuuuc

SEQ ID NO: 271444 - RNA, 21 nt, Human
agaacugauuaaauaagcagu

SEQ ID NO: 271445 - RNA, 22 nt, Human
uuuaugucaaaacuacaguugg

SEQ ID NO: 271446 - RNA, 22 nt, Human
caggagagauaugaguccccac

SEQ ID NO: 271447 - RNA, 22 nt, Human
cauuacaaacauguuaagauuu

SEQ ID NO: 271448 - RNA, 22 nt, Human
gcaugcuuuuauaucuguuuaa

SEQ ID NO: 271449 - RNA, 22 nt, Human
ccacagcuagggcaaucugauu

SEQ ID NO: 271450 - RNA, 22 nt, Human
ucugggaaaguaaauguaaagg

SEQ ID NO: 271451 - RNA, 22 nt, Human
cagugacacccagucuggccca

SEQ ID NO: 271452 - RNA, 22 nt, Human
ugagcuuuguuguuaguauauu

SEQ ID NO: 271453 - RNA, 22 nt, Human
gcuggcugcgucaucacagggc

SEQ ID NO: 271454 - RNA, 22 nt, Human
ucuucuccuuugccauguguuu

SEQ ID NO: 271455 - RNA, 22 nt, Human
aauuauguagccauaugaaaca

SEQ ID NO: 271456 - RNA, 22 nt, Human
uagaaacagaaaacuguaauag

SEQ ID NO: 271457 - RNA, 22 nt, Human
acucuucaccgcuacugaaaua

SEQ ID NO: 271458 - RNA, 22 nt, Human
aguggggacaaugagagcaggu

SEQ ID NO: 271459 - RNA, 22 nt, Human
ucuuagaaugucaacugauguu

SEQ ID NO: 271460 - RNA, 22 nt, Human
acaggcuuuuuugcucucgaau

SEQ ID NO: 271461 - RNA, 22 nt, Human
auggcagauggcuggagcaggu

SEQ ID NO: 271462 - RNA, 22 nt, Human
ccucagcucccaugagaucugc

SEQ ID NO: 271463 - RNA, 22 nt, Human
ccaggcuuuaagagguggaaac

SEQ ID NO: 271464 - RNA, 22 nt, Human
ggcuucaucucguugacaccuc

SEQ ID NO: 271465 - RNA, 22 nt, Human
uguuaucugguugucugauuac

SEQ ID NO: 271466 - RNA, 22 nt, Human
ccugaagaaaauuccacgagaa

SEQ ID NO: 271467 - RNA, 23 nt, Human
uggcauuuuaguuagcuucagug

SEQ ID NO: 271468 - RNA, 22 nt, Human
ugaaggcugggcucagccagcu

SEQ ID NO: 271469 - RNA, 22 nt, Human
agcuggcacagaccaggagauc

SEQ ID NO: 271470 - RNA, 22 nt, Human
uagcucauguaauccgaacaua

SEQ ID NO: 271471 - RNA, 22 nt, Human
aagaacauuuaugauggcauuu

SEQ ID NO: 271472 - RNA, 22 nt, Human
ccuccugguugcaaugaaaugg

SEQ ID NO: 271473 - RNA, 22 nt, Human
ugaggggcauguguuuacacau

SEQ ID NO: 271474 - RNA, 19 nt, Human
agcuggagauuggagggca

SEQ ID NO: 271475 - RNA, 22 nt, Human
gcagagcucaagguguucagcu

SEQ ID NO: 271476 - RNA, 22 nt, Human
cuuccagaguugcguucucggu

SEQ ID NO: 271477 - RNA, 22 nt, Human
ccaaggcuucccagagaugcuc

SEQ ID NO: 271478 - RNA, 22 nt, Human
aaggccagauucucucuagggg

SEQ ID NO: 271479 - RNA, 22 nt, Human
aggcuucucugcaagauguuaa

SEQ ID NO: 271480 - RNA, 20 nt, Human
ucucagcauaagaacccuuc

SEQ ID NO: 271481 - RNA, 22 nt, Human
cugucagguuucccaucugcaa

SEQ ID NO: 271482 - RNA, 22 nt, Human
ugguuccugguucacuuggcag

SEQ ID NO: 271483 - RNA, 22 nt, Human
cugccccaggccuccuuuucuu

SEQ ID NO: 271484 - RNA, 22 nt, Human
gcaguggcaugaugugggcuca

SEQ ID NO: 271485 - RNA, 21 nt, Human
ucagaguguguuacagcaagc

SEQ ID NO: 271486 - RNA, 22 nt, Human
uuggaaauacgaguaguaucau

SEQ ID NO: 271487 - RNA, 22 nt, Human
cagagcauuuggaagccacgug

SEQ ID NO: 271488 - RNA, 21 nt, Human
uaaaggcuuuagaauggcaaa

SEQ ID NO: 271489 - RNA, 22 nt, Human
uuauuuaggagaaggaacccug

SEQ ID NO: 271490 - RNA, 22 nt, Human
cacuuuauaugcauuaccucau

SEQ ID NO: 271491 - RNA, 22 nt, Human
uccuggagaaacucagagaucu

SEQ ID NO: 271492 - RNA, 17 nt, Human
gacagcugguuccuggc

SEQ ID NO: 271493 - RNA, 22 nt, Human
uggcagcugcaggccuccugag

SEQ ID NO: 271494 - RNA, 22 nt, Human
uucauucaagggguuccugauu

SEQ ID NO: 271495 - RNA, 22 nt, Human
uccagccccuccugagccaagc

SEQ ID NO: 271496 - RNA, 22 nt, Human
aguauauggggaauugcauaau

SEQ ID NO: 271497 - RNA, 22 nt, Human
gggcucuggauggagccugcag

SEQ ID NO: 271498 - RNA, 23 nt, Human
ucuuuccuaaugaaacagugaaa

SEQ ID NO: 271499 - RNA, 19 nt, Human
ccuggguccacucagacua

SEQ ID NO: 271500 - RNA, 22 nt, Human
ugcauuauaacugaauguuguu

SEQ ID NO: 271501 - RNA, 22 nt, Human
ugaugacagcaaaaaaugcuag

SEQ ID NO: 271502 - RNA, 22 nt, Human
agaauuuaggaugcaugugaau

SEQ ID NO: 271503 - RNA, 22 nt, Human
augaauauugaaugucuuauga

SEQ ID NO: 271504 - RNA, 22 nt, Human
cauggcuggccagugggagugg

SEQ ID NO: 271505 - RNA, 22 nt, Human
aacuacauagaaauuaguauuu

SEQ ID NO: 271506 - RNA, 17 nt, Human
ugaggccauggcaccau

SEQ ID NO: 271507 - RNA, 22 nt, Human
cagguggcuuauuagggucagu

SEQ ID NO: 271508 - RNA, 22 nt, Human
agguggguucccgacucuggcu

SEQ ID NO: 271509 - RNA, 21 nt, Human
auacuuugaauuacagccuug

SEQ ID NO: 271510 - RNA, 22 nt, Human
ccccaaaacuuggugacuucca

SEQ ID NO: 271511 - RNA, 22 nt, Human
uucuuuggggucuccagcauag

SEQ ID NO: 271512 - RNA, 22 nt, Human
auauaucuucauuaggucgaga

SEQ ID NO: 271513 - RNA, 22 nt, Human
uaaaggcaguaauuccugaguu

SEQ ID NO: 271514 - RNA, 22 nt, Human
uggccaggaggcugcuucugac

SEQ ID NO: 271515 - RNA, 22 nt, Human
cagagcagguaucuuuggugaa

SEQ ID NO: 271516 - RNA, 22 nt, Human
aaucuucacagagaaaauuagg

SEQ ID NO: 271517 - RNA, 22 nt, Human
ucaugcaaggcugaaacauggu

SEQ ID NO: 271518 - RNA, 22 nt, Human
ccaggaagcggugagggcugcc

SEQ ID NO: 271519 - RNA, 22 nt, Human
agcaaauacuugaauaaaaaga

SEQ ID NO: 271520 - RNA, 22 nt, Human
aagcaugggaggccuggaggag

SEQ ID NO: 271521 - RNA, 22 nt, Human
caaaugcaaaauauaacccugu

SEQ ID NO: 271522 - RNA, 22 nt, Human
gcugccacucugagcuugcuuc

SEQ ID NO: 271523 - RNA, 22 nt, Human
cucccuggcagccgcacuccug

SEQ ID NO: 271524 - RNA, 22 nt, Human
uucucugggacaggaacaguuu

SEQ ID NO: 271525 - RNA, 22 nt, Human
ucccagugggaagcagcacgcu

SEQ ID NO: 271526 - RNA, 22 nt, Human
gaugcuucaagcuuccuuauaa

SEQ ID NO: 271527 - RNA, 22 nt, Human
cuucuuaaugacagauuaaaau

SEQ ID NO: 271528 - RNA, 22 nt, Human
agauuuagacugccuuaaucau

SEQ ID NO: 271529 - RNA, 22 nt, Human
aaguauuucagcgguucuuugu

SEQ ID NO: 271530 - RNA, 22 nt, Human
gaggcugcccacaccugcgccg

SEQ ID NO: 271531 - RNA, 22 nt, Human
accuccuggcuuaucauggaca

SEQ ID NO: 271532 - RNA, 22 nt, Human
cagguggcuucucccuaggcca

SEQ ID NO: 271533 - RNA, 22 nt, Human
uuauuuuaccuuccucugagcu

SEQ ID NO: 271534 - RNA, 22 nt, Human
caacaguuccuccauccucucu

SEQ ID NO: 271535 - RNA, 22 nt, Human
guuuuccugaaacugauggugu

SEQ ID NO: 271536 - RNA, 22 nt, Human
cagauggcacagauuuagagug

SEQ ID NO: 271537 - RNA, 22 nt, Human
ccaggugggcgugucuucaccu

SEQ ID NO: 271538 - RNA, 19 nt, Human
agugugaguaauuggaguu

SEQ ID NO: 271539 - RNA, 22 nt, Human
ugucugggucaccccuccuggc

SEQ ID NO: 271540 - RNA, 22 nt, Human
caaggccuugcugucuccuccu

SEQ ID NO: 271541 - RNA, 22 nt, Human
aaaaacagaaugugucuaacuc

SEQ ID NO: 271542 - RNA, 22 nt, Human
ggcaauaguuguggguucuuua

SEQ ID NO: 271543 - RNA, 22 nt, Human
aaggcaaugcuaagagguuugg

SEQ ID NO: 271544 - RNA, 21 nt, Human
acuuggccaggcccccaccug

SEQ ID NO: 271545 - RNA, 22 nt, Human
caaggcugagaaauucugcccu

SEQ ID NO: 271546 - RNA, 22 nt, Human
auuuggaaacaauuauauucuu

SEQ ID NO: 271547 - RNA, 22 nt, Human
cggcuggguucggcugcaggcc

SEQ ID NO: 271548 - RNA, 22 nt, Human
uucaaucauuuuuacauagucc

SEQ ID NO: 271549 - RNA, 22 nt, Human
guaggggaugguucccuagaaa

SEQ ID NO: 271550 - RNA, 22 nt, Human
ccagcagcugcaaagccugggu

SEQ ID NO: 271551 - RNA, 22 nt, Human
ugugugucagucuuguuuaggg

SEQ ID NO: 271552 - RNA, 23 nt, Human
uggcucagcuaguuuuccauuuc

SEQ ID NO: 271553 - RNA, 22 nt, Human
uucauucuugggaucagagagu

SEQ ID NO: 271554 - RNA, 22 nt, Human
aacuaguaaaagcaacaguaua

SEQ ID NO: 271555 - RNA, 22 nt, Human
uucauuuagcaugcuaaaccug

SEQ ID NO: 271556 - RNA, 22 nt, Human
gagggggcucugccaaccuguc

SEQ ID NO: 271557 - RNA, 22 nt, Human
uccuggucuacacugcauuggg

SEQ ID NO: 271558 - RNA, 22 nt, Human
ugggagcaggugugcuagggaa

SEQ ID NO: 271559 - RNA, 20 nt, Human
cucugggcugcguugcaaac

SEQ ID NO: 271560 - RNA, 16 nt, Human
gggcugggggauucug

SEQ ID NO: 271561 - RNA, 22 nt, Human
gccuggcacauugcaguggauu

SEQ ID NO: 271562 - RNA, 22 nt, Human
uguaaugagaaagagagugaau

SEQ ID NO: 271563 - RNA, 22 nt, Human
cccaguggggagcugagguuca

SEQ ID NO: 271564 - RNA, 20 nt, Human
gaaucuuacuacauucucuc

SEQ ID NO: 271565 - RNA, 22 nt, Human
caacugaacugauaucaacuau

SEQ ID NO: 271566 - RNA, 22 nt, Human
augcugaaugaaagaaauuagu

SEQ ID NO: 271567 - RNA, 22 nt, Human
gcccagcaaggaccaagggccg

SEQ ID NO: 271568 - RNA, 22 nt, Human
gacagcagaugaagccugcaga

SEQ ID NO: 271569 - RNA, 22 nt, Human
ggugcugagagccuaggagggc

SEQ ID NO: 271570 - RNA, 22 nt, Human
cugagcagaccauggcagaggu

SEQ ID NO: 271571 - RNA, 22 nt, Human
ucaaaugcaggucuggucuugg

SEQ ID NO: 271572 - RNA, 23 nt, Human
aacugucuugcaagugugauacc

SEQ ID NO: 271573 - RNA, 22 nt, Human
auugugaauugagaguacuucu

SEQ ID NO: 271574 - RNA, 22 nt, Human
acuaaugauuauugucauugug

SEQ ID NO: 271575 - RNA, 22 nt, Human
gugggugugagugacggcgucc

SEQ ID NO: 271576 - RNA, 22 nt, Human
acagcagguuacaguggcacag

SEQ ID NO: 271577 - RNA, 22 nt, Human
uaugcacacauuagcacagggu

SEQ ID NO: 271578 - RNA, 22 nt, Human
uggcucagaguucaucuuuuag

SEQ ID NO: 271579 - RNA, 22 nt, Human
acugggcuagaguggaagcugg

SEQ ID NO: 271580 - RNA, 22 nt, Human
uggggaaaaugcagaagauuac

SEQ ID NO: 271581 - RNA, 20 nt, Human
ugucauuuauuuaucaaaug

SEQ ID NO: 271582 - RNA, 22 nt, Human
aguaacacuuggaaugauagca

SEQ ID NO: 271583 - RNA, 22 nt, Human
aaacauuugcaacucgguuugg

SEQ ID NO: 271584 - RNA, 22 nt, Human
acuuugauaguuuaaucuagga

SEQ ID NO: 271585 - RNA, 22 nt, Human
uaaggaauagugcuaugaaaaa

SEQ ID NO: 271586 - RNA, 22 nt, Human
gccuggcuuggggcucaguggu

SEQ ID NO: 271587 - RNA, 22 nt, Human
ugcucugcacaucccucacaaa

SEQ ID NO: 271588 - RNA, 22 nt, Human
aggcaggcucaggcccaugcuu

SEQ ID NO: 271589 - RNA, 22 nt, Human
uccaggcuagguuuacaggaca

SEQ ID NO: 271590 - RNA, 22 nt, Human
ggcagccauggacacuggcuag

SEQ ID NO: 271591 - RNA, 22 nt, Human
caaauguauaaauguacuuucu

SEQ ID NO: 271592 - RNA, 20 nt, Human
uaucuuacuuuagucauuug

SEQ ID NO: 271593 - RNA, 22 nt, Human
uggaaacugugguauuucuuua

SEQ ID NO: 271594 - RNA, 18 nt, Human
gugcugugggcaguggcc

SEQ ID NO: 271595 - RNA, 22 nt, Human
ugaaauuagugaaguuacaguu

SEQ ID NO: 271596 - RNA, 22 nt, Human
acgaugcuggauuaucucaagg

SEQ ID NO: 271597 - RNA, 22 nt, Human
cacuauaucuguucuuguuuau

SEQ ID NO: 271598 - RNA, 22 nt, Human
ugggcucuuccuauaguuuaua

SEQ ID NO: 271599 - RNA, 21 nt, Human
uauuucuuugacucucucccu

SEQ ID NO: 271600 - RNA, 22 nt, Human
acacugaguuuuaccaggcaca

SEQ ID NO: 271601 - RNA, 22 nt, Human
aaauagcauaaaauaggaagcu

SEQ ID NO: 271602 - RNA, 22 nt, Human
cuaacauuuauugagcacuuag

SEQ ID NO: 271603 - RNA, 22 nt, Human
acaaagugcacaagaugagaac

SEQ ID NO: 271604 - RNA, 18 nt, Human
gggcaucauucacaaagu

SEQ ID NO: 271605 - RNA, 22 nt, Human
ccugcuccugcuauucuucugg

SEQ ID NO: 271606 - RNA, 22 nt, Human
cagccaggggcuggcguguuga

SEQ ID NO: 271607 - RNA, 22 nt, Human
agacacuguucucacaugcuug

SEQ ID NO: 271608 - RNA, 22 nt, Human
uguauuagagcaguagaauuau

SEQ ID NO: 271609 - RNA, 22 nt, Human
uggucacccacugggacugcgg

SEQ ID NO: 271610 - RNA, 22 nt, Human
uagcuacauacuuggccauucu

SEQ ID NO: 271611 - RNA, 22 nt, Human
uggcccaggggcucuugguguu

SEQ ID NO: 271612 - RNA, 22 nt, Human
uuuccaggugcauagaaaacag

SEQ ID NO: 271613 - RNA, 22 nt, Human
aucuuacacgauaacuguuagu

SEQ ID NO: 271614 - RNA, 22 nt, Human
aacugcauuguacuaaacuugu

SEQ ID NO: 271615 - RNA, 22 nt, Human
cuuuggaggaaaauugagguca

SEQ ID NO: 271616 - RNA, 22 nt, Human
uuucaucuuccuuggcauaggu

SEQ ID NO: 271617 - RNA, 22 nt, Human
uucuggaagcugcagguggccg

SEQ ID NO: 271618 - RNA, 22 nt, Human
ugcccuggcauuggguuggaua

SEQ ID NO: 271619 - RNA, 22 nt, Human
aggcacugggaauaugcugagg

SEQ ID NO: 271620 - RNA, 22 nt, Human
aacccuggagaaggcuuuggau

SEQ ID NO: 271621 - RNA, 22 nt, Human
uucuucuucuggcugcaccugg

SEQ ID NO: 271622 - RNA, 22 nt, Human
ucagaauaaacaugggcauggg

SEQ ID NO: 271623 - RNA, 22 nt, Human
uugguacaugcagauauuuagu

SEQ ID NO: 271624 - RNA, 22 nt, Human
ugguccuguagcacuugauuag

SEQ ID NO: 271625 - RNA, 22 nt, Human
gauuuaaaguagaccuuuguuu

SEQ ID NO: 271626 - RNA, 22 nt, Human
cugcugggcuccucaugugacu

SEQ ID NO: 271627 - RNA, 22 nt, Human
agcugguggagccuuucuguuu

SEQ ID NO: 271628 - RNA, 22 nt, Human
aaggcauauauucuaaacagga

SEQ ID NO: 271629 - RNA, 22 nt, Human
uguuacugugguuaccagaagc

SEQ ID NO: 271630 - RNA, 22 nt, Human
agagccagcaagugaauaguga

SEQ ID NO: 271631 - RNA, 22 nt, Human
cugcucuguucccccaucaucu

SEQ ID NO: 271632 - RNA, 22 nt, Human
cagggcucagggacugcagaaa

SEQ ID NO: 271633 - RNA, 22 nt, Human
uagggcaggugaagaaaagcua

SEQ ID NO: 271634 - RNA, 22 nt, Human
gcugucugcugggucgcucagg

SEQ ID NO: 271635 - RNA, 22 nt, Human
acaguuuaucgauucaccuacc

SEQ ID NO: 271636 - RNA, 21 nt, Human
agagucugagugugcaagggc

SEQ ID NO: 271637 - RNA, 22 nt, Human
aaagaacuaccuguaugauauu

SEQ ID NO: 271638 - RNA, 23 nt, Human
uuucaacuccugccauuauuucu

SEQ ID NO: 271639 - RNA, 23 nt, Human
ccucaaauguagccuuuuuccca

SEQ ID NO: 271640 - RNA, 22 nt, Human
uggcuggcugucaaggaaagcc

SEQ ID NO: 271641 - RNA, 22 nt, Human
gcccucagaggacagcugacuu

SEQ ID NO: 271642 - RNA, 22 nt, Human
agccuugaaccaauuguuuagc

SEQ ID NO: 271643 - RNA, 22 nt, Human
augccagaagagucugcaggga

SEQ ID NO: 271644 - RNA, 22 nt, Human
agccucugggggagcugggagc

SEQ ID NO: 271645 - RNA, 22 nt, Human
cuguauuugaaagaaaagauuu

SEQ ID NO: 271646 - RNA, 22 nt, Human
acuagaaauguauugguagcug

SEQ ID NO: 271647 - RNA, 23 nt, Human
uagauccuuccaacuacucuuac

SEQ ID NO: 271648 - RNA, 22 nt, Human
aucuucuacuuugccaaucagg

SEQ ID NO: 271649 - RNA, 22 nt, Human
aagaugauaggacuugcuuaag

SEQ ID NO: 271650 - RNA, 21 nt, Human
aaauguguuccauaaugcuuu

SEQ ID NO: 271651 - RNA, 22 nt, Human
aggcaaagaggauauuuugggg

SEQ ID NO: 271652 - RNA, 22 nt, Human
cugagggauguggauuuugguc

SEQ ID NO: 271653 - RNA, 22 nt, Human
cugcaggguuuuucaaggacaa

SEQ ID NO: 271654 - RNA, 22 nt, Human
uccugggguuuuggccgcagcu

SEQ ID NO: 271655 - RNA, 20 nt, Human
ucuggccccuuccuguccug

SEQ ID NO: 271656 - RNA, 22 nt, Human
aggagcucauugaaguggauga

SEQ ID NO: 271657 - RNA, 22 nt, Human
guccucagaagccugcuuagcu

SEQ ID NO: 271658 - RNA, 22 nt, Human
ucucauggagucaggagcagaa

SEQ ID NO: 271659 - RNA, 22 nt, Human
uuugcaaauaccaugaaacuug

SEQ ID NO: 271660 - RNA, 22 nt, Human
aggcuucuugauaaaaugcaga

SEQ ID NO: 271661 - RNA, 22 nt, Human
ccugccuucagcccugaagucu

SEQ ID NO: 271662 - RNA, 22 nt, Human
aacacuuuuuauauauuguauc

SEQ ID NO: 271663 - RNA, 20 nt, Human
gcagcagugcaaguccucuu

SEQ ID NO: 271664 - RNA, 22 nt, Human
uuuacagaugaggauacugagg

SEQ ID NO: 271665 - RNA, 22 nt, Human
auuagaagcgugaauccuuuca

SEQ ID NO: 271666 - RNA, 22 nt, Human
uccagggcaugcucagacucag

SEQ ID NO: 271667 - RNA, 22 nt, Human
cccacacaaaucauggggagaa

SEQ ID NO: 271668 - RNA, 22 nt, Human
ucaggaagugccuaggcuggcc

SEQ ID NO: 271669 - RNA, 22 nt, Human
ccagaggugaacaggaggcugu

SEQ ID NO: 271670 - RNA, 22 nt, Human
cccaggguagcugagcuggcag

SEQ ID NO: 271671 - RNA, 22 nt, Human
uucugucucuguguuuacauua

SEQ ID NO: 271672 - RNA, 22 nt, Human
cauuuguaggaugcuucuuguu

SEQ ID NO: 271673 - RNA, 22 nt, Human
ugcugccacauuuaaagagggg

SEQ ID NO: 271674 - RNA, 22 nt, Human
aaaucucaggccucuauuuacu

SEQ ID NO: 271675 - RNA, 22 nt, Human
ucuggaggcucugagggugagu

SEQ ID NO: 271676 - RNA, 22 nt, Human
cagagguacaagcuaaguuggg

SEQ ID NO: 271677 - RNA, 22 nt, Human
ucagagccaaucauggugcauu

SEQ ID NO: 271678 - RNA, 22 nt, Human
aaggugcucacgggcucaggga

SEQ ID NO: 271679 - RNA, 22 nt, Human
acaggacugugauccaguaacc

SEQ ID NO: 271680 - RNA, 22 nt, Human
ggcuccagauguccccuggcaa

SEQ ID NO: 271681 - RNA, 22 nt, Human
caguugcagcugugacauugcg

SEQ ID NO: 271682 - RNA, 22 nt, Human
gcaccugccugggacugaagau

SEQ ID NO: 271683 - RNA, 22 nt, Human
ucuauacaaguuucacuuugac

SEQ ID NO: 271684 - RNA, 18 nt, Human
ucuggagggaagcuuuga

SEQ ID NO: 271685 - RNA, 22 nt, Human
augcuuuuuaaacuuaauugga

SEQ ID NO: 271686 - RNA, 22 nt, Human
gagauccacuuaauuuuuuugc

SEQ ID NO: 271687 - RNA, 22 nt, Human
uaggauaugcauuuuuauacau

SEQ ID NO: 271688 - RNA, 22 nt, Human
acacaguucuuucacuguuggu

SEQ ID NO: 271689 - RNA, 22 nt, Human
agcaacagcccuguuucauuag

SEQ ID NO: 271690 - RNA, 22 nt, Human
cuggcucccguuguccuugaag

SEQ ID NO: 271691 - RNA, 22 nt, Human
aaacaaugacaacacagcugcg

SEQ ID NO: 271692 - RNA, 22 nt, Human
gguguccucaugauuuucuaga

SEQ ID NO: 271693 - RNA, 22 nt, Human
uucaacauguucuacauaaggg

SEQ ID NO: 271694 - RNA, 22 nt, Human
agagagggaauauuugggguau

SEQ ID NO: 271695 - RNA, 22 nt, Human
ugcaagagguaaaaugaaagga

SEQ ID NO: 271696 - RNA, 22 nt, Human
agcauccaggccagguugggca

SEQ ID NO: 271697 - RNA, 22 nt, Human
aaguuaguggauaaacagcaaa

SEQ ID NO: 271698 - RNA, 22 nt, Human
cuggacagaaagggcugcugug

SEQ ID NO: 271699 - RNA, 22 nt, Human
uuucauaaccucaagcuacagu

SEQ ID NO: 271700 - RNA, 21 nt, Human
gugguuauuuucauuagcauc

SEQ ID NO: 271701 - RNA, 22 nt, Human
gaaggagggugcggaucugagc

SEQ ID NO: 271702 - RNA, 22 nt, Human
gauugagucugaggaugcugca

SEQ ID NO: 271703 - RNA, 22 nt, Human
gagcccugcccacuugucugag

SEQ ID NO: 271704 - RNA, 22 nt, Human
aagcacugggaggaggcugaga

SEQ ID NO: 271705 - RNA, 18 nt, Human
ucucucugauaacauuuu

SEQ ID NO: 271706 - RNA, 22 nt, Human
agggccugggauguccuccuag

SEQ ID NO: 271707 - RNA, 22 nt, Human
aaagugcugugggcuguaagug

SEQ ID NO: 271708 - RNA, 22 nt, Human
agcuugaauuauucugcucuua

SEQ ID NO: 271709 - RNA, 22 nt, Human
auuuuacauaaggaagguuuaa

SEQ ID NO: 271710 - RNA, 22 nt, Human
gacagacauuuccugauccaau

SEQ ID NO: 271711 - RNA, 21 nt, Human
uauuaauaugucuaagcugau

SEQ ID NO: 271712 - RNA, 22 nt, Human
ugauucacagacuucacaaggc

SEQ ID NO: 271713 - RNA, 22 nt, Human
ccaggaggcucugcccauccca

SEQ ID NO: 271714 - RNA, 18 nt, Human
auccaaaaagauggaagu

SEQ ID NO: 271715 - RNA, 22 nt, Human
acccuccaggcugcagcuccug

SEQ ID NO: 271716 - RNA, 22 nt, Human
caugugugagugagcagucuuc

SEQ ID NO: 271717 - RNA, 19 nt, Human
cagcugccuuuucuuugca

SEQ ID NO: 271718 - RNA, 22 nt, Human
uucauucagguguauuuauggg

SEQ ID NO: 271719 - RNA, 22 nt, Human
gucucaguaagaaaggcuccug

SEQ ID NO: 271720 - RNA, 22 nt, Human
ccagguggaaggucugugcucu

SEQ ID NO: 271721 - RNA, 22 nt, Human
cugcugaaccuuugcuagauaa

SEQ ID NO: 271722 - RNA, 22 nt, Human
auagcauauaaguuauaaaacu

SEQ ID NO: 271723 - RNA, 23 nt, Human
uggaagaaaaugguuuggcugug

SEQ ID NO: 271724 - RNA, 19 nt, Human
uucuggucuggaaucaagg

SEQ ID NO: 271725 - RNA, 22 nt, Human
cugccaggcagcagagggagaa

SEQ ID NO: 271726 - RNA, 22 nt, Human
ggcugaggguauagcuguccca

SEQ ID NO: 271727 - RNA, 22 nt, Human
ucagcuggcagguucugggaag

SEQ ID NO: 271728 - RNA, 22 nt, Human
cugggcugucaauggcccucug

SEQ ID NO: 271729 - RNA, 22 nt, Human
ucuucaggaagggaaaucaucc

SEQ ID NO: 271730 - RNA, 22 nt, Human
aucagaaaguucaucauguuug

SEQ ID NO: 271731 - RNA, 22 nt, Human
uugaggcagcccuuaauuggga

SEQ ID NO: 271732 - RNA, 22 nt, Human
uuaaacagagucugaaauguaa

SEQ ID NO: 271733 - RNA, 22 nt, Human
cagcaugauuggugucugguga

SEQ ID NO: 271734 - RNA, 22 nt, Human
cugucccagugauccugagugc

SEQ ID NO: 271735 - RNA, 22 nt, Human
uuagagagaaccaucaggaucu

SEQ ID NO: 271736 - RNA, 22 nt, Human
gaggcuuuucucuaaauagugg

SEQ ID NO: 271737 - RNA, 22 nt, Human
guuauuuuaacuucucaguaau

SEQ ID NO: 271738 - RNA, 22 nt, Human
uucaauuucauaauaucuagcu

SEQ ID NO: 271739 - RNA, 22 nt, Human
cauggcaauaaaccuacacagu

SEQ ID NO: 271740 - RNA, 22 nt, Human
ucaggcuuugggucaggcucug

SEQ ID NO: 271741 - RNA, 22 nt, Human
ugggccaggggccucuucugau

SEQ ID NO: 271742 - RNA, 22 nt, Human
aaugugucccuuauuucacagg

SEQ ID NO: 271743 - RNA, 22 nt, Human
cugaggagcccccucucagcau

SEQ ID NO: 271744 - RNA, 21 nt, Human
cacaugugaauuacugaacug

SEQ ID NO: 271745 - RNA, 22 nt, Human
aaagggccuccgccugggcagg

SEQ ID NO: 271746 - RNA, 22 nt, Human
ugggcacagggguaggaaugag

SEQ ID NO: 271747 - RNA, 22 nt, Human
uccaguccagggaauggcugau

SEQ ID NO: 271748 - RNA, 23 nt, Human
acagaggcuuaaaugaguggcag

SEQ ID NO: 271749 - RNA, 22 nt, Human
ugaguucuaggcuuaaaacuaa

SEQ ID NO: 271750 - RNA, 22 nt, Human
ccaggagagcagaagcccaggc

SEQ ID NO: 271751 - RNA, 22 nt, Human
cuggcugggcagacagaaugcu

SEQ ID NO: 271752 - RNA, 22 nt, Human
uguuuacuccugauauauuuuu

SEQ ID NO: 271753 - RNA, 22 nt, Human
cauacauuuauacacaucuaug

SEQ ID NO: 271754 - RNA, 22 nt, Human
ccagcuuuuagugggcuuauua

SEQ ID NO: 271755 - RNA, 22 nt, Human
aggggaugccugaggaucugua

SEQ ID NO: 271756 - RNA, 22 nt, Human
agagggugaaugagauagaaaa

SEQ ID NO: 271757 - RNA, 22 nt, Human
uuucaaggugcaggaggguuuu

SEQ ID NO: 271758 - RNA, 22 nt, Human
uggaauaugcaauugcauuuca

SEQ ID NO: 271759 - RNA, 22 nt, Human
gcugcagaccucaugcaggugg

SEQ ID NO: 271760 - RNA, 22 nt, Human
cuccuggcucugccacuuacua

SEQ ID NO: 271761 - RNA, 22 nt, Human
gcacacauucggauucuuaacc

SEQ ID NO: 271762 - RNA, 22 nt, Human
uucuguuagaauuuugaaaaua

SEQ ID NO: 271763 - RNA, 22 nt, Human
ucauugaggaaagguaguggcu

SEQ ID NO: 271764 - RNA, 22 nt, Human
uggccucaaucuguccuccagc

SEQ ID NO: 271765 - RNA, 22 nt, Human
ggucccagcugcucaagaggcu

SEQ ID NO: 271766 - RNA, 22 nt, Human
aacuggaagagugaauauaacu

SEQ ID NO: 271767 - RNA, 22 nt, Human
ugcucccacacuacucggaggc

SEQ ID NO: 271768 - RNA, 22 nt, Human
uucuagaugcuuauaggcauau

SEQ ID NO: 271769 - RNA, 20 nt, Human
gacaggugcuaaagaggggc

SEQ ID NO: 271770 - RNA, 22 nt, Human
cuuuggaaguaaagucagcagg

SEQ ID NO: 271771 - RNA, 22 nt, Human
gugccuggaacuggguaggcug

SEQ ID NO: 271772 - RNA, 22 nt, Human
uagcaagagugggcuuuguggg

SEQ ID NO: 271773 - RNA, 22 nt, Human
auuuuguuauaggagcugaaau

SEQ ID NO: 271774 - RNA, 22 nt, Human
ugagcccaggaguaugaggcug

SEQ ID NO: 271775 - RNA, 17 nt, Human
uaaauacacaaggguau

SEQ ID NO: 271776 - RNA, 22 nt, Human
gcugggcaacggaagagagaaa

SEQ ID NO: 271777 - RNA, 22 nt, Human
ucagagaaaugaaguagggauu

SEQ ID NO: 271778 - RNA, 22 nt, Human
ugguccaguucugugauauugc

SEQ ID NO: 271779 - RNA, 22 nt, Human
gaccacagauuccuaaguggca

SEQ ID NO: 271780 - RNA, 22 nt, Human
aauaacagugccaugaaauuga

SEQ ID NO: 271781 - RNA, 22 nt, Human
gaggcugguucccuugaucuuu

SEQ ID NO: 271782 - RNA, 22 nt, Human
ucccagggucaguggugaggcc

SEQ ID NO: 271783 - RNA, 22 nt, Human
uuuagagcugugcugccacaug

SEQ ID NO: 271784 - RNA, 22 nt, Human
auuggcuuucuuuugugaaaau

SEQ ID NO: 271785 - RNA, 22 nt, Human
aaagaagagcuggaaggagucu

SEQ ID NO: 271786 - RNA, 19 nt, Human
uuugcagugguuccuuugu

SEQ ID NO: 271787 - RNA, 22 nt, Human
cucagaggucaagagcagagcu

SEQ ID NO: 271788 - RNA, 22 nt, Human
uggcugagcucccuguguguug

SEQ ID NO: 271789 - RNA, 21 nt, Human
gcccagcaaggugagaaggcc

SEQ ID NO: 271790 - RNA, 22 nt, Human
cagacaaggccaucuuucauuu

SEQ ID NO: 271791 - RNA, 22 nt, Human
auucaguguaguuauuaucuuu

SEQ ID NO: 271792 - RNA, 22 nt, Human
cccuggcagaaugucucugggc

SEQ ID NO: 271793 - RNA, 22 nt, Human
auagacauauggcuuuguuucu

SEQ ID NO: 271794 - RNA, 20 nt, Human
uccagcccagguccugccug

SEQ ID NO: 271795 - RNA, 22 nt, Human
uguguccaacccagggacaagu

SEQ ID NO: 271796 - RNA, 22 nt, Human
ucaugccugauuauguuacuca

SEQ ID NO: 271797 - RNA, 22 nt, Human
ccagggccaagagaccucgagg

SEQ ID NO: 271798 - RNA, 22 nt, Human
gagagggauacugaguuuuggu

SEQ ID NO: 271799 - RNA, 22 nt, Human
ugggaagaggcgggaggcuguu

SEQ ID NO: 271800 - RNA, 22 nt, Human
ugguccugguagcggugugcuu

SEQ ID NO: 271801 - RNA, 22 nt, Human
gugugagagcaaaacugcagga

SEQ ID NO: 271802 - RNA, 22 nt, Human
ugccugguauuugaauaaagag

SEQ ID NO: 271803 - RNA, 23 nt, Human
ugaaucaauuaugggauucaaug

SEQ ID NO: 271804 - RNA, 22 nt, Human
aaggcugacguuuguguuuauu

SEQ ID NO: 271805 - RNA, 22 nt, Human
agagauuugucaaugauuucca

SEQ ID NO: 271806 - RNA, 23 nt, Human
aaucuggcugauguuuuuucucu

SEQ ID NO: 271807 - RNA, 23 nt, Human
auugagaaggauacauuguucuc

SEQ ID NO: 271808 - RNA, 22 nt, Human
cagagggcacucggagugacau

SEQ ID NO: 271809 - RNA, 22 nt, Human
agcugugaccuucaagagcuac

SEQ ID NO: 271810 - RNA, 22 nt, Human
ggccuugccucaauagcuccac

SEQ ID NO: 271811 - RNA, 22 nt, Human
uguguccuuucuaaugcccaga

SEQ ID NO: 271812 - RNA, 22 nt, Human
aaauaguccugggaauaguacu

SEQ ID NO: 271813 - RNA, 22 nt, Human
cauaugaaauaugaguugaaca

SEQ ID NO: 271814 - RNA, 22 nt, Human
aggacuuuucaucagcuauccu

SEQ ID NO: 271815 - RNA, 22 nt, Human
cagcuauugauaaauguugggg

SEQ ID NO: 271816 - RNA, 22 nt, Human
gguguccuucguccgcuggcau

SEQ ID NO: 271817 - RNA, 22 nt, Human
uguagcucuccagccagcaagg

SEQ ID NO: 271818 - RNA, 22 nt, Human
cucaggagacaguguccacaug

SEQ ID NO: 271819 - RNA, 22 nt, Human
aggggagccgaggggcaucugu

SEQ ID NO: 271820 - RNA, 22 nt, Human
ucagcuuucucuucuaucgaua

SEQ ID NO: 271821 - RNA, 18 nt, Human
gcagugccagccucuccu

SEQ ID NO: 271822 - RNA, 22 nt, Human
caguuucuucaucaguuaagca

SEQ ID NO: 271823 - RNA, 22 nt, Human
ugagggcagagcacuggggagc

SEQ ID NO: 271824 - RNA, 22 nt, Human
caggcuagauuggggccaguag

SEQ ID NO: 271825 - RNA, 22 nt, Human
cagggccuguacaagucccacc

SEQ ID NO: 271826 - RNA, 22 nt, Human
gaggcagcucuucugaaugggg

SEQ ID NO: 271827 - RNA, 22 nt, Human
uguguccuuccaguuuuuccug

SEQ ID NO: 271828 - RNA, 22 nt, Human
agcaggcuuuccacagaaggag

SEQ ID NO: 271829 - RNA, 22 nt, Human
cagaaaccaaaugggaugggga

SEQ ID NO: 271830 - RNA, 22 nt, Human
gauuagaugacuaaugagcugu

SEQ ID NO: 271831 - RNA, 22 nt, Human
cagcucuuugaguauuccauuu

SEQ ID NO: 271832 - RNA, 22 nt, Human
gugggacaaggaugaagauauu

SEQ ID NO: 271833 - RNA, 22 nt, Human
uccauacuaacagcauuuauca

SEQ ID NO: 271834 - RNA, 22 nt, Human
cagauggagucccguggaguuc

SEQ ID NO: 271835 - RNA, 22 nt, Human
ggaccugaacauaaaacgaggc

SEQ ID NO: 271836 - RNA, 22 nt, Human
ggcucugcuggauugaggccag

SEQ ID NO: 271837 - RNA, 22 nt, Human
ucccagggauuaggacauggau

SEQ ID NO: 271838 - RNA, 22 nt, Human
augaaaaguucgaucuagaagg

SEQ ID NO: 271839 - RNA, 22 nt, Human
cauuguaagcuguugaauccuc

SEQ ID NO: 271840 - RNA, 22 nt, Human
uauguacaucguugaauucaaa

SEQ ID NO: 271841 - RNA, 22 nt, Human
uuugucuugaggcuggggaagu

SEQ ID NO: 271842 - RNA, 22 nt, Human
gcugccacuuggucaugucaug

SEQ ID NO: 271843 - RNA, 22 nt, Human
cacagguguguccuggucuugu

SEQ ID NO: 271844 - RNA, 22 nt, Human
ggguccaguaguugguggccgu

SEQ ID NO: 271845 - RNA, 22 nt, Human
agaaguuguagguuugcauauu

SEQ ID NO: 271846 - RNA, 22 nt, Human
aaaugcacagguuuuaaauccu

SEQ ID NO: 271847 - RNA, 22 nt, Human
gagcuuaaauggcuaaauauaa

SEQ ID NO: 271848 - RNA, 22 nt, Human
acagaauucucucugcagaggc

SEQ ID NO: 271849 - RNA, 22 nt, Human
guaaacaugcuguguacucagc

SEQ ID NO: 271850 - RNA, 22 nt, Human
ggcugaggcggcgaugcccuug

SEQ ID NO: 271851 - RNA, 22 nt, Human
uggcuucugucccugcuacauu

SEQ ID NO: 271852 - RNA, 22 nt, Human
ucugggagccugaaagugaaug

SEQ ID NO: 271853 - RNA, 22 nt, Human
caggaaaaggagacuuuagcac

SEQ ID NO: 271854 - RNA, 22 nt, Human
uagggcagccuuauagcuccca

SEQ ID NO: 271855 - RNA, 22 nt, Human
aaagacaucagaaccagcugag

SEQ ID NO: 271856 - RNA, 22 nt, Human
cccacaggcaggggcagagaca

SEQ ID NO: 271857 - RNA, 21 nt, Human
ucugggagugggaaaaugguc

SEQ ID NO: 271858 - RNA, 22 nt, Human
uaaauuacccuuuagggaauug

SEQ ID NO: 271859 - RNA, 22 nt, Human
aagacacugauacucugugauu

SEQ ID NO: 271860 - RNA, 22 nt, Human
uauaugaugccaaauaaccugu

SEQ ID NO: 271861 - RNA, 22 nt, Human
aauaugcagcuuaucuucuagg

SEQ ID NO: 271862 - RNA, 22 nt, Human
ucuggguacuugcaagauuuuc

SEQ ID NO: 271863 - RNA, 22 nt, Human
aggcagggucuugcuauguugc

SEQ ID NO: 271864 - RNA, 22 nt, Human
uuucauugucaauaaacuguau

SEQ ID NO: 271865 - RNA, 22 nt, Human
augguuuacagaacuccuagca

SEQ ID NO: 271866 - RNA, 22 nt, Human
uggaagaagcuacaagcgguga

SEQ ID NO: 271867 - RNA, 22 nt, Human
guuuauaagguaaaggagagag

SEQ ID NO: 271868 - RNA, 22 nt, Human
acugaacuuggugaaugccaca

SEQ ID NO: 271869 - RNA, 22 nt, Human
cagagggacaguguaaugcaua

SEQ ID NO: 271870 - RNA, 22 nt, Human
auacaaaguauugauccugagu

SEQ ID NO: 271871 - RNA, 22 nt, Human
aaacaauguagauuaccauuua

SEQ ID NO: 271872 - RNA, 22 nt, Human
gcacuuuguggauuguauuucc

SEQ ID NO: 271873 - RNA, 22 nt, Human
ggccagggggcuucagacucca

SEQ ID NO: 271874 - RNA, 19 nt, Human
uguguaaagucugugguca

SEQ ID NO: 271875 - RNA, 22 nt, Human
aagggcuguaguuuguugauca

SEQ ID NO: 271876 - RNA, 22 nt, Human
uguguucauuucucucugcugu

SEQ ID NO: 271877 - RNA, 22 nt, Human
ucucugggaaauggagaauuuu

SEQ ID NO: 271878 - RNA, 22 nt, Human
aggcuguauguuuccauuugaa

SEQ ID NO: 271879 - RNA, 22 nt, Human
uggggaaggcggagcuugcagc

SEQ ID NO: 271880 - RNA, 22 nt, Human
acuccuguguggcugggagguu

SEQ ID NO: 271881 - RNA, 22 nt, Human
caagcauuuauuauaauuauca

SEQ ID NO: 271882 - RNA, 22 nt, Human
gagcagcagcugggccagguuc

SEQ ID NO: 271883 - RNA, 22 nt, Human
ccuggcaggacuguuguaagaa

SEQ ID NO: 271884 - RNA, 22 nt, Human
ccuggcaggccccuccuggauu

SEQ ID NO: 271885 - RNA, 22 nt, Human
cccacuguguugcagucuagug

SEQ ID NO: 271886 - RNA, 22 nt, Human
ccugagagccagugccugccca

SEQ ID NO: 271887 - RNA, 22 nt, Human
uccuaggguuggagacagugac

SEQ ID NO: 271888 - RNA, 22 nt, Human
ucugcugccaccuuguggugag

SEQ ID NO: 271889 - RNA, 23 nt, Human
gcccucaguagaaaauguuagaa

SEQ ID NO: 271890 - RNA, 22 nt, Human
aaaggauuaaauaaaugugcug

SEQ ID NO: 271891 - RNA, 22 nt, Human
ggguccagacuaugaagaacuu

SEQ ID NO: 271892 - RNA, 22 nt, Human
ucaugaaaauagaucagaaauu

SEQ ID NO: 271893 - RNA, 22 nt, Human
agaaagugugucauacuaagug

SEQ ID NO: 271894 - RNA, 22 nt, Human
ugaaggcuuucuccccucuggu

SEQ ID NO: 271895 - RNA, 22 nt, Human
aaugauuggcacuagauacaca

SEQ ID NO: 271896 - RNA, 22 nt, Human
accucaagaauguauaacacag

SEQ ID NO: 271897 - RNA, 22 nt, Human
uauuuguuucuaguggcagcaa

SEQ ID NO: 271898 - RNA, 20 nt, Human
auauguguacguguauacau

SEQ ID NO: 271899 - RNA, 22 nt, Human
ugaagccaaucugccaggcaga

SEQ ID NO: 271900 - RNA, 22 nt, Human
gcccuccuuugcuucuccuagu

SEQ ID NO: 271901 - RNA, 22 nt, Human
aucugcuguucuucacagcuug

SEQ ID NO: 271902 - RNA, 22 nt, Human
ugagcuggcuugucaaccaggg

SEQ ID NO: 271903 - RNA, 22 nt, Human
aguuacagugaccauuuauuua

SEQ ID NO: 271904 - RNA, 22 nt, Human
gcuaggaggaagaaugugaauu

SEQ ID NO: 271905 - RNA, 22 nt, Human
gcaggcaguuauuuaguagaau

SEQ ID NO: 271906 - RNA, 22 nt, Human
cugcugagagccccagcugaga

SEQ ID NO: 271907 - RNA, 22 nt, Human
guaauagucucaaacuccugga

SEQ ID NO: 271908 - RNA, 22 nt, Human
ugaaaaugcacgcuggaaagca

SEQ ID NO: 271909 - RNA, 20 nt, Human
uacaacaaguagagacauac

SEQ ID NO: 271910 - RNA, 22 nt, Human
gguccugcgucuggcucgcccg

SEQ ID NO: 271911 - RNA, 22 nt, Human
ggaggcagaacuucccgucagu

SEQ ID NO: 271912 - RNA, 22 nt, Human
cagggcucacucggcuggcguc

SEQ ID NO: 271913 - RNA, 22 nt, Human
gggagggacacaaagaguuccc

SEQ ID NO: 271914 - RNA, 22 nt, Human
uagauuaagaugccaguuuuga

SEQ ID NO: 271915 - RNA, 19 nt, Human
ugccuggcaccagcuccac

SEQ ID NO: 271916 - RNA, 20 nt, Human
aggugcaagcaguaaauugc

SEQ ID NO: 271917 - RNA, 22 nt, Human
ccaggguugcuguauggcacuu

SEQ ID NO: 271918 - RNA, 22 nt, Human
gcuccaagguauccaccagggu

SEQ ID NO: 271919 - RNA, 22 nt, Human
cuggaggcaguugccccaguca

SEQ ID NO: 271920 - RNA, 16 nt, Human
aggaggggaauuagga

SEQ ID NO: 271921 - RNA, 22 nt, Human
ugaguacugauuuaagauacac

SEQ ID NO: 271922 - RNA, 22 nt, Human
uugaaugaguguuuuacucaug

SEQ ID NO: 271923 - RNA, 22 nt, Human
ccaggcucaggugcgagagaca

SEQ ID NO: 271924 - RNA, 22 nt, Human
agacauagauaggcacugauug

SEQ ID NO: 271925 - RNA, 22 nt, Human
agggcccaugugggagcacuug

SEQ ID NO: 271926 - RNA, 22 nt, Human
uagaggcacagucuauguagag

SEQ ID NO: 271927 - RNA, 22 nt, Human
aggcucagucccggcccgcgcc

SEQ ID NO: 271928 - RNA, 23 nt, Human
gguuccaggaacacagccugaug

SEQ ID NO: 271929 - RNA, 22 nt, Human
cuggcagucugguggaaggccu

SEQ ID NO: 271930 - RNA, 19 nt, Human
cucuggcuccugggcugcc

SEQ ID NO: 271931 - RNA, 22 nt, Human
cucuccaguuauagcugauuug

SEQ ID NO: 271932 - RNA, 22 nt, Human
ugcuuuaaaccauggaugugag

SEQ ID NO: 271933 - RNA, 22 nt, Human
uggaggugagugugguacagca

SEQ ID NO: 271934 - RNA, 22 nt, Human
cugggcucagcaggccaaggcc

SEQ ID NO: 271935 - RNA, 22 nt, Human
ugcugaggucaccuugcugcua

SEQ ID NO: 271936 - RNA, 22 nt, Human
aaguuccugggccaaguccagg

SEQ ID NO: 271937 - RNA, 22 nt, Human
gcagggaccaaaagaggcagua

SEQ ID NO: 271938 - RNA, 22 nt, Human
ucucagacauguaaucucuacc

SEQ ID NO: 271939 - RNA, 22 nt, Human
gggggucccaagcugggcugcu

SEQ ID NO: 271940 - RNA, 22 nt, Human
cuggcuccucaguauuccacuu

SEQ ID NO: 271941 - RNA, 22 nt, Human
aaauagcagccuuuaguuaaca

SEQ ID NO: 271942 - RNA, 22 nt, Human
uccaguguugucagaucaucug

SEQ ID NO: 271943 - RNA, 19 nt, Human
auggaaaauuguacucaau

SEQ ID NO: 271944 - RNA, 22 nt, Human
cuuuacagccuccagaaggaac

SEQ ID NO: 271945 - RNA, 22 nt, Human
cugcucuggggaagccagaugu

SEQ ID NO: 271946 - RNA, 22 nt, Human
gcaggcugcccucuuguguuga

SEQ ID NO: 271947 - RNA, 22 nt, Human
auguaaagggcaugguauuggg

SEQ ID NO: 271948 - RNA, 22 nt, Human
ggaaaucaugggagaguuggaa

SEQ ID NO: 271949 - RNA, 23 nt, Human
ugucaacaaaacuuucaggagaa

SEQ ID NO: 271950 - RNA, 22 nt, Human
agggagaagguccaugccuguc

SEQ ID NO: 271951 - RNA, 22 nt, Human
uaguuuuagcagcaaugggaug

SEQ ID NO: 271952 - RNA, 22 nt, Human
agguccuguuucuucccugggg

SEQ ID NO: 271953 - RNA, 22 nt, Human
uacaugcaugucacagaaugaa

SEQ ID NO: 271954 - RNA, 22 nt, Human
acucucacugcuuggcuccugc

SEQ ID NO: 271955 - RNA, 22 nt, Human
auuuggaagguuuacaaagaga

SEQ ID NO: 271956 - RNA, 18 nt, Human
ucagcuggguuucugggu

SEQ ID NO: 271957 - RNA, 22 nt, Human
uucacauugguucuugauagcu

SEQ ID NO: 271958 - RNA, 19 nt, Human
uaccagccuccugccugau

SEQ ID NO: 271959 - RNA, 22 nt, Human
cagcaggacguccaagugcuau

SEQ ID NO: 271960 - RNA, 22 nt, Human
gagcuugggugccaugcugagc

SEQ ID NO: 271961 - RNA, 22 nt, Human
gaccuccagcggcccugcagag

SEQ ID NO: 271962 - RNA, 22 nt, Human
ugggaaccacaggacucggcac

SEQ ID NO: 271963 - RNA, 22 nt, Human
gauucugagcugguguuuuacg

SEQ ID NO: 271964 - RNA, 22 nt, Human
ucugcuguacuuuuggucuguu

SEQ ID NO: 271965 - RNA, 22 nt, Human
gggagagaugcugauugccaau

SEQ ID NO: 271966 - RNA, 21 nt, Human
aauuacagauggaauuacaga

SEQ ID NO: 271967 - RNA, 22 nt, Human
accuggacaccugcugucaucu

SEQ ID NO: 271968 - RNA, 22 nt, Human
gcaggccugucuugcucgcccu

SEQ ID NO: 271969 - RNA, 22 nt, Human
gggcacagucugcagcccccca

SEQ ID NO: 271970 - RNA, 22 nt, Human
ggaagaggcucucauugagggc

SEQ ID NO: 271971 - RNA, 19 nt, Human
ggaaggagagaaaugcaug

SEQ ID NO: 271972 - RNA, 22 nt, Human
ccugagaguaggugucucuuua

SEQ ID NO: 271973 - RNA, 22 nt, Human
cagugcaauuacaagcuaauuc

SEQ ID NO: 271974 - RNA, 22 nt, Human
agccccagccccucucucacaa

SEQ ID NO: 271975 - RNA, 22 nt, Human
cgacugucauacacaagacaug

SEQ ID NO: 271976 - RNA, 22 nt, Human
guggcuucacauggcauuuggc

SEQ ID NO: 271977 - RNA, 22 nt, Human
caagaugugccuaaucagaccu

SEQ ID NO: 271978 - RNA, 22 nt, Human
cccuguuuggauggggacccag

SEQ ID NO: 271979 - RNA, 22 nt, Human
cuggcccuguggccuaaggacu

SEQ ID NO: 271980 - RNA, 22 nt, Human
gugguaucugucucccccacug

SEQ ID NO: 271981 - RNA, 22 nt, Human
auguaucagaaauagcauuggc

SEQ ID NO: 271982 - RNA, 22 nt, Human
ggcucucuuaacuggccauccu

SEQ ID NO: 271983 - RNA, 22 nt, Human
acuguacauauggauucuaaga

SEQ ID NO: 271984 - RNA, 22 nt, Human
ggcuuggcuugggcucagaggc

SEQ ID NO: 271985 - RNA, 22 nt, Human
cuguggcugcguaggucuggca

SEQ ID NO: 271986 - RNA, 22 nt, Human
uacaaagauaaaaucucaccau

SEQ ID NO: 271987 - RNA, 22 nt, Human
gccaggcucagcagucaaccug

SEQ ID NO: 271988 - RNA, 22 nt, Human
ucuggcccagccccugauccca

SEQ ID NO: 271989 - RNA, 22 nt, Human
agguacagggugaaaguuuaug

SEQ ID NO: 271990 - RNA, 22 nt, Human
acagguguuuuggaggaugauu

SEQ ID NO: 271991 - RNA, 21 nt, Human
agagucugcauuucugacaag

SEQ ID NO: 271992 - RNA, 22 nt, Human
uuucuguaauuggccaagucac

SEQ ID NO: 271993 - RNA, 21 nt, Human
uagggcucucugugucaggug

SEQ ID NO: 271994 - RNA, 22 nt, Human
uuggcugcuauuuccauauuua

SEQ ID NO: 271995 - RNA, 22 nt, Human
cuguuuauugagcaaucugcca

SEQ ID NO: 271996 - RNA, 22 nt, Human
gcccugcucuggucucugcccg

SEQ ID NO: 271997 - RNA, 22 nt, Human
ucucugagaagcugaggcuggg

SEQ ID NO: 271998 - RNA, 22 nt, Human
gauugcuguucccagggggcug

SEQ ID NO: 271999 - RNA, 22 nt, Human
auguagaguagaauaguacaac

SEQ ID NO: 272000 - RNA, 22 nt, Human
uugcacagugguuuagagccug

SEQ ID NO: 272001 - RNA, 22 nt, Human
uaucuagauggauuuuagugaa

SEQ ID NO: 272002 - RNA, 22 nt, Human
uauguaaaggauugagaugaau

SEQ ID NO: 272003 - RNA, 22 nt, Human
aaauugugagcuauagaucuag

SEQ ID NO: 272004 - RNA, 22 nt, Human
cuucucugucacaggguuacgu

SEQ ID NO: 272005 - RNA, 23 nt, Human
cuguuaaauuccuuaagagcagg

SEQ ID NO: 272006 - RNA, 23 nt, Human
acaagauagggauaaaaagauaa

SEQ ID NO: 272007 - RNA, 22 nt, Human
uugaaacuaugaagacaaccau

SEQ ID NO: 272008 - RNA, 22 nt, Human
auuaggugggguuguuacuguu

SEQ ID NO: 272009 - RNA, 22 nt, Human
caggaaauaaaaaguaucuucu

SEQ ID NO: 272010 - RNA, 22 nt, Human
guagcuucaaguacucucccug

SEQ ID NO: 272011 - RNA, 22 nt, Human
uuccuuucccucacagccucgg

SEQ ID NO: 272012 - RNA, 22 nt, Human
ggugggucuuguggggcagcuu

SEQ ID NO: 272013 - RNA, 22 nt, Human
uggagcagaggcugagguuggg

SEQ ID NO: 272014 - RNA, 22 nt, Human
aauguacacugaaagccuauca

SEQ ID NO: 272015 - RNA, 22 nt, Human
gggaacagcauaucugaagggu

SEQ ID NO: 272016 - RNA, 18 nt, Human
aggucaggaaagcagagu

SEQ ID NO: 272017 - RNA, 22 nt, Human
uggcaguuuacagaguucugaa

SEQ ID NO: 272018 - RNA, 22 nt, Human
ggucuggauuucugcuucuuuc

SEQ ID NO: 272019 - RNA, 22 nt, Human
cugagcugggcaacucuuagau

SEQ ID NO: 272020 - RNA, 22 nt, Human
agaggccaccuucucuugagaa

SEQ ID NO: 272021 - RNA, 22 nt, Human
uuacaaacaacagacauuuauu

SEQ ID NO: 272022 - RNA, 22 nt, Human
ucucuuuaaagacucagagauu

SEQ ID NO: 272023 - RNA, 22 nt, Human
ucuagacaaugcacuguaagga

SEQ ID NO: 272024 - RNA, 22 nt, Human
cacacgaugugaauucuugccc

SEQ ID NO: 272025 - RNA, 22 nt, Human
uggguccugcacugcaagcacc

SEQ ID NO: 272026 - RNA, 22 nt, Human
cacagcauucacagaaagacau

SEQ ID NO: 272027 - RNA, 22 nt, Human
caauauagagagaaaauuaugu

SEQ ID NO: 272028 - RNA, 21 nt, Human
ucaggcugucugcugguucca

SEQ ID NO: 272029 - RNA, 19 nt, Human
aaggcuggagaaggccucu

SEQ ID NO: 272030 - RNA, 22 nt, Human
gaaggcuugccgggaagcggca

SEQ ID NO: 272031 - RNA, 23 nt, Human
auguaaacuucagagucauugcc

SEQ ID NO: 272032 - RNA, 22 nt, Human
cauuaucugccauugacaccau

SEQ ID NO: 272033 - RNA, 22 nt, Human
uccuggcucaggccccuggugc

SEQ ID NO: 272034 - RNA, 22 nt, Human
gcugccaguguggcaugaugca

SEQ ID NO: 272035 - RNA, 22 nt, Human
uucaguuuccacuuacauuuaa

SEQ ID NO: 272036 - RNA, 22 nt, Human
uuauuguaggccuauuguagaa

SEQ ID NO: 272037 - RNA, 22 nt, Human
cuggaaggucuguccccacugc

SEQ ID NO: 272038 - RNA, 22 nt, Human
agcauuuaggagaauuugagaa

SEQ ID NO: 272039 - RNA, 22 nt, Human
gcagacaggcccaguggaggga

SEQ ID NO: 272040 - RNA, 22 nt, Human
uuggagagaggcugcucaggcu

SEQ ID NO: 272041 - RNA, 22 nt, Human
augcaaaauaaggcagaaacau

SEQ ID NO: 272042 - RNA, 22 nt, Human
gaugcacagugacccugccagu

SEQ ID NO: 272043 - RNA, 22 nt, Human
uguauuagguugaugcgaaagu

SEQ ID NO: 272044 - RNA, 22 nt, Human
gccuguuuaaguauucugacau

SEQ ID NO: 272045 - RNA, 22 nt, Human
cugaggccgucugggucugcag

SEQ ID NO: 272046 - RNA, 22 nt, Human
agccagaggaacuugaugacug

SEQ ID NO: 272047 - RNA, 20 nt, Human
agcuggagaagggcccuucc

SEQ ID NO: 272048 - RNA, 23 nt, Human
agcaacagugggugaguguugcu

SEQ ID NO: 272049 - RNA, 22 nt, Human
ugacauguauguauuuguuuau

SEQ ID NO: 272050 - RNA, 22 nt, Human
aaugcuggaagccucaguagau

SEQ ID NO: 272051 - RNA, 22 nt, Human
agaaggccagauggacggggcu

SEQ ID NO: 272052 - RNA, 22 nt, Human
cucugugauucucauguaccac

SEQ ID NO: 272053 - RNA, 21 nt, Human
ucaugcaggcagaguuuggua

SEQ ID NO: 272054 - RNA, 22 nt, Human
agucccagcuacucaagaggcu

SEQ ID NO: 272055 - RNA, 20 nt, Human
aacuuucucccauuggacug

SEQ ID NO: 272056 - RNA, 22 nt, Human
aaacaguuucauuuucaugacc

SEQ ID NO: 272057 - RNA, 22 nt, Human
uuggcagagggaccagccuaca

SEQ ID NO: 272058 - RNA, 22 nt, Human
uuugaguugcuuauuuaauagg

SEQ ID NO: 272059 - RNA, 22 nt, Human
ggucccaguccucucccugcua

SEQ ID NO: 272060 - RNA, 22 nt, Human
uccucacagggcaggaaggagg

SEQ ID NO: 272061 - RNA, 18 nt, Human
auccugggagcagacagc

SEQ ID NO: 272062 - RNA, 22 nt, Human
aaggaugaacauuaauacauca

SEQ ID NO: 272063 - RNA, 22 nt, Human
gggcuccagaguccauguucuu

SEQ ID NO: 272064 - RNA, 22 nt, Human
gggaaggccgguccagucaggu

SEQ ID NO: 272065 - RNA, 22 nt, Human
agcuucucagaagaguccugua

SEQ ID NO: 272066 - RNA, 22 nt, Human
ucucucuugucaccccaucugc

SEQ ID NO: 272067 - RNA, 22 nt, Human
acucugggaauccucaccuucc

SEQ ID NO: 272068 - RNA, 22 nt, Human
ugaaugauguauaauauugaga

SEQ ID NO: 272069 - RNA, 22 nt, Human
ucugagaaauuucuuugugaug

SEQ ID NO: 272070 - RNA, 22 nt, Human
auggccagcucagagcacucag

SEQ ID NO: 272071 - RNA, 22 nt, Human
ugcagagagauauggcaagagg

SEQ ID NO: 272072 - RNA, 22 nt, Human
ucucugagaaguuccuuuguga

SEQ ID NO: 272073 - RNA, 22 nt, Human
agaaggcuggcccuggguggcc

SEQ ID NO: 272074 - RNA, 22 nt, Human
gacuuuauucguuaacuguuaa

SEQ ID NO: 272075 - RNA, 22 nt, Human
uuuucauuagaaugacugagaa

SEQ ID NO: 272076 - RNA, 22 nt, Human
ucagaacagaagaaggaacacg

SEQ ID NO: 272077 - RNA, 21 nt, Human
gccugcccucugugauggcca

SEQ ID NO: 272078 - RNA, 22 nt, Human
cuuagaaugggacccaaugggu

SEQ ID NO: 272079 - RNA, 22 nt, Human
aacaugcaugaagaaguuauau

SEQ ID NO: 272080 - RNA, 22 nt, Human
agucacaguuucccugagagag

SEQ ID NO: 272081 - RNA, 22 nt, Human
cauuuacuguugaaucccuagc

SEQ ID NO: 272082 - RNA, 22 nt, Human
auacagagcaguaauagaggag

SEQ ID NO: 272083 - RNA, 22 nt, Human
ggaggauuugucaucugaagau

SEQ ID NO: 272084 - RNA, 22 nt, Human
acagacauuuucuguauugccu

SEQ ID NO: 272085 - RNA, 22 nt, Human
uauacagaaccgccugaagucu

SEQ ID NO: 272086 - RNA, 22 nt, Human
auuagacaucauaugauucagc

SEQ ID NO: 272087 - RNA, 22 nt, Human
gcaugugugucacuuuccugcc

SEQ ID NO: 272088 - RNA, 22 nt, Human
acuugggagggugugggcagcu

SEQ ID NO: 272089 - RNA, 22 nt, Human
gccagcugaggccgugcaggcu

SEQ ID NO: 272090 - RNA, 22 nt, Human
uuuacagucuauguugaauuaa

SEQ ID NO: 272091 - RNA, 22 nt, Human
cacacgugugagagcuguggca

SEQ ID NO: 272092 - RNA, 22 nt, Human
gcaguccuccugccucagccuc

SEQ ID NO: 272093 - RNA, 22 nt, Human
cucuggaguuagugaucugggc

SEQ ID NO: 272094 - RNA, 22 nt, Human
ccacaguagcauccaaacagua

SEQ ID NO: 272095 - RNA, 23 nt, Human
ucucaaauaugaucugggucauc

SEQ ID NO: 272096 - RNA, 22 nt, Human
uauacaauggcugaaucaucca

SEQ ID NO: 272097 - RNA, 21 nt, Human
ucacaacuuugaauuucaaua

SEQ ID NO: 272098 - RNA, 20 nt, Human
agaagcugauacugauggaa

SEQ ID NO: 272099 - RNA, 22 nt, Human
cacagugcaugaugggcagaag

SEQ ID NO: 272100 - RNA, 22 nt, Human
ccuucugauacugacaucauuu

SEQ ID NO: 272101 - RNA, 22 nt, Human
aaaaguguucaggaagaauaau

SEQ ID NO: 272102 - RNA, 21 nt, Human
uacuguagccuugcacuguag

SEQ ID NO: 272103 - RNA, 22 nt, Human
gacaccagagacugaugaggcc

SEQ ID NO: 272104 - RNA, 22 nt, Human
agaugguccaugcacagauaug

SEQ ID NO: 272105 - RNA, 22 nt, Human
cugccccugccaggcagcuguc

SEQ ID NO: 272106 - RNA, 22 nt, Human
cacacacaguuuuguauucugu

SEQ ID NO: 272107 - RNA, 22 nt, Human
aguacugucagcaggguguuga

SEQ ID NO: 272108 - RNA, 22 nt, Human
ucaaucaaagcacugggcuuug

SEQ ID NO: 272109 - RNA, 17 nt, Human
agugucagggcccuucc

SEQ ID NO: 272110 - RNA, 22 nt, Human
gccaggaccucagaugcagggc

SEQ ID NO: 272111 - RNA, 22 nt, Human
uaacaaacuggaaauugacauu

SEQ ID NO: 272112 - RNA, 22 nt, Human
aacuggaaugaaauuuacgaug

SEQ ID NO: 272113 - RNA, 22 nt, Human
gugcaaaaguaacugugguuuu

SEQ ID NO: 272114 - RNA, 22 nt, Human
guauuagacugagaaauggagu

SEQ ID NO: 272115 - RNA, 22 nt, Human
ucagcaggcgguuccuuguggg

SEQ ID NO: 272116 - RNA, 17 nt, Human
acagagcuacauauucu

SEQ ID NO: 272117 - RNA, 22 nt, Human
aacuccuuaaugcauuucagag

SEQ ID NO: 272118 - RNA, 22 nt, Human
cugggccuucauugcucuccca

SEQ ID NO: 272119 - RNA, 22 nt, Human
aacaggcuucuucugggcuccu

SEQ ID NO: 272120 - RNA, 22 nt, Human
uucucaacucucaagagaagcu

SEQ ID NO: 272121 - RNA, 21 nt, Human
cucugcagcccugcuuccagg

SEQ ID NO: 272122 - RNA, 22 nt, Human
uggaguugcagcuaccagacau

SEQ ID NO: 272123 - RNA, 22 nt, Human
auccucaguguuucugacaucu

SEQ ID NO: 272124 - RNA, 22 nt, Human
uggcucugggaaucuguugcuu

SEQ ID NO: 272125 - RNA, 22 nt, Human
caggcagggagcuggaaaggau

SEQ ID NO: 272126 - RNA, 22 nt, Human
gagccugaugaaacaggcagac

SEQ ID NO: 272127 - RNA, 22 nt, Human
auggcucucuagggcccagguu

SEQ ID NO: 272128 - RNA, 22 nt, Human
acaugccaagauccucgucuuu

SEQ ID NO: 272129 - RNA, 22 nt, Human
aaaaguuaccucuguaauauaa

SEQ ID NO: 272130 - RNA, 22 nt, Human
aaggcauuaugauuugaguacc

SEQ ID NO: 272131 - RNA, 22 nt, Human
gaagcaguucgaaagcaguugg

SEQ ID NO: 272132 - RNA, 22 nt, Human
auuagagcaguguauuaugaua

SEQ ID NO: 272133 - RNA, 20 nt, Human
uauuaugaccuguguucugg

SEQ ID NO: 272134 - RNA, 22 nt, Human
aagcucagcaugucuccuagaa

SEQ ID NO: 272135 - RNA, 20 nt, Human
acaaaugcauucugugacau

SEQ ID NO: 272136 - RNA, 22 nt, Human
cucaccccuguaauuccagcac

SEQ ID NO: 272137 - RNA, 22 nt, Human
agaaaagugcucuagugagagc

SEQ ID NO: 272138 - RNA, 22 nt, Human
gauuuuacaugucauaucuauu

SEQ ID NO: 272139 - RNA, 17 nt, Human
uuaguguaucuguuuug

SEQ ID NO: 272140 - RNA, 22 nt, Human
gauggacaccuccugagguucu

SEQ ID NO: 272141 - RNA, 22 nt, Human
ggagucugagcuuguguccugg

SEQ ID NO: 272142 - RNA, 22 nt, Human
aaagccauugcagagcaggauu

SEQ ID NO: 272143 - RNA, 18 nt, Human
ggauaggaccuuaggcag

SEQ ID NO: 272144 - RNA, 22 nt, Human
uugcaaauaaacaaguauacau

SEQ ID NO: 272145 - RNA, 23 nt, Human
cauuagaagguagaguggaauga

SEQ ID NO: 272146 - RNA, 22 nt, Human
caagcagagacuagauagcugu

SEQ ID NO: 272147 - RNA, 22 nt, Human
auaagccugauucacuugucau

SEQ ID NO: 272148 - RNA, 22 nt, Human
uucaguaugauuccuccaguag

SEQ ID NO: 272149 - RNA, 22 nt, Human
ucuccugguacccuuccuagca

SEQ ID NO: 272150 - RNA, 22 nt, Human
uuguuagugcaauguuugguga

SEQ ID NO: 272151 - RNA, 22 nt, Human
acagguggaggcuuuaggaggu

SEQ ID NO: 272152 - RNA, 20 nt, Human
uggcuucucuucacuccugu

SEQ ID NO: 272153 - RNA, 22 nt, Human
caggcugcugacaggcuuggag

SEQ ID NO: 272154 - RNA, 22 nt, Human
acaaucacacaugcaauuauac

SEQ ID NO: 272155 - RNA, 22 nt, Human
ucugaaauggcgauggccguug

SEQ ID NO: 272156 - RNA, 22 nt, Human
ucuggcuagauugaugaguccc

SEQ ID NO: 272157 - RNA, 22 nt, Human
acacaguucaggaucaaauagc

SEQ ID NO: 272158 - RNA, 22 nt, Human
cuggcuguguccacagaguaag

SEQ ID NO: 272159 - RNA, 22 nt, Human
aauuagagaucgcaauaacggg

SEQ ID NO: 272160 - RNA, 22 nt, Human
gcuccuggagagauugagaaag

SEQ ID NO: 272161 - RNA, 22 nt, Human
gccaguggguaguuggagcugg

SEQ ID NO: 272162 - RNA, 22 nt, Human
uccaggccccugccugggccug

SEQ ID NO: 272163 - RNA, 22 nt, Human
cagaaagcgggaugcagcaugu

SEQ ID NO: 272164 - RNA, 22 nt, Human
acucugggcuguuaggagcugu

SEQ ID NO: 272165 - RNA, 22 nt, Human
cugugccauccuagggcugcug

SEQ ID NO: 272166 - RNA, 22 nt, Human
aguuauauaacuaucuagaugc

SEQ ID NO: 272167 - RNA, 22 nt, Human
gggcugaggcuaccacuggucu

SEQ ID NO: 272168 - RNA, 22 nt, Human
auguacauuuguaguaauauca

SEQ ID NO: 272169 - RNA, 22 nt, Human
uuuggaagacagggcaggaaag

SEQ ID NO: 272170 - RNA, 22 nt, Human
agugcauuugggguaguggaag

SEQ ID NO: 272171 - RNA, 22 nt, Human
uggaucugacuggcuuuucuuc

SEQ ID NO: 272172 - RNA, 22 nt, Human
aaucuuuaaggacucagucucu

SEQ ID NO: 272173 - RNA, 22 nt, Human
aagucucuaagacugugccauc

SEQ ID NO: 272174 - RNA, 22 nt, Human
gucaacaaguaguuuucuucca

SEQ ID NO: 272175 - RNA, 22 nt, Human
uucaguguucuuuucuguuagc

SEQ ID NO: 272176 - RNA, 22 nt, Human
ucugugugcccuaaagccugcu

SEQ ID NO: 272177 - RNA, 22 nt, Human
ucaacguuuguuaaaugaguau

SEQ ID NO: 272178 - RNA, 22 nt, Human
aucuguggccaaaagacuguug

SEQ ID NO: 272179 - RNA, 22 nt, Human
agcacuuugugcauuucugaag

SEQ ID NO: 272180 - RNA, 22 nt, Human
uguggaaggggccccaugacca

SEQ ID NO: 272181 - RNA, 22 nt, Human
ugucaggagccaccagcacucc

SEQ ID NO: 272182 - RNA, 22 nt, Human
ccuggcucugggaucuucgcuu

SEQ ID NO: 272183 - RNA, 22 nt, Human
aagcacuaauauuuuggcaccu

SEQ ID NO: 272184 - RNA, 22 nt, Human
auacaugaggcucauuuauguc

SEQ ID NO: 272185 - RNA, 21 nt, Human
uuuguucauagcucacucuuu

SEQ ID NO: 272186 - RNA, 22 nt, Human
gauuguaauuuucaagagguaa

SEQ ID NO: 272187 - RNA, 22 nt, Human
aggcacagauuuggggaaagca

SEQ ID NO: 272188 - RNA, 22 nt, Human
uggcagguacccauuggcugua

SEQ ID NO: 272189 - RNA, 22 nt, Human
aagaguuugaccugugccaucc

SEQ ID NO: 272190 - RNA, 22 nt, Human
auuuccaugccuuagcuuaagg

SEQ ID NO: 272191 - RNA, 22 nt, Human
cuggggaccgagcaagcucugg

SEQ ID NO: 272192 - RNA, 22 nt, Human
cugauagacaaucaccauggga

SEQ ID NO: 272193 - RNA, 22 nt, Human
gggcagguacaagaugcuucuu

SEQ ID NO: 272194 - RNA, 19 nt, Human
uucacaauuaugaaauuag

SEQ ID NO: 272195 - RNA, 22 nt, Human
uccugaggugcucagccaggaa

SEQ ID NO: 272196 - RNA, 22 nt, Human
auaaauuaugaauggcccuuuu

SEQ ID NO: 272197 - RNA, 23 nt, Human
accagcugcccugaacuuugugc

SEQ ID NO: 272198 - RNA, 22 nt, Human
ugucucagaguaucccugaacu

SEQ ID NO: 272199 - RNA, 22 nt, Human
uaggcucccagaucguuugcug

SEQ ID NO: 272200 - RNA, 19 nt, Human
uuaaagugcgagaagucuu

SEQ ID NO: 272201 - RNA, 22 nt, Human
ucucaaauucccuuuuccuccu

SEQ ID NO: 272202 - RNA, 22 nt, Human
ggacaggcgcagggccaaggaa

SEQ ID NO: 272203 - RNA, 22 nt, Human
gauauuuugagaaauccuauga

SEQ ID NO: 272204 - RNA, 22 nt, Human
cuguuauuugagaguguugaau

SEQ ID NO: 272205 - RNA, 22 nt, Human
ccuuaaacuuuaucuugugaga

SEQ ID NO: 272206 - RNA, 22 nt, Human
auaaagcaaauaggacuauugc

SEQ ID NO: 272207 - RNA, 22 nt, Human
cuggagccccagacagggagag

SEQ ID NO: 272208 - RNA, 22 nt, Human
ucugcccucauugcugccugga

SEQ ID NO: 272209 - RNA, 22 nt, Human
aucacaaaggucucagagcaca

SEQ ID NO: 272210 - RNA, 22 nt, Human
uaggugucuguccugggcugug

SEQ ID NO: 272211 - RNA, 22 nt, Human
agaaauacaaaguacuaagaua

SEQ ID NO: 272212 - RNA, 22 nt, Human
gacuuucuuaggcccccuaaua

SEQ ID NO: 272213 - RNA, 22 nt, Human
cuggacaaccacucagccucag

SEQ ID NO: 272214 - RNA, 22 nt, Human
gaagagccaggugucgcugugg

SEQ ID NO: 272215 - RNA, 22 nt, Human
uccugauggaggggucaucuuu

SEQ ID NO: 272216 - RNA, 22 nt, Human
ccugggcuccacuccaagagca

SEQ ID NO: 272217 - RNA, 22 nt, Human
uuuaacagaugugaaauuuuca

SEQ ID NO: 272218 - RNA, 23 nt, Human
auguuauuauuagcagucuugcc

SEQ ID NO: 272219 - RNA, 22 nt, Human
uucaggagaaaguucaguacuu

SEQ ID NO: 272220 - RNA, 22 nt, Human
aaaagagagcugaggagcucca

SEQ ID NO: 272221 - RNA, 22 nt, Human
ccuaauuaucucccaaagaucc

SEQ ID NO: 272222 - RNA, 22 nt, Human
cagcaggcagccauuucacugu

SEQ ID NO: 272223 - RNA, 22 nt, Human
aguccagggcuuagucagcggg

SEQ ID NO: 272224 - RNA, 22 nt, Human
gugggaguggagcucagcaugu

SEQ ID NO: 272225 - RNA, 21 nt, Human
ccuuuagauuucuaugcaguu

SEQ ID NO: 272226 - RNA, 22 nt, Human
gcagggacaaggcagguguucu

SEQ ID NO: 272227 - RNA, 22 nt, Human
ugaaagcacaaguucuaacagg

SEQ ID NO: 272228 - RNA, 22 nt, Human
cuggcaggagcauucacagagg

SEQ ID NO: 272229 - RNA, 22 nt, Human
uucuagaauccuugucuacuuu

SEQ ID NO: 272230 - RNA, 22 nt, Human
cagcagccugccuugggagcuu

SEQ ID NO: 272231 - RNA, 22 nt, Human
gguggcugaaucaaaucaggcc

SEQ ID NO: 272232 - RNA, 22 nt, Human
agagcugucacauagagccaga

SEQ ID NO: 272233 - RNA, 22 nt, Human
agcagcaggauuuucguuggga

SEQ ID NO: 272234 - RNA, 22 nt, Human
ggccuuggguauagguggguau

SEQ ID NO: 272235 - RNA, 22 nt, Human
agcuccagcccaucugcucgug

SEQ ID NO: 272236 - RNA, 22 nt, Human
cuugaaugggccauaagacggu

SEQ ID NO: 272237 - RNA, 20 nt, Human
aggcugccuaaggcucugca

SEQ ID NO: 272238 - RNA, 22 nt, Human
uccaguccauggccucagucuu

SEQ ID NO: 272239 - RNA, 22 nt, Human
guggcuuccaagacuaagucac

SEQ ID NO: 272240 - RNA, 22 nt, Human
cuuugaauuccaguacaauaac

SEQ ID NO: 272241 - RNA, 22 nt, Human
uggcagauucugguugauacuu

SEQ ID NO: 272242 - RNA, 22 nt, Human
acauugaagcugugaaaucaaa

SEQ ID NO: 272243 - RNA, 22 nt, Human
ugcaucuuucugcauauguaaa

SEQ ID NO: 272244 - RNA, 22 nt, Human
uuggaaggcugaauggccucuc

SEQ ID NO: 272245 - RNA, 22 nt, Human
ccagccagggaaacuuuuucuu

SEQ ID NO: 272246 - RNA, 22 nt, Human
uccagugcuggaccagagcacc

SEQ ID NO: 272247 - RNA, 22 nt, Human
auuaaagugaaguucucagaug

SEQ ID NO: 272248 - RNA, 22 nt, Human
cuucccagaccuuagagugcag

SEQ ID NO: 272249 - RNA, 22 nt, Human
caucaucugugcuggagagccu

SEQ ID NO: 272250 - RNA, 22 nt, Human
caggaaacauucccauaacaca

SEQ ID NO: 272251 - RNA, 22 nt, Human
uggaaacacccacgcaugcaua

SEQ ID NO: 272252 - RNA, 22 nt, Human
gguuggggcgagcuggaggccc

SEQ ID NO: 272253 - RNA, 22 nt, Human
uaagcuggggcuaugcuaaaua

SEQ ID NO: 272254 - RNA, 22 nt, Human
cacacagguauauauauguaca

SEQ ID NO: 272255 - RNA, 22 nt, Human
aacaagucuuugguuuuggcua

SEQ ID NO: 272256 - RNA, 22 nt, Human
cuggggaauagagcuggagacc

SEQ ID NO: 272257 - RNA, 22 nt, Human
auuggucuaggcuuuaaaaaga

SEQ ID NO: 272258 - RNA, 18 nt, Human
uggcaggggcaguacgcc

SEQ ID NO: 272259 - RNA, 22 nt, Human
gaaaugcauggaucuuggcaga

SEQ ID NO: 272260 - RNA, 22 nt, Human
cccagagcugggugggcagcgg

SEQ ID NO: 272261 - RNA, 22 nt, Human
ucugagagccacugaacagcaa

SEQ ID NO: 272262 - RNA, 22 nt, Human
cuggcaggcaaauuggugggag

SEQ ID NO: 272263 - RNA, 22 nt, Human
ugcccugccaagacucaguggu

SEQ ID NO: 272264 - RNA, 22 nt, Human
ugagucugcuccugguagcaga

SEQ ID NO: 272265 - RNA, 22 nt, Human
caggauggucuucauuuggcuc

SEQ ID NO: 272266 - RNA, 22 nt, Human
uugugcaauuuaaaaucuuccu

SEQ ID NO: 272267 - RNA, 22 nt, Human
gcagcagcggggccccugcgcg

SEQ ID NO: 272268 - RNA, 22 nt, Human
gguggcuggaggagcugaugga

SEQ ID NO: 272269 - RNA, 22 nt, Human
aagggcugcauuugauguguca

SEQ ID NO: 272270 - RNA, 22 nt, Human
ucuuccuggcauugaugcugca

SEQ ID NO: 272271 - RNA, 22 nt, Human
aguguggaccuucacacagaga

SEQ ID NO: 272272 - RNA, 22 nt, Human
guaacacuggcaccgucucaca

SEQ ID NO: 272273 - RNA, 22 nt, Human
uuccaggcuucucuggggcguc

SEQ ID NO: 272274 - RNA, 22 nt, Human
cucugagcuuugcagccccugg

SEQ ID NO: 272275 - RNA, 22 nt, Human
aagcagacagagaauggguuug

SEQ ID NO: 272276 - RNA, 22 nt, Human
uugauucagagaagauuggccc

SEQ ID NO: 272277 - RNA, 22 nt, Human
guuaauacaaccaugaucuucu

SEQ ID NO: 272278 - RNA, 22 nt, Human
cuauuagacacaauuagugauu

SEQ ID NO: 272279 - RNA, 22 nt, Human
aaacaguauuaucaauauauuu

SEQ ID NO: 272280 - RNA, 22 nt, Human
acaggaagaaagugcaguagau

SEQ ID NO: 272281 - RNA, 22 nt, Human
cagcaggucuuguugcugcuga

SEQ ID NO: 272282 - RNA, 22 nt, Human
uggagagaugucuguucaaggu

SEQ ID NO: 272283 - RNA, 22 nt, Human
cccagagguuccuuagggacca

SEQ ID NO: 272284 - RNA, 20 nt, Human
ucaaagcaaagggagaugau

SEQ ID NO: 272285 - RNA, 22 nt, Human
ggcuccagcccuggcucuucac

SEQ ID NO: 272286 - RNA, 16 nt, Human
gcagguggaucaccug

SEQ ID NO: 272287 - RNA, 22 nt, Human
agcccaggagccuuuggagggu

SEQ ID NO: 272288 - RNA, 20 nt, Human
uucuaaacuguuaggcuugc

SEQ ID NO: 272289 - RNA, 22 nt, Human
auuaguguacaucucacacgca

SEQ ID NO: 272290 - RNA, 20 nt, Human
aggcccagugaauauauugc

SEQ ID NO: 272291 - RNA, 22 nt, Human
gacauuaauggcaaauuaauua

SEQ ID NO: 272292 - RNA, 22 nt, Human
ucaaaggcgguccaggaauaaa

SEQ ID NO: 272293 - RNA, 22 nt, Human
cuagagaaaaugauagcaggaa

SEQ ID NO: 272294 - RNA, 22 nt, Human
uguguccuucugggagucccag

SEQ ID NO: 272295 - RNA, 22 nt, Human
ccucaugcugcaucucugaggu

SEQ ID NO: 272296 - RNA, 22 nt, Human
gcugucaccaaagcaggcacug

SEQ ID NO: 272297 - RNA, 22 nt, Human
ugaaucaauaguugcaaguauu

SEQ ID NO: 272298 - RNA, 22 nt, Human
gccuuccuuuuaccaccagcca

SEQ ID NO: 272299 - RNA, 22 nt, Human
gcagcccaggucucucucacuc

SEQ ID NO: 272300 - RNA, 21 nt, Human
auaaagacaaacacuauuugg

SEQ ID NO: 272301 - RNA, 22 nt, Human
agcuguuuccauaaaugagaca

SEQ ID NO: 272302 - RNA, 22 nt, Human
caggcauuguucuagguucuca

SEQ ID NO: 272303 - RNA, 22 nt, Human
uguccugggucccugcuagaag

SEQ ID NO: 272304 - RNA, 20 nt, Human
cuggaguguagcaguggcug

SEQ ID NO: 272305 - RNA, 22 nt, Human
augaaacucuaacuuaacaagu

SEQ ID NO: 272306 - RNA, 22 nt, Human
auauuaauuauuuacacaugag

SEQ ID NO: 272307 - RNA, 22 nt, Human
auucucuguggugaugcuggug

SEQ ID NO: 272308 - RNA, 22 nt, Human
agcaagcagaauucuguccucu

SEQ ID NO: 272309 - RNA, 22 nt, Human
cucguugcugaagccaaaguca

SEQ ID NO: 272310 - RNA, 22 nt, Human
gggagcuggaugauugaggcaa

SEQ ID NO: 272311 - RNA, 22 nt, Human
ucucagaaaaacuuugagggua

SEQ ID NO: 272312 - RNA, 22 nt, Human
acugccuuccaccuauggauga

SEQ ID NO: 272313 - RNA, 22 nt, Human
uuuaaaaaacuagucugagucu

SEQ ID NO: 272314 - RNA, 22 nt, Human
uugaacauaaaucacuggucag

SEQ ID NO: 272315 - RNA, 22 nt, Human
ugcacuuugcaggcauggaaac

SEQ ID NO: 272316 - RNA, 22 nt, Human
uucaauucugaugaaggcaaua

SEQ ID NO: 272317 - RNA, 20 nt, Human
agcuccugguauaggugccu

SEQ ID NO: 272318 - RNA, 22 nt, Human
guugagaguuaagcgggcuaau

SEQ ID NO: 272319 - RNA, 22 nt, Human
uugaucaaaucagcuacugagg

SEQ ID NO: 272320 - RNA, 22 nt, Human
aauguauuccucaugcaagagu

SEQ ID NO: 272321 - RNA, 23 nt, Human
aagaacuuugguccugcagaguc

SEQ ID NO: 272322 - RNA, 22 nt, Human
ccugguccuuacgucauugcuu

SEQ ID NO: 272323 - RNA, 22 nt, Human
gcagagcccuggggguauggug

SEQ ID NO: 272324 - RNA, 22 nt, Human
guccaggccccagggauucuug

SEQ ID NO: 272325 - RNA, 22 nt, Human
cugguccucuccagcaggcauu

SEQ ID NO: 272326 - RNA, 22 nt, Human
uugagacacuuugggcaucacu

SEQ ID NO: 272327 - RNA, 17 nt, Human
auacauuguuaaaguau

SEQ ID NO: 272328 - RNA, 22 nt, Human
cccagcaggucggugcugccug

SEQ ID NO: 272329 - RNA, 22 nt, Human
cccugcuaguugucucagugau

SEQ ID NO: 272330 - RNA, 22 nt, Human
uuuuucugagaauaugagagga

SEQ ID NO: 272331 - RNA, 22 nt, Human
agguucuguuuggcugaggauc

SEQ ID NO: 272332 - RNA, 22 nt, Human
augaccagccgagauaaacaga

SEQ ID NO: 272333 - RNA, 22 nt, Human
gcuggagugcaguugcacaguc

SEQ ID NO: 272334 - RNA, 22 nt, Human
cugggucucuuaccaugugacu

SEQ ID NO: 272335 - RNA, 22 nt, Human
cugcagccacgagucacagccc

SEQ ID NO: 272336 - RNA, 22 nt, Human
ccugggaagaccggcagugggg

SEQ ID NO: 272337 - RNA, 22 nt, Human
ugcucaggaggaggcugugagg

SEQ ID NO: 272338 - RNA, 22 nt, Human
aaggcucuggguuucauaggug

SEQ ID NO: 272339 - RNA, 22 nt, Human
ucagcaggcacaccaaaaacug

SEQ ID NO: 272340 - RNA, 22 nt, Human
uauauuuaauccuagagccauu

SEQ ID NO: 272341 - RNA, 22 nt, Human
ugaauauggcaacucuuguaac

SEQ ID NO: 272342 - RNA, 21 nt, Human
ucugcccuccaggagcucaua

SEQ ID NO: 272343 - RNA, 22 nt, Human
uucugggagauucauaugaaaa

SEQ ID NO: 272344 - RNA, 21 nt, Human
cugcccauuugugaugucccc

SEQ ID NO: 272345 - RNA, 22 nt, Human
aaacuaaaccuggcuuaguaag

SEQ ID NO: 272346 - RNA, 22 nt, Human
uccuaggcaguuggugcuccau

SEQ ID NO: 272347 - RNA, 20 nt, Human
cuggcuggaaacuuagccuu

SEQ ID NO: 272348 - RNA, 18 nt, Human
cagcugccagcucaugga

SEQ ID NO: 272349 - RNA, 22 nt, Human
uggaagccaaggucagaaggag

SEQ ID NO: 272350 - RNA, 22 nt, Human
acuggcagagggaaaaccauuc

SEQ ID NO: 272351 - RNA, 22 nt, Human
uugcuuuaacuaguaaaugggg

SEQ ID NO: 272352 - RNA, 22 nt, Human
guuacaaauguaaauucugggg

SEQ ID NO: 272353 - RNA, 22 nt, Human
cauuuugugcuagacacuaugg

SEQ ID NO: 272354 - RNA, 22 nt, Human
aggaagagcuggaccagaggac

SEQ ID NO: 272355 - RNA, 22 nt, Human
uagaaaucagguuuuuagaaag

SEQ ID NO: 272356 - RNA, 22 nt, Human
gaggcggcggccgagccuggcu

SEQ ID NO: 272357 - RNA, 18 nt, Human
cugggccuuuguauuuuu

SEQ ID NO: 272358 - RNA, 18 nt, Human
cacaggcaggugauaggu

SEQ ID NO: 272359 - RNA, 22 nt, Human
aagcaagcccaggcucagucaa

SEQ ID NO: 272360 - RNA, 22 nt, Human
aggaaggacugcagcauuuggu

SEQ ID NO: 272361 - RNA, 22 nt, Human
uaaaggccuaguaaguugagac

SEQ ID NO: 272362 - RNA, 19 nt, Human
ugccuggacaaaugugggg

SEQ ID NO: 272363 - RNA, 22 nt, Human
uaagaugggggaaagaaauagu

SEQ ID NO: 272364 - RNA, 22 nt, Human
ugaagccacuuuccagaaucac

SEQ ID NO: 272365 - RNA, 22 nt, Human
aaucucuugggaggaaugaauu

SEQ ID NO: 272366 - RNA, 21 nt, Human
agcuggcagauauggugucug

SEQ ID NO: 272367 - RNA, 22 nt, Human
gccuguuuggaaucuguuuaau

SEQ ID NO: 272368 - RNA, 22 nt, Human
ucaaaggguaauguaauagucu

SEQ ID NO: 272369 - RNA, 22 nt, Human
uugguacagaugagguauucuc

SEQ ID NO: 272370 - RNA, 23 nt, Human
acagucguagguauccuuuuccu

SEQ ID NO: 272371 - RNA, 22 nt, Human
ucugggcugaaaugaaggccuu

SEQ ID NO: 272372 - RNA, 22 nt, Human
gagggcucacugagaaagcagu

SEQ ID NO: 272373 - RNA, 22 nt, Human
ugagaaaauccagaggcuaguu

SEQ ID NO: 272374 - RNA, 22 nt, Human
uggggauguaaaugaggugaua

SEQ ID NO: 272375 - RNA, 22 nt, Human
aaacccugcucuuauggaacuu

SEQ ID NO: 272376 - RNA, 22 nt, Human
cugcugcaacucuuuagagggu

SEQ ID NO: 272377 - RNA, 22 nt, Human
ggccccaggccuuuggucuggc

SEQ ID NO: 272378 - RNA, 22 nt, Human
cauggcagccugcccugcuugc

SEQ ID NO: 272379 - RNA, 22 nt, Human
cauauuugguauaacuuaagca

SEQ ID NO: 272380 - RNA, 22 nt, Human
ugagcaggacugaccggccuua

SEQ ID NO: 272381 - RNA, 22 nt, Human
augauugaccaucugcugggcu

SEQ ID NO: 272382 - RNA, 20 nt, Human
ggaggguggaagaaagcaag

SEQ ID NO: 272383 - RNA, 22 nt, Human
cauguacaguuuuucuguccug

SEQ ID NO: 272384 - RNA, 22 nt, Human
gcaggcagguggcaucuuguga

SEQ ID NO: 272385 - RNA, 22 nt, Human
augcaggggcagcagagccugg

SEQ ID NO: 272386 - RNA, 22 nt, Human
caggacacauuucuuguucagg

SEQ ID NO: 272387 - RNA, 22 nt, Human
ucagcuuuuuggauugcccaag

SEQ ID NO: 272388 - RNA, 22 nt, Human
uccucggcugggccccaggcuu

SEQ ID NO: 272389 - RNA, 22 nt, Human
gcucugagucucagcuaccaca

SEQ ID NO: 272390 - RNA, 22 nt, Human
gucaacaauuccaguuuuuacu

SEQ ID NO: 272391 - RNA, 22 nt, Human
uugaggaguacaaagcaugcuu

SEQ ID NO: 272392 - RNA, 20 nt, Human
cacaggaaagcuacucaguu

SEQ ID NO: 272393 - RNA, 22 nt, Human
gccugagggcuccuagcaggcu

SEQ ID NO: 272394 - RNA, 22 nt, Human
auguuacugugaucaugauacu

SEQ ID NO: 272395 - RNA, 22 nt, Human
uugguacaaaaccaugaaagaa

SEQ ID NO: 272396 - RNA, 22 nt, Human
cuuuggaguucccuaauuuccc

SEQ ID NO: 272397 - RNA, 22 nt, Human
aguuagaagugugucaucugug

SEQ ID NO: 272398 - RNA, 22 nt, Human
cuacuuguucacuguaggucgc

SEQ ID NO: 272399 - RNA, 22 nt, Human
cauggccugccuccuccuggug

SEQ ID NO: 272400 - RNA, 22 nt, Human
agggccugugaauucucccugc

SEQ ID NO: 272401 - RNA, 22 nt, Human
ugggguccucucacuuggaggg

SEQ ID NO: 272402 - RNA, 22 nt, Human
aaggugguuguaggcuggucug

SEQ ID NO: 272403 - RNA, 22 nt, Human
auccaaaggugacacagaauac

SEQ ID NO: 272404 - RNA, 22 nt, Human
cuguuacccagcaaccccagca

SEQ ID NO: 272405 - RNA, 22 nt, Human
aggugcuggcgccccaggagac

SEQ ID NO: 272406 - RNA, 22 nt, Human
agcagagccaggucucucugua

SEQ ID NO: 272407 - RNA, 22 nt, Human
acagcugcucaccugugagccc

SEQ ID NO: 272408 - RNA, 22 nt, Human
cucugcagaggcccaaggcuga

SEQ ID NO: 272409 - RNA, 19 nt, Human
acugcagggaggaggugug

SEQ ID NO: 272410 - RNA, 19 nt, Human
aguuuagagagacucuaaa

SEQ ID NO: 272411 - RNA, 17 nt, Human
cagcucuuccucccucu

SEQ ID NO: 272412 - RNA, 22 nt, Human
guuggcuuugcucucuguccua

SEQ ID NO: 272413 - RNA, 22 nt, Human
agucagagaauguuuucaugga

SEQ ID NO: 272414 - RNA, 22 nt, Human
agaaaaacacaaucgggccucc

SEQ ID NO: 272415 - RNA, 22 nt, Human
acaugccaauuugguuaguuca

SEQ ID NO: 272416 - RNA, 22 nt, Human
gaaaucuuugccuuagcugugu

SEQ ID NO: 272417 - RNA, 22 nt, Human
gaggcucaccuagggagcacug

SEQ ID NO: 272418 - RNA, 21 nt, Human
ucaaagcacauauuugcacau

SEQ ID NO: 272419 - RNA, 22 nt, Human
cuggccaccaagagcuugcuca

SEQ ID NO: 272420 - RNA, 22 nt, Human
gggaggugaaaggucaugugug

SEQ ID NO: 272421 - RNA, 22 nt, Human
gggccccuuguaucucuggcuc

SEQ ID NO: 272422 - RNA, 22 nt, Human
ugagacuuccugaugaggcccg

SEQ ID NO: 272423 - RNA, 22 nt, Human
ugagcugucuaugguccugucu

SEQ ID NO: 272424 - RNA, 22 nt, Human
uucuggcugaaaguuuauuuga

SEQ ID NO: 272425 - RNA, 22 nt, Human
guauccuuugcggaaauuucua

SEQ ID NO: 272426 - RNA, 23 nt, Human
cagaugagguuggcagcaugguc

SEQ ID NO: 272427 - RNA, 23 nt, Human
cccagcugcagacaagggagggu

SEQ ID NO: 272428 - RNA, 22 nt, Human
cagaaugcauugcuucugaugg

SEQ ID NO: 272429 - RNA, 22 nt, Human
ucugagacaggaaguggagggu

SEQ ID NO: 272430 - RNA, 22 nt, Human
aggacaguuaguuaggaaguuu

SEQ ID NO: 272431 - RNA, 22 nt, Human
ugagauggggagggcugcagaa

SEQ ID NO: 272432 - RNA, 22 nt, Human
agugcauguucacuggcauggu

SEQ ID NO: 272433 - RNA, 22 nt, Human
cuggaggaccccugccuggaag

SEQ ID NO: 272434 - RNA, 22 nt, Human
uugguacaaugugcuagguagg

SEQ ID NO: 272435 - RNA, 20 nt, Human
cauuugaaucuccauucugc

SEQ ID NO: 272436 - RNA, 22 nt, Human
aaggccaggggcuggcgccucc

SEQ ID NO: 272437 - RNA, 22 nt, Human
ggcagggguggccuuccuuugg

SEQ ID NO: 272438 - RNA, 22 nt, Human
agacagcugcucgcagagcuau

SEQ ID NO: 272439 - RNA, 22 nt, Human
uggcuucuggccaggcacagga

SEQ ID NO: 272440 - RNA, 22 nt, Human
uugggaaguaauaugguggucu

SEQ ID NO: 272441 - RNA, 22 nt, Human
uaacagaaaagaacugaguuug

SEQ ID NO: 272442 - RNA, 22 nt, Human
gacugccagaaugugaggccug

SEQ ID NO: 272443 - RNA, 22 nt, Human
ccucagaggcaugguuagaaua

SEQ ID NO: 272444 - RNA, 22 nt, Human
uggagcucagcgggugguuucu

SEQ ID NO: 272445 - RNA, 22 nt, Human
gaaggggaguggcuagugugug

SEQ ID NO: 272446 - RNA, 22 nt, Human
agugggagccagcagcuugggg

SEQ ID NO: 272447 - RNA, 22 nt, Human
ccagggugcucuguggcgucgc

SEQ ID NO: 272448 - RNA, 22 nt, Human
aagccuucccuuuuugagcuca

SEQ ID NO: 272449 - RNA, 22 nt, Human
aaagaguuggacuuucucaggc

SEQ ID NO: 272450 - RNA, 22 nt, Human
auagacauagccguaauuuauu

SEQ ID NO: 272451 - RNA, 22 nt, Human
ccagcuggaaacaaauagagug

SEQ ID NO: 272452 - RNA, 22 nt, Human
ugccagaagauucucuaucaga

SEQ ID NO: 272453 - RNA, 20 nt, Human
aggcaguguagagaugagua

SEQ ID NO: 272454 - RNA, 22 nt, Human
ugcaggugcugugucaagagag

SEQ ID NO: 272455 - RNA, 22 nt, Human
ggaaagcuuuguacuugaaaac

SEQ ID NO: 272456 - RNA, 22 nt, Human
cauuugcagagggugacacucu

SEQ ID NO: 272457 - RNA, 22 nt, Human
ccagagcuugacgugcaacgga

SEQ ID NO: 272458 - RNA, 22 nt, Human
ugagacacucucgggcacauuu

SEQ ID NO: 272459 - RNA, 22 nt, Human
auggaacaagaacucagauuua

SEQ ID NO: 272460 - RNA, 22 nt, Human
aguagcacaauuuugucccuaa

SEQ ID NO: 272461 - RNA, 22 nt, Human
uuuuagaaucagguugucuggg

SEQ ID NO: 272462 - RNA, 22 nt, Human
gcacagaacuucucuuaguagg

SEQ ID NO: 272463 - RNA, 22 nt, Human
aagucuaaacacauauuuaaaa

SEQ ID NO: 272464 - RNA, 22 nt, Human
agaaucaggaagacagccuggc

SEQ ID NO: 272465 - RNA, 22 nt, Human
aggcaaaucugagacauuuaaa

SEQ ID NO: 272466 - RNA, 22 nt, Human
uggcuuuaggagcuauauaccu

SEQ ID NO: 272467 - RNA, 22 nt, Human
aggagcccagccugggcucgga

SEQ ID NO: 272468 - RNA, 22 nt, Human
agcagggcccacuaggggagau

SEQ ID NO: 272469 - RNA, 22 nt, Human
ucaagcaacagaacugugagac

SEQ ID NO: 272470 - RNA, 22 nt, Human
uuggccagcagcucuggcuuag

SEQ ID NO: 272471 - RNA, 22 nt, Human
ucacagcuccagacugcaacuc

SEQ ID NO: 272472 - RNA, 22 nt, Human
ucuauguagugccagcuaguau

SEQ ID NO: 272473 - RNA, 20 nt, Human
caggcuccgcaggacuaggg

SEQ ID NO: 272474 - RNA, 22 nt, Human
gcccuggaugcucauggcauca

SEQ ID NO: 272475 - RNA, 22 nt, Human
cagauucucacuguauucaggu

SEQ ID NO: 272476 - RNA, 22 nt, Human
ccugacucuggccaggccagcu

SEQ ID NO: 272477 - RNA, 22 nt, Human
caggauaaauaguaaauguaag

SEQ ID NO: 272478 - RNA, 22 nt, Human
uagauuaacaguuuuguugaag

SEQ ID NO: 272479 - RNA, 22 nt, Human
cauuacagaauauguaaugauc

SEQ ID NO: 272480 - RNA, 22 nt, Human
aggaggaaagaaggcccccagc

SEQ ID NO: 272481 - RNA, 22 nt, Human
gcaaagcacacuggagaugucg

SEQ ID NO: 272482 - RNA, 22 nt, Human
uucucuggaaggcucuacggga

SEQ ID NO: 272483 - RNA, 22 nt, Human
ugcaugcaugugagcaugcaua

SEQ ID NO: 272484 - RNA, 22 nt, Human
caaaugauaccuauuacuaggc

SEQ ID NO: 272485 - RNA, 22 nt, Human
caggccaggugcucuagaauca

SEQ ID NO: 272486 - RNA, 20 nt, Human
ucugagaagcaaacaauguu

SEQ ID NO: 272487 - RNA, 22 nt, Human
cacugcaggucugagauggggg

SEQ ID NO: 272488 - RNA, 22 nt, Human
auuccucauuuguugagaacca

SEQ ID NO: 272489 - RNA, 22 nt, Human
ucugaaagcccuaguuuguaau

SEQ ID NO: 272490 - RNA, 22 nt, Human
aauaucaacaguguccuucuaa

SEQ ID NO: 272491 - RNA, 22 nt, Human
agggcuggcuaggugcguuccc

SEQ ID NO: 272492 - RNA, 22 nt, Human
uggccaggccggggacagaacu

SEQ ID NO: 272493 - RNA, 22 nt, Human
ucugacuugcaucuuaaaggag

SEQ ID NO: 272494 - RNA, 22 nt, Human
cagcuucugcucauggaggggu

SEQ ID NO: 272495 - RNA, 22 nt, Human
aagcacaggagacgcacagcca

SEQ ID NO: 272496 - RNA, 22 nt, Human
ccaggaagauuuauuuuggcuu

SEQ ID NO: 272497 - RNA, 22 nt, Human
ggcauggcuggguucuggugag

SEQ ID NO: 272498 - RNA, 22 nt, Human
caaauuacccucaacaucuaga

SEQ ID NO: 272499 - RNA, 22 nt, Human
ucugcuguucauucuuuuagcu

SEQ ID NO: 272500 - RNA, 19 nt, Human
acagugcaugggaccuggu

SEQ ID NO: 272501 - RNA, 22 nt, Human
cuuguauucagaguggacauga

SEQ ID NO: 272502 - RNA, 22 nt, Human
cugagcugaaacuugagaggcu

SEQ ID NO: 272503 - RNA, 22 nt, Human
uuuucaguaaugucuacauaau

SEQ ID NO: 272504 - RNA, 22 nt, Human
uuuuagaagugccuauccuaug

SEQ ID NO: 272505 - RNA, 22 nt, Human
guccugugaugaguaccaggug

SEQ ID NO: 272506 - RNA, 22 nt, Human
augcaacaccccuauggaugga

SEQ ID NO: 272507 - RNA, 22 nt, Human
uccagcuuuuaccaaaugagca

SEQ ID NO: 272508 - RNA, 22 nt, Human
agguauaugaagaugaaauaac

SEQ ID NO: 272509 - RNA, 22 nt, Human
guucuucaucauuuuagauagg

SEQ ID NO: 272510 - RNA, 22 nt, Human
uauuagaaagcuuaauaucgug

SEQ ID NO: 272511 - RNA, 22 nt, Human
gccagcccauuaaccccugucc

SEQ ID NO: 272512 - RNA, 22 nt, Human
agccucagggcucugcgcagac

SEQ ID NO: 272513 - RNA, 22 nt, Human
ucugggaacauuuugagggcaa

SEQ ID NO: 272514 - RNA, 22 nt, Human
aagccagggucaggggccuccu

SEQ ID NO: 272515 - RNA, 22 nt, Human
cacuggaauggauagagcagag

SEQ ID NO: 272516 - RNA, 17 nt, Human
uuuuguucaucuucaaa

SEQ ID NO: 272517 - RNA, 22 nt, Human
agcccagagggguuugaggacu

SEQ ID NO: 272518 - RNA, 22 nt, Human
agccacagugcaagagagaaaa

SEQ ID NO: 272519 - RNA, 23 nt, Human
uugaauuucucuugcaauauuua

SEQ ID NO: 272520 - RNA, 22 nt, Human
gagagaauguacaugcuagggg

SEQ ID NO: 272521 - RNA, 22 nt, Human
uaacuagaauggcuauuuugag

SEQ ID NO: 272522 - RNA, 22 nt, Human
cacagcuggugcacuagcucug

SEQ ID NO: 272523 - RNA, 19 nt, Human
uucucagagcuugcagcac

SEQ ID NO: 272524 - RNA, 22 nt, Human
caggccuggagugcaauggcac

SEQ ID NO: 272525 - RNA, 22 nt, Human
ggaaggcuuugaggggugcugg

SEQ ID NO: 272526 - RNA, 22 nt, Human
uccacaggcaagucucuuggca

SEQ ID NO: 272527 - RNA, 22 nt, Human
ggcuuccccuccagugcucugu

SEQ ID NO: 272528 - RNA, 22 nt, Human
ccuggguggcagagguugcagu

SEQ ID NO: 272529 - RNA, 23 nt, Human
aguguugagcagaugcaaagguu

SEQ ID NO: 272530 - RNA, 22 nt, Human
agacacagaugguaccugagcc

SEQ ID NO: 272531 - RNA, 22 nt, Human
cagcugcuguucaguuuuguuu

SEQ ID NO: 272532 - RNA, 22 nt, Human
cagaugcuaaacaaaggacuuu

SEQ ID NO: 272533 - RNA, 22 nt, Human
cagaacagacuuaacagggcug

SEQ ID NO: 272534 - RNA, 23 nt, Human
auugaacagagagaaaaacaucc

SEQ ID NO: 272535 - RNA, 22 nt, Human
aucaaugcuugccaaauggaag

SEQ ID NO: 272536 - RNA, 22 nt, Human
cuggccugagcacagcggcugc

SEQ ID NO: 272537 - RNA, 22 nt, Human
gagcaucugugguccaucagaa

SEQ ID NO: 272538 - RNA, 23 nt, Human
aaugaguugggcagcauacaggc

SEQ ID NO: 272539 - RNA, 22 nt, Human
uggccaugacauggaggcuuug

SEQ ID NO: 272540 - RNA, 22 nt, Human
gcuggaaaugaauggagaggug

SEQ ID NO: 272541 - RNA, 22 nt, Human
agcaggcacuaugccaggaucu

SEQ ID NO: 272542 - RNA, 22 nt, Human
cugaggaagacagcagcugugu

SEQ ID NO: 272543 - RNA, 22 nt, Human
uacagcaaugguucuaagaguc

SEQ ID NO: 272544 - RNA, 22 nt, Human
agcaagaagggcaaggaaguuu

SEQ ID NO: 272545 - RNA, 23 nt, Human
agggccucaggagggcugcaugg

SEQ ID NO: 272546 - RNA, 22 nt, Human
cgcaggcaagagaguacaguua

SEQ ID NO: 272547 - RNA, 22 nt, Human
cagcuuuguggccuugaccucg

SEQ ID NO: 272548 - RNA, 22 nt, Human
caggcaccugugugucucaggg

SEQ ID NO: 272549 - RNA, 22 nt, Human
ggcaggcaccagcucagcaaua

SEQ ID NO: 272550 - RNA, 22 nt, Human
cuuuuguugcccuugucgcagg

SEQ ID NO: 272551 - RNA, 22 nt, Human
uuuguguggauggaaggcagua

SEQ ID NO: 272552 - RNA, 20 nt, Human
cagcagccaaacuucuauuc

SEQ ID NO: 272553 - RNA, 22 nt, Human
ggugaggaauuggggacugacc

SEQ ID NO: 272554 - RNA, 22 nt, Human
uuaaggcauucuccuacuaaua

SEQ ID NO: 272555 - RNA, 22 nt, Human
augucacaucugggauggcccu

SEQ ID NO: 272556 - RNA, 22 nt, Human
cccagcuucugagggggccuug

SEQ ID NO: 272557 - RNA, 21 nt, Human
gcacagggacagaucaucaca

SEQ ID NO: 272558 - RNA, 22 nt, Human
guuuccuaccagugguuccaga

SEQ ID NO: 272559 - RNA, 19 nt, Human
ccugcagggaugagagguu

SEQ ID NO: 272560 - RNA, 20 nt, Human
cugcuugggccccucuggcc

SEQ ID NO: 272561 - RNA, 22 nt, Human
ccagugcucuuaaaggucauaa

SEQ ID NO: 272562 - RNA, 22 nt, Human
cagcacuaugacauuuaauucu

SEQ ID NO: 272563 - RNA, 20 nt, Human
gaugaaaucacugggcagcc

SEQ ID NO: 272564 - RNA, 22 nt, Human
auagaauagcauagaaaauuga

SEQ ID NO: 272565 - RNA, 22 nt, Human
cuggcuuugcgucuuugccaca

SEQ ID NO: 272566 - RNA, 22 nt, Human
cagagagagucaaaucuuugcu

SEQ ID NO: 272567 - RNA, 22 nt, Human
uucuuaagcguaugauaaugaa

SEQ ID NO: 272568 - RNA, 22 nt, Human
uuacaaugacagguguaucauu

SEQ ID NO: 272569 - RNA, 20 nt, Human
cccagggaccugagcuccau

SEQ ID NO: 272570 - RNA, 22 nt, Human
guagcuuauuagggauaauagu

SEQ ID NO: 272571 - RNA, 22 nt, Human
gccugagaguugaaguucagug

SEQ ID NO: 272572 - RNA, 22 nt, Human
gaauugcuaauccaagugacug

SEQ ID NO: 272573 - RNA, 22 nt, Human
gugagcugggugaaugguaggg

SEQ ID NO: 272574 - RNA, 23 nt, Human
ucugucuguguaugugcagaaag

SEQ ID NO: 272575 - RNA, 22 nt, Human
acaggcugaaaguuaaguucug

SEQ ID NO: 272576 - RNA, 22 nt, Human
ugagcaucuuuuuacagguuua

SEQ ID NO: 272577 - RNA, 22 nt, Human
ccuuugugguggcccagugugg

SEQ ID NO: 272578 - RNA, 22 nt, Human
agcccagauaaaguacaaccau

SEQ ID NO: 272579 - RNA, 22 nt, Human
cugguacagggaaauaaaggaa

SEQ ID NO: 272580 - RNA, 22 nt, Human
uucacauuguuuuaaugugaau

SEQ ID NO: 272581 - RNA, 22 nt, Human
acaaauguuggauuugucuucc

SEQ ID NO: 272582 - RNA, 20 nt, Human
auucucugcucaaguggcac

SEQ ID NO: 272583 - RNA, 22 nt, Human
cguggcaguggaaggcugggug

SEQ ID NO: 272584 - RNA, 22 nt, Human
uccugggacucuuuaucagaga

SEQ ID NO: 272585 - RNA, 22 nt, Human
caggcccaaaugcaaccuucuu

SEQ ID NO: 272586 - RNA, 22 nt, Human
agggaagcuuguuacugagaag

SEQ ID NO: 272587 - RNA, 19 nt, Human
uuuacucuccaaggugagu

SEQ ID NO: 272588 - RNA, 22 nt, Human
gcucugagugaucagcugggaa

SEQ ID NO: 272589 - RNA, 22 nt, Human
agcuacagaugagcccaguauc

SEQ ID NO: 272590 - RNA, 22 nt, Human
uuauuuaaaauguagguuggga

SEQ ID NO: 272591 - RNA, 22 nt, Human
cuagaaucugggauuucugacu

SEQ ID NO: 272592 - RNA, 22 nt, Human
uuuuccucaggaaugcuaagcu

SEQ ID NO: 272593 - RNA, 22 nt, Human
ugggcaggggcccugcuuccgu

SEQ ID NO: 272594 - RNA, 22 nt, Human
caggaaauucuuuuguuugugc

SEQ ID NO: 272595 - RNA, 22 nt, Human
cauggggagacaccuagggaaa

SEQ ID NO: 272596 - RNA, 22 nt, Human
agucuucugcucugucacuaac

SEQ ID NO: 272597 - RNA, 22 nt, Human
gcuggccucaucacugacuucu

SEQ ID NO: 272598 - RNA, 22 nt, Human
agggucucuggagagcugagga

SEQ ID NO: 272599 - RNA, 22 nt, Human
cugcagggaacugaggcccaga

SEQ ID NO: 272600 - RNA, 22 nt, Human
uucuuuucuuggcaggaguaga

SEQ ID NO: 272601 - RNA, 22 nt, Human
ccaggccuuucuucuuggucug

SEQ ID NO: 272602 - RNA, 22 nt, Human
cuugccugcuggagcagggcuc

SEQ ID NO: 272603 - RNA, 22 nt, Human
uucagagcuggugucuacagcu

SEQ ID NO: 272604 - RNA, 22 nt, Human
agcccaggucucaaaguacagg

SEQ ID NO: 272605 - RNA, 19 nt, Human
gcacacauacacccuuugg

SEQ ID NO: 272606 - RNA, 19 nt, Human
ucucacaagcaacauuguu

SEQ ID NO: 272607 - RNA, 20 nt, Human
cuccaaggcuugcaggaggc

SEQ ID NO: 272608 - RNA, 22 nt, Human
ggucucugacuuagagauggau

SEQ ID NO: 272609 - RNA, 22 nt, Human
gcaggagagucugugccagguu

SEQ ID NO: 272610 - RNA, 22 nt, Human
caggacagcucaacaccuccuc

SEQ ID NO: 272611 - RNA, 22 nt, Human
acucucacuagcucugugaccu

SEQ ID NO: 272612 - RNA, 19 nt, Human
uuucucugugcaccuuuuc

SEQ ID NO: 272613 - RNA, 22 nt, Human
uguuuacagggugauuuuaccu

SEQ ID NO: 272614 - RNA, 22 nt, Human
uggggaggaagucagauuucag

SEQ ID NO: 272615 - RNA, 22 nt, Human
ugcuuuuaggagauuaaaauua

SEQ ID NO: 272616 - RNA, 22 nt, Human
uggcagugucuuaucaggagug

SEQ ID NO: 272617 - RNA, 22 nt, Human
cugcuguggccagccaggucaa

SEQ ID NO: 272618 - RNA, 22 nt, Human
guuguuuauaaaaauaucuagc

SEQ ID NO: 272619 - RNA, 22 nt, Human
ugucuccaccaucaucuuacca

SEQ ID NO: 272620 - RNA, 22 nt, Human
uuuuauguaauccuuacugucg

SEQ ID NO: 272621 - RNA, 22 nt, Human
uccaucuggugagugaggagcc

SEQ ID NO: 272622 - RNA, 22 nt, Human
ggcuggcauccagggaaaucca

SEQ ID NO: 272623 - RNA, 22 nt, Human
acgugcauauguauacacacau

SEQ ID NO: 272624 - RNA, 22 nt, Human
auauuuucuggaacuaugccug

SEQ ID NO: 272625 - RNA, 22 nt, Human
uucuucaaagaugucuguugga

SEQ ID NO: 272626 - RNA, 22 nt, Human
gagaggcuggcagugccagguu

SEQ ID NO: 272627 - RNA, 22 nt, Human
ugagcaauuaacagagucuaaa

SEQ ID NO: 272628 - RNA, 22 nt, Human
gguggaguaauucgcagagguu

SEQ ID NO: 272629 - RNA, 17 nt, Human
uguuuuuucccuguucu

SEQ ID NO: 272630 - RNA, 22 nt, Human
augucuuggguuucaguuuacu

SEQ ID NO: 272631 - RNA, 22 nt, Human
acaguaaaacauuuuuauuagg

SEQ ID NO: 272632 - RNA, 22 nt, Human
ugcaucugauucucaggcagaa

SEQ ID NO: 272633 - RNA, 22 nt, Human
caggaagcugugaaggagacgg

SEQ ID NO: 272634 - RNA, 20 nt, Human
ccaguccaccugagacaugu

SEQ ID NO: 272635 - RNA, 22 nt, Human
accucaaggaaaaucuagacag

SEQ ID NO: 272636 - RNA, 22 nt, Human
gucaaauauaugcaaaacuauu

SEQ ID NO: 272637 - RNA, 22 nt, Human
cacuguaucuuuuccaaagucu

SEQ ID NO: 272638 - RNA, 22 nt, Human
aauguguguauuucuaggcgag

SEQ ID NO: 272639 - RNA, 22 nt, Human
gcacaagaauaaccauauuuaa

SEQ ID NO: 272640 - RNA, 22 nt, Human
ucagaguccaugguacuuaauu

SEQ ID NO: 272641 - RNA, 23 nt, Human
uccuggguuugaauucuagucuu

SEQ ID NO: 272642 - RNA, 21 nt, Human
ucaggaagagccaguucaugc

SEQ ID NO: 272643 - RNA, 22 nt, Human
acagacaucuauccauuuaauu

SEQ ID NO: 272644 - RNA, 22 nt, Human
guucugcuuaaauuauugaucc

SEQ ID NO: 272645 - RNA, 15 nt, Human
caggagaggaagguu

SEQ ID NO: 272646 - RNA, 22 nt, Human
caggcuggagugcaguugugca

SEQ ID NO: 272647 - RNA, 22 nt, Human
gggccugauuagcaggcuagcu

SEQ ID NO: 272648 - RNA, 22 nt, Human
uccucagcuuuuauuucacuug

SEQ ID NO: 272649 - RNA, 22 nt, Human
gcugccuguguggccacucacu

SEQ ID NO: 272650 - RNA, 22 nt, Human
ugugaauauccauuuguuucag

SEQ ID NO: 272651 - RNA, 22 nt, Human
agcaggccugccaccucggggu

SEQ ID NO: 272652 - RNA, 22 nt, Human
uccuggaucuacucucaauugg

SEQ ID NO: 272653 - RNA, 22 nt, Human
ugacuuuaagcuaucugauucu

SEQ ID NO: 272654 - RNA, 22 nt, Human
ggcccagagucugcaauggagu

SEQ ID NO: 272655 - RNA, 22 nt, Human
ucaggacagaaggcugccaggg

SEQ ID NO: 272656 - RNA, 20 nt, Human
ugugacaaaggcauauuuua

SEQ ID NO: 272657 - RNA, 22 nt, Human
caugcacaaagguaagaugcgu

SEQ ID NO: 272658 - RNA, 22 nt, Human
ggcucuggggccuccucccuug

SEQ ID NO: 272659 - RNA, 22 nt, Human
uucugucuucccacugaggagc

SEQ ID NO: 272660 - RNA, 22 nt, Human
uccugugaguagauaguauugu

SEQ ID NO: 272661 - RNA, 22 nt, Human
gucuggcucuggaaggcaaagg

SEQ ID NO: 272662 - RNA, 19 nt, Human
auucagugucucugacuuc

SEQ ID NO: 272663 - RNA, 22 nt, Human
agggucaacauuucauugauuc

SEQ ID NO: 272664 - RNA, 22 nt, Human
aauaaauguuaagauugucuca

SEQ ID NO: 272665 - RNA, 22 nt, Human
acacauuccugcagacaugaug

SEQ ID NO: 272666 - RNA, 22 nt, Human
aaacaaagcaucuugcuaugca

SEQ ID NO: 272667 - RNA, 22 nt, Human
auccagccaguguggaugacuu

SEQ ID NO: 272668 - RNA, 23 nt, Human
ccuggcuguggauuugggccugc

SEQ ID NO: 272669 - RNA, 22 nt, Human
gaggccagaaugagcugaaugc

SEQ ID NO: 272670 - RNA, 22 nt, Human
gaaggccacaaaaaaugucaua

SEQ ID NO: 272671 - RNA, 22 nt, Human
agggcagcucucaccucuggcc

SEQ ID NO: 272672 - RNA, 22 nt, Human
aaagugcagcugaaaacauccu

SEQ ID NO: 272673 - RNA, 22 nt, Human
uggcaaaggggaccauguugaa

SEQ ID NO: 272674 - RNA, 22 nt, Human
agaggcagaaguguucaaaccc

SEQ ID NO: 272675 - RNA, 22 nt, Human
ugcccugccugagagacaguaa

SEQ ID NO: 272676 - RNA, 22 nt, Human
aaggcaaugagggagauagagu

SEQ ID NO: 272677 - RNA, 22 nt, Human
acuccuggugcugaugaagaga

SEQ ID NO: 272678 - RNA, 22 nt, Human
gagugucagugccuggcuuguu

SEQ ID NO: 272679 - RNA, 22 nt, Human
uacaugcuccacuuucuccugu

SEQ ID NO: 272680 - RNA, 22 nt, Human
cugaggcacugucagcugaggc

SEQ ID NO: 272681 - RNA, 23 nt, Human
aaacaagucucucaauggcuugc

SEQ ID NO: 272682 - RNA, 22 nt, Human
uggagccagcaggacucagagg

SEQ ID NO: 272683 - RNA, 22 nt, Human
guggauuacaagacaguugaga

SEQ ID NO: 272684 - RNA, 22 nt, Human
uauuccagaugaaaucauucag

SEQ ID NO: 272685 - RNA, 22 nt, Human
agcuuuuacauaaugaucuuga

SEQ ID NO: 272686 - RNA, 22 nt, Human
cugcugggucccccugcugauu

SEQ ID NO: 272687 - RNA, 22 nt, Human
auauuuuggcaaaugucuagau

SEQ ID NO: 272688 - RNA, 22 nt, Human
cuuuacauccuguuucccguuu

SEQ ID NO: 272689 - RNA, 22 nt, Human
uccauacauugaaauaccauuc

SEQ ID NO: 272690 - RNA, 22 nt, Human
ucuuucuggucucgccuuauuc

SEQ ID NO: 272691 - RNA, 22 nt, Human
agcaggugccagguguacccgc

SEQ ID NO: 272692 - RNA, 22 nt, Human
cucaggucacggaucugagcug

SEQ ID NO: 272693 - RNA, 22 nt, Human
aguggcagagugcacucaggca

SEQ ID NO: 272694 - RNA, 22 nt, Human
ugguuacagagauuuuuaagau

SEQ ID NO: 272695 - RNA, 22 nt, Human
acacacagaaggaagccccacu

SEQ ID NO: 272696 - RNA, 22 nt, Human
aacuguagggaucugucuuagu

SEQ ID NO: 272697 - RNA, 22 nt, Human
uaccuagaccaguuacaaugca

SEQ ID NO: 272698 - RNA, 22 nt, Human
uuaaucugaaucaguaaacacu

SEQ ID NO: 272699 - RNA, 22 nt, Human
uacuuuuagccuauuugauucu

SEQ ID NO: 272700 - RNA, 22 nt, Human
ugaggcacugggagagcacacu

SEQ ID NO: 272701 - RNA, 17 nt, Human
agcagcugaagcagcca

SEQ ID NO: 272702 - RNA, 22 nt, Human
aggcugugggaguugagagucu

SEQ ID NO: 272703 - RNA, 22 nt, Human
gggcaaguccggugcccagagc

SEQ ID NO: 272704 - RNA, 22 nt, Human
cugugggaauacugcgagugua

SEQ ID NO: 272705 - RNA, 22 nt, Human
agcaguguggccuuagacccgg

SEQ ID NO: 272706 - RNA, 22 nt, Human
aggaccugacauuguguuuucu

SEQ ID NO: 272707 - RNA, 22 nt, Human
aaagggaaguugcacauguucc

SEQ ID NO: 272708 - RNA, 22 nt, Human
uucccagucccaagaaaagcca

SEQ ID NO: 272709 - RNA, 22 nt, Human
ucucuguaagagaggcuuucau

SEQ ID NO: 272710 - RNA, 22 nt, Human
caguguggugugcacagcuuag

SEQ ID NO: 272711 - RNA, 22 nt, Human
ugccuugacaguuguaagaccu

SEQ ID NO: 272712 - RNA, 22 nt, Human
ccuggcugaacaaagucccucc

SEQ ID NO: 272713 - RNA, 22 nt, Human
cugggccucaaucucagaguuu

SEQ ID NO: 272714 - RNA, 22 nt, Human
gacugguaaggaaauucacuaa

SEQ ID NO: 272715 - RNA, 22 nt, Human
caguccuuauuccuauauuccu

SEQ ID NO: 272716 - RNA, 22 nt, Human
agcugugggauuugggugugcc

SEQ ID NO: 272717 - RNA, 22 nt, Human
uaacuuagaaguuuaauuguau

SEQ ID NO: 272718 - RNA, 22 nt, Human
cuucaggaaaaucucuaaggau

SEQ ID NO: 272719 - RNA, 22 nt, Human
uguuccugguuccugcaugaug

SEQ ID NO: 272720 - RNA, 22 nt, Human
ugaccagugaucuacugggauu

SEQ ID NO: 272721 - RNA, 22 nt, Human
ucugaaagaugagugguccauu

SEQ ID NO: 272722 - RNA, 22 nt, Human
gagggguguggagccaucaguu

SEQ ID NO: 272723 - RNA, 22 nt, Human
cugccccaggaccucuucugga

SEQ ID NO: 272724 - RNA, 22 nt, Human
ggaagcugaacuuagcaaggaa

SEQ ID NO: 272725 - RNA, 22 nt, Human
uuuacagaucuguugauuuguu

SEQ ID NO: 272726 - RNA, 22 nt, Human
uggcagucugccucuucaccau

SEQ ID NO: 272727 - RNA, 20 nt, Human
ucauguguguccuacagaga

SEQ ID NO: 272728 - RNA, 22 nt, Human
aaauauuugucugaggcgguug

SEQ ID NO: 272729 - RNA, 21 nt, Human
uccagccuuucccucacuucc

SEQ ID NO: 272730 - RNA, 22 nt, Human
uucaguaucccugcuuggacag

SEQ ID NO: 272731 - RNA, 22 nt, Human
agaguggguuauaggcagacuu

SEQ ID NO: 272732 - RNA, 22 nt, Human
uuucagaucauuuuuuaaguac

SEQ ID NO: 272733 - RNA, 22 nt, Human
caaaagucuguccuuuaacuuc

SEQ ID NO: 272734 - RNA, 22 nt, Human
cucuggaggccuaaggaagugg

SEQ ID NO: 272735 - RNA, 22 nt, Human
gcucagaggaugcuccuuuaug

SEQ ID NO: 272736 - RNA, 22 nt, Human
ccacaauuuuaugauuuaggag

SEQ ID NO: 272737 - RNA, 22 nt, Human
uuugacucuugcccaguuuggc

SEQ ID NO: 272738 - RNA, 22 nt, Human
augauauuugcaaugugcuugc

SEQ ID NO: 272739 - RNA, 22 nt, Human
caugaggugauaaagcugggau

SEQ ID NO: 272740 - RNA, 22 nt, Human
acauuucuggaguuucucaaca

SEQ ID NO: 272741 - RNA, 22 nt, Human
uuuaacaugugaauuuuggaag

SEQ ID NO: 272742 - RNA, 22 nt, Human
guccuggcuuaguucgcuguaa

SEQ ID NO: 272743 - RNA, 22 nt, Human
ugagcagugguguuuuucuauc

SEQ ID NO: 272744 - RNA, 22 nt, Human
ucagaggaacacuguuucaugc

SEQ ID NO: 272745 - RNA, 21 nt, Human
ugggaccuauuucaacuggau

SEQ ID NO: 272746 - RNA, 22 nt, Human
ugauuuacaguagugucuaaac

SEQ ID NO: 272747 - RNA, 22 nt, Human
aacuuucagcaaguaauucugg

SEQ ID NO: 272748 - RNA, 22 nt, Human
gcuucugcaggguccucgcugu

SEQ ID NO: 272749 - RNA, 22 nt, Human
uaaaguauccaguuauucuucu

SEQ ID NO: 272750 - RNA, 18 nt, Human
uagcaaagauguggauug

SEQ ID NO: 272751 - RNA, 22 nt, Human
augacacauaaaacaaggacug

SEQ ID NO: 272752 - RNA, 22 nt, Human
uuauuguuuacuaguuugcaga

SEQ ID NO: 272753 - RNA, 22 nt, Human
gucuaugauauuuuguuauagc

SEQ ID NO: 272754 - RNA, 22 nt, Human
uccacagguaugaggccccacc

SEQ ID NO: 272755 - RNA, 22 nt, Human
aucaagaguauugacaagacca

SEQ ID NO: 272756 - RNA, 22 nt, Human
ugccugcuuucuccucaacuca

SEQ ID NO: 272757 - RNA, 22 nt, Human
uuuuccucuguauuugaaaugc

SEQ ID NO: 272758 - RNA, 22 nt, Human
uaguaaauuaaaauauugacuu

SEQ ID NO: 272759 - RNA, 22 nt, Human
aucagagcuaguacuugcaggu

SEQ ID NO: 272760 - RNA, 22 nt, Human
uuacacaucuagacccauuuuu

SEQ ID NO: 272761 - RNA, 22 nt, Human
cuguacagauugcacacgggga

SEQ ID NO: 272762 - RNA, 22 nt, Human
ucucuggggaaaaggcugauac

SEQ ID NO: 272763 - RNA, 22 nt, Human
uaacauuugcugucuccuaugu

SEQ ID NO: 272764 - RNA, 22 nt, Human
gcuucaugggugugcaaccugu

SEQ ID NO: 272765 - RNA, 21 nt, Human
agggccagaucaccaaggagc

SEQ ID NO: 272766 - RNA, 22 nt, Human
cagaucuuguacucauuauuga

SEQ ID NO: 272767 - RNA, 22 nt, Human
cauucuugcaccgugauggcuu

SEQ ID NO: 272768 - RNA, 22 nt, Human
ugcuuuauugcaucaguguggg

SEQ ID NO: 272769 - RNA, 22 nt, Human
gaagcaguagcaacugugucuu

SEQ ID NO: 272770 - RNA, 20 nt, Human
guuuagcauggcagugaaag

SEQ ID NO: 272771 - RNA, 22 nt, Human
acagaugagaagcugcauucaa

SEQ ID NO: 272772 - RNA, 22 nt, Human
agcuccuggaggugcgcacucg

SEQ ID NO: 272773 - RNA, 22 nt, Human
cagccuccugggacacucaccg

SEQ ID NO: 272774 - RNA, 22 nt, Human
cugucccauccuuacucuaccc

SEQ ID NO: 272775 - RNA, 22 nt, Human
agggaagaagcugguaguaggu

SEQ ID NO: 272776 - RNA, 22 nt, Human
ucagaggaaaggucagauggcu

SEQ ID NO: 272777 - RNA, 22 nt, Human
cagacccugggccacagaggag

SEQ ID NO: 272778 - RNA, 22 nt, Human
cagcucuuauuuucucuccuaa

SEQ ID NO: 272779 - RNA, 22 nt, Human
auugucuuuaaaaauauacaac

SEQ ID NO: 272780 - RNA, 22 nt, Human
cacagcuaggaggaaagcagag

SEQ ID NO: 272781 - RNA, 23 nt, Human
uccagcucccuucaauggcacug

SEQ ID NO: 272782 - RNA, 22 nt, Human
ggcucagguuuccuucccagcu

SEQ ID NO: 272783 - RNA, 23 nt, Human
auauucacgccgccagagguccc

SEQ ID NO: 272784 - RNA, 22 nt, Human
cacagauaaggauguuaauuuu

SEQ ID NO: 272785 - RNA, 22 nt, Human
ccagcccuguaaggaugaggca

SEQ ID NO: 272786 - RNA, 22 nt, Human
gaagcugcguguagccauacuu

SEQ ID NO: 272787 - RNA, 22 nt, Human
gcagaagggaauaaggagcuuu

SEQ ID NO: 272788 - RNA, 22 nt, Human
aauccugaccugggcaugcuug

SEQ ID NO: 272789 - RNA, 22 nt, Human
agugucugaucaguugacuaga

SEQ ID NO: 272790 - RNA, 22 nt, Human
ugcuggcuuugcgagaugcauu

SEQ ID NO: 272791 - RNA, 22 nt, Human
ccauuuggcaagaaagagucau

SEQ ID NO: 272792 - RNA, 22 nt, Human
auuucuacaguacacaugcauu

SEQ ID NO: 272793 - RNA, 22 nt, Human
uaugaagauugcggucuggaau

SEQ ID NO: 272794 - RNA, 22 nt, Human
uucaacuagaggugauuuugcc

SEQ ID NO: 272795 - RNA, 22 nt, Human
guucccauugcccuagcuugua

SEQ ID NO: 272796 - RNA, 22 nt, Human
uaaugucaaggucauucuagag

SEQ ID NO: 272797 - RNA, 17 nt, Human
cucuguggagguguuua

SEQ ID NO: 272798 - RNA, 22 nt, Human
gcucuauuacuuucaauaaaaa

SEQ ID NO: 272799 - RNA, 22 nt, Human
ugggugcuucgucagcucugag

SEQ ID NO: 272800 - RNA, 22 nt, Human
agggagcagggcuccuuugggu

SEQ ID NO: 272801 - RNA, 22 nt, Human
cuggcagguggauggggacucc

SEQ ID NO: 272802 - RNA, 22 nt, Human
auuuuguuuccuuuggaguaga

SEQ ID NO: 272803 - RNA, 22 nt, Human
guacaugugcacaaugugcagg

SEQ ID NO: 272804 - RNA, 22 nt, Human
ucuggcagcgaagcguguacuu

SEQ ID NO: 272805 - RNA, 22 nt, Human
ggcagaaggcaauuagagacug

SEQ ID NO: 272806 - RNA, 22 nt, Human
aggaaacuaaagcccagagagg

SEQ ID NO: 272807 - RNA, 22 nt, Human
cagcuccugcagcuggcuccca

SEQ ID NO: 272808 - RNA, 22 nt, Human
uagcacuuguguuaugccuugu

SEQ ID NO: 272809 - RNA, 22 nt, Human
ugagcccaggaguuggagaccg

SEQ ID NO: 272810 - RNA, 22 nt, Human
ugccugugggugccaccacccu

SEQ ID NO: 272811 - RNA, 22 nt, Human
ugaggagucgagaagggguaau

SEQ ID NO: 272812 - RNA, 22 nt, Human
gcccuguguauccccugugcuu

SEQ ID NO: 272813 - RNA, 18 nt, Human
uucucugguggauguuau

SEQ ID NO: 272814 - RNA, 22 nt, Human
uggcucugggaaugggaagaug

SEQ ID NO: 272815 - RNA, 22 nt, Human
gcagcagauuguuuuuucaccu

SEQ ID NO: 272816 - RNA, 22 nt, Human
ucugagcuaauccuguugccga

SEQ ID NO: 272817 - RNA, 22 nt, Human
acagauuugacugguaccuggc

SEQ ID NO: 272818 - RNA, 22 nt, Human
aacugcaaagccaaucucagga

SEQ ID NO: 272819 - RNA, 22 nt, Human
uaggggcagaagcggcggucca

SEQ ID NO: 272820 - RNA, 22 nt, Human
ccugcccaggagucucucugug

SEQ ID NO: 272821 - RNA, 22 nt, Human
gaugcgggcccgcuccacugcc

SEQ ID NO: 272822 - RNA, 22 nt, Human
aacauaaauuugaaguggcaaa

SEQ ID NO: 272823 - RNA, 22 nt, Human
ucugccuuuguggucgggagaa

SEQ ID NO: 272824 - RNA, 21 nt, Human
gacaggcaaggagucacuuag

SEQ ID NO: 272825 - RNA, 20 nt, Human
caugccugcugguaucuggc

SEQ ID NO: 272826 - RNA, 22 nt, Human
gagguugggaaguccaagcugg

SEQ ID NO: 272827 - RNA, 22 nt, Human
ugucucaguacacuccgauguu

SEQ ID NO: 272828 - RNA, 22 nt, Human
ugcuggagaucauuaauguuca

SEQ ID NO: 272829 - RNA, 18 nt, Human
cuccagagcugugagaca

SEQ ID NO: 272830 - RNA, 22 nt, Human
uaucagcucggaaucuguugaa

SEQ ID NO: 272831 - RNA, 22 nt, Human
aggcugggcaccguuuugaucc

SEQ ID NO: 272832 - RNA, 22 nt, Human
ucugaauuaaucaugccucuuu

SEQ ID NO: 272833 - RNA, 22 nt, Human
cuccagcuuuagcucuccaggg

SEQ ID NO: 272834 - RNA, 22 nt, Human
gguuucaaaguggacaguuagu

SEQ ID NO: 272835 - RNA, 22 nt, Human
ugguuagacacaugcaugucau

SEQ ID NO: 272836 - RNA, 22 nt, Human
cagggcacaguuauggaggugg

SEQ ID NO: 272837 - RNA, 22 nt, Human
aaagcauguucugggaauagua

SEQ ID NO: 272838 - RNA, 17 nt, Human
auacaguuuauuuuaca

SEQ ID NO: 272839 - RNA, 22 nt, Human
agcuccuggcuuuccucucacc

SEQ ID NO: 272840 - RNA, 22 nt, Human
ugcagggcuacaggacuacaac

SEQ ID NO: 272841 - RNA, 22 nt, Human
cauaaaguaaagaugucuucca

SEQ ID NO: 272842 - RNA, 22 nt, Human
aagacauuccaaaguggcuaau

SEQ ID NO: 272843 - RNA, 22 nt, Human
gggaugagaguagggugugaaa

SEQ ID NO: 272844 - RNA, 22 nt, Human
uaacaguauauuuaccaaaccu

SEQ ID NO: 272845 - RNA, 20 nt, Human
cacagaacaaauugcaggac

SEQ ID NO: 272846 - RNA, 22 nt, Human
agucacuguuucagaacugagu

SEQ ID NO: 272847 - RNA, 22 nt, Human
aaaaggcauuuugucaaccaua

SEQ ID NO: 272848 - RNA, 22 nt, Human
cucaggacagauuccagagaaa

SEQ ID NO: 272849 - RNA, 21 nt, Human
ugguacagaggaggugaagug

SEQ ID NO: 272850 - RNA, 22 nt, Human
uaugauguguaccuaagucacc

SEQ ID NO: 272851 - RNA, 22 nt, Human
agcacacaucacuucugcucau

SEQ ID NO: 272852 - RNA, 19 nt, Human
aggcugcccagucucugcc

SEQ ID NO: 272853 - RNA, 22 nt, Human
agaucugguuggaguccugaca

SEQ ID NO: 272854 - RNA, 22 nt, Human
caaaugaagaaccuucucaccu

SEQ ID NO: 272855 - RNA, 22 nt, Human
ucacaugcccuaccuaaucuua

SEQ ID NO: 272856 - RNA, 22 nt, Human
aagccuggacuaucgcgugugc

SEQ ID NO: 272857 - RNA, 22 nt, Human
uccauacacauugaauuuuagu

SEQ ID NO: 272858 - RNA, 22 nt, Human
aacagugucaggauuacagaua

SEQ ID NO: 272859 - RNA, 22 nt, Human
uaggaaacucaaagggaagugg

SEQ ID NO: 272860 - RNA, 22 nt, Human
ccagggcaucacauccaguguu

SEQ ID NO: 272861 - RNA, 22 nt, Human
uuugcaaaugaagcucugagga

SEQ ID NO: 272862 - RNA, 22 nt, Human
aucuguggcuggugagaggcag

SEQ ID NO: 272863 - RNA, 22 nt, Human
aggccagacagcuagaaacagg

SEQ ID NO: 272864 - RNA, 22 nt, Human
ccagugucuacuguggcauauc

SEQ ID NO: 272865 - RNA, 20 nt, Human
gccaacgcgcuggggcugcc

SEQ ID NO: 272866 - RNA, 22 nt, Human
ucugucaucuguucagugcuca

SEQ ID NO: 272867 - RNA, 22 nt, Human
gugcaaaaaucuaucaccagca

SEQ ID NO: 272868 - RNA, 22 nt, Human
aggaaagauggaaggaggauaa

SEQ ID NO: 272869 - RNA, 22 nt, Human
uccccuccaacuccaacuaugg

SEQ ID NO: 272870 - RNA, 22 nt, Human
uuagagcuagaugaggucauga

SEQ ID NO: 272871 - RNA, 22 nt, Human
ugaggcagucacccccuccugc

SEQ ID NO: 272872 - RNA, 19 nt, Human
aaaugugaugguacaauuc

SEQ ID NO: 272873 - RNA, 22 nt, Human
ucugguggcacgugucuugcau

SEQ ID NO: 272874 - RNA, 22 nt, Human
ucacugggagagcugacaagga

SEQ ID NO: 272875 - RNA, 22 nt, Human
uauagaggccaccaacaugaaa

SEQ ID NO: 272876 - RNA, 22 nt, Human
ugcacacacaggagucuccucc

SEQ ID NO: 272877 - RNA, 17 nt, Human
uuucagauucacuuucu

SEQ ID NO: 272878 - RNA, 22 nt, Human
agugugaguuacaaagugugaa

SEQ ID NO: 272879 - RNA, 18 nt, Human
ucucagaggccauccuag

SEQ ID NO: 272880 - RNA, 22 nt, Human
ccucugcucugguccaugugcu

SEQ ID NO: 272881 - RNA, 22 nt, Human
uggccuggggaagaccaugggc

SEQ ID NO: 272882 - RNA, 22 nt, Human
ccuauacaggcuucuuuacaug

SEQ ID NO: 272883 - RNA, 23 nt, Human
agcagcugugguuuaccuuagua

SEQ ID NO: 272884 - RNA, 22 nt, Human
ugaaccuuuguguuggaccugg

SEQ ID NO: 272885 - RNA, 22 nt, Human
aguucuuauugaauagaaauca

SEQ ID NO: 272886 - RNA, 22 nt, Human
ccuugcucucccaagcccgcag

SEQ ID NO: 272887 - RNA, 22 nt, Human
gagggccagcagccucagcaug

SEQ ID NO: 272888 - RNA, 22 nt, Human
cucaggaugucggugacuauug

SEQ ID NO: 272889 - RNA, 22 nt, Human
ugaggccacuuccccacagccc

SEQ ID NO: 272890 - RNA, 22 nt, Human
cugguucauccccuuccaggaa

SEQ ID NO: 272891 - RNA, 22 nt, Human
gugaaauuguauuuggcauuga

SEQ ID NO: 272892 - RNA, 22 nt, Human
gaggccugaaaggggaccuaug

SEQ ID NO: 272893 - RNA, 22 nt, Human
ggccauggaccccgagcugacc

SEQ ID NO: 272894 - RNA, 22 nt, Human
augguacagauaauacaugcug

SEQ ID NO: 272895 - RNA, 21 nt, Human
gucagagaugcccaacugccu

SEQ ID NO: 272896 - RNA, 22 nt, Human
gaaaaggccuggggcaaagugu

SEQ ID NO: 272897 - RNA, 22 nt, Human
aaugccaucuggugauguauua

SEQ ID NO: 272898 - RNA, 22 nt, Human
aucaaauaaagguaccuagcuu

SEQ ID NO: 272899 - RNA, 20 nt, Human
ugggagcuggugaggucuca

SEQ ID NO: 272900 - RNA, 22 nt, Human
cuccacagcucaggcucagagu

SEQ ID NO: 272901 - RNA, 22 nt, Human
ggcuucugcucagccugcacgc

SEQ ID NO: 272902 - RNA, 22 nt, Human
gcacgugcacacauguguacaa

SEQ ID NO: 272903 - RNA, 22 nt, Human
auccaguuuaugucauauucuu

SEQ ID NO: 272904 - RNA, 22 nt, Human
ucugaggaauucugcagugaga

SEQ ID NO: 272905 - RNA, 22 nt, Human
ggccaggcgaugaccccuccac

SEQ ID NO: 272906 - RNA, 22 nt, Human
caggccugaguguggaagucuu

SEQ ID NO: 272907 - RNA, 22 nt, Human
ugcuuuauucccuucugaugug

SEQ ID NO: 272908 - RNA, 22 nt, Human
gggcugcuacgagaacugaaua

SEQ ID NO: 272909 - RNA, 22 nt, Human
guccucugauuucuagguauau

SEQ ID NO: 272910 - RNA, 22 nt, Human
gagauggggaauaggagcaagc

SEQ ID NO: 272911 - RNA, 22 nt, Human
agcugagagcugugucaagaua

SEQ ID NO: 272912 - RNA, 23 nt, Human
ccucccaccuauuucacuuucuu

SEQ ID NO: 272913 - RNA, 22 nt, Human
aagcccugucacccugacuuca

SEQ ID NO: 272914 - RNA, 20 nt, Human
gucuccacuggggguuaacc

SEQ ID NO: 272915 - RNA, 22 nt, Human
uauugguaggacucagcugaga

SEQ ID NO: 272916 - RNA, 22 nt, Human
agccagggugagagggcuuugu

SEQ ID NO: 272917 - RNA, 22 nt, Human
uuauaucuuuuuacaucucucc

SEQ ID NO: 272918 - RNA, 22 nt, Human
caggaaauggcugaauaaauuc

SEQ ID NO: 272919 - RNA, 22 nt, Human
uggauuaguuuaacaauguggc

SEQ ID NO: 272920 - RNA, 22 nt, Human
ccagaggggcugagcaggucac

SEQ ID NO: 272921 - RNA, 22 nt, Human
gccacuguacuccagccugcga

SEQ ID NO: 272922 - RNA, 22 nt, Human
ccaugagcuucaacugacacag

SEQ ID NO: 272923 - RNA, 18 nt, Human
auauucaagaagacagag

SEQ ID NO: 272924 - RNA, 22 nt, Human
ugccugccccacaagggguugc

SEQ ID NO: 272925 - RNA, 22 nt, Human
agaaacucaccuuuccagccau

SEQ ID NO: 272926 - RNA, 22 nt, Human
ugccugggagugaccaagacuc

SEQ ID NO: 272927 - RNA, 21 nt, Human
ucugggcuuucuuauaaggca

SEQ ID NO: 272928 - RNA, 22 nt, Human
ggcugagcacuuuaggcaggag

SEQ ID NO: 272929 - RNA, 22 nt, Human
agcuugggcaacacagcaagac

SEQ ID NO: 272930 - RNA, 22 nt, Human
uaaagacaauaggaaaguuguu

SEQ ID NO: 272931 - RNA, 22 nt, Human
aaagcaauugugguuuuuguca

SEQ ID NO: 272932 - RNA, 22 nt, Human
uuggaaagucucacccaguuga

SEQ ID NO: 272933 - RNA, 22 nt, Human
cuguccugcccacccugcaggg

SEQ ID NO: 272934 - RNA, 22 nt, Human
cagcagcucccauccgcugagc

SEQ ID NO: 272935 - RNA, 22 nt, Human
ucuuggaaguagaacacagucu

SEQ ID NO: 272936 - RNA, 22 nt, Human
uccaugguuucagucuggcugg

SEQ ID NO: 272937 - RNA, 22 nt, Human
aaugcacacauuugguacugaa

SEQ ID NO: 272938 - RNA, 22 nt, Human
cagcagaaacccagcaaagcca

SEQ ID NO: 272939 - RNA, 22 nt, Human
uaugaagaaaccuauccucuag

SEQ ID NO: 272940 - RNA, 22 nt, Human
ucccagggugaaaugcaguagg

SEQ ID NO: 272941 - RNA, 23 nt, Human
aguauucaaaaggcaagcuauau

SEQ ID NO: 272942 - RNA, 22 nt, Human
uguacuugcuuauuagaaaucu

SEQ ID NO: 272943 - RNA, 22 nt, Human
gcugguccacucccuggaggcu

SEQ ID NO: 272944 - RNA, 22 nt, Human
ucauccaguuguggagagggaa

SEQ ID NO: 272945 - RNA, 22 nt, Human
uauccauuauguuggcuagucu

SEQ ID NO: 272946 - RNA, 20 nt, Human
gcugcucgcugcagucacuc

SEQ ID NO: 272947 - RNA, 22 nt, Human
aagcccuggaacuuuccuagcc

SEQ ID NO: 272948 - RNA, 22 nt, Human
uaaagugcuuccuaacccagag

SEQ ID NO: 272949 - RNA, 22 nt, Human
gcuauucauggagcauguacug

SEQ ID NO: 272950 - RNA, 22 nt, Human
uuuacagagagagaacuggacu

SEQ ID NO: 272951 - RNA, 22 nt, Human
gccuguuuuugcuucguuuaag

SEQ ID NO: 272952 - RNA, 20 nt, Human
gccaggagggugugaugagc

SEQ ID NO: 272953 - RNA, 22 nt, Human
agguaaauucagcagugacauu

SEQ ID NO: 272954 - RNA, 22 nt, Human
ucuuucauucuagucugagguu

SEQ ID NO: 272955 - RNA, 22 nt, Human
ggagacugaucugagugauaac

SEQ ID NO: 272956 - RNA, 22 nt, Human
guauaagguauguaaacuauuu

SEQ ID NO: 272957 - RNA, 22 nt, Human
uggccagcccuucagccaugcc

SEQ ID NO: 272958 - RNA, 22 nt, Human
ugggccaggucugugucagcug

SEQ ID NO: 272959 - RNA, 22 nt, Human
guuagaaaugcagaaacuugac

SEQ ID NO: 272960 - RNA, 22 nt, Human
guggccuggcgagcuggcgcgg

SEQ ID NO: 272961 - RNA, 21 nt, Human
aggcagcucaggcccagagag

SEQ ID NO: 272962 - RNA, 22 nt, Human
uaaaugucaaugugauuuauaa

SEQ ID NO: 272963 - RNA, 22 nt, Human
gagggaggggagcuccacccuc

SEQ ID NO: 272964 - RNA, 18 nt, Human
aucugcuggcaggucugg

SEQ ID NO: 272965 - RNA, 22 nt, Human
cugagccagagggagucggguc

SEQ ID NO: 272966 - RNA, 22 nt, Human
ggagagaaucugaaccugcucc

SEQ ID NO: 272967 - RNA, 22 nt, Human
ugcaugcagcuggugauaagaa

SEQ ID NO: 272968 - RNA, 22 nt, Human
uagacaggagucaggcuagaau

SEQ ID NO: 272969 - RNA, 22 nt, Human
auaguuugugaaacacagcagu

SEQ ID NO: 272970 - RNA, 22 nt, Human
ccucuuccagcuguugcuucca

SEQ ID NO: 272971 - RNA, 22 nt, Human
agcagcagugacagccgaaagc

SEQ ID NO: 272972 - RNA, 22 nt, Human
auacauagcaggguaguagauc

SEQ ID NO: 272973 - RNA, 23 nt, Human
caggagauggcugcugugucagc

SEQ ID NO: 272974 - RNA, 22 nt, Human
uuaggaaagaagcagcuaggag

SEQ ID NO: 272975 - RNA, 22 nt, Human
ucugcuggccuuagcaggucua

SEQ ID NO: 272976 - RNA, 22 nt, Human
agcuggguacagccugugccua

SEQ ID NO: 272977 - RNA, 22 nt, Human
agugauuugggugucagaaagu

SEQ ID NO: 272978 - RNA, 22 nt, Human
ucaaaugcuucuacuccuaaga

SEQ ID NO: 272979 - RNA, 22 nt, Human
gcaaagcacacccucagaguuu

SEQ ID NO: 272980 - RNA, 22 nt, Human
aggaauguaauaguguggcuca

SEQ ID NO: 272981 - RNA, 22 nt, Human
ggccuugagcagggagaaacca

SEQ ID NO: 272982 - RNA, 22 nt, Human
ucugucuucaucagcaugugau

SEQ ID NO: 272983 - RNA, 22 nt, Human
uggcagggugggcuucagcccc

SEQ ID NO: 272984 - RNA, 22 nt, Human
cucaggcccacagcagacccac

SEQ ID NO: 272985 - RNA, 18 nt, Human
cuccugggcugcagaugc

SEQ ID NO: 272986 - RNA, 22 nt, Human
gacagccaucagcacacgcugc

SEQ ID NO: 272987 - RNA, 22 nt, Human
auggaauuaaaagucaaguaau

SEQ ID NO: 272988 - RNA, 22 nt, Human
agagcuuuagcugcuggucugg

SEQ ID NO: 272989 - RNA, 22 nt, Human
uuuacuuucucaaguauauagg

SEQ ID NO: 272990 - RNA, 23 nt, Human
caggugguagagaaaaauccaga

SEQ ID NO: 272991 - RNA, 22 nt, Human
augcaaaaacugcacuuacgcu

SEQ ID NO: 272992 - RNA, 22 nt, Human
ugaucccaaucuuuccugcucc

SEQ ID NO: 272993 - RNA, 22 nt, Human
ucuguggcaguucugguucauc

SEQ ID NO: 272994 - RNA, 22 nt, Human
cugcccugggauggucugugcg

SEQ ID NO: 272995 - RNA, 22 nt, Human
ucuccucccaggcucuuccagg

SEQ ID NO: 272996 - RNA, 22 nt, Human
agggaacuccaugaggccagag

SEQ ID NO: 272997 - RNA, 22 nt, Human
cagaugcugccugggaaugucu

SEQ ID NO: 272998 - RNA, 22 nt, Human
cuggcaggaagaggaaagguca

SEQ ID NO: 272999 - RNA, 22 nt, Human
gaugugucauuuggucaucugc

SEQ ID NO: 273000 - RNA, 22 nt, Human
uccuagaacagcccaccuggaa

SEQ ID NO: 273001 - RNA, 22 nt, Human
cauuuguuaauuacuauuaucu

SEQ ID NO: 273002 - RNA, 22 nt, Human
auguucuuucagccagugcauc

SEQ ID NO: 273003 - RNA, 22 nt, Human
ggaggccauaguuugggaguca

SEQ ID NO: 273004 - RNA, 22 nt, Human
gacuaaaugcuuugugcaugca

SEQ ID NO: 273005 - RNA, 22 nt, Human
aaagccaugggucuuuggcaua

SEQ ID NO: 273006 - RNA, 22 nt, Human
ccuggcuguuuauuucggggcu

SEQ ID NO: 273007 - RNA, 17 nt, Human
uuacaacgucaucucug

SEQ ID NO: 273008 - RNA, 21 nt, Human
ugauugauauuugcaaacaga

SEQ ID NO: 273009 - RNA, 22 nt, Human
agaagccaaaugccagugaccu

SEQ ID NO: 273010 - RNA, 22 nt, Human
gcugauuuugagaagcacaguc

SEQ ID NO: 273011 - RNA, 22 nt, Human
uguacuugaacuugacuguaga

SEQ ID NO: 273012 - RNA, 22 nt, Human
ggcacagggugauguugcaguu

SEQ ID NO: 273013 - RNA, 22 nt, Human
ucagcaggcaccggaaguguuu

SEQ ID NO: 273014 - RNA, 22 nt, Human
ucucaggcuccugacauauaug

SEQ ID NO: 273015 - RNA, 22 nt, Human
uuguuacuguucuacauacagu

SEQ ID NO: 273016 - RNA, 22 nt, Human
aggccagaacagcucugcacca

SEQ ID NO: 273017 - RNA, 22 nt, Human
ucaggaagcugcucuggguggu

SEQ ID NO: 273018 - RNA, 22 nt, Human
gcccagccuccaagcuccaagg

SEQ ID NO: 273019 - RNA, 22 nt, Human
uagcaaaguuuuguggugauua

SEQ ID NO: 273020 - RNA, 22 nt, Human
caguccugcuggccuucccugg

SEQ ID NO: 273021 - RNA, 22 nt, Human
ugcuuccugcuaaggcugccug

SEQ ID NO: 273022 - RNA, 22 nt, Human
aucuuguucucccuuguucuua

SEQ ID NO: 273023 - RNA, 22 nt, Human
gcuggcagggugguugagagag

SEQ ID NO: 273024 - RNA, 22 nt, Human
ucugaauuuugaugugcauuga

SEQ ID NO: 273025 - RNA, 22 nt, Human
ggacaggcugcaucugagcaug

SEQ ID NO: 273026 - RNA, 22 nt, Human
ucugcaccuuucuuaaaaaucg

SEQ ID NO: 273027 - RNA, 22 nt, Human
uuuucuucggugcuggguugau

SEQ ID NO: 273028 - RNA, 18 nt, Human
ucuagaaacccagacucu

SEQ ID NO: 273029 - RNA, 22 nt, Human
aaacauguaauucugcuuaaga

SEQ ID NO: 273030 - RNA, 18 nt, Human
cccccagccaaauucucu

SEQ ID NO: 273031 - RNA, 22 nt, Human
uuucaucauguuggcagauugg

SEQ ID NO: 273032 - RNA, 22 nt, Human
aacuagaaaacaagaugcugau

SEQ ID NO: 273033 - RNA, 22 nt, Human
gucuguggucccugcuggggac

SEQ ID NO: 273034 - RNA, 22 nt, Human
ucuuuuuuuccugugcagagcu

SEQ ID NO: 273035 - RNA, 22 nt, Human
cucugucacuucuccagcugag

SEQ ID NO: 273036 - RNA, 22 nt, Human
agucuuagaacuacagugccua

SEQ ID NO: 273037 - RNA, 22 nt, Human
ugcaagcacucaaugcaaacag

SEQ ID NO: 273038 - RNA, 22 nt, Human
guccugagggcccaggcauucu

SEQ ID NO: 273039 - RNA, 22 nt, Human
uuugaauauacuucaaacaaag

SEQ ID NO: 273040 - RNA, 22 nt, Human
ggcucccacccauagggcgagu

SEQ ID NO: 273041 - RNA, 22 nt, Human
cccaguuuucugauugaagagc

SEQ ID NO: 273042 - RNA, 22 nt, Human
accagcagaguugaggaggaca

SEQ ID NO: 273043 - RNA, 22 nt, Human
acuguucauuuguccuguaucu

SEQ ID NO: 273044 - RNA, 22 nt, Human
ucuuugggagaaggggucccag

SEQ ID NO: 273045 - RNA, 19 nt, Human
ugcuuugcaucugauuguu

SEQ ID NO: 273046 - RNA, 22 nt, Human
acugugauguucucuaucuugg

SEQ ID NO: 273047 - RNA, 22 nt, Human
acucuggcccuccugcugccag

SEQ ID NO: 273048 - RNA, 22 nt, Human
gaguccaguuguucacagaggc

SEQ ID NO: 273049 - RNA, 22 nt, Human
guuucaaagcacagcucacauu

SEQ ID NO: 273050 - RNA, 22 nt, Human
uugagggagcacagauucuuau

SEQ ID NO: 273051 - RNA, 22 nt, Human
uauguauccguguguguacaga

SEQ ID NO: 273052 - RNA, 22 nt, Human
ggcgcccaucggugcagagggc

SEQ ID NO: 273053 - RNA, 22 nt, Human
guaucuaugauccuuuauaucu

SEQ ID NO: 273054 - RNA, 22 nt, Human
uuccugggccuuaaaucuuuug

SEQ ID NO: 273055 - RNA, 22 nt, Human
cuggccagaagcaccuuuggcg

SEQ ID NO: 273056 - RNA, 19 nt, Human
acagugcuucugagugagg

SEQ ID NO: 273057 - RNA, 20 nt, Human
uggucuggagccagugagga

SEQ ID NO: 273058 - RNA, 23 nt, Human
uuucuguuccucuagcuuugcau

SEQ ID NO: 273059 - RNA, 22 nt, Human
auuucauacuaaggcucaaaaa

SEQ ID NO: 273060 - RNA, 22 nt, Human
uuccugguggcuuugccaacug

SEQ ID NO: 273061 - RNA, 22 nt, Human
acaaaguuauucuuucagagga

SEQ ID NO: 273062 - RNA, 22 nt, Human
aaggcuggguuugggaugugau

SEQ ID NO: 273063 - RNA, 22 nt, Human
caguucucugugccucgcuggg

SEQ ID NO: 273064 - RNA, 22 nt, Human
cauuuguaauacugacuugcag

SEQ ID NO: 273065 - RNA, 22 nt, Human
gcagcacaaaguccccagggac

SEQ ID NO: 273066 - RNA, 22 nt, Human
ugauuuacacaucaaagcagca

SEQ ID NO: 273067 - RNA, 22 nt, Human
gaggugucaggguagucaugau

SEQ ID NO: 273068 - RNA, 22 nt, Human
agguaacuguggcuagguaacu

SEQ ID NO: 273069 - RNA, 22 nt, Human
acuaaagugcaccccuuugaga

SEQ ID NO: 273070 - RNA, 22 nt, Human
aaggcuccgugacuggggcuga

SEQ ID NO: 273071 - RNA, 22 nt, Human
uaaggccagcaugaaugcagca

SEQ ID NO: 273072 - RNA, 21 nt, Human
uacaccaguuuacacuuccuc

SEQ ID NO: 273073 - RNA, 22 nt, Human
aaccagcuuugauacgcauuau

SEQ ID NO: 273074 - RNA, 22 nt, Human
ucuguaaacacccguaagcuuu

SEQ ID NO: 273075 - RNA, 22 nt, Human
aggcucugggcucuagauuuug

SEQ ID NO: 273076 - RNA, 22 nt, Human
uucaaucauuagaaucucaggc

SEQ ID NO: 273077 - RNA, 21 nt, Human
agaagcuagucacuaaaucca

SEQ ID NO: 273078 - RNA, 22 nt, Human
uguauguguauguacauaugca

SEQ ID NO: 273079 - RNA, 22 nt, Human
auguucauccaugucguagcag

SEQ ID NO: 273080 - RNA, 22 nt, Human
uuccauaaucaccuuauucuuu

SEQ ID NO: 273081 - RNA, 22 nt, Human
gaccauuagcugcuauucagua

SEQ ID NO: 273082 - RNA, 22 nt, Human
ccugccagaaaagagggaguuc

SEQ ID NO: 273083 - RNA, 22 nt, Human
gagggcugcuggaaaaaugcag

SEQ ID NO: 273084 - RNA, 22 nt, Human
gucucagaccacccucuuuggc

SEQ ID NO: 273085 - RNA, 22 nt, Human
uucacaucuauaacuuagauaa

SEQ ID NO: 273086 - RNA, 22 nt, Human
cugggcuuuugagucacaaggg

SEQ ID NO: 273087 - RNA, 22 nt, Human
uaucuacaggugucagguaaga

SEQ ID NO: 273088 - RNA, 22 nt, Human
cagggcaggaauuugacauugc

SEQ ID NO: 273089 - RNA, 22 nt, Human
uguauugaggauucauuuuugu

SEQ ID NO: 273090 - RNA, 22 nt, Human
accagccaccaccaggagaucg

SEQ ID NO: 273091 - RNA, 19 nt, Human
cccacaggaggacauaugg

SEQ ID NO: 273092 - RNA, 22 nt, Human
cacaugacacuauuuuguucua

SEQ ID NO: 273093 - RNA, 22 nt, Human
caggaaacggcuauucuuuugu

SEQ ID NO: 273094 - RNA, 22 nt, Human
agugugagaacggacuaauaaa

SEQ ID NO: 273095 - RNA, 22 nt, Human
cagugcuggaggcuggagggaa

SEQ ID NO: 273096 - RNA, 22 nt, Human
cuugggaaugcuaacagaugac

SEQ ID NO: 273097 - RNA, 22 nt, Human
ucuucuguggcucucaccaccc

SEQ ID NO: 273098 - RNA, 21 nt, Human
agugacagaggaaggugcaua

SEQ ID NO: 273099 - RNA, 19 nt, Human
agggccugcagcucaagcu

SEQ ID NO: 273100 - RNA, 22 nt, Human
aaugagcugcugcuguuccacc

SEQ ID NO: 273101 - RNA, 21 nt, Human
gccugccugcgugacccucuu

SEQ ID NO: 273102 - RNA, 22 nt, Human
gagcccuguucaggccuccuca

SEQ ID NO: 273103 - RNA, 22 nt, Human
uuccuggguuuacguauugggu

SEQ ID NO: 273104 - RNA, 22 nt, Human
uuuggacaaguuacugguuucc

SEQ ID NO: 273105 - RNA, 22 nt, Human
guucauauuacuuugagugcag

SEQ ID NO: 273106 - RNA, 22 nt, Human
gagcugcuggcuccucagguua

SEQ ID NO: 273107 - RNA, 22 nt, Human
ccucagccuuggccccaggcag

SEQ ID NO: 273108 - RNA, 21 nt, Human
uucauucauggcauaauauag

SEQ ID NO: 273109 - RNA, 18 nt, Human
cauuaugugguuauagaa

SEQ ID NO: 273110 - RNA, 22 nt, Human
cccaggcuggaauuccaggccu

SEQ ID NO: 273111 - RNA, 22 nt, Human
gcugagguuuucugccugcuca

SEQ ID NO: 273112 - RNA, 22 nt, Human
ccaggccuccugugaguggacc

SEQ ID NO: 273113 - RNA, 22 nt, Human
gaccagcugauaaggcauauaa

SEQ ID NO: 273114 - RNA, 22 nt, Human
aggcuuuaauuaucuacaggag

SEQ ID NO: 273115 - RNA, 22 nt, Human
uggcucugucacugugagcuau

SEQ ID NO: 273116 - RNA, 22 nt, Human
agcuagaauauugaucugaaau

SEQ ID NO: 273117 - RNA, 22 nt, Human
aaaugaugcucacagauuagug

SEQ ID NO: 273118 - RNA, 22 nt, Human
ggaauaaaaauuguuuacugua

SEQ ID NO: 273119 - RNA, 18 nt, Human
uccagucccaaggccagc

SEQ ID NO: 273120 - RNA, 22 nt, Human
auuuccuaauuuaugcaggagu

SEQ ID NO: 273121 - RNA, 22 nt, Human
ucugcgcccugucgccugcucc

SEQ ID NO: 273122 - RNA, 22 nt, Human
ucugggagguguuuugagaacu

SEQ ID NO: 273123 - RNA, 22 nt, Human
aucuuucaaucaggaaaaaucu

SEQ ID NO: 273124 - RNA, 22 nt, Human
uggagcagcuaagccucugaga

SEQ ID NO: 273125 - RNA, 22 nt, Human
ccuccaggaggaaauggaacac

SEQ ID NO: 273126 - RNA, 22 nt, Human
cuuguauuaugguucgcuuagu

SEQ ID NO: 273127 - RNA, 22 nt, Human
ccuggcagcgugccgagcugcg

SEQ ID NO: 273128 - RNA, 22 nt, Human
aggaagccuggcauuaaaaagc

SEQ ID NO: 273129 - RNA, 20 nt, Human
aacauugaaagucuagaaga

SEQ ID NO: 273130 - RNA, 22 nt, Human
uuuaauauccaguggauacaaa

SEQ ID NO: 273131 - RNA, 22 nt, Human
gaggagaggggcucccaagagc

SEQ ID NO: 273132 - RNA, 22 nt, Human
acaggcagcaaaaucagccuca

SEQ ID NO: 273133 - RNA, 22 nt, Human
aaggcacucauucaaggagaua

SEQ ID NO: 273134 - RNA, 22 nt, Human
agucacugagauggugaggcua

SEQ ID NO: 273135 - RNA, 22 nt, Human
gggaccagaagaaggaugguga

SEQ ID NO: 273136 - RNA, 18 nt, Human
ucuuuguuuccuucuugc

SEQ ID NO: 273137 - RNA, 22 nt, Human
ugacacaggggaaggagucugg

SEQ ID NO: 273138 - RNA, 22 nt, Human
agggccugugcugaguagacga

SEQ ID NO: 273139 - RNA, 22 nt, Human
uggauucucaugggaccaguag

SEQ ID NO: 273140 - RNA, 22 nt, Human
uggcagguuaugcgggccacau

SEQ ID NO: 273141 - RNA, 22 nt, Human
caaguccuuagaugguucuuug

SEQ ID NO: 273142 - RNA, 22 nt, Human
caggcauaaucucaucuuguuu

SEQ ID NO: 273143 - RNA, 22 nt, Human
guuuccuaggcuuauacagcug

SEQ ID NO: 273144 - RNA, 22 nt, Human
agaccuggaugugagggaagua

SEQ ID NO: 273145 - RNA, 18 nt, Human
guccauggccuccaccca

SEQ ID NO: 273146 - RNA, 22 nt, Human
caggccagugggaaauagggau

SEQ ID NO: 273147 - RNA, 20 nt, Human
cagcuuuagaucuuugauua

SEQ ID NO: 273148 - RNA, 18 nt, Human
ucuuuggacaacuacugg

SEQ ID NO: 273149 - RNA, 22 nt, Human
augcuaaauguuaauguuaccu

SEQ ID NO: 273150 - RNA, 22 nt, Human
auuguacaugcagugagucauc

SEQ ID NO: 273151 - RNA, 23 nt, Human
ggggacagagggcagcccgcauc

SEQ ID NO: 273152 - RNA, 22 nt, Human
auucuuauuuaaauagagucug

SEQ ID NO: 273153 - RNA, 21 nt, Human
cuguuucuugugaagugacac

SEQ ID NO: 273154 - RNA, 22 nt, Human
uaacuguuuuugaaauauaucu

SEQ ID NO: 273155 - RNA, 18 nt, Human
aaaugcuaggcuacauga

SEQ ID NO: 273156 - RNA, 22 nt, Human
gcaaaaguacagccggauuucu

SEQ ID NO: 273157 - RNA, 22 nt, Human
ucaggugguccuaagugccauc

SEQ ID NO: 273158 - RNA, 22 nt, Human
agucucugagguucagaugccu

SEQ ID NO: 273159 - RNA, 22 nt, Human
guaggcagugcuugauuuucca

SEQ ID NO: 273160 - RNA, 20 nt, Human
ggaaggcuguuuuuccacca

SEQ ID NO: 273161 - RNA, 22 nt, Human
agagcuuuuugacaucucucua

SEQ ID NO: 273162 - RNA, 22 nt, Human
aggaaaaauaaggcagcagggc

SEQ ID NO: 273163 - RNA, 22 nt, Human
ucuccccagcugagcugcccuu

SEQ ID NO: 273164 - RNA, 22 nt, Human
auguuacuuagaauaauucugg

SEQ ID NO: 273165 - RNA, 22 nt, Human
aagggcagggaguuugugucua

SEQ ID NO: 273166 - RNA, 20 nt, Human
acuggcagccugccugcugu

SEQ ID NO: 273167 - RNA, 19 nt, Human
uagggcuggccgggcggug

SEQ ID NO: 273168 - RNA, 22 nt, Human
ggccacagaacagcuacaggac

SEQ ID NO: 273169 - RNA, 22 nt, Human
cacugcccaggcacccaucuug

SEQ ID NO: 273170 - RNA, 22 nt, Human
ccagggcauccucacaucgcag

SEQ ID NO: 273171 - RNA, 18 nt, Human
gcucagguauagacaggg

SEQ ID NO: 273172 - RNA, 22 nt, Human
uccaggucaucuuggagagcug

SEQ ID NO: 273173 - RNA, 22 nt, Human
gcugccugcuucaugugggaga

SEQ ID NO: 273174 - RNA, 22 nt, Human
ugcucuggcuggagcaaugacu

SEQ ID NO: 273175 - RNA, 22 nt, Human
ggcucugcuucagaaggcucau

SEQ ID NO: 273176 - RNA, 18 nt, Human
ccagcaugccagaggcug

SEQ ID NO: 273177 - RNA, 22 nt, Human
uuggaugggcauuaggaaaguc

SEQ ID NO: 273178 - RNA, 22 nt, Human
aaggcugauuagacugauagcu

SEQ ID NO: 273179 - RNA, 21 nt, Human
uuagaaagcucacuacaguua

SEQ ID NO: 273180 - RNA, 22 nt, Human
cugcccaggcugaaggaacauc

SEQ ID NO: 273181 - RNA, 22 nt, Human
aggacaguguggaagagggugc

SEQ ID NO: 273182 - RNA, 22 nt, Human
uggcccugcugggucagagcug

SEQ ID NO: 273183 - RNA, 22 nt, Human
gguuuuaaccauucacaaguga

SEQ ID NO: 273184 - RNA, 22 nt, Human
auccugggggcagcuggaaaca

SEQ ID NO: 273185 - RNA, 22 nt, Human
agggcacaggcuccggguccag

SEQ ID NO: 273186 - RNA, 22 nt, Human
gaggggcacagcagcuguugca

SEQ ID NO: 273187 - RNA, 22 nt, Human
uuuuauauugagugagaguucc

SEQ ID NO: 273188 - RNA, 22 nt, Human
agaaguaucaggaagauucuca

SEQ ID NO: 273189 - RNA, 22 nt, Human
cucuauuuauggcaucuuuaug

SEQ ID NO: 273190 - RNA, 22 nt, Human
ugaggccugggcacauaaccuc

SEQ ID NO: 273191 - RNA, 22 nt, Human
gugaauaauauuguuuauaaaa

SEQ ID NO: 273192 - RNA, 22 nt, Human
ucugccaugcuaacuucaguau

SEQ ID NO: 273193 - RNA, 22 nt, Human
gaggccaacuuuggagaacagg

SEQ ID NO: 273194 - RNA, 22 nt, Human
ccugggcuguaccugugcgcgg

SEQ ID NO: 273195 - RNA, 22 nt, Human
ugccugacugcugccaccacua

SEQ ID NO: 273196 - RNA, 22 nt, Human
aagaaaugcacacaacugcugg

SEQ ID NO: 273197 - RNA, 22 nt, Human
uccaauaaccacaaucagauag

SEQ ID NO: 273198 - RNA, 22 nt, Human
gcacacaguagggauucaauga

SEQ ID NO: 273199 - RNA, 22 nt, Human
uagagguguugacgccaaggua

SEQ ID NO: 273200 - RNA, 22 nt, Human
acuuuacaggcacuucaaguau

SEQ ID NO: 273201 - RNA, 22 nt, Human
aaggaggguucccagguccugg

SEQ ID NO: 273202 - RNA, 20 nt, Human
aagaggugauaacaggugag

SEQ ID NO: 273203 - RNA, 22 nt, Human
acagggcagcaacuuugugccu

SEQ ID NO: 273204 - RNA, 22 nt, Human
cuacaugaaaauaaguuugaaa

SEQ ID NO: 273205 - RNA, 22 nt, Human
gacuuuaugaagagaugaccaa

SEQ ID NO: 273206 - RNA, 22 nt, Human
cauuucugauuacagaauacua

SEQ ID NO: 273207 - RNA, 22 nt, Human
guagggcauguaagucaccaua

SEQ ID NO: 273208 - RNA, 22 nt, Human
aggcacaggaacaggaaaagag

SEQ ID NO: 273209 - RNA, 22 nt, Human
ccauccugucuguggccucagg

SEQ ID NO: 273210 - RNA, 22 nt, Human
ccuuucugauggccucccagcc

SEQ ID NO: 273211 - RNA, 22 nt, Human
gugcaaaaguacuugcggauuu

SEQ ID NO: 273212 - RNA, 22 nt, Human
acucugggaucuugaaaagagu

SEQ ID NO: 273213 - RNA, 21 nt, Human
gggagggauggaaaugauguu

SEQ ID NO: 273214 - RNA, 22 nt, Human
agauaucugcaauauaauuuaa

SEQ ID NO: 273215 - RNA, 20 nt, Human
gcugccuguuucuguaagua

SEQ ID NO: 273216 - RNA, 22 nt, Human
uauaguaaaauuuucauuuaug

SEQ ID NO: 273217 - RNA, 22 nt, Human
gccuugggcacaggcagggccc

SEQ ID NO: 273218 - RNA, 22 nt, Human
uguguucuggcugugacagcug

SEQ ID NO: 273219 - RNA, 19 nt, Human
ugggcuuccccagggcaga

SEQ ID NO: 273220 - RNA, 22 nt, Human
guccuggcaccucacuggcuac

SEQ ID NO: 273221 - RNA, 22 nt, Human
cagcucuuccuagccaugccac

SEQ ID NO: 273222 - RNA, 22 nt, Human
caaauagaagguacucagagaa

SEQ ID NO: 273223 - RNA, 19 nt, Human
aauagauuaauuauccucu

SEQ ID NO: 273224 - RNA, 22 nt, Human
cccagagggcugaggauaugaa

SEQ ID NO: 273225 - RNA, 22 nt, Human
ucugggagguggcagggugcau

SEQ ID NO: 273226 - RNA, 22 nt, Human
ucuggggagugccuaaguggaa

SEQ ID NO: 273227 - RNA, 22 nt, Human
cugggagacgcagcuggggauc

SEQ ID NO: 273228 - RNA, 22 nt, Human
aaacugcagccuugaguucagg

SEQ ID NO: 273229 - RNA, 22 nt, Human
cuggauguaacgaagguuucac

SEQ ID NO: 273230 - RNA, 22 nt, Human
uaaauacuuuacaggaugucuc

SEQ ID NO: 273231 - RNA, 22 nt, Human
uuagacaggauguaugaaagcu

SEQ ID NO: 273232 - RNA, 22 nt, Human
uuuguccucuccauguacaaua

SEQ ID NO: 273233 - RNA, 22 nt, Human
uauuucuggcuuugagggugau

SEQ ID NO: 273234 - RNA, 22 nt, Human
gaggaaaaugggacaggcugua

SEQ ID NO: 273235 - RNA, 22 nt, Human
aagcccagcaucccugcaccag

SEQ ID NO: 273236 - RNA, 19 nt, Human
uggcucuguuucucuggag

SEQ ID NO: 273237 - RNA, 22 nt, Human
ugggcugcggauaggccucgga

SEQ ID NO: 273238 - RNA, 22 nt, Human
ugacguuuuagguguuaaaucg

SEQ ID NO: 273239 - RNA, 19 nt, Human
cuuuucaucaacagccaau

SEQ ID NO: 273240 - RNA, 22 nt, Human
agaaauuaggaaaguaacacuu

SEQ ID NO: 273241 - RNA, 22 nt, Human
uucugcuuauucuguagccuuu

SEQ ID NO: 273242 - RNA, 22 nt, Human
uuucacauucagauauagacuu

SEQ ID NO: 273243 - RNA, 22 nt, Human
agucucucacagaggauucucc

SEQ ID NO: 273244 - RNA, 22 nt, Human
gagaaaccuguaaggaaggaag

SEQ ID NO: 273245 - RNA, 22 nt, Human
cucaguguuaaauauaagguau

SEQ ID NO: 273246 - RNA, 22 nt, Human
ggccagagagcagccaggauuc

SEQ ID NO: 273247 - RNA, 22 nt, Human
cacccacauuccucuaguaugu

SEQ ID NO: 273248 - RNA, 22 nt, Human
ugacagagcauguagugacagc

SEQ ID NO: 273249 - RNA, 22 nt, Human
acagguguguucccggaaagcc

SEQ ID NO: 273250 - RNA, 22 nt, Human
uaguuaggaaaguccagggagc

SEQ ID NO: 273251 - RNA, 22 nt, Human
gauuuggcuuggaugauuaaac

SEQ ID NO: 273252 - RNA, 22 nt, Human
agaaucaauuagauucuaugag

SEQ ID NO: 273253 - RNA, 22 nt, Human
uuccagccagauuugcuggguu

SEQ ID NO: 273254 - RNA, 22 nt, Human
ccaggcugcuuuauuacucugu

SEQ ID NO: 273255 - RNA, 22 nt, Human
aaaguuuuagaacuaggaagca

SEQ ID NO: 273256 - RNA, 17 nt, Human
ucuccuggcucuaucag

SEQ ID NO: 273257 - RNA, 22 nt, Human
gcccuguuuugaaacuugcaua

SEQ ID NO: 273258 - RNA, 22 nt, Human
acagguguaaaacccaggaugg

SEQ ID NO: 273259 - RNA, 22 nt, Human
cagcaugaaacaauugagccca

SEQ ID NO: 273260 - RNA, 22 nt, Human
uuuaaauucugucugccgcuua

SEQ ID NO: 273261 - RNA, 22 nt, Human
aaaguggucaccuucucauuuc

SEQ ID NO: 273262 - RNA, 21 nt, Human
ggccucagccaccuggcucug

SEQ ID NO: 273263 - RNA, 22 nt, Human
cuccagauuccugcuggcagaa

SEQ ID NO: 273264 - RNA, 18 nt, Human
acaggcugugggaauggu

SEQ ID NO: 273265 - RNA, 22 nt, Human
ucagaagucaugcucagucugu

SEQ ID NO: 273266 - RNA, 22 nt, Human
aaaaguauuuuggaucucagau

SEQ ID NO: 273267 - RNA, 20 nt, Human
ggaaggcuugaaguuuacau

SEQ ID NO: 273268 - RNA, 20 nt, Human
uucuggaggcuacaagucug

SEQ ID NO: 273269 - RNA, 22 nt, Human
gggcugagccacagcuuuuguu

SEQ ID NO: 273270 - RNA, 22 nt, Human
ucucagaguaauucuuuaaggu

SEQ ID NO: 273271 - RNA, 22 nt, Human
ugagauguaagguaugcuuacu

SEQ ID NO: 273272 - RNA, 22 nt, Human
uguauuuucuucuggaagcuua

SEQ ID NO: 273273 - RNA, 22 nt, Human
uccugggaguaaaagcugcccu

SEQ ID NO: 273274 - RNA, 22 nt, Human
cuggcagcuuagcacucugguu

SEQ ID NO: 273275 - RNA, 22 nt, Human
agggcugacaguggcguggcgu

SEQ ID NO: 273276 - RNA, 22 nt, Human
agcugggcuggagcuccaagcg

SEQ ID NO: 273277 - RNA, 22 nt, Human
ugauuuaggaaacagcuacagg

SEQ ID NO: 273278 - RNA, 22 nt, Human
ucugagcuacgaugccugucac

SEQ ID NO: 273279 - RNA, 22 nt, Human
gacccagcuaaccaggugggga

SEQ ID NO: 273280 - RNA, 22 nt, Human
guguaugauuucaaauggcuag

SEQ ID NO: 273281 - RNA, 23 nt, Human
ccugcaaagaaacaagccaccug

SEQ ID NO: 273282 - RNA, 22 nt, Human
uuuacagucucuauagucaaaa

SEQ ID NO: 273283 - RNA, 22 nt, Human
ugggugagccacaggaguuguc

SEQ ID NO: 273284 - RNA, 22 nt, Human
uucuaauuguguuugcauaucu

SEQ ID NO: 273285 - RNA, 22 nt, Human
cccagacauaacagcagagagg

SEQ ID NO: 273286 - RNA, 22 nt, Human
gcagggcucauugccaggcauu

SEQ ID NO: 273287 - RNA, 19 nt, Human
aauguaguguuaugucaac

SEQ ID NO: 273288 - RNA, 22 nt, Human
uuucuuccuaaauaugauuucc

SEQ ID NO: 273289 - RNA, 22 nt, Human
agguagggcuaggcugcgucug

SEQ ID NO: 273290 - RNA, 22 nt, Human
aagcugcagguugaauccaggu

SEQ ID NO: 273291 - RNA, 20 nt, Human
ggaccagcugucugaggggc

SEQ ID NO: 273292 - RNA, 22 nt, Human
aagacuacuuuuggcagugugu

SEQ ID NO: 273293 - RNA, 22 nt, Human
cagcugggugaucuugggcagg

SEQ ID NO: 273294 - RNA, 22 nt, Human
caugcugugguaaaucacugaa

SEQ ID NO: 273295 - RNA, 22 nt, Human
uccaggagaaggccauccagcg

SEQ ID NO: 273296 - RNA, 22 nt, Human
gugaauggggcaggaaggaugg

SEQ ID NO: 273297 - RNA, 22 nt, Human
cuuugcauucucagcacagagc

SEQ ID NO: 273298 - RNA, 22 nt, Human
aucuguguguucaggaaguccu

SEQ ID NO: 273299 - RNA, 22 nt, Human
gaauacaagccugccaccugga

SEQ ID NO: 273300 - RNA, 22 nt, Human
uaugagcagacagugguuuuac

SEQ ID NO: 273301 - RNA, 22 nt, Human
gggcaggcugagcaugucaccu

SEQ ID NO: 273302 - RNA, 22 nt, Human
aaauauagugacacuuauaguc

SEQ ID NO: 273303 - RNA, 22 nt, Human
accagcugccuggucuaucugc

SEQ ID NO: 273304 - RNA, 22 nt, Human
gaccccaggcagaucagggggu

SEQ ID NO: 273305 - RNA, 21 nt, Human
uucacagaugggaaaacugag

SEQ ID NO: 273306 - RNA, 22 nt, Human
guuaguguauauugccuucaaa

SEQ ID NO: 273307 - RNA, 22 nt, Human
uccucacagcugguucauucag

SEQ ID NO: 273308 - RNA, 22 nt, Human
gcuccagaugaaaggccagagg

SEQ ID NO: 273309 - RNA, 22 nt, Human
gaguuagaagacagaauguaaa

SEQ ID NO: 273310 - RNA, 22 nt, Human
uguguccugugaucucuagggu

SEQ ID NO: 273311 - RNA, 22 nt, Human
auaaaugugaauuagagcuuug

SEQ ID NO: 273312 - RNA, 22 nt, Human
gucuggaguggggccugagaau

SEQ ID NO: 273313 - RNA, 22 nt, Human
gacaggugagaugaggaacacc

SEQ ID NO: 273314 - RNA, 22 nt, Human
cagaguggcgacccccucagcu

SEQ ID NO: 273315 - RNA, 22 nt, Human
ugcaggcugggaagagggacaa

SEQ ID NO: 273316 - RNA, 22 nt, Human
guucauuuuacuguaaauagca

SEQ ID NO: 273317 - RNA, 18 nt, Human
ggucacugagaugcuacu

SEQ ID NO: 273318 - RNA, 22 nt, Human
gcuggcuggaugguugguucgc

SEQ ID NO: 273319 - RNA, 22 nt, Human
auccugaaaauugaauggaagg

SEQ ID NO: 273320 - RNA, 22 nt, Human
ccaacucugaaaauccagauau

SEQ ID NO: 273321 - RNA, 22 nt, Human
gauacacuggccaaguggagga

SEQ ID NO: 273322 - RNA, 22 nt, Human
augcuauacucaaagaaauuca

SEQ ID NO: 273323 - RNA, 19 nt, Human
ucugcagaaggcauacaug

SEQ ID NO: 273324 - RNA, 22 nt, Human
ucuguggauuuuaguguucaug

SEQ ID NO: 273325 - RNA, 20 nt, Human
ggcaggugcuguccccuccu

SEQ ID NO: 273326 - RNA, 22 nt, Human
uacaccagguuaccaaucacug

SEQ ID NO: 273327 - RNA, 22 nt, Human
uuauuuaaugugaucugaagag

SEQ ID NO: 273328 - RNA, 22 nt, Human
ugugcagcagcagcuguggaga

SEQ ID NO: 273329 - RNA, 22 nt, Human
ggcaguuuggcaggauggaggg

SEQ ID NO: 273330 - RNA, 22 nt, Human
ugggccucugccacgcuccccc

SEQ ID NO: 273331 - RNA, 22 nt, Human
caggaagcaagugauuuucuug

SEQ ID NO: 273332 - RNA, 22 nt, Human
caccagcuugcagucuuaaccc

SEQ ID NO: 273333 - RNA, 22 nt, Human
aaagccaucaguaaaaugauuu

SEQ ID NO: 273334 - RNA, 22 nt, Human
cugucaaagacuaagguucuua

SEQ ID NO: 273335 - RNA, 22 nt, Human
uacaugugcuggguucuuggcc

SEQ ID NO: 273336 - RNA, 22 nt, Human
gcugggaagugcaagaucaagg

SEQ ID NO: 273337 - RNA, 22 nt, Human
cucugcagagccuccagcccag

SEQ ID NO: 273338 - RNA, 22 nt, Human
uaaacauggauucugaucacag

SEQ ID NO: 273339 - RNA, 17 nt, Human
cagagucugucugcauc

SEQ ID NO: 273340 - RNA, 22 nt, Human
aacugauuguuggaugauagug

SEQ ID NO: 273341 - RNA, 22 nt, Human
uccuguguuaaagggggugcua

SEQ ID NO: 273342 - RNA, 22 nt, Human
aaagugcugggauuacaagugu

SEQ ID NO: 273343 - RNA, 22 nt, Human
uuaagucaauaucaaucucagc

SEQ ID NO: 273344 - RNA, 22 nt, Human
cagaaccugagagcacaauccu

SEQ ID NO: 273345 - RNA, 22 nt, Human
aggccugucccagcugaggacg

SEQ ID NO: 273346 - RNA, 22 nt, Human
aucuuuggguacaaacuugccu

SEQ ID NO: 273347 - RNA, 22 nt, Human
ggcaggcugggugucauggagu

SEQ ID NO: 273348 - RNA, 20 nt, Human
uccugcugccaccucuucuu

SEQ ID NO: 273349 - RNA, 22 nt, Human
aauaauuuccagccaacuggaa

SEQ ID NO: 273350 - RNA, 17 nt, Human
gucuggaguggccuuca

SEQ ID NO: 273351 - RNA, 22 nt, Human
agauuuuaguguagaggacuug

SEQ ID NO: 273352 - RNA, 22 nt, Human
auacaucuuccuuuuaaaaugc

SEQ ID NO: 273353 - RNA, 22 nt, Human
ggaaaaaugacacauaucucaa

SEQ ID NO: 273354 - RNA, 18 nt, Human
acugaagaugcaagaccu

SEQ ID NO: 273355 - RNA, 22 nt, Human
uccuggcucucuacaaaccaga

SEQ ID NO: 273356 - RNA, 22 nt, Human
cuccaggguuccccgauccacu

SEQ ID NO: 273357 - RNA, 22 nt, Human
ugucucugaggugagggucagc

SEQ ID NO: 273358 - RNA, 22 nt, Human
aggugucuucagggugagacag

SEQ ID NO: 273359 - RNA, 20 nt, Human
aagaaguugguaagcagugc

SEQ ID NO: 273360 - RNA, 22 nt, Human
cugaguccuugggcuuagagug

SEQ ID NO: 273361 - RNA, 22 nt, Human
cugcacaguguuggaagcugcc

SEQ ID NO: 273362 - RNA, 22 nt, Human
gagguccauacagcuauucuac

SEQ ID NO: 273363 - RNA, 22 nt, Human
uucacuuauagggauguuauug

SEQ ID NO: 273364 - RNA, 17 nt, Human
agguuuaugguauuuga

SEQ ID NO: 273365 - RNA, 22 nt, Human
agcccuccuuuguucaugcugc

SEQ ID NO: 273366 - RNA, 22 nt, Human
gggucuccuaauggaggaugac

SEQ ID NO: 273367 - RNA, 22 nt, Human
uggcugaguaaguugugauaug

SEQ ID NO: 273368 - RNA, 22 nt, Human
gggggaugcucaggaggcugcu

SEQ ID NO: 273369 - RNA, 15 nt, Human
cuauuucauccuucu

SEQ ID NO: 273370 - RNA, 22 nt, Human
cagcugaggaauacuagaugua

SEQ ID NO: 273371 - RNA, 22 nt, Human
ugucagugucuaugaagaauuu

SEQ ID NO: 273372 - RNA, 22 nt, Human
uagaaacccaggauuuguauuu

SEQ ID NO: 273373 - RNA, 22 nt, Human
agucugaagacucaugucugaa

SEQ ID NO: 273374 - RNA, 22 nt, Human
gaagaggcuuuccuagggcaag

SEQ ID NO: 273375 - RNA, 22 nt, Human
cauagcgguauuccacgugguu

SEQ ID NO: 273376 - RNA, 22 nt, Human
cggagcuggcgucuguguggac

SEQ ID NO: 273377 - RNA, 22 nt, Human
ugggccucggggaagcccgugu

SEQ ID NO: 273378 - RNA, 22 nt, Human
ggccacagugggaaauccuggg

SEQ ID NO: 273379 - RNA, 22 nt, Human
ggcugaaacagauuucaagaca

SEQ ID NO: 273380 - RNA, 22 nt, Human
gguguugggcucacugguccuu

SEQ ID NO: 273381 - RNA, 23 nt, Human
ucuguaggcagcaugccacucuc

SEQ ID NO: 273382 - RNA, 22 nt, Human
uugggaaggcguggaagcagaa

SEQ ID NO: 273383 - RNA, 22 nt, Human
gcucagagcaucccagugaaug

SEQ ID NO: 273384 - RNA, 22 nt, Human
auggcuuugaaguucagcuuuu

SEQ ID NO: 273385 - RNA, 20 nt, Human
ugaaauagauacucagagau

SEQ ID NO: 273386 - RNA, 22 nt, Human
caggugcucugcugcagguaag

SEQ ID NO: 273387 - RNA, 22 nt, Human
ucaggcugcuguacugugaaug

SEQ ID NO: 273388 - RNA, 19 nt, Human
ugcccaggccucccaaaag

SEQ ID NO: 273389 - RNA, 22 nt, Human
cacagaacauuuuuagaugcag

SEQ ID NO: 273390 - RNA, 22 nt, Human
aagggcugcuguagaagcagag

SEQ ID NO: 273391 - RNA, 22 nt, Human
ucuuucggccauagcgaugauu

SEQ ID NO: 273392 - RNA, 22 nt, Human
uucuccaacacaagcaugaugu

SEQ ID NO: 273393 - RNA, 22 nt, Human
ugaggccaugcccgugccggcc

SEQ ID NO: 273394 - RNA, 22 nt, Human
ggcaaagagacaugcaucgggg

SEQ ID NO: 273395 - RNA, 22 nt, Human
aauucaaucuaagaaaugauca

SEQ ID NO: 273396 - RNA, 22 nt, Human
acacauguuuacagucuucagu

SEQ ID NO: 273397 - RNA, 22 nt, Human
ugucuguaauagucacuaugug

SEQ ID NO: 273398 - RNA, 22 nt, Human
cagcugcucugguggucucucc

SEQ ID NO: 273399 - RNA, 22 nt, Human
gcuuucccugcccucagaagga

SEQ ID NO: 273400 - RNA, 22 nt, Human
augaaugagaaagcugaaaucu

SEQ ID NO: 273401 - RNA, 22 nt, Human
cagcuggcuccaccucugggcu

SEQ ID NO: 273402 - RNA, 22 nt, Human
cacagguuugacaaggauaaaa

SEQ ID NO: 273403 - RNA, 22 nt, Human
uggcaguggcucagagugcaga

SEQ ID NO: 273404 - RNA, 22 nt, Human
aacuacagaaucauagaaaaua

SEQ ID NO: 273405 - RNA, 19 nt, Human
cuguugcuggggcucucuu

SEQ ID NO: 273406 - RNA, 22 nt, Human
uugagauggagcuucacucuug

SEQ ID NO: 273407 - RNA, 22 nt, Human
aggccuugccaaugagagaacu

SEQ ID NO: 273408 - RNA, 22 nt, Human
agaauucugacaauagaauugg

SEQ ID NO: 273409 - RNA, 22 nt, Human
aauaucugucucuaaugcauau

SEQ ID NO: 273410 - RNA, 22 nt, Human
accugggaaaaggaguggccau

SEQ ID NO: 273411 - RNA, 22 nt, Human
gaccugggguaagcuuggcaac

SEQ ID NO: 273412 - RNA, 20 nt, Human
ucuccuggugacaguaccca

SEQ ID NO: 273413 - RNA, 21 nt, Human
acaguacuugagaucuuuuga

SEQ ID NO: 273414 - RNA, 22 nt, Human
acuugaauaggaaagccacaaa

SEQ ID NO: 273415 - RNA, 22 nt, Human
uagaaaacuaauacaugcuuga

SEQ ID NO: 273416 - RNA, 22 nt, Human
ggcugagaaggagugggugagg

SEQ ID NO: 273417 - RNA, 22 nt, Human
gcaggcuugggacgagcuggag

SEQ ID NO: 273418 - RNA, 22 nt, Human
uacaaacuguuauuauuauugu

SEQ ID NO: 273419 - RNA, 22 nt, Human
caguagccuuauuuggaucauu

SEQ ID NO: 273420 - RNA, 22 nt, Human
accccaaaagaguaauagaauu

SEQ ID NO: 273421 - RNA, 22 nt, Human
gccuggcuggucacugccuggc

SEQ ID NO: 273422 - RNA, 22 nt, Human
uugcuuagagccaaucuugauu

SEQ ID NO: 273423 - RNA, 19 nt, Human
uaucaaucacggcaucuuu

SEQ ID NO: 273424 - RNA, 22 nt, Human
ucugggcagccucaggccaggg

SEQ ID NO: 273425 - RNA, 22 nt, Human
aaucagaauuuauugaaucuuu

SEQ ID NO: 273426 - RNA, 22 nt, Human
ccuggacuguguccugugguca

SEQ ID NO: 273427 - RNA, 23 nt, Human
cagaccuuucuguaucaguuauc

SEQ ID NO: 273428 - RNA, 22 nt, Human
uauccaauucaccauugauggg

SEQ ID NO: 273429 - RNA, 22 nt, Human
cuggcccuaugagccuccugau

SEQ ID NO: 273430 - RNA, 22 nt, Human
gaaacacauaugaacaguugau

SEQ ID NO: 273431 - RNA, 22 nt, Human
ugacagagagguaaguuaugaa

SEQ ID NO: 273432 - RNA, 22 nt, Human
uuauugaaggaacugaaauaaa

SEQ ID NO: 273433 - RNA, 22 nt, Human
augugucaauuuucaaaugcuu

SEQ ID NO: 273434 - RNA, 22 nt, Human
ucucccaguccucugugcuuac

SEQ ID NO: 273435 - RNA, 22 nt, Human
uuuggaaugcccauggacuggu

SEQ ID NO: 273436 - RNA, 22 nt, Human
uagcauuuauggucaugugucc

SEQ ID NO: 273437 - RNA, 22 nt, Human
ugacccauuaaccacuuucccu

SEQ ID NO: 273438 - RNA, 22 nt, Human
ccagacccugcucuggggcucu

SEQ ID NO: 273439 - RNA, 22 nt, Human
uuugcaguuucauugcugaaau

SEQ ID NO: 273440 - RNA, 22 nt, Human
uguagauaaguaaaagcccagu

SEQ ID NO: 273441 - RNA, 22 nt, Human
ucugggcuuuguaaugggaggu

SEQ ID NO: 273442 - RNA, 22 nt, Human
gacaccaggaauaguucugucu

SEQ ID NO: 273443 - RNA, 22 nt, Human
ucuucauuuuacaggcagaccu

SEQ ID NO: 273444 - RNA, 22 nt, Human
auuaaauuaaguggcuaauuua

SEQ ID NO: 273445 - RNA, 22 nt, Human
ucagagaggcaauacuguuuaa

SEQ ID NO: 273446 - RNA, 22 nt, Human
cuggcucaguucuugguuuuca

SEQ ID NO: 273447 - RNA, 22 nt, Human
aaugaaacuaguagaaucuuug

SEQ ID NO: 273448 - RNA, 22 nt, Human
uuugaaacucugaacauguuuc

SEQ ID NO: 273449 - RNA, 22 nt, Human
uguccuggagugcuugggggaa

SEQ ID NO: 273450 - RNA, 22 nt, Human
ugccacccuggcggcagccugc

SEQ ID NO: 273451 - RNA, 23 nt, Human
gguuauuugcauccuguaauuau

SEQ ID NO: 273452 - RNA, 22 nt, Human
ucagauggaggcaauguuaccu

SEQ ID NO: 273453 - RNA, 22 nt, Human
ugcuaucuaggcaagguggucc

SEQ ID NO: 273454 - RNA, 22 nt, Human
acagcagaguaguuuuccaacu

SEQ ID NO: 273455 - RNA, 22 nt, Human
auuucuguuauaccuuucucag

SEQ ID NO: 273456 - RNA, 22 nt, Human
caguggaagacucagcucuccc

SEQ ID NO: 273457 - RNA, 22 nt, Human
acagugcaaauaggacugucuu

SEQ ID NO: 273458 - RNA, 19 nt, Human
gcugugugaccuugggcaa

SEQ ID NO: 273459 - RNA, 22 nt, Human
uuaugcaacaggugagcagaca

SEQ ID NO: 273460 - RNA, 22 nt, Human
auagcacuuauagauuuggucu

SEQ ID NO: 273461 - RNA, 22 nt, Human
aaggcugaggcuggagaauuac

SEQ ID NO: 273462 - RNA, 22 nt, Human
gggagaaggagcuaguucuuga

SEQ ID NO: 273463 - RNA, 20 nt, Human
ucugagagucugagugauga

SEQ ID NO: 273464 - RNA, 22 nt, Human
ucuuauugugaugaugaagaac

SEQ ID NO: 273465 - RNA, 22 nt, Human
auauucuuauccuuuucucugu

SEQ ID NO: 273466 - RNA, 22 nt, Human
aggcaagcccaggcacuuggag

SEQ ID NO: 273467 - RNA, 22 nt, Human
aaaagcaauugcaguucuugcc

SEQ ID NO: 273468 - RNA, 22 nt, Human
ggaugaggaagauuacugagaa

SEQ ID NO: 273469 - RNA, 22 nt, Human
auugauuugaacaaagauauua

SEQ ID NO: 273470 - RNA, 22 nt, Human
gaaggaaaaauacucuguaagg

SEQ ID NO: 273471 - RNA, 22 nt, Human
ucuaagacacuguacuuucagu

SEQ ID NO: 273472 - RNA, 22 nt, Human
cgcugcagcuggcugcagggaa

SEQ ID NO: 273473 - RNA, 22 nt, Human
gcagguuagauuuaauccauuc

SEQ ID NO: 273474 - RNA, 22 nt, Human
uuaauauacaauuuuacgggcu

SEQ ID NO: 273475 - RNA, 22 nt, Human
guucugggucuggacacacaga

SEQ ID NO: 273476 - RNA, 22 nt, Human
uggcaggguacaccuuaacacc

SEQ ID NO: 273477 - RNA, 23 nt, Human
uuucccacccucucucauugcug

SEQ ID NO: 273478 - RNA, 22 nt, Human
agcuggcauacuuugcuaggaa

SEQ ID NO: 273479 - RNA, 22 nt, Human
caucuuuaguuauugaauauag

SEQ ID NO: 273480 - RNA, 23 nt, Human
ucugucuuguuuaggccacuguu

SEQ ID NO: 273481 - RNA, 22 nt, Human
ggcuucucuccaguaugcauuc

SEQ ID NO: 273482 - RNA, 22 nt, Human
ugcuugcuggaggcagacagaa

SEQ ID NO: 273483 - RNA, 22 nt, Human
cauauaucuaccugcaauugca

SEQ ID NO: 273484 - RNA, 22 nt, Human
agaacucuuuaucuguggaaug

SEQ ID NO: 273485 - RNA, 22 nt, Human
acacuuuaagcauuucacacug

SEQ ID NO: 273486 - RNA, 22 nt, Human
auggcagaauuaggauuucaag

SEQ ID NO: 273487 - RNA, 22 nt, Human
auguggcuagugcaacugagaa

SEQ ID NO: 273488 - RNA, 22 nt, Human
uacacuggacaggaguaggaag

SEQ ID NO: 273489 - RNA, 22 nt, Human
gcugguggcagagacaucaggu

SEQ ID NO: 273490 - RNA, 22 nt, Human
caggcuggucccagagcauugc

SEQ ID NO: 273491 - RNA, 22 nt, Human
gucacaugccagugcacacagg

SEQ ID NO: 273492 - RNA, 20 nt, Human
agauuauuccuaagauuucu

SEQ ID NO: 273493 - RNA, 22 nt, Human
aucugagucucugacagcaugu

SEQ ID NO: 273494 - RNA, 22 nt, Human
gacagaggcaagaccagaagcc

SEQ ID NO: 273495 - RNA, 22 nt, Human
ugcaagagauucaaaccauaaa

SEQ ID NO: 273496 - RNA, 22 nt, Human
uugcaacaucugaacauuuauc

SEQ ID NO: 273497 - RNA, 22 nt, Human
agggacuggcucucugagcagg

SEQ ID NO: 273498 - RNA, 22 nt, Human
gagaggcuaugagguucugugu

SEQ ID NO: 273499 - RNA, 22 nt, Human
agggcagcuagcuguagaaaga

SEQ ID NO: 273500 - RNA, 22 nt, Human
ucucacagugcaggucugucuc

SEQ ID NO: 273501 - RNA, 22 nt, Human
gagagggccagggugagaacua

SEQ ID NO: 273502 - RNA, 22 nt, Human
uugugagcauguuuacuugauu

SEQ ID NO: 273503 - RNA, 22 nt, Human
agcuucagcuugcagcugugau

SEQ ID NO: 273504 - RNA, 22 nt, Human
cugugggacucugaggaaaagc

SEQ ID NO: 273505 - RNA, 22 nt, Human
agcuguuuucuaaugcauuuga

SEQ ID NO: 273506 - RNA, 22 nt, Human
guaugcaucgacucaagucuga

SEQ ID NO: 273507 - RNA, 22 nt, Human
ugccaggcucagccccuaucuu

SEQ ID NO: 273508 - RNA, 22 nt, Human
acuuuggacgccaugcuguuug

SEQ ID NO: 273509 - RNA, 22 nt, Human
aggagauagucaaagcuucuug

SEQ ID NO: 273510 - RNA, 22 nt, Human
uuccauacgacugaggucucgg

SEQ ID NO: 273511 - RNA, 22 nt, Human
cacauacaaugguguuauuugg

SEQ ID NO: 273512 - RNA, 22 nt, Human
gccuccugacuuacacugagcu

SEQ ID NO: 273513 - RNA, 22 nt, Human
uuauugagcaacucuggggcuc

SEQ ID NO: 273514 - RNA, 22 nt, Human
ggcugcggccgcgggucugugc

SEQ ID NO: 273515 - RNA, 16 nt, Human
acaaauacaacugcug

SEQ ID NO: 273516 - RNA, 22 nt, Human
ucugagcuagaaaguaugcccu

SEQ ID NO: 273517 - RNA, 22 nt, Human
auaaaugccucagaaucauccc

SEQ ID NO: 273518 - RNA, 22 nt, Human
aggcugugaugagccucaugga

SEQ ID NO: 273519 - RNA, 22 nt, Human
auccucagaccucagcaaagcc

SEQ ID NO: 273520 - RNA, 23 nt, Human
ucagugcaaaaauaggauuuugg

SEQ ID NO: 273521 - RNA, 20 nt, Human
ucccaaaauucuacuuuauc

SEQ ID NO: 273522 - RNA, 22 nt, Human
ccugugacauuagaauuucauu

SEQ ID NO: 273523 - RNA, 20 nt, Human
uguaaaacaaggugaauccu

SEQ ID NO: 273524 - RNA, 19 nt, Human
guccaggcauuggguuggu

SEQ ID NO: 273525 - RNA, 22 nt, Human
aaaccauuugaauuauuacuga

SEQ ID NO: 273526 - RNA, 22 nt, Human
ggcugcaguugugugaaggccg

SEQ ID NO: 273527 - RNA, 22 nt, Human
uauuuguauguguguacauaua

SEQ ID NO: 273528 - RNA, 22 nt, Human
augucacaugagagcgcagcac

SEQ ID NO: 273529 - RNA, 22 nt, Human
uccuucuggaggcuguaaagga

SEQ ID NO: 273530 - RNA, 22 nt, Human
uccuuggcaagacacagcacag

SEQ ID NO: 273531 - RNA, 22 nt, Human
ugcuggagaugaaagggcccug

SEQ ID NO: 273532 - RNA, 23 nt, Human
ugaaguucauucucacugaugua

SEQ ID NO: 273533 - RNA, 22 nt, Human
uggccuggaagagaggucgagg

SEQ ID NO: 273534 - RNA, 22 nt, Human
cacaaggagguccugaggaagc

SEQ ID NO: 273535 - RNA, 22 nt, Human
uuggcugccuguggaucgcauu

SEQ ID NO: 273536 - RNA, 22 nt, Human
acaugccagcccauuuaaaugg

SEQ ID NO: 273537 - RNA, 23 nt, Human
ugugggcgcauuguaaggguagc

SEQ ID NO: 273538 - RNA, 22 nt, Human
uguguacucaauugagccauuu

SEQ ID NO: 273539 - RNA, 18 nt, Human
gcccugguggagcuggug

SEQ ID NO: 273540 - RNA, 22 nt, Human
augcccugggagugcuguacca

SEQ ID NO: 273541 - RNA, 17 nt, Human
agccugggaaggaguga

SEQ ID NO: 273542 - RNA, 22 nt, Human
uagcuuuagugaaaaauaucag

SEQ ID NO: 273543 - RNA, 22 nt, Human
cauuccaaguauauacaugaua

SEQ ID NO: 273544 - RNA, 22 nt, Human
ugauucaagcuacuguuacugg

SEQ ID NO: 273545 - RNA, 22 nt, Human
uauuuccaccuauuauuuucug

SEQ ID NO: 273546 - RNA, 17 nt, Human
uccaggagaggcaaugg

SEQ ID NO: 273547 - RNA, 22 nt, Human
uuugcugaccccauucugaguc

SEQ ID NO: 273548 - RNA, 22 nt, Human
ugucaauaguuuugaguucucu

SEQ ID NO: 273549 - RNA, 22 nt, Human
gaaagugcucucucuauacaca

SEQ ID NO: 273550 - RNA, 22 nt, Human
augcuaaagcuuugcuuucauu

SEQ ID NO: 273551 - RNA, 22 nt, Human
uguuuggaaacacuggcagaaa

SEQ ID NO: 273552 - RNA, 23 nt, Human
ugguggcagaaguagcagaugac

SEQ ID NO: 273553 - RNA, 22 nt, Human
uaucagugauugcuguauacaa

SEQ ID NO: 273554 - RNA, 22 nt, Human
guucacaagaguuacagacaga

SEQ ID NO: 273555 - RNA, 22 nt, Human
gcucagggucccuuggugcugg

SEQ ID NO: 273556 - RNA, 22 nt, Human
uugggcuuuaauuccagagagg

SEQ ID NO: 273557 - RNA, 22 nt, Human
agggagacaaaagcagcugcca

SEQ ID NO: 273558 - RNA, 22 nt, Human
uugaaaaaauugguagaggaug

SEQ ID NO: 273559 - RNA, 22 nt, Human
ugaaaaacuuuaauccauaaag

SEQ ID NO: 273560 - RNA, 20 nt, Human
ccacaagggaauauuguuga

SEQ ID NO: 273561 - RNA, 22 nt, Human
ggcagcugguucuuuccauuaa

SEQ ID NO: 273562 - RNA, 22 nt, Human
uguucugagugcagcuuaauaa

SEQ ID NO: 273563 - RNA, 22 nt, Human
gaggucuucacaaagaacagca

SEQ ID NO: 273564 - RNA, 22 nt, Human
gcaggugugcugaauuacguga

SEQ ID NO: 273565 - RNA, 22 nt, Human
cagauuaagugcucaacagugu

SEQ ID NO: 273566 - RNA, 22 nt, Human
cauuuaaagguuguggguaaaa

SEQ ID NO: 273567 - RNA, 22 nt, Human
aaauuauuuucagaauggagaa

SEQ ID NO: 273568 - RNA, 22 nt, Human
gcucaggccucacuccauuugg

SEQ ID NO: 273569 - RNA, 22 nt, Human
ugucauuuucugguuaguuaau

SEQ ID NO: 273570 - RNA, 18 nt, Human
uucuggguguuauguuua

SEQ ID NO: 273571 - RNA, 22 nt, Human
cucccaguguuguuuucugaug

SEQ ID NO: 273572 - RNA, 21 nt, Human
agcugagcccagaagacuggu

SEQ ID NO: 273573 - RNA, 22 nt, Human
augaggcaaagguggagguggg

SEQ ID NO: 273574 - RNA, 20 nt, Human
ucacuguaauugccuacauu

SEQ ID NO: 273575 - RNA, 22 nt, Human
cucuccacucagcgucaugucc

SEQ ID NO: 273576 - RNA, 22 nt, Human
caggaggcuccuagggcucugu

SEQ ID NO: 273577 - RNA, 22 nt, Human
uggcccuuguucaaauauguca

SEQ ID NO: 273578 - RNA, 22 nt, Human
cugaggaguuuggguuguucaa

SEQ ID NO: 273579 - RNA, 22 nt, Human
ucccugcccugccuucaugguu

SEQ ID NO: 273580 - RNA, 22 nt, Human
ucagagucuaaauagaagaaua

SEQ ID NO: 273581 - RNA, 22 nt, Human
uccaggcagucauuaaucucua

SEQ ID NO: 273582 - RNA, 22 nt, Human
cugcagaacaauuccugcuguu

SEQ ID NO: 273583 - RNA, 22 nt, Human
ugguccagcuugauucucuucu

SEQ ID NO: 273584 - RNA, 22 nt, Human
gugugucccuacaacagcuuca

SEQ ID NO: 273585 - RNA, 20 nt, Human
ucuugagaacaauuucuggc

SEQ ID NO: 273586 - RNA, 22 nt, Human
uaaguucagaguucucauuugu

SEQ ID NO: 273587 - RNA, 22 nt, Human
gaggagggcaguuccucuuuua

SEQ ID NO: 273588 - RNA, 22 nt, Human
aagcaagacagaaguuacugcc

SEQ ID NO: 273589 - RNA, 22 nt, Human
aaaggccucuguccuagugccu

SEQ ID NO: 273590 - RNA, 22 nt, Human
agggggaggcugugcugcgucu

SEQ ID NO: 273591 - RNA, 22 nt, Human
cucaggaaccgcggcagcagcc

SEQ ID NO: 273592 - RNA, 22 nt, Human
uuuuauugucaaugaagacaga

SEQ ID NO: 273593 - RNA, 22 nt, Human
gcaggcuccaaggccugggaga

SEQ ID NO: 273594 - RNA, 22 nt, Human
ugggccuguggcuuggcucuag

SEQ ID NO: 273595 - RNA, 22 nt, Human
uuuacuguguccaucugugacu

SEQ ID NO: 273596 - RNA, 22 nt, Human
uccagacccaugacccugggga

SEQ ID NO: 273597 - RNA, 22 nt, Human
aaugcugcucucauaauuauag

SEQ ID NO: 273598 - RNA, 22 nt, Human
cagagcugcgcuuuuuccuggu

SEQ ID NO: 273599 - RNA, 22 nt, Human
ugagcccagagaucugagcuau

SEQ ID NO: 273600 - RNA, 19 nt, Human
agcuggcacuagaauccag

SEQ ID NO: 273601 - RNA, 22 nt, Human
uuuguacaccuaccuaauacag

SEQ ID NO: 273602 - RNA, 22 nt, Human
ugagaggucauuaggccaugag

SEQ ID NO: 273603 - RNA, 22 nt, Human
auuuacugagcagcuaccaugu

SEQ ID NO: 273604 - RNA, 22 nt, Human
uuguacaaagauuucacagcuc

SEQ ID NO: 273605 - RNA, 22 nt, Human
ccagagguuacuuugccuugga

SEQ ID NO: 273606 - RNA, 22 nt, Human
ucauucaauguaagcauauaua

SEQ ID NO: 273607 - RNA, 22 nt, Human
gccuguuugagaauagucaggg

SEQ ID NO: 273608 - RNA, 22 nt, Human
ggccugugagcccuugcaugua

SEQ ID NO: 273609 - RNA, 22 nt, Human
cugggagagguggugggaagua

SEQ ID NO: 273610 - RNA, 22 nt, Human
cccagaggggucgucugagggg

SEQ ID NO: 273611 - RNA, 22 nt, Human
uggcagguagaguucugagaug

SEQ ID NO: 273612 - RNA, 22 nt, Human
ccugggaggcugugggucugcu

SEQ ID NO: 273613 - RNA, 19 nt, Human
cugcagggaugugcagagu

SEQ ID NO: 273614 - RNA, 22 nt, Human
aggcacagugccuggaaucaaa

SEQ ID NO: 273615 - RNA, 22 nt, Human
agacugggauucucccugauca

SEQ ID NO: 273616 - RNA, 22 nt, Human
cuggccaggccccuugcagggc

SEQ ID NO: 273617 - RNA, 22 nt, Human
ucaaagucauggcaggcucaga

SEQ ID NO: 273618 - RNA, 20 nt, Human
aggagcugaauuagaggguu

SEQ ID NO: 273619 - RNA, 20 nt, Human
gcacaguuugggaaccaugg

SEQ ID NO: 273620 - RNA, 22 nt, Human
gacccggcuccaggcccagcag

SEQ ID NO: 273621 - RNA, 22 nt, Human
caagccuuggaaauccauucug

SEQ ID NO: 273622 - RNA, 23 nt, Human
uccaugagaugugggcuucuagu

SEQ ID NO: 273623 - RNA, 22 nt, Human
uaugcacaauaugaucuauuug

SEQ ID NO: 273624 - RNA, 22 nt, Human
gcaggcuugcccggccuccuuc

SEQ ID NO: 273625 - RNA, 22 nt, Human
gaagauaauuccuacuuauaac

SEQ ID NO: 273626 - RNA, 22 nt, Human
ucuguucauuugccucggcucu

SEQ ID NO: 273627 - RNA, 22 nt, Human
uugggacagcaaccaucugcua

SEQ ID NO: 273628 - RNA, 22 nt, Human
guccagagguccaggaucaagg

SEQ ID NO: 273629 - RNA, 22 nt, Human
acuuauauuugcuuuaugcuuc

SEQ ID NO: 273630 - RNA, 22 nt, Human
uuagaaucuuguaucagaaguu

SEQ ID NO: 273631 - RNA, 22 nt, Human
guccuuggagguguggaaucug

SEQ ID NO: 273632 - RNA, 22 nt, Human
ggccagacauaucgcucccaaa

SEQ ID NO: 273633 - RNA, 23 nt, Human
uguuuucuuguccugguauaauu

SEQ ID NO: 273634 - RNA, 22 nt, Human
gccucaggugcaucucucauuc

SEQ ID NO: 273635 - RNA, 21 nt, Human
cagugaggcccuccuguuccc

SEQ ID NO: 273636 - RNA, 22 nt, Human
aguuccaccauuuaggaucugu

SEQ ID NO: 273637 - RNA, 22 nt, Human
ugguccugggcacaguauaugc

SEQ ID NO: 273638 - RNA, 22 nt, Human
aagcacagugggcagagcagcc

SEQ ID NO: 273639 - RNA, 22 nt, Human
ugcauuauuugcaugugccugu

SEQ ID NO: 273640 - RNA, 22 nt, Human
ccagagccugcugagccccauu

SEQ ID NO: 273641 - RNA, 22 nt, Human
gucucaguccgugcuguucagg

SEQ ID NO: 273642 - RNA, 22 nt, Human
agccacaaugccaaccucuacu

SEQ ID NO: 273643 - RNA, 22 nt, Human
uggcugagaccuucccaaauuc

SEQ ID NO: 273644 - RNA, 22 nt, Human
augcuaaagggguaggccuccu

SEQ ID NO: 273645 - RNA, 20 nt, Human
uccagccacuuccgcugguc

SEQ ID NO: 273646 - RNA, 21 nt, Human
uccagaccucccucuccuagc

SEQ ID NO: 273647 - RNA, 22 nt, Human
cagagagagcaggaaaccuccg

SEQ ID NO: 273648 - RNA, 22 nt, Human
acagcaggcaugaagaaauguu

SEQ ID NO: 273649 - RNA, 22 nt, Human
uauuaacauuuuaugaaaauaa

SEQ ID NO: 273650 - RNA, 22 nt, Human
uuucucuucacugugugccuca

SEQ ID NO: 273651 - RNA, 22 nt, Human
auaacagauacucucugugagg

SEQ ID NO: 273652 - RNA, 22 nt, Human
gagugcugaaugcgagaacaga

SEQ ID NO: 273653 - RNA, 22 nt, Human
cagggagggacaauugucaccu

SEQ ID NO: 273654 - RNA, 22 nt, Human
aguguguccagaaaucuguauu

SEQ ID NO: 273655 - RNA, 22 nt, Human
aaaugaguagcgaugcacauua

SEQ ID NO: 273656 - RNA, 22 nt, Human
auuccacacaguaauacucaau

SEQ ID NO: 273657 - RNA, 22 nt, Human
ucugggagguaaccaugcugau

SEQ ID NO: 273658 - RNA, 22 nt, Human
uguguccugguguuaauuuuau

SEQ ID NO: 273659 - RNA, 22 nt, Human
agagggcccauguugggcugcu

SEQ ID NO: 273660 - RNA, 22 nt, Human
ucucagagaucuuucugcaugu

SEQ ID NO: 273661 - RNA, 22 nt, Human
aaaugcuugcaacaucccaggu

SEQ ID NO: 273662 - RNA, 22 nt, Human
agcugcaaagaucugucaguca

SEQ ID NO: 273663 - RNA, 22 nt, Human
aacugcauuugcauaaguccau

SEQ ID NO: 273664 - RNA, 22 nt, Human
ggcaaacagacuugaccaucuu

SEQ ID NO: 273665 - RNA, 19 nt, Human
uacaugcagcaggcacgca

SEQ ID NO: 273666 - RNA, 22 nt, Human
gaagguuuucaggagccuaguc

SEQ ID NO: 273667 - RNA, 22 nt, Human
uggagcagugguccuggagaug

SEQ ID NO: 273668 - RNA, 22 nt, Human
gcaguucuacuuauccauagac

SEQ ID NO: 273669 - RNA, 23 nt, Human
guaaugaugggaauuuacuuaga

SEQ ID NO: 273670 - RNA, 22 nt, Human
aggucugguguugaugaauucc

SEQ ID NO: 273671 - RNA, 21 nt, Human
uccaagccuucaacacauuca

SEQ ID NO: 273672 - RNA, 22 nt, Human
uaaaaccaggucuugggauuua

SEQ ID NO: 273673 - RNA, 22 nt, Human
ucugcagggucccagccucagc

SEQ ID NO: 273674 - RNA, 22 nt, Human
auaaaaccaaagcagcaguguu

SEQ ID NO: 273675 - RNA, 22 nt, Human
ugccgcagugcggggagggccc

SEQ ID NO: 273676 - RNA, 22 nt, Human
agaagucaaugaugagagugcu

SEQ ID NO: 273677 - RNA, 19 nt, Human
gcagguggauguggucagc

SEQ ID NO: 273678 - RNA, 22 nt, Human
ccagucuguacuuugcucuguu

SEQ ID NO: 273679 - RNA, 20 nt, Human
uccagggcccuggcuccucu

SEQ ID NO: 273680 - RNA, 22 nt, Human
cuccuccuggacacaggcugug

SEQ ID NO: 273681 - RNA, 19 nt, Human
uggagaggaaaugcugcuc

SEQ ID NO: 273682 - RNA, 22 nt, Human
uuuuugaaggcugaugugauua

SEQ ID NO: 273683 - RNA, 16 nt, Human
ugggugggaggagcgg

SEQ ID NO: 273684 - RNA, 22 nt, Human
cagcaacucuccugugcucaaa

SEQ ID NO: 273685 - RNA, 22 nt, Human
uacuuuaauauaugugaaguuc

SEQ ID NO: 273686 - RNA, 22 nt, Human
ucuacaaauaaauuacuaugua

SEQ ID NO: 273687 - RNA, 22 nt, Human
uucauucuugucuuuguauagu

SEQ ID NO: 273688 - RNA, 22 nt, Human
gcagaauagggcauaacuuugc

SEQ ID NO: 273689 - RNA, 22 nt, Human
ccagccuugcaccgagccagcc

SEQ ID NO: 273690 - RNA, 22 nt, Human
uuuaucaguagcaaaguuuuaa

SEQ ID NO: 273691 - RNA, 22 nt, Human
uaaagguaguuuuaaaggugcu

SEQ ID NO: 273692 - RNA, 22 nt, Human
guggggguggaaaggcaaguug

SEQ ID NO: 273693 - RNA, 22 nt, Human
agcaaagcacuuugcauacaua

SEQ ID NO: 273694 - RNA, 20 nt, Human
uucaaagacccucaggucca

SEQ ID NO: 273695 - RNA, 22 nt, Human
uucaguguuaaucuugggagaa

SEQ ID NO: 273696 - RNA, 22 nt, Human
uccuggauuaauagggagcugu

SEQ ID NO: 273697 - RNA, 22 nt, Human
uaaacagagagugcaguuauag

SEQ ID NO: 273698 - RNA, 22 nt, Human
uaaacugcuucucucagucugu

SEQ ID NO: 273699 - RNA, 23 nt, Human
ggucacaugugagauuaaacuug

SEQ ID NO: 273700 - RNA, 22 nt, Human
ccaggcccguucccuucuccag

SEQ ID NO: 273701 - RNA, 22 nt, Human
uuucauuuugguuaugccauaa

SEQ ID NO: 273702 - RNA, 22 nt, Human
uagcuucuugagaaagggugcc

SEQ ID NO: 273703 - RNA, 22 nt, Human
ggaacugauuaagucaugagaa

SEQ ID NO: 273704 - RNA, 22 nt, Human
gagagcccucacuccuucccug

SEQ ID NO: 273705 - RNA, 22 nt, Human
uggaaucuguauguauguauaa

SEQ ID NO: 273706 - RNA, 23 nt, Human
uccuccugagugagagugccagc

SEQ ID NO: 273707 - RNA, 22 nt, Human
ccauccaggcugugggugagcu

SEQ ID NO: 273708 - RNA, 22 nt, Human
uugcaacagguguguuuuggug

SEQ ID NO: 273709 - RNA, 22 nt, Human
agcuggugugccacuguugggg

SEQ ID NO: 273710 - RNA, 19 nt, Human
acucaggcuuccucugagg

SEQ ID NO: 273711 - RNA, 22 nt, Human
cagggcugagucauauagccuu

SEQ ID NO: 273712 - RNA, 22 nt, Human
caaguuuuagaaauaucuggau

SEQ ID NO: 273713 - RNA, 22 nt, Human
ggccagagagccgcuguuagga

SEQ ID NO: 273714 - RNA, 22 nt, Human
cuggacucauccauagagguga

SEQ ID NO: 273715 - RNA, 22 nt, Human
caggcauggagaggcagagacu

SEQ ID NO: 273716 - RNA, 22 nt, Human
ugguaccagcuguguguucacu

SEQ ID NO: 273717 - RNA, 22 nt, Human
gcagauguucugugucucacaa

SEQ ID NO: 273718 - RNA, 22 nt, Human
cggcugaggaucuccaggccug

SEQ ID NO: 273719 - RNA, 22 nt, Human
uggagagaaaaaagacaguucu

SEQ ID NO: 273720 - RNA, 18 nt, Human
gaggaaacaaggcagagg

SEQ ID NO: 273721 - RNA, 22 nt, Human
uugaggaggacagaaacauuua

SEQ ID NO: 273722 - RNA, 19 nt, Human
ugagaaggcaguggggagc

SEQ ID NO: 273723 - RNA, 22 nt, Human
ugaaaggaagagggcuacuccu

SEQ ID NO: 273724 - RNA, 22 nt, Human
ucaguccauaggugggccugag

SEQ ID NO: 273725 - RNA, 22 nt, Human
cauuuuaccuagaagcugaaag

SEQ ID NO: 273726 - RNA, 22 nt, Human
guuuauacagugcaugguguua

SEQ ID NO: 273727 - RNA, 22 nt, Human
agggccucugacgcccccagcc

SEQ ID NO: 273728 - RNA, 19 nt, Human
uuucagacauuucaaauuu

SEQ ID NO: 273729 - RNA, 22 nt, Human
ggaacugaggaacgaacuggga

SEQ ID NO: 273730 - RNA, 22 nt, Human
agaaaucugacugcugugcaca

SEQ ID NO: 273731 - RNA, 22 nt, Human
agccuugacacuggggaaacug

SEQ ID NO: 273732 - RNA, 22 nt, Human
ggcugagacaaccugggaccca

SEQ ID NO: 273733 - RNA, 22 nt, Human
acuaauuguauaguugauguaa

SEQ ID NO: 273734 - RNA, 22 nt, Human
agagaagagucuugucaaauua

SEQ ID NO: 273735 - RNA, 22 nt, Human
uauauguagucagucagaguaa

SEQ ID NO: 273736 - RNA, 22 nt, Human
cugcccugugaggguccuuggg

SEQ ID NO: 273737 - RNA, 22 nt, Human
ugacaauagcgauuuaucuugc

SEQ ID NO: 273738 - RNA, 22 nt, Human
agagacaccgcgcaucauggcu

SEQ ID NO: 273739 - RNA, 19 nt, Human
ugugugcaaauggaagcca

SEQ ID NO: 273740 - RNA, 22 nt, Human
aaggugguuugauuaucccacu

SEQ ID NO: 273741 - RNA, 20 nt, Human
guggccucucacauucugag

SEQ ID NO: 273742 - RNA, 22 nt, Human
gggcaggugauuuuggcuccau

SEQ ID NO: 273743 - RNA, 21 nt, Human
augguagguggagcaggugau

SEQ ID NO: 273744 - RNA, 22 nt, Human
acucagagaacauucccagucu

SEQ ID NO: 273745 - RNA, 22 nt, Human
gaccugccugagcugccucugc

SEQ ID NO: 273746 - RNA, 22 nt, Human
gguccuggaaguguaaguggca

SEQ ID NO: 273747 - RNA, 22 nt, Human
aguuauuuuggaaaaugaguca

SEQ ID NO: 273748 - RNA, 22 nt, Human
cagcgcaggcgugugaaggcgc

SEQ ID NO: 273749 - RNA, 22 nt, Human
caugucaauaaauauaacugca

SEQ ID NO: 273750 - RNA, 22 nt, Human
guuauuuauaagguguaacucc

SEQ ID NO: 273751 - RNA, 22 nt, Human
ggcugaguugagaggauuacuu

SEQ ID NO: 273752 - RNA, 22 nt, Human
uaggcugagguugaugccaggg

SEQ ID NO: 273753 - RNA, 22 nt, Human
ugggcucauggcccagcacugg

SEQ ID NO: 273754 - RNA, 22 nt, Human
cccugggauucaauuucacucu

SEQ ID NO: 273755 - RNA, 22 nt, Human
uccacaucuagguuugucaaca

SEQ ID NO: 273756 - RNA, 22 nt, Human
agggaugauggaaagaagcagg

SEQ ID NO: 273757 - RNA, 22 nt, Human
uucugcugaaaacagccaugua

SEQ ID NO: 273758 - RNA, 16 nt, Human
uuuauuuacuaguguu

SEQ ID NO: 273759 - RNA, 22 nt, Human
acauuuacagugcuagacaauc

SEQ ID NO: 273760 - RNA, 22 nt, Human
uuugcauuucuaaugagcuccg

SEQ ID NO: 273761 - RNA, 22 nt, Human
uacuccagacauucuguccucg

SEQ ID NO: 273762 - RNA, 22 nt, Human
ggagcagggaauuacagcgcag

SEQ ID NO: 273763 - RNA, 22 nt, Human
ccugagcauuagacauccauca

SEQ ID NO: 273764 - RNA, 22 nt, Human
uuggaggacuaguuaagagacc

SEQ ID NO: 273765 - RNA, 22 nt, Human
auuuugauguaucuuuguagcu

SEQ ID NO: 273766 - RNA, 18 nt, Human
gcccagaggucugggccc

SEQ ID NO: 273767 - RNA, 22 nt, Human
ggcuucccagucccugcucuca

SEQ ID NO: 273768 - RNA, 22 nt, Human
aaauguuuugcucccauguggu

SEQ ID NO: 273769 - RNA, 22 nt, Human
cagugcuguguuugcugccugg

SEQ ID NO: 273770 - RNA, 22 nt, Human
ugaguccgaaguugcagugagc

SEQ ID NO: 273771 - RNA, 22 nt, Human
uuggcccagggucagcggcgcu

SEQ ID NO: 273772 - RNA, 22 nt, Human
auucauguaaaauuggauagac

SEQ ID NO: 273773 - RNA, 22 nt, Human
agcuguggcagcagccguggca

SEQ ID NO: 273774 - RNA, 22 nt, Human
aucuugggaauuuuccaggagu

SEQ ID NO: 273775 - RNA, 22 nt, Human
gcccucagcuccuggacacaug

SEQ ID NO: 273776 - RNA, 22 nt, Human
aagucuaaccuauuccgguguu

SEQ ID NO: 273777 - RNA, 22 nt, Human
cugugcaguggggcucuggguu

SEQ ID NO: 273778 - RNA, 22 nt, Human
acaggcagguccugucccagcu

SEQ ID NO: 273779 - RNA, 22 nt, Human
agaggacacaucuuuccucaaa

SEQ ID NO: 273780 - RNA, 22 nt, Human
agcuuguuaaacagccuccacu

SEQ ID NO: 273781 - RNA, 22 nt, Human
uaucuugugcagaugaaagaau

SEQ ID NO: 273782 - RNA, 22 nt, Human
uggcuuccuguuucccagaaag

SEQ ID NO: 273783 - RNA, 22 nt, Human
gccugugucauguaguagcuuc

SEQ ID NO: 273784 - RNA, 22 nt, Human
acagaacugggaaaugcacaua

SEQ ID NO: 273785 - RNA, 22 nt, Human
aacauugaauuuaaaauacagu

SEQ ID NO: 273786 - RNA, 22 nt, Human
uugcaaaucagaaguauagauu

SEQ ID NO: 273787 - RNA, 22 nt, Human
aguuagcagcuuauuagaaaca

SEQ ID NO: 273788 - RNA, 22 nt, Human
cuccgcagcgggccaauccgga

SEQ ID NO: 273789 - RNA, 22 nt, Human
acagagagaaacaaucagcagc

SEQ ID NO: 273790 - RNA, 22 nt, Human
ucccugggcggacauucuccca

SEQ ID NO: 273791 - RNA, 21 nt, Human
uucuccaggcaaccauuucag

SEQ ID NO: 273792 - RNA, 22 nt, Human
cucacagcagcucugcgagaua

SEQ ID NO: 273793 - RNA, 22 nt, Human
aacagugauaucaagacagaca

SEQ ID NO: 273794 - RNA, 22 nt, Human
uggucccuaaagaugucuacau

SEQ ID NO: 273795 - RNA, 22 nt, Human
auaacauggaguuugucauuua

SEQ ID NO: 273796 - RNA, 22 nt, Human
acucugugugaguagagccugu

SEQ ID NO: 273797 - RNA, 22 nt, Human
uaacuugguuggugggcaggag

SEQ ID NO: 273798 - RNA, 22 nt, Human
uuuguuuauuaggggagaguug

SEQ ID NO: 273799 - RNA, 19 nt, Human
uaaguguuggugaauuucu

SEQ ID NO: 273800 - RNA, 22 nt, Human
uaauuucaauagcuugcauaau

SEQ ID NO: 273801 - RNA, 22 nt, Human
ccagugcagucccccugaacug

SEQ ID NO: 273802 - RNA, 22 nt, Human
agauaggagccaggacuuaaca

SEQ ID NO: 273803 - RNA, 20 nt, Human
aguuuauuccaggagaacug

SEQ ID NO: 273804 - RNA, 22 nt, Human
gaacuauaucuucaagaaaaug

SEQ ID NO: 273805 - RNA, 22 nt, Human
caaaugaagagggcaacuucug

SEQ ID NO: 273806 - RNA, 22 nt, Human
ucaagucuggagaucuggaacu

SEQ ID NO: 273807 - RNA, 22 nt, Human
uccuaggccuggccugguggau

SEQ ID NO: 273808 - RNA, 22 nt, Human
ggcugcagcccucgccuagcca

SEQ ID NO: 273809 - RNA, 22 nt, Human
ugcugaggacaccuagccuucu

SEQ ID NO: 273810 - RNA, 22 nt, Human
ugucucugaaauauguggcucc

SEQ ID NO: 273811 - RNA, 22 nt, Human
gccagagcugagugagguucuu

SEQ ID NO: 273812 - RNA, 22 nt, Human
cacagaggugauaguggucaag

SEQ ID NO: 273813 - RNA, 22 nt, Human
accugaggcuguuagucuaggu

SEQ ID NO: 273814 - RNA, 22 nt, Human
uauuuauucauucagcaagcau

SEQ ID NO: 273815 - RNA, 22 nt, Human
gcugauuuugucacauagcaag

SEQ ID NO: 273816 - RNA, 22 nt, Human
uccuggcccgaucccugugaag

SEQ ID NO: 273817 - RNA, 22 nt, Human
aaugaaacuguauauagacugu

SEQ ID NO: 273818 - RNA, 22 nt, Human
gcgcucaggugccaggccugcg

SEQ ID NO: 273819 - RNA, 22 nt, Human
auucacaaugauacauaagcga

SEQ ID NO: 273820 - RNA, 22 nt, Human
ggcuccugcaccugucccucug

SEQ ID NO: 273821 - RNA, 22 nt, Human
uuuggacauguugagucugaua

SEQ ID NO: 273822 - RNA, 18 nt, Human
aggaaagacgaagagggc

SEQ ID NO: 273823 - RNA, 22 nt, Human
ggcuguagguuggugcuggaca

SEQ ID NO: 273824 - RNA, 22 nt, Human
ucaaaaauguuuuauauuggua

SEQ ID NO: 273825 - RNA, 22 nt, Human
gugugggaaggcuaggaugcug

SEQ ID NO: 273826 - RNA, 22 nt, Human
aacugucuaaggagaauaugaa

SEQ ID NO: 273827 - RNA, 22 nt, Human
agacaucauguuacagauuaag

SEQ ID NO: 273828 - RNA, 22 nt, Human
agagcccuggagggcagucccg

SEQ ID NO: 273829 - RNA, 22 nt, Human
cccaagccuuucaaaacucaga

SEQ ID NO: 273830 - RNA, 22 nt, Human
aggcggcugguguccugcaggu

SEQ ID NO: 273831 - RNA, 18 nt, Human
ggcaugugagugcugagg

SEQ ID NO: 273832 - RNA, 22 nt, Human
ucagcaggcccauccuccaggc

SEQ ID NO: 273833 - RNA, 22 nt, Human
ugucaugguagcugaaggaugu

SEQ ID NO: 273834 - RNA, 22 nt, Human
gugugggaggaaggugaacaga

SEQ ID NO: 273835 - RNA, 22 nt, Human
ucaaaggagacacaaggagaaa

SEQ ID NO: 273836 - RNA, 17 nt, Human
ggagacagggucuuuaa

SEQ ID NO: 273837 - RNA, 22 nt, Human
cuuaggaagcuuuugaggacaa

SEQ ID NO: 273838 - RNA, 19 nt, Human
gcugggugggguccacagc

SEQ ID NO: 273839 - RNA, 22 nt, Human
uacauuccugggcuccacccua

SEQ ID NO: 273840 - RNA, 22 nt, Human
acaguuaaucaaauggcauaug

SEQ ID NO: 273841 - RNA, 22 nt, Human
guuaugauggcaccacugcacu

SEQ ID NO: 273842 - RNA, 22 nt, Human
ugucagugccaacuuugcuggu

SEQ ID NO: 273843 - RNA, 21 nt, Human
ugggccugauucccaggguca

SEQ ID NO: 273844 - RNA, 22 nt, Human
aguuaacacaaguaagauucca

SEQ ID NO: 273845 - RNA, 22 nt, Human
caggcauaucuacauuauccaa

SEQ ID NO: 273846 - RNA, 22 nt, Human
acagggcaccugagguaggaag

SEQ ID NO: 273847 - RNA, 22 nt, Human
aggaugagaagauuggaaucuu

SEQ ID NO: 273848 - RNA, 22 nt, Human
acuauaaaaggauaaaccagaa

SEQ ID NO: 273849 - RNA, 22 nt, Human
ucagauggauucauuacaugac

SEQ ID NO: 273850 - RNA, 22 nt, Human
uucaaaugcaaguuacuacuuu

SEQ ID NO: 273851 - RNA, 22 nt, Human
agaugguuaucuuuucuuugua

SEQ ID NO: 273852 - RNA, 19 nt, Human
uuuuuaaugggcuggagca

SEQ ID NO: 273853 - RNA, 22 nt, Human
acucaggcuucaggcacagcug

SEQ ID NO: 273854 - RNA, 22 nt, Human
ugcagguggauucaauguggga

SEQ ID NO: 273855 - RNA, 22 nt, Human
agggagaguagauaucaggugu

SEQ ID NO: 273856 - RNA, 22 nt, Human
cagucagggacaccagcuagga

SEQ ID NO: 273857 - RNA, 22 nt, Human
gcucaggccucggacacacaau

SEQ ID NO: 273858 - RNA, 22 nt, Human
ugccuucucccuuggacccuga

SEQ ID NO: 273859 - RNA, 22 nt, Human
agucuggucuguucauggguca

SEQ ID NO: 273860 - RNA, 21 nt, Human
ucuccagagugggaggaaauc

SEQ ID NO: 273861 - RNA, 22 nt, Human
uccagcccaggcuggaguguag

SEQ ID NO: 273862 - RNA, 22 nt, Human
cccuggcaugcaugucccuggc

SEQ ID NO: 273863 - RNA, 22 nt, Human
gcuucaggguuaugcaagagug

SEQ ID NO: 273864 - RNA, 23 nt, Human
cagaagcaccuguugacugcugc

SEQ ID NO: 273865 - RNA, 22 nt, Human
agcagagcugcaguggccugcu

SEQ ID NO: 273866 - RNA, 19 nt, Human
uccucugguaccacccuug

SEQ ID NO: 273867 - RNA, 22 nt, Human
auauaauucucagguuugacua

SEQ ID NO: 273868 - RNA, 22 nt, Human
aacaggcucacucugacuucua

SEQ ID NO: 273869 - RNA, 22 nt, Human
uucauguuucauuuguuacuau

SEQ ID NO: 273870 - RNA, 23 nt, Human
ccaagcuugucccugccugcuuu

SEQ ID NO: 273871 - RNA, 22 nt, Human
guuugcauggaagacagugagu

SEQ ID NO: 273872 - RNA, 22 nt, Human
ugacccaucaggccacaugagg

SEQ ID NO: 273873 - RNA, 22 nt, Human
ucacacuuagagcgaauuguuu

SEQ ID NO: 273874 - RNA, 18 nt, Human
acacugcagcagucugcu

SEQ ID NO: 273875 - RNA, 22 nt, Human
cugggagaucuguugggacugg

SEQ ID NO: 273876 - RNA, 22 nt, Human
uaccugaauuaccaaaagcuuu

SEQ ID NO: 273877 - RNA, 22 nt, Human
cugagccuugaugucccuuguc

SEQ ID NO: 273878 - RNA, 22 nt, Human
agagugcucagaugcaugucuu

SEQ ID NO: 273879 - RNA, 22 nt, Human
gcacggcaagacggggccuccu

SEQ ID NO: 273880 - RNA, 20 nt, Human
ucuucuguugccuuguucug

SEQ ID NO: 273881 - RNA, 22 nt, Human
gacuuuauuacuaacccuguga

SEQ ID NO: 273882 - RNA, 22 nt, Human
ucuucaguauuuggauaacauu

SEQ ID NO: 273883 - RNA, 22 nt, Human
cuguugucuucauugucauauc

SEQ ID NO: 273884 - RNA, 22 nt, Human
gagcuggaggcagugcugaggu

SEQ ID NO: 273885 - RNA, 22 nt, Human
aacagcuucaucacauggcaua

SEQ ID NO: 273886 - RNA, 22 nt, Human
cagcuccaaagccccacugucc

SEQ ID NO: 273887 - RNA, 22 nt, Human
gugcacagauucagagguuuug

SEQ ID NO: 273888 - RNA, 22 nt, Human
auaaaaguucaagagaguacag

SEQ ID NO: 273889 - RNA, 22 nt, Human
cagcaucuggauuuccuccacu

SEQ ID NO: 273890 - RNA, 22 nt, Human
ccagagccucuuaugaagaucg

SEQ ID NO: 273891 - RNA, 22 nt, Human
agcugcugcaaguggugcuaac

SEQ ID NO: 273892 - RNA, 22 nt, Human
uggcuuccuaaacugauuucca

SEQ ID NO: 273893 - RNA, 22 nt, Human
ucucaacuuugagaaacauugu

SEQ ID NO: 273894 - RNA, 22 nt, Human
aggcuucuaaaucacaaggaaa

SEQ ID NO: 273895 - RNA, 22 nt, Human
cccagggaaugacucuggccuu

SEQ ID NO: 273896 - RNA, 22 nt, Human
uuuaguuuuaacugaaagcuau

SEQ ID NO: 273897 - RNA, 22 nt, Human
cugagccuccauuucaucaggu

SEQ ID NO: 273898 - RNA, 22 nt, Human
gcuucuuuggcaacccugacau

SEQ ID NO: 273899 - RNA, 22 nt, Human
aggcucuguuugcugugguacc

SEQ ID NO: 273900 - RNA, 22 nt, Human
agagccaggcggcugggcaccu

SEQ ID NO: 273901 - RNA, 22 nt, Human
augcuaaugagcuaaggagucc

SEQ ID NO: 273902 - RNA, 22 nt, Human
caaagcaagggcugaagacucc

SEQ ID NO: 273903 - RNA, 22 nt, Human
uuggccaacauggugaaacccc

SEQ ID NO: 273904 - RNA, 22 nt, Human
gacccugauaggaguagaagaa

SEQ ID NO: 273905 - RNA, 22 nt, Human
ugcuggcugggcugcuggagac

SEQ ID NO: 273906 - RNA, 22 nt, Human
cuuucucuucagcacccagccc

SEQ ID NO: 273907 - RNA, 22 nt, Human
uggcacucacucucagagucug

SEQ ID NO: 273908 - RNA, 22 nt, Human
uguccagguggccucugcugcu

SEQ ID NO: 273909 - RNA, 22 nt, Human
uaagaacuucggacauguuauc

SEQ ID NO: 273910 - RNA, 22 nt, Human
uuuugaauaauucagaaacagc

SEQ ID NO: 273911 - RNA, 22 nt, Human
uuaaagcugagcccucagaagc

SEQ ID NO: 273912 - RNA, 22 nt, Human
gaggucugggcuugggccuggu

SEQ ID NO: 273913 - RNA, 22 nt, Human
uucuccugcgcaggcccaggga

SEQ ID NO: 273914 - RNA, 22 nt, Human
gcuccaggccacggcuucuugg

SEQ ID NO: 273915 - RNA, 22 nt, Human
cagacuggccacaucugcacug

SEQ ID NO: 273916 - RNA, 22 nt, Human
ugccagauuguggcauggcacu

SEQ ID NO: 273917 - RNA, 22 nt, Human
aguuagaauagucagauuguag

SEQ ID NO: 273918 - RNA, 22 nt, Human
accagcugccuuuucuuaguag

SEQ ID NO: 273919 - RNA, 22 nt, Human
ugaacauugucacauuccuagc

SEQ ID NO: 273920 - RNA, 22 nt, Human
ggaauguuuuccagaccuagau

SEQ ID NO: 273921 - RNA, 22 nt, Human
auuaaaugguggucauucauuu

SEQ ID NO: 273922 - RNA, 22 nt, Human
acugagcaguagauuuucuguu

SEQ ID NO: 273923 - RNA, 22 nt, Human
ccuguucacccuccaugcacag

SEQ ID NO: 273924 - RNA, 22 nt, Human
ggucaacacugugaccaacagg

SEQ ID NO: 273925 - RNA, 22 nt, Human
ccuaaggaccagggcuuccagc

SEQ ID NO: 273926 - RNA, 22 nt, Human
gaucugguuucaucauggacuu

SEQ ID NO: 273927 - RNA, 22 nt, Human
ggcugcaggaugcccagccgug

SEQ ID NO: 273928 - RNA, 22 nt, Human
cuagagaagaggcucagccagc

SEQ ID NO: 273929 - RNA, 22 nt, Human
uugcugggcucuucaacacaca

SEQ ID NO: 273930 - RNA, 22 nt, Human
uacagacauuuacuccacuccu

SEQ ID NO: 273931 - RNA, 22 nt, Human
uuguacaaaggauuuggaagag

SEQ ID NO: 273932 - RNA, 22 nt, Human
ucaugaacaucucaaauaacca

SEQ ID NO: 273933 - RNA, 22 nt, Human
ugcuuuauuggaaccucauccu

SEQ ID NO: 273934 - RNA, 22 nt, Human
gaguauuuauauguaaguaccu

SEQ ID NO: 273935 - RNA, 18 nt, Human
gccugagggucaagugug

SEQ ID NO: 273936 - RNA, 22 nt, Human
ccaaguacucucaccaaagcuu

SEQ ID NO: 273937 - RNA, 21 nt, Human
agcaggcuuuggaguggggcu

SEQ ID NO: 273938 - RNA, 22 nt, Human
cugggcagugguggcccuuccc

SEQ ID NO: 273939 - RNA, 22 nt, Human
cagggcuuugaacaggcaucaa

SEQ ID NO: 273940 - RNA, 22 nt, Human
gcuaggagccgcugcacuaggu

SEQ ID NO: 273941 - RNA, 22 nt, Human
ccugcugucucugggcaggcag

SEQ ID NO: 273942 - RNA, 22 nt, Human
uccaaauauagaugaguuguaa

SEQ ID NO: 273943 - RNA, 22 nt, Human
gacccaggaagcuacuucuggu

SEQ ID NO: 273944 - RNA, 22 nt, Human
uuuaaauuuguguuuagagggu

SEQ ID NO: 273945 - RNA, 22 nt, Human
cuauuguuauaauuguugacau

SEQ ID NO: 273946 - RNA, 22 nt, Human
aggcuugccacuuguuagucua

SEQ ID NO: 273947 - RNA, 22 nt, Human
uuauccaacaugacuuaugucc

SEQ ID NO: 273948 - RNA, 22 nt, Human
guucaaaucucaggacuucaga

SEQ ID NO: 273949 - RNA, 22 nt, Human
gaccaggcuguuccagucuaac

SEQ ID NO: 273950 - RNA, 22 nt, Human
agcuggguacugaugucuucag

SEQ ID NO: 273951 - RNA, 22 nt, Human
cagaugagaguggccaggguuc

SEQ ID NO: 273952 - RNA, 22 nt, Human
cagagacccuaggcaggugaca

SEQ ID NO: 273953 - RNA, 22 nt, Human
aggcaggugcuuaugacuugcu

SEQ ID NO: 273954 - RNA, 22 nt, Human
aucuuguuaaagugcagauuuu

SEQ ID NO: 273955 - RNA, 22 nt, Human
ucugccuuguuugagcuuugac

SEQ ID NO: 273956 - RNA, 19 nt, Human
aaaaagaggcuauaauauu

SEQ ID NO: 273957 - RNA, 22 nt, Human
augcagggaaaagagauauuau

SEQ ID NO: 273958 - RNA, 22 nt, Human
aauucacaggagguauuugucc

SEQ ID NO: 273959 - RNA, 22 nt, Human
ucaguuaagcacuauacccuaa

SEQ ID NO: 273960 - RNA, 22 nt, Human
auucagucaaaaaugauggaga

SEQ ID NO: 273961 - RNA, 22 nt, Human
ugucagcaugaacccugaauua

SEQ ID NO: 273962 - RNA, 22 nt, Human
gacacagagauaggccuguguu

SEQ ID NO: 273963 - RNA, 22 nt, Human
ucucugaagaaucgaugauucu

SEQ ID NO: 273964 - RNA, 22 nt, Human
auauugagauaagaacugacau

SEQ ID NO: 273965 - RNA, 22 nt, Human
acccagcuaacccuacccugga

SEQ ID NO: 273966 - RNA, 22 nt, Human
cuuuagaauuugauauaaucaa

SEQ ID NO: 273967 - RNA, 22 nt, Human
acuuuggaauaagcuauauaac

SEQ ID NO: 273968 - RNA, 22 nt, Human
aaguguuuacuuaaagucaugg

SEQ ID NO: 273969 - RNA, 22 nt, Human
gcuuccuaaaugcacagggcag

SEQ ID NO: 273970 - RNA, 22 nt, Human
ucuggcagcagcaucaguggcu

SEQ ID NO: 273971 - RNA, 22 nt, Human
auugguauguauucugaaaacu

SEQ ID NO: 273972 - RNA, 22 nt, Human
gccagguugcugacgacgaucu

SEQ ID NO: 273973 - RNA, 22 nt, Human
uuaggaaugagauuucuaguga

SEQ ID NO: 273974 - RNA, 22 nt, Human
gagcuccuggauugcuccuagg

SEQ ID NO: 273975 - RNA, 22 nt, Human
guuaggaacacuggagccuaaa

SEQ ID NO: 273976 - RNA, 22 nt, Human
uggaaggggagcuggaaagggg

SEQ ID NO: 273977 - RNA, 22 nt, Human
ucuuaaugaaagugaaauauca

SEQ ID NO: 273978 - RNA, 22 nt, Human
agucugcaggaccgcgucacau

SEQ ID NO: 273979 - RNA, 20 nt, Human
uccaggcagcucagaguguc

SEQ ID NO: 273980 - RNA, 22 nt, Human
ggaagaggcugaggccaugcug

SEQ ID NO: 273981 - RNA, 19 nt, Human
gucuagaccaggcuccuua

SEQ ID NO: 273982 - RNA, 21 nt, Human
uaggacagccccccugcccuc

SEQ ID NO: 273983 - RNA, 22 nt, Human
uacuaguucucauaugaaauaa

SEQ ID NO: 273984 - RNA, 17 nt, Human
accaggcaacacgccca

SEQ ID NO: 273985 - RNA, 22 nt, Human
uuacugaaauaaugaaacacau

SEQ ID NO: 273986 - RNA, 22 nt, Human
ucccacaccugucuauuccuag

SEQ ID NO: 273987 - RNA, 22 nt, Human
ucuuugcaacucccauuuccau

SEQ ID NO: 273988 - RNA, 22 nt, Human
uuagaagugguaaguagaaaga

SEQ ID NO: 273989 - RNA, 22 nt, Human
gggcuggagagucccacguggg

SEQ ID NO: 273990 - RNA, 22 nt, Human
gcuucucucaggagcaucagcc

SEQ ID NO: 273991 - RNA, 17 nt, Human
aauugcuuguacuccca

SEQ ID NO: 273992 - RNA, 22 nt, Human
auccaguucucagugcuuacag

SEQ ID NO: 273993 - RNA, 22 nt, Human
aucucuagcuaacccucuggca

SEQ ID NO: 273994 - RNA, 22 nt, Human
cugucccagccccguacucuaa

SEQ ID NO: 273995 - RNA, 22 nt, Human
agggccaaguccaggaccucgg

SEQ ID NO: 273996 - RNA, 22 nt, Human
uuauguguguguauacauacaa

SEQ ID NO: 273997 - RNA, 22 nt, Human
cuuuggaaggaacaggauucuc

SEQ ID NO: 273998 - RNA, 22 nt, Human
gacagacacuguguccucacuu

SEQ ID NO: 273999 - RNA, 23 nt, Human
aggucuggacccuuggccccugc

SEQ ID NO: 274000 - RNA, 19 nt, Human
uugcuggagaaaaaggaga

SEQ ID NO: 274001 - RNA, 22 nt, Human
guuugugucaaugacuucugca

SEQ ID NO: 274002 - RNA, 22 nt, Human
agcagcuguggggacaagggua

SEQ ID NO: 274003 - RNA, 22 nt, Human
ccugucaggguuugccucagaa

SEQ ID NO: 274004 - RNA, 22 nt, Human
gcucaggaaggcucaaccagga

SEQ ID NO: 274005 - RNA, 22 nt, Human
auucuagauaagaaaagggcug

SEQ ID NO: 274006 - RNA, 22 nt, Human
uuugaaaggguuaugagacuga

SEQ ID NO: 274007 - RNA, 22 nt, Human
uagcaucagccacaccuuguac

SEQ ID NO: 274008 - RNA, 22 nt, Human
ucugccuuuucacugccacuaa

SEQ ID NO: 274009 - RNA, 22 nt, Human
ccucagucuccgugcucaccuu

SEQ ID NO: 274010 - RNA, 22 nt, Human
agaaaucucuagcacaucgaau

SEQ ID NO: 274011 - RNA, 22 nt, Human
aaauuucuggaagugucagagu

SEQ ID NO: 274012 - RNA, 22 nt, Human
ccagcaggaaagugacguuuga

SEQ ID NO: 274013 - RNA, 22 nt, Human
acagcacaaucugagucccaga

SEQ ID NO: 274014 - RNA, 22 nt, Human
aaugucuucccuggcaggccaa

SEQ ID NO: 274015 - RNA, 22 nt, Human
agagugggccucugagucccag

SEQ ID NO: 274016 - RNA, 22 nt, Human
uagcaacaagugacuaucuaua

SEQ ID NO: 274017 - RNA, 22 nt, Human
uaccugcacagccagccaugug

SEQ ID NO: 274018 - RNA, 22 nt, Human
ggacaguugguugggcucuugu

SEQ ID NO: 274019 - RNA, 17 nt, Human
aaucagauuucugagga

SEQ ID NO: 274020 - RNA, 22 nt, Human
ugauuuugucauguuucugaua

SEQ ID NO: 274021 - RNA, 22 nt, Human
agugacuucuccuaaugucaua

SEQ ID NO: 274022 - RNA, 22 nt, Human
ucagagcaugugggcugcaguu

SEQ ID NO: 274023 - RNA, 22 nt, Human
cauuuuaaaugauuuaagccaa

SEQ ID NO: 274024 - RNA, 22 nt, Human
acugggccaggugugggugagu

SEQ ID NO: 274025 - RNA, 22 nt, Human
ucaaaugcugccuuugugugcc

SEQ ID NO: 274026 - RNA, 22 nt, Human
caugcccauugagaagggccuc

SEQ ID NO: 274027 - RNA, 22 nt, Human
gaggcugagacucugaauuuuu

SEQ ID NO: 274028 - RNA, 22 nt, Human
gaaaugaaauagcaccaagguu

SEQ ID NO: 274029 - RNA, 22 nt, Human
cauguuaaugaauuuuugcagu

SEQ ID NO: 274030 - RNA, 22 nt, Human
cagagccagucagucagaaacu

SEQ ID NO: 274031 - RNA, 20 nt, Human
caggugagcagaucugggug

SEQ ID NO: 274032 - RNA, 22 nt, Human
ccuggggcucaagauggcgccg

SEQ ID NO: 274033 - RNA, 22 nt, Human
aauggcagaggcaaagauggua

SEQ ID NO: 274034 - RNA, 22 nt, Human
aucucagaaacauaucuaaucc

SEQ ID NO: 274035 - RNA, 22 nt, Human
ugaguggguuaucaggaaaggu

SEQ ID NO: 274036 - RNA, 21 nt, Human
ugcaggagucugugagucagg

SEQ ID NO: 274037 - RNA, 22 nt, Human
gaaaaucugcuuauauuauuuu

SEQ ID NO: 274038 - RNA, 22 nt, Human
ggacccugggcagcuggcugcu

SEQ ID NO: 274039 - RNA, 22 nt, Human
uuccaggcuauccggugaaggg

SEQ ID NO: 274040 - RNA, 22 nt, Human
gaguaggguuuccagguuagag

SEQ ID NO: 274041 - RNA, 23 nt, Human
agcagcccagaugccuuccaucc

SEQ ID NO: 274042 - RNA, 22 nt, Human
ggucaguggcaggggguacuuc

SEQ ID NO: 274043 - RNA, 22 nt, Human
ccccagcacaggcuccucagau

SEQ ID NO: 274044 - RNA, 22 nt, Human
cugccucucaggucccugagau

SEQ ID NO: 274045 - RNA, 22 nt, Human
uagcaucuugauuucagaccag

SEQ ID NO: 274046 - RNA, 22 nt, Human
ccuggcucuguccucgcgcaaa

SEQ ID NO: 274047 - RNA, 22 nt, Human
cuccugcugaauggccaggagc

SEQ ID NO: 274048 - RNA, 22 nt, Human
acaauagucaaugcacgucauu

SEQ ID NO: 274049 - RNA, 22 nt, Human
ucccagagaaagucaaggucuu

SEQ ID NO: 274050 - RNA, 22 nt, Human
agccuggaguucccaggagaag

SEQ ID NO: 274051 - RNA, 22 nt, Human
agcaggagcccuuaucaccagg

SEQ ID NO: 274052 - RNA, 22 nt, Human
ucugucauaaacacacacaagc

SEQ ID NO: 274053 - RNA, 22 nt, Human
uguucuuuggcuucacagcucu

SEQ ID NO: 274054 - RNA, 18 nt, Human
ucccuggggcugccaccc

SEQ ID NO: 274055 - RNA, 22 nt, Human
agcagggccugagugaccuaac

SEQ ID NO: 274056 - RNA, 22 nt, Human
aucagcugcuacauuggccucu

SEQ ID NO: 274057 - RNA, 21 nt, Human
agacacugguuuagcauucau

SEQ ID NO: 274058 - RNA, 21 nt, Human
cuuggaacggguagaacucac

SEQ ID NO: 274059 - RNA, 22 nt, Human
ucauguuuuagcugcaaaauga

SEQ ID NO: 274060 - RNA, 22 nt, Human
agcaagauugaggcuuccucag

SEQ ID NO: 274061 - RNA, 22 nt, Human
ugguggcaucaauugacuucuc

SEQ ID NO: 274062 - RNA, 22 nt, Human
uuauuauugauucgcucucaaa

SEQ ID NO: 274063 - RNA, 22 nt, Human
guccauggcagagcccuucugc

SEQ ID NO: 274064 - RNA, 22 nt, Human
uucuuuaugcuucuguuuaggc

SEQ ID NO: 274065 - RNA, 22 nt, Human
guccagagauggacgagcagau

SEQ ID NO: 274066 - RNA, 22 nt, Human
gcagcuuuagaaacaagggcug

SEQ ID NO: 274067 - RNA, 22 nt, Human
uacagugcaaugugauguagau

SEQ ID NO: 274068 - RNA, 22 nt, Human
gugugcugagugacugucauca

SEQ ID NO: 274069 - RNA, 22 nt, Human
guggcaggaucacggcucacug

SEQ ID NO: 274070 - RNA, 22 nt, Human
gauggccuggguccccuuccgg

SEQ ID NO: 274071 - RNA, 21 nt, Human
ggaugccacgaagcaccagga

SEQ ID NO: 274072 - RNA, 22 nt, Human
uucuaccuacccucugcauaca

SEQ ID NO: 274073 - RNA, 22 nt, Human
ggucacuggucucugcuuccau

SEQ ID NO: 274074 - RNA, 22 nt, Human
aguaucagaugugauuaaaggg

SEQ ID NO: 274075 - RNA, 22 nt, Human
caugagcauuuuggucuaguuu

SEQ ID NO: 274076 - RNA, 22 nt, Human
uuggggaaggcuucccuguacc

SEQ ID NO: 274077 - RNA, 22 nt, Human
caucuuuguucuguaaacuuuu

SEQ ID NO: 274078 - RNA, 22 nt, Human
uccuggcaguaauuugauguug

SEQ ID NO: 274079 - RNA, 20 nt, Human
cagcuuggaugagaggcuga

SEQ ID NO: 274080 - RNA, 22 nt, Human
aacuagaacgucuaguugcugg

SEQ ID NO: 274081 - RNA, 22 nt, Human
ucaaaggcauugccaauaagua

SEQ ID NO: 274082 - RNA, 22 nt, Human
gugcugagauuggagugagcag

SEQ ID NO: 274083 - RNA, 22 nt, Human
ugcuccaggcugcugaagaucu

SEQ ID NO: 274084 - RNA, 22 nt, Human
caaagucauggggaugcagguc

SEQ ID NO: 274085 - RNA, 22 nt, Human
ccagcuccacugucagaugaga

SEQ ID NO: 274086 - RNA, 22 nt, Human
caagauuuuaucuccguuucug

SEQ ID NO: 274087 - RNA, 22 nt, Human
aacagcugcuucaguacuugaa

SEQ ID NO: 274088 - RNA, 22 nt, Human
cucugugggaagcuggguguga

SEQ ID NO: 274089 - RNA, 22 nt, Human
aacaauguguucagcacugugg

SEQ ID NO: 274090 - RNA, 19 nt, Human
acauggcucuccagucugg

SEQ ID NO: 274091 - RNA, 22 nt, Human
uccagggagcaagucaggccgg

SEQ ID NO: 274092 - RNA, 21 nt, Human
ccugggugggaccccucuucc

SEQ ID NO: 274093 - RNA, 22 nt, Human
ccuggcucuagaggccacuccu

SEQ ID NO: 274094 - RNA, 23 nt, Human
agacacauaggagcagcuauugg

SEQ ID NO: 274095 - RNA, 22 nt, Human
ucagagcccugcuccuccccaa

SEQ ID NO: 274096 - RNA, 22 nt, Human
acagaauuaucaggaaauguua

SEQ ID NO: 274097 - RNA, 22 nt, Human
augaguaagaccauaauuuuug

SEQ ID NO: 274098 - RNA, 22 nt, Human
uccaggcuggagugcaguggca

SEQ ID NO: 274099 - RNA, 18 nt, Human
acaaauguagugucuuaa

SEQ ID NO: 274100 - RNA, 22 nt, Human
gagagcuggauucuggauaggu

SEQ ID NO: 274101 - RNA, 22 nt, Human
uccuccagaaacugaggcagaa

SEQ ID NO: 274102 - RNA, 22 nt, Human
auacacauguuauuguggaagc

SEQ ID NO: 274103 - RNA, 22 nt, Human
acuagaaaauuccuagaaacua

SEQ ID NO: 274104 - RNA, 22 nt, Human
gcuggcuggaaugggagaagaa

SEQ ID NO: 274105 - RNA, 22 nt, Human
cugccuuugaaaguucuguuga

SEQ ID NO: 274106 - RNA, 22 nt, Human
aaaacuuagcuaggcaaguuuu

SEQ ID NO: 274107 - RNA, 22 nt, Human
uugacacagaucaauauucaac

SEQ ID NO: 274108 - RNA, 22 nt, Human
uggcuuccugcauggauccucu

SEQ ID NO: 274109 - RNA, 22 nt, Human
agcuggagaauaggaauuagug

SEQ ID NO: 274110 - RNA, 22 nt, Human
acauuucuaguuguucaucucc

SEQ ID NO: 274111 - RNA, 22 nt, Human
agugacucacacaaacaugugu

SEQ ID NO: 274112 - RNA, 22 nt, Human
uuugcaaauaaauaagugcucg

SEQ ID NO: 274113 - RNA, 21 nt, Human
aggacagauguaggaauaaag

SEQ ID NO: 274114 - RNA, 22 nt, Human
cuuagcuuguuuucaccuaaga

SEQ ID NO: 274115 - RNA, 22 nt, Human
ugguccaguaaggguggagaga

SEQ ID NO: 274116 - RNA, 22 nt, Human
uagggcucuggugggcucuguu

SEQ ID NO: 274117 - RNA, 22 nt, Human
caagagcuuuagaaaugcucau

SEQ ID NO: 274118 - RNA, 22 nt, Human
cuccaggggccagaagccuggc

SEQ ID NO: 274119 - RNA, 22 nt, Human
acacaaguucuaaagauugcgc

SEQ ID NO: 274120 - RNA, 22 nt, Human
ccugagaauguuuaacagagaa

SEQ ID NO: 274121 - RNA, 21 nt, Human
aggcucccagaaaugggcauc

SEQ ID NO: 274122 - RNA, 22 nt, Human
aacagcagggaugacauggcca

SEQ ID NO: 274123 - RNA, 22 nt, Human
ugcaaacauccgacugaaagcc

SEQ ID NO: 274124 - RNA, 22 nt, Human
cuccucgaagcaaccugcaggc

SEQ ID NO: 274125 - RNA, 22 nt, Human
uucugugguugaaaggagagau

SEQ ID NO: 274126 - RNA, 22 nt, Human
aggggccaccuguggcacccug

SEQ ID NO: 274127 - RNA, 22 nt, Human
uaacauguuaagaaauuagaua

SEQ ID NO: 274128 - RNA, 22 nt, Human
uggaggucgcgcgggugcugca

SEQ ID NO: 274129 - RNA, 19 nt, Human
cugaggugcaguaagaggc

SEQ ID NO: 274130 - RNA, 19 nt, Human
uuucaauggcuuagagaaa

SEQ ID NO: 274131 - RNA, 22 nt, Human
aguccaggaaaauaagcuaggu

SEQ ID NO: 274132 - RNA, 22 nt, Human
gugggagaaauuagcucuaguu

SEQ ID NO: 274133 - RNA, 21 nt, Human
gagaacugaaccagagcagcu

SEQ ID NO: 274134 - RNA, 22 nt, Human
ggcagcuccucucagcaaaaga

SEQ ID NO: 274135 - RNA, 22 nt, Human
ucagaacauccugguuuaaaau

SEQ ID NO: 274136 - RNA, 22 nt, Human
gcagccacuaguuuuccuguuu

SEQ ID NO: 274137 - RNA, 22 nt, Human
aauaaaauggucaguuuucuca

SEQ ID NO: 274138 - RNA, 16 nt, Human
gugcaaaagugaggag

SEQ ID NO: 274139 - RNA, 22 nt, Human
acaagucuguuaugcaccugga

SEQ ID NO: 274140 - RNA, 22 nt, Human
gcuggcucaagugugcuuccca

SEQ ID NO: 274141 - RNA, 22 nt, Human
aaaugguauuuacucuguauua

SEQ ID NO: 274142 - RNA, 21 nt, Human
cucuuugggaucuuuggaaag

SEQ ID NO: 274143 - RNA, 22 nt, Human
uacccagggcuuuucugaugca

SEQ ID NO: 274144 - RNA, 22 nt, Human
uagggcagagcuuguacacgau

SEQ ID NO: 274145 - RNA, 22 nt, Human
uuuuuccuuggaugugucucuc

SEQ ID NO: 274146 - RNA, 22 nt, Human
gcugggugucacggggcucgug

SEQ ID NO: 274147 - RNA, 22 nt, Human
agucccaacagcuuacaaggaa

SEQ ID NO: 274148 - RNA, 22 nt, Human
aaucaagaaaaugaggauucuu

SEQ ID NO: 274149 - RNA, 22 nt, Human
uuauucuucuucucuugccagg

SEQ ID NO: 274150 - RNA, 22 nt, Human
agaaaucuuuccugaaguguuu

SEQ ID NO: 274151 - RNA, 22 nt, Human
uacagacauucaauuuugaccc

SEQ ID NO: 274152 - RNA, 22 nt, Human
ucagcagggcugugguguggcu

SEQ ID NO: 274153 - RNA, 22 nt, Human
guuacaaaggacugggggccac

SEQ ID NO: 274154 - RNA, 22 nt, Human
guccuuccccagccagcucugg

SEQ ID NO: 274155 - RNA, 21 nt, Human
acaggaugauuuuuccuuaug

SEQ ID NO: 274156 - RNA, 22 nt, Human
ggcuccagaaaucauagagcag

SEQ ID NO: 274157 - RNA, 22 nt, Human
ugcaggaauagcuacagagcug

SEQ ID NO: 274158 - RNA, 22 nt, Human
ugacagaaauaguucuuaauuu

SEQ ID NO: 274159 - RNA, 22 nt, Human
aaugagauggcaaugacuuaaa

SEQ ID NO: 274160 - RNA, 22 nt, Human
cuggcuggucaugucaugagcc

SEQ ID NO: 274161 - RNA, 22 nt, Human
ugggcaggauaauaucucaugu

SEQ ID NO: 274162 - RNA, 20 nt, Human
uuacaaagaggcaucgcuuu

SEQ ID NO: 274163 - RNA, 22 nt, Human
gccagccacguuagacuggccc

SEQ ID NO: 274164 - RNA, 22 nt, Human
cacauaauaaauguuccugaug

SEQ ID NO: 274165 - RNA, 22 nt, Human
guuuacauugcuguuugugucu

SEQ ID NO: 274166 - RNA, 22 nt, Human
auauauuugagaauauucauga

SEQ ID NO: 274167 - RNA, 21 nt, Human
agacaggucagggagagguga

SEQ ID NO: 274168 - RNA, 20 nt, Human
ucugguccaggucuucaugg

SEQ ID NO: 274169 - RNA, 21 nt, Human
uucuggguuguuaaucugaac

SEQ ID NO: 274170 - RNA, 18 nt, Human
uuccaugauuccuuucac

SEQ ID NO: 274171 - RNA, 22 nt, Human
aaacagaugaguuauaauagcc

SEQ ID NO: 274172 - RNA, 22 nt, Human
cccugaggaaaggguggagggc

SEQ ID NO: 274173 - RNA, 22 nt, Human
uuguacaaguuuugagcuuaag

SEQ ID NO: 274174 - RNA, 22 nt, Human
uuucaauguaugucuuucugag

SEQ ID NO: 274175 - RNA, 22 nt, Human
uccuggccaugcaagaugagga

SEQ ID NO: 274176 - RNA, 22 nt, Human
uuuccaagagcuuauuucugaa

SEQ ID NO: 274177 - RNA, 22 nt, Human
agguaugccaauuaggucaagu

SEQ ID NO: 274178 - RNA, 22 nt, Human
caaacuuacguagucuuacuac

SEQ ID NO: 274179 - RNA, 23 nt, Human
uugaaagauugcuaaguaaaaau

SEQ ID NO: 274180 - RNA, 22 nt, Human
cuggcuccaccccaggaggaug

SEQ ID NO: 274181 - RNA, 22 nt, Human
accaggcaguauggugcugcaa

SEQ ID NO: 274182 - RNA, 22 nt, Human
gcuggacuagaagcagggcuca

SEQ ID NO: 274183 - RNA, 22 nt, Human
aagcuuggaagucuuccuuuca

SEQ ID NO: 274184 - RNA, 22 nt, Human
gcuugucugcugagccaccugu

SEQ ID NO: 274185 - RNA, 22 nt, Human
guucuucaucauuaacacucug

SEQ ID NO: 274186 - RNA, 22 nt, Human
gcacucaguaccaggucacugc

SEQ ID NO: 274187 - RNA, 22 nt, Human
aaaaguuuaagacucauucuag

SEQ ID NO: 274188 - RNA, 22 nt, Human
gcagggugacguugcccaccuc

SEQ ID NO: 274189 - RNA, 22 nt, Human
ucucagagggaggauuacugcc

SEQ ID NO: 274190 - RNA, 23 nt, Human
ucugaaagggaugcugggcagga

SEQ ID NO: 274191 - RNA, 22 nt, Human
aaauagcaaugugaaaagagga

SEQ ID NO: 274192 - RNA, 22 nt, Human
uugcuugcccugcagcauacuu

SEQ ID NO: 274193 - RNA, 22 nt, Human
ugaaccuuuugaauaaggacca

SEQ ID NO: 274194 - RNA, 22 nt, Human
uuccuuccugucuuccuuacug

SEQ ID NO: 274195 - RNA, 22 nt, Human
guauuacaaauaaauguuacug

SEQ ID NO: 274196 - RNA, 22 nt, Human
acugccuucuuuaauccuaguu

SEQ ID NO: 274197 - RNA, 22 nt, Human
gugcuggcccuguccucgagcu

SEQ ID NO: 274198 - RNA, 22 nt, Human
acuuugcagggcuugauaucca

SEQ ID NO: 274199 - RNA, 22 nt, Human
aacacuuaaggagagaucaaau

SEQ ID NO: 274200 - RNA, 22 nt, Human
uguauucagugccuagcauaug

SEQ ID NO: 274201 - RNA, 22 nt, Human
accagcuccaggccccugcugg

SEQ ID NO: 274202 - RNA, 22 nt, Human
uuucaagacucauugaguauug

SEQ ID NO: 274203 - RNA, 22 nt, Human
uuggaaauggcuguaguuauga

SEQ ID NO: 274204 - RNA, 22 nt, Human
ucccuccugcaugaggcucggc

SEQ ID NO: 274205 - RNA, 22 nt, Human
cagaauucgaaugagcagaauc

SEQ ID NO: 274206 - RNA, 22 nt, Human
gggaagagaccguacccuggcc

SEQ ID NO: 274207 - RNA, 22 nt, Human
agugucaaugccaacaguauau

SEQ ID NO: 274208 - RNA, 22 nt, Human
aaauaguaaagugguagccauc

SEQ ID NO: 274209 - RNA, 22 nt, Human
ccucagaccccacagggccugu

SEQ ID NO: 274210 - RNA, 22 nt, Human
auauacaaagggcaaccucgcu

SEQ ID NO: 274211 - RNA, 22 nt, Human
gcaggcagagucaauuugaucc

SEQ ID NO: 274212 - RNA, 22 nt, Human
ucagagacuggucugcagaugc

SEQ ID NO: 274213 - RNA, 22 nt, Human
ugcuggcuacugauggcaggcc

SEQ ID NO: 274214 - RNA, 22 nt, Human
cagagccuaaaacgacuccacu

SEQ ID NO: 274215 - RNA, 22 nt, Human
ccuucugagcuucaauuucagu

SEQ ID NO: 274216 - RNA, 22 nt, Human
aacagcauaaguauuuauuuca

SEQ ID NO: 274217 - RNA, 22 nt, Human
aggaccuuuggcaaggcugcuc

SEQ ID NO: 274218 - RNA, 22 nt, Human
ucugcccucgaggagcuugugu

SEQ ID NO: 274219 - RNA, 22 nt, Human
uacacaucauacacugggauua

SEQ ID NO: 274220 - RNA, 22 nt, Human
aauucuagcauugugaaaauau

SEQ ID NO: 274221 - RNA, 22 nt, Human
aaacaaauagugcaugggaauu

SEQ ID NO: 274222 - RNA, 22 nt, Human
cagaguggcacucugcuggaug

SEQ ID NO: 274223 - RNA, 22 nt, Human
agcaggugggcaugaaagcuga

SEQ ID NO: 274224 - RNA, 22 nt, Human
uccagugcaauggcucauucau

SEQ ID NO: 274225 - RNA, 22 nt, Human
uggggaagacagcagacacugu

SEQ ID NO: 274226 - RNA, 22 nt, Human
uccaggagaaaacugacggugg

SEQ ID NO: 274227 - RNA, 22 nt, Human
uuagucuucuuccuuauauguu

SEQ ID NO: 274228 - RNA, 22 nt, Human
gaucuucuagcagaaguaauuu

SEQ ID NO: 274229 - RNA, 22 nt, Human
aagccaaugauacgggugaucu

SEQ ID NO: 274230 - RNA, 22 nt, Human
ucacccuucccagcuguccgcc

SEQ ID NO: 274231 - RNA, 22 nt, Human
ccaggagcaaagaucacuggga

SEQ ID NO: 274232 - RNA, 22 nt, Human
gccuggcccagggcucuuguug

SEQ ID NO: 274233 - RNA, 22 nt, Human
cugcucagcggaaggaagagcg

SEQ ID NO: 274234 - RNA, 22 nt, Human
cuguaagggccugacuacccug

SEQ ID NO: 274235 - RNA, 22 nt, Human
uaaggacaaucagguuaguagc

SEQ ID NO: 274236 - RNA, 22 nt, Human
cauggcaggcuucuucagccuu

SEQ ID NO: 274237 - RNA, 19 nt, Human
agucugguggcgugcaugu

SEQ ID NO: 274238 - RNA, 20 nt, Human
ggugucagggccaugccugg

SEQ ID NO: 274239 - RNA, 17 nt, Human
gaggagcuccaguaggu

SEQ ID NO: 274240 - RNA, 22 nt, Human
gccugcagugagugcagaaggu

SEQ ID NO: 274241 - RNA, 22 nt, Human
agcugcaguuagccccagauga

SEQ ID NO: 274242 - RNA, 22 nt, Human
gacuugccugcacugagccuau

SEQ ID NO: 274243 - RNA, 22 nt, Human
agccuccaaaugucaggucccg

SEQ ID NO: 274244 - RNA, 22 nt, Human
gaucuucuauguaaugaagugu

SEQ ID NO: 274245 - RNA, 22 nt, Human
uggcuucugcuuucaguggagg

SEQ ID NO: 274246 - RNA, 22 nt, Human
augaaugggucauuauuugauc

SEQ ID NO: 274247 - RNA, 22 nt, Human
gaaggccacaagagaaguuaag

SEQ ID NO: 274248 - RNA, 22 nt, Human
ugcacacacgcggcacaucugu

SEQ ID NO: 274249 - RNA, 20 nt, Human
acuguuaguauacuugugcc

SEQ ID NO: 274250 - RNA, 19 nt, Human
cucuccagcuccaguagcu

SEQ ID NO: 274251 - RNA, 22 nt, Human
agcagggcucuguggagggugg

SEQ ID NO: 274252 - RNA, 21 nt, Human
gugcugggacacagccaggcu

SEQ ID NO: 274253 - RNA, 22 nt, Human
ggaccuuccuggcuccuggggu

SEQ ID NO: 274254 - RNA, 22 nt, Human
ugucccagggaaggcccagcac

SEQ ID NO: 274255 - RNA, 22 nt, Human
cucuccuccaacagcccugccg

SEQ ID NO: 274256 - RNA, 22 nt, Human
agugccuggaccccaugacaua

SEQ ID NO: 274257 - RNA, 22 nt, Human
aggcuggagagugcaguggcgu

SEQ ID NO: 274258 - RNA, 18 nt, Human
uggagcugagugcugugc

SEQ ID NO: 274259 - RNA, 22 nt, Human
auuucuagaggcagcuucuagg

SEQ ID NO: 274260 - RNA, 22 nt, Human
cugaggcaggggcagcuggaga

SEQ ID NO: 274261 - RNA, 22 nt, Human
agaagccaagaacagacagugc

SEQ ID NO: 274262 - RNA, 22 nt, Human
agcagggcagguaaggaucaga

SEQ ID NO: 274263 - RNA, 22 nt, Human
guggcccacuuacgucaugugu

SEQ ID NO: 274264 - RNA, 22 nt, Human
uguuuccuucugucucuuugga

SEQ ID NO: 274265 - RNA, 20 nt, Human
ucugggcagggcacauggaa

SEQ ID NO: 274266 - RNA, 22 nt, Human
ucuuccagauacuuccugacuu

SEQ ID NO: 274267 - RNA, 22 nt, Human
uuuguucaacaggugaaauaga

SEQ ID NO: 274268 - RNA, 22 nt, Human
uauuuagaacagacaauagaaa

SEQ ID NO: 274269 - RNA, 22 nt, Human
caaggccaguucaccaagggca

SEQ ID NO: 274270 - RNA, 22 nt, Human
uggaauauacucagaacaggcu

SEQ ID NO: 274271 - RNA, 22 nt, Human
uuuguugguugcacuggugggu

SEQ ID NO: 274272 - RNA, 22 nt, Human
ugaggccaggcaaaggcgaucu

SEQ ID NO: 274273 - RNA, 23 nt, Human
acugaaaggauccuagcagagac

SEQ ID NO: 274274 - RNA, 22 nt, Human
agguuucuuuaugcugcuagaa

SEQ ID NO: 274275 - RNA, 22 nt, Human
agcauggacaguggcagcagug

SEQ ID NO: 274276 - RNA, 22 nt, Human
ugucagggauuuaaagacacaa

SEQ ID NO: 274277 - RNA, 22 nt, Human
uaggaaaugaaugcaggcuccc

SEQ ID NO: 274278 - RNA, 22 nt, Human
guguggcccugcguccugaguc

SEQ ID NO: 274279 - RNA, 22 nt, Human
gggcuggaccgcgaccccugag

SEQ ID NO: 274280 - RNA, 21 nt, Human
cagcagaguaaugcauucgua

SEQ ID NO: 274281 - RNA, 20 nt, Human
cuguggcaucugucauggug

SEQ ID NO: 274282 - RNA, 22 nt, Human
cuuagaauuuuaauccagaaag

SEQ ID NO: 274283 - RNA, 22 nt, Human
gcauggcagccaguacauggug

SEQ ID NO: 274284 - RNA, 22 nt, Human
ugggccugggagggcagacgcu

SEQ ID NO: 274285 - RNA, 22 nt, Human
aggccagcuuccagaggggcag

SEQ ID NO: 274286 - RNA, 22 nt, Human
acugccugccuuccagguacug

SEQ ID NO: 274287 - RNA, 22 nt, Human
cugagaaaggaccucaaacagg

SEQ ID NO: 274288 - RNA, 22 nt, Human
aaguucaagucuccugaguaua

SEQ ID NO: 274289 - RNA, 22 nt, Human
augugguugaagaauuacaucu

SEQ ID NO: 274290 - RNA, 22 nt, Human
aagaaaaucaguucuggucagu

SEQ ID NO: 274291 - RNA, 22 nt, Human
acaacucucaguuaaauaaaga

SEQ ID NO: 274292 - RNA, 22 nt, Human
agcagcucugagaggccagcac

SEQ ID NO: 274293 - RNA, 22 nt, Human
auuuugugaacccucaagcaau

SEQ ID NO: 274294 - RNA, 22 nt, Human
aaccccaaaaccucugaagugg

SEQ ID NO: 274295 - RNA, 20 nt, Human
agugcauggagggagagggc

SEQ ID NO: 274296 - RNA, 22 nt, Human
cuauuuuccgcagcaggaagua

SEQ ID NO: 274297 - RNA, 23 nt, Human
cuggggcuuucaaaucugggcag

SEQ ID NO: 274298 - RNA, 22 nt, Human
ggagaaggcacacccaccucug

SEQ ID NO: 274299 - RNA, 22 nt, Human
ugcaggugcuacaagaacucac

SEQ ID NO: 274300 - RNA, 22 nt, Human
aacuggauuuaggaacagagaa

SEQ ID NO: 274301 - RNA, 22 nt, Human
aguggcugacaacuggguuaac

SEQ ID NO: 274302 - RNA, 22 nt, Human
ggcagaggugacagugucuuuu

SEQ ID NO: 274303 - RNA, 23 nt, Human
acucguggaauucucugcgaucg

SEQ ID NO: 274304 - RNA, 18 nt, Human
cucugggagaggcauaca

SEQ ID NO: 274305 - RNA, 22 nt, Human
auuagaacuaggcuaaguaaaa

SEQ ID NO: 274306 - RNA, 22 nt, Human
ucacaaagcuuugauaagcaga

SEQ ID NO: 274307 - RNA, 22 nt, Human
gccucucucuacccaguaugau

SEQ ID NO: 274308 - RNA, 22 nt, Human
aagggcuccaagagguagcugg

SEQ ID NO: 274309 - RNA, 22 nt, Human
gaccuccauucugucaugacug

SEQ ID NO: 274310 - RNA, 22 nt, Human
uauuuauucuuuguacugccuu

SEQ ID NO: 274311 - RNA, 22 nt, Human
aucuaaacuauaguaccuaguc

SEQ ID NO: 274312 - RNA, 22 nt, Human
cuuuaagacuaaauuagaguuu

SEQ ID NO: 274313 - RNA, 22 nt, Human
acagugcaaacccucgggaaag

SEQ ID NO: 274314 - RNA, 22 nt, Human
uucucuggguuaggggaacuau

SEQ ID NO: 274315 - RNA, 22 nt, Human
gacagcugcauccucagacaca

SEQ ID NO: 274316 - RNA, 22 nt, Human
uucuacuucugacacuguuugu

SEQ ID NO: 274317 - RNA, 20 nt, Human
gccagaguuaugaugagagg

SEQ ID NO: 274318 - RNA, 20 nt, Human
acuaaucauccagucacagu

SEQ ID NO: 274319 - RNA, 22 nt, Human
caggucuggugagagaacaguu

SEQ ID NO: 274320 - RNA, 22 nt, Human
caggcggccaugaucuggcagg

SEQ ID NO: 274321 - RNA, 22 nt, Human
auugugcaaauauuaucuguag

SEQ ID NO: 274322 - RNA, 22 nt, Human
aacugguagaaagcaguaagug

SEQ ID NO: 274323 - RNA, 22 nt, Human
caggcucccgcuccacugggca

SEQ ID NO: 274324 - RNA, 22 nt, Human
uugugcaaggucuggacuauag

SEQ ID NO: 274325 - RNA, 22 nt, Human
gggagcgggacugcgcaggcuu

SEQ ID NO: 274326 - RNA, 22 nt, Human
gcuguauucaacagugaaaaga

SEQ ID NO: 274327 - RNA, 22 nt, Human
ucagcagauggguuguguuggc

SEQ ID NO: 274328 - RNA, 22 nt, Human
acugugcugcucuccgcagccc

SEQ ID NO: 274329 - RNA, 22 nt, Human
aacaguuucaguuacugaugag

SEQ ID NO: 274330 - RNA, 22 nt, Human
uaagaaacuaaugcaauaagag

SEQ ID NO: 274331 - RNA, 22 nt, Human
gcuggccagggcugcucgcgga

SEQ ID NO: 274332 - RNA, 22 nt, Human
cuggaucuugcugcauugagaa

SEQ ID NO: 274333 - RNA, 23 nt, Human
cagaaaugacaguaagcacccug

SEQ ID NO: 274334 - RNA, 22 nt, Human
acagauuuguucuuuugggcua

SEQ ID NO: 274335 - RNA, 22 nt, Human
uugggaagaggccccuggauuc

SEQ ID NO: 274336 - RNA, 22 nt, Human
cugggcugcaguuccugguccu

SEQ ID NO: 274337 - RNA, 22 nt, Human
aaaguaaccuaguaauaguguc

SEQ ID NO: 274338 - RNA, 22 nt, Human
ucauguauugaaaagcauuuua

SEQ ID NO: 274339 - RNA, 22 nt, Human
cauaagaaauaaugaugaugac

SEQ ID NO: 274340 - RNA, 22 nt, Human
cugaaggagcauagucaguuuu

SEQ ID NO: 274341 - RNA, 22 nt, Human
caggaaagucuguaaaggaacc

SEQ ID NO: 274342 - RNA, 23 nt, Human
auacaaaccuugcaggacauguu

SEQ ID NO: 274343 - RNA, 22 nt, Human
ugcauuuauggagcaaggcagu

SEQ ID NO: 274344 - RNA, 22 nt, Human
agcugugccuugcugcacggug

SEQ ID NO: 274345 - RNA, 22 nt, Human
gcagugggcaacaagagcugga

SEQ ID NO: 274346 - RNA, 22 nt, Human
cuugccuuugucuucaaaggcu

SEQ ID NO: 274347 - RNA, 22 nt, Human
cacaauuuccuugcuucacuuu

SEQ ID NO: 274348 - RNA, 22 nt, Human
gaccauuuuuacagagcauuca

SEQ ID NO: 274349 - RNA, 22 nt, Human
ucccugcaguaguggcuaagau

SEQ ID NO: 274350 - RNA, 22 nt, Human
cugaggaaggaguuaggcaguu

SEQ ID NO: 274351 - RNA, 22 nt, Human
gagggucccugcucagggccag

SEQ ID NO: 274352 - RNA, 22 nt, Human
auccauugucuuguuggcuucu

SEQ ID NO: 274353 - RNA, 22 nt, Human
gugcccugaucgcuaggcuccc

SEQ ID NO: 274354 - RNA, 22 nt, Human
gguccagggaacuuugaaggau

SEQ ID NO: 274355 - RNA, 22 nt, Human
ucuauagacuuggacauauagu

SEQ ID NO: 274356 - RNA, 21 nt, Human
cagggcacacagaggauggua

SEQ ID NO: 274357 - RNA, 22 nt, Human
ugcuccagugagcuggccaucc

SEQ ID NO: 274358 - RNA, 22 nt, Human
agugcuguccaguuucacaggu

SEQ ID NO: 274359 - RNA, 20 nt, Human
gaaauacuuacccaacuguu

SEQ ID NO: 274360 - RNA, 22 nt, Human
aggccucacacaacagaugcau

SEQ ID NO: 274361 - RNA, 19 nt, Human
aggucuaaucauaagacaa

SEQ ID NO: 274362 - RNA, 22 nt, Human
acauuuauauaacucacuagga

SEQ ID NO: 274363 - RNA, 22 nt, Human
accccaggagcugugccuaguc

SEQ ID NO: 274364 - RNA, 22 nt, Human
uaaaguuauaaauuaccuguca

SEQ ID NO: 274365 - RNA, 22 nt, Human
ucuuucugcacuuaguggggcu

SEQ ID NO: 274366 - RNA, 22 nt, Human
ucucugggugauggcagggcac

SEQ ID NO: 274367 - RNA, 22 nt, Human
cuggcucuugcgacucagcuug

SEQ ID NO: 274368 - RNA, 22 nt, Human
ccauccugcaggaccuccauau

SEQ ID NO: 274369 - RNA, 22 nt, Human
ccucccugccggcuggacuagu

SEQ ID NO: 274370 - RNA, 22 nt, Human
uucuaacuuuugaggcaaugug

SEQ ID NO: 274371 - RNA, 22 nt, Human
gccugggagauuaauuaggaag

SEQ ID NO: 274372 - RNA, 22 nt, Human
ugcauagaggauccaguguggu

SEQ ID NO: 274373 - RNA, 22 nt, Human
aggacacagguaagccagugga

SEQ ID NO: 274374 - RNA, 22 nt, Human
uagacuuugauauuguacaccc

SEQ ID NO: 274375 - RNA, 22 nt, Human
agguuccucuuccucuggccug

SEQ ID NO: 274376 - RNA, 23 nt, Human
aaggguccauagcuaucauuaca

SEQ ID NO: 274377 - RNA, 22 nt, Human
gagcuggccucaggcacaggag

SEQ ID NO: 274378 - RNA, 22 nt, Human
ccacaucuuuuuuccugaacag

SEQ ID NO: 274379 - RNA, 22 nt, Human
uuuauacuucauaaugucuauu

SEQ ID NO: 274380 - RNA, 22 nt, Human
ccaaggacguacaggagauaau

SEQ ID NO: 274381 - RNA, 22 nt, Human
acuauuagcauaucaugaaugg

SEQ ID NO: 274382 - RNA, 22 nt, Human
cuggaggaggaagucuacaaug

SEQ ID NO: 274383 - RNA, 22 nt, Human
agucuuagagucugugucauga

SEQ ID NO: 274384 - RNA, 20 nt, Human
uggaaccuaggcagagcugg

SEQ ID NO: 274385 - RNA, 22 nt, Human
gccaggugagaggacugaggcu

SEQ ID NO: 274386 - RNA, 22 nt, Human
caggcagcgcucguggccuggc

SEQ ID NO: 274387 - RNA, 22 nt, Human
aggucugaguauggccugagaa

SEQ ID NO: 274388 - RNA, 22 nt, Human
cuucuauucacuggucacaguu

SEQ ID NO: 274389 - RNA, 22 nt, Human
cugggugguuuugaugugaauu

SEQ ID NO: 274390 - RNA, 22 nt, Human
auaggcguguuuaggaggacgu

SEQ ID NO: 274391 - RNA, 22 nt, Human
uuccuacauuugccucacuccc

SEQ ID NO: 274392 - RNA, 22 nt, Human
aaauaaucaauuuuuguagaua

SEQ ID NO: 274393 - RNA, 22 nt, Human
uacaguaaccuuauuugucauu

SEQ ID NO: 274394 - RNA, 22 nt, Human
cugcccuguagcuguucuagca

SEQ ID NO: 274395 - RNA, 22 nt, Human
cucagagguggaugccuugugg

SEQ ID NO: 274396 - RNA, 21 nt, Human
gcaguuuauguaauaugcacu

SEQ ID NO: 274397 - RNA, 22 nt, Human
ugggcacaaacaucugccuguu

SEQ ID NO: 274398 - RNA, 22 nt, Human
uccaccauguaacaagcucugu

SEQ ID NO: 274399 - RNA, 22 nt, Human
uagugauuaaaggcagaauguu

SEQ ID NO: 274400 - RNA, 19 nt, Human
auguacccagugucaaucc

SEQ ID NO: 274401 - RNA, 22 nt, Human
aaaggcugccagguaaaauauu

SEQ ID NO: 274402 - RNA, 22 nt, Human
aagaaagcauuagacaggcauu

SEQ ID NO: 274403 - RNA, 22 nt, Human
gcugcuguugauuuaguccaau

SEQ ID NO: 274404 - RNA, 22 nt, Human
gagauccagauuuccauuccuu

SEQ ID NO: 274405 - RNA, 22 nt, Human
ggcacagcaggagcuaugugaa

SEQ ID NO: 274406 - RNA, 22 nt, Human
ccaggcucugcgcuggacaugg

SEQ ID NO: 274407 - RNA, 22 nt, Human
uaaggcuagcaagaugagaaua

SEQ ID NO: 274408 - RNA, 22 nt, Human
uggguccuaaaugcagucacau

SEQ ID NO: 274409 - RNA, 22 nt, Human
caacagcuuuagaaacacuuuc

SEQ ID NO: 274410 - RNA, 22 nt, Human
uucucugggcuuuucggauccg

SEQ ID NO: 274411 - RNA, 22 nt, Human
agaguugcuauagaaggaugga

SEQ ID NO: 274412 - RNA, 22 nt, Human
ucaugaaucguggaaugauuua

SEQ ID NO: 274413 - RNA, 22 nt, Human
uucuccagucacugacuucgag

SEQ ID NO: 274414 - RNA, 22 nt, Human
uucuaaagagaaugcguuucug

SEQ ID NO: 274415 - RNA, 22 nt, Human
caugcagcaggaucucauuccc

SEQ ID NO: 274416 - RNA, 23 nt, Human
auccacauuacaguaucauacaa

SEQ ID NO: 274417 - RNA, 22 nt, Human
agacagcucuggguuccacacu

SEQ ID NO: 274418 - RNA, 22 nt, Human
agcugguguccuccuggagcug

SEQ ID NO: 274419 - RNA, 22 nt, Human
caggugguacuuaaagucagaa

SEQ ID NO: 274420 - RNA, 22 nt, Human
gggaggugauuaggaccaugua

SEQ ID NO: 274421 - RNA, 22 nt, Human
uagaucugauacaauucaucug

SEQ ID NO: 274422 - RNA, 22 nt, Human
accaguuauuagcccuacaacu

SEQ ID NO: 274423 - RNA, 22 nt, Human
uucacauuagugguucuauaua

SEQ ID NO: 274424 - RNA, 22 nt, Human
uucagaaacaucaguggaugga

SEQ ID NO: 274425 - RNA, 22 nt, Human
ccagcagguguagggcucaugg

SEQ ID NO: 274426 - RNA, 22 nt, Human
acaguguagaauccuguacuua

SEQ ID NO: 274427 - RNA, 22 nt, Human
cucagcucugacaggaggcauc

SEQ ID NO: 274428 - RNA, 22 nt, Human
uccuggcagggaacuugucagc

SEQ ID NO: 274429 - RNA, 22 nt, Human
accugccuucucaaggacauga

SEQ ID NO: 274430 - RNA, 22 nt, Human
agcccagggcuaauaggaacca

SEQ ID NO: 274431 - RNA, 22 nt, Human
caggagcugggucuggaagcag

SEQ ID NO: 274432 - RNA, 22 nt, Human
cuauuagguaugcagccuauuu

SEQ ID NO: 274433 - RNA, 22 nt, Human
aagaguuuaauuuugucuagac

SEQ ID NO: 274434 - RNA, 22 nt, Human
aagaaaggauauaugggaggua

SEQ ID NO: 274435 - RNA, 22 nt, Human
uugcucauauuugcauguguuu

SEQ ID NO: 274436 - RNA, 22 nt, Human
ugacccauuggucccuagaucc

SEQ ID NO: 274437 - RNA, 22 nt, Human
acccagagcagagcuuggcuuc

SEQ ID NO: 274438 - RNA, 22 nt, Human
acacauauaccacuguaaauga

SEQ ID NO: 274439 - RNA, 22 nt, Human
ccagcaggagaugccugugucu

SEQ ID NO: 274440 - RNA, 20 nt, Human
cagcugccuggcucugggau

SEQ ID NO: 274441 - RNA, 22 nt, Human
ucccagaagugaaauuucuaga

SEQ ID NO: 274442 - RNA, 19 nt, Human
cccaggcuacauggagagg

SEQ ID NO: 274443 - RNA, 22 nt, Human
uguguccuguccccuugcugcu

SEQ ID NO: 274444 - RNA, 22 nt, Human
caguuaaaagaagucuaucuua

SEQ ID NO: 274445 - RNA, 22 nt, Human
cugaaaggaauaaggcucuuug

SEQ ID NO: 274446 - RNA, 22 nt, Human
gucuccaguuacagcagccagg

SEQ ID NO: 274447 - RNA, 20 nt, Human
cacaggccuugugagcagac

SEQ ID NO: 274448 - RNA, 22 nt, Human
uccuagaaugcaccucugcugu

SEQ ID NO: 274449 - RNA, 21 nt, Human
ucugaggagaaacucuuggug

SEQ ID NO: 274450 - RNA, 19 nt, Human
cugcucaggucagucuguc

SEQ ID NO: 274451 - RNA, 22 nt, Human
uuucuacuuuggaaugcacuga

SEQ ID NO: 274452 - RNA, 22 nt, Human
ccuucccaggcuagaccaacau

SEQ ID NO: 274453 - RNA, 22 nt, Human
cagggccucucaucccacgggc

SEQ ID NO: 274454 - RNA, 22 nt, Human
uauuggucaauuucaccuugau

SEQ ID NO: 274455 - RNA, 22 nt, Human
acaguaauaaguguuggugagg

SEQ ID NO: 274456 - RNA, 22 nt, Human
auacacuaaucaugugcucagu

SEQ ID NO: 274457 - RNA, 22 nt, Human
ugagaggucaaagggcauggag

SEQ ID NO: 274458 - RNA, 22 nt, Human
ggccagcccagugguccucucu

SEQ ID NO: 274459 - RNA, 18 nt, Human
gggcuaggcaaggaccac

SEQ ID NO: 274460 - RNA, 22 nt, Human
uuggcuucuuuucuagacagaa

SEQ ID NO: 274461 - RNA, 22 nt, Human
ucuuuaucuggcucagagacac

SEQ ID NO: 274462 - RNA, 22 nt, Human
aagggcuguagacaagauugcu

SEQ ID NO: 274463 - RNA, 22 nt, Human
cacagaggcaugacccugcccu

SEQ ID NO: 274464 - RNA, 22 nt, Human
uuguagcugaaaguaaagaagu

SEQ ID NO: 274465 - RNA, 22 nt, Human
ucucacaggugcacguggcugu

SEQ ID NO: 274466 - RNA, 22 nt, Human
acacuguaaagugaugcuuaaa

SEQ ID NO: 274467 - RNA, 22 nt, Human
aaauggcugacuaaauuaaauu

SEQ ID NO: 274468 - RNA, 22 nt, Human
ggucuggcaggugaggacucag

SEQ ID NO: 274469 - RNA, 22 nt, Human
aaauauguauggaguucaugaa

SEQ ID NO: 274470 - RNA, 22 nt, Human
gcuggcucuucaguggagauag

SEQ ID NO: 274471 - RNA, 22 nt, Human
uagcuggguugaggucaucuac

SEQ ID NO: 274472 - RNA, 22 nt, Human
ugcuccagcgcugccaccaguu

SEQ ID NO: 274473 - RNA, 22 nt, Human
agccaguccaucacuaaugggu

SEQ ID NO: 274474 - RNA, 22 nt, Human
ccauggccgccgcugcucagga

SEQ ID NO: 274475 - RNA, 22 nt, Human
cugccugugaacauacuggggg

SEQ ID NO: 274476 - RNA, 22 nt, Human
ugcuggggcagaagagccaaga

SEQ ID NO: 274477 - RNA, 22 nt, Human
acucugggauuguuucugguau

SEQ ID NO: 274478 - RNA, 17 nt, Human
uuuuggugaguuguuuc

SEQ ID NO: 274479 - RNA, 18 nt, Human
aggcuucuuggcucaguc

SEQ ID NO: 274480 - RNA, 23 nt, Human
ccugcagcugccacgcccugcuc

SEQ ID NO: 274481 - RNA, 22 nt, Human
ggccaggagcaagccaggcucu

SEQ ID NO: 274482 - RNA, 22 nt, Human
uacauguauguuuaucuugaga

SEQ ID NO: 274483 - RNA, 22 nt, Human
cccccagucugaacagcagcug

SEQ ID NO: 274484 - RNA, 17 nt, Human
ccacagcugggugccuu

SEQ ID NO: 274485 - RNA, 22 nt, Human
ggucuagaugaaauuaaauguu

SEQ ID NO: 274486 - RNA, 22 nt, Human
aauuucagauauuaaagaauga

SEQ ID NO: 274487 - RNA, 22 nt, Human
aguggggccggugaggccgagg

SEQ ID NO: 274488 - RNA, 22 nt, Human
ccuccuggagcauuggugagga

SEQ ID NO: 274489 - RNA, 22 nt, Human
acagguggccccgagggagugg

SEQ ID NO: 274490 - RNA, 22 nt, Human
aauggcuuagcagaguuagaag

SEQ ID NO: 274491 - RNA, 22 nt, Human
ggagaaugauucuuugcucacu

SEQ ID NO: 274492 - RNA, 22 nt, Human
ugagacagccucugcacucaug

SEQ ID NO: 274493 - RNA, 22 nt, Human
gaagauugaaggcugggaauua

SEQ ID NO: 274494 - RNA, 22 nt, Human
accuccugaugagaguaaagga

SEQ ID NO: 274495 - RNA, 22 nt, Human
auuuuaccuuaaagucuauauu

SEQ ID NO: 274496 - RNA, 22 nt, Human
ugggcuucauaauugguccuag

SEQ ID NO: 274497 - RNA, 22 nt, Human
uagcaaaggaugacuauguacc

SEQ ID NO: 274498 - RNA, 22 nt, Human
ucugccuugccgaauuccaggc

SEQ ID NO: 274499 - RNA, 23 nt, Human
cacugggggcugcuacagagagg

SEQ ID NO: 274500 - RNA, 22 nt, Human
agagaugacugauggcugauua

SEQ ID NO: 274501 - RNA, 22 nt, Human
acuuuugaggacuuuauuguau

SEQ ID NO: 274502 - RNA, 22 nt, Human
cccaggagcuucucucugccuc

SEQ ID NO: 274503 - RNA, 21 nt, Human
uuucuaaggaggaagaaaaga

SEQ ID NO: 274504 - RNA, 22 nt, Human
gugcccucaugaaacgaaggau

SEQ ID NO: 274505 - RNA, 22 nt, Human
cuggcugcaguagcaagagacu

SEQ ID NO: 274506 - RNA, 22 nt, Human
ggcucugggcauagaaggaagc

SEQ ID NO: 274507 - RNA, 22 nt, Human
ucacagaaagcuguguccugac

SEQ ID NO: 274508 - RNA, 22 nt, Human
uuaauuuuuauguauagugugu

SEQ ID NO: 274509 - RNA, 19 nt, Human
ucucugcagcgcgcccggc

SEQ ID NO: 274510 - RNA, 22 nt, Human
aacuguucacacugaugugacg

SEQ ID NO: 274511 - RNA, 22 nt, Human
gagcuggccgcagagagggcag

SEQ ID NO: 274512 - RNA, 22 nt, Human
cacuucaacaguuauuucuuag

SEQ ID NO: 274513 - RNA, 22 nt, Human
uuaacagacuugggauuuucua

SEQ ID NO: 274514 - RNA, 22 nt, Human
acagcuguggucuccuuagugu

SEQ ID NO: 274515 - RNA, 22 nt, Human
caggagcccugguggguggaca

SEQ ID NO: 274516 - RNA, 23 nt, Human
uguuuguuucuaugagagauagc

SEQ ID NO: 274517 - RNA, 22 nt, Human
ucuguugaccaagucuucuucc

SEQ ID NO: 274518 - RNA, 22 nt, Human
ugaaauuaugcauuguuguacc

SEQ ID NO: 274519 - RNA, 20 nt, Human
aaacauaguggauaccacag

SEQ ID NO: 274520 - RNA, 22 nt, Human
gucuguggcaggggagaaguuu

SEQ ID NO: 274521 - RNA, 22 nt, Human
ucauuuuuuuccgguaggaaua

SEQ ID NO: 274522 - RNA, 22 nt, Human
caccauuuaagaaagccaaauu

SEQ ID NO: 274523 - RNA, 22 nt, Human
ucucagaguuugaaucuggagu

SEQ ID NO: 274524 - RNA, 22 nt, Human
gacugagcuucugcaacacugg

SEQ ID NO: 274525 - RNA, 22 nt, Human
uagggcucugagaguucagccu

SEQ ID NO: 274526 - RNA, 22 nt, Human
uccugacccaccaagucuguaa

SEQ ID NO: 274527 - RNA, 22 nt, Human
cugugugaugggaagaauguuu

SEQ ID NO: 274528 - RNA, 22 nt, Human
uugggaaagaaugagaagguga

SEQ ID NO: 274529 - RNA, 22 nt, Human
gggcagguggcagggucucugg

SEQ ID NO: 274530 - RNA, 22 nt, Human
guccaggcaccucccuugugcu

SEQ ID NO: 274531 - RNA, 22 nt, Human
accuggcacagaguaugcucuc

SEQ ID NO: 274532 - RNA, 23 nt, Human
agagcuuucuaaaauguaaaucu

SEQ ID NO: 274533 - RNA, 23 nt, Human
cuccuugguaugccaugcccagc

SEQ ID NO: 274534 - RNA, 22 nt, Human
gcuacagugauaggaaacacau

SEQ ID NO: 274535 - RNA, 22 nt, Human
ugccuccaccauugcucacuuu

SEQ ID NO: 274536 - RNA, 22 nt, Human
uaguccaggaagguggggcaga

SEQ ID NO: 274537 - RNA, 21 nt, Human
ucucuggaguuagcagagaga

SEQ ID NO: 274538 - RNA, 22 nt, Human
augcacuuucuagagauucuga

SEQ ID NO: 274539 - RNA, 22 nt, Human
ucuuuggauaucgcuagaccgu

SEQ ID NO: 274540 - RNA, 22 nt, Human
guuuuucuaggaccaugugauu

SEQ ID NO: 274541 - RNA, 22 nt, Human
aacugagacacgaacuaugauu

SEQ ID NO: 274542 - RNA, 22 nt, Human
acaugcaagccccugaacacau

SEQ ID NO: 274543 - RNA, 22 nt, Human
gaagcagccacggggagacaga

SEQ ID NO: 274544 - RNA, 22 nt, Human
caguucuaauuaauaggaguaa

SEQ ID NO: 274545 - RNA, 20 nt, Human
ccugggcuccaggagccccg

SEQ ID NO: 274546 - RNA, 22 nt, Human
gagccaggagauaccuaagggg

SEQ ID NO: 274547 - RNA, 18 nt, Human
caauuuuacccagucccu

SEQ ID NO: 274548 - RNA, 22 nt, Human
aaguuucuguucauaucucuga

SEQ ID NO: 274549 - RNA, 22 nt, Human
gcugugugacccuagccaguag

SEQ ID NO: 274550 - RNA, 22 nt, Human
aaacuguuauagcagaaaggac

SEQ ID NO: 274551 - RNA, 22 nt, Human
aguggcugcugacuuuaauaca

SEQ ID NO: 274552 - RNA, 22 nt, Human
uuuauuagauuaucaaagaggu

SEQ ID NO: 274553 - RNA, 22 nt, Human
cuugggcucuaaaugccaguga

SEQ ID NO: 274554 - RNA, 22 nt, Human
ggugucugcuucccuccagcug

SEQ ID NO: 274555 - RNA, 20 nt, Human
uaaaugcaucuguucaacug

SEQ ID NO: 274556 - RNA, 22 nt, Human
uucaaauccuagcccuguggcc

SEQ ID NO: 274557 - RNA, 22 nt, Human
augucagucuuucugucucaga

SEQ ID NO: 274558 - RNA, 22 nt, Human
gcuggggucugugaggagggcu

SEQ ID NO: 274559 - RNA, 22 nt, Human
aaaugcuaacaaggaaugcugc

SEQ ID NO: 274560 - RNA, 22 nt, Human
ucuaaaugugguagucauaaga

SEQ ID NO: 274561 - RNA, 22 nt, Human
agcuggaaagaagguggcagcc

SEQ ID NO: 274562 - RNA, 22 nt, Human
cagcuagcuaagaaggccagag

SEQ ID NO: 274563 - RNA, 22 nt, Human
agcggcuggaccagcguucaag

SEQ ID NO: 274564 - RNA, 22 nt, Human
auaaguucagguaaagaaauca

SEQ ID NO: 274565 - RNA, 22 nt, Human
cugaggagugggugggcaguga

SEQ ID NO: 274566 - RNA, 22 nt, Human
ccuggcagcuguuuggcuuggc

SEQ ID NO: 274567 - RNA, 22 nt, Human
caaagggcauuuuagugaacug

SEQ ID NO: 274568 - RNA, 22 nt, Human
uuuucuauucauugucuauggu

SEQ ID NO: 274569 - RNA, 22 nt, Human
uccugagcuucaguuucuucau

SEQ ID NO: 274570 - RNA, 22 nt, Human
uguguucaccaaaguguagaaa

SEQ ID NO: 274571 - RNA, 21 nt, Human
uagcuuuaauauucccacauu

SEQ ID NO: 274572 - RNA, 22 nt, Human
cagaugaaguaggugacgagca

SEQ ID NO: 274573 - RNA, 22 nt, Human
cacuuuauaaaauuggugugag

SEQ ID NO: 274574 - RNA, 22 nt, Human
acagaagaaguucaaggugaag

SEQ ID NO: 274575 - RNA, 22 nt, Human
aagcauuuuguuuuaagaauga

SEQ ID NO: 274576 - RNA, 22 nt, Human
acaauaacuucuguuuccuugc

SEQ ID NO: 274577 - RNA, 18 nt, Human
cagcagguagaguuuggu

SEQ ID NO: 274578 - RNA, 22 nt, Human
gaaaggugccccauaggcagga

SEQ ID NO: 274579 - RNA, 22 nt, Human
aauguuuuauagcucaagcaau

SEQ ID NO: 274580 - RNA, 22 nt, Human
cucgggcaggagggcccucucc

SEQ ID NO: 274581 - RNA, 22 nt, Human
gaugauucuguguuuggaaugc

SEQ ID NO: 274582 - RNA, 22 nt, Human
cugggccaucucucugcaagug

SEQ ID NO: 274583 - RNA, 22 nt, Human
gagcuccaccaccuucaggcag

SEQ ID NO: 274584 - RNA, 22 nt, Human
ccuggcugccgagugugcagcg

SEQ ID NO: 274585 - RNA, 22 nt, Human
aagagaugauggcagccagagg

SEQ ID NO: 274586 - RNA, 22 nt, Human
acagaauuaaugaaaauuacaa

SEQ ID NO: 274587 - RNA, 22 nt, Human
uguuaauauacuaaaauccacu

SEQ ID NO: 274588 - RNA, 22 nt, Human
ucacuggugugagaggagcaaa

SEQ ID NO: 274589 - RNA, 22 nt, Human
ugucuccauagaagagacugca

SEQ ID NO: 274590 - RNA, 22 nt, Human
cuggcuuccaccauggccccug

SEQ ID NO: 274591 - RNA, 22 nt, Human
cuuauagaauguuuuuauaugu

SEQ ID NO: 274592 - RNA, 22 nt, Human
cagcaggucucagcagcuccuu

SEQ ID NO: 274593 - RNA, 22 nt, Human
uggaagagcaggcagacaaugc

SEQ ID NO: 274594 - RNA, 22 nt, Human
ugugcaacaugagacagaacag

SEQ ID NO: 274595 - RNA, 22 nt, Human
aaguuaacccaguauuucuuuu

SEQ ID NO: 274596 - RNA, 22 nt, Human
aaaggccacugcaagggaaggu

SEQ ID NO: 274597 - RNA, 22 nt, Human
augugcugaguguguauauaca

SEQ ID NO: 274598 - RNA, 20 nt, Human
cugcacugaacaugucugag

SEQ ID NO: 274599 - RNA, 19 nt, Human
gcucugagaggggcauggg

SEQ ID NO: 274600 - RNA, 22 nt, Human
aaacugccuccugggcaacuaa

SEQ ID NO: 274601 - RNA, 22 nt, Human
gaagacacuaaacuggggcuuc

SEQ ID NO: 274602 - RNA, 22 nt, Human
cuucaaaugugauuuuaauaac

SEQ ID NO: 274603 - RNA, 22 nt, Human
aaaugccucugcuguacacaau

SEQ ID NO: 274604 - RNA, 22 nt, Human
ugaauagacuggggcugugaag

SEQ ID NO: 274605 - RNA, 22 nt, Human
auggacaggcuuauaacagcaa

SEQ ID NO: 274606 - RNA, 20 nt, Human
aguuugugugucuaugcgcu

SEQ ID NO: 274607 - RNA, 23 nt, Human
cagugcugguucugccugugggg

SEQ ID NO: 274608 - RNA, 22 nt, Human
uccuccccucagggcaacggau

SEQ ID NO: 274609 - RNA, 22 nt, Human
augaaacacacacgcgcauacu

SEQ ID NO: 274610 - RNA, 22 nt, Human
auucuuuuuuaaggaauagaac

SEQ ID NO: 274611 - RNA, 22 nt, Human
uaaugucagcauaguuuauuuu

SEQ ID NO: 274612 - RNA, 22 nt, Human
uugagauggagucucacucugu

SEQ ID NO: 274613 - RNA, 22 nt, Human
gcaggcugugguauguugggca

SEQ ID NO: 274614 - RNA, 22 nt, Human
acugggcaucccauggcagagc

SEQ ID NO: 274615 - RNA, 22 nt, Human
ucugugugcccaccugacaccu

SEQ ID NO: 274616 - RNA, 22 nt, Human
ugcucagagcucuggugcaggu

SEQ ID NO: 274617 - RNA, 22 nt, Human
cugcacccaugagcucaaggga

SEQ ID NO: 274618 - RNA, 22 nt, Human
ccaucagagggcugcucugcaa

SEQ ID NO: 274619 - RNA, 21 nt, Human
ucaggcaggcgcagagggaag

SEQ ID NO: 274620 - RNA, 22 nt, Human
cccagcagccuggauguucuuu

SEQ ID NO: 274621 - RNA, 22 nt, Human
agaauucuuggugguuagaaua

SEQ ID NO: 274622 - RNA, 19 nt, Human
ccucucccaugcuuaccuc

SEQ ID NO: 274623 - RNA, 22 nt, Human
uccuggguagagaccugaugaa

SEQ ID NO: 274624 - RNA, 22 nt, Human
aaggucuggaugaugggugugc

SEQ ID NO: 274625 - RNA, 22 nt, Human
uuucucaaaagacagaagugaa

SEQ ID NO: 274626 - RNA, 22 nt, Human
uggguccuugcuggcuucaaag

SEQ ID NO: 274627 - RNA, 22 nt, Human
acucuggggcgcuacuccaacu

SEQ ID NO: 274628 - RNA, 22 nt, Human
acaagcgggccacagugcuggu

SEQ ID NO: 274629 - RNA, 22 nt, Human
ggccagagaauaugccuuacgu

SEQ ID NO: 274630 - RNA, 22 nt, Human
cucagggugcagcacaguuccu

SEQ ID NO: 274631 - RNA, 22 nt, Human
ugaugaaaauaugauucugagg

SEQ ID NO: 274632 - RNA, 22 nt, Human
caaaguuaugaaugauaagauu

SEQ ID NO: 274633 - RNA, 22 nt, Human
guccaggagcucagggcuuauu

SEQ ID NO: 274634 - RNA, 22 nt, Human
ucugccuuugcuuuggcuguca

SEQ ID NO: 274635 - RNA, 22 nt, Human
cagcaggagcagucagacuccu

SEQ ID NO: 274636 - RNA, 22 nt, Human
uuucauuauucaugcuaguuau

SEQ ID NO: 274637 - RNA, 22 nt, Human
cuaugaccccagcaugaauaag

SEQ ID NO: 274638 - RNA, 22 nt, Human
agcauucucagaaugucauuuu

SEQ ID NO: 274639 - RNA, 22 nt, Human
agcucccaggcagucaugagga

SEQ ID NO: 274640 - RNA, 19 nt, Human
gcaucagagcagaaggggu

SEQ ID NO: 274641 - RNA, 22 nt, Human
auucugaucauucaagauguca

SEQ ID NO: 274642 - RNA, 22 nt, Human
uggauuucuccagcucuccauu

SEQ ID NO: 274643 - RNA, 22 nt, Human
uagggcugccuauggcuagaua

SEQ ID NO: 274644 - RNA, 22 nt, Human
ucaggcugauuucuuuugaggg

SEQ ID NO: 274645 - RNA, 22 nt, Human
acagaagacagaguguucaucu

SEQ ID NO: 274646 - RNA, 22 nt, Human
auauuaggugcucaauacaugc

SEQ ID NO: 274647 - RNA, 22 nt, Human
ccuuccuggagcccaugcagau

SEQ ID NO: 274648 - RNA, 22 nt, Human
auuuggaagcuugaagauuauu

SEQ ID NO: 274649 - RNA, 22 nt, Human
ugaggcagaguaagauacauga

SEQ ID NO: 274650 - RNA, 22 nt, Human
ccugcccugucacuggcuaggg

SEQ ID NO: 274651 - RNA, 22 nt, Human
gauucuuuagcccagaaaguua

SEQ ID NO: 274652 - RNA, 22 nt, Human
cuggagagaccgaaagaggcug

SEQ ID NO: 274653 - RNA, 21 nt, Human
ugggaccuagcuuugcacagg

SEQ ID NO: 274654 - RNA, 22 nt, Human
acucaggcuacaacgcguggcu

SEQ ID NO: 274655 - RNA, 22 nt, Human
ucccaaauauaaugcaagagac

SEQ ID NO: 274656 - RNA, 22 nt, Human
ucaaugcaugugacaaagagua

SEQ ID NO: 274657 - RNA, 22 nt, Human
guuuuucuuugugugaagacaa

SEQ ID NO: 274658 - RNA, 22 nt, Human
cugccguguuuuucauguuaaa

SEQ ID NO: 274659 - RNA, 19 nt, Human
cagcacaugcuucucugag

SEQ ID NO: 274660 - RNA, 22 nt, Human
aggagcugcagauucugccuug

SEQ ID NO: 274661 - RNA, 22 nt, Human
guuaaagugaucuugucagguu

SEQ ID NO: 274662 - RNA, 22 nt, Human
gagagaaaggcuugcaggcugu

SEQ ID NO: 274663 - RNA, 22 nt, Human
agucacauaguguuuuggaauc

SEQ ID NO: 274664 - RNA, 22 nt, Human
aauagguagccagauauauaaa

SEQ ID NO: 274665 - RNA, 19 nt, Human
augucacucauguucccug

SEQ ID NO: 274666 - RNA, 19 nt, Human
acuaaaaaugauguuugag

SEQ ID NO: 274667 - RNA, 22 nt, Human
ucaggcugcuuucaugcuuaga

SEQ ID NO: 274668 - RNA, 22 nt, Human
ugcucuucacaguuucagcauc

SEQ ID NO: 274669 - RNA, 22 nt, Human
cugagaggaacaucuuaugcuu

SEQ ID NO: 274670 - RNA, 22 nt, Human
ucaaauacauggucaaucaacu

SEQ ID NO: 274671 - RNA, 22 nt, Human
guaacagaaagucaugcucauu

SEQ ID NO: 274672 - RNA, 20 nt, Human
gaagccagaggggaaaggag

SEQ ID NO: 274673 - RNA, 22 nt, Human
aaguaacacauguuacuucugc

SEQ ID NO: 274674 - RNA, 21 nt, Human
uccagccaguaaaugcucagc

SEQ ID NO: 274675 - RNA, 22 nt, Human
uuuccauguuaucuugcagacu

SEQ ID NO: 274676 - RNA, 22 nt, Human
acaugcuaauggagaugccaag

SEQ ID NO: 274677 - RNA, 22 nt, Human
cagagacauucaguaaauuauc

SEQ ID NO: 274678 - RNA, 22 nt, Human
cuucuggcaaaacaggcagaaa

SEQ ID NO: 274679 - RNA, 22 nt, Human
cuuauuagaaagaaaagacaug

SEQ ID NO: 274680 - RNA, 22 nt, Human
cugugggagggugagagaacca

SEQ ID NO: 274681 - RNA, 22 nt, Human
ugagcagagacgggggccucca

SEQ ID NO: 274682 - RNA, 22 nt, Human
gacaggcuuagggagggugcuc

SEQ ID NO: 274683 - RNA, 22 nt, Human
cuguguccugcgucaagccaau

SEQ ID NO: 274684 - RNA, 22 nt, Human
ucucaggcuaguaaaagauggg

SEQ ID NO: 274685 - RNA, 22 nt, Human
aggcugugagaaguccuucagu

SEQ ID NO: 274686 - RNA, 22 nt, Human
gaaugcagugacggaggcuuac

SEQ ID NO: 274687 - RNA, 22 nt, Human
agcuccugugugcccaccugcu

SEQ ID NO: 274688 - RNA, 22 nt, Human
ggagacacagagcaacaaaaua

SEQ ID NO: 274689 - RNA, 22 nt, Human
caggcugggacugaccccugcu

SEQ ID NO: 274690 - RNA, 22 nt, Human
aaggugucacugggacaggaaa

SEQ ID NO: 274691 - RNA, 22 nt, Human
agccugggcaugggacgggagg

SEQ ID NO: 274692 - RNA, 20 nt, Human
ucagacagucgcaguucugg

SEQ ID NO: 274693 - RNA, 22 nt, Human
agcucaggcucugcagggacua

SEQ ID NO: 274694 - RNA, 22 nt, Human
cagagcagaaaccugggugauu

SEQ ID NO: 274695 - RNA, 22 nt, Human
uggacccaggcaggucuguccu

SEQ ID NO: 274696 - RNA, 22 nt, Human
gcaugaugaaggaggaggaguc

SEQ ID NO: 274697 - RNA, 23 nt, Human
cagcccuggagaugugggaggca

SEQ ID NO: 274698 - RNA, 22 nt, Human
cugugagagugguggccuaggc

SEQ ID NO: 274699 - RNA, 22 nt, Human
ucagaacaucccagauaguaga

SEQ ID NO: 274700 - RNA, 22 nt, Human
cuacuuuaauuuucugcagaga

SEQ ID NO: 274701 - RNA, 22 nt, Human
ugucuagaggccaacaggaaag

SEQ ID NO: 274702 - RNA, 22 nt, Human
ucagaggaacuggacuaaagcc

SEQ ID NO: 274703 - RNA, 22 nt, Human
ugaggauggggagauggugucu

SEQ ID NO: 274704 - RNA, 22 nt, Human
gcaggcugcugagauccuuagg

SEQ ID NO: 274705 - RNA, 22 nt, Human
cccagcagccagaaugaggagc

SEQ ID NO: 274706 - RNA, 23 nt, Human
ugcaggggaggcuuaaagcaggu

SEQ ID NO: 274707 - RNA, 22 nt, Human
cagagagggcggcccuggcuuc

SEQ ID NO: 274708 - RNA, 22 nt, Human
ccacugaggcaggcaguaucua

SEQ ID NO: 274709 - RNA, 22 nt, Human
agacagugauggacaggcagac

SEQ ID NO: 274710 - RNA, 22 nt, Human
aaggguuggggaagagcaaauu

SEQ ID NO: 274711 - RNA, 22 nt, Human
agcagggcaugaauaaggguuu

SEQ ID NO: 274712 - RNA, 23 nt, Human
aagcuugucaccauuucuuucag

SEQ ID NO: 274713 - RNA, 22 nt, Human
ugcacacauucuauggggcuga

SEQ ID NO: 274714 - RNA, 22 nt, Human
uacauucacuuguugaaggugg

SEQ ID NO: 274715 - RNA, 22 nt, Human
uccagggcucauucccucugca

SEQ ID NO: 274716 - RNA, 22 nt, Human
ggcuucucucuucacauggcuu

SEQ ID NO: 274717 - RNA, 22 nt, Human
aacacagggcagcugcugggaa

SEQ ID NO: 274718 - RNA, 22 nt, Human
guguuacugacacauuuuuguc

SEQ ID NO: 274719 - RNA, 22 nt, Human
augggagaaacaucaugaggca

SEQ ID NO: 274720 - RNA, 22 nt, Human
ucacagaauugacaugggaauc

SEQ ID NO: 274721 - RNA, 22 nt, Human
cagggcucccuugcaaggaggg

SEQ ID NO: 274722 - RNA, 20 nt, Human
cuggccagaacgccuacaca

SEQ ID NO: 274723 - RNA, 22 nt, Human
uguuuucugauucucguguggu

SEQ ID NO: 274724 - RNA, 22 nt, Human
caggaccaggcguucugggcug

SEQ ID NO: 274725 - RNA, 18 nt, Human
ucuugccugcacccucuc

SEQ ID NO: 274726 - RNA, 21 nt, Human
aggaaaauugaggguuguugu

SEQ ID NO: 274727 - RNA, 22 nt, Human
ugguaucugugaaugugacauu

SEQ ID NO: 274728 - RNA, 22 nt, Human
ugccuugcuuuggcggaggcug

SEQ ID NO: 274729 - RNA, 22 nt, Human
uacagccugauuuggagccacu

SEQ ID NO: 274730 - RNA, 18 nt, Human
uaggcugggggcuguagu

SEQ ID NO: 274731 - RNA, 22 nt, Human
gaaggcuacuucuccucagggc

SEQ ID NO: 274732 - RNA, 20 nt, Human
gcucagggccugggucugga

SEQ ID NO: 274733 - RNA, 22 nt, Human
ugcaggugguacuucuuuuucu

SEQ ID NO: 274734 - RNA, 22 nt, Human
uauugcugaaaugcugaguuca

SEQ ID NO: 274735 - RNA, 22 nt, Human
caaauguaaauucuuuugaagc

SEQ ID NO: 274736 - RNA, 22 nt, Human
aggcaccuugcgguccagugaa

SEQ ID NO: 274737 - RNA, 22 nt, Human
cuggcugguagaauugugaccu

SEQ ID NO: 274738 - RNA, 22 nt, Human
ccagguguucuuugucccuguu

SEQ ID NO: 274739 - RNA, 19 nt, Human
cucuggagcagacacugga

SEQ ID NO: 274740 - RNA, 22 nt, Human
uccaggccugcaaugacaaagc

SEQ ID NO: 274741 - RNA, 22 nt, Human
ccaggcuucccugagaggcugc

SEQ ID NO: 274742 - RNA, 22 nt, Human
aaagcucacaguaauacaaggc

SEQ ID NO: 274743 - RNA, 22 nt, Human
agagaggcgaguuaccugugcu

SEQ ID NO: 274744 - RNA, 22 nt, Human
caaaguuuaaaguagauuucag

SEQ ID NO: 274745 - RNA, 22 nt, Human
aggcaggccccugagaauagac

SEQ ID NO: 274746 - RNA, 22 nt, Human
uuaaaugaugcauaucauuuag

SEQ ID NO: 274747 - RNA, 22 nt, Human
uccagccuaauguucuucccac

SEQ ID NO: 274748 - RNA, 22 nt, Human
ucagaggauugccucagcgagc

SEQ ID NO: 274749 - RNA, 22 nt, Human
agggcagaaaccaccuugaugg

SEQ ID NO: 274750 - RNA, 22 nt, Human
ugcuuuauggauuuguguccug

SEQ ID NO: 274751 - RNA, 22 nt, Human
ugugcauguauugauuuguacc

SEQ ID NO: 274752 - RNA, 22 nt, Human
aggaaaauggaccagaguuguu

SEQ ID NO: 274753 - RNA, 22 nt, Human
ucccagcccagacuucuccagu

SEQ ID NO: 274754 - RNA, 18 nt, Human
auggucucauacugggag

SEQ ID NO: 274755 - RNA, 22 nt, Human
uccuggcuuuucuuggcucauc

SEQ ID NO: 274756 - RNA, 22 nt, Human
uagaaucuguguucaaaccuac

SEQ ID NO: 274757 - RNA, 22 nt, Human
aauaugugagguauguucagug

SEQ ID NO: 274758 - RNA, 22 nt, Human
gugcugggugcugcagacaggu

SEQ ID NO: 274759 - RNA, 22 nt, Human
cagagcaacacccuuuacaucg

SEQ ID NO: 274760 - RNA, 22 nt, Human
agcugggugaaggcagauggcu

SEQ ID NO: 274761 - RNA, 22 nt, Human
guaaagaaguuuuugaaugcau

SEQ ID NO: 274762 - RNA, 22 nt, Human
cuccagauaggagggggucccc

SEQ ID NO: 274763 - RNA, 22 nt, Human
cacuggcaaauggagagaaugu

SEQ ID NO: 274764 - RNA, 22 nt, Human
gagaaagauguaggcugggagg

SEQ ID NO: 274765 - RNA, 22 nt, Human
cagaaguuugcaauuguuuauu

SEQ ID NO: 274766 - RNA, 22 nt, Human
uucggcauauuaauggugggug

SEQ ID NO: 274767 - RNA, 22 nt, Human
uuuggcucgauggacuuugaau

SEQ ID NO: 274768 - RNA, 22 nt, Human
aaugaagaaauggacaucuuua

SEQ ID NO: 274769 - RNA, 22 nt, Human
uucaacauuuaucaguuuauca

SEQ ID NO: 274770 - RNA, 22 nt, Human
ccuuucccgcuuugagggcaag

SEQ ID NO: 274771 - RNA, 22 nt, Human
agucacaguucugcugucugag

SEQ ID NO: 274772 - RNA, 22 nt, Human
gcaggccagcugugcagauggg

SEQ ID NO: 274773 - RNA, 22 nt, Human
ggugaggaaagauggugacagu

SEQ ID NO: 274774 - RNA, 18 nt, Human
aggcacagagcauacaua

SEQ ID NO: 274775 - RNA, 22 nt, Human
ucagggagagugacccauccac

SEQ ID NO: 274776 - RNA, 22 nt, Human
caugucuguguacacaugcaca

SEQ ID NO: 274777 - RNA, 22 nt, Human
acagucuucaugcuagaauggc

SEQ ID NO: 274778 - RNA, 22 nt, Human
ggucccaugacugacacagcag

SEQ ID NO: 274779 - RNA, 22 nt, Human
cucuggacagcaggugcugugg

SEQ ID NO: 274780 - RNA, 23 nt, Human
ugcuggcuuuuaucuggucccua

SEQ ID NO: 274781 - RNA, 22 nt, Human
agaaccaugaguuugaguaucu

SEQ ID NO: 274782 - RNA, 22 nt, Human
cagucucucagcuuucagcugu

SEQ ID NO: 274783 - RNA, 22 nt, Human
uaaguguuauuauucucacuuu

SEQ ID NO: 274784 - RNA, 22 nt, Human
aagaauaagaggauuuagaaca

SEQ ID NO: 274785 - RNA, 22 nt, Human
uccaguuuccuguggcugccua

SEQ ID NO: 274786 - RNA, 22 nt, Human
cacuauaucucuuucaucuuuu

SEQ ID NO: 274787 - RNA, 19 nt, Human
uccucccuuugguguccug

SEQ ID NO: 274788 - RNA, 22 nt, Human
ucugugcugcaggagucugcau

SEQ ID NO: 274789 - RNA, 22 nt, Human
ccagagaggggaagggcuugcc

SEQ ID NO: 274790 - RNA, 21 nt, Human
gcauucuucaugugauucaga

SEQ ID NO: 274791 - RNA, 22 nt, Human
agcaccaggcaguauaucaaag

SEQ ID NO: 274792 - RNA, 22 nt, Human
uaagauaaggaacauucuguga

SEQ ID NO: 274793 - RNA, 22 nt, Human
auucuucacaaauauauagaag

SEQ ID NO: 274794 - RNA, 22 nt, Human
cagugagguagacagcuuuuuc

SEQ ID NO: 274795 - RNA, 19 nt, Human
gcucaacagcucggguccu

SEQ ID NO: 274796 - RNA, 22 nt, Human
uggggugggguuacucauucug

SEQ ID NO: 274797 - RNA, 22 nt, Human
cacacagcuagugacaggagaa

SEQ ID NO: 274798 - RNA, 22 nt, Human
uuucugaagucuucuaacagau

SEQ ID NO: 274799 - RNA, 21 nt, Human
ccagcagcucaaggaucucuu

SEQ ID NO: 274800 - RNA, 20 nt, Human
acugccuuuagguauccuug

SEQ ID NO: 274801 - RNA, 22 nt, Human
gauccacuguguuuguguugag

SEQ ID NO: 274802 - RNA, 22 nt, Human
auacuacacuaugcauggaugu

SEQ ID NO: 274803 - RNA, 22 nt, Human
acaagaauuuacauguagugga

SEQ ID NO: 274804 - RNA, 22 nt, Human
uucugggcaguuggaaauuuca

SEQ ID NO: 274805 - RNA, 22 nt, Human
uaggugucuugucacuaccguu

SEQ ID NO: 274806 - RNA, 22 nt, Human
cuggugaccggaccucaguuuu

SEQ ID NO: 274807 - RNA, 22 nt, Human
aguggcaggaucucgguucacu

SEQ ID NO: 274808 - RNA, 22 nt, Human
uaugccagacugugagcuucuu

SEQ ID NO: 274809 - RNA, 22 nt, Human
ugcacaagucagaguaacauuu

SEQ ID NO: 274810 - RNA, 22 nt, Human
caugucaagcuuaucucugugg

SEQ ID NO: 274811 - RNA, 22 nt, Human
acuccaguuaccuuggcugagg

SEQ ID NO: 274812 - RNA, 22 nt, Human
uuccucuggggccaggccaaca

SEQ ID NO: 274813 - RNA, 22 nt, Human
ucaggaggcggugcugccuuug

SEQ ID NO: 274814 - RNA, 22 nt, Human
cacagaggcucaaagccaggug

SEQ ID NO: 274815 - RNA, 19 nt, Human
uggcuucuucgguguuccc

SEQ ID NO: 274816 - RNA, 22 nt, Human
cuccuucacgcaggcugccaug

SEQ ID NO: 274817 - RNA, 22 nt, Human
gucccuggggguuuaggacuca

SEQ ID NO: 274818 - RNA, 22 nt, Human
acuuuaaaacugaucaucagag

SEQ ID NO: 274819 - RNA, 22 nt, Human
aucagcaagcauuuauugagug

SEQ ID NO: 274820 - RNA, 22 nt, Human
gcuauugugacagcuuuucgcc

SEQ ID NO: 274821 - RNA, 22 nt, Human
agcccagcugcuauguaccugg

SEQ ID NO: 274822 - RNA, 22 nt, Human
agauaacucauuuuguauaucc

SEQ ID NO: 274823 - RNA, 22 nt, Human
cccugcagaccaaugccauaga

SEQ ID NO: 274824 - RNA, 22 nt, Human
agcucccagaagccagagucgg

SEQ ID NO: 274825 - RNA, 22 nt, Human
accugaauuuuggaugagcugu

SEQ ID NO: 274826 - RNA, 22 nt, Human
agguaaagacugcaaggagaau

SEQ ID NO: 274827 - RNA, 21 nt, Human
caggcucugcugggugcuggg

SEQ ID NO: 274828 - RNA, 22 nt, Human
ugcaaauuuaaugaaacuaugu

SEQ ID NO: 274829 - RNA, 22 nt, Human
uguccaggucagcagcagggac

SEQ ID NO: 274830 - RNA, 22 nt, Human
auacagggacauccaguuuuuc

SEQ ID NO: 274831 - RNA, 22 nt, Human
aacaucuucagagaagcuaagu

SEQ ID NO: 274832 - RNA, 22 nt, Human
auuuccaugucgguauuuuaua

SEQ ID NO: 274833 - RNA, 20 nt, Human
ggucacuguggcugcaggau

SEQ ID NO: 274834 - RNA, 22 nt, Human
cagggcuggguuaaaagcaggg

SEQ ID NO: 274835 - RNA, 22 nt, Human
ccacccugugcaggcgugggua

SEQ ID NO: 274836 - RNA, 22 nt, Human
uugccaggagacaucuggagcc

SEQ ID NO: 274837 - RNA, 18 nt, Human
agcagggcauuuugccau

SEQ ID NO: 274838 - RNA, 22 nt, Human
uucacaagugugaaggcagagc

SEQ ID NO: 274839 - RNA, 20 nt, Human
uccuucugaggugaggagga

SEQ ID NO: 274840 - RNA, 17 nt, Human
gcuggcugacccaugcc

SEQ ID NO: 274841 - RNA, 21 nt, Human
ucagacuugagcucuucuaca

SEQ ID NO: 274842 - RNA, 21 nt, Human
ggaggaaaaaggaaugacuug

SEQ ID NO: 274843 - RNA, 22 nt, Human
ugauuuaugcauuauacuguug

SEQ ID NO: 274844 - RNA, 22 nt, Human
agagugcuagccugagggaggu

SEQ ID NO: 274845 - RNA, 22 nt, Human
acuguucaagcaaaugacauug

SEQ ID NO: 274846 - RNA, 22 nt, Human
uucauagugcuuaauuugauaa

SEQ ID NO: 274847 - RNA, 22 nt, Human
aaaggcuuugagaaguccugca

SEQ ID NO: 274848 - RNA, 22 nt, Human
cuuuauauauucccaggcugcc

SEQ ID NO: 274849 - RNA, 22 nt, Human
auccacagaaggaacuugaaag

SEQ ID NO: 274850 - RNA, 22 nt, Human
uuuucauuguuacuaugagcua

SEQ ID NO: 274851 - RNA, 22 nt, Human
gagugcugcuaaugcaagggug

SEQ ID NO: 274852 - RNA, 20 nt, Human
uccagguaacaucucucugg

SEQ ID NO: 274853 - RNA, 22 nt, Human
uguuaacagguaacugaggcug

SEQ ID NO: 274854 - RNA, 22 nt, Human
gguauuuauaugucugaagcug

SEQ ID NO: 274855 - RNA, 22 nt, Human
uggguccugucuccuuguucug

SEQ ID NO: 274856 - RNA, 22 nt, Human
uccaggcaucccccaggacaga

SEQ ID NO: 274857 - RNA, 22 nt, Human
gaucauuugcaggaaacauuaa

SEQ ID NO: 274858 - RNA, 22 nt, Human
caguguggcugagacagaggcu

SEQ ID NO: 274859 - RNA, 22 nt, Human
uuuguuuaucaaggucuagcau

SEQ ID NO: 274860 - RNA, 22 nt, Human
aagggcuccacuugaaucacac

SEQ ID NO: 274861 - RNA, 22 nt, Human
cagcuaauccucucuauccaag

SEQ ID NO: 274862 - RNA, 22 nt, Human
cauagaaacugagacaaggauu

SEQ ID NO: 274863 - RNA, 22 nt, Human
uggaaagguaggauuucaagac

SEQ ID NO: 274864 - RNA, 22 nt, Human
ugagcaggcaaacaaugguuau

SEQ ID NO: 274865 - RNA, 22 nt, Human
agaucaaaucugggauuucuaa

SEQ ID NO: 274866 - RNA, 22 nt, Human
gaaagcacugugagaucuuguu

SEQ ID NO: 274867 - RNA, 22 nt, Human
uucauugacugguucguuaagu

SEQ ID NO: 274868 - RNA, 22 nt, Human
cugggguggagauuggcaaucu

SEQ ID NO: 274869 - RNA, 22 nt, Human
gggaagggagggaccucagucu

SEQ ID NO: 274870 - RNA, 22 nt, Human
ugcugggcuagaagcugaggcc

SEQ ID NO: 274871 - RNA, 22 nt, Human
cgcaggcuggcgcggaguggca

SEQ ID NO: 274872 - RNA, 22 nt, Human
uggugcugugauacgaggcacu

SEQ ID NO: 274873 - RNA, 22 nt, Human
uggcccugguggcacagccugc

SEQ ID NO: 274874 - RNA, 22 nt, Human
uguccuuuaugaaaugguguuu

SEQ ID NO: 274875 - RNA, 22 nt, Human
augucuuuuaugauuacgggau

SEQ ID NO: 274876 - RNA, 22 nt, Human
cucccaagauaaauaaggcagu

SEQ ID NO: 274877 - RNA, 22 nt, Human
agcaccaggcuguuggaagccc

SEQ ID NO: 274878 - RNA, 22 nt, Human
ucaaaauuaaaccaacguccag

SEQ ID NO: 274879 - RNA, 18 nt, Human
caugcagagggaucugug

SEQ ID NO: 274880 - RNA, 22 nt, Human
acggcuucuugacuguggguug

SEQ ID NO: 274881 - RNA, 22 nt, Human
guuuccuauggcugcugcagga

SEQ ID NO: 274882 - RNA, 22 nt, Human
uuucuauuguaagucuccuaua

SEQ ID NO: 274883 - RNA, 22 nt, Human
uaacugguuuggcucagggucu

SEQ ID NO: 274884 - RNA, 22 nt, Human
ccacuguuuuucaguuaacuuu

SEQ ID NO: 274885 - RNA, 22 nt, Human
aggagcucacaucuuuauuucu

SEQ ID NO: 274886 - RNA, 22 nt, Human
gcagcccaaaaaagagguagau

SEQ ID NO: 274887 - RNA, 17 nt, Human
uaggagacuggcugucc

SEQ ID NO: 274888 - RNA, 22 nt, Human
aaugucuucaguguauacaugg

SEQ ID NO: 274889 - RNA, 22 nt, Human
cagacacuaggugacagagugc

SEQ ID NO: 274890 - RNA, 22 nt, Human
uuguacaguuuaagugggugaa

SEQ ID NO: 274891 - RNA, 20 nt, Human
ucagaagugcagcugccccu

SEQ ID NO: 274892 - RNA, 22 nt, Human
gcacuuuaaauguucacggaaa

SEQ ID NO: 274893 - RNA, 22 nt, Human
gcuucugugguugucacgacua

SEQ ID NO: 274894 - RNA, 22 nt, Human
uuuaggaauauuuucuuucagg

SEQ ID NO: 274895 - RNA, 21 nt, Human
ucccagggccaggugccauca

SEQ ID NO: 274896 - RNA, 22 nt, Human
ugccuucaccaggccuucagcc

SEQ ID NO: 274897 - RNA, 22 nt, Human
aaagagggacaggcgcagacac

SEQ ID NO: 274898 - RNA, 22 nt, Human
ucugugcagaacucacagaagg

SEQ ID NO: 274899 - RNA, 22 nt, Human
uucaguuucguuaucuaugaga

SEQ ID NO: 274900 - RNA, 22 nt, Human
guuauugcaguauagaggucua

SEQ ID NO: 274901 - RNA, 22 nt, Human
auacauuagaaucugguacuca

SEQ ID NO: 274902 - RNA, 22 nt, Human
uacagcuguugguguuuccucu

SEQ ID NO: 274903 - RNA, 22 nt, Human
guacaaauacauucugaaggua

SEQ ID NO: 274904 - RNA, 22 nt, Human
cucuggaauuaaggaagccugu

SEQ ID NO: 274905 - RNA, 22 nt, Human
gaggcauaaaucacaguguuca

SEQ ID NO: 274906 - RNA, 22 nt, Human
gggcucagaggaguggccuggg

SEQ ID NO: 274907 - RNA, 22 nt, Human
uaacugaacagccuaauucuuu

SEQ ID NO: 274908 - RNA, 22 nt, Human
uggugagauaacuuucggcaag

SEQ ID NO: 274909 - RNA, 22 nt, Human
aucuuugucacucuacugucua

SEQ ID NO: 274910 - RNA, 22 nt, Human
uucagcuugcugacugcggcag

SEQ ID NO: 274911 - RNA, 22 nt, Human
ugaaagcauaugcuaaagacca

SEQ ID NO: 274912 - RNA, 21 nt, Human
agccagucuguuuucuagugc

SEQ ID NO: 274913 - RNA, 22 nt, Human
ccccagggucaguguguggagg

SEQ ID NO: 274914 - RNA, 19 nt, Human
acugccugaggcucacagg

SEQ ID NO: 274915 - RNA, 22 nt, Human
uuuccaggagaaagagagccuu

SEQ ID NO: 274916 - RNA, 16 nt, Human
ucagugucagcuccug

SEQ ID NO: 274917 - RNA, 22 nt, Human
cccagcuguaacgggucugcac

SEQ ID NO: 274918 - RNA, 22 nt, Human
cacugugucuggagugagcugg

SEQ ID NO: 274919 - RNA, 22 nt, Human
caugagaucugcagggaugggc

SEQ ID NO: 274920 - RNA, 18 nt, Human
aucuuuccauagcauguu

SEQ ID NO: 274921 - RNA, 22 nt, Human
ccauuuguaccauuucuuugua

SEQ ID NO: 274922 - RNA, 22 nt, Human
auuguuccuggaaaagaacagg

SEQ ID NO: 274923 - RNA, 18 nt, Human
ccuggcagccaugcgcgc

SEQ ID NO: 274924 - RNA, 22 nt, Human
cccugggcagucugcacuucag

SEQ ID NO: 274925 - RNA, 22 nt, Human
aagaacuuccuaauauauuuuc

SEQ ID NO: 274926 - RNA, 18 nt, Human
uccagagagggagaagug

SEQ ID NO: 274927 - RNA, 22 nt, Human
cuggcauguguuuggcuccugu

SEQ ID NO: 274928 - RNA, 22 nt, Human
gauuucuaaguuuuaccacaaa

SEQ ID NO: 274929 - RNA, 22 nt, Human
uaucuaaaggauuuaauuuagu

SEQ ID NO: 274930 - RNA, 22 nt, Human
guagggcagaaguucaaugugg

SEQ ID NO: 274931 - RNA, 22 nt, Human
caugcucacuuuuauacuguaa

SEQ ID NO: 274932 - RNA, 22 nt, Human
ccagcuccucuugucucuagca

SEQ ID NO: 274933 - RNA, 21 nt, Human
ucugucuuccucagccuaagg

SEQ ID NO: 274934 - RNA, 22 nt, Human
acagcagcauccuauuucacuc

SEQ ID NO: 274935 - RNA, 22 nt, Human
guuuagaagccaagauuugggu

SEQ ID NO: 274936 - RNA, 22 nt, Human
gcuuuggaacuuaaauccuugg

SEQ ID NO: 274937 - RNA, 22 nt, Human
uagcuggcuuauauaaaagggc

SEQ ID NO: 274938 - RNA, 22 nt, Human
cccagugugguugugaauucug

SEQ ID NO: 274939 - RNA, 22 nt, Human
gagcaggcucugccuguguguc

SEQ ID NO: 274940 - RNA, 22 nt, Human
acuuagaaagggauucuagauu

SEQ ID NO: 274941 - RNA, 22 nt, Human
aucuguaaaugcaaauguagcu

SEQ ID NO: 274942 - RNA, 22 nt, Human
auaaugucugcagagccacaca

SEQ ID NO: 274943 - RNA, 22 nt, Human
uagguucauauucuagaaucau

SEQ ID NO: 274944 - RNA, 22 nt, Human
aagcaauucacaguucacuuaa

SEQ ID NO: 274945 - RNA, 23 nt, Human
cucuggguccgauguccugacag

SEQ ID NO: 274946 - RNA, 22 nt, Human
cuuuuucauuggcuuuaggaca

SEQ ID NO: 274947 - RNA, 22 nt, Human
agaagaauacuugauguucaug

SEQ ID NO: 274948 - RNA, 22 nt, Human
uuuguauaagaacauucuagca

SEQ ID NO: 274949 - RNA, 22 nt, Human
uugaggaggccuuucagggcuu

SEQ ID NO: 274950 - RNA, 22 nt, Human
cugcagagcaugaggaggucug

SEQ ID NO: 274951 - RNA, 22 nt, Human
augagaugugucuaauggaacc

SEQ ID NO: 274952 - RNA, 22 nt, Human
cucacaggguucuaucgaagag

SEQ ID NO: 274953 - RNA, 22 nt, Human
ucugggcuuuaagaacucuguu

SEQ ID NO: 274954 - RNA, 22 nt, Human
cagcagagguuuugcuccauga

SEQ ID NO: 274955 - RNA, 23 nt, Human
agggccucugucccccagcacuc

SEQ ID NO: 274956 - RNA, 19 nt, Human
cucagagaggggcagugcc

SEQ ID NO: 274957 - RNA, 22 nt, Human
ugccccagacucugcucaccuc

SEQ ID NO: 274958 - RNA, 22 nt, Human
ugagguggcacacacuuccugc

SEQ ID NO: 274959 - RNA, 22 nt, Human
ggcaagagggcagauggagugc

SEQ ID NO: 274960 - RNA, 22 nt, Human
ucaggagcugcacugggcccac

SEQ ID NO: 274961 - RNA, 22 nt, Human
uacaguuuuuauucaugacaag

SEQ ID NO: 274962 - RNA, 22 nt, Human
aaacucaagucuaugaacaagg

SEQ ID NO: 274963 - RNA, 22 nt, Human
uuucacagugcucuguaaguau

SEQ ID NO: 274964 - RNA, 22 nt, Human
cugaaaauguuacacaggaaga

SEQ ID NO: 274965 - RNA, 22 nt, Human
uguccagguuagcuucaaacac

SEQ ID NO: 274966 - RNA, 22 nt, Human
gagcacugaggaaagcugguua

SEQ ID NO: 274967 - RNA, 22 nt, Human
cacaauuagcagcucuuuauuu

SEQ ID NO: 274968 - RNA, 18 nt, Human
cuccccagcugcccccag

SEQ ID NO: 274969 - RNA, 22 nt, Human
uuccaggcugaugggccacagg

SEQ ID NO: 274970 - RNA, 22 nt, Human
agcauuuaugacuaauguaaaa

SEQ ID NO: 274971 - RNA, 22 nt, Human
agaaacaucgcuuaguccucau

SEQ ID NO: 274972 - RNA, 22 nt, Human
ugaaaugauuauaugguguuug

SEQ ID NO: 274973 - RNA, 22 nt, Human
cccagagccucauucuguuggg

SEQ ID NO: 274974 - RNA, 22 nt, Human
ggcagccaguagggccagccug

SEQ ID NO: 274975 - RNA, 22 nt, Human
cugcaggggccucgagcacagg

SEQ ID NO: 274976 - RNA, 22 nt, Human
cagcuagcggugcuggcggcuc

SEQ ID NO: 274977 - RNA, 22 nt, Human
uauuuaacuggaaacacaauga

SEQ ID NO: 274978 - RNA, 22 nt, Human
ucacaucucucauugccucugc

SEQ ID NO: 274979 - RNA, 22 nt, Human
cauagcuuagggguuaaacuca

SEQ ID NO: 274980 - RNA, 22 nt, Human
uuaugauuuagaaagauucacu

SEQ ID NO: 274981 - RNA, 22 nt, Human
uccagccugaacuuuguccaga

SEQ ID NO: 274982 - RNA, 22 nt, Human
ccugggucccagccaggcuuug

SEQ ID NO: 274983 - RNA, 22 nt, Human
ggcugccucuauuuaggaucaa

SEQ ID NO: 274984 - RNA, 22 nt, Human
acuuuccuagacuucagugaca

SEQ ID NO: 274985 - RNA, 22 nt, Human
aauuagaaucuuauuuggggaa

SEQ ID NO: 274986 - RNA, 22 nt, Human
uggcacaggaauuuagaugcag

SEQ ID NO: 274987 - RNA, 22 nt, Human
aaguaguuaggaacauucucuc

SEQ ID NO: 274988 - RNA, 22 nt, Human
aggcucaguucuguggugagcc

SEQ ID NO: 274989 - RNA, 22 nt, Human
ugggaaaguguugaggugucuu

SEQ ID NO: 274990 - RNA, 22 nt, Human
ucuguucacugagcaauggcaa

SEQ ID NO: 274991 - RNA, 22 nt, Human
uuauuguagcacuuuggcagug

SEQ ID NO: 274992 - RNA, 22 nt, Human
uaggugucuggacaacuuugua

SEQ ID NO: 274993 - RNA, 22 nt, Human
aaagcuaagguagcauuggaga

SEQ ID NO: 274994 - RNA, 22 nt, Human
caguagcccacuaguaugcagu

SEQ ID NO: 274995 - RNA, 18 nt, Human
gcugcccuagcuccccuc

SEQ ID NO: 274996 - RNA, 22 nt, Human
aacuguaagagaauaaaugugu

SEQ ID NO: 274997 - RNA, 22 nt, Human
acugggaagacaagaaagauag

SEQ ID NO: 274998 - RNA, 22 nt, Human
cucuggucaagcaaagagguuu

SEQ ID NO: 274999 - RNA, 22 nt, Human
acaggcucucuauugagugcag

SEQ ID NO: 275000 - RNA, 19 nt, Human
aucuuuagcaacuuucaaa

SEQ ID NO: 275001 - RNA, 22 nt, Human
uggcaacaccuggaagacaugg

SEQ ID NO: 275002 - RNA, 22 nt, Human
uguuuaaccaccauucuauucu

SEQ ID NO: 275003 - RNA, 22 nt, Human
aaagucuuguuacguuccauug

SEQ ID NO: 275004 - RNA, 22 nt, Human
gguggcaggcccugagcauccc

SEQ ID NO: 275005 - RNA, 22 nt, Human
ggggagaauuacauggcgugga

SEQ ID NO: 275006 - RNA, 22 nt, Human
uauuucagguauggugugaaau

SEQ ID NO: 275007 - RNA, 22 nt, Human
gugagggguggcugagcaguuu

SEQ ID NO: 275008 - RNA, 22 nt, Human
agcuccagaaagguacacacag

SEQ ID NO: 275009 - RNA, 22 nt, Human
cugggcugcagcgggagcgacg

SEQ ID NO: 275010 - RNA, 22 nt, Human
ugggagauaauucauuguguuc

SEQ ID NO: 275011 - RNA, 22 nt, Human
gcuuagcagucacacauuguuc

SEQ ID NO: 275012 - RNA, 22 nt, Human
cuguggcuaggaagcuguggga

SEQ ID NO: 275013 - RNA, 22 nt, Human
ccagaggagaugccuccucugu

SEQ ID NO: 275014 - RNA, 22 nt, Human
auugucaucgauguuagccagu

SEQ ID NO: 275015 - RNA, 22 nt, Human
ucuggcuuuccuggagcaagaa

SEQ ID NO: 275016 - RNA, 22 nt, Human
cuuagaacagugucugccagag

SEQ ID NO: 275017 - RNA, 20 nt, Human
guacacuucauguuucaccu

SEQ ID NO: 275018 - RNA, 22 nt, Human
agccaggccagacucacacccu

SEQ ID NO: 275019 - RNA, 22 nt, Human
cgcagguguguuuucaggacua

SEQ ID NO: 275020 - RNA, 22 nt, Human
ccugggcucaagugaugguccc

SEQ ID NO: 275021 - RNA, 22 nt, Human
ugggugccaaccucugguggcc

SEQ ID NO: 275022 - RNA, 22 nt, Human
uuuauuauucucuggagaaugu

SEQ ID NO: 275023 - RNA, 22 nt, Human
ggcugggucccagcugggagga

SEQ ID NO: 275024 - RNA, 23 nt, Human
agcugcagaugcucagcgggcag

SEQ ID NO: 275025 - RNA, 22 nt, Human
uaauaaaugaaagugcuggcau

SEQ ID NO: 275026 - RNA, 22 nt, Human
ccagcccuacaguaucaccugu

SEQ ID NO: 275027 - RNA, 22 nt, Human
uggcagauguggcauagagcau

SEQ ID NO: 275028 - RNA, 22 nt, Human
gaggcuccucauucaguaugcu

SEQ ID NO: 275029 - RNA, 22 nt, Human
gcauguguuauuucucuguggg

SEQ ID NO: 275030 - RNA, 19 nt, Human
agccagugagccucugggu

SEQ ID NO: 275031 - RNA, 22 nt, Human
cuggcucauuuuagcaucaggu

SEQ ID NO: 275032 - RNA, 22 nt, Human
uugguuuugggauguacaaagg

SEQ ID NO: 275033 - RNA, 22 nt, Human
ugcuuuguguuugaauagauaa

SEQ ID NO: 275034 - RNA, 22 nt, Human
aggaauguuaagaaggucuacc

SEQ ID NO: 275035 - RNA, 22 nt, Human
auuugugauaauuuguuacagc

SEQ ID NO: 275036 - RNA, 22 nt, Human
ccugaggcuuaaucugucccaa

SEQ ID NO: 275037 - RNA, 22 nt, Human
cuuauacacgaacacaaggugu

SEQ ID NO: 275038 - RNA, 22 nt, Human
ggcccagcucuauugaauuaca

SEQ ID NO: 275039 - RNA, 22 nt, Human
ccugcugucugcuguguuaagc

SEQ ID NO: 275040 - RNA, 20 nt, Human
agcauucauucagcaagccu

SEQ ID NO: 275041 - RNA, 22 nt, Human
cacaguuucuauaggucagaau

SEQ ID NO: 275042 - RNA, 22 nt, Human
auggcagcaaaugucuggcugg

SEQ ID NO: 275043 - RNA, 22 nt, Human
ugggccuccuuuccauucagag

SEQ ID NO: 275044 - RNA, 22 nt, Human
gaagagaagcaucaauagguaa

SEQ ID NO: 275045 - RNA, 22 nt, Human
ccuguauuauuuguaugugcug

SEQ ID NO: 275046 - RNA, 22 nt, Human
uccaggcaggguuaaggguccu

SEQ ID NO: 275047 - RNA, 22 nt, Human
aguguauuaguuguccagcagu

SEQ ID NO: 275048 - RNA, 18 nt, Human
agcuuagcauacuuuucc

SEQ ID NO: 275049 - RNA, 22 nt, Human
ucugagcauugaauuuucuucc

SEQ ID NO: 275050 - RNA, 21 nt, Human
gcagugucaugguuucaaguu

SEQ ID NO: 275051 - RNA, 22 nt, Human
gacaggaagucugaaggaggga

SEQ ID NO: 275052 - RNA, 22 nt, Human
ucuauaaagggccagauaguag

SEQ ID NO: 275053 - RNA, 22 nt, Human
cuuagggaaucuuagagcugga

SEQ ID NO: 275054 - RNA, 20 nt, Human
aaagucuuaugguuaauuuu

SEQ ID NO: 275055 - RNA, 22 nt, Human
cacaagucauuuucagcaggcu

SEQ ID NO: 275056 - RNA, 22 nt, Human
cugagccaaccacagcaggagc

SEQ ID NO: 275057 - RNA, 22 nt, Human
acacuuauuuuuguccacuucc

SEQ ID NO: 275058 - RNA, 22 nt, Human
gaaggggacuggcagcugcaga

SEQ ID NO: 275059 - RNA, 22 nt, Human
ucaggacaguucccugcaaauu

SEQ ID NO: 275060 - RNA, 22 nt, Human
ugauuauauucuaacuucauaa

SEQ ID NO: 275061 - RNA, 22 nt, Human
uucuuugggcaauugcuggccc

SEQ ID NO: 275062 - RNA, 22 nt, Human
agggugcaaaagcaaggacagu

SEQ ID NO: 275063 - RNA, 22 nt, Human
caguggcagaucaccaacugga

SEQ ID NO: 275064 - RNA, 22 nt, Human
cugagacuuucaugugcuuuua

SEQ ID NO: 275065 - RNA, 22 nt, Human
auauguguauuugguuagccua

SEQ ID NO: 275066 - RNA, 22 nt, Human
auuauaggcuugagccaccgug

SEQ ID NO: 275067 - RNA, 22 nt, Human
gauagucaccucccuuaacuuu

SEQ ID NO: 275068 - RNA, 22 nt, Human
auuucaguguugguuagcaagc

SEQ ID NO: 275069 - RNA, 22 nt, Human
ccuuuuaagggagacuagagau

SEQ ID NO: 275070 - RNA, 23 nt, Human
ccagggccccuacaccacugucc

SEQ ID NO: 275071 - RNA, 22 nt, Human
cacacuaucuuccuauccuggc

SEQ ID NO: 275072 - RNA, 22 nt, Human
agcagugugggcugcacgcugg

SEQ ID NO: 275073 - RNA, 16 nt, Human
ugguggggaggacagc

SEQ ID NO: 275074 - RNA, 22 nt, Human
uuguuuauguaauuggcacacu

SEQ ID NO: 275075 - RNA, 19 nt, Human
gaggaggaaaacuagugua

SEQ ID NO: 275076 - RNA, 22 nt, Human
uucuguuugccauauauaguag

SEQ ID NO: 275077 - RNA, 22 nt, Human
ggguccaggcggcauaguugua

SEQ ID NO: 275078 - RNA, 22 nt, Human
cccaggcagucuggcucuaaag

SEQ ID NO: 275079 - RNA, 22 nt, Human
cagaggaggccaccgcauaggc

SEQ ID NO: 275080 - RNA, 22 nt, Human
cugcaggguuucgccaguugug

SEQ ID NO: 275081 - RNA, 22 nt, Human
aagaacauguuaaaagauucac

SEQ ID NO: 275082 - RNA, 22 nt, Human
uggcagcuugaaugcagucuuu

SEQ ID NO: 275083 - RNA, 21 nt, Human
ucuagaauccuguauaagacu

SEQ ID NO: 275084 - RNA, 22 nt, Human
aagcaggcccugggccagggga

SEQ ID NO: 275085 - RNA, 22 nt, Human
acagguguagcaggagcaucaa

SEQ ID NO: 275086 - RNA, 22 nt, Human
gagcucauuguggauggauggg

SEQ ID NO: 275087 - RNA, 22 nt, Human
cacaugcauuggcaaaagugua

SEQ ID NO: 275088 - RNA, 22 nt, Human
uuuggaauggaauagagauugc

SEQ ID NO: 275089 - RNA, 22 nt, Human
aggagcugggcccaaggaugcu

SEQ ID NO: 275090 - RNA, 22 nt, Human
auaaagcauacuuuguaugacu

SEQ ID NO: 275091 - RNA, 22 nt, Human
cacaccagauggcagcguggga

SEQ ID NO: 275092 - RNA, 22 nt, Human
cuggcuguaacauuuugccaua

SEQ ID NO: 275093 - RNA, 22 nt, Human
uacaaaaaauugauacugacga

SEQ ID NO: 275094 - RNA, 22 nt, Human
ccagggcagccaacccagaugc

SEQ ID NO: 275095 - RNA, 22 nt, Human
acacuuggagcaacacuuaugg

SEQ ID NO: 275096 - RNA, 22 nt, Human
ugcagagauccuggacugagcg

SEQ ID NO: 275097 - RNA, 22 nt, Human
cuccagugcccuccuugggggc

SEQ ID NO: 275098 - RNA, 22 nt, Human
agguaacacuacuuaguauacu

SEQ ID NO: 275099 - RNA, 19 nt, Human
aaaguuuuauucucauuug

SEQ ID NO: 275100 - RNA, 22 nt, Human
uuaaaggcgauaaggcaguguu

SEQ ID NO: 275101 - RNA, 22 nt, Human
uguccucaucuuuuccagaaau

SEQ ID NO: 275102 - RNA, 22 nt, Human
ccuggcagcauugguagagauu

SEQ ID NO: 275103 - RNA, 22 nt, Human
cagcuggcugcggugaggggac

SEQ ID NO: 275104 - RNA, 22 nt, Human
uauuuccacccucaguaaggaa

SEQ ID NO: 275105 - RNA, 22 nt, Human
gacauaaaauggaauucuguug

SEQ ID NO: 275106 - RNA, 22 nt, Human
uuuuacaguuccaugcaaagcg

SEQ ID NO: 275107 - RNA, 22 nt, Human
gggccucagcucugcucugcaa

SEQ ID NO: 275108 - RNA, 22 nt, Human
acauucuuugaguuuuguuaaa

SEQ ID NO: 275109 - RNA, 22 nt, Human
aauuugugaaucugucucuuga

SEQ ID NO: 275110 - RNA, 22 nt, Human
cuggcagggcucuuugggugcu

SEQ ID NO: 275111 - RNA, 22 nt, Human
ucugccagguggggagaggcca

SEQ ID NO: 275112 - RNA, 22 nt, Human
cagcaugaucccaguugauugc

SEQ ID NO: 275113 - RNA, 22 nt, Human
caggaagauuguggaggugguu

SEQ ID NO: 275114 - RNA, 22 nt, Human
acucugggagaggacaaacaaa

SEQ ID NO: 275115 - RNA, 22 nt, Human
gcagcuggcucagagagguggg

SEQ ID NO: 275116 - RNA, 22 nt, Human
ucuauuuuauacucaaaucuuc

SEQ ID NO: 275117 - RNA, 20 nt, Human
ucccucaggucauugggcug

SEQ ID NO: 275118 - RNA, 22 nt, Human
uggcaggaaaguaacagagcac

SEQ ID NO: 275119 - RNA, 22 nt, Human
augugcuguaauccauugaagg

SEQ ID NO: 275120 - RNA, 22 nt, Human
aaggguccaaggcuuugcguuu

SEQ ID NO: 275121 - RNA, 22 nt, Human
cagaccaucuugaagcaaacug

SEQ ID NO: 275122 - RNA, 16 nt, Human
uucagagcggcucaua

SEQ ID NO: 275123 - RNA, 22 nt, Human
auuauguaacugugguucagca

SEQ ID NO: 275124 - RNA, 22 nt, Human
aacaaagaagacugguuauuuu

SEQ ID NO: 275125 - RNA, 22 nt, Human
cacagcuuguuuagugacucac

SEQ ID NO: 275126 - RNA, 22 nt, Human
gaggccugcagcguggucccug

SEQ ID NO: 275127 - RNA, 22 nt, Human
cacaugaguguaggaagaggga

SEQ ID NO: 275128 - RNA, 22 nt, Human
agucauuuaucuuagccauuau

SEQ ID NO: 275129 - RNA, 20 nt, Human
gcccaagguccagaaggggg

SEQ ID NO: 275130 - RNA, 22 nt, Human
uaguacaguuccaucaaagcag

SEQ ID NO: 275131 - RNA, 22 nt, Human
ggaaagaaagugugaacaacuu

SEQ ID NO: 275132 - RNA, 22 nt, Human
augaacuaucaucaguuccacc

SEQ ID NO: 275133 - RNA, 22 nt, Human
guggaaauuuuaggaucaucuu

SEQ ID NO: 275134 - RNA, 22 nt, Human
ugcagagguuuccaggcaaguu

SEQ ID NO: 275135 - RNA, 22 nt, Human
ccugggucuugguucaugcucu

SEQ ID NO: 275136 - RNA, 18 nt, Human
uggaggcagaguucuggc

SEQ ID NO: 275137 - RNA, 22 nt, Human
uucucacaguaccuaacaugua

SEQ ID NO: 275138 - RNA, 21 nt, Human
uucauaaaccauucucaugca

SEQ ID NO: 275139 - RNA, 22 nt, Human
auaauauuuggauaggacagua

SEQ ID NO: 275140 - RNA, 22 nt, Human
agcugccaaguuucucaguuua

SEQ ID NO: 275141 - RNA, 22 nt, Human
aauagcuuggacccauugcuuu

SEQ ID NO: 275142 - RNA, 22 nt, Human
uucccaaagcuuugucugugaa

SEQ ID NO: 275143 - RNA, 22 nt, Human
aguaaacagaaagcaagaugau

SEQ ID NO: 275144 - RNA, 22 nt, Human
uaaggcuaucuuuugagugugu

SEQ ID NO: 275145 - RNA, 22 nt, Human
aucucaaaugauuacaccaagc

SEQ ID NO: 275146 - RNA, 22 nt, Human
acauuucucuugaugucucuau

SEQ ID NO: 275147 - RNA, 22 nt, Human
guacauuucauuuaaaugaugu

SEQ ID NO: 275148 - RNA, 22 nt, Human
ugugcugcucucagugacagcc

SEQ ID NO: 275149 - RNA, 22 nt, Human
aggcugcuggcaggcguggacg

SEQ ID NO: 275150 - RNA, 22 nt, Human
ugcuuucauauugccuaugacu

SEQ ID NO: 275151 - RNA, 22 nt, Human
uuacaguggcagaguuggguag

SEQ ID NO: 275152 - RNA, 22 nt, Human
guccaguguguuuaucuuggau

SEQ ID NO: 275153 - RNA, 22 nt, Human
ucaaggaaugacuauaugagga

SEQ ID NO: 275154 - RNA, 22 nt, Human
gaaagugccagaauaggaggcc

SEQ ID NO: 275155 - RNA, 22 nt, Human
uucuagacuucaggcauucucc

SEQ ID NO: 275156 - RNA, 22 nt, Human
gaaauagacacuuucuaugaau

SEQ ID NO: 275157 - RNA, 22 nt, Human
cauguuaauaugcauugaguac

SEQ ID NO: 275158 - RNA, 22 nt, Human
aauuccacagaugucuaucugu

SEQ ID NO: 275159 - RNA, 22 nt, Human
uugggacaucuggcauacaguu

SEQ ID NO: 275160 - RNA, 22 nt, Human
uaggaacuagacucaugacuca

SEQ ID NO: 275161 - RNA, 22 nt, Human
agcaucuaaacuaucaguuuga

SEQ ID NO: 275162 - RNA, 22 nt, Human
cagggccugcuuccuucuuguu

SEQ ID NO: 275163 - RNA, 22 nt, Human
gaaguggggaagcaacaggaga

SEQ ID NO: 275164 - RNA, 22 nt, Human
uuucuguaauuaaaagggcagg

SEQ ID NO: 275165 - RNA, 22 nt, Human
gggcucugccuggcugggagua

SEQ ID NO: 275166 - RNA, 22 nt, Human
acuguugaagugccagcuugau

SEQ ID NO: 275167 - RNA, 22 nt, Human
gccuccaggguagaggaggaag

SEQ ID NO: 275168 - RNA, 22 nt, Human
aagucccugguuccuagcaaaa

SEQ ID NO: 275169 - RNA, 22 nt, Human
cuucaagauauuucuagaauca

SEQ ID NO: 275170 - RNA, 22 nt, Human
uggcagugggaauggacaaaca

SEQ ID NO: 275171 - RNA, 22 nt, Human
cagcccugcacgcugccuccgc

SEQ ID NO: 275172 - RNA, 17 nt, Human
ccagguggaaucgugga

SEQ ID NO: 275173 - RNA, 22 nt, Human
gccugugcuguucccucugcca

SEQ ID NO: 275174 - RNA, 22 nt, Human
aguguucuucugggguaugcuc

SEQ ID NO: 275175 - RNA, 22 nt, Human
augguacaaugauggauagugg

SEQ ID NO: 275176 - RNA, 22 nt, Human
aagcaaagugaauuuugccaag

SEQ ID NO: 275177 - RNA, 22 nt, Human
ccuuggauuuugugcccacgcc

SEQ ID NO: 275178 - RNA, 22 nt, Human
ucucauugguauauacaugugu

SEQ ID NO: 275179 - RNA, 22 nt, Human
agaucagacacggcuugugacg

SEQ ID NO: 275180 - RNA, 22 nt, Human
uggugggcacagugcccaggcu

SEQ ID NO: 275181 - RNA, 22 nt, Human
uauuucugaggcccaggaagug

SEQ ID NO: 275182 - RNA, 20 nt, Human
agacuuaggcaauuuaggcu

SEQ ID NO: 275183 - RNA, 22 nt, Human
ucagagaauucucagaugacuc

SEQ ID NO: 275184 - RNA, 22 nt, Human
auacauguugagaaaauaucug

SEQ ID NO: 275185 - RNA, 22 nt, Human
gcauuuagcuuuaaaauauuuc

SEQ ID NO: 275186 - RNA, 22 nt, Human
ccaugccauacuggccacccgg

SEQ ID NO: 275187 - RNA, 22 nt, Human
uuacauaacgguaugaaaaaug

SEQ ID NO: 275188 - RNA, 22 nt, Human
ugccugggccucugaggaaggc

SEQ ID NO: 275189 - RNA, 22 nt, Human
ucuguuuagacucaguugaaac

SEQ ID NO: 275190 - RNA, 22 nt, Human
gccuguccuauacaggcggcug

SEQ ID NO: 275191 - RNA, 22 nt, Human
cugaggcauguuacaggacaua

SEQ ID NO: 275192 - RNA, 22 nt, Human
aauaauauuugaagcuucaaag

SEQ ID NO: 275193 - RNA, 22 nt, Human
uuuacagaauguugaauuuggg

SEQ ID NO: 275194 - RNA, 22 nt, Human
uucuucaaccaucuacauaaac

SEQ ID NO: 275195 - RNA, 22 nt, Human
auguaaaggcagacuuuaauuu

SEQ ID NO: 275196 - RNA, 19 nt, Human
ccagagacauuggcaucuu

SEQ ID NO: 275197 - RNA, 22 nt, Human
gaauguaagugggcagaagaca

SEQ ID NO: 275198 - RNA, 22 nt, Human
aaaaccacaaugacuuuugcac

SEQ ID NO: 275199 - RNA, 22 nt, Human
gucucuaucauagcugaacccu

SEQ ID NO: 275200 - RNA, 22 nt, Human
cucuugggugggcagugggccu

SEQ ID NO: 275201 - RNA, 21 nt, Human
ccuucucuugcuucagcuuca

SEQ ID NO: 275202 - RNA, 22 nt, Human
gcugggucuggcugugagccgg

SEQ ID NO: 275203 - RNA, 22 nt, Human
uucuuuauugagacuucauugu

SEQ ID NO: 275204 - RNA, 22 nt, Human
ugcuggcugccagguucccugu

SEQ ID NO: 275205 - RNA, 22 nt, Human
gucaaguuaagauaaggucaug

SEQ ID NO: 275206 - RNA, 22 nt, Human
ugcuggagucucuugacccugg

SEQ ID NO: 275207 - RNA, 22 nt, Human
ccaaaauaacagcccaauucac

SEQ ID NO: 275208 - RNA, 22 nt, Human
uacauguuauuucacuauuggu

SEQ ID NO: 275209 - RNA, 22 nt, Human
gacagcagccacagggagaggg

SEQ ID NO: 275210 - RNA, 22 nt, Human
uuauugcuuuggaaaacacuca

SEQ ID NO: 275211 - RNA, 22 nt, Human
agacaucucuaugcaggaucuc

SEQ ID NO: 275212 - RNA, 22 nt, Human
agucuagaggauggguccagau

SEQ ID NO: 275213 - RNA, 22 nt, Human
ggagggagucagcugauuagaa

SEQ ID NO: 275214 - RNA, 22 nt, Human
aaacagcuaauggccaggaaua

SEQ ID NO: 275215 - RNA, 22 nt, Human
ucccugggcacaaucugcuggc

SEQ ID NO: 275216 - RNA, 22 nt, Human
agcucccugcacgacccugccc

SEQ ID NO: 275217 - RNA, 22 nt, Human
uuccaaguccagccaggccaaa

SEQ ID NO: 275218 - RNA, 22 nt, Human
gcugggaaguggcagagcugga

SEQ ID NO: 275219 - RNA, 22 nt, Human
gcacuucucgggggcgcugucu

SEQ ID NO: 275220 - RNA, 22 nt, Human
gcauugaaauggcaaaaagaga

SEQ ID NO: 275221 - RNA, 22 nt, Human
gccuucaggaaaucaguccuug

SEQ ID NO: 275222 - RNA, 22 nt, Human
cagaggguugucaggcgccuug

SEQ ID NO: 275223 - RNA, 21 nt, Human
guucuguugacugugggcauc

SEQ ID NO: 275224 - RNA, 22 nt, Human
gaauggcugaaugucuuaaauu

SEQ ID NO: 275225 - RNA, 22 nt, Human
ucagaggagaccaaggggaaua

SEQ ID NO: 275226 - RNA, 20 nt, Human
ggccauggguugccugaggu

SEQ ID NO: 275227 - RNA, 22 nt, Human
aagcaacagaaacauucuaaua

SEQ ID NO: 275228 - RNA, 22 nt, Human
uggagggcauagcuguucuuuc

SEQ ID NO: 275229 - RNA, 19 nt, Human
cccagucuagguccuagga

SEQ ID NO: 275230 - RNA, 22 nt, Human
ucaggcagucugacuccggagg

SEQ ID NO: 275231 - RNA, 22 nt, Human
ggcccagcuguauauuacaguu

SEQ ID NO: 275232 - RNA, 22 nt, Human
uuucucugggcuguuggcagcc

SEQ ID NO: 275233 - RNA, 22 nt, Human
cucucaugagcauuccuaaggg

SEQ ID NO: 275234 - RNA, 22 nt, Human
aagaacuuugauuucauugcau

SEQ ID NO: 275235 - RNA, 22 nt, Human
acaggggaauuuacugucauua

SEQ ID NO: 275236 - RNA, 22 nt, Human
agcugcugcccauaggugacau

SEQ ID NO: 275237 - RNA, 22 nt, Human
caagaaccgcaauuacuuuugc

SEQ ID NO: 275238 - RNA, 22 nt, Human
gauuuuacaaacugcaggaccc

SEQ ID NO: 275239 - RNA, 20 nt, Human
aaaaacaguaaugcugaaga

SEQ ID NO: 275240 - RNA, 22 nt, Human
uagcaucaugaucagaacuguu

SEQ ID NO: 275241 - RNA, 22 nt, Human
uggauaaauggugcuaucaccc

SEQ ID NO: 275242 - RNA, 22 nt, Human
gcagggcaguaagagcuagagu

SEQ ID NO: 275243 - RNA, 22 nt, Human
auuuccauguccaaaaauuagu

SEQ ID NO: 275244 - RNA, 22 nt, Human
ccuggaccugcagcaucagcau

SEQ ID NO: 275245 - RNA, 22 nt, Human
uucauucugcaguucucagcuc

SEQ ID NO: 275246 - RNA, 22 nt, Human
ccuagaugggauggcggccggg

SEQ ID NO: 275247 - RNA, 22 nt, Human
auuauguagcuaaaaauugugu

SEQ ID NO: 275248 - RNA, 22 nt, Human
ucagggccacgcggaggugacg

SEQ ID NO: 275249 - RNA, 22 nt, Human
gcucuagguuccuagccaaguc

SEQ ID NO: 275250 - RNA, 22 nt, Human
auuacugagcuuguagcugcau

SEQ ID NO: 275251 - RNA, 22 nt, Human
cagggcuggauccuccagacuc

SEQ ID NO: 275252 - RNA, 22 nt, Human
ucauauaaguuuaaaacuaucu

SEQ ID NO: 275253 - RNA, 22 nt, Human
ucacaggaggacugaaagauau

SEQ ID NO: 275254 - RNA, 19 nt, Human
agggccugagcagauguug

SEQ ID NO: 275255 - RNA, 22 nt, Human
ggccugugggaggacagcuggg

SEQ ID NO: 275256 - RNA, 21 nt, Human
ccugccaggaaacugaguguc

SEQ ID NO: 275257 - RNA, 22 nt, Human
cuggcccagucucagaguguca

SEQ ID NO: 275258 - RNA, 22 nt, Human
acucaggcacucagcccucgcc

SEQ ID NO: 275259 - RNA, 20 nt, Human
agcuucuucugucuaauuuu

SEQ ID NO: 275260 - RNA, 22 nt, Human
uaauucuucaggccuuuugucu

SEQ ID NO: 275261 - RNA, 22 nt, Human
ugugaaagauacuaggcagagg

SEQ ID NO: 275262 - RNA, 22 nt, Human
uggcugucagcugccuggugcg

SEQ ID NO: 275263 - RNA, 20 nt, Human
ucugugcauugccugcuggu

SEQ ID NO: 275264 - RNA, 18 nt, Human
gccagccaggcguugcuc

SEQ ID NO: 275265 - RNA, 22 nt, Human
cuggaaggagaaggaggcugug

SEQ ID NO: 275266 - RNA, 22 nt, Human
accagaaaggaugccuccuucc

SEQ ID NO: 275267 - RNA, 17 nt, Human
agcacuugaaaauuucu

SEQ ID NO: 275268 - RNA, 22 nt, Human
uggaggagggcuggugucugua

SEQ ID NO: 275269 - RNA, 22 nt, Human
aauguaaaguugggcacaaaug

SEQ ID NO: 275270 - RNA, 22 nt, Human
gaauuucuggacccuuugagaa

SEQ ID NO: 275271 - RNA, 22 nt, Human
ugaggcaacagaaagggccaau

SEQ ID NO: 275272 - RNA, 22 nt, Human
caacuuuaugauugguuuguca

SEQ ID NO: 275273 - RNA, 22 nt, Human
ccauuccaugugcuacacauaa

SEQ ID NO: 275274 - RNA, 22 nt, Human
acacugugacaagaaagagcug

SEQ ID NO: 275275 - RNA, 22 nt, Human
uagacuagaggaucagcaaggg

SEQ ID NO: 275276 - RNA, 22 nt, Human
auccuggcuuuaggucagaggc

SEQ ID NO: 275277 - RNA, 22 nt, Human
agcuucuccaucugcccagaga

SEQ ID NO: 275278 - RNA, 22 nt, Human
uggcuucucauuugcauuaaac

SEQ ID NO: 275279 - RNA, 22 nt, Human
cugggacaguucagguagggca

SEQ ID NO: 275280 - RNA, 23 nt, Human
uuuggcauguuaacuucacuuac

SEQ ID NO: 275281 - RNA, 22 nt, Human
cuuauuagugucugucugaguu

SEQ ID NO: 275282 - RNA, 22 nt, Human
ucugggccagaucuagggaucu

SEQ ID NO: 275283 - RNA, 22 nt, Human
aaugguauuugucaagcauagu

SEQ ID NO: 275284 - RNA, 22 nt, Human
aucucugcaucccucaagguug

SEQ ID NO: 275285 - RNA, 22 nt, Human
uuggaaaaugaggcacagagag

SEQ ID NO: 275286 - RNA, 22 nt, Human
agcuggcugccuucuccuuagg

SEQ ID NO: 275287 - RNA, 22 nt, Human
ggcaggcaaggcagccugguga

SEQ ID NO: 275288 - RNA, 22 nt, Human
ggcuggugaguucagagaaccc

SEQ ID NO: 275289 - RNA, 20 nt, Human
agcaggccuuggggagagga

SEQ ID NO: 275290 - RNA, 23 nt, Human
aggagccccuaauucugggcagc

SEQ ID NO: 275291 - RNA, 20 nt, Human
uggcuucauaaugguuucug

SEQ ID NO: 275292 - RNA, 22 nt, Human
agcaagaugcauuauuucuuau

SEQ ID NO: 275293 - RNA, 18 nt, Human
cagcagagacauucaaaa

SEQ ID NO: 275294 - RNA, 22 nt, Human
uccagccuccuauuuacccuaa

SEQ ID NO: 275295 - RNA, 22 nt, Human
aggugagguuugggagguguca

SEQ ID NO: 275296 - RNA, 21 nt, Human
uacacaaagcgugguccagag

SEQ ID NO: 275297 - RNA, 22 nt, Human
ugaggaagugguuguaugguuu

SEQ ID NO: 275298 - RNA, 22 nt, Human
ucuguucaguugauguaguuuu

SEQ ID NO: 275299 - RNA, 20 nt, Human
uuuuagcacuuguuauggug

SEQ ID NO: 275300 - RNA, 22 nt, Human
aggcuuuggggcauucuguguu

SEQ ID NO: 275301 - RNA, 22 nt, Human
ccaugcauauaauagugccugg

SEQ ID NO: 275302 - RNA, 22 nt, Human
aaugcacagcuaaagugguucc

SEQ ID NO: 275303 - RNA, 22 nt, Human
uucagcaacauuuguugagugc

SEQ ID NO: 275304 - RNA, 23 nt, Human
auuuccuacuauaaaagagguaa

SEQ ID NO: 275305 - RNA, 19 nt, Human
caagauuuguucacacaug

SEQ ID NO: 275306 - RNA, 22 nt, Human
uauucacagcugccgcacucag

SEQ ID NO: 275307 - RNA, 22 nt, Human
aagugcauaaguaugauuauuu

SEQ ID NO: 275308 - RNA, 22 nt, Human
aacuguuggaggauuauuuugc

SEQ ID NO: 275309 - RNA, 22 nt, Human
uuaagaaggcuguuugcuagac

SEQ ID NO: 275310 - RNA, 22 nt, Human
ugcuggcccuggcucagggaac

SEQ ID NO: 275311 - RNA, 22 nt, Human
ucagcugcaguuucacaagcac

SEQ ID NO: 275312 - RNA, 17 nt, Human
gcuaggagagggaggag

SEQ ID NO: 275313 - RNA, 19 nt, Human
uccugggcugggccagguc

SEQ ID NO: 275314 - RNA, 22 nt, Human
uggcaggagacacauggcauag

SEQ ID NO: 275315 - RNA, 22 nt, Human
cuccagagagaaaggaggccgc

SEQ ID NO: 275316 - RNA, 19 nt, Human
uuugugaagaaaaugaugc

SEQ ID NO: 275317 - RNA, 22 nt, Human
agucacccuccaacucuccacu

SEQ ID NO: 275318 - RNA, 22 nt, Human
gcucugggauuaccagccuuag

SEQ ID NO: 275319 - RNA, 22 nt, Human
ccucacaguuuggcuaacugug

SEQ ID NO: 275320 - RNA, 21 nt, Human
cuuaagauggcauaguacgaa

SEQ ID NO: 275321 - RNA, 22 nt, Human
ccaugugucuccccuggaagua

SEQ ID NO: 275322 - RNA, 22 nt, Human
gcuuugcugaggucugaggauu

SEQ ID NO: 275323 - RNA, 22 nt, Human
acugccuuauaugcugugugug

SEQ ID NO: 275324 - RNA, 22 nt, Human
auucuuuauugcugaugguuau

SEQ ID NO: 275325 - RNA, 22 nt, Human
caaauggucauuucucuuuugu

SEQ ID NO: 275326 - RNA, 22 nt, Human
auuauucagucuuguaaggagu

SEQ ID NO: 275327 - RNA, 22 nt, Human
uggcacagacagcacagcaaug

SEQ ID NO: 275328 - RNA, 22 nt, Human
gcagcccagcagggcccggagc

SEQ ID NO: 275329 - RNA, 22 nt, Human
caacuuuugacacgugugcuaa

SEQ ID NO: 275330 - RNA, 22 nt, Human
ucuucagacuguuguucuuuug

SEQ ID NO: 275331 - RNA, 22 nt, Human
cugcccugcuggagaucacagu

SEQ ID NO: 275332 - RNA, 19 nt, Human
gccucugcuggggacaggc

SEQ ID NO: 275333 - RNA, 22 nt, Human
gggcuggacaucuaagguagcu

SEQ ID NO: 275334 - RNA, 22 nt, Human
cugacugucucuucucccauga

SEQ ID NO: 275335 - RNA, 22 nt, Human
ccugccuggcuuccagaagaga

SEQ ID NO: 275336 - RNA, 22 nt, Human
uucaacauuuuugaguuuaggu

SEQ ID NO: 275337 - RNA, 22 nt, Human
agagucaaaauuuaccagaaug

SEQ ID NO: 275338 - RNA, 22 nt, Human
agugcauucugucaucuugguu

SEQ ID NO: 275339 - RNA, 22 nt, Human
ggagaggggcaaguuuaucuag

SEQ ID NO: 275340 - RNA, 22 nt, Human
auaagcugaauagucaacacaa

SEQ ID NO: 275341 - RNA, 22 nt, Human
cuggcagcgugagcagcaucca

SEQ ID NO: 275342 - RNA, 22 nt, Human
cuauuauuauguuaacuggacu

SEQ ID NO: 275343 - RNA, 22 nt, Human
uuacagaggcuuccagggccca

SEQ ID NO: 275344 - RNA, 22 nt, Human
aggggaagagcccuuuacaugg

SEQ ID NO: 275345 - RNA, 20 nt, Human
agugauuuguuaguacauug

SEQ ID NO: 275346 - RNA, 23 nt, Human
cagggcugguagggaagagcgug

SEQ ID NO: 275347 - RNA, 22 nt, Human
aggccaguuguucagugggccg

SEQ ID NO: 275348 - RNA, 22 nt, Human
cagcagagcugugugggaaggg

SEQ ID NO: 275349 - RNA, 22 nt, Human
cuagcacugagaauagugcaua

SEQ ID NO: 275350 - RNA, 22 nt, Human
ucugcccagccagacccaaggu

SEQ ID NO: 275351 - RNA, 16 nt, Human
uucucugggguugugc

SEQ ID NO: 275352 - RNA, 22 nt, Human
uaauuuuuccacguacacuggg

SEQ ID NO: 275353 - RNA, 22 nt, Human
uugaggagguccuggguuuacu

SEQ ID NO: 275354 - RNA, 22 nt, Human
ucccagagauuuccucuccuuc

SEQ ID NO: 275355 - RNA, 22 nt, Human
uugccaucccuuaccucaguca

SEQ ID NO: 275356 - RNA, 22 nt, Human
auuucucauguacaaaaacacu

SEQ ID NO: 275357 - RNA, 22 nt, Human
guauauauuggauaaaccagag

SEQ ID NO: 275358 - RNA, 22 nt, Human
agacaucuugcacacauauacu

SEQ ID NO: 275359 - RNA, 22 nt, Human
cucagcaguauacucugaagau

SEQ ID NO: 275360 - RNA, 22 nt, Human
gaucuucucuuuaguagaaaca

SEQ ID NO: 275361 - RNA, 22 nt, Human
gcaugucuguaauuacagagcc

SEQ ID NO: 275362 - RNA, 22 nt, Human
uuauuuugccacaggugaccuu

SEQ ID NO: 275363 - RNA, 22 nt, Human
acucuguagggacgguucuccc

SEQ ID NO: 275364 - RNA, 23 nt, Human
ggcucagaaaaaguccuggccuc

SEQ ID NO: 275365 - RNA, 22 nt, Human
uguaaagagaaggcuuauaaag

SEQ ID NO: 275366 - RNA, 22 nt, Human
acaggugugagaacaugccuug

SEQ ID NO: 275367 - RNA, 22 nt, Human
aggcccagagagccaguuagug

SEQ ID NO: 275368 - RNA, 19 nt, Human
uugagcagugcuuagcacc

SEQ ID NO: 275369 - RNA, 22 nt, Human
aagggcagagggaaucccacau

SEQ ID NO: 275370 - RNA, 22 nt, Human
aauuuuacuaaucugaguguga

SEQ ID NO: 275371 - RNA, 22 nt, Human
cugaggagaacaaugagaucaa

SEQ ID NO: 275372 - RNA, 22 nt, Human
aaauuagaagugcucaggaaua

SEQ ID NO: 275373 - RNA, 22 nt, Human
ucagugugaguaccaugcucag

SEQ ID NO: 275374 - RNA, 22 nt, Human
agggccagcacuccuggcagga

SEQ ID NO: 275375 - RNA, 22 nt, Human
ucccacauuacccugacugaca

SEQ ID NO: 275376 - RNA, 22 nt, Human
acagcuuuaguguggguggugc

SEQ ID NO: 275377 - RNA, 22 nt, Human
ucugucauuagccuugacugua

SEQ ID NO: 275378 - RNA, 22 nt, Human
caauuagacauuuauuggccag

SEQ ID NO: 275379 - RNA, 22 nt, Human
uguuuuaagagcgcacuuuaua

SEQ ID NO: 275380 - RNA, 22 nt, Human
cagagucucugggaggcugggu

SEQ ID NO: 275381 - RNA, 22 nt, Human
gauacacuggagcuuccugaca

SEQ ID NO: 275382 - RNA, 22 nt, Human
caucacauguaggcagcaucac

SEQ ID NO: 275383 - RNA, 22 nt, Human
uggcuucuauugcuguggcauu

SEQ ID NO: 275384 - RNA, 22 nt, Human
uuccuggaaauuaugcucaccu

SEQ ID NO: 275385 - RNA, 22 nt, Human
uuugaaauuaagauauugucca

SEQ ID NO: 275386 - RNA, 22 nt, Human
ugaguucaaguccaaguugcug

SEQ ID NO: 275387 - RNA, 22 nt, Human
aucauguguaauuucaagcuac

SEQ ID NO: 275388 - RNA, 22 nt, Human
auagacauuauaacacagagcu

SEQ ID NO: 275389 - RNA, 22 nt, Human
ggcuccuguggcaagacagcuu

SEQ ID NO: 275390 - RNA, 22 nt, Human
aggcugccucgugagcucgcug

SEQ ID NO: 275391 - RNA, 22 nt, Human
aaagcaguauauugguaguugu

SEQ ID NO: 275392 - RNA, 22 nt, Human
agaugaaaauacgugacuuuaa

SEQ ID NO: 275393 - RNA, 21 nt, Human
agaaaauggcguuuuagauuu

SEQ ID NO: 275394 - RNA, 23 nt, Human
aacacaaagcugauuccaguggc

SEQ ID NO: 275395 - RNA, 22 nt, Human
gcagggcagaccuccagccuau

SEQ ID NO: 275396 - RNA, 22 nt, Human
uagcugggagugucugaugggu

SEQ ID NO: 275397 - RNA, 22 nt, Human
aaaagagcaaacauguaauagu

SEQ ID NO: 275398 - RNA, 22 nt, Human
cagcauggacccaucgcugagu

SEQ ID NO: 275399 - RNA, 22 nt, Human
aauauggcuccauuccuuuagg

SEQ ID NO: 275400 - RNA, 22 nt, Human
uuccuucuuccagaggcugccc

SEQ ID NO: 275401 - RNA, 23 nt, Human
agagugcagagauaugcuugugu

SEQ ID NO: 275402 - RNA, 22 nt, Human
ggccaccaaaguccuguggcuu

SEQ ID NO: 275403 - RNA, 22 nt, Human
gaaugugucacccugucccaug

SEQ ID NO: 275404 - RNA, 22 nt, Human
ggcaggaagcucauguggacug

SEQ ID NO: 275405 - RNA, 22 nt, Human
agccucaguuucaggccuccuc

SEQ ID NO: 275406 - RNA, 22 nt, Human
caccuggaguagcaagguaauu

SEQ ID NO: 275407 - RNA, 22 nt, Human
ugcccagccccuaucccuggga

SEQ ID NO: 275408 - RNA, 22 nt, Human
uuugauuuucagcaauaguggc

SEQ ID NO: 275409 - RNA, 22 nt, Human
aaggaaacacugaacuuuguag

SEQ ID NO: 275410 - RNA, 22 nt, Human
ugucuacuugggcucuacagca

SEQ ID NO: 275411 - RNA, 22 nt, Human
guccccagaaaggugaggcagg

SEQ ID NO: 275412 - RNA, 22 nt, Human
agacacugaaauguauugaaga

SEQ ID NO: 275413 - RNA, 22 nt, Human
cuucagaaccagccagaagagg

SEQ ID NO: 275414 - RNA, 22 nt, Human
cuggcuccaggucaugcacuca

SEQ ID NO: 275415 - RNA, 22 nt, Human
uacugaaacucuuguaaauauc

SEQ ID NO: 275416 - RNA, 22 nt, Human
ucagagacuguaggagcagccu

SEQ ID NO: 275417 - RNA, 22 nt, Human
ccagggaguuuccaaucugaga

SEQ ID NO: 275418 - RNA, 22 nt, Human
uagcaggcauggagaugacugu

SEQ ID NO: 275419 - RNA, 22 nt, Human
acaggccuuggcaggcauguga

SEQ ID NO: 275420 - RNA, 22 nt, Human
caggucagcuggugccccaggu

SEQ ID NO: 275421 - RNA, 22 nt, Human
caggugucagcagcacuguacu

SEQ ID NO: 275422 - RNA, 23 nt, Human
uucuuuauaaaucaaugggaugu

SEQ ID NO: 275423 - RNA, 22 nt, Human
cuuaaagaguauuuaauauaau

SEQ ID NO: 275424 - RNA, 22 nt, Human
guacccaggcacgccuugcuga

SEQ ID NO: 275425 - RNA, 23 nt, Human
guacacauaguguaguuauauuu

SEQ ID NO: 275426 - RNA, 22 nt, Human
uuggcugcugaaauauguucug

SEQ ID NO: 275427 - RNA, 22 nt, Human
gaauguuugacuaaagguagcu

SEQ ID NO: 275428 - RNA, 22 nt, Human
aggcucugaaggagaaccuguu

SEQ ID NO: 275429 - RNA, 16 nt, Human
ccagguggggcuguga

SEQ ID NO: 275430 - RNA, 22 nt, Human
ugucucugucucccagguugug

SEQ ID NO: 275431 - RNA, 22 nt, Human
aacagcagcugaggagcugggc

SEQ ID NO: 275432 - RNA, 19 nt, Human
ccugaggaaaagaugauug

SEQ ID NO: 275433 - RNA, 21 nt, Human
ugauaggguuugggcaauuau

SEQ ID NO: 275434 - RNA, 22 nt, Human
uguaauuauguuguuagaguau

SEQ ID NO: 275435 - RNA, 22 nt, Human
ucacacguccuugcuacuccuc

SEQ ID NO: 275436 - RNA, 22 nt, Human
ucuggagcuugaagcuuugguu

SEQ ID NO: 275437 - RNA, 22 nt, Human
cuugcacacauguacaugugua

SEQ ID NO: 275438 - RNA, 22 nt, Human
cugaaggauuuaguucuuugcu

SEQ ID NO: 275439 - RNA, 22 nt, Human
agggauggaagcucgucugcaa

SEQ ID NO: 275440 - RNA, 22 nt, Human
ccuagggauguguuagccagau

SEQ ID NO: 275441 - RNA, 22 nt, Human
ucaggcagguuggcugcagguc

SEQ ID NO: 275442 - RNA, 22 nt, Human
aggcaguuuaggcagcgauuua

SEQ ID NO: 275443 - RNA, 22 nt, Human
uagaacuuagcacuagacuugu

SEQ ID NO: 275444 - RNA, 22 nt, Human
uguguucaucaugauaucaggu

SEQ ID NO: 275445 - RNA, 22 nt, Human
uaaaguauaagcauuggaguau

SEQ ID NO: 275446 - RNA, 22 nt, Human
augcaggagcccucuugagggc

SEQ ID NO: 275447 - RNA, 22 nt, Human
acagccugagaguggagcuggc

SEQ ID NO: 275448 - RNA, 22 nt, Human
uuuuguuuucuuagaaaccugg

SEQ ID NO: 275449 - RNA, 22 nt, Human
ggaagaggcugagccagguccc

SEQ ID NO: 275450 - RNA, 22 nt, Human
acagucuugagcaucagccaga

SEQ ID NO: 275451 - RNA, 22 nt, Human
ugugacaucgcugugucuguuu

SEQ ID NO: 275452 - RNA, 22 nt, Human
cugcaggcaucuaacugugggc

SEQ ID NO: 275453 - RNA, 22 nt, Human
gaaguucaaugucagcaucuau

SEQ ID NO: 275454 - RNA, 22 nt, Human
uguguucaaucaccaaagguau

SEQ ID NO: 275455 - RNA, 22 nt, Human
uccagggcuggguuggcucagc

SEQ ID NO: 275456 - RNA, 22 nt, Human
cuguggaacuuagugggagaca

SEQ ID NO: 275457 - RNA, 22 nt, Human
aggcucuuugagacuaccugga

SEQ ID NO: 275458 - RNA, 22 nt, Human
caggacucacuucucacauccc

SEQ ID NO: 275459 - RNA, 22 nt, Human
uaaauuguguguugcuagggga

SEQ ID NO: 275460 - RNA, 22 nt, Human
ccaaaauuauuacauuuguagg

SEQ ID NO: 275461 - RNA, 22 nt, Human
cccaaggaauaggaucccagga

SEQ ID NO: 275462 - RNA, 22 nt, Human
ucucaagcuuguugguauguuu

SEQ ID NO: 275463 - RNA, 19 nt, Human
agacaaugggguuggcagu

SEQ ID NO: 275464 - RNA, 18 nt, Human
gaaaggagagacaguagg

SEQ ID NO: 275465 - RNA, 23 nt, Human
uggcuucugccccauucucucca

SEQ ID NO: 275466 - RNA, 22 nt, Human
ucaggcuguagggccccuggag

SEQ ID NO: 275467 - RNA, 22 nt, Human
ucugagcuucugccugcugcaa

SEQ ID NO: 275468 - RNA, 22 nt, Human
ggcaaggggucaggcugagaca

SEQ ID NO: 275469 - RNA, 22 nt, Human
ccuggccuuaagggcagggagc

SEQ ID NO: 275470 - RNA, 22 nt, Human
uagggacaaagagcugaggccu

SEQ ID NO: 275471 - RNA, 22 nt, Human
aaaauuauggaguaucccaaag

SEQ ID NO: 275472 - RNA, 21 nt, Human
ucauuuauugagaaaugacug

SEQ ID NO: 275473 - RNA, 22 nt, Human
uugagggagaaagccgaggugu

SEQ ID NO: 275474 - RNA, 22 nt, Human
uggacaugucuucuccaagaaa

SEQ ID NO: 275475 - RNA, 22 nt, Human
cucugggcuuaccugcuuccug

SEQ ID NO: 275476 - RNA, 22 nt, Human
gguggccucgguggugcacagg

SEQ ID NO: 275477 - RNA, 22 nt, Human
ggcuccaggugcaugccaggcu

SEQ ID NO: 275478 - RNA, 17 nt, Human
ucauuucaguaaaucca

SEQ ID NO: 275479 - RNA, 21 nt, Human
gcaaauguucaggaaaaaaga

SEQ ID NO: 275480 - RNA, 22 nt, Human
uuaaacauuuauggaggcagca

SEQ ID NO: 275481 - RNA, 22 nt, Human
cuggccaguugccuuccugggu

SEQ ID NO: 275482 - RNA, 22 nt, Human
uuagcagguuucuggcucuugg

SEQ ID NO: 275483 - RNA, 22 nt, Human
ccucaggcuucuaguucaguga

SEQ ID NO: 275484 - RNA, 21 nt, Human
aaacuagcagcaaccaugauc

SEQ ID NO: 275485 - RNA, 17 nt, Human
uggcacagaggugcuau

SEQ ID NO: 275486 - RNA, 22 nt, Human
cuggccuuuagccccagugucu

SEQ ID NO: 275487 - RNA, 22 nt, Human
ugcauugauagaaaaacaugga

SEQ ID NO: 275488 - RNA, 22 nt, Human
uacagagauacucuagaucaaa

SEQ ID NO: 275489 - RNA, 22 nt, Human
cccugcagagccagcccugacc

SEQ ID NO: 275490 - RNA, 22 nt, Human
ucagugcagggugggagagaga

SEQ ID NO: 275491 - RNA, 22 nt, Human
ucaggagccugaaagaggucua

SEQ ID NO: 275492 - RNA, 22 nt, Human
uaaagguaacaugaacugcuuu

SEQ ID NO: 275493 - RNA, 22 nt, Human
uauucaaaguaccuucauugcc

SEQ ID NO: 275494 - RNA, 20 nt, Human
agugcaagaaagcacagcug

SEQ ID NO: 275495 - RNA, 22 nt, Human
ggaagaaaagcuuccagcgccu

SEQ ID NO: 275496 - RNA, 22 nt, Human
cagggccagcgcccaggcccag

SEQ ID NO: 275497 - RNA, 22 nt, Human
uaacacagacagccacuaguaa

SEQ ID NO: 275498 - RNA, 22 nt, Human
uucccaguuagucauuuuuaca

SEQ ID NO: 275499 - RNA, 22 nt, Human
guucuggguucuggguuauugg

SEQ ID NO: 275500 - RNA, 22 nt, Human
ugaggugggcuuguggauuugc

SEQ ID NO: 275501 - RNA, 22 nt, Human
auaucuuggccccaggauuuua

SEQ ID NO: 275502 - RNA, 23 nt, Human
uuucaaggugucuguaccacuga

SEQ ID NO: 275503 - RNA, 22 nt, Human
acacuuuaucaauauucaaaaa

SEQ ID NO: 275504 - RNA, 22 nt, Human
gcaagcuggcuguuagaggaug

SEQ ID NO: 275505 - RNA, 22 nt, Human
acucuggguucuuucacuugac

SEQ ID NO: 275506 - RNA, 22 nt, Human
ccuguacauuagcugugaauug

SEQ ID NO: 275507 - RNA, 22 nt, Human
ccagcccuucccaacuggccag

SEQ ID NO: 275508 - RNA, 22 nt, Human
aguggaggcacuaauuggauuu

SEQ ID NO: 275509 - RNA, 22 nt, Human
aagccaaggagaauggccucag

SEQ ID NO: 275510 - RNA, 19 nt, Human
cagagcugcuggccucguc

SEQ ID NO: 275511 - RNA, 20 nt, Human
ccagcuuucccugcagcauc

SEQ ID NO: 275512 - RNA, 22 nt, Human
guucaaauuuuggcuguacugc

SEQ ID NO: 275513 - RNA, 21 nt, Human
ggccugaguauaggacaggcc

SEQ ID NO: 275514 - RNA, 18 nt, Human
auuuugaacaaugcugua

SEQ ID NO: 275515 - RNA, 22 nt, Human
gcuugggaggcaagcauuccau

SEQ ID NO: 275516 - RNA, 22 nt, Human
aucuuuuuacuaacacugcuua

SEQ ID NO: 275517 - RNA, 22 nt, Human
ucccugccucucagacuuccuu

SEQ ID NO: 275518 - RNA, 22 nt, Human
ggccugugucugugccuguccu

SEQ ID NO: 275519 - RNA, 22 nt, Human
uccugggacaagccguggaagu

SEQ ID NO: 275520 - RNA, 22 nt, Human
cugggacauauugcuaguguug

SEQ ID NO: 275521 - RNA, 22 nt, Human
cuccugagggaugcuuaggcuu

SEQ ID NO: 275522 - RNA, 22 nt, Human
acaaagaucuugcuuuccuacu

SEQ ID NO: 275523 - RNA, 20 nt, Human
uuggaagguggagaagagga

SEQ ID NO: 275524 - RNA, 22 nt, Human
ugcccucagcagcagcuccugc

SEQ ID NO: 275525 - RNA, 22 nt, Human
gaaaguauuuacauuaacaucu

SEQ ID NO: 275526 - RNA, 22 nt, Human
aguugcagacgcagagauguug

SEQ ID NO: 275527 - RNA, 22 nt, Human
ugucucagauacgccaucaagg

SEQ ID NO: 275528 - RNA, 22 nt, Human
aggaaaacacaguauugaugga

SEQ ID NO: 275529 - RNA, 22 nt, Human
auucucuggucauugagcauau

SEQ ID NO: 275530 - RNA, 22 nt, Human
ggccacugcccuggcuacaccg

SEQ ID NO: 275531 - RNA, 22 nt, Human
gcccuccugcaggggcuucugg

SEQ ID NO: 275532 - RNA, 22 nt, Human
aucuuugcccagagacucagcc

SEQ ID NO: 275533 - RNA, 22 nt, Human
gucucaaacuccuaggcuaaag

SEQ ID NO: 275534 - RNA, 22 nt, Human
gcagcuuucuacuuccuacagc

SEQ ID NO: 275535 - RNA, 22 nt, Human
aguggcugagugacugugacuc

SEQ ID NO: 275536 - RNA, 22 nt, Human
gaauuucaagcagugcaauguu

SEQ ID NO: 275537 - RNA, 22 nt, Human
aagcccaguaccuucagugagg

SEQ ID NO: 275538 - RNA, 22 nt, Human
agauguuuguguuaucuccauu

SEQ ID NO: 275539 - RNA, 22 nt, Human
ugcuguuaguaaggaacaugac

SEQ ID NO: 275540 - RNA, 21 nt, Human
acccuggguucuccauacccu

SEQ ID NO: 275541 - RNA, 19 nt, Human
ucuagcaacccacugcaug

SEQ ID NO: 275542 - RNA, 23 nt, Human
cccagagcacagccuccagaugc

SEQ ID NO: 275543 - RNA, 22 nt, Human
acaguacagugcagaggaagau

SEQ ID NO: 275544 - RNA, 22 nt, Human
ggaaggcuuucuguucugugac

SEQ ID NO: 275545 - RNA, 22 nt, Human
ggccagaaguuggaaaagagcc

SEQ ID NO: 275546 - RNA, 22 nt, Human
guccagucacugucaauguucc

SEQ ID NO: 275547 - RNA, 22 nt, Human
auuucucaucaagugccaacuc

SEQ ID NO: 275548 - RNA, 22 nt, Human
ccugagaauaauucuccauagc

SEQ ID NO: 275549 - RNA, 22 nt, Human
gcagcauauuguacuggccugc

SEQ ID NO: 275550 - RNA, 22 nt, Human
uaaaguucuggugagagguaag

SEQ ID NO: 275551 - RNA, 22 nt, Human
agcugugugcccaugguggagg

SEQ ID NO: 275552 - RNA, 22 nt, Human
uuugaguagugagacuaggcag

SEQ ID NO: 275553 - RNA, 22 nt, Human
gaccugagauuuugaggcucau

SEQ ID NO: 275554 - RNA, 22 nt, Human
aaaauacacauacuaggggaaa

SEQ ID NO: 275555 - RNA, 22 nt, Human
guccuuaguuacuuuucauguc

SEQ ID NO: 275556 - RNA, 22 nt, Human
ugaagaggccgugugcagguga

SEQ ID NO: 275557 - RNA, 22 nt, Human
gcuggcagccaagugaagaggg

SEQ ID NO: 275558 - RNA, 22 nt, Human
gugcaugcaaauuacuguaaag

SEQ ID NO: 275559 - RNA, 22 nt, Human
gaaggcuagaaacgaugcuuau

SEQ ID NO: 275560 - RNA, 22 nt, Human
ugccugggugcccucugcuccu

SEQ ID NO: 275561 - RNA, 23 nt, Human
uuucagaagugguccuaggaagc

SEQ ID NO: 275562 - RNA, 22 nt, Human
gagauuuauugacuuaacagua

SEQ ID NO: 275563 - RNA, 22 nt, Human
agggcagccauugagggauucu

SEQ ID NO: 275564 - RNA, 21 nt, Human
gccagccaugcuugccuaggc

SEQ ID NO: 275565 - RNA, 22 nt, Human
uagaagcaguaauagaaauagg

SEQ ID NO: 275566 - RNA, 22 nt, Human
gugcauuuggugacucucaccc

SEQ ID NO: 275567 - RNA, 22 nt, Human
ugcuggagaagcuccugggacu

SEQ ID NO: 275568 - RNA, 18 nt, Human
acagugcugucacugcuu

SEQ ID NO: 275569 - RNA, 22 nt, Human
agaaggcucaucccucacccca

SEQ ID NO: 275570 - RNA, 22 nt, Human
uccugcagccauuagaggucaa

SEQ ID NO: 275571 - RNA, 22 nt, Human
ccaggcucacugacuaccacau

SEQ ID NO: 275572 - RNA, 22 nt, Human
ucaaauuuuaacaugcauuaga

SEQ ID NO: 275573 - RNA, 23 nt, Human
gagcuuagucuacucagacaucc

SEQ ID NO: 275574 - RNA, 22 nt, Human
agaaucugaaggcaccucuggu

SEQ ID NO: 275575 - RNA, 22 nt, Human
augcccugcaucaagugacacu

SEQ ID NO: 275576 - RNA, 22 nt, Human
gcaaaguaaaaauagauucuga

SEQ ID NO: 275577 - RNA, 22 nt, Human
agagauggcgucucagagccug

SEQ ID NO: 275578 - RNA, 22 nt, Human
cuugaagaaauggagacaggau

SEQ ID NO: 275579 - RNA, 22 nt, Human
ucagcacuuugaagcagaagga

SEQ ID NO: 275580 - RNA, 22 nt, Human
uccagcucaggguuggcucaag

SEQ ID NO: 275581 - RNA, 22 nt, Human
cugcccucgggcccucccauag

SEQ ID NO: 275582 - RNA, 22 nt, Human
uugcauguacguacagagagag

SEQ ID NO: 275583 - RNA, 22 nt, Human
ugucucagaggcaggaagagcc

SEQ ID NO: 275584 - RNA, 22 nt, Human
acugugcagguagaugccuggg

SEQ ID NO: 275585 - RNA, 22 nt, Human
aagcccugagcacugcagagaa

SEQ ID NO: 275586 - RNA, 22 nt, Human
aauuagggaggacaaagguaca

SEQ ID NO: 275587 - RNA, 22 nt, Human
agaaagaacguugguuaucuua

SEQ ID NO: 275588 - RNA, 22 nt, Human
ugcuccaggccgccuggggcug

SEQ ID NO: 275589 - RNA, 23 nt, Human
ucccuggccgcaauggccgccuu

SEQ ID NO: 275590 - RNA, 22 nt, Human
uaaagacagauggaccagccau

SEQ ID NO: 275591 - RNA, 22 nt, Human
acaguaaccucuccucugaagg

SEQ ID NO: 275592 - RNA, 22 nt, Human
uuucuucucacccaggacagag

SEQ ID NO: 275593 - RNA, 22 nt, Human
acacuguaggagaaaggaguuu

SEQ ID NO: 275594 - RNA, 22 nt, Human
ggugggggagacuuggucaaga

SEQ ID NO: 275595 - RNA, 22 nt, Human
ggcucaggccagaccacgacuc

SEQ ID NO: 275596 - RNA, 22 nt, Human
gucugggccaggcgagccgagg

SEQ ID NO: 275597 - RNA, 22 nt, Human
ccuggaucccgauggcugugag

SEQ ID NO: 275598 - RNA, 21 nt, Human
ucacuacaauguucucuuaua

SEQ ID NO: 275599 - RNA, 22 nt, Human
ggcccuuccucuugugcuggca

SEQ ID NO: 275600 - RNA, 20 nt, Human
augauuuugcacuaacuuca

SEQ ID NO: 275601 - RNA, 22 nt, Human
ccagaggcuggguucaccucag

SEQ ID NO: 275602 - RNA, 22 nt, Human
aaaucagucccucuuggaauuu

SEQ ID NO: 275603 - RNA, 22 nt, Human
ugggagaagcauggggugcaga

SEQ ID NO: 275604 - RNA, 22 nt, Human
augcacauaggccaaaucauuu

SEQ ID NO: 275605 - RNA, 22 nt, Human
auggcuuccucuggauuggauu

SEQ ID NO: 275606 - RNA, 22 nt, Human
agccauguuggggaaggugggc

SEQ ID NO: 275607 - RNA, 22 nt, Human
caaggaaacaugaaaugcauug

SEQ ID NO: 275608 - RNA, 22 nt, Human
aaugcauauguaggcaagcagu

SEQ ID NO: 275609 - RNA, 22 nt, Human
cuuccuggaugaagcccagcau

SEQ ID NO: 275610 - RNA, 22 nt, Human
ucuuucaaugagcauucuuucc

SEQ ID NO: 275611 - RNA, 22 nt, Human
uucuuuauggaauggugauagu

SEQ ID NO: 275612 - RNA, 22 nt, Human
ucaggauccauagacucccaaa

SEQ ID NO: 275613 - RNA, 22 nt, Human
gucccagggcaaggcuguuucu

SEQ ID NO: 275614 - RNA, 22 nt, Human
ccagugcugaaugaggaggucu

SEQ ID NO: 275615 - RNA, 22 nt, Human
uuccaggacaagauguuucagg

SEQ ID NO: 275616 - RNA, 22 nt, Human
uuuuuugucccagagagccugg

SEQ ID NO: 275617 - RNA, 22 nt, Human
aacaugaagguaggaugguuuu

SEQ ID NO: 275618 - RNA, 22 nt, Human
cagaagcuuugucuagucuuga

SEQ ID NO: 275619 - RNA, 22 nt, Human
agggaagggcagggucuaugca

SEQ ID NO: 275620 - RNA, 22 nt, Human
ugcacagcgggugucugucagg

SEQ ID NO: 275621 - RNA, 22 nt, Human
uggcauuucaccuuucauuucc

SEQ ID NO: 275622 - RNA, 22 nt, Human
uggagcuggaagacagugauau

SEQ ID NO: 275623 - RNA, 22 nt, Human
uggcuucauucuccugugaaua

SEQ ID NO: 275624 - RNA, 22 nt, Human
auauuuuccgaacuugagguag

SEQ ID NO: 275625 - RNA, 22 nt, Human
guccuucaaguaaccugggacc

SEQ ID NO: 275626 - RNA, 22 nt, Human
uuuuaugugugaaaugcugucu

SEQ ID NO: 275627 - RNA, 20 nt, Human
agggucaguagcacagagcu

SEQ ID NO: 275628 - RNA, 22 nt, Human
aaguccuuggagaauagaaagg

SEQ ID NO: 275629 - RNA, 22 nt, Human
caggaaggaaaggguguggaga

SEQ ID NO: 275630 - RNA, 22 nt, Human
gaggaaugggugucucgugauu

SEQ ID NO: 275631 - RNA, 22 nt, Human
uaugcacaccuggguccuuguc

SEQ ID NO: 275632 - RNA, 22 nt, Human
aaaaccacaguuacuuuugcac

SEQ ID NO: 275633 - RNA, 22 nt, Human
uaacacuaagaaucuaaauuua

SEQ ID NO: 275634 - RNA, 22 nt, Human
gcugugugcuaggauauguuuu

SEQ ID NO: 275635 - RNA, 22 nt, Human
ggacagggaucauuaucugagc

SEQ ID NO: 275636 - RNA, 22 nt, Human
gucuccuggaaauaugcccaua

SEQ ID NO: 275637 - RNA, 22 nt, Human
ugaguaggugguuaagcaugga

SEQ ID NO: 275638 - RNA, 22 nt, Human
uuuuaauccucuugguaucuua

SEQ ID NO: 275639 - RNA, 21 nt, Human
cagccugcugcuccagggcca

SEQ ID NO: 275640 - RNA, 22 nt, Human
ggcagcucugcuaauugagccu

SEQ ID NO: 275641 - RNA, 22 nt, Human
ugucuggggaacugugcaucca

SEQ ID NO: 275642 - RNA, 22 nt, Human
uggagacagagauagccaauug

SEQ ID NO: 275643 - RNA, 22 nt, Human
cugagcagugguucuugagcgc

SEQ ID NO: 275644 - RNA, 22 nt, Human
gccaggucuggguagcagagga

SEQ ID NO: 275645 - RNA, 22 nt, Human
ugcaggugacaccacucuuccu

SEQ ID NO: 275646 - RNA, 22 nt, Human
aagacaagcaucaaaucaggca

SEQ ID NO: 275647 - RNA, 22 nt, Human
cuccaggccccuggccuucugc

SEQ ID NO: 275648 - RNA, 22 nt, Human
uaaauuagggacuuuaguuaau

SEQ ID NO: 275649 - RNA, 22 nt, Human
ucuuauuauuguuguaaaagca

SEQ ID NO: 275650 - RNA, 22 nt, Human
aggcucagagaugaguaagcac

SEQ ID NO: 275651 - RNA, 22 nt, Human
aaaaggcuagcuaguaacagaa

SEQ ID NO: 275652 - RNA, 22 nt, Human
guucucuggaaacuaugauuca

SEQ ID NO: 275653 - RNA, 22 nt, Human
acuggaggggaaaaugguagua

SEQ ID NO: 275654 - RNA, 22 nt, Human
ccugggaagucagccaaggacg

SEQ ID NO: 275655 - RNA, 22 nt, Human
gcuuggcuggagaaaguuaccu

SEQ ID NO: 275656 - RNA, 22 nt, Human
agaagaaagauugaagguuccu

SEQ ID NO: 275657 - RNA, 23 nt, Human
caggaaauguucuugaagccuga

SEQ ID NO: 275658 - RNA, 22 nt, Human
aaguguguugacugaauugggg

SEQ ID NO: 275659 - RNA, 22 nt, Human
uccagccaccaccuugauugcc

SEQ ID NO: 275660 - RNA, 22 nt, Human
gcuggccuugaggugucuuuau

SEQ ID NO: 275661 - RNA, 22 nt, Human
ugagucacuaucacuuucucug

SEQ ID NO: 275662 - RNA, 22 nt, Human
cagggcucgcugccagcuucag

SEQ ID NO: 275663 - RNA, 22 nt, Human
ggcugcagcagagggacucacg

SEQ ID NO: 275664 - RNA, 22 nt, Human
uuugguauugcacacugucuuc

SEQ ID NO: 275665 - RNA, 22 nt, Human
uuggccuuugcugggcuguuga

SEQ ID NO: 275666 - RNA, 22 nt, Human
aguuuacagaugcuacaggagc

SEQ ID NO: 275667 - RNA, 22 nt, Human
aaguuucuguaugcucuucugu

SEQ ID NO: 275668 - RNA, 22 nt, Human
gcacaggcacagagggccacug

SEQ ID NO: 275669 - RNA, 22 nt, Human
uuuacagcacugaagccagggg

SEQ ID NO: 275670 - RNA, 15 nt, Human
gcccucaggcgacac

SEQ ID NO: 275671 - RNA, 22 nt, Human
agugcauucucuaauuacaggu

SEQ ID NO: 275672 - RNA, 22 nt, Human
ggcucugaaggagacagcugcu

SEQ ID NO: 275673 - RNA, 22 nt, Human
caggcagagcaacugguccaga

SEQ ID NO: 275674 - RNA, 22 nt, Human
gcuggccacacugcugauggag

SEQ ID NO: 275675 - RNA, 22 nt, Human
ucugccugaaccacucuuggag

SEQ ID NO: 275676 - RNA, 22 nt, Human
aaauuaccauuguaaaguauuu

SEQ ID NO: 275677 - RNA, 22 nt, Human
aggugcugaacuggugaggucu

SEQ ID NO: 275678 - RNA, 22 nt, Human
uuagaaaugauuucaccucuuu

SEQ ID NO: 275679 - RNA, 22 nt, Human
uccaggcugacgcagcuauuua

SEQ ID NO: 275680 - RNA, 22 nt, Human
gcaaggaacaaaugcucugcuu

SEQ ID NO: 275681 - RNA, 22 nt, Human
acagagcucccagccaucuccu

SEQ ID NO: 275682 - RNA, 22 nt, Human
gcauggcuguugaagucagcuc

SEQ ID NO: 275683 - RNA, 20 nt, Human
aacacugaggccuacucuuc

SEQ ID NO: 275684 - RNA, 22 nt, Human
gggcagugggaccaggcaccag

SEQ ID NO: 275685 - RNA, 22 nt, Human
cacaauuuccaagucauguuau

SEQ ID NO: 275686 - RNA, 22 nt, Human
uaauuuuacuuccugagcaccu

SEQ ID NO: 275687 - RNA, 22 nt, Human
ucugcaugaugaacaaaugagc

SEQ ID NO: 275688 - RNA, 22 nt, Human
cugcaucacagcaggaggcaca

SEQ ID NO: 275689 - RNA, 22 nt, Human
cuccuggggcacuuagaagcaa

SEQ ID NO: 275690 - RNA, 22 nt, Human
acuuggaaagaugcaacacagu

SEQ ID NO: 275691 - RNA, 22 nt, Human
auccuggcgccacacggcucua

SEQ ID NO: 275692 - RNA, 22 nt, Human
aaaugcaauuguauguacucca

SEQ ID NO: 275693 - RNA, 23 nt, Human
cccagggacacgaugacaccucc

SEQ ID NO: 275694 - RNA, 22 nt, Human
gcaccagggagggugugcuuca

SEQ ID NO: 275695 - RNA, 22 nt, Human
uccauggguagcccugguugag

SEQ ID NO: 275696 - RNA, 22 nt, Human
caacaacaugggauucauuucu

SEQ ID NO: 275697 - RNA, 22 nt, Human
cuuucuggaguggaaagguauu

SEQ ID NO: 275698 - RNA, 22 nt, Human
gaaaacugugauuagaaugccu

SEQ ID NO: 275699 - RNA, 22 nt, Human
aagucuaggacaggaagucuau

SEQ ID NO: 275700 - RNA, 22 nt, Human
acaggugugggcugggcucuga

SEQ ID NO: 275701 - RNA, 22 nt, Human
uuguccagagccaggcugucgg

SEQ ID NO: 275702 - RNA, 22 nt, Human
agcugugguuagauagaguccu

SEQ ID NO: 275703 - RNA, 22 nt, Human
caggaaagguagucacaaugua

SEQ ID NO: 275704 - RNA, 22 nt, Human
uccagcccagcuguccccuuca

SEQ ID NO: 275705 - RNA, 22 nt, Human
gccgaggcucugcccagcugcu

SEQ ID NO: 275706 - RNA, 22 nt, Human
ggcagaccucuccagccccaca

SEQ ID NO: 275707 - RNA, 22 nt, Human
acuuucccacuuaauguauuua

SEQ ID NO: 275708 - RNA, 22 nt, Human
cuuuucaugagucuguuauggg

SEQ ID NO: 275709 - RNA, 22 nt, Human
aguggcuggucuaaggucacag

SEQ ID NO: 275710 - RNA, 22 nt, Human
aggaagccaugguggacgucua

SEQ ID NO: 275711 - RNA, 22 nt, Human
ccauagaugagacaaaguagag

SEQ ID NO: 275712 - RNA, 21 nt, Human
ccaggcugggagggcaguucc

SEQ ID NO: 275713 - RNA, 22 nt, Human
gcagagaacccagcagauuggc

SEQ ID NO: 275714 - RNA, 22 nt, Human
ucagguggcuucggggaguggc

SEQ ID NO: 275715 - RNA, 23 nt, Human
agggagcuaaaaggcuggagcag

SEQ ID NO: 275716 - RNA, 22 nt, Human
ggaaggaauuccaagacuaaag

SEQ ID NO: 275717 - RNA, 22 nt, Human
agagauggagagcacuggggcu

SEQ ID NO: 275718 - RNA, 22 nt, Human
uagugcacacgcauguagcagu

SEQ ID NO: 275719 - RNA, 22 nt, Human
ugcaaauuccauuuaaacacua

SEQ ID NO: 275720 - RNA, 22 nt, Human
uccaggaaagcacugggcuggg

SEQ ID NO: 275721 - RNA, 22 nt, Human
gcuuccagacgaucauguaaga

SEQ ID NO: 275722 - RNA, 22 nt, Human
guaaucucagcuacuugggagg

SEQ ID NO: 275723 - RNA, 19 nt, Human
acacuguagauauagcuau

SEQ ID NO: 275724 - RNA, 22 nt, Human
uggcuucugagucuccugacau

SEQ ID NO: 275725 - RNA, 22 nt, Human
ugcccagucuccgggccagccc

SEQ ID NO: 275726 - RNA, 22 nt, Human
cugggcuuugaagccaggcugc

SEQ ID NO: 275727 - RNA, 22 nt, Human
uuccagugaugggcaauuuggu

SEQ ID NO: 275728 - RNA, 22 nt, Human
accacccaccucacagcauagu

SEQ ID NO: 275729 - RNA, 22 nt, Human
ucuaaugaggacuuuauagaga

SEQ ID NO: 275730 - RNA, 22 nt, Human
uauaggaaauuuaucuccuggg

SEQ ID NO: 275731 - RNA, 22 nt, Human
cugcacaguggguggggcguca

SEQ ID NO: 275732 - RNA, 22 nt, Human
ccugguucagucuuucuaugcu

SEQ ID NO: 275733 - RNA, 22 nt, Human
aggacaggauugagcugaacug

SEQ ID NO: 275734 - RNA, 22 nt, Human
gauggcagguaguggucucauc

SEQ ID NO: 275735 - RNA, 20 nt, Human
guacauuuucaggaggggau

SEQ ID NO: 275736 - RNA, 19 nt, Human
aagcaagcuuugagugggu

SEQ ID NO: 275737 - RNA, 22 nt, Human
acacuaauuaagcugcuuuacu

SEQ ID NO: 275738 - RNA, 22 nt, Human
ccaguuacaagugauucuuggu

SEQ ID NO: 275739 - RNA, 22 nt, Human
uuccaggaacaaacucaccuua

SEQ ID NO: 275740 - RNA, 19 nt, Human
agccagaacuaguguuucu

SEQ ID NO: 275741 - RNA, 22 nt, Human
ugaggcagcccacuuuccuuag

SEQ ID NO: 275742 - RNA, 22 nt, Human
ugcugagaggaaagaaugcaca

SEQ ID NO: 275743 - RNA, 22 nt, Human
acuucauugcuaagaacaaggu

SEQ ID NO: 275744 - RNA, 22 nt, Human
acucugagucaugcacuccuug

SEQ ID NO: 275745 - RNA, 22 nt, Human
auuuccuaacagaggcaacagu

SEQ ID NO: 275746 - RNA, 22 nt, Human
ugaguccauaguggauccuuca

SEQ ID NO: 275747 - RNA, 20 nt, Human
caaagacaugcuaggggugg

SEQ ID NO: 275748 - RNA, 22 nt, Human
cauuucugugacacuuccaucu

SEQ ID NO: 275749 - RNA, 22 nt, Human
aggccaggcaacauucugaagu

SEQ ID NO: 275750 - RNA, 22 nt, Human
ucugagaagcaccuucuggaca

SEQ ID NO: 275751 - RNA, 22 nt, Human
ggcagcugggucacaccgaucu

SEQ ID NO: 275752 - RNA, 22 nt, Human
ucuggccugaaaguccaugcuu

SEQ ID NO: 275753 - RNA, 22 nt, Human
agaaaucauugaauuauuugcu

SEQ ID NO: 275754 - RNA, 22 nt, Human
agaaagcuggagucaagcagag

SEQ ID NO: 275755 - RNA, 22 nt, Human
ggguauuaaaaugaaggagaaa

SEQ ID NO: 275756 - RNA, 20 nt, Human
agugggagagggcagacugc

SEQ ID NO: 275757 - RNA, 22 nt, Human
uaugugucccuugguguagcaa

SEQ ID NO: 275758 - RNA, 22 nt, Human
ugguggggauucccucccuggc

SEQ ID NO: 275759 - RNA, 22 nt, Human
uucauugauaguuuuauguaug

SEQ ID NO: 275760 - RNA, 22 nt, Human
gaauacaagccaggcacaaggc

SEQ ID NO: 275761 - RNA, 22 nt, Human
cagaacacaggcuaaacugaga

SEQ ID NO: 275762 - RNA, 22 nt, Human
aacaaugcugaacugaggaaag

SEQ ID NO: 275763 - RNA, 22 nt, Human
ucccuggcugggggcugccuug

SEQ ID NO: 275764 - RNA, 22 nt, Human
cacacaguggaguauuacucag

SEQ ID NO: 275765 - RNA, 22 nt, Human
gccacccccaaguagguggucu

SEQ ID NO: 275766 - RNA, 22 nt, Human
cacagcuguuuucuccaggcag

SEQ ID NO: 275767 - RNA, 22 nt, Human
uuugcuugacccuugugcugaa

SEQ ID NO: 275768 - RNA, 22 nt, Human
gccugcagccucaagggcugag

SEQ ID NO: 275769 - RNA, 22 nt, Human
ucuagggagcucuagcaguggu

SEQ ID NO: 275770 - RNA, 22 nt, Human
aaacugggauucuucacaaggu

SEQ ID NO: 275771 - RNA, 22 nt, Human
gcugccugcucacccggccugg

SEQ ID NO: 275772 - RNA, 22 nt, Human
caugcuuucuguccaaauguua

SEQ ID NO: 275773 - RNA, 22 nt, Human
ugcaaucagaaaguucagcggu

SEQ ID NO: 275774 - RNA, 19 nt, Human
acacaccagugccugugac

SEQ ID NO: 275775 - RNA, 22 nt, Human
ggagaagaggagcuggaagccu

SEQ ID NO: 275776 - RNA, 19 nt, Human
acuguucuaacuugcagcu

SEQ ID NO: 275777 - RNA, 23 nt, Human
ugcagcugccucuggcgggccgg

SEQ ID NO: 275778 - RNA, 22 nt, Human
augguguuuauaggcaaagauc

SEQ ID NO: 275779 - RNA, 22 nt, Human
agguuucuccuuuaaagcaugg

SEQ ID NO: 275780 - RNA, 22 nt, Human
uuccaguucuggcuuugccacu

SEQ ID NO: 275781 - RNA, 22 nt, Human
ugacauuucgguguaugugaug

SEQ ID NO: 275782 - RNA, 22 nt, Human
aacccuggggcugcucugccug

SEQ ID NO: 275783 - RNA, 22 nt, Human
acaggugcaugcuaccaugucu

SEQ ID NO: 275784 - RNA, 23 nt, Human
agaugaggcuucuccauguuggu

SEQ ID NO: 275785 - RNA, 20 nt, Human
guggccuguccuguuguggg

SEQ ID NO: 275786 - RNA, 22 nt, Human
ucccagagccucugccacucug

SEQ ID NO: 275787 - RNA, 22 nt, Human
gcugggcacugucccauaggcu

SEQ ID NO: 275788 - RNA, 22 nt, Human
ucacacauacucaugugugagu

SEQ ID NO: 275789 - RNA, 22 nt, Human
auagauguguguaaguacauaa

SEQ ID NO: 275790 - RNA, 22 nt, Human
ggaagccaggccaaugagaaca

SEQ ID NO: 275791 - RNA, 22 nt, Human
uguauauauuucuuucauucua

SEQ ID NO: 275792 - RNA, 22 nt, Human
ccaauaauucuucaaguguuuu

SEQ ID NO: 275793 - RNA, 22 nt, Human
gugcacagaagcagaagcuaga

SEQ ID NO: 275794 - RNA, 17 nt, Human
ucugcucugccaaucca

SEQ ID NO: 275795 - RNA, 22 nt, Human
cugcuccaggauuucaggccag

SEQ ID NO: 275796 - RNA, 22 nt, Human
uggcuucucuggcauccccauc

SEQ ID NO: 275797 - RNA, 22 nt, Human
auucuccuuauucugaaaaaag

SEQ ID NO: 275798 - RNA, 17 nt, Human
uuugguaauauauuaag

SEQ ID NO: 275799 - RNA, 22 nt, Human
acaggacagggaauucgaaauu

SEQ ID NO: 275800 - RNA, 22 nt, Human
ccuggcagguggagguugcagu

SEQ ID NO: 275801 - RNA, 22 nt, Human
uaggugucugcucuuauuuaac

SEQ ID NO: 275802 - RNA, 22 nt, Human
cagcagcaguguucuagaaucu

SEQ ID NO: 275803 - RNA, 22 nt, Human
uccugcagcauccgucgucugu

SEQ ID NO: 275804 - RNA, 22 nt, Human
ggagcccuugcugaccuuccaa

SEQ ID NO: 275805 - RNA, 22 nt, Human
agcacuauuccaaugauccaau

SEQ ID NO: 275806 - RNA, 22 nt, Human
auucauuuagguauucacuuac

SEQ ID NO: 275807 - RNA, 21 nt, Human
ucuccccauucuuauucccau

SEQ ID NO: 275808 - RNA, 22 nt, Human
uguacaugaauaaaagaucuug

SEQ ID NO: 275809 - RNA, 22 nt, Human
ugagaaccucgaagauuuugcc

SEQ ID NO: 275810 - RNA, 22 nt, Human
ugggaagcacgcucagcagaaa

SEQ ID NO: 275811 - RNA, 22 nt, Human
aaagaucaauagauaaagcuac

SEQ ID NO: 275812 - RNA, 22 nt, Human
ggcccugcaagguacccaggcc

SEQ ID NO: 275813 - RNA, 18 nt, Human
ugcugggcauuaggcuua

SEQ ID NO: 275814 - RNA, 22 nt, Human
ucaugccacuuacaaaauaaug

SEQ ID NO: 275815 - RNA, 22 nt, Human
cugcaggagugaaagcaggccu

SEQ ID NO: 275816 - RNA, 23 nt, Human
cauggcugauuucaagcuaccac

SEQ ID NO: 275817 - RNA, 22 nt, Human
gcagcccugcagcuccacaccg

SEQ ID NO: 275818 - RNA, 22 nt, Human
gagcuuggggcauauggugcua

SEQ ID NO: 275819 - RNA, 19 nt, Human
ucuccagcuuugggcuuuu

SEQ ID NO: 275820 - RNA, 22 nt, Human
caggaagcugaugucuagucau

SEQ ID NO: 275821 - RNA, 22 nt, Human
caggagcaaggagcagugggau

SEQ ID NO: 275822 - RNA, 22 nt, Human
acuacauucaugcucguguugg

SEQ ID NO: 275823 - RNA, 22 nt, Human
caccuucagaaugcuccaggca

SEQ ID NO: 275824 - RNA, 22 nt, Human
gcagccuguuguaccagccugu

SEQ ID NO: 275825 - RNA, 22 nt, Human
acugggagucaugaggaaggag

SEQ ID NO: 275826 - RNA, 22 nt, Human
uaguacaguggcauucaaacuu

SEQ ID NO: 275827 - RNA, 22 nt, Human
cccagagcugagggggcacguu

SEQ ID NO: 275828 - RNA, 22 nt, Human
gagaggugaauguggaugccac

SEQ ID NO: 275829 - RNA, 22 nt, Human
cuauuuuaacuugauuaccucu

SEQ ID NO: 275830 - RNA, 22 nt, Human
aaauccuaauaaugcacuagug

SEQ ID NO: 275831 - RNA, 22 nt, Human
agcagggggaguuagacuagau

SEQ ID NO: 275832 - RNA, 22 nt, Human
uguuuuggaacaaaagcuauuc

SEQ ID NO: 275833 - RNA, 22 nt, Human
aaauaacuuucuguguauaguc

SEQ ID NO: 275834 - RNA, 22 nt, Human
aaauucuaaggucacaauguug

SEQ ID NO: 275835 - RNA, 22 nt, Human
uacaugcuggugacuguagaca

SEQ ID NO: 275836 - RNA, 22 nt, Human
agucacugucaaagccacacac

SEQ ID NO: 275837 - RNA, 18 nt, Human
ggcagggaaaagauaggg

SEQ ID NO: 275838 - RNA, 18 nt, Human
cagugaggaugaaggguu

SEQ ID NO: 275839 - RNA, 22 nt, Human
aaagaaauaccuuucucagcuu

SEQ ID NO: 275840 - RNA, 22 nt, Human
acucccugcaagauuuuccaug

SEQ ID NO: 275841 - RNA, 22 nt, Human
cuggcacgcccacguaggcacu

SEQ ID NO: 275842 - RNA, 21 nt, Human
uccuugcuauuuuccucagcu

SEQ ID NO: 275843 - RNA, 22 nt, Human
uguaucuuucuguacuuuuaug

SEQ ID NO: 275844 - RNA, 19 nt, Human
agggccaggauucuggaac

SEQ ID NO: 275845 - RNA, 22 nt, Human
uaagugaugucuugguuaauga

SEQ ID NO: 275846 - RNA, 22 nt, Human
gacugucuccugucaugaggga

SEQ ID NO: 275847 - RNA, 22 nt, Human
aguugacucucaagauccuguu

SEQ ID NO: 275848 - RNA, 22 nt, Human
ugcaguuagccuaggauugagc

SEQ ID NO: 275849 - RNA, 22 nt, Human
ugagcaguaggucugaauagug

SEQ ID NO: 275850 - RNA, 22 nt, Human
uuccuuccauagcaaaacaugc

SEQ ID NO: 275851 - RNA, 22 nt, Human
aaggcugaaagaccuugaaccu

SEQ ID NO: 275852 - RNA, 22 nt, Human
guggccagaaccaggagaauga

SEQ ID NO: 275853 - RNA, 22 nt, Human
gcacacagacuaaccauauuuc

SEQ ID NO: 275854 - RNA, 22 nt, Human
cagugccucaggccagccugca

SEQ ID NO: 275855 - RNA, 22 nt, Human
gauggcagucaaccaggugagg

SEQ ID NO: 275856 - RNA, 22 nt, Human
aagauauauuuuggugauuuca

SEQ ID NO: 275857 - RNA, 22 nt, Human
gccuggagaaaggaagguggga

SEQ ID NO: 275858 - RNA, 22 nt, Human
gucuggggaagucagggcauca

SEQ ID NO: 275859 - RNA, 23 nt, Human
aggacagcaaaccccgccucccc

SEQ ID NO: 275860 - RNA, 22 nt, Human
auccacaguggggguggcggaa

SEQ ID NO: 275861 - RNA, 22 nt, Human
caggccagcguccagaacaagc

SEQ ID NO: 275862 - RNA, 22 nt, Human
aaaggccacacagagcagggag

SEQ ID NO: 275863 - RNA, 23 nt, Human
ucaaaguaguuuuauccaauaaa

SEQ ID NO: 275864 - RNA, 23 nt, Human
aucaaaugauuggccauucagug

SEQ ID NO: 275865 - RNA, 23 nt, Human
uagaaugucauucaaugauaugg

SEQ ID NO: 275866 - RNA, 22 nt, Human
cauguacaaaaggcaaaugccu

SEQ ID NO: 275867 - RNA, 22 nt, Human
agagcuuuucuguaauaacauc

SEQ ID NO: 275868 - RNA, 22 nt, Human
caucuugugaggaccuucuugc

SEQ ID NO: 275869 - RNA, 20 nt, Human
aggguggcaaguuagugaca

SEQ ID NO: 275870 - RNA, 18 nt, Human
gcuuggcugcagagagag

SEQ ID NO: 275871 - RNA, 22 nt, Human
gauaauaucugguuuauucacc

SEQ ID NO: 275872 - RNA, 22 nt, Human
uaaagccacuucauucuagucu

SEQ ID NO: 275873 - RNA, 22 nt, Human
uugauacaggcucuauuucauc

SEQ ID NO: 275874 - RNA, 22 nt, Human
cuccagugcucaugccguugac

SEQ ID NO: 275875 - RNA, 22 nt, Human
aucucuguaaaccauaaauuga

SEQ ID NO: 275876 - RNA, 22 nt, Human
aaacaaguguaaacuagucugu

SEQ ID NO: 275877 - RNA, 22 nt, Human
auuccuugcacaucagauaguu

SEQ ID NO: 275878 - RNA, 22 nt, Human
uacacguguguguauguacaua

SEQ ID NO: 275879 - RNA, 22 nt, Human
aguguuuggggugauuguaacc

SEQ ID NO: 275880 - RNA, 22 nt, Human
uucuguacaaguuguggcugcu

SEQ ID NO: 275881 - RNA, 22 nt, Human
ggcucugcucacagcccgcagc

SEQ ID NO: 275882 - RNA, 22 nt, Human
cacaggagagguuaaugggggc

SEQ ID NO: 275883 - RNA, 22 nt, Human
uaaaaugaucucucauguucuu

SEQ ID NO: 275884 - RNA, 22 nt, Human
ugagcagagcaguaacaggagc

SEQ ID NO: 275885 - RNA, 22 nt, Human
uucauucugggcucuaaggaac

SEQ ID NO: 275886 - RNA, 22 nt, Human
auaugaaaguaagcaugugugu

SEQ ID NO: 275887 - RNA, 22 nt, Human
ucagagcuuuggagaccaggaa

SEQ ID NO: 275888 - RNA, 22 nt, Human
ugucugugaccucuuaggcaag

SEQ ID NO: 275889 - RNA, 22 nt, Human
uucagaacaaccaugguuagau

SEQ ID NO: 275890 - RNA, 22 nt, Human
gucuagagugcuuccuagucau

SEQ ID NO: 275891 - RNA, 23 nt, Human
cuucagugugggacugcagcgug

SEQ ID NO: 275892 - RNA, 22 nt, Human
uccuggccugucuggaguagcu

SEQ ID NO: 275893 - RNA, 18 nt, Human
guuuacauuacugaauag

SEQ ID NO: 275894 - RNA, 22 nt, Human
gaggaaggcuaaggggcuuaga

SEQ ID NO: 275895 - RNA, 22 nt, Human
gagcagcugagcuggaaugaga

SEQ ID NO: 275896 - RNA, 22 nt, Human
auuuuacuuaguguaaugucca

SEQ ID NO: 275897 - RNA, 22 nt, Human
gcugagggcauguguggcgacu

SEQ ID NO: 275898 - RNA, 22 nt, Human
aggagccuggcuggcccacagg

SEQ ID NO: 275899 - RNA, 22 nt, Human
ugaggggagaagcagcagccug

SEQ ID NO: 275900 - RNA, 22 nt, Human
gagccugggacugggggucaug

SEQ ID NO: 275901 - RNA, 22 nt, Human
ucaguuuucucaucuguaauuu

SEQ ID NO: 275902 - RNA, 22 nt, Human
aggcccagacucagcggggcgg

SEQ ID NO: 275903 - RNA, 22 nt, Human
cccugacccuaucagagggcca

SEQ ID NO: 275904 - RNA, 22 nt, Human
ucucugaaugagauuacugccu

SEQ ID NO: 275905 - RNA, 22 nt, Human
aagcccagaugagaucccugga

SEQ ID NO: 275906 - RNA, 22 nt, Human
cuggagccugcaguuuucacuu

SEQ ID NO: 275907 - RNA, 22 nt, Human
aauucuauguucuugaguaaga

SEQ ID NO: 275908 - RNA, 22 nt, Human
ucaaaguauaauugcuuuuuug

SEQ ID NO: 275909 - RNA, 22 nt, Human
uugugaaaucguguuuggaagc

SEQ ID NO: 275910 - RNA, 22 nt, Human
gaggccagacugccuuuuauga

SEQ ID NO: 275911 - RNA, 22 nt, Human
aaaggcaguggguauguggauc

SEQ ID NO: 275912 - RNA, 22 nt, Human
cuggcugcagcuccgaggaaga

SEQ ID NO: 275913 - RNA, 22 nt, Human
cuccuucccuucaaguguuccu

SEQ ID NO: 275914 - RNA, 22 nt, Human
ccagagagcuacaaggcauaaa

SEQ ID NO: 275915 - RNA, 22 nt, Human
uucuuccucacacucucaccca

SEQ ID NO: 275916 - RNA, 22 nt, Human
ggauggagaugaccauggugac

SEQ ID NO: 275917 - RNA, 22 nt, Human
uugaaagaacucuucagagaua

SEQ ID NO: 275918 - RNA, 23 nt, Human
auguuaaacauaacugaagagcc

SEQ ID NO: 275919 - RNA, 22 nt, Human
agggccagccccacccucucug

SEQ ID NO: 275920 - RNA, 22 nt, Human
uugaacauuggcaauuucauau

SEQ ID NO: 275921 - RNA, 22 nt, Human
cugguggcaucuugagaugguu

SEQ ID NO: 275922 - RNA, 22 nt, Human
ucagcuuugaucucaggcaauc

SEQ ID NO: 275923 - RNA, 22 nt, Human
agggacacaugugauuauuuau

SEQ ID NO: 275924 - RNA, 22 nt, Human
cagcuguugugcugggcaguua

SEQ ID NO: 275925 - RNA, 22 nt, Human
guaacucuuuggaaaacauuuu

SEQ ID NO: 275926 - RNA, 19 nt, Human
uugugagcugaagaacagg

SEQ ID NO: 275927 - RNA, 22 nt, Human
ucucugcagucuugggcaggca

SEQ ID NO: 275928 - RNA, 22 nt, Human
cacagcuaugagcagccuagcu

SEQ ID NO: 275929 - RNA, 22 nt, Human
acauacaugggauuaaaaaauu

SEQ ID NO: 275930 - RNA, 22 nt, Human
gcccacaguuaaugggggcucu

SEQ ID NO: 275931 - RNA, 22 nt, Human
aguguccuggggcccuaaggcc

SEQ ID NO: 275932 - RNA, 22 nt, Human
cccagcugcaccucuauggccu

SEQ ID NO: 275933 - RNA, 22 nt, Human
cagagcugacccaaggauugaa

SEQ ID NO: 275934 - RNA, 18 nt, Human
aaugaaauguacaccuuu

SEQ ID NO: 275935 - RNA, 22 nt, Human
cuauacuacuauacagauguaa

SEQ ID NO: 275936 - RNA, 22 nt, Human
caggaagcaguagaacuuuucc

SEQ ID NO: 275937 - RNA, 22 nt, Human
gcauucuuuuuaggagguuccu

SEQ ID NO: 275938 - RNA, 22 nt, Human
aacaggacacugggauggcuac

SEQ ID NO: 275939 - RNA, 22 nt, Human
ucugagagucucugaggcagau

SEQ ID NO: 275940 - RNA, 22 nt, Human
gcucugggaauucagaaagccu

SEQ ID NO: 275941 - RNA, 22 nt, Human
agagagcccgggccagggcaca

SEQ ID NO: 275942 - RNA, 22 nt, Human
gcacagcacagcaacauguuuu

SEQ ID NO: 275943 - RNA, 22 nt, Human
uucaucaauguguuuaauaaug

SEQ ID NO: 275944 - RNA, 22 nt, Human
uuagaucauuuuagcuaaaugg

SEQ ID NO: 275945 - RNA, 22 nt, Human
uuguauuucgaugcacguguag

SEQ ID NO: 275946 - RNA, 22 nt, Human
ccagagcugcagguaaaaugcu

SEQ ID NO: 275947 - RNA, 22 nt, Human
uccaaauauucggucuuucuga

SEQ ID NO: 275948 - RNA, 22 nt, Human
gcugucuuguauguuguaggac

SEQ ID NO: 275949 - RNA, 22 nt, Human
gcuggagugcugaggugcagug

SEQ ID NO: 275950 - RNA, 22 nt, Human
aagaccuaaaauucccucagau

SEQ ID NO: 275951 - RNA, 22 nt, Human
aguacacacaguagaauagagu

SEQ ID NO: 275952 - RNA, 22 nt, Human
ugaggcuccagccaggccagca

SEQ ID NO: 275953 - RNA, 22 nt, Human
cuccuacacauagaugcuuuca

SEQ ID NO: 275954 - RNA, 22 nt, Human
aucagcaagcaugguuaggugu

SEQ ID NO: 275955 - RNA, 22 nt, Human
auguaucaauuaucugucugca

SEQ ID NO: 275956 - RNA, 22 nt, Human
auccaaaauuuacuguagcauu

SEQ ID NO: 275957 - RNA, 19 nt, Human
aggguuacccgcugccacc

SEQ ID NO: 275958 - RNA, 22 nt, Human
ugauuuuacuuagcaugauguu

SEQ ID NO: 275959 - RNA, 21 nt, Human
auuugcauuaaaauauuacgc

SEQ ID NO: 275960 - RNA, 22 nt, Human
gcuggcucugccccaccuguuc

SEQ ID NO: 275961 - RNA, 22 nt, Human
aggcccuuggguccucuccaca

SEQ ID NO: 275962 - RNA, 20 nt, Human
uacugggucuggguccugga

SEQ ID NO: 275963 - RNA, 22 nt, Human
ugcccaggcuucacccucagag

SEQ ID NO: 275964 - RNA, 22 nt, Human
ggaggagguggguuaaguugua

SEQ ID NO: 275965 - RNA, 22 nt, Human
ucaucucuuuuguauugggguu

SEQ ID NO: 275966 - RNA, 22 nt, Human
gugggggcaggcagugcuagga

SEQ ID NO: 275967 - RNA, 22 nt, Human
cccuguuuaagaaaccuguaaa

SEQ ID NO: 275968 - RNA, 18 nt, Human
auggaggcagagagcuga

SEQ ID NO: 275969 - RNA, 22 nt, Human
ccuguggcuuccacgaccuaau

SEQ ID NO: 275970 - RNA, 22 nt, Human
uuauuagguuauucucuguacu

SEQ ID NO: 275971 - RNA, 22 nt, Human
agcccagagccccggccauguu

SEQ ID NO: 275972 - RNA, 17 nt, Human
uugagucuggggucuac

SEQ ID NO: 275973 - RNA, 22 nt, Human
cucuaauacugaccaagucacc

SEQ ID NO: 275974 - RNA, 22 nt, Human
auuaaacugagcaaauuaacau

SEQ ID NO: 275975 - RNA, 22 nt, Human
gagcaguggucugaucuucuaa

SEQ ID NO: 275976 - RNA, 22 nt, Human
aguaaacauaauuuaccuguag

SEQ ID NO: 275977 - RNA, 22 nt, Human
gugcugcagagucucgugccgc

SEQ ID NO: 275978 - RNA, 22 nt, Human
cuggccugaggucggcuguagg

SEQ ID NO: 275979 - RNA, 22 nt, Human
uuccugugaagccgguggucuc

SEQ ID NO: 275980 - RNA, 22 nt, Human
cagggcagggccacacccccug

SEQ ID NO: 275981 - RNA, 22 nt, Human
aagggugggcccuggcagccau

SEQ ID NO: 275982 - RNA, 22 nt, Human
cuggagcugucuucacaggccu

SEQ ID NO: 275983 - RNA, 22 nt, Human
cuacagccagaugcagaaaguu

SEQ ID NO: 275984 - RNA, 22 nt, Human
gguggggcccuggcacugguau

SEQ ID NO: 275985 - RNA, 22 nt, Human
acauucuuauaagagugaggca

SEQ ID NO: 275986 - RNA, 22 nt, Human
acagguggucuuugcuccuuuu

SEQ ID NO: 275987 - RNA, 22 nt, Human
ugcagguggcuccagggacugc

SEQ ID NO: 275988 - RNA, 22 nt, Human
cauuuguucugauuucaaaagg

SEQ ID NO: 275989 - RNA, 22 nt, Human
uuauuaguguugauauuaggau

SEQ ID NO: 275990 - RNA, 22 nt, Human
acucagcacagcacugggaacc

SEQ ID NO: 275991 - RNA, 22 nt, Human
agagucuucuggggccacuuuc

SEQ ID NO: 275992 - RNA, 22 nt, Human
ugggccacggggguggagagcu

SEQ ID NO: 275993 - RNA, 22 nt, Human
acuuagaagaugcaguaaagca

SEQ ID NO: 275994 - RNA, 22 nt, Human
ccugcucugccaaguccucuuu

SEQ ID NO: 275995 - RNA, 16 nt, Human
agcccugccguguacu

SEQ ID NO: 275996 - RNA, 22 nt, Human
cacaagcuccuuauguggagaa

SEQ ID NO: 275997 - RNA, 22 nt, Human
gagacacacacaggagguggca

SEQ ID NO: 275998 - RNA, 22 nt, Human
aucuggauagguuguuuugcau

SEQ ID NO: 275999 - RNA, 22 nt, Human
acugggaaucucaggaacaugg

SEQ ID NO: 276000 - RNA, 22 nt, Human
uuugugaaaugaagucacaacu

SEQ ID NO: 276001 - RNA, 22 nt, Human
ucagagguaagggcugagagga

SEQ ID NO: 276002 - RNA, 22 nt, Human
cucagcagagaccagggaggaa

SEQ ID NO: 276003 - RNA, 22 nt, Human
agaagcugacagaugcagcagg

SEQ ID NO: 276004 - RNA, 20 nt, Human
ugaucaugugaaagucaugu

SEQ ID NO: 276005 - RNA, 22 nt, Human
gaggaaaauauucagggagguu

SEQ ID NO: 276006 - RNA, 22 nt, Human
aaggcuuccuggaggagguguc

SEQ ID NO: 276007 - RNA, 22 nt, Human
uccugggucucuuccuuaguuc

SEQ ID NO: 276008 - RNA, 20 nt, Human
aggcuccuccaggaugugug

SEQ ID NO: 276009 - RNA, 22 nt, Human
gaccauuuguugaaaagauuau

SEQ ID NO: 276010 - RNA, 22 nt, Human
caguggagagacuuuuacucuu

SEQ ID NO: 276011 - RNA, 20 nt, Human
ugcugcagacagggccauug

SEQ ID NO: 276012 - RNA, 22 nt, Human
ggaaggcugugccagaagaacu

SEQ ID NO: 276013 - RNA, 22 nt, Human
cuagaauaucauaugaagagac

SEQ ID NO: 276014 - RNA, 19 nt, Human
caccuacuuuuggauuugc

SEQ ID NO: 276015 - RNA, 22 nt, Human
agugcagugaugaauaaugguu

SEQ ID NO: 276016 - RNA, 21 nt, Human
ccugaaauucucacuagcuua

SEQ ID NO: 276017 - RNA, 22 nt, Human
acagguguccucacagggggug

SEQ ID NO: 276018 - RNA, 22 nt, Human
gagcugugccaaucugucuggg

SEQ ID NO: 276019 - RNA, 22 nt, Human
ucaggucuugagccaucaggau

SEQ ID NO: 276020 - RNA, 22 nt, Human
guucacuggcugugugacucug

SEQ ID NO: 276021 - RNA, 22 nt, Human
uucuaaacuucaauucuaaauu

SEQ ID NO: 276022 - RNA, 22 nt, Human
cuuagagccuuacucuucuugu

SEQ ID NO: 276023 - RNA, 22 nt, Human
gccagcuguaagcagugauucu

SEQ ID NO: 276024 - RNA, 22 nt, Human
auagagugauguaagguaugug

SEQ ID NO: 276025 - RNA, 23 nt, Human
cagggccaggcagcagcugucac

SEQ ID NO: 276026 - RNA, 22 nt, Human
cagggccugucacgacgcucau

SEQ ID NO: 276027 - RNA, 22 nt, Human
ugcuggaggggccugaccagga

SEQ ID NO: 276028 - RNA, 22 nt, Human
ccaaaguccauaguuuacauaa

SEQ ID NO: 276029 - RNA, 22 nt, Human
gccuagguaccagcagagagcc

SEQ ID NO: 276030 - RNA, 22 nt, Human
ccuccugcacuugcuuuccuuc

SEQ ID NO: 276031 - RNA, 22 nt, Human
uggcucugugucucccagcagc

SEQ ID NO: 276032 - RNA, 21 nt, Human
ucucuggaauuagaccauguu

SEQ ID NO: 276033 - RNA, 22 nt, Human
acaggaagugcuggcacuuaca

SEQ ID NO: 276034 - RNA, 22 nt, Human
agcccaaggcuucccugcuggc

SEQ ID NO: 276035 - RNA, 22 nt, Human
augaggauaccgcagggggcag

SEQ ID NO: 276036 - RNA, 22 nt, Human
aacuagcagcuaagacauaauu

SEQ ID NO: 276037 - RNA, 22 nt, Human
acauauuaacugcacuacacua

SEQ ID NO: 276038 - RNA, 22 nt, Human
gagagggugccuggaagccagg

SEQ ID NO: 276039 - RNA, 22 nt, Human
uauguuuuucaagugcacacua

SEQ ID NO: 276040 - RNA, 22 nt, Human
uauguguaggaggaggacaggg

SEQ ID NO: 276041 - RNA, 22 nt, Human
ccaggagcagccggcccaccug

SEQ ID NO: 276042 - RNA, 22 nt, Human
caucugcugcugaagccagcau

SEQ ID NO: 276043 - RNA, 22 nt, Human
auuguauuauaauuaggccaaa

SEQ ID NO: 276044 - RNA, 22 nt, Human
augaaacaguguguauagcaaa

SEQ ID NO: 276045 - RNA, 20 nt, Human
gaaaugugaccucuucugug

SEQ ID NO: 276046 - RNA, 22 nt, Human
gcucugggugaaggguaccauu

SEQ ID NO: 276047 - RNA, 22 nt, Human
caggcagugucccaggaagcca

SEQ ID NO: 276048 - RNA, 22 nt, Human
gggcugggauugcuugcuguga

SEQ ID NO: 276049 - RNA, 20 nt, Human
acaaaauagguacuggguag

SEQ ID NO: 276050 - RNA, 22 nt, Human
uuuguguuguacuucugugcau

SEQ ID NO: 276051 - RNA, 22 nt, Human
agguagaucaacuggggaggga

SEQ ID NO: 276052 - RNA, 22 nt, Human
acuuaguauuuuucagcuuuga

SEQ ID NO: 276053 - RNA, 22 nt, Human
auucauguuagcccacauguag

SEQ ID NO: 276054 - RNA, 22 nt, Human
ucucagaaauacuauguuguca

SEQ ID NO: 276055 - RNA, 22 nt, Human
gccuuggcccacagugcuccug

SEQ ID NO: 276056 - RNA, 22 nt, Human
ugcccugcuucucuugggacag

SEQ ID NO: 276057 - RNA, 22 nt, Human
ugccaggcauuugacagacacu

SEQ ID NO: 276058 - RNA, 22 nt, Human
uaggguccucaucuguaaauga

SEQ ID NO: 276059 - RNA, 22 nt, Human
cauguaaaaaauuaggucaucu

SEQ ID NO: 276060 - RNA, 22 nt, Human
ggcucagguuuaaagugcuuua

SEQ ID NO: 276061 - RNA, 22 nt, Human
gcuguauuuauaugaaggcaug

SEQ ID NO: 276062 - RNA, 22 nt, Human
agcccggcuuccccgguugcua

SEQ ID NO: 276063 - RNA, 22 nt, Human
ugcagcaguguuccuuggcuug

SEQ ID NO: 276064 - RNA, 22 nt, Human
caggcugaggguuaggccuuag

SEQ ID NO: 276065 - RNA, 22 nt, Human
cuccucuggcuuccuggaggca

SEQ ID NO: 276066 - RNA, 22 nt, Human
agguucuugguguccagauuuc

SEQ ID NO: 276067 - RNA, 21 nt, Human
acagccaggaacaugaggggc

SEQ ID NO: 276068 - RNA, 22 nt, Human
cacugaaaggaaaccagagcau

SEQ ID NO: 276069 - RNA, 22 nt, Human
gcuggucagagagaaaggaggc

SEQ ID NO: 276070 - RNA, 22 nt, Human
aauagcaaaugcucauuugaaa

SEQ ID NO: 276071 - RNA, 16 nt, Human
ugagugggagaagggg

SEQ ID NO: 276072 - RNA, 22 nt, Human
aucacaauguacguuaaaaugu

SEQ ID NO: 276073 - RNA, 22 nt, Human
ucaaauugucaucuugauaaug

SEQ ID NO: 276074 - RNA, 22 nt, Human
uucuguuuacucagaaauacaa

SEQ ID NO: 276075 - RNA, 22 nt, Human
ccaggcucugacauagauggga

SEQ ID NO: 276076 - RNA, 22 nt, Human
aagaaucauccugcaagagucu

SEQ ID NO: 276077 - RNA, 22 nt, Human
uguuccuucacagcaguggaca

SEQ ID NO: 276078 - RNA, 22 nt, Human
cuggcuucccugucuuauggaa

SEQ ID NO: 276079 - RNA, 22 nt, Human
ccagguggcccugcccuacucu

SEQ ID NO: 276080 - RNA, 22 nt, Human
cacaacuuuaggaaccacauuc

SEQ ID NO: 276081 - RNA, 22 nt, Human
aaggccagaguugaacugcucc

SEQ ID NO: 276082 - RNA, 22 nt, Human
gggaggaaggcuugggugagua

SEQ ID NO: 276083 - RNA, 22 nt, Human
gccuggacaccgcccuugcaga

SEQ ID NO: 276084 - RNA, 22 nt, Human
uggagagcaaugaggggcaggc

SEQ ID NO: 276085 - RNA, 22 nt, Human
aaagguguugccuuggagaccu

SEQ ID NO: 276086 - RNA, 18 nt, Human
uggcucugccacucaccg

SEQ ID NO: 276087 - RNA, 22 nt, Human
aacuggugagauaaauuauuua

SEQ ID NO: 276088 - RNA, 22 nt, Human
gggaccugaggagggguuucag

SEQ ID NO: 276089 - RNA, 22 nt, Human
caauacugaguuuacauucauc

SEQ ID NO: 276090 - RNA, 22 nt, Human
cucuuagaaacuauagagauua

SEQ ID NO: 276091 - RNA, 22 nt, Human
agacaaaccuuguuuuaugaug

SEQ ID NO: 276092 - RNA, 22 nt, Human
caggagcucucaucgucagggc

SEQ ID NO: 276093 - RNA, 22 nt, Human
gcaccaggaagcuguuauagca

SEQ ID NO: 276094 - RNA, 22 nt, Human
uauaacugagaagauacauagu

SEQ ID NO: 276095 - RNA, 22 nt, Human
uuuucuagggugcuaaaugaac

SEQ ID NO: 276096 - RNA, 22 nt, Human
uaacaguuuugaguuuugcuuc

SEQ ID NO: 276097 - RNA, 21 nt, Human
agcaagcagaauccaucuaga

SEQ ID NO: 276098 - RNA, 22 nt, Human
guggcuuuggaauuguagacuc

SEQ ID NO: 276099 - RNA, 22 nt, Human
ccugcuggcugguagaguuccg

SEQ ID NO: 276100 - RNA, 22 nt, Human
cuuggaauugaugauuuucaua

SEQ ID NO: 276101 - RNA, 21 nt, Human
gugcacaguccugcacacagg

SEQ ID NO: 276102 - RNA, 22 nt, Human
uugcaaauuauauaagggaugc

SEQ ID NO: 276103 - RNA, 22 nt, Human
ggguuaaacaugcuauaugagu

SEQ ID NO: 276104 - RNA, 23 nt, Human
aacagcaggaugauagaggaggu

SEQ ID NO: 276105 - RNA, 23 nt, Human
ccacaggcacagaggcuugcauc

SEQ ID NO: 276106 - RNA, 22 nt, Human
uacauguaagacaugagacucu

SEQ ID NO: 276107 - RNA, 22 nt, Human
gcaggucuggcauagagccugc

SEQ ID NO: 276108 - RNA, 22 nt, Human
cagcagagguuggaacaguucu

SEQ ID NO: 276109 - RNA, 22 nt, Human
uucaggcaucccuacaguuagg

SEQ ID NO: 276110 - RNA, 22 nt, Human
ccucuggggcaucagacaaagg

SEQ ID NO: 276111 - RNA, 22 nt, Human
gcccuggagcuagacuaggaca

SEQ ID NO: 276112 - RNA, 22 nt, Human
ggauucagugucuguuaauagu

SEQ ID NO: 276113 - RNA, 22 nt, Human
ccuggguccacccugugaagua

SEQ ID NO: 276114 - RNA, 22 nt, Human
gcugcagagggaggggcucgca

SEQ ID NO: 276115 - RNA, 22 nt, Human
auggaaagccaguguuccauca

SEQ ID NO: 276116 - RNA, 22 nt, Human
gucccugguuugcccaggacca

SEQ ID NO: 276117 - RNA, 22 nt, Human
cauuuguuaaugcugcuuuuaa

SEQ ID NO: 276118 - RNA, 20 nt, Human
aggccaggaaauguaguucu

SEQ ID NO: 276119 - RNA, 22 nt, Human
auaaauuuucuugcuguacuua

SEQ ID NO: 276120 - RNA, 22 nt, Human
uccuuggagcucuccaagggau

SEQ ID NO: 276121 - RNA, 22 nt, Human
cucuccucugaaguggugaccc

SEQ ID NO: 276122 - RNA, 22 nt, Human
gguggcaccuugaucuuggacu

SEQ ID NO: 276123 - RNA, 22 nt, Human
uuccuagaaugguuagaaaaua

SEQ ID NO: 276124 - RNA, 22 nt, Human
ccucccuggccagagcagcagc

SEQ ID NO: 276125 - RNA, 19 nt, Human
gggcuucugggaucaagag

SEQ ID NO: 276126 - RNA, 22 nt, Human
cccaggcagaauuaguguuuca

SEQ ID NO: 276127 - RNA, 22 nt, Human
uguaacaguuauaacaaugugg

SEQ ID NO: 276128 - RNA, 22 nt, Human
cccaggaggguggccucugccc

SEQ ID NO: 276129 - RNA, 22 nt, Human
uuacugauggaacagagauaga

SEQ ID NO: 276130 - RNA, 22 nt, Human
aguccaggcucuuccugaagaa

SEQ ID NO: 276131 - RNA, 22 nt, Human
uugaggagaagacuuugcuucc

SEQ ID NO: 276132 - RNA, 22 nt, Human
aauaaucucccuuuuuguaugu

SEQ ID NO: 276133 - RNA, 22 nt, Human
ucagugcacagagauuuuuguu

SEQ ID NO: 276134 - RNA, 22 nt, Human
agugaaaucagguuuugacugc

SEQ ID NO: 276135 - RNA, 22 nt, Human
uggcugagagaagacggggaag

SEQ ID NO: 276136 - RNA, 22 nt, Human
cuucuccgacaaccgacgccgg

SEQ ID NO: 276137 - RNA, 22 nt, Human
aagggggcgaagacgugauuga

SEQ ID NO: 276138 - RNA, 22 nt, Human
auugaaaaugacauuugugccc

SEQ ID NO: 276139 - RNA, 19 nt, Human
ccagcagguucauuucagg

SEQ ID NO: 276140 - RNA, 22 nt, Human
uugcccugcguuaccaucucuu

SEQ ID NO: 276141 - RNA, 22 nt, Human
cagcugucagccggugcaggcu

SEQ ID NO: 276142 - RNA, 22 nt, Human
ccugaggcaaggacuugguggc

SEQ ID NO: 276143 - RNA, 22 nt, Human
cccagaggugcuucagaggugc

SEQ ID NO: 276144 - RNA, 22 nt, Human
agccaacagccagcaucaacca

SEQ ID NO: 276145 - RNA, 22 nt, Human
ccagcuuuugcacuggacuggg

SEQ ID NO: 276146 - RNA, 22 nt, Human
aggagcugauagucuauggaga

SEQ ID NO: 276147 - RNA, 22 nt, Human
gccagcaguccugcugugugcc

SEQ ID NO: 276148 - RNA, 20 nt, Human
uggccucugagaugccacgg

SEQ ID NO: 276149 - RNA, 22 nt, Human
uuuaagacuuagauuuauuggg

SEQ ID NO: 276150 - RNA, 22 nt, Human
uugcaggggaaggagcagagcu

SEQ ID NO: 276151 - RNA, 22 nt, Human
gacccugagcaaaagcaguucu

SEQ ID NO: 276152 - RNA, 22 nt, Human
uagcuugaguguuucauaaaua

SEQ ID NO: 276153 - RNA, 22 nt, Human
gacagggaggagcagagcuucu

SEQ ID NO: 276154 - RNA, 22 nt, Human
cagcuguuguguaucaggcaga

SEQ ID NO: 276155 - RNA, 20 nt, Human
aaaugcuuuugacacauauu

SEQ ID NO: 276156 - RNA, 22 nt, Human
uuuuccagauuggacuuagucc

SEQ ID NO: 276157 - RNA, 22 nt, Human
cucuagaaagauuguugaccaa

SEQ ID NO: 276158 - RNA, 22 nt, Human
ugcccugcggcuaucuagauga

SEQ ID NO: 276159 - RNA, 22 nt, Human
aggcugugaaauguggcaagga

SEQ ID NO: 276160 - RNA, 22 nt, Human
uuccuggcuucauacuuuguac

SEQ ID NO: 276161 - RNA, 22 nt, Human
agggucucuacgcacuagaggg

SEQ ID NO: 276162 - RNA, 22 nt, Human
aagaauauagauuuuuugaagu

SEQ ID NO: 276163 - RNA, 22 nt, Human
ccugagcuuuaaaagccaugua

SEQ ID NO: 276164 - RNA, 22 nt, Human
uaacagaauccuguuauugcca

SEQ ID NO: 276165 - RNA, 22 nt, Human
uuuacaauugguuuucucuaau

SEQ ID NO: 276166 - RNA, 22 nt, Human
aaugcuuugacuauaucuauaa

SEQ ID NO: 276167 - RNA, 22 nt, Human
agacagcugguagcacuuccug

SEQ ID NO: 276168 - RNA, 22 nt, Human
uccaggcuuuggggcaggagcg

SEQ ID NO: 276169 - RNA, 22 nt, Human
ugcagcccugugcacauccccu

SEQ ID NO: 276170 - RNA, 22 nt, Human
cugggucugggccuccuggagu

SEQ ID NO: 276171 - RNA, 22 nt, Human
uccuccaagcguggguguuuga

SEQ ID NO: 276172 - RNA, 22 nt, Human
uccugggagcccuugcuccacc

SEQ ID NO: 276173 - RNA, 22 nt, Human
aaaggcuauuucagggucagua

SEQ ID NO: 276174 - RNA, 22 nt, Human
augcacagaacaauuuuaagag

SEQ ID NO: 276175 - RNA, 17 nt, Human
ucugcagggggccgugu

SEQ ID NO: 276176 - RNA, 22 nt, Human
uagauucuacugucacuuaguu

SEQ ID NO: 276177 - RNA, 22 nt, Human
cugugcaguaggucagggcugg

SEQ ID NO: 276178 - RNA, 22 nt, Human
aagauuuucagcuaauggugca

SEQ ID NO: 276179 - RNA, 22 nt, Human
gcugguggugggccaguucugu

SEQ ID NO: 276180 - RNA, 22 nt, Human
uaaguucaagucuuggauauaa

SEQ ID NO: 276181 - RNA, 22 nt, Human
aaagccuuuuaugaucaguuaa

SEQ ID NO: 276182 - RNA, 22 nt, Human
aaggaggcacucgcucucaggg

SEQ ID NO: 276183 - RNA, 22 nt, Human
ugagcccagaagcccacucggc

SEQ ID NO: 276184 - RNA, 22 nt, Human
accugccuauggagccacaugg

SEQ ID NO: 276185 - RNA, 22 nt, Human
guauacaacuauuguuggguaa

SEQ ID NO: 276186 - RNA, 22 nt, Human
aggcucugcagugcuggaggac

SEQ ID NO: 276187 - RNA, 22 nt, Human
caucucaugggcaugccaagcu

SEQ ID NO: 276188 - RNA, 19 nt, Human
agagccagacagcauagga

SEQ ID NO: 276189 - RNA, 22 nt, Human
uuaggaaacaguagccuuugcu

SEQ ID NO: 276190 - RNA, 22 nt, Human
uuauaacaucaaucagaguuaa

SEQ ID NO: 276191 - RNA, 22 nt, Human
uucauguaggcugcaaugcaca

SEQ ID NO: 276192 - RNA, 22 nt, Human
acaggcaggagcuccccauucc

SEQ ID NO: 276193 - RNA, 22 nt, Human
agugcacaacaugcagguuugu

SEQ ID NO: 276194 - RNA, 21 nt, Human
caggcuugaggaaugugccug

SEQ ID NO: 276195 - RNA, 22 nt, Human
agcuuuaaaaauccaauaucca

SEQ ID NO: 276196 - RNA, 22 nt, Human
gguggacaguguuagcucuggg

SEQ ID NO: 276197 - RNA, 22 nt, Human
auagauuauuugcucauuacuu

SEQ ID NO: 276198 - RNA, 22 nt, Human
acuggcagaggauagcacuaau

SEQ ID NO: 276199 - RNA, 22 nt, Human
uagguaguuuccuguuguuggg

SEQ ID NO: 276200 - RNA, 22 nt, Human
acccuugguuuugcagagcugu

SEQ ID NO: 276201 - RNA, 22 nt, Human
aaaagucugcucucauuucaga

SEQ ID NO: 276202 - RNA, 22 nt, Human
ugaaaucugucccacuuuagcu

SEQ ID NO: 276203 - RNA, 22 nt, Human
cuauuuuaagaggccauuaggu

SEQ ID NO: 276204 - RNA, 22 nt, Human
cugcugagccgcacccaggagc

SEQ ID NO: 276205 - RNA, 22 nt, Human
aacaaugcacuaucguaagugg

SEQ ID NO: 276206 - RNA, 22 nt, Human
uaggcuggaggaagcagugccu

SEQ ID NO: 276207 - RNA, 22 nt, Human
ucaauaaauagcuuggcucagc

SEQ ID NO: 276208 - RNA, 21 nt, Human
uuaccaauggcuucucuuucc

SEQ ID NO: 276209 - RNA, 22 nt, Human
uuucuucucuaaucucaaugau

SEQ ID NO: 276210 - RNA, 22 nt, Human
gcuuuugugagauuaagcuacu

SEQ ID NO: 276211 - RNA, 22 nt, Human
gggaaacucacaggugcagggg

SEQ ID NO: 276212 - RNA, 22 nt, Human
acaggggcuccgaaggugaggg

SEQ ID NO: 276213 - RNA, 22 nt, Human
aguuuccucaucuguaaaauga

SEQ ID NO: 276214 - RNA, 22 nt, Human
cuccagggagcugcgggagcca

SEQ ID NO: 276215 - RNA, 22 nt, Human
agcuggguugacaagauggaaa

SEQ ID NO: 276216 - RNA, 22 nt, Human
ucucugggguagggcccaggac

SEQ ID NO: 276217 - RNA, 22 nt, Human
auucagaaauagaaaauuugau

SEQ ID NO: 276218 - RNA, 21 nt, Human
uuuuauugaugaauggccacu

SEQ ID NO: 276219 - RNA, 22 nt, Human
acuuauuagacaucuucauugu

SEQ ID NO: 276220 - RNA, 22 nt, Human
cucuggcuguuugcagcucaag

SEQ ID NO: 276221 - RNA, 22 nt, Human
ugcugaggucauuuccaaguga

SEQ ID NO: 276222 - RNA, 22 nt, Human
acauuucucagggaguuuugcu

SEQ ID NO: 276223 - RNA, 22 nt, Human
ucaucauaauauggaaucuugu

SEQ ID NO: 276224 - RNA, 22 nt, Human
acagucuuaugcauacacuauu

SEQ ID NO: 276225 - RNA, 22 nt, Human
aagucaugaguccucuucugug

SEQ ID NO: 276226 - RNA, 22 nt, Human
uguucaguccaauguuggaaaa

SEQ ID NO: 276227 - RNA, 22 nt, Human
cugggccuaacccacagcguuu

SEQ ID NO: 276228 - RNA, 22 nt, Human
cagugggguuucugugggugcu

SEQ ID NO: 276229 - RNA, 22 nt, Human
agcuggugugccaguuccaguu

SEQ ID NO: 276230 - RNA, 22 nt, Human
aaugcuuuaaauccuaguguaa

SEQ ID NO: 276231 - RNA, 22 nt, Human
guccagagggcugcaggaugcu

SEQ ID NO: 276232 - RNA, 22 nt, Human
ugaccugcguaggugguuucug

SEQ ID NO: 276233 - RNA, 22 nt, Human
gaguccaguuagugaggcuggg

SEQ ID NO: 276234 - RNA, 22 nt, Human
ggcuggagauaugucuggaaca

SEQ ID NO: 276235 - RNA, 22 nt, Human
ucugugcugucucagagaaagc

SEQ ID NO: 276236 - RNA, 22 nt, Human
cuugaagaaaguauguugggau

SEQ ID NO: 276237 - RNA, 22 nt, Human
cagcuggcauaccugggcccgg

SEQ ID NO: 276238 - RNA, 22 nt, Human
uauucaugagauaggcaguuuu

SEQ ID NO: 276239 - RNA, 22 nt, Human
gaaaaggcucucacucccuccg

SEQ ID NO: 276240 - RNA, 22 nt, Human
uuuugcccuugcuagaucacug

SEQ ID NO: 276241 - RNA, 22 nt, Human
ugguggaaggcagagcuacacc

SEQ ID NO: 276242 - RNA, 22 nt, Human
agacagaauuugucagauaaau

SEQ ID NO: 276243 - RNA, 21 nt, Human
uccauccaucaguccagccag

SEQ ID NO: 276244 - RNA, 22 nt, Human
ccuuuucuauccuucuagguuc

SEQ ID NO: 276245 - RNA, 22 nt, Human
augcccaaugucacaauuuuug

SEQ ID NO: 276246 - RNA, 22 nt, Human
cuuucuuauaccugucagggcc

SEQ ID NO: 276247 - RNA, 22 nt, Human
gugcaaucugguuaauacgacu

SEQ ID NO: 276248 - RNA, 22 nt, Human
uuagaacaauauucucccuaca

SEQ ID NO: 276249 - RNA, 22 nt, Human
ccuugagacacagccaaagaug

SEQ ID NO: 276250 - RNA, 22 nt, Human
ggugaggguaaauauaggcaaa

SEQ ID NO: 276251 - RNA, 22 nt, Human
agcucccugagaugccacagca

SEQ ID NO: 276252 - RNA, 22 nt, Human
guuguuuuaaaauacuccagaa

SEQ ID NO: 276253 - RNA, 22 nt, Human
augaaggauagggcaaaauuuu

SEQ ID NO: 276254 - RNA, 21 nt, Human
uaaaacuguaacuuuguccug

SEQ ID NO: 276255 - RNA, 22 nt, Human
gaacaguaacugucugcugugu

SEQ ID NO: 276256 - RNA, 18 nt, Human
caugucugcgccacaagg

SEQ ID NO: 276257 - RNA, 22 nt, Human
ccuggcaacauuucaaggucuu

SEQ ID NO: 276258 - RNA, 22 nt, Human
agcuucucggcugggaguauuu

SEQ ID NO: 276259 - RNA, 22 nt, Human
aaugaacauggacaaguuaaua

SEQ ID NO: 276260 - RNA, 21 nt, Human
caauaaacugcacauugagac

SEQ ID NO: 276261 - RNA, 22 nt, Human
ccugcccagcuucccgagugca

SEQ ID NO: 276262 - RNA, 18 nt, Human
uccagcaggucugaggug

SEQ ID NO: 276263 - RNA, 22 nt, Human
gcuaucuuucugcaccauaauu

SEQ ID NO: 276264 - RNA, 22 nt, Human
aucauggaagccuaucuugaga

SEQ ID NO: 276265 - RNA, 22 nt, Human
uggguccuucaaagcugggucu

SEQ ID NO: 276266 - RNA, 22 nt, Human
gggccagucugacucugcuggu

SEQ ID NO: 276267 - RNA, 22 nt, Human
accugcagguguuuccacacuu

SEQ ID NO: 276268 - RNA, 22 nt, Human
auaaauuuauaauuguuuccug

SEQ ID NO: 276269 - RNA, 22 nt, Human
gccacugucauacccuggcaau

SEQ ID NO: 276270 - RNA, 22 nt, Human
gucaauaucuugguuguacuau

SEQ ID NO: 276271 - RNA, 22 nt, Human
uccuccugcuguuagucuugaa

SEQ ID NO: 276272 - RNA, 22 nt, Human
aguguucuuccuaucugcuguu

SEQ ID NO: 276273 - RNA, 22 nt, Human
ccaggcagaaugaaaccccugu

SEQ ID NO: 276274 - RNA, 20 nt, Human
agcaaacucuucccaucuuc

SEQ ID NO: 276275 - RNA, 22 nt, Human
ggcagcuuacguuuugcuagug

SEQ ID NO: 276276 - RNA, 22 nt, Human
ucaacaauugcauguugauguu

SEQ ID NO: 276277 - RNA, 17 nt, Human
gugaagagucauugaau

SEQ ID NO: 276278 - RNA, 22 nt, Human
aaggcauaggacaaaucaguga

SEQ ID NO: 276279 - RNA, 22 nt, Human
auuagguugagguacucagagc

SEQ ID NO: 276280 - RNA, 22 nt, Human
ucugcagcccaaagucucuuag

SEQ ID NO: 276281 - RNA, 22 nt, Human
ucuggcagcaagauaacaaugg

SEQ ID NO: 276282 - RNA, 23 nt, Human
ucugggcaccuuguugacaugau

SEQ ID NO: 276283 - RNA, 22 nt, Human
gcaggccuccccugcuggagcu

SEQ ID NO: 276284 - RNA, 22 nt, Human
ugguucagagaguugcugacca

SEQ ID NO: 276285 - RNA, 20 nt, Human
ccagcacccucucagcugaa

SEQ ID NO: 276286 - RNA, 22 nt, Human
agagucaguuagcgaauacuua

SEQ ID NO: 276287 - RNA, 22 nt, Human
uguuuaauugggccaacagcgg

SEQ ID NO: 276288 - RNA, 22 nt, Human
cauuagaaccuauaaaaagcau

SEQ ID NO: 276289 - RNA, 22 nt, Human
uggcuccaggggacacgcagua

SEQ ID NO: 276290 - RNA, 22 nt, Human
ucagagauggaguuagcaguga

SEQ ID NO: 276291 - RNA, 22 nt, Human
ucugcucuguacugcacuggcc

SEQ ID NO: 276292 - RNA, 21 nt, Human
ccuagccucuuacccagcuuu

SEQ ID NO: 276293 - RNA, 22 nt, Human
aaguguauuuuuguacuaacau

SEQ ID NO: 276294 - RNA, 23 nt, Human
ucuggcucuaugugacagcucuc

SEQ ID NO: 276295 - RNA, 20 nt, Human
aagggagaauaaugauugua

SEQ ID NO: 276296 - RNA, 22 nt, Human
uuagcaaauaucuugaaacagg

SEQ ID NO: 276297 - RNA, 22 nt, Human
augugacaauauuuggucuuau

SEQ ID NO: 276298 - RNA, 22 nt, Human
uuuaucagaggcuauguuucau

SEQ ID NO: 276299 - RNA, 23 nt, Human
uaauucacauauacauugcuuca

SEQ ID NO: 276300 - RNA, 22 nt, Human
cccugugcacacacuucacucu

SEQ ID NO: 276301 - RNA, 22 nt, Human
cuagaacuacaucuuuuaauag

SEQ ID NO: 276302 - RNA, 22 nt, Human
ucucuggcagacaccucccuga

SEQ ID NO: 276303 - RNA, 18 nt, Human
ucuguguucugucauugc

SEQ ID NO: 276304 - RNA, 22 nt, Human
uuuuccucaccuaacucaaggu

SEQ ID NO: 276305 - RNA, 22 nt, Human
ucacaggcccaaaccacgcuua

SEQ ID NO: 276306 - RNA, 22 nt, Human
uuccuggcgccacggagccggu

SEQ ID NO: 276307 - RNA, 22 nt, Human
gaagccaucuuuguuccccacc

SEQ ID NO: 276308 - RNA, 22 nt, Human
auucacaaaaugauauagauac

SEQ ID NO: 276309 - RNA, 22 nt, Human
gaaggagagggucaaggauaau

SEQ ID NO: 276310 - RNA, 22 nt, Human
aaagccagcaaggugaguuuca

SEQ ID NO: 276311 - RNA, 22 nt, Human
ggcaggcugggagucaucagag

SEQ ID NO: 276312 - RNA, 22 nt, Human
acuggcugaggaaguugccacu

SEQ ID NO: 276313 - RNA, 22 nt, Human
ugggaggagcccucugggaagg

SEQ ID NO: 276314 - RNA, 22 nt, Human
caggcucccuucucggaauucu

SEQ ID NO: 276315 - RNA, 22 nt, Human
cugccugcaucccacagugggg

SEQ ID NO: 276316 - RNA, 22 nt, Human
cuauuucaaggcccagauauga

SEQ ID NO: 276317 - RNA, 22 nt, Human
gcuggaguuaggugggcuugaa

SEQ ID NO: 276318 - RNA, 22 nt, Human
agcuucucagcuucagaacugu

SEQ ID NO: 276319 - RNA, 22 nt, Human
uauuacagaaucaggcauaacu

SEQ ID NO: 276320 - RNA, 22 nt, Human
ugcuauuuuuaucuugaucaaa

SEQ ID NO: 276321 - RNA, 22 nt, Human
agaguuuacagaaauaagcugu

SEQ ID NO: 276322 - RNA, 22 nt, Human
gcagacagccagacugcacugg

SEQ ID NO: 276323 - RNA, 22 nt, Human
uuucugugguggguaguucaga

SEQ ID NO: 276324 - RNA, 22 nt, Human
gcuguggcugacauugcagaca

SEQ ID NO: 276325 - RNA, 22 nt, Human
uuuccuucuuagcgguguucuu

SEQ ID NO: 276326 - RNA, 20 nt, Human
gcagccucaacaggcacagc

SEQ ID NO: 276327 - RNA, 22 nt, Human
guuagggagucagguggcucuu

SEQ ID NO: 276328 - RNA, 22 nt, Human
uaggcucagugaguagggaguu

SEQ ID NO: 276329 - RNA, 22 nt, Human
gacagcauccaagagggaggga

SEQ ID NO: 276330 - RNA, 22 nt, Human
gacuuugguucagggcucagag

SEQ ID NO: 276331 - RNA, 22 nt, Human
acaugacuauaauuacuuaaau

SEQ ID NO: 276332 - RNA, 21 nt, Human
gauuuaguggcuguucuaccu

SEQ ID NO: 276333 - RNA, 22 nt, Human
aggagcugggcugcugcuggga

SEQ ID NO: 276334 - RNA, 22 nt, Human
uuuuccaaaguaccaugucccu

SEQ ID NO: 276335 - RNA, 22 nt, Human
guagaaccuucuuuacuagagu

SEQ ID NO: 276336 - RNA, 22 nt, Human
uacaacaugugguccuuuauga

SEQ ID NO: 276337 - RNA, 22 nt, Human
aaugggcucacaagaccugaau

SEQ ID NO: 276338 - RNA, 22 nt, Human
ugcagcugccuagggcuggcuu

SEQ ID NO: 276339 - RNA, 21 nt, Human
gggaucugaggcaagucuccu

SEQ ID NO: 276340 - RNA, 22 nt, Human
cauuccuuaacguggggagucu

SEQ ID NO: 276341 - RNA, 22 nt, Human
guucacaauggcuuuaccuaag

SEQ ID NO: 276342 - RNA, 22 nt, Human
acaguuuguguuggccaugggc

SEQ ID NO: 276343 - RNA, 22 nt, Human
gcugagacuuccacugccaucu

SEQ ID NO: 276344 - RNA, 22 nt, Human
ugaggcaagaguuugauuagag

SEQ ID NO: 276345 - RNA, 18 nt, Human
uucuccagaaaacauagc

SEQ ID NO: 276346 - RNA, 22 nt, Human
ccuggccagccagggcuggggu

SEQ ID NO: 276347 - RNA, 22 nt, Human
aagcuacaauguguuuuugaaa

SEQ ID NO: 276348 - RNA, 22 nt, Human
aacaagaagggaaggcaugauu

SEQ ID NO: 276349 - RNA, 22 nt, Human
cacccagcacagagggaggcga

SEQ ID NO: 276350 - RNA, 22 nt, Human
acuauucaccuuucaugcagga

SEQ ID NO: 276351 - RNA, 22 nt, Human
agcugcaaguccaaaggaauua

SEQ ID NO: 276352 - RNA, 22 nt, Human
ucauggcacaugcccuccaggg

SEQ ID NO: 276353 - RNA, 22 nt, Human
gcucuggccagacccucagugg

SEQ ID NO: 276354 - RNA, 22 nt, Human
ucugaaauauauuuugaguguu

SEQ ID NO: 276355 - RNA, 22 nt, Human
ugagaggauauuuugggaggau

SEQ ID NO: 276356 - RNA, 22 nt, Human
aauguggccacuuuuuucuggg

SEQ ID NO: 276357 - RNA, 22 nt, Human
gaggcugugugucccucuggac

SEQ ID NO: 276358 - RNA, 22 nt, Human
ucauugaaugagaugcaauaga

SEQ ID NO: 276359 - RNA, 22 nt, Human
ugaggcaggacauggacaacug

SEQ ID NO: 276360 - RNA, 22 nt, Human
uucuuggccaccagaucucacu

SEQ ID NO: 276361 - RNA, 22 nt, Human
uucuuuggggaauauucugguu

SEQ ID NO: 276362 - RNA, 22 nt, Human
gcuccugucaucaaacaauccu

SEQ ID NO: 276363 - RNA, 17 nt, Human
agugacuuggaaagagc

SEQ ID NO: 276364 - RNA, 22 nt, Human
ugcccagaauagaugggcugug

SEQ ID NO: 276365 - RNA, 22 nt, Human
acuuuacaaacuccucacuguu

SEQ ID NO: 276366 - RNA, 22 nt, Human
cucuuccuacagucugcuaugc

SEQ ID NO: 276367 - RNA, 22 nt, Human
acagaaagaugauuugaaaugg

SEQ ID NO: 276368 - RNA, 22 nt, Human
uugagucuccucagcagggcua

SEQ ID NO: 276369 - RNA, 22 nt, Human
uaauaucuacuucauagaguuu

SEQ ID NO: 276370 - RNA, 22 nt, Human
ucaggugggaguagaaugcuag

SEQ ID NO: 276371 - RNA, 22 nt, Human
gaaaguauuagccuagaaguca

SEQ ID NO: 276372 - RNA, 22 nt, Human
cagagucaauguccaagaagcu

SEQ ID NO: 276373 - RNA, 22 nt, Human
uaggaaauuggaaacucuucac

SEQ ID NO: 276374 - RNA, 22 nt, Human
agaagucauuuauguuagauga

SEQ ID NO: 276375 - RNA, 22 nt, Human
cuauucaacuugacuguuucac

SEQ ID NO: 276376 - RNA, 22 nt, Human
aaagucuuuauuuuguaucuuu

SEQ ID NO: 276377 - RNA, 22 nt, Human
ugcuuaaacauacuauuuauau

SEQ ID NO: 276378 - RNA, 22 nt, Human
uuucuaguucucugccaaaaaa

SEQ ID NO: 276379 - RNA, 22 nt, Human
cuuggagacaggacaggcagaa

SEQ ID NO: 276380 - RNA, 22 nt, Human
ucuauuucgcauauaaguuuug

SEQ ID NO: 276381 - RNA, 22 nt, Human
cccagggacagaugggcagcua

SEQ ID NO: 276382 - RNA, 22 nt, Human
uauagaucuugcuauuuaagga

SEQ ID NO: 276383 - RNA, 22 nt, Human
ccauucugacuucauugccuca

SEQ ID NO: 276384 - RNA, 22 nt, Human
agccuggauccuaggcucagcu

SEQ ID NO: 276385 - RNA, 20 nt, Human
gucuucuauucccagaaagu

SEQ ID NO: 276386 - RNA, 18 nt, Human
ggccuuaguaugugccuu

SEQ ID NO: 276387 - RNA, 22 nt, Human
aauuucaaagcucacuggcaua

SEQ ID NO: 276388 - RNA, 22 nt, Human
cucuggguucacugaggcucug

SEQ ID NO: 276389 - RNA, 22 nt, Human
ugggccuccugcccuggccuag

SEQ ID NO: 276390 - RNA, 22 nt, Human
gaggugucccugacccuuugca

SEQ ID NO: 276391 - RNA, 22 nt, Human
gguguccucacuauagcaaguc

SEQ ID NO: 276392 - RNA, 22 nt, Human
uuagauaaauuaagacuuuaca

SEQ ID NO: 276393 - RNA, 22 nt, Human
ccagcugguuaaaauagagaaa

SEQ ID NO: 276394 - RNA, 22 nt, Human
gggcagcucugcccaucagagg

SEQ ID NO: 276395 - RNA, 23 nt, Human
cagugggaggacugagauaaaac

SEQ ID NO: 276396 - RNA, 22 nt, Human
ccaggccuggacggguggccug

SEQ ID NO: 276397 - RNA, 22 nt, Human
caguuuuagcuagagcaaacca

SEQ ID NO: 276398 - RNA, 22 nt, Human
aagggcugaucucacuuucuuu

SEQ ID NO: 276399 - RNA, 22 nt, Human
cugaaacuggucaauuaaucug

SEQ ID NO: 276400 - RNA, 18 nt, Human
acagcagguuucauucuu

SEQ ID NO: 276401 - RNA, 22 nt, Human
ugcucauuugcccauuagcauc

SEQ ID NO: 276402 - RNA, 22 nt, Human
gccugagcuuuaauuuucuugu

SEQ ID NO: 276403 - RNA, 22 nt, Human
ggcucugccgugugcucacaug

SEQ ID NO: 276404 - RNA, 22 nt, Human
ccugcaccugagcagccugacu

SEQ ID NO: 276405 - RNA, 22 nt, Human
ucuccuggcucaccaggcugga

SEQ ID NO: 276406 - RNA, 22 nt, Human
cauugcugugggcauuugcugc

SEQ ID NO: 276407 - RNA, 22 nt, Human
ccucccuucaguagagcccaau

SEQ ID NO: 276408 - RNA, 22 nt, Human
gagaggcauggaacagauucuu

SEQ ID NO: 276409 - RNA, 22 nt, Human
ccaggugugauuuggcaguguc

SEQ ID NO: 276410 - RNA, 22 nt, Human
agagcagcucgcuaccucucua

SEQ ID NO: 276411 - RNA, 22 nt, Human
ccucugggcagguagcagcagc

SEQ ID NO: 276412 - RNA, 22 nt, Human
uuggcagacuggguccugggga

SEQ ID NO: 276413 - RNA, 22 nt, Human
gaauguuauuggacagcagugg

SEQ ID NO: 276414 - RNA, 22 nt, Human
ccacccugagccgcaagagcag

SEQ ID NO: 276415 - RNA, 22 nt, Human
ucauucauugcuuacccugugu

SEQ ID NO: 276416 - RNA, 22 nt, Human
aaauaugaaugauaagaguuau

SEQ ID NO: 276417 - RNA, 21 nt, Human
aagcuuccaaacugcuggacu

SEQ ID NO: 276418 - RNA, 22 nt, Human
gaggggccuggcacugagcugg

SEQ ID NO: 276419 - RNA, 22 nt, Human
ggagaggugagagguacaaguu

SEQ ID NO: 276420 - RNA, 22 nt, Human
gaggcucccucaacucugggug

SEQ ID NO: 276421 - RNA, 22 nt, Human
cuggaggaauaauggcaucuug

SEQ ID NO: 276422 - RNA, 22 nt, Human
cagcccuguugcgcuuccggcg

SEQ ID NO: 276423 - RNA, 22 nt, Human
ggccuugacaguuaagagaccu

SEQ ID NO: 276424 - RNA, 22 nt, Human
cccaggaggugugcccaacucg

SEQ ID NO: 276425 - RNA, 22 nt, Human
acaggaagcuggagacccuuga

SEQ ID NO: 276426 - RNA, 16 nt, Human
cagccugcagugguca

SEQ ID NO: 276427 - RNA, 22 nt, Human
ucaaggaaggucuguugcucca

SEQ ID NO: 276428 - RNA, 22 nt, Human
cagcucaggaaggaaggccggc

SEQ ID NO: 276429 - RNA, 20 nt, Human
ggcuccuucuuucauggccc

SEQ ID NO: 276430 - RNA, 22 nt, Human
agugugaguaauucagggaggg

SEQ ID NO: 276431 - RNA, 22 nt, Human
cacaaaguuggacaacgcaccc

SEQ ID NO: 276432 - RNA, 22 nt, Human
ccugcccacugcccggucagcc

SEQ ID NO: 276433 - RNA, 22 nt, Human
ugcagaaauucagaaagcauaa

SEQ ID NO: 276434 - RNA, 22 nt, Human
gggcucugggaugcucuuagag

SEQ ID NO: 276435 - RNA, 22 nt, Human
agacaacuagaaaacuagacag

SEQ ID NO: 276436 - RNA, 17 nt, Human
aucuggaagcuagcuga

SEQ ID NO: 276437 - RNA, 22 nt, Human
uguagaacugacauuuuggacu

SEQ ID NO: 276438 - RNA, 22 nt, Human
auuggaaauacaguagaaaaau

SEQ ID NO: 276439 - RNA, 22 nt, Human
gccuccuggguucaugccauuc

SEQ ID NO: 276440 - RNA, 22 nt, Human
uucauugcaguucuucagguua

SEQ ID NO: 276441 - RNA, 22 nt, Human
uggagcugagaaguggagcucu

SEQ ID NO: 276442 - RNA, 22 nt, Human
gcacagugauaggcaguugugc

SEQ ID NO: 276443 - RNA, 22 nt, Human
uccauaaauuuuaugaacauau

SEQ ID NO: 276444 - RNA, 22 nt, Human
ucauaauacaaagaguucugca

SEQ ID NO: 276445 - RNA, 22 nt, Human
cugucccagauguucucagcac

SEQ ID NO: 276446 - RNA, 22 nt, Human
cuguuauuuuauaauucaagaa

SEQ ID NO: 276447 - RNA, 22 nt, Human
ugagagaguaauugagugguaa

SEQ ID NO: 276448 - RNA, 22 nt, Human
caagcugaacacugucuucaag

SEQ ID NO: 276449 - RNA, 22 nt, Human
cccugugcagauggcagcuggg

SEQ ID NO: 276450 - RNA, 22 nt, Human
aauacuauguagccaaaauaau

SEQ ID NO: 276451 - RNA, 22 nt, Human
ccccugccauagucaaaucuaa

SEQ ID NO: 276452 - RNA, 22 nt, Human
uucccucucacuuaaagcuugg

SEQ ID NO: 276453 - RNA, 22 nt, Human
aucuuuauuuauugagcacuua

SEQ ID NO: 276454 - RNA, 22 nt, Human
ucuguuuaggcaaaauagcuac

SEQ ID NO: 276455 - RNA, 22 nt, Human
auuucuauaggaggacaguauu

SEQ ID NO: 276456 - RNA, 22 nt, Human
uauacacaccuccaaagcagga

SEQ ID NO: 276457 - RNA, 22 nt, Human
gcucagaguuaaauauagugcu

SEQ ID NO: 276458 - RNA, 22 nt, Human
caguguggcuuagggaauaggc

SEQ ID NO: 276459 - RNA, 22 nt, Human
ucaauuuauguggcuauucauu

SEQ ID NO: 276460 - RNA, 22 nt, Human
agaggccaccagagguggugcc

SEQ ID NO: 276461 - RNA, 22 nt, Human
gcugggcugcgucggggaagcc

SEQ ID NO: 276462 - RNA, 23 nt, Human
aggaccagguucccaaaagucaa

SEQ ID NO: 276463 - RNA, 23 nt, Human
uuccuggcagguacaacuuuuac

SEQ ID NO: 276464 - RNA, 22 nt, Human
ggcagugguuagaaacaugagc

SEQ ID NO: 276465 - RNA, 22 nt, Human
uucuuuuaauugugggggagug

SEQ ID NO: 276466 - RNA, 22 nt, Human
cucugcagauucaucccuucac

SEQ ID NO: 276467 - RNA, 22 nt, Human
uuucacagucaauuuggaguca

SEQ ID NO: 276468 - RNA, 20 nt, Human
cugacucuccuuggcuugga

SEQ ID NO: 276469 - RNA, 22 nt, Human
ucugggaaccagugcggcuggg

SEQ ID NO: 276470 - RNA, 22 nt, Human
aagaaaugcugauguuggaugg

SEQ ID NO: 276471 - RNA, 22 nt, Human
acacugugucuagcauuuuaca

SEQ ID NO: 276472 - RNA, 23 nt, Human
ugagcccaggaggucaaggcugc

SEQ ID NO: 276473 - RNA, 21 nt, Human
agggaaaaggcugagugaggg

SEQ ID NO: 276474 - RNA, 22 nt, Human
uccuggcagaaauggggcugug

SEQ ID NO: 276475 - RNA, 22 nt, Human
cugccuggucucaggcaugggg

SEQ ID NO: 276476 - RNA, 22 nt, Human
aggaaagggguagguguggacg

SEQ ID NO: 276477 - RNA, 22 nt, Human
caauucaugugagcggacucuu

SEQ ID NO: 276478 - RNA, 22 nt, Human
gcugcccagggcugaguguccu

SEQ ID NO: 276479 - RNA, 22 nt, Human
gagggacagcuaaagagaaauu

SEQ ID NO: 276480 - RNA, 22 nt, Human
cagcugucucagggaggugauc

SEQ ID NO: 276481 - RNA, 22 nt, Human
cacacauggcugccagggaggu

SEQ ID NO: 276482 - RNA, 22 nt, Human
ccauggcaauggucagucuauu

SEQ ID NO: 276483 - RNA, 22 nt, Human
aguuguaauaacaauaccaaaa

SEQ ID NO: 276484 - RNA, 22 nt, Human
caaauguguagagcuuuugggg

SEQ ID NO: 276485 - RNA, 22 nt, Human
acuguucacagauuagucgaug

SEQ ID NO: 276486 - RNA, 22 nt, Human
cuccaggugcagaaggacucag

SEQ ID NO: 276487 - RNA, 22 nt, Human
auggccagagaggccagccugg

SEQ ID NO: 276488 - RNA, 22 nt, Human
aagauuuucucaacuguauuug

SEQ ID NO: 276489 - RNA, 22 nt, Human
agugucaaauuaaauaaucugg

SEQ ID NO: 276490 - RNA, 20 nt, Human
ugcauggcgcacaucugugg

SEQ ID NO: 276491 - RNA, 22 nt, Human
uuuauguuugacaaugaucugg

SEQ ID NO: 276492 - RNA, 22 nt, Human
aaacaggcuugcaacauguuuu

SEQ ID NO: 276493 - RNA, 22 nt, Human
ccuuagcauuagaagcuguggg

SEQ ID NO: 276494 - RNA, 22 nt, Human
aacugcaacuucguaaagugag

SEQ ID NO: 276495 - RNA, 22 nt, Human
ucucuccaacaugguggugcug

SEQ ID NO: 276496 - RNA, 22 nt, Human
gguggggagucaggcauucuug

SEQ ID NO: 276497 - RNA, 22 nt, Human
uucuucugacacugaugcugua

SEQ ID NO: 276498 - RNA, 22 nt, Human
augauugaaaaugacauugcca

SEQ ID NO: 276499 - RNA, 22 nt, Human
ugggagaaagaacccugaguga

SEQ ID NO: 276500 - RNA, 18 nt, Human
cucaggcagagaagcuuu

SEQ ID NO: 276501 - RNA, 22 nt, Human
ugcauuaaauauaaucuguuga

SEQ ID NO: 276502 - RNA, 22 nt, Human
ugagccagcaggccuccagugg

SEQ ID NO: 276503 - RNA, 22 nt, Human
ggaggugggagccuccaguggu

SEQ ID NO: 276504 - RNA, 20 nt, Human
aggcucugccauugucccug

SEQ ID NO: 276505 - RNA, 22 nt, Human
gguuuuaacuacagaauugcaa

SEQ ID NO: 276506 - RNA, 22 nt, Human
uuuauuauucuguucucucuac

SEQ ID NO: 276507 - RNA, 23 nt, Human
ggccuguguuuugucugaaguac

SEQ ID NO: 276508 - RNA, 22 nt, Human
ccaggcucagcgcgcacgucug

SEQ ID NO: 276509 - RNA, 23 nt, Human
gugagcagcccacuaggaaugcc

SEQ ID NO: 276510 - RNA, 23 nt, Human
agaggcugcaggguauugagaau

SEQ ID NO: 276511 - RNA, 22 nt, Human
cugagccaccggcagggacauc

SEQ ID NO: 276512 - RNA, 21 nt, Human
ucuccagugcuucugccucuu

SEQ ID NO: 276513 - RNA, 22 nt, Human
aggaugagauugcuguguugua

SEQ ID NO: 276514 - RNA, 22 nt, Human
aaaauaucagcaaagggugaca

SEQ ID NO: 276515 - RNA, 22 nt, Human
cuccucccugcgauugcucugc

SEQ ID NO: 276516 - RNA, 22 nt, Human
caaguccucgcuucuagcugug

SEQ ID NO: 276517 - RNA, 19 nt, Human
ucaaaacacaaaugguuga

SEQ ID NO: 276518 - RNA, 22 nt, Human
uucuguuaccuuugugaguuuc

SEQ ID NO: 276519 - RNA, 22 nt, Human
uuccugugaagaucugggugcu

SEQ ID NO: 276520 - RNA, 22 nt, Human
ucugcaggcuuauaggaugggu

SEQ ID NO: 276521 - RNA, 22 nt, Human
uauuauguagaguaaggguuaa

SEQ ID NO: 276522 - RNA, 21 nt, Human
agcucagccgggcacaguggc

SEQ ID NO: 276523 - RNA, 22 nt, Human
agacccacacuuugaguagcaa

SEQ ID NO: 276524 - RNA, 17 nt, Human
ugagacagggcaggccc

SEQ ID NO: 276525 - RNA, 21 nt, Human
uuuaucaucacgagcuugagc

SEQ ID NO: 276526 - RNA, 22 nt, Human
aaaucacugauuaaaguuagaa

SEQ ID NO: 276527 - RNA, 22 nt, Human
caagcuggcucuuaugcaaaaa

SEQ ID NO: 276528 - RNA, 19 nt, Human
ucuccaguuuauucuucca

SEQ ID NO: 276529 - RNA, 22 nt, Human
cauuguaagaggcuuugcagca

SEQ ID NO: 276530 - RNA, 22 nt, Human
augguacauaguuuaaauaagg

SEQ ID NO: 276531 - RNA, 22 nt, Human
gcugcuuuauaaucucggcaga

SEQ ID NO: 276532 - RNA, 22 nt, Human
gggcagcucuggcugugggaag

SEQ ID NO: 276533 - RNA, 22 nt, Human
agaaacugaacacaagagucgg

SEQ ID NO: 276534 - RNA, 22 nt, Human
aggaggaggugggacacaguga

SEQ ID NO: 276535 - RNA, 18 nt, Human
agacaaacuucuucugcc

SEQ ID NO: 276536 - RNA, 22 nt, Human
uagcugggacuacuggcccugc

SEQ ID NO: 276537 - RNA, 22 nt, Human
cagggcuccaugcagggacucc

SEQ ID NO: 276538 - RNA, 22 nt, Human
aggagagcaggccagccguccc

SEQ ID NO: 276539 - RNA, 22 nt, Human
acuugaaaccuuggcaaacaau

SEQ ID NO: 276540 - RNA, 22 nt, Human
ucucucagucagaugcuaaaga

SEQ ID NO: 276541 - RNA, 22 nt, Human
ccaccagcuucagcagccgcgg

SEQ ID NO: 276542 - RNA, 22 nt, Human
gcaauuauuaugugacuuuuac

SEQ ID NO: 276543 - RNA, 22 nt, Human
ugcauuauacuuuuagaaauuu

SEQ ID NO: 276544 - RNA, 22 nt, Human
ggcaucaguauggccauagggu

SEQ ID NO: 276545 - RNA, 22 nt, Human
uuucuagucucgaucucuuaau

SEQ ID NO: 276546 - RNA, 22 nt, Human
gaagacacuaaggcccagggag

SEQ ID NO: 276547 - RNA, 22 nt, Human
cauaaaagguagcaguuugaaa

SEQ ID NO: 276548 - RNA, 22 nt, Human
auauauaagcugaugagccaca

SEQ ID NO: 276549 - RNA, 22 nt, Human
gcugaaaugaaaacacaggucg

SEQ ID NO: 276550 - RNA, 22 nt, Human
cauggcuucuaagugauaacgu

SEQ ID NO: 276551 - RNA, 18 nt, Human
aaguaacagaagagcaca

SEQ ID NO: 276552 - RNA, 22 nt, Human
uccagcccugcacugauuagau

SEQ ID NO: 276553 - RNA, 21 nt, Human
ugaaaguuggagucaaaugua

SEQ ID NO: 276554 - RNA, 22 nt, Human
ccagcagagcuggaagugugcu

SEQ ID NO: 276555 - RNA, 22 nt, Human
uuccuggcacccuuguuagccu

SEQ ID NO: 276556 - RNA, 22 nt, Human
ugagcaauaugugaauuuucuu

SEQ ID NO: 276557 - RNA, 22 nt, Human
gcaccugggguacacagcuaca

SEQ ID NO: 276558 - RNA, 22 nt, Human
ucucuggguccuggcaagcuca

SEQ ID NO: 276559 - RNA, 22 nt, Human
ccaggccagcaggcacaccugc

SEQ ID NO: 276560 - RNA, 22 nt, Human
uacuguuaauguuaaauucagg

SEQ ID NO: 276561 - RNA, 22 nt, Human
aaacagcucaagaaguuacucu

SEQ ID NO: 276562 - RNA, 22 nt, Human
aggaaucugggcccaacugugc

SEQ ID NO: 276563 - RNA, 23 nt, Human
agcugggaauuuucugaagcuuu

SEQ ID NO: 276564 - RNA, 22 nt, Human
ucuuuacauaguguggacuacu

SEQ ID NO: 276565 - RNA, 22 nt, Human
ugucaccaccggaagaaacugc

SEQ ID NO: 276566 - RNA, 22 nt, Human
gacuuuggcaucuagacauugu

SEQ ID NO: 276567 - RNA, 22 nt, Human
ggcaaacaggagaguaaagaga

SEQ ID NO: 276568 - RNA, 22 nt, Human
cuucccagacgggguggcagcc

SEQ ID NO: 276569 - RNA, 18 nt, Human
ugucucaggcugaaacag

SEQ ID NO: 276570 - RNA, 22 nt, Human
cccaggcagagagcuggugagc

SEQ ID NO: 276571 - RNA, 21 nt, Human
cugccaccugcuccaucagca

SEQ ID NO: 276572 - RNA, 22 nt, Human
caggcaugagccaggccccucc

SEQ ID NO: 276573 - RNA, 20 nt, Human
cuccagccccugcccugguc

SEQ ID NO: 276574 - RNA, 22 nt, Human
uucugaggcuuucccguccccu

SEQ ID NO: 276575 - RNA, 22 nt, Human
uucugugauuccuccagccagc

SEQ ID NO: 276576 - RNA, 19 nt, Human
aggugaggggcaccauguc

SEQ ID NO: 276577 - RNA, 19 nt, Human
cauuuagaaguacauauua

SEQ ID NO: 276578 - RNA, 22 nt, Human
gcagggcaaugaucccgagagg

SEQ ID NO: 276579 - RNA, 22 nt, Human
gagcacuguacucauuugcacu

SEQ ID NO: 276580 - RNA, 22 nt, Human
acaaggcaguacaaugaugaca

SEQ ID NO: 276581 - RNA, 19 nt, Human
ccaacaguacugaagcacu

SEQ ID NO: 276582 - RNA, 22 nt, Human
gcuguggucugugagcuccaaa

SEQ ID NO: 276583 - RNA, 22 nt, Human
aggcucugcauccaggcuuuau

SEQ ID NO: 276584 - RNA, 22 nt, Human
ggcucuggcaaggggaggcuac

SEQ ID NO: 276585 - RNA, 22 nt, Human
auguguuuguaccuuuaaauau

SEQ ID NO: 276586 - RNA, 22 nt, Human
uagcaauagaaacauauaaagu

SEQ ID NO: 276587 - RNA, 22 nt, Human
uagagcugggcagugcucugag

SEQ ID NO: 276588 - RNA, 22 nt, Human
cgggcuggcugcagcugcugga

SEQ ID NO: 276589 - RNA, 22 nt, Human
gaguggagcaaaagagguagau

SEQ ID NO: 276590 - RNA, 22 nt, Human
uagacacaucuucauccacaau

SEQ ID NO: 276591 - RNA, 22 nt, Human
gagggcagaaaauuaugcggug

SEQ ID NO: 276592 - RNA, 22 nt, Human
aaacaaauuucaagcugugaca

SEQ ID NO: 276593 - RNA, 18 nt, Human
aggcaggugcuaauauuu

SEQ ID NO: 276594 - RNA, 23 nt, Human
ggaaaaacacugugucuuggcag

SEQ ID NO: 276595 - RNA, 22 nt, Human
uuccugaagucaaagaucuaaa

SEQ ID NO: 276596 - RNA, 22 nt, Human
ggacagagagugaauaugacau

SEQ ID NO: 276597 - RNA, 22 nt, Human
cagccacuggugccaggcuguu

SEQ ID NO: 276598 - RNA, 22 nt, Human
ugucagugucugagguuuuaua

SEQ ID NO: 276599 - RNA, 22 nt, Human
agauggcugauuaacuccaugg

SEQ ID NO: 276600 - RNA, 22 nt, Human
agauuccagaucccaaaaauga

SEQ ID NO: 276601 - RNA, 22 nt, Human
augugggccgugcggguguccu

SEQ ID NO: 276602 - RNA, 22 nt, Human
cugaggcagagagaacccgggc

SEQ ID NO: 276603 - RNA, 22 nt, Human
augguccuuauggccgugauau

SEQ ID NO: 276604 - RNA, 22 nt, Human
agauucuacucuagauccaugg

SEQ ID NO: 276605 - RNA, 22 nt, Human
aggcacagggaugcggagccag

SEQ ID NO: 276606 - RNA, 22 nt, Human
uagcaaccagaacagcacucua

SEQ ID NO: 276607 - RNA, 22 nt, Human
uucaucaggcaucaugcucaag

SEQ ID NO: 276608 - RNA, 22 nt, Human
agcaggauuuugaagugcaagu

SEQ ID NO: 276609 - RNA, 22 nt, Human
ucaggaaauggacaucuuugcu

SEQ ID NO: 276610 - RNA, 22 nt, Human
ggcuucucccuucuucugauug

SEQ ID NO: 276611 - RNA, 22 nt, Human
aaugaaacucgaaauaaucaca

SEQ ID NO: 276612 - RNA, 16 nt, Human
agccaggcugccucgg

SEQ ID NO: 276613 - RNA, 22 nt, Human
aaugauugcaaacauugagaac

SEQ ID NO: 276614 - RNA, 22 nt, Human
ugggaaagccagcagugucacc

SEQ ID NO: 276615 - RNA, 22 nt, Human
cuggcugcuuguagacucgacu

SEQ ID NO: 276616 - RNA, 22 nt, Human
guugaauaucguguucuuguuu

SEQ ID NO: 276617 - RNA, 22 nt, Human
ucauugcaguugaguuguguua

SEQ ID NO: 276618 - RNA, 22 nt, Human
cucuuaaauaacaucauugcuu

SEQ ID NO: 276619 - RNA, 22 nt, Human
agaaacuaagucauaacucuuu

SEQ ID NO: 276620 - RNA, 22 nt, Human
cagggaggaugggcuguuuugc

SEQ ID NO: 276621 - RNA, 22 nt, Human
ccauuguaguaucuguuuuagu

SEQ ID NO: 276622 - RNA, 22 nt, Human
aggcuggcccaccucuugucuu

SEQ ID NO: 276623 - RNA, 22 nt, Human
ugucagcaucauuuguugaagg

SEQ ID NO: 276624 - RNA, 22 nt, Human
caaguuauuccuuuacacuaua

SEQ ID NO: 276625 - RNA, 21 nt, Human
uggcccuggccacggcugcca

SEQ ID NO: 276626 - RNA, 20 nt, Human
ugauuuucugaaacagcaca

SEQ ID NO: 276627 - RNA, 23 nt, Human
aguuuguaaagaaauauuugcac

SEQ ID NO: 276628 - RNA, 22 nt, Human
agccucuggcccuagacugcuu

SEQ ID NO: 276629 - RNA, 22 nt, Human
cacaaaugugcagaaaugugag

SEQ ID NO: 276630 - RNA, 22 nt, Human
agaaggaguguacaggucaugc

SEQ ID NO: 276631 - RNA, 22 nt, Human
gugcugaggugggugggcagcc

SEQ ID NO: 276632 - RNA, 22 nt, Human
cuguggcucaaaaucccaugau

SEQ ID NO: 276633 - RNA, 22 nt, Human
aaaaccagguagcaaaggagac

SEQ ID NO: 276634 - RNA, 22 nt, Human
uggagcugacucacaccagcua

SEQ ID NO: 276635 - RNA, 22 nt, Human
gaguccuuuguuccuugccaca

SEQ ID NO: 276636 - RNA, 18 nt, Human
augagaggugucagaaga

SEQ ID NO: 276637 - RNA, 22 nt, Human
guuaaauucgaugauggauaaa

SEQ ID NO: 276638 - RNA, 22 nt, Human
ucucuggguaugguaacguugg

SEQ ID NO: 276639 - RNA, 22 nt, Human
uccuguuucuccugcaaaaucc

SEQ ID NO: 276640 - RNA, 22 nt, Human
ugcagcugauuaaagggcagac

SEQ ID NO: 276641 - RNA, 22 nt, Human
agagcaccccgggaagagcaag

SEQ ID NO: 276642 - RNA, 18 nt, Human
ucaggcugggccuccuuc

SEQ ID NO: 276643 - RNA, 22 nt, Human
augucaggacccuacugcauug

SEQ ID NO: 276644 - RNA, 22 nt, Human
guuaaauaaccucauguccguu

SEQ ID NO: 276645 - RNA, 22 nt, Human
uucacacuuguuaggauggcuu

SEQ ID NO: 276646 - RNA, 22 nt, Human
gaggacagcuuagggcuuccug

SEQ ID NO: 276647 - RNA, 22 nt, Human
auauuaggaguuaaauguauua

SEQ ID NO: 276648 - RNA, 22 nt, Human
auuuaucucuggaaacuaagca

SEQ ID NO: 276649 - RNA, 22 nt, Human
ggcugagggucccagacccuaa

SEQ ID NO: 276650 - RNA, 22 nt, Human
agcaguuuuuauaacacuggaa

SEQ ID NO: 276651 - RNA, 21 nt, Human
aaagaaaucucccauugguag

SEQ ID NO: 276652 - RNA, 22 nt, Human
guucaaaauucaaaugguauac

SEQ ID NO: 276653 - RNA, 22 nt, Human
uuuaggaugcucuauucugacu

SEQ ID NO: 276654 - RNA, 19 nt, Human
gugucugccuuugugccac

SEQ ID NO: 276655 - RNA, 22 nt, Human
gcucagagggaacaaggggcug

SEQ ID NO: 276656 - RNA, 22 nt, Human
gaauuauagguuugcaugcuaa

SEQ ID NO: 276657 - RNA, 22 nt, Human
uaaaaggcacuuggaugcugag

SEQ ID NO: 276658 - RNA, 22 nt, Human
caaaaguaauugcaguuuuugc

SEQ ID NO: 276659 - RNA, 22 nt, Human
ugaggaaggaauugagguuuua

SEQ ID NO: 276660 - RNA, 22 nt, Human
uauuucacaugugggaaacaua

SEQ ID NO: 276661 - RNA, 19 nt, Human
aggaauggaauuaauucug

SEQ ID NO: 276662 - RNA, 22 nt, Human
auccaggcugcuaugaggauga

SEQ ID NO: 276663 - RNA, 21 nt, Human
agauuguauggaggugagagg

SEQ ID NO: 276664 - RNA, 22 nt, Human
gcugccuguccugaggaguccg

SEQ ID NO: 276665 - RNA, 22 nt, Human
uaagacaagccucgcauuugua

SEQ ID NO: 276666 - RNA, 22 nt, Human
gccuggagacaaggacaaaggg

SEQ ID NO: 276667 - RNA, 22 nt, Human
aaggaacuaaauaguucuggaa

SEQ ID NO: 276668 - RNA, 22 nt, Human
agucaguuaaccucacagcauc

SEQ ID NO: 276669 - RNA, 19 nt, Human
gagacauguagauagaaga

SEQ ID NO: 276670 - RNA, 22 nt, Human
aaaggcuauucagggacuugcc

SEQ ID NO: 276671 - RNA, 22 nt, Human
ccacugagugagcagagcaggg

SEQ ID NO: 276672 - RNA, 22 nt, Human
uagaaagacagagguuuugucu

SEQ ID NO: 276673 - RNA, 22 nt, Human
ccugagccucuugcacgcucag

SEQ ID NO: 276674 - RNA, 21 nt, Human
ucugccugagacuuugcuggu

SEQ ID NO: 276675 - RNA, 22 nt, Human
cuagagcuguucugugcacuca

SEQ ID NO: 276676 - RNA, 22 nt, Human
uaugacauuuucccagauuuau

SEQ ID NO: 276677 - RNA, 19 nt, Human
cuguuucugagcuugcuuu

SEQ ID NO: 276678 - RNA, 22 nt, Human
auuugccuuacugaagaaggag

SEQ ID NO: 276679 - RNA, 22 nt, Human
ucaggugugaacuauuuggaaa

SEQ ID NO: 276680 - RNA, 18 nt, Human
gagaaaccugugaaugcu

SEQ ID NO: 276681 - RNA, 23 nt, Human
acagggcuggcagcugcaagacc

SEQ ID NO: 276682 - RNA, 22 nt, Human
gagcucugcuuggguucuuagg

SEQ ID NO: 276683 - RNA, 22 nt, Human
aguauugugacucaaguauucu

SEQ ID NO: 276684 - RNA, 22 nt, Human
gaacuauucauucucauuagcg

SEQ ID NO: 276685 - RNA, 22 nt, Human
agaacagaggccuuauguuuca

SEQ ID NO: 276686 - RNA, 22 nt, Human
uauugaguuacagaaaauacuu

SEQ ID NO: 276687 - RNA, 19 nt, Human
gucucuggauuucaggucc

SEQ ID NO: 276688 - RNA, 22 nt, Human
aacuuaaugauuucaugcaugu

SEQ ID NO: 276689 - RNA, 22 nt, Human
uggcuccagauuuccugcugca

SEQ ID NO: 276690 - RNA, 22 nt, Human
uggcaaaguaauuggguuucuc

SEQ ID NO: 276691 - RNA, 22 nt, Human
augcaucaggcacuaggaauag

SEQ ID NO: 276692 - RNA, 22 nt, Human
gaggaggggacaguacuugugc

SEQ ID NO: 276693 - RNA, 22 nt, Human
uguguucaugucacuggaaucc

SEQ ID NO: 276694 - RNA, 22 nt, Human
gugacccaugcagugguuuugg

SEQ ID NO: 276695 - RNA, 22 nt, Human
cuggccacuggagguggcaccc

SEQ ID NO: 276696 - RNA, 22 nt, Human
agucuacauuuuuguuaauggu

SEQ ID NO: 276697 - RNA, 22 nt, Human
ggcccagaauacaugaaguaua

SEQ ID NO: 276698 - RNA, 22 nt, Human
uuagggaaggcugcugucagcu

SEQ ID NO: 276699 - RNA, 22 nt, Human
caggcugcuccaggguaggaaa

SEQ ID NO: 276700 - RNA, 22 nt, Human
aagcauguguauaagcugggca

SEQ ID NO: 276701 - RNA, 22 nt, Human
aaacuguauagggaaaaguaga

SEQ ID NO: 276702 - RNA, 22 nt, Human
accagcauccuuccuauuaaca

SEQ ID NO: 276703 - RNA, 22 nt, Human
cuguaaaacacuguaguaucug

SEQ ID NO: 276704 - RNA, 22 nt, Human
uguaaaggguguuaaauuacuc

SEQ ID NO: 276705 - RNA, 22 nt, Human
ggccagcauauagagugaagua

SEQ ID NO: 276706 - RNA, 22 nt, Human
ugcuuaggaugcuagcaggcau

SEQ ID NO: 276707 - RNA, 22 nt, Human
ccugagauuucauugucuggcc

SEQ ID NO: 276708 - RNA, 22 nt, Human
gccagccagagaggcaugguua

SEQ ID NO: 276709 - RNA, 22 nt, Human
uuuuggcuuaaagagaauguau

SEQ ID NO: 276710 - RNA, 22 nt, Human
aucagacaauuguugaguacug

SEQ ID NO: 276711 - RNA, 22 nt, Human
gggaacagggccugagcugggg

SEQ ID NO: 276712 - RNA, 22 nt, Human
ggucucugaacuuccacugcgc

SEQ ID NO: 276713 - RNA, 22 nt, Human
acauuucuucccuuuagcagaa

SEQ ID NO: 276714 - RNA, 22 nt, Human
ugcauuauacauggaucuaaag

SEQ ID NO: 276715 - RNA, 22 nt, Human
aaacaaguuuagaauaaugaau

SEQ ID NO: 276716 - RNA, 22 nt, Human
auuccuucuaaaacgcugcccu

SEQ ID NO: 276717 - RNA, 22 nt, Human
gcuuacaagaucgugcuccagu

SEQ ID NO: 276718 - RNA, 22 nt, Human
ccugcugugugacgggauguua

SEQ ID NO: 276719 - RNA, 22 nt, Human
caauagugucugcuuguuucua

SEQ ID NO: 276720 - RNA, 22 nt, Human
uuauacaccaucacugccuugg

SEQ ID NO: 276721 - RNA, 22 nt, Human
ugucaaaaauaagagagauugu

SEQ ID NO: 276722 - RNA, 22 nt, Human
uauuaucauugguaauaugguc

SEQ ID NO: 276723 - RNA, 22 nt, Human
ccugaggucacaacuugcuuau

SEQ ID NO: 276724 - RNA, 22 nt, Human
agucugaaccagauggcaaggu

SEQ ID NO: 276725 - RNA, 22 nt, Human
aggccucuugucuuccucacau

SEQ ID NO: 276726 - RNA, 22 nt, Human
agauuuccguucucucuucagu

SEQ ID NO: 276727 - RNA, 22 nt, Human
ugccugccucuggcagcccugc

SEQ ID NO: 276728 - RNA, 22 nt, Human
aaagauuaggcggcaacugggc

SEQ ID NO: 276729 - RNA, 22 nt, Human
ugccuucacugagcuuauggga

SEQ ID NO: 276730 - RNA, 22 nt, Human
ugagcuggucuugaguguagcu

SEQ ID NO: 276731 - RNA, 18 nt, Human
uccaggucccaggggaag

SEQ ID NO: 276732 - RNA, 22 nt, Human
uacacauccuucugaacaaccu

SEQ ID NO: 276733 - RNA, 22 nt, Human
gagcuccucccaggguagcacu

SEQ ID NO: 276734 - RNA, 22 nt, Human
cagucucuggugaguugacagu

SEQ ID NO: 276735 - RNA, 22 nt, Human
agacagcaugagccugcugaug

SEQ ID NO: 276736 - RNA, 22 nt, Human
uuagaaccauaaugaaucaaug

SEQ ID NO: 276737 - RNA, 22 nt, Human
ucccagggcuuuucucaugcuu

SEQ ID NO: 276738 - RNA, 22 nt, Human
guguguccucaguaguggcaug

SEQ ID NO: 276739 - RNA, 22 nt, Human
cuggcaggcggagguugcagug

SEQ ID NO: 276740 - RNA, 22 nt, Human
uuuaugagcaaugcugagggga

SEQ ID NO: 276741 - RNA, 22 nt, Human
uuucuguagugugguauguagg

SEQ ID NO: 276742 - RNA, 22 nt, Human
ucucagcacguuguuuucauug

SEQ ID NO: 276743 - RNA, 22 nt, Human
uauuugcaggacauagauaugg

SEQ ID NO: 276744 - RNA, 22 nt, Human
gcacagggcccugugcguaggu

SEQ ID NO: 276745 - RNA, 22 nt, Human
gagcaggacgugggaaugggaa

SEQ ID NO: 276746 - RNA, 22 nt, Human
accucacaagucucugucagcu

SEQ ID NO: 276747 - RNA, 22 nt, Human
aauuagaagggaguuauugaua

SEQ ID NO: 276748 - RNA, 22 nt, Human
augaaauugaucuugaacuuuu

SEQ ID NO: 276749 - RNA, 22 nt, Human
uuccuggcaugaaaaauaucac

SEQ ID NO: 276750 - RNA, 22 nt, Human
cagugccugucuuauucuuaca

SEQ ID NO: 276751 - RNA, 17 nt, Human
ucugagaaaggagaauc

SEQ ID NO: 276752 - RNA, 22 nt, Human
cagagacacuuaacaggaaugg

SEQ ID NO: 276753 - RNA, 20 nt, Human
uuagaaguggcuauuuccuc

SEQ ID NO: 276754 - RNA, 22 nt, Human
uuguuucuggaaaaggcgagaa

SEQ ID NO: 276755 - RNA, 18 nt, Human
agcagguucucacagcca

SEQ ID NO: 276756 - RNA, 22 nt, Human
ugucucagaauggcucauaaua

SEQ ID NO: 276757 - RNA, 22 nt, Human
acugucacugugauguuagaga

SEQ ID NO: 276758 - RNA, 22 nt, Human
acucuggcuauucacuauaaua

SEQ ID NO: 276759 - RNA, 22 nt, Human
ccuuuucugaaccacuuaaaua

SEQ ID NO: 276760 - RNA, 22 nt, Human
ccucaaauugcucagcgucuag

SEQ ID NO: 276761 - RNA, 22 nt, Human
ucucccaggcuggagugcagug

SEQ ID NO: 276762 - RNA, 22 nt, Human
uuugacucaagcccucauguua

SEQ ID NO: 276763 - RNA, 22 nt, Human
aggcacugacaauucuggacug

SEQ ID NO: 276764 - RNA, 22 nt, Human
uaacaagucauuuuaaauuaug

SEQ ID NO: 276765 - RNA, 22 nt, Human
gacauuuagaaguuagauucaa

SEQ ID NO: 276766 - RNA, 21 nt, Human
ccagucuguaaaauggggaca

SEQ ID NO: 276767 - RNA, 22 nt, Human
gccuguggggcugaggcugccu

SEQ ID NO: 276768 - RNA, 22 nt, Human
ugguuugacaaugaggacuggu

SEQ ID NO: 276769 - RNA, 22 nt, Human
acaucuuuguuucuuaguguau

SEQ ID NO: 276770 - RNA, 19 nt, Human
ucaguggagaaaggggaag

SEQ ID NO: 276771 - RNA, 22 nt, Human
ugccagcacuucuggcugucug

SEQ ID NO: 276772 - RNA, 22 nt, Human
cugaggagcagcuggcccgcua

SEQ ID NO: 276773 - RNA, 22 nt, Human
acuuccugcaaucguccacucc

SEQ ID NO: 276774 - RNA, 21 nt, Human
cuuuggcaagggagaagucac

SEQ ID NO: 276775 - RNA, 22 nt, Human
aaguauuucguucugaaaaagu

SEQ ID NO: 276776 - RNA, 22 nt, Human
auaaugagcuuuugaauacuga

SEQ ID NO: 276777 - RNA, 22 nt, Human
uuuuucuuaaauguggguuggc

SEQ ID NO: 276778 - RNA, 22 nt, Human
auuucagauucagaaauguagg

SEQ ID NO: 276779 - RNA, 22 nt, Human
gugaaggacuagcauggagggc

SEQ ID NO: 276780 - RNA, 22 nt, Human
ugccuggguguaaagggccaac

SEQ ID NO: 276781 - RNA, 22 nt, Human
uggggcuggggaucuugagccu

SEQ ID NO: 276782 - RNA, 22 nt, Human
uggcccugccgcacuauccuca

SEQ ID NO: 276783 - RNA, 22 nt, Human
aaaaagagaaaugcucuagucc

SEQ ID NO: 276784 - RNA, 22 nt, Human
cuggcuggcguuuuccaaaagc

SEQ ID NO: 276785 - RNA, 22 nt, Human
aggaauguuaggagaugagucu

SEQ ID NO: 276786 - RNA, 22 nt, Human
uuguuuauguguugucuauggc

SEQ ID NO: 276787 - RNA, 22 nt, Human
uucagaaugugaccuuauuugg

SEQ ID NO: 276788 - RNA, 22 nt, Human
ucaggcagaguggaagcugcaa

SEQ ID NO: 276789 - RNA, 22 nt, Human
aauucuugguccuaguguauaa

SEQ ID NO: 276790 - RNA, 22 nt, Human
acugagggagagucuuagguug

SEQ ID NO: 276791 - RNA, 22 nt, Human
gcucugugcuagaacuaagaau

SEQ ID NO: 276792 - RNA, 22 nt, Human
ugcuguaauacuuaagguuaag

SEQ ID NO: 276793 - RNA, 22 nt, Human
auuuuuucagauugaguguuaa

SEQ ID NO: 276794 - RNA, 22 nt, Human
auuucuguaacuuaugaaaguu

SEQ ID NO: 276795 - RNA, 22 nt, Human
agcuuuauuaacucuccaggug

SEQ ID NO: 276796 - RNA, 18 nt, Human
cugugggcuggugcauga

SEQ ID NO: 276797 - RNA, 22 nt, Human
aggcccugaccugggagaucua

SEQ ID NO: 276798 - RNA, 22 nt, Human
gcuggccagcccucuuccucca

SEQ ID NO: 276799 - RNA, 22 nt, Human
ggugggaggacuguuugaggca

SEQ ID NO: 276800 - RNA, 22 nt, Human
ucaguauuccuggaaauacaag

SEQ ID NO: 276801 - RNA, 22 nt, Human
aagcaagaguuggagugauguu

SEQ ID NO: 276802 - RNA, 20 nt, Human
agcacagcgcgguguuccuu

SEQ ID NO: 276803 - RNA, 22 nt, Human
gggggcuggacuuucccacaca

SEQ ID NO: 276804 - RNA, 22 nt, Human
gccaccuguuucagaugugguu

SEQ ID NO: 276805 - RNA, 22 nt, Human
guccugggcccaggggcugccu

SEQ ID NO: 276806 - RNA, 22 nt, Human
uggaggaaguggacaguugugu

SEQ ID NO: 276807 - RNA, 22 nt, Human
ccugggcuuccacgagcagagg

SEQ ID NO: 276808 - RNA, 22 nt, Human
gauccagcuucuacacagagcu

SEQ ID NO: 276809 - RNA, 22 nt, Human
uccaggcaaagccuuguagacg

SEQ ID NO: 276810 - RNA, 22 nt, Human
uauugcacaugcgcuagaacca

SEQ ID NO: 276811 - RNA, 22 nt, Human
cagagccccucagcucucuccc

SEQ ID NO: 276812 - RNA, 22 nt, Human
acagccugacuuuuguugucac

SEQ ID NO: 276813 - RNA, 22 nt, Human
guccacccaugacaccugccug

SEQ ID NO: 276814 - RNA, 22 nt, Human
uggaaagagaaacucuugcuaa

SEQ ID NO: 276815 - RNA, 22 nt, Human
uggcuguggguggaaggaaacc

SEQ ID NO: 276816 - RNA, 22 nt, Human
uucagagccagcaacacuaggc

SEQ ID NO: 276817 - RNA, 22 nt, Human
acagugugaugggccugccuga

SEQ ID NO: 276818 - RNA, 22 nt, Human
uguacacaaugugcagguuugu

SEQ ID NO: 276819 - RNA, 22 nt, Human
agagaaaugggguaaucuuuca

SEQ ID NO: 276820 - RNA, 22 nt, Human
auuaauguguagccaacuuaau

SEQ ID NO: 276821 - RNA, 22 nt, Human
uaggcuaggcugaagguuuugg

SEQ ID NO: 276822 - RNA, 22 nt, Human
uccaggagcauccaggugaagc

SEQ ID NO: 276823 - RNA, 20 nt, Human
ggcuucuuuacaucuguguu

SEQ ID NO: 276824 - RNA, 22 nt, Human
cuggcagcuggaggcuagaggc

SEQ ID NO: 276825 - RNA, 22 nt, Human
ugaaugcucacaugccuagguc

SEQ ID NO: 276826 - RNA, 22 nt, Human
gagagcccugcauggcugauga

SEQ ID NO: 276827 - RNA, 22 nt, Human
aguggcagguguuucguggugc

SEQ ID NO: 276828 - RNA, 22 nt, Human
ggacagaaauucuuguuggaca

SEQ ID NO: 276829 - RNA, 22 nt, Human
aaggcuauaucucaauacuauu

SEQ ID NO: 276830 - RNA, 22 nt, Human
uuuuagaaauacugauuuagug

SEQ ID NO: 276831 - RNA, 22 nt, Human
uaccagccucaguugugagccc

SEQ ID NO: 276832 - RNA, 22 nt, Human
uagcaagaugaugaauuauuca

SEQ ID NO: 276833 - RNA, 22 nt, Human
gucugcugcagucguggcucua

SEQ ID NO: 276834 - RNA, 22 nt, Human
ucaggcucugccaccuagauua

SEQ ID NO: 276835 - RNA, 22 nt, Human
guuuggauagugagagauacuu

SEQ ID NO: 276836 - RNA, 18 nt, Human
uggcagggaggaaauaua

SEQ ID NO: 276837 - RNA, 22 nt, Human
cuucaaaagccagaagccugcg

SEQ ID NO: 276838 - RNA, 22 nt, Human
cagcacacagugacucgcaccu

SEQ ID NO: 276839 - RNA, 22 nt, Human
ugagugggauuaaaugagguga

SEQ ID NO: 276840 - RNA, 22 nt, Human
uggaaauggaucugaugagucu

SEQ ID NO: 276841 - RNA, 22 nt, Human
auucuacacaacaugaugaugg

SEQ ID NO: 276842 - RNA, 22 nt, Human
cacaguuagagguagaguccag

SEQ ID NO: 276843 - RNA, 22 nt, Human
ugcuuugcagugucuaacagaa

SEQ ID NO: 276844 - RNA, 22 nt, Human
agcuguggggaggaggcuagca

SEQ ID NO: 276845 - RNA, 22 nt, Human
ucagagaguuggaaagaauuaa

SEQ ID NO: 276846 - RNA, 22 nt, Human
gccaggaaagccacuggcauac

SEQ ID NO: 276847 - RNA, 22 nt, Human
cacaaauaccaguuuccuaaca

SEQ ID NO: 276848 - RNA, 22 nt, Human
cacaccuguaauaccagcuacu

SEQ ID NO: 276849 - RNA, 22 nt, Human
acauggugagcggcaggccuau

SEQ ID NO: 276850 - RNA, 22 nt, Human
aaguguuuaugguuauuguuaa

SEQ ID NO: 276851 - RNA, 22 nt, Human
ucagcaggguuugacuucuaau

SEQ ID NO: 276852 - RNA, 22 nt, Human
guccuggaguggcauggcaugg

SEQ ID NO: 276853 - RNA, 22 nt, Human
gaaaagggcaagagagagggca

SEQ ID NO: 276854 - RNA, 22 nt, Human
ggcuccacugcugaccacucca

SEQ ID NO: 276855 - RNA, 22 nt, Human
uagagaaaaccacuggugagcu

SEQ ID NO: 276856 - RNA, 22 nt, Human
cccagagauguccugagugaua

SEQ ID NO: 276857 - RNA, 22 nt, Human
ucagaaagacgaaacagauggg

SEQ ID NO: 276858 - RNA, 22 nt, Human
uacuuuauuguaaaugcugaug

SEQ ID NO: 276859 - RNA, 22 nt, Human
uuacauucaauuucuagaggua

SEQ ID NO: 276860 - RNA, 22 nt, Human
ggccuggaagaggacagagaaa

SEQ ID NO: 276861 - RNA, 22 nt, Human
uuccuucuggaagcuucagggg

SEQ ID NO: 276862 - RNA, 22 nt, Human
caggagacaauggcuguggggc

SEQ ID NO: 276863 - RNA, 22 nt, Human
accuuuauaugaaagaugacau

SEQ ID NO: 276864 - RNA, 20 nt, Human
cccaggaguuugcucuuacu

SEQ ID NO: 276865 - RNA, 22 nt, Human
gacugucuuuugaauaaaaaug

SEQ ID NO: 276866 - RNA, 22 nt, Human
cucccagguuacaucugagccu

SEQ ID NO: 276867 - RNA, 22 nt, Human
agugaaauagcauuuaugaagc

SEQ ID NO: 276868 - RNA, 22 nt, Human
agcugcaagauaaaagugaugu

SEQ ID NO: 276869 - RNA, 22 nt, Human
gaguggcagaacuggggguccu

SEQ ID NO: 276870 - RNA, 22 nt, Human
ucuucucuguggccugguggug

SEQ ID NO: 276871 - RNA, 22 nt, Human
agguguggcuugaagucucuau

SEQ ID NO: 276872 - RNA, 22 nt, Human
uucuuucugggaagaguucaga

SEQ ID NO: 276873 - RNA, 20 nt, Human
aggcugaguucuaugcacuu

SEQ ID NO: 276874 - RNA, 22 nt, Human
agucacaugggauuagaaccca

SEQ ID NO: 276875 - RNA, 22 nt, Human
cagacaggguggguuucugggc

SEQ ID NO: 276876 - RNA, 22 nt, Human
uggagggcucuuucaccuggua

SEQ ID NO: 276877 - RNA, 22 nt, Human
ucagaggagcaaaagaggggau

SEQ ID NO: 276878 - RNA, 22 nt, Human
ucaguggucuuggcugauuguu

SEQ ID NO: 276879 - RNA, 22 nt, Human
gcauucuuguuuuuccuacccu

SEQ ID NO: 276880 - RNA, 22 nt, Human
ccaaggcaaugugcagcuggug

SEQ ID NO: 276881 - RNA, 22 nt, Human
gagaaacaacacuugaugccuu

SEQ ID NO: 276882 - RNA, 22 nt, Human
caauagcaggucuacagagaga

SEQ ID NO: 276883 - RNA, 19 nt, Human
uuugauagggcauaauaua

SEQ ID NO: 276884 - RNA, 22 nt, Human
gaggugucuguuaggaauaggc

SEQ ID NO: 276885 - RNA, 22 nt, Human
aagucuggaaccucaugcuggc

SEQ ID NO: 276886 - RNA, 22 nt, Human
caugugcauccuuaaucucccu

SEQ ID NO: 276887 - RNA, 22 nt, Human
gcacaaaacacauuuugacaau

SEQ ID NO: 276888 - RNA, 22 nt, Human
ugcugggugguugcuccucccg

SEQ ID NO: 276889 - RNA, 22 nt, Human
gugccagccgcaccccaggaga

SEQ ID NO: 276890 - RNA, 22 nt, Human
auguuacaacccugaggagccg

SEQ ID NO: 276891 - RNA, 22 nt, Human
aggacuaaggaacagcugauuc

SEQ ID NO: 276892 - RNA, 22 nt, Human
aaagaacaauguggaaucuccu

SEQ ID NO: 276893 - RNA, 19 nt, Human
ccugugacuaucuuuguaa

SEQ ID NO: 276894 - RNA, 21 nt, Human
uuccagagauuguuucaccug

SEQ ID NO: 276895 - RNA, 22 nt, Human
aggucucucacacucacagggc

SEQ ID NO: 276896 - RNA, 22 nt, Human
aggcagacaaggacacaguggg

SEQ ID NO: 276897 - RNA, 22 nt, Human
auagcuguagaauguauacaca

SEQ ID NO: 276898 - RNA, 22 nt, Human
cacauuucuuauggauguuggc

SEQ ID NO: 276899 - RNA, 22 nt, Human
acagaggccgccucucucacgg

SEQ ID NO: 276900 - RNA, 18 nt, Human
cagacacucugcucugca

SEQ ID NO: 276901 - RNA, 22 nt, Human
uucugucuucucgguuguuuac

SEQ ID NO: 276902 - RNA, 22 nt, Human
uggagccagagcgcagccuggg

SEQ ID NO: 276903 - RNA, 22 nt, Human
aauuccaaguagcaucccauca

SEQ ID NO: 276904 - RNA, 22 nt, Human
ugagcccauguagcacuuccau

SEQ ID NO: 276905 - RNA, 22 nt, Human
aaacagauaaugcuauaaaugg

SEQ ID NO: 276906 - RNA, 22 nt, Human
ucagcccugggcuuccucaugg

SEQ ID NO: 276907 - RNA, 20 nt, Human
uauaagcagcuccaggcaga

SEQ ID NO: 276908 - RNA, 22 nt, Human
auguaucaugcaggguccauga

SEQ ID NO: 276909 - RNA, 22 nt, Human
guuugcaaauuguguuaaagcu

SEQ ID NO: 276910 - RNA, 22 nt, Human
cacagaauuaagggagaaauau

SEQ ID NO: 276911 - RNA, 22 nt, Human
ccauuaguaccucuggaaaauu

SEQ ID NO: 276912 - RNA, 22 nt, Human
ucuggaagaacggggcaugcug

SEQ ID NO: 276913 - RNA, 22 nt, Human
uguuuaaauagaacauacugca

SEQ ID NO: 276914 - RNA, 22 nt, Human
uacccagcuccucagaagacca

SEQ ID NO: 276915 - RNA, 22 nt, Human
ccugcccaucccguccuuggcc

SEQ ID NO: 276916 - RNA, 22 nt, Human
ugucucuuggcucuaucacuua

SEQ ID NO: 276917 - RNA, 22 nt, Human
uuuagcauguuccuuucauaga

SEQ ID NO: 276918 - RNA, 22 nt, Human
gcuggagcugcagccugggccu

SEQ ID NO: 276919 - RNA, 22 nt, Human
agaugguccaucuauuuucuau

SEQ ID NO: 276920 - RNA, 22 nt, Human
uuuaaauaggacuccugggggu

SEQ ID NO: 276921 - RNA, 22 nt, Human
ugauuuuauuggugaggaaauu

SEQ ID NO: 276922 - RNA, 22 nt, Human
uagguguccucguccaaagauu

SEQ ID NO: 276923 - RNA, 22 nt, Human
gaggaggcuggcgccgccugcc

SEQ ID NO: 276924 - RNA, 22 nt, Human
gaaagaggaaggagauguauua

SEQ ID NO: 276925 - RNA, 22 nt, Human
gaguuacauuuggugacacuuc

SEQ ID NO: 276926 - RNA, 22 nt, Human
ccugagcucaagaaggugacca

SEQ ID NO: 276927 - RNA, 22 nt, Human
ccugagcuugauccuucugucu

SEQ ID NO: 276928 - RNA, 22 nt, Human
auuuacagccuugaaaacagca

SEQ ID NO: 276929 - RNA, 22 nt, Human
uccuuucccuuuccauccuggc

SEQ ID NO: 276930 - RNA, 22 nt, Human
agaaggcugagacugggaugaa

SEQ ID NO: 276931 - RNA, 22 nt, Human
ggggcugguggugguuucucca

SEQ ID NO: 276932 - RNA, 22 nt, Human
ucacagaaggcaucacagaaga

SEQ ID NO: 276933 - RNA, 22 nt, Human
auuacaaucgagagaaacaaau

SEQ ID NO: 276934 - RNA, 21 nt, Human
ccaccaggucuucugcucggg

SEQ ID NO: 276935 - RNA, 22 nt, Human
gcaggucuagaagcugccucug

SEQ ID NO: 276936 - RNA, 23 nt, Human
cccagcuggaaguuagaggacca

SEQ ID NO: 276937 - RNA, 22 nt, Human
uuauuagggugguuuauguucu

SEQ ID NO: 276938 - RNA, 22 nt, Human
cuguuuaucucuaaccuguuua

SEQ ID NO: 276939 - RNA, 22 nt, Human
gauuuagauucgcuggggcugg

SEQ ID NO: 276940 - RNA, 22 nt, Human
aagggcuguaagccaaguaaag

SEQ ID NO: 276941 - RNA, 22 nt, Human
caggcugauuaggccucgucca

SEQ ID NO: 276942 - RNA, 22 nt, Human
ccugggaggcggagguugcagg

SEQ ID NO: 276943 - RNA, 22 nt, Human
cagcuggggcagccacgugcgg

SEQ ID NO: 276944 - RNA, 22 nt, Human
caggggcucuaaugcaugauca

SEQ ID NO: 276945 - RNA, 20 nt, Human
uuucauugucagaaucuuau

SEQ ID NO: 276946 - RNA, 22 nt, Human
aguggccacuagaagcucagcu

SEQ ID NO: 276947 - RNA, 22 nt, Human
uggaaucugugcuguuuuagug

SEQ ID NO: 276948 - RNA, 22 nt, Human
ucaggugggcaguggguugagc

SEQ ID NO: 276949 - RNA, 22 nt, Human
gcugguggcagagcuccgcggc

SEQ ID NO: 276950 - RNA, 21 nt, Human
ccacagcuggucucugagccc

SEQ ID NO: 276951 - RNA, 22 nt, Human
ggcuggcacugaggagagcucu

SEQ ID NO: 276952 - RNA, 22 nt, Human
cugggacuuuguaggccaguug

SEQ ID NO: 276953 - RNA, 22 nt, Human
ccgggagcaggcgccaccgcca

SEQ ID NO: 276954 - RNA, 20 nt, Human
guauuacaggcuuagaacca

SEQ ID NO: 276955 - RNA, 22 nt, Human
gcaaacaagcugccugaagauu

SEQ ID NO: 276956 - RNA, 22 nt, Human
cuagggagggauguuggcauga

SEQ ID NO: 276957 - RNA, 22 nt, Human
aucuguucuugugucaguaauu

SEQ ID NO: 276958 - RNA, 22 nt, Human
ucaucucuccccagugucuuua

SEQ ID NO: 276959 - RNA, 22 nt, Human
uuccaugacugaagcaggggcg

SEQ ID NO: 276960 - RNA, 22 nt, Human
gcugccugugcgggucgcuagg

SEQ ID NO: 276961 - RNA, 22 nt, Human
ucugccucgcuaacagcagcca

SEQ ID NO: 276962 - RNA, 22 nt, Human
gaccacagcagugcaagaggag

SEQ ID NO: 276963 - RNA, 22 nt, Human
cugaggcaccuacagucucggg

SEQ ID NO: 276964 - RNA, 21 nt, Human
ggggaugcgaccacaggcucc

SEQ ID NO: 276965 - RNA, 21 nt, Human
cacauuccaugggucuauuua

SEQ ID NO: 276966 - RNA, 22 nt, Human
aaaaguaauugcaguuuuguca

SEQ ID NO: 276967 - RNA, 22 nt, Human
ucauggcagcccuuuacuagag

SEQ ID NO: 276968 - RNA, 22 nt, Human
ucugggucuuaguuuucuugau

SEQ ID NO: 276969 - RNA, 22 nt, Human
auggaggaugugcagcaugggc

SEQ ID NO: 276970 - RNA, 22 nt, Human
cucauuuacuguagaacaguua

SEQ ID NO: 276971 - RNA, 17 nt, Human
agcaggcugcagaggcc

SEQ ID NO: 276972 - RNA, 20 nt, Human
ucucaguuucuagagucagg

SEQ ID NO: 276973 - RNA, 22 nt, Human
ucccagagacaucauuucuccg

SEQ ID NO: 276974 - RNA, 22 nt, Human
aucuacaggauaguuuaauauu

SEQ ID NO: 276975 - RNA, 22 nt, Human
ggcuuagauugacacugaucuc

SEQ ID NO: 276976 - RNA, 22 nt, Human
ggccagcuuauuagcucagagg

SEQ ID NO: 276977 - RNA, 22 nt, Human
ugucacauaauuuaucuguagg

SEQ ID NO: 276978 - RNA, 22 nt, Human
cuucucuggcuccucagcgccc

SEQ ID NO: 276979 - RNA, 22 nt, Human
ugaagaaacagaccaagaggau

SEQ ID NO: 276980 - RNA, 22 nt, Human
ccagagggaagaggaagcgcug

SEQ ID NO: 276981 - RNA, 22 nt, Human
uacacaugcucagauuccugug

SEQ ID NO: 276982 - RNA, 22 nt, Human
aggaaagcuuggcaaacuaaau

SEQ ID NO: 276983 - RNA, 21 nt, Human
aggaggccaguacugcugaac

SEQ ID NO: 276984 - RNA, 22 nt, Human
auuauuaggacuacugggguug

SEQ ID NO: 276985 - RNA, 22 nt, Human
uuucccagccuccuuugcagcu

SEQ ID NO: 276986 - RNA, 22 nt, Human
uuaaaguguuaacugaagcuua

SEQ ID NO: 276987 - RNA, 22 nt, Human
auccauuugacauaauuucagc

SEQ ID NO: 276988 - RNA, 22 nt, Human
gggcacagucuaaaguugggcc

SEQ ID NO: 276989 - RNA, 22 nt, Human
cugcagagaccuaggucagguu

SEQ ID NO: 276990 - RNA, 22 nt, Human
cagguggggcgcccucaggcag

SEQ ID NO: 276991 - RNA, 22 nt, Human
ucugaggccugaagcagcagag

SEQ ID NO: 276992 - RNA, 22 nt, Human
cagcaggugggcuuugcggaug

SEQ ID NO: 276993 - RNA, 22 nt, Human
aagggcuggagaggaaagguug

SEQ ID NO: 276994 - RNA, 22 nt, Human
acaacaguuuagguauuuguag

SEQ ID NO: 276995 - RNA, 22 nt, Human
gcagagugaagggagaggugug

SEQ ID NO: 276996 - RNA, 22 nt, Human
ccaagcugacugugcuguugug

SEQ ID NO: 276997 - RNA, 22 nt, Human
uagggggcuuugcugcuugaca

SEQ ID NO: 276998 - RNA, 22 nt, Human
acagggcagguggcuacugguc

SEQ ID NO: 276999 - RNA, 22 nt, Human
gugaccauccugguaaugaauc

SEQ ID NO: 277000 - RNA, 22 nt, Human
cugcagcuaaggaaugugguug

SEQ ID NO: 277001 - RNA, 22 nt, Human
gaggcuguaaguguggagccua

SEQ ID NO: 277002 - RNA, 22 nt, Human
ccaguguccuuccuuuccaugg

SEQ ID NO: 277003 - RNA, 22 nt, Human
uauuucuucgggauucaagcua

SEQ ID NO: 277004 - RNA, 22 nt, Human
ggcagagccucagcccuccacc

SEQ ID NO: 277005 - RNA, 22 nt, Human
cucuagaguacgggcuggcaug

SEQ ID NO: 277006 - RNA, 18 nt, Human
gaggaaacaggcucugug

SEQ ID NO: 277007 - RNA, 22 nt, Human
ucucuggcagcuugugcuguug

SEQ ID NO: 277008 - RNA, 22 nt, Human
uaacaacuugcuuuuaucuuag

SEQ ID NO: 277009 - RNA, 22 nt, Human
ucuuuacacaagacaagaauaa

SEQ ID NO: 277010 - RNA, 22 nt, Human
cagaccucaaagcugcagugcu

SEQ ID NO: 277011 - RNA, 22 nt, Human
gacaguaagucagagacuuggu

SEQ ID NO: 277012 - RNA, 22 nt, Human
cuugagaaucuucucugaagag

SEQ ID NO: 277013 - RNA, 22 nt, Human
acuccagguuuuuucacugaag

SEQ ID NO: 277014 - RNA, 22 nt, Human
acuucuuucacaauguuucuag

SEQ ID NO: 277015 - RNA, 22 nt, Human
gaucggguggguucugccauca

SEQ ID NO: 277016 - RNA, 22 nt, Human
ccuggagggcagcccauucugg

SEQ ID NO: 277017 - RNA, 22 nt, Human
gaaauguuuuacaaggcauacu

SEQ ID NO: 277018 - RNA, 22 nt, Human
cagccagcugaauguaccauga

SEQ ID NO: 277019 - RNA, 22 nt, Human
uuguuucauggggauguuuauu

SEQ ID NO: 277020 - RNA, 22 nt, Human
cucugaggaagucaaguagcca

SEQ ID NO: 277021 - RNA, 22 nt, Human
cacaugugcaguuacaugaauu

SEQ ID NO: 277022 - RNA, 22 nt, Human
agucucacuucuugagcuaugc

SEQ ID NO: 277023 - RNA, 22 nt, Human
uaaaaugacuuccuccaacauc

SEQ ID NO: 277024 - RNA, 22 nt, Human
uuuuauugcaauaaagugugua

SEQ ID NO: 277025 - RNA, 22 nt, Human
uugaauuauuuguuugcaagcu

SEQ ID NO: 277026 - RNA, 18 nt, Human
auguggcuagugcuacug

SEQ ID NO: 277027 - RNA, 22 nt, Human
gaaauauugggacucagagcuu

SEQ ID NO: 277028 - RNA, 22 nt, Human
accacaucuagauugcagcccu

SEQ ID NO: 277029 - RNA, 22 nt, Human
acaaggcuuauaguugcuuuuu

SEQ ID NO: 277030 - RNA, 23 nt, Human
cucccuggaguuucuggaagaug

SEQ ID NO: 277031 - RNA, 23 nt, Human
ucagucuucccugucaguaauag

SEQ ID NO: 277032 - RNA, 22 nt, Human
cugugucccuugucccagagcc

SEQ ID NO: 277033 - RNA, 22 nt, Human
gcaugcagggagggucuggcug

SEQ ID NO: 277034 - RNA, 22 nt, Human
auuugccucugcuuucaaggau

SEQ ID NO: 277035 - RNA, 22 nt, Human
ggccaccaguccucuggcaggg

SEQ ID NO: 277036 - RNA, 22 nt, Human
ucugaaauuuuaguuauagaaa

SEQ ID NO: 277037 - RNA, 22 nt, Human
agagcauccaucggccaggacc

SEQ ID NO: 277038 - RNA, 22 nt, Human
auuguaacauguucagaucacu

SEQ ID NO: 277039 - RNA, 22 nt, Human
ucaauauucuucuuuaguagga

SEQ ID NO: 277040 - RNA, 22 nt, Human
ucuccagggacauguuucugga

SEQ ID NO: 277041 - RNA, 22 nt, Human
gugcugagcugcagaugcgcuc

SEQ ID NO: 277042 - RNA, 22 nt, Human
ggcucugccucugacccucugg

SEQ ID NO: 277043 - RNA, 22 nt, Human
uggaaauacuugccauaaaacu

SEQ ID NO: 277044 - RNA, 22 nt, Human
ugucugagcuuuaugauggaag

SEQ ID NO: 277045 - RNA, 23 nt, Human
aaaugcacaguauugauuuuuaa

SEQ ID NO: 277046 - RNA, 22 nt, Human
ucagggcagguuaacuugggug

SEQ ID NO: 277047 - RNA, 22 nt, Human
uacuuauuguugaacugaauca

SEQ ID NO: 277048 - RNA, 22 nt, Human
uucuucuuuccaauuacauggu

SEQ ID NO: 277049 - RNA, 22 nt, Human
gcaccagagggggcucugcagg

SEQ ID NO: 277050 - RNA, 22 nt, Human
uggcucagccagcccuaggaac

SEQ ID NO: 277051 - RNA, 22 nt, Human
gacauggauacuugauaagggg

SEQ ID NO: 277052 - RNA, 22 nt, Human
caaacugagcaucagaaaguuu

SEQ ID NO: 277053 - RNA, 22 nt, Human
aagacaaagggguccuuggaug

SEQ ID NO: 277054 - RNA, 22 nt, Human
uuagagauugucuaguauugug

SEQ ID NO: 277055 - RNA, 22 nt, Human
ugagagcaacacgcaguaguau

SEQ ID NO: 277056 - RNA, 22 nt, Human
uucuaacucuacacuagcuuug

SEQ ID NO: 277057 - RNA, 22 nt, Human
agguggcuucuggccaggugug

SEQ ID NO: 277058 - RNA, 22 nt, Human
gacauucauuaagccuuucugu

SEQ ID NO: 277059 - RNA, 22 nt, Human
cugcugggggacacagguccgg

SEQ ID NO: 277060 - RNA, 22 nt, Human
uggcagccucagacaaggaccu

SEQ ID NO: 277061 - RNA, 22 nt, Human
uucuuggaaacugauuccuugu

SEQ ID NO: 277062 - RNA, 22 nt, Human
agagccagcauuugggcccugc

SEQ ID NO: 277063 - RNA, 22 nt, Human
acuccuggguuccggagauucu

SEQ ID NO: 277064 - RNA, 22 nt, Human
ucccugggguaacauuagaggg

SEQ ID NO: 277065 - RNA, 22 nt, Human
agaugagugagagcaucaacuu

SEQ ID NO: 277066 - RNA, 22 nt, Human
ucucuguagggcugcuugagua

SEQ ID NO: 277067 - RNA, 22 nt, Human
ccagaggagcauggccuugaga

SEQ ID NO: 277068 - RNA, 22 nt, Human
cuucucagcauuuugucagucu

SEQ ID NO: 277069 - RNA, 22 nt, Human
ugcaauuaugggcaauuuuuaa

SEQ ID NO: 277070 - RNA, 22 nt, Human
uguguuuugaacucaucuacug

SEQ ID NO: 277071 - RNA, 22 nt, Human
aggcaggugggucacuugaguc

SEQ ID NO: 277072 - RNA, 22 nt, Human
uauaucuuauaugugcagguac

SEQ ID NO: 277073 - RNA, 22 nt, Human
caggcuagcagggcccagggca

SEQ ID NO: 277074 - RNA, 22 nt, Human
uccuggcuaguuuugcugaaau

SEQ ID NO: 277075 - RNA, 22 nt, Human
uggcaggugccaugggcucaga

SEQ ID NO: 277076 - RNA, 22 nt, Human
guguuacuuaauuagaaucugc

SEQ ID NO: 277077 - RNA, 22 nt, Human
aagaaauggcuucaucugagua

SEQ ID NO: 277078 - RNA, 22 nt, Human
cugggcucuucccagauccaga

SEQ ID NO: 277079 - RNA, 22 nt, Human
aaagcaaugcccguucauuauc

SEQ ID NO: 277080 - RNA, 22 nt, Human
gaaguuuauuucaaucuauuca

SEQ ID NO: 277081 - RNA, 22 nt, Human
cagggaugagagauggcacaga

SEQ ID NO: 277082 - RNA, 22 nt, Human
acccagagaacugugccuugag

SEQ ID NO: 277083 - RNA, 22 nt, Human
cacagcagacagggaggcggcu

SEQ ID NO: 277084 - RNA, 22 nt, Human
cagagcuggggacuguuggaug

SEQ ID NO: 277085 - RNA, 18 nt, Human
gccugggagaaguuucac

SEQ ID NO: 277086 - RNA, 20 nt, Human
ggcucuggaaucuggugggc

SEQ ID NO: 277087 - RNA, 22 nt, Human
ggcaggcauggccacucccuag

SEQ ID NO: 277088 - RNA, 22 nt, Human
cuugccuguggcuaguuggcuc

SEQ ID NO: 277089 - RNA, 20 nt, Human
uauacuaacauauaucuguu

SEQ ID NO: 277090 - RNA, 22 nt, Human
ucucagagauuuuguuucccuu

SEQ ID NO: 277091 - RNA, 22 nt, Human
uaaggacaauuugucgcuugca

SEQ ID NO: 277092 - RNA, 19 nt, Human
cagagagaccaaggcgcca

SEQ ID NO: 277093 - RNA, 22 nt, Human
cagggcuccccgcaccgcagcc

SEQ ID NO: 277094 - RNA, 22 nt, Human
gguuucaaauuaaagucuuaag

SEQ ID NO: 277095 - RNA, 22 nt, Human
agggccaggcucccaugucagg

SEQ ID NO: 277096 - RNA, 22 nt, Human
uucuguuuauaauuugcaguug

SEQ ID NO: 277097 - RNA, 22 nt, Human
auguccagagaacauuugcuuu

SEQ ID NO: 277098 - RNA, 22 nt, Human
gcucucuggguggugggcaaca

SEQ ID NO: 277099 - RNA, 22 nt, Human
aagaaccuauaugcugaugaau

SEQ ID NO: 277100 - RNA, 18 nt, Human
cagaaguccuucaaggcc

SEQ ID NO: 277101 - RNA, 22 nt, Human
uucaagcaccaaauuaguaggc

SEQ ID NO: 277102 - RNA, 22 nt, Human
cuccauacuuccaacaaacuuu

SEQ ID NO: 277103 - RNA, 22 nt, Human
gcugcccucugugacccggccc

SEQ ID NO: 277104 - RNA, 22 nt, Human
gacaauaaaaugaucuuacagu

SEQ ID NO: 277105 - RNA, 22 nt, Human
uggcuucugggacuugugagca

SEQ ID NO: 277106 - RNA, 22 nt, Human
uaccauuucuacauaucuuguc

SEQ ID NO: 277107 - RNA, 22 nt, Human
cagcucaggcucuccaugcucc

SEQ ID NO: 277108 - RNA, 22 nt, Human
caagcuuguuucuccugggggu

SEQ ID NO: 277109 - RNA, 22 nt, Human
cagcuuucuaccuuaggcagug

SEQ ID NO: 277110 - RNA, 22 nt, Human
cccaggaguaagugacauuguu

SEQ ID NO: 277111 - RNA, 22 nt, Human
gaaucaauuauccaggcuguug

SEQ ID NO: 277112 - RNA, 22 nt, Human
agucccagagaggucggggcca

SEQ ID NO: 277113 - RNA, 22 nt, Human
ugggcucucucaccuggaggcu

SEQ ID NO: 277114 - RNA, 22 nt, Human
aauguauuugauguauuagccu

SEQ ID NO: 277115 - RNA, 22 nt, Human
acauucuugaagugaaguuuau

SEQ ID NO: 277116 - RNA, 22 nt, Human
cuggcuguuucaggcagugucc

SEQ ID NO: 277117 - RNA, 22 nt, Human
gcuggaaaucaaagaaguggau

SEQ ID NO: 277118 - RNA, 22 nt, Human
agccccugggaguagcugcugc

SEQ ID NO: 277119 - RNA, 22 nt, Human
ugcauacacaugugcacauacg

SEQ ID NO: 277120 - RNA, 22 nt, Human
aaaauugucgaacaguaguaac

SEQ ID NO: 277121 - RNA, 22 nt, Human
acucuguagaguauaccaaugu

SEQ ID NO: 277122 - RNA, 22 nt, Human
uuucaugucauuccauuucaga

SEQ ID NO: 277123 - RNA, 22 nt, Human
agagaauuacagaagaauguca

SEQ ID NO: 277124 - RNA, 22 nt, Human
gggugggguucaggaaucuuca

SEQ ID NO: 277125 - RNA, 22 nt, Human
uggaagccucaguuugccuucu

SEQ ID NO: 277126 - RNA, 22 nt, Human
ucugggcugggcuuaggaaccc

SEQ ID NO: 277127 - RNA, 22 nt, Human
augcaggaguucgaggcuguau

SEQ ID NO: 277128 - RNA, 22 nt, Human
ccacuggcaguuggcuagccuu

SEQ ID NO: 277129 - RNA, 22 nt, Human
uggggagagauugaggaguuuu

SEQ ID NO: 277130 - RNA, 22 nt, Human
acagcaggagccuucauaugcu

SEQ ID NO: 277131 - RNA, 22 nt, Human
aggguccauucuuugccuuuuc

SEQ ID NO: 277132 - RNA, 22 nt, Human
cugaggagucaguuccacucag

SEQ ID NO: 277133 - RNA, 22 nt, Human
acuaaauggaaugauuacuaua

SEQ ID NO: 277134 - RNA, 22 nt, Human
cuguacagaguucugaguguac

SEQ ID NO: 277135 - RNA, 22 nt, Human
agggcucugagcuggaccaccu

SEQ ID NO: 277136 - RNA, 22 nt, Human
gcucuuuguauuuuggaaucaa

SEQ ID NO: 277137 - RNA, 22 nt, Human
ggcucuggcuacuccacccugu

SEQ ID NO: 277138 - RNA, 22 nt, Human
aacaggcuuuuggaaaguuaca

SEQ ID NO: 277139 - RNA, 22 nt, Human
gcagggcuggggcugcuccuga

SEQ ID NO: 277140 - RNA, 21 nt, Human
cugcaucucauagaacauguc

SEQ ID NO: 277141 - RNA, 22 nt, Human
gggaggaaagagaaguggucca

SEQ ID NO: 277142 - RNA, 22 nt, Human
gggcccuggacguggcggcaga

SEQ ID NO: 277143 - RNA, 22 nt, Human
gagaugggcgagaagguggacu

SEQ ID NO: 277144 - RNA, 22 nt, Human
ggaaaacaagagaaugauguuu

SEQ ID NO: 277145 - RNA, 17 nt, Human
gucugggcuuuagagac

SEQ ID NO: 277146 - RNA, 22 nt, Human
aacgugcauuaggaccucucca

SEQ ID NO: 277147 - RNA, 22 nt, Human
aggcucucagaucagccacauu

SEQ ID NO: 277148 - RNA, 22 nt, Human
guuuucuggcaguuauuccuua

SEQ ID NO: 277149 - RNA, 20 nt, Human
acacaagcacuucugguauu

SEQ ID NO: 277150 - RNA, 22 nt, Human
cacaguuugguauagaagugau

SEQ ID NO: 277151 - RNA, 22 nt, Human
gacacuuuggugcuuugugguu

SEQ ID NO: 277152 - RNA, 22 nt, Human
ucacaugcucaccuaagccaca

SEQ ID NO: 277153 - RNA, 22 nt, Human
ccagcugguaagugauggagcc

SEQ ID NO: 277154 - RNA, 22 nt, Human
cuggagccggcgagccccagcc

SEQ ID NO: 277155 - RNA, 22 nt, Human
gugcauuaacaacccagaacuc

SEQ ID NO: 277156 - RNA, 22 nt, Human
guggcugcagagccagcaagcu

SEQ ID NO: 277157 - RNA, 22 nt, Human
ccugcaccucugugcuuggaac

SEQ ID NO: 277158 - RNA, 22 nt, Human
gagguccagccaagcggcaagg

SEQ ID NO: 277159 - RNA, 22 nt, Human
auauuagguuggugcaaaagua

SEQ ID NO: 277160 - RNA, 22 nt, Human
aagaagcauucuuucauugguu

SEQ ID NO: 277161 - RNA, 22 nt, Human
cuccugugggucaccaauaggc

SEQ ID NO: 277162 - RNA, 22 nt, Human
gaauuacauuuguguuacugca

SEQ ID NO: 277163 - RNA, 22 nt, Human
ggccagaggugguacauagcuu

SEQ ID NO: 277164 - RNA, 22 nt, Human
aucuagaagucauggcuuucuu

SEQ ID NO: 277165 - RNA, 22 nt, Human
uguguacaagaguguuuacugu

SEQ ID NO: 277166 - RNA, 22 nt, Human
aagcucagagucucggagggaa

SEQ ID NO: 277167 - RNA, 22 nt, Human
uccauacauacagauaugcauu

SEQ ID NO: 277168 - RNA, 22 nt, Human
ucccagccuuaucuccccuggc

SEQ ID NO: 277169 - RNA, 22 nt, Human
cauuuccagcuccugcaucaug

SEQ ID NO: 277170 - RNA, 22 nt, Human
cacaguauucacugggcagauu

SEQ ID NO: 277171 - RNA, 22 nt, Human
gcuguauuggaacacauccaug

SEQ ID NO: 277172 - RNA, 22 nt, Human
caaguccucaaagggcucugcu

SEQ ID NO: 277173 - RNA, 22 nt, Human
aaaauuacuauuguuccugggc

SEQ ID NO: 277174 - RNA, 22 nt, Human
gcccugagccaccaaugccauu

SEQ ID NO: 277175 - RNA, 22 nt, Human
agcagggguaacagaaggaaag

SEQ ID NO: 277176 - RNA, 22 nt, Human
gcacagcaauuucuauaagcuc

SEQ ID NO: 277177 - RNA, 23 nt, Human
uagggcagcugggagggacaugc

SEQ ID NO: 277178 - RNA, 22 nt, Human
ucaaagaacaucaucugaaaug

SEQ ID NO: 277179 - RNA, 21 nt, Human
ugcaggcuacuucugacucua

SEQ ID NO: 277180 - RNA, 22 nt, Human
agaaauguauucuguauguuuu

SEQ ID NO: 277181 - RNA, 22 nt, Human
gaggggagacagggaaaucagu

SEQ ID NO: 277182 - RNA, 22 nt, Human
cagaugaggggcauauaacaau

SEQ ID NO: 277183 - RNA, 22 nt, Human
aaagaaggaugggagaaauccu

SEQ ID NO: 277184 - RNA, 22 nt, Human
ggaggggccggcugccugccac

SEQ ID NO: 277185 - RNA, 22 nt, Human
acauaugugucugcacaugccc

SEQ ID NO: 277186 - RNA, 22 nt, Human
gagcaggccagcaauggaaggg

SEQ ID NO: 277187 - RNA, 22 nt, Human
aagacaggaaaagcuccaggcc

SEQ ID NO: 277188 - RNA, 22 nt, Human
uaaacucucaacagagaaccac

SEQ ID NO: 277189 - RNA, 22 nt, Human
uucuguauguacauauguguau

SEQ ID NO: 277190 - RNA, 19 nt, Human
uagcccuggccaucaugag

SEQ ID NO: 277191 - RNA, 20 nt, Human
ugauuucucuucuauuccuu

SEQ ID NO: 277192 - RNA, 22 nt, Human
ucagucuucuagcaaauccagg

SEQ ID NO: 277193 - RNA, 22 nt, Human
aaugcaaauuaucaggcuucuc

SEQ ID NO: 277194 - RNA, 22 nt, Human
aguguauuaucagaaacugugg

SEQ ID NO: 277195 - RNA, 22 nt, Human
aacuugaaaaccucaugaauug

SEQ ID NO: 277196 - RNA, 22 nt, Human
cggcagggcuccaugcauuucu

SEQ ID NO: 277197 - RNA, 22 nt, Human
ggaugacaaggaaagcaaacca

SEQ ID NO: 277198 - RNA, 22 nt, Human
cuuguuuaauaauaccuuagca

SEQ ID NO: 277199 - RNA, 20 nt, Human
gagcaguggaguuuccaggg

SEQ ID NO: 277200 - RNA, 22 nt, Human
gggaggaggaauguuuugugua

SEQ ID NO: 277201 - RNA, 22 nt, Human
gcuaucuucauggaaauacagg

SEQ ID NO: 277202 - RNA, 22 nt, Human
agggaccucauguaaguggauu

SEQ ID NO: 277203 - RNA, 22 nt, Human
acaauauuguacccagaaguuu

SEQ ID NO: 277204 - RNA, 22 nt, Human
caguccugugucccuugguggg

SEQ ID NO: 277205 - RNA, 22 nt, Human
uacaccauucccagguggauuu

SEQ ID NO: 277206 - RNA, 22 nt, Human
cauggugaggggugaagggcag

SEQ ID NO: 277207 - RNA, 22 nt, Human
ucuuuccagaggaauuuuuaga

SEQ ID NO: 277208 - RNA, 22 nt, Human
cugauugagaaggaaggggauc

SEQ ID NO: 277209 - RNA, 22 nt, Human
gcugggcuuguggccagcuggg

SEQ ID NO: 277210 - RNA, 22 nt, Human
augugucuuugagacucugcua

SEQ ID NO: 277211 - RNA, 22 nt, Human
aagacccuaccccuggagagga

SEQ ID NO: 277212 - RNA, 22 nt, Human
agaacaauguuaaauuauuaag

SEQ ID NO: 277213 - RNA, 22 nt, Human
ucacaaaaggccauguggcuuc

SEQ ID NO: 277214 - RNA, 22 nt, Human
ggcaggugcucaaaaauauuug

SEQ ID NO: 277215 - RNA, 22 nt, Human
auuuuacuaaguggauaucugu

SEQ ID NO: 277216 - RNA, 21 nt, Human
aucucacagcccagagaagcc

SEQ ID NO: 277217 - RNA, 22 nt, Human
caggccuuugcagggagagaga

SEQ ID NO: 277218 - RNA, 22 nt, Human
uccuggagugucuuccccaagg

SEQ ID NO: 277219 - RNA, 22 nt, Human
auugcaaaugguuuggucaucu

SEQ ID NO: 277220 - RNA, 22 nt, Human
uaucagaaaucaacacacagug

SEQ ID NO: 277221 - RNA, 19 nt, Human
agcaaauacaucaaaauug

SEQ ID NO: 277222 - RNA, 22 nt, Human
cagcagccauguaccacacuca

SEQ ID NO: 277223 - RNA, 22 nt, Human
aacugagggcccugcugaagca

SEQ ID NO: 277224 - RNA, 22 nt, Human
agacaggcagaggcugcagagg

SEQ ID NO: 277225 - RNA, 22 nt, Human
ggcuggagacaacguccugccc

SEQ ID NO: 277226 - RNA, 22 nt, Human
cuuagggaauugggaggaugcc

SEQ ID NO: 277227 - RNA, 23 nt, Human
cagcccuuccugcauguuuuugu

SEQ ID NO: 277228 - RNA, 22 nt, Human
ugucacauauauaauguucaau

SEQ ID NO: 277229 - RNA, 22 nt, Human
cugcagagaugaagaagguggc

SEQ ID NO: 277230 - RNA, 22 nt, Human
aagcuuuaagugucagucagcc

SEQ ID NO: 277231 - RNA, 22 nt, Human
uagcaagaagggagaugggguu

SEQ ID NO: 277232 - RNA, 22 nt, Human
uuccaggaugggcuguccuacu

SEQ ID NO: 277233 - RNA, 22 nt, Human
ucucuucacaugcuugcuccaa

SEQ ID NO: 277234 - RNA, 22 nt, Human
aagugucugcaaaaugacagag

SEQ ID NO: 277235 - RNA, 21 nt, Human
agcugccacccuagcuucuga

SEQ ID NO: 277236 - RNA, 22 nt, Human
uccuuccaugguggggcugcuu

SEQ ID NO: 277237 - RNA, 22 nt, Human
ucuagaauuuugccauauagcu

SEQ ID NO: 277238 - RNA, 22 nt, Human
cacacuuugugcuaaucuauuu

SEQ ID NO: 277239 - RNA, 22 nt, Human
gggcagugguuacacagcugag

SEQ ID NO: 277240 - RNA, 22 nt, Human
caggcucccuaagucagcagcc

SEQ ID NO: 277241 - RNA, 20 nt, Human
ugaauagagagcacauaugc

SEQ ID NO: 277242 - RNA, 22 nt, Human
caccagcuuacagucucacccc

SEQ ID NO: 277243 - RNA, 22 nt, Human
ccucuuuguucaggcugcuggc

SEQ ID NO: 277244 - RNA, 22 nt, Human
cuucucccuggcuucugcacac

SEQ ID NO: 277245 - RNA, 23 nt, Human
ugagaagccgccgggcagccugg

SEQ ID NO: 277246 - RNA, 22 nt, Human
ugagggacucccggcccugcca

SEQ ID NO: 277247 - RNA, 22 nt, Human
uuuguguuggaagaaaugcuac

SEQ ID NO: 277248 - RNA, 22 nt, Human
cuaaaugucauggaguuguaga

SEQ ID NO: 277249 - RNA, 17 nt, Human
ucagcaaagacaaagga

SEQ ID NO: 277250 - RNA, 22 nt, Human
ccagcaucuaugugcuguugau

SEQ ID NO: 277251 - RNA, 22 nt, Human
cuggaaggcggagguuguagug

SEQ ID NO: 277252 - RNA, 22 nt, Human
auguacaguuucuagacucaaa

SEQ ID NO: 277253 - RNA, 22 nt, Human
cugagggagaagucacgggcag

SEQ ID NO: 277254 - RNA, 19 nt, Human
ugcucuggagccagcucuc

SEQ ID NO: 277255 - RNA, 22 nt, Human
cggaaacuacgugacacccguu

SEQ ID NO: 277256 - RNA, 22 nt, Human
ggcaaaaaguucccaucagugu

SEQ ID NO: 277257 - RNA, 22 nt, Human
ucacagagaaauguggcacaaa

SEQ ID NO: 277258 - RNA, 22 nt, Human
auguguccaaggccacaauagc

SEQ ID NO: 277259 - RNA, 22 nt, Human
acccaggcuggagugcaguagc

SEQ ID NO: 277260 - RNA, 22 nt, Human
guuguacaaaauaucagugagg

SEQ ID NO: 277261 - RNA, 22 nt, Human
aguaugcaaaugucauaagcau

SEQ ID NO: 277262 - RNA, 21 nt, Human
ccccugggagcccugucagua

SEQ ID NO: 277263 - RNA, 22 nt, Human
ggcugccuccucgagacaggau

SEQ ID NO: 277264 - RNA, 22 nt, Human
uuagaaccaggaacucuaauau

SEQ ID NO: 277265 - RNA, 22 nt, Human
ucagugcagacuguaaguugga

SEQ ID NO: 277266 - RNA, 22 nt, Human
ucugggaguuagaauacauggg

SEQ ID NO: 277267 - RNA, 22 nt, Human
uuauguuugaguauaugacuca

SEQ ID NO: 277268 - RNA, 22 nt, Human
ugggucuccaguucagggcagg

SEQ ID NO: 277269 - RNA, 22 nt, Human
gcucugggugaauggcagauug

SEQ ID NO: 277270 - RNA, 22 nt, Human
uuacaaagagugccagagugug

SEQ ID NO: 277271 - RNA, 21 nt, Human
uuugcugaagauuuuaggcug

SEQ ID NO: 277272 - RNA, 22 nt, Human
uccuggcccuguggccugcagu

SEQ ID NO: 277273 - RNA, 22 nt, Human
uuuggcucggcugcugauggug

SEQ ID NO: 277274 - RNA, 22 nt, Human
uguuuaaucuucaggacagucu

SEQ ID NO: 277275 - RNA, 22 nt, Human
uuugugaauagguuggcuucca

SEQ ID NO: 277276 - RNA, 20 nt, Human
cccuggagagaagcuccacg

SEQ ID NO: 277277 - RNA, 21 nt, Human
ugaaugaucugguugccuuuu

SEQ ID NO: 277278 - RNA, 22 nt, Human
aagaagcagcugccaggccagu

SEQ ID NO: 277279 - RNA, 22 nt, Human
acugccaaugguaguuugaugg

SEQ ID NO: 277280 - RNA, 22 nt, Human
uuguagaauuuggaucucggca

SEQ ID NO: 277281 - RNA, 22 nt, Human
gucuacuuuugucaucauugca

SEQ ID NO: 277282 - RNA, 22 nt, Human
uguggcagucucacuggagggc

SEQ ID NO: 277283 - RNA, 20 nt, Human
uugguugagccagggccugg

SEQ ID NO: 277284 - RNA, 22 nt, Human
uggcucucaauggcuguacuau

SEQ ID NO: 277285 - RNA, 22 nt, Human
aaagaaucagaagucucaaaca

SEQ ID NO: 277286 - RNA, 22 nt, Human
aaauacauuagacggagaguua

SEQ ID NO: 277287 - RNA, 22 nt, Human
agcucagggccaggcgcguuuc

SEQ ID NO: 277288 - RNA, 22 nt, Human
ccaggcucagcuauuaagaaac

SEQ ID NO: 277289 - RNA, 22 nt, Human
cuggugagacucagggaugcuu

SEQ ID NO: 277290 - RNA, 22 nt, Human
aggacaaaggaccagaucugga

SEQ ID NO: 277291 - RNA, 22 nt, Human
ggguccagcuacaucagggugg

SEQ ID NO: 277292 - RNA, 22 nt, Human
aaguauauuuagcugagcuugu

SEQ ID NO: 277293 - RNA, 22 nt, Human
uguuuucuagaaacaaugccua

SEQ ID NO: 277294 - RNA, 22 nt, Human
uacugucuauacacuugauuac

SEQ ID NO: 277295 - RNA, 21 nt, Human
uggcucugagccucauggcug

SEQ ID NO: 277296 - RNA, 22 nt, Human
ugcccaggcuggaaugcagugg

SEQ ID NO: 277297 - RNA, 22 nt, Human
cugggaggugaacagaaaaacu

SEQ ID NO: 277298 - RNA, 17 nt, Human
acaacagaaauguauuc

SEQ ID NO: 277299 - RNA, 22 nt, Human
gacaaaugaaugaugaacacca

SEQ ID NO: 277300 - RNA, 22 nt, Human
ucuggggaugagguccagugau

SEQ ID NO: 277301 - RNA, 22 nt, Human
cuccuacauaacccagcgaacu

SEQ ID NO: 277302 - RNA, 22 nt, Human
ccugccaggacauugcuugaag

SEQ ID NO: 277303 - RNA, 22 nt, Human
aggcacagcacaccuggccccc

SEQ ID NO: 277304 - RNA, 22 nt, Human
cuuuucuggaaucaucucuaac

SEQ ID NO: 277305 - RNA, 22 nt, Human
uccugggcuuuguuucucuccu

SEQ ID NO: 277306 - RNA, 22 nt, Human
auggcuucucgcuggcaccugu

SEQ ID NO: 277307 - RNA, 19 nt, Human
aggcuucuacccuguccag

SEQ ID NO: 277308 - RNA, 22 nt, Human
cacuccagccucagugacagag

SEQ ID NO: 277309 - RNA, 22 nt, Human
ucuuauuugcaacuggcucaga

SEQ ID NO: 277310 - RNA, 22 nt, Human
cugagccaguagucagggacaa

SEQ ID NO: 277311 - RNA, 22 nt, Human
cuccugucccggggaccgccga

SEQ ID NO: 277312 - RNA, 22 nt, Human
ucaauucaauugaacaguuacu

SEQ ID NO: 277313 - RNA, 22 nt, Human
uuggcugcugggaacucaaaca

SEQ ID NO: 277314 - RNA, 22 nt, Human
agucucucuugggugugguuug

SEQ ID NO: 277315 - RNA, 22 nt, Human
ucacagacucaagggcauagga

SEQ ID NO: 277316 - RNA, 22 nt, Human
gcagagcuucuguccuucagga

SEQ ID NO: 277317 - RNA, 22 nt, Human
gaaucauuuagcucugcaugga

SEQ ID NO: 277318 - RNA, 22 nt, Human
auguuucucacuguuucucuau

SEQ ID NO: 277319 - RNA, 22 nt, Human
uucauagugauuguucagauag

SEQ ID NO: 277320 - RNA, 20 nt, Human
ccagagaguagguuagugau

SEQ ID NO: 277321 - RNA, 19 nt, Human
aacaccagagucaggaguc

SEQ ID NO: 277322 - RNA, 22 nt, Human
uuuccuugccuccuguccuucu

SEQ ID NO: 277323 - RNA, 22 nt, Human
uaugcacacauguaugcaugug

SEQ ID NO: 277324 - RNA, 22 nt, Human
ggcugaggcucaugccaucuug

SEQ ID NO: 277325 - RNA, 22 nt, Human
augugucucuaaaauuuaguaa

SEQ ID NO: 277326 - RNA, 22 nt, Human
uaagucuucauagucuaauguc

SEQ ID NO: 277327 - RNA, 22 nt, Human
gccugcugggagacacccccag

SEQ ID NO: 277328 - RNA, 22 nt, Human
cacuugaacuguuugaaugaga

SEQ ID NO: 277329 - RNA, 22 nt, Human
acaucugauuacaugagaauau

SEQ ID NO: 277330 - RNA, 22 nt, Human
agcaaguaguaccaaguagcuc

SEQ ID NO: 277331 - RNA, 22 nt, Human
uagaaacaaugacaugcuugua

SEQ ID NO: 277332 - RNA, 22 nt, Human
ggcucaggaugagccuucucau

SEQ ID NO: 277333 - RNA, 23 nt, Human
agcugagaauaaggagccguuug

SEQ ID NO: 277334 - RNA, 22 nt, Human
ccugguggcgaauggugguagg

SEQ ID NO: 277335 - RNA, 22 nt, Human
cuucagcagccucuugcauaaa

SEQ ID NO: 277336 - RNA, 22 nt, Human
auaaauagugugucauaaaguc

SEQ ID NO: 277337 - RNA, 22 nt, Human
gcccagggcugcaaguggacgc

SEQ ID NO: 277338 - RNA, 22 nt, Human
ucuggcagugauuucugugauc

SEQ ID NO: 277339 - RNA, 22 nt, Human
gaaaaggcagaguuccggggaa

SEQ ID NO: 277340 - RNA, 19 nt, Human
cauauugugcuugcauuuu

SEQ ID NO: 277341 - RNA, 22 nt, Human
cacaauauuggccgggcugguc

SEQ ID NO: 277342 - RNA, 22 nt, Human
uguaucuguaaucccagaucaa

SEQ ID NO: 277343 - RNA, 22 nt, Human
uacagcuuuagcaaauuaccua

SEQ ID NO: 277344 - RNA, 22 nt, Human
acuguggccaaagccucuggga

SEQ ID NO: 277345 - RNA, 22 nt, Human
aaggcaaaagaggugucaucac

SEQ ID NO: 277346 - RNA, 22 nt, Human
ucaaaccugcugucuuguucau

SEQ ID NO: 277347 - RNA, 22 nt, Human
ggagagcugguagcuggcucca

SEQ ID NO: 277348 - RNA, 22 nt, Human
uauacacugauauaaggaguaa

SEQ ID NO: 277349 - RNA, 23 nt, Human
aucaaaguggaaaucaauuaucu

SEQ ID NO: 277350 - RNA, 22 nt, Human
uugcuaggauucauucuauacu

SEQ ID NO: 277351 - RNA, 18 nt, Human
ccugugcuccagcaucug

SEQ ID NO: 277352 - RNA, 22 nt, Human
acagggugacuuugugacagau

SEQ ID NO: 277353 - RNA, 22 nt, Human
ucugaaagcauaauuuguccca

SEQ ID NO: 277354 - RNA, 22 nt, Human
uggcagaaugaagacuggggcc

SEQ ID NO: 277355 - RNA, 22 nt, Human
cauuaucugagaguguccuaca

SEQ ID NO: 277356 - RNA, 22 nt, Human
gucuucaauagagccucaauuu

SEQ ID NO: 277357 - RNA, 22 nt, Human
ccaggcacuuguuugccaggca

SEQ ID NO: 277358 - RNA, 23 nt, Human
ucagaacaaugccuuaggggcau

SEQ ID NO: 277359 - RNA, 22 nt, Human
agucugagguaauauuuuucuc

SEQ ID NO: 277360 - RNA, 20 nt, Human
auucuaaagcucugcucuuu

SEQ ID NO: 277361 - RNA, 22 nt, Human
guauaucuucagaaauuauagg

SEQ ID NO: 277362 - RNA, 22 nt, Human
uugcagacauuccagagcuuuu

SEQ ID NO: 277363 - RNA, 22 nt, Human
uugcaaggugauaaaagaauga

SEQ ID NO: 277364 - RNA, 21 nt, Human
uggcugccuacaugcugcagg

SEQ ID NO: 277365 - RNA, 22 nt, Human
auaauuuaauuuucacaguggu

SEQ ID NO: 277366 - RNA, 22 nt, Human
gcagcuggucuggccuagagua

SEQ ID NO: 277367 - RNA, 22 nt, Human
auauacuuccccauuauggggg

SEQ ID NO: 277368 - RNA, 22 nt, Human
ucauaaaaauagacucuaaagu

SEQ ID NO: 277369 - RNA, 22 nt, Human
uggaaacuaagacuagagagac

SEQ ID NO: 277370 - RNA, 18 nt, Human
ugaggcucagcuccuggu

SEQ ID NO: 277371 - RNA, 22 nt, Human
ucugccaguauucacggcccgu

SEQ ID NO: 277372 - RNA, 22 nt, Human
auguacaaaauguuuugaaaug

SEQ ID NO: 277373 - RNA, 22 nt, Human
uacaacacuguucagccucuuc

SEQ ID NO: 277374 - RNA, 22 nt, Human
uuuagagaguguaaaaauauau

SEQ ID NO: 277375 - RNA, 22 nt, Human
ucaguaaauaacucagaugcuc

SEQ ID NO: 277376 - RNA, 19 nt, Human
ugguccagcuucuucuccu

SEQ ID NO: 277377 - RNA, 22 nt, Human
ugggacagguuggagagaagca

SEQ ID NO: 277378 - RNA, 22 nt, Human
gcaggccacaguggagucucug

SEQ ID NO: 277379 - RNA, 22 nt, Human
gaggggcaagaaguuggccucu

SEQ ID NO: 277380 - RNA, 22 nt, Human
cugauaauguccugcaguaaau

SEQ ID NO: 277381 - RNA, 20 nt, Human
accugggauuagauacccaa

SEQ ID NO: 277382 - RNA, 20 nt, Human
cuccugggacugcugguuau

SEQ ID NO: 277383 - RNA, 22 nt, Human
uuaggaagaaggaggcaguauu

SEQ ID NO: 277384 - RNA, 22 nt, Human
ugccucccucucugccacugga

SEQ ID NO: 277385 - RNA, 22 nt, Human
ugagauaauuaaaucaaaaccu

SEQ ID NO: 277386 - RNA, 23 nt, Human
agcuuugugaaagcagacauggg

SEQ ID NO: 277387 - RNA, 22 nt, Human
aagcccuggauuaaagaugcca

SEQ ID NO: 277388 - RNA, 22 nt, Human
uguccagggauggggucaggga

SEQ ID NO: 277389 - RNA, 22 nt, Human
agcagccaguucucugugguag

SEQ ID NO: 277390 - RNA, 22 nt, Human
guaacaaaguuucuaggugcug

SEQ ID NO: 277391 - RNA, 22 nt, Human
uuucaaagucaagaaggauacu

SEQ ID NO: 277392 - RNA, 22 nt, Human
ggugcugggaacgaggaauuca

SEQ ID NO: 277393 - RNA, 22 nt, Human
gcuccugggcccugggcuaacu

SEQ ID NO: 277394 - RNA, 22 nt, Human
caucagugagccccuugaugag

SEQ ID NO: 277395 - RNA, 18 nt, Human
uguaaacacuuucauucu

SEQ ID NO: 277396 - RNA, 22 nt, Human
ccugcucuagacucugggaagg

SEQ ID NO: 277397 - RNA, 23 nt, Human
augguuuauguuguugugaagca

SEQ ID NO: 277398 - RNA, 22 nt, Human
aagcagaaaaacugagcuccaa

SEQ ID NO: 277399 - RNA, 22 nt, Human
ucugaagauggaggaacuuaga

SEQ ID NO: 277400 - RNA, 22 nt, Human
ugagcagauggaggcuucugca

SEQ ID NO: 277401 - RNA, 22 nt, Human
ucagggcacauucugcaguggc

SEQ ID NO: 277402 - RNA, 22 nt, Human
gcagaggacacaggagggcaag

SEQ ID NO: 277403 - RNA, 22 nt, Human
gcaguguuacuuggaguacuaa

SEQ ID NO: 277404 - RNA, 22 nt, Human
cucucuggaagggggagcugau

SEQ ID NO: 277405 - RNA, 22 nt, Human
gagcuuggacaagcucugaagg

SEQ ID NO: 277406 - RNA, 22 nt, Human
guuuccuacacuguaguauuau

SEQ ID NO: 277407 - RNA, 22 nt, Human
uccagagagguuucuccaugcu

SEQ ID NO: 277408 - RNA, 22 nt, Human
caacacagggguuaugccaugg

SEQ ID NO: 277409 - RNA, 22 nt, Human
uaucuuuaacuugcaguauuua

SEQ ID NO: 277410 - RNA, 22 nt, Human
ugagauuuuaauauugagaaaa

SEQ ID NO: 277411 - RNA, 22 nt, Human
gucuucuuguuuugaaggaaau

SEQ ID NO: 277412 - RNA, 22 nt, Human
cccugcagcauucucuaacugg

SEQ ID NO: 277413 - RNA, 22 nt, Human
ucauagaaugaguuaaugaacu

SEQ ID NO: 277414 - RNA, 22 nt, Human
acaggcucaguucacuggauuu

SEQ ID NO: 277415 - RNA, 22 nt, Human
aucucuguaauuacaugauauu

SEQ ID NO: 277416 - RNA, 22 nt, Human
uagaaagcugaguaauacauuu

SEQ ID NO: 277417 - RNA, 22 nt, Human
gcagggcaaauguggaaaggag

SEQ ID NO: 277418 - RNA, 22 nt, Human
aauauuucaaaaggaaacacag

SEQ ID NO: 277419 - RNA, 22 nt, Human
auuacuaugauuugaucauuac

SEQ ID NO: 277420 - RNA, 22 nt, Human
uaaaauguuugcaagagaccag

SEQ ID NO: 277421 - RNA, 22 nt, Human
gcugccuccgccggcuccacag

SEQ ID NO: 277422 - RNA, 22 nt, Human
gcaaauguuuuugaguguuuac

SEQ ID NO: 277423 - RNA, 22 nt, Human
gcauucuucgaaguaaguagug

SEQ ID NO: 277424 - RNA, 22 nt, Human
ugacagggagguggaauaagua

SEQ ID NO: 277425 - RNA, 22 nt, Human
ugcucagcuggugccagggucc

SEQ ID NO: 277426 - RNA, 22 nt, Human
ucccaggcuggcaggcagcagu

SEQ ID NO: 277427 - RNA, 22 nt, Human
gaaaaugugucaucccuacugu

SEQ ID NO: 277428 - RNA, 22 nt, Human
cuggcugggguccauccucuaa

SEQ ID NO: 277429 - RNA, 22 nt, Human
cugcugcugagaaugccucagg

SEQ ID NO: 277430 - RNA, 19 nt, Human
ugggcagcucccucugucc

SEQ ID NO: 277431 - RNA, 22 nt, Human
guuuauugauaaaagcuggaca

SEQ ID NO: 277432 - RNA, 22 nt, Human
uuauucagggauaacauccagg

SEQ ID NO: 277433 - RNA, 23 nt, Human
ucccucaggccuuaucuccaucu

SEQ ID NO: 277434 - RNA, 22 nt, Human
ggaagaguaacaggagguggaa

SEQ ID NO: 277435 - RNA, 22 nt, Human
aguaaacaguuucuuagaagaa

SEQ ID NO: 277436 - RNA, 22 nt, Human
ccaggaggcagagguuguagug

SEQ ID NO: 277437 - RNA, 22 nt, Human
aguuuucacacucaccaaaagg

SEQ ID NO: 277438 - RNA, 22 nt, Human
augcauauguacccauguucug

SEQ ID NO: 277439 - RNA, 22 nt, Human
uugaggcacagauuuuaguggc

SEQ ID NO: 277440 - RNA, 22 nt, Human
ugcugggccuuuaccuccaggg

SEQ ID NO: 277441 - RNA, 22 nt, Human
ucucagaggugcccuggcaucu

SEQ ID NO: 277442 - RNA, 22 nt, Human
aaucuggagagucaucucugac

SEQ ID NO: 277443 - RNA, 22 nt, Human
gucccaggggagcucucugauu

SEQ ID NO: 277444 - RNA, 20 nt, Human
ugcagggcucugcuucucuc

SEQ ID NO: 277445 - RNA, 22 nt, Human
caugaaacaucagagauuucuc

SEQ ID NO: 277446 - RNA, 18 nt, Human
acagggagggcgcugggg

SEQ ID NO: 277447 - RNA, 22 nt, Human
uaacagaaauauuuccagguga

SEQ ID NO: 277448 - RNA, 22 nt, Human
agauauaauaauuuacaagugu

SEQ ID NO: 277449 - RNA, 22 nt, Human
augaauacgcggucauacacau

SEQ ID NO: 277450 - RNA, 22 nt, Human
ucccagcagggccgaccagccu

SEQ ID NO: 277451 - RNA, 22 nt, Human
uccuggagccaaugugcugcug

SEQ ID NO: 277452 - RNA, 22 nt, Human
ugugaauagauugaagcuuugg

SEQ ID NO: 277453 - RNA, 22 nt, Human
uucuaagucacucagauuuugg

SEQ ID NO: 277454 - RNA, 22 nt, Human
cuaauauuuuuagaaaucacga

SEQ ID NO: 277455 - RNA, 22 nt, Human
agggacagucuacuguucacug

SEQ ID NO: 277456 - RNA, 22 nt, Human
gcuggcacuugggacaaaaucu

SEQ ID NO: 277457 - RNA, 22 nt, Human
ugcuggcuuuaagguuaaagug

SEQ ID NO: 277458 - RNA, 22 nt, Human
aucugcuggcaucucuagccca

SEQ ID NO: 277459 - RNA, 22 nt, Human
aacaguaucuuuuaucagaaau

SEQ ID NO: 277460 - RNA, 19 nt, Human
uauucaggaugauggcaca

SEQ ID NO: 277461 - RNA, 22 nt, Human
acaucacagagcccagauaaag

SEQ ID NO: 277462 - RNA, 22 nt, Human
uuauacccuccauaccuggccu

SEQ ID NO: 277463 - RNA, 22 nt, Human
uccaggagguugagacugcagu

SEQ ID NO: 277464 - RNA, 22 nt, Human
ucaguguccuucguucuuguug

SEQ ID NO: 277465 - RNA, 22 nt, Human
aauagcauguuaauaaccagag

SEQ ID NO: 277466 - RNA, 22 nt, Human
aauugcuugaugacuaguaauu

SEQ ID NO: 277467 - RNA, 20 nt, Human
cccagcccgggccgcgcucg

SEQ ID NO: 277468 - RNA, 22 nt, Human
ccuggguccuggcagccuccug

SEQ ID NO: 277469 - RNA, 22 nt, Human
gggagcugagcuggaagagaau

SEQ ID NO: 277470 - RNA, 17 nt, Human
uuacagcagcaauagag

SEQ ID NO: 277471 - RNA, 22 nt, Human
gugagucugugggugggaacug

SEQ ID NO: 277472 - RNA, 22 nt, Human
aggguccuaagccucagauaag

SEQ ID NO: 277473 - RNA, 18 nt, Human
ccauuucaugauuauuac

SEQ ID NO: 277474 - RNA, 23 nt, Human
aaggugucauugaugggauucua

SEQ ID NO: 277475 - RNA, 22 nt, Human
ggugacaucuagagacauccaa

SEQ ID NO: 277476 - RNA, 22 nt, Human
uuugcagaguaccugaagagga

SEQ ID NO: 277477 - RNA, 22 nt, Human
ggcccugcucaggcugcgauga

SEQ ID NO: 277478 - RNA, 18 nt, Human
caaauacuguugucuuau

SEQ ID NO: 277479 - RNA, 22 nt, Human
uuccauauucccaauuuugcca

SEQ ID NO: 277480 - RNA, 22 nt, Human
uccagccacguauuaucucacu

SEQ ID NO: 277481 - RNA, 22 nt, Human
ugugacccccgucacggcugcu

SEQ ID NO: 277482 - RNA, 22 nt, Human
uagaucuuguuacagauuuccu

SEQ ID NO: 277483 - RNA, 22 nt, Human
uagaaagagcauaguauuauaa

SEQ ID NO: 277484 - RNA, 23 nt, Human
gcccaugcuguugggcccgagca

SEQ ID NO: 277485 - RNA, 22 nt, Human
uucagaaaugaauauugguauu

SEQ ID NO: 277486 - RNA, 22 nt, Human
guuguaaguuuaaugucaauug

SEQ ID NO: 277487 - RNA, 22 nt, Human
acucuacuguaguaugggcacu

SEQ ID NO: 277488 - RNA, 22 nt, Human
gcuguggaguacagagcugguu

SEQ ID NO: 277489 - RNA, 21 nt, Human
ugggugggcagagucucuuca

SEQ ID NO: 277490 - RNA, 22 nt, Human
aggaaacuggguaugguuauac

SEQ ID NO: 277491 - RNA, 22 nt, Human
auacuuuggucacuauuauugg

SEQ ID NO: 277492 - RNA, 22 nt, Human
ucuggaauuaaacucaggagac

SEQ ID NO: 277493 - RNA, 22 nt, Human
ugucaguuaccuagcacaagaa

SEQ ID NO: 277494 - RNA, 22 nt, Human
uggugaggccaaagccaugaca

SEQ ID NO: 277495 - RNA, 22 nt, Human
gccaggcaauguguuagaagcg

SEQ ID NO: 277496 - RNA, 22 nt, Human
ggguguccagggcgugucugga

SEQ ID NO: 277497 - RNA, 22 nt, Human
uggcugaguucuccaggaguag

SEQ ID NO: 277498 - RNA, 22 nt, Human
uuccuggcacugcagugguuga

SEQ ID NO: 277499 - RNA, 21 nt, Human
agccugaaucccaccaguuca

SEQ ID NO: 277500 - RNA, 21 nt, Human
acucugucuugagccaucugu

SEQ ID NO: 277501 - RNA, 22 nt, Human
auucugggugacuacgugauca

SEQ ID NO: 277502 - RNA, 18 nt, Human
uccaccagucaaucuguc

SEQ ID NO: 277503 - RNA, 22 nt, Human
cuccugggggacagcggcaggg

SEQ ID NO: 277504 - RNA, 22 nt, Human
ugcugggucccuugagagcuca

SEQ ID NO: 277505 - RNA, 22 nt, Human
augccuuaaggcgagauacuua

SEQ ID NO: 277506 - RNA, 17 nt, Human
cugggccucugcccuuu

SEQ ID NO: 277507 - RNA, 22 nt, Human
ugcugucugcaacaguacuaca

SEQ ID NO: 277508 - RNA, 22 nt, Human
uugagucugcaauacauaacac

SEQ ID NO: 277509 - RNA, 22 nt, Human
gccuucccaagacgccugaguu

SEQ ID NO: 277510 - RNA, 22 nt, Human
aaaggcuucggaucagaaggua

SEQ ID NO: 277511 - RNA, 21 nt, Human
cucagggcuugguguccucau

SEQ ID NO: 277512 - RNA, 22 nt, Human
cagacaggaaguucagaagaaa

SEQ ID NO: 277513 - RNA, 22 nt, Human
gggggcaguaaggauauggaaa

SEQ ID NO: 277514 - RNA, 21 nt, Human
acauacauuaucuuuuuaaaa

SEQ ID NO: 277515 - RNA, 17 nt, Human
gacaggcucagugacga

SEQ ID NO: 277516 - RNA, 22 nt, Human
acacauuuucuaacagggauca

SEQ ID NO: 277517 - RNA, 22 nt, Human
agugcuggaaagggacggagga

SEQ ID NO: 277518 - RNA, 22 nt, Human
aaagcugcccuugugaaacaag

SEQ ID NO: 277519 - RNA, 22 nt, Human
auauacacauguguauacauuu

SEQ ID NO: 277520 - RNA, 22 nt, Human
ggcucuggucagugaggggccu

SEQ ID NO: 277521 - RNA, 22 nt, Human
uuccuguguguugguggcagaa

SEQ ID NO: 277522 - RNA, 22 nt, Human
uccaaagccgacugacaucuga

SEQ ID NO: 277523 - RNA, 22 nt, Human
uucaauucuaaacuaauauucu

SEQ ID NO: 277524 - RNA, 22 nt, Human
ggugcugacugaggauggcuug

SEQ ID NO: 277525 - RNA, 22 nt, Human
uucuacacaccucugaggacau

SEQ ID NO: 277526 - RNA, 22 nt, Human
ccugugacgugucuccuggcac

SEQ ID NO: 277527 - RNA, 22 nt, Human
caagggcucacggucugcuggg

SEQ ID NO: 277528 - RNA, 22 nt, Human
acacauuuuggcuagguggaga

SEQ ID NO: 277529 - RNA, 19 nt, Human
gauagcugaugaccaucau

SEQ ID NO: 277530 - RNA, 22 nt, Human
gcuaacauugauucagugccug

SEQ ID NO: 277531 - RNA, 22 nt, Human
augauucuuuuggauagaugau

SEQ ID NO: 277532 - RNA, 22 nt, Human
uuacauucauugaagugauuca

SEQ ID NO: 277533 - RNA, 22 nt, Human
ugucacaugaagccaacauagc

SEQ ID NO: 277534 - RNA, 22 nt, Human
ucucccucuuugucugcuuugg

SEQ ID NO: 277535 - RNA, 22 nt, Human
cugcccuggaaaacguaucuua

SEQ ID NO: 277536 - RNA, 22 nt, Human
agacccuggggaaagucacuuc

SEQ ID NO: 277537 - RNA, 22 nt, Human
aagucucugauguguguuaggu

SEQ ID NO: 277538 - RNA, 22 nt, Human
acagcuguauccccagagcuca

SEQ ID NO: 277539 - RNA, 22 nt, Human
augaaaugcugagaggugcuuc

SEQ ID NO: 277540 - RNA, 22 nt, Human
aacuuucucuggauggcuuccu

SEQ ID NO: 277541 - RNA, 22 nt, Human
gucaggacucugacccgucccg

SEQ ID NO: 277542 - RNA, 22 nt, Human
cagaggcuagacugugcuuccu

SEQ ID NO: 277543 - RNA, 22 nt, Human
cauacauuaccuaacuuaaugc

SEQ ID NO: 277544 - RNA, 22 nt, Human
uggcagagcccagaacugagca

SEQ ID NO: 277545 - RNA, 22 nt, Human
ggaaggcucgaggaugcuucug

SEQ ID NO: 277546 - RNA, 22 nt, Human
uugaacaaucaaaagaauucau

SEQ ID NO: 277547 - RNA, 22 nt, Human
uguuuuaaucucccauugcucu

SEQ ID NO: 277548 - RNA, 22 nt, Human
gcagggcucagccgcucccacc

SEQ ID NO: 277549 - RNA, 22 nt, Human
ucugaauucuuagaauuaaagg

SEQ ID NO: 277550 - RNA, 22 nt, Human
gaggccuggguuggaggugcau

SEQ ID NO: 277551 - RNA, 22 nt, Human
ugcuagggauacaguggugaau

SEQ ID NO: 277552 - RNA, 22 nt, Human
ggcagagacuggguuggcagag

SEQ ID NO: 277553 - RNA, 22 nt, Human
acagguguaugaauauguucca

SEQ ID NO: 277554 - RNA, 22 nt, Human
ccacaucucgguccccucuuug

SEQ ID NO: 277555 - RNA, 22 nt, Human
aacauugcugaaagcugggaca

SEQ ID NO: 277556 - RNA, 22 nt, Human
acagccuuuaaccauuucuucc

SEQ ID NO: 277557 - RNA, 22 nt, Human
uucucuuugacauuauucaggu

SEQ ID NO: 277558 - RNA, 22 nt, Human
uguuuuaugagccauauaaccu

SEQ ID NO: 277559 - RNA, 22 nt, Human
ucuuagcagacuuggcuacugu

SEQ ID NO: 277560 - RNA, 22 nt, Human
agaagaugucacugcagacagc

SEQ ID NO: 277561 - RNA, 22 nt, Human
guaauuacauuaggguaaauaa

SEQ ID NO: 277562 - RNA, 22 nt, Human
ugggaagguuagcaguuuguca

SEQ ID NO: 277563 - RNA, 22 nt, Human
cugaggucagaguuuagucugg

SEQ ID NO: 277564 - RNA, 22 nt, Human
gcuuucugguuugugcuacagg

SEQ ID NO: 277565 - RNA, 22 nt, Human
aggucaaaaugcuuuucagguc

SEQ ID NO: 277566 - RNA, 21 nt, Human
gcaggguccuuuccauuccua

SEQ ID NO: 277567 - RNA, 22 nt, Human
aaagcacauaguagaaggauuu

SEQ ID NO: 277568 - RNA, 22 nt, Human
acaguaauugugaacuuaacgu

SEQ ID NO: 277569 - RNA, 22 nt, Human
uacaugugcacgugugacuuug

SEQ ID NO: 277570 - RNA, 22 nt, Human
augcacaguaaugagcugguug

SEQ ID NO: 277571 - RNA, 22 nt, Human
cagcugucacuucuaaguuuug

SEQ ID NO: 277572 - RNA, 22 nt, Human
accagcuguuaucuguaguauc

SEQ ID NO: 277573 - RNA, 22 nt, Human
auguccagaguguccuggaaag

SEQ ID NO: 277574 - RNA, 22 nt, Human
ccagcuuuuggggugacaauuu

SEQ ID NO: 277575 - RNA, 22 nt, Human
gcugucuuggaaaaggcaaaga

SEQ ID NO: 277576 - RNA, 22 nt, Human
agagagggcauagaaaaaggga

SEQ ID NO: 277577 - RNA, 21 nt, Human
auucaacuagaugauuauuuc

SEQ ID NO: 277578 - RNA, 22 nt, Human
aaagagaaaaugaucuguacau

SEQ ID NO: 277579 - RNA, 22 nt, Human
uacuuucuagcucuccccaguu

SEQ ID NO: 277580 - RNA, 22 nt, Human
auauuaggcaaggagauuauuu

SEQ ID NO: 277581 - RNA, 22 nt, Human
ugcugagggagcaucaaagaaa

SEQ ID NO: 277582 - RNA, 22 nt, Human
ucucuucugaaaccugucuuua

SEQ ID NO: 277583 - RNA, 22 nt, Human
agcagggcucugccaugggccc

SEQ ID NO: 277584 - RNA, 22 nt, Human
ucaaaugcucuuugcagagagg

SEQ ID NO: 277585 - RNA, 22 nt, Human
accagaggcucugccaccucca

SEQ ID NO: 277586 - RNA, 23 nt, Human
ucacacagcuggucagguacaga

SEQ ID NO: 277587 - RNA, 22 nt, Human
gcauucagccuaaagagaaaag

SEQ ID NO: 277588 - RNA, 22 nt, Human
agcuuugguugaggggagugug

SEQ ID NO: 277589 - RNA, 22 nt, Human
uuguacuaucaccaugucaugu

SEQ ID NO: 277590 - RNA, 23 nt, Human
uaguuacauuauugucagagcug

SEQ ID NO: 277591 - RNA, 22 nt, Human
acaggaugauaaaggauggcca

SEQ ID NO: 277592 - RNA, 22 nt, Human
cacaggagaaaggggaagcucg

SEQ ID NO: 277593 - RNA, 21 nt, Human
cucugguccugucuggcaggc

SEQ ID NO: 277594 - RNA, 22 nt, Human
agaggacagguuuuccaugggc

SEQ ID NO: 277595 - RNA, 22 nt, Human
ucagauuuuauuuuccuguuac

SEQ ID NO: 277596 - RNA, 22 nt, Human
gcugagcagguuugaugcuuuu

SEQ ID NO: 277597 - RNA, 22 nt, Human
caucacuacaaauuuaagaaau

SEQ ID NO: 277598 - RNA, 22 nt, Human
acugaauagugcugcauuguac

SEQ ID NO: 277599 - RNA, 22 nt, Human
uuauugacugaucagagaggga

SEQ ID NO: 277600 - RNA, 21 nt, Human
ugacauuuggauucauaguaa

SEQ ID NO: 277601 - RNA, 22 nt, Human
ucugcccaggaggucccauggg

SEQ ID NO: 277602 - RNA, 22 nt, Human
aggcuggaguguagcagugcag

SEQ ID NO: 277603 - RNA, 22 nt, Human
cuggauuaaguaaaauagagga

SEQ ID NO: 277604 - RNA, 23 nt, Human
uggcagauacaggcaugacuucu

SEQ ID NO: 277605 - RNA, 22 nt, Human
gggcugagugaccucaggccaa

SEQ ID NO: 277606 - RNA, 22 nt, Human
ucaccuugugaucucccugccu

SEQ ID NO: 277607 - RNA, 22 nt, Human
auagauuugaauuuaagacuug

SEQ ID NO: 277608 - RNA, 22 nt, Human
aacaugaaaguugcuaagugca

SEQ ID NO: 277609 - RNA, 22 nt, Human
aaaggacucagacugaagggag

SEQ ID NO: 277610 - RNA, 22 nt, Human
uggaaucucugguaucugggga

SEQ ID NO: 277611 - RNA, 20 nt, Human
gagccugggaagucuaaggu

SEQ ID NO: 277612 - RNA, 22 nt, Human
cuggcugccuauagucucccuu

SEQ ID NO: 277613 - RNA, 22 nt, Human
uaguccaggacaaucuucauau

SEQ ID NO: 277614 - RNA, 22 nt, Human
uccccagggucccugcuuccau

SEQ ID NO: 277615 - RNA, 22 nt, Human
agcagugugcuucguuucauga

SEQ ID NO: 277616 - RNA, 22 nt, Human
agacuguagggauagaggucuu

SEQ ID NO: 277617 - RNA, 22 nt, Human
cagguuggucggcaaguacaca

SEQ ID NO: 277618 - RNA, 22 nt, Human
ugcugggcuggggccucagacc

SEQ ID NO: 277619 - RNA, 22 nt, Human
acagggagaugggugaaagcgg

SEQ ID NO: 277620 - RNA, 22 nt, Human
uggcagguuaacuuacaacugu

SEQ ID NO: 277621 - RNA, 22 nt, Human
guacacauauauuaaaaauugu

SEQ ID NO: 277622 - RNA, 22 nt, Human
uggccacaguguccagcagcag

SEQ ID NO: 277623 - RNA, 22 nt, Human
ugauuuucuccauuguaaauuc

SEQ ID NO: 277624 - RNA, 22 nt, Human
cucugcuacuguuaaaccauuu

SEQ ID NO: 277625 - RNA, 22 nt, Human
uggcaugaauuuagcuuuccau

SEQ ID NO: 277626 - RNA, 22 nt, Human
gagcacagaacuaaaugcuggu

SEQ ID NO: 277627 - RNA, 22 nt, Human
gaagcagucagcagcaccuuug

SEQ ID NO: 277628 - RNA, 22 nt, Human
cuggcugugcugacugagaggg

SEQ ID NO: 277629 - RNA, 22 nt, Human
augcugaagaaucacagggacu

SEQ ID NO: 277630 - RNA, 22 nt, Human
aggugccuaucuggucucugca

SEQ ID NO: 277631 - RNA, 20 nt, Human
uggcaggagccacuggaagc

SEQ ID NO: 277632 - RNA, 22 nt, Human
uguauguaaaguuuguaauaga

SEQ ID NO: 277633 - RNA, 20 nt, Human
agcaagaguaaggacagcga

SEQ ID NO: 277634 - RNA, 22 nt, Human
ccagaggacuugggggcugaau

SEQ ID NO: 277635 - RNA, 22 nt, Human
aacagauaaguauaucuaugua

SEQ ID NO: 277636 - RNA, 22 nt, Human
gccccagccuaguuuucuuuca

SEQ ID NO: 277637 - RNA, 23 nt, Human
ccugacccugucucccucacaug

SEQ ID NO: 277638 - RNA, 22 nt, Human
ccaggcugcuuagccuuaucuu

SEQ ID NO: 277639 - RNA, 22 nt, Human
gcaggacaggcguugguccagu

SEQ ID NO: 277640 - RNA, 22 nt, Human
aguggggaagagcaugggcccu

SEQ ID NO: 277641 - RNA, 22 nt, Human
ccucucucuuguagucccugcc

SEQ ID NO: 277642 - RNA, 22 nt, Human
ccuggcacaucuaacucacucu

SEQ ID NO: 277643 - RNA, 22 nt, Human
gcucaaaggccagguagcagca

SEQ ID NO: 277644 - RNA, 22 nt, Human
ugcuggaggggaugccuucacu

SEQ ID NO: 277645 - RNA, 22 nt, Human
uuugcaaaccggagcucugcaa

SEQ ID NO: 277646 - RNA, 23 nt, Human
agacaaaagccucagucuuaggc

SEQ ID NO: 277647 - RNA, 22 nt, Human
aagugcuuucauauagucuuaa

SEQ ID NO: 277648 - RNA, 22 nt, Human
caucuuugccauaugauguaau

SEQ ID NO: 277649 - RNA, 18 nt, Human
agaggaugcaucuaagag

SEQ ID NO: 277650 - RNA, 22 nt, Human
cagggcugcuggccgugcccuc

SEQ ID NO: 277651 - RNA, 22 nt, Human
cuuacaggaaagaagaaagcau

SEQ ID NO: 277652 - RNA, 22 nt, Human
accucuguauaguugccugugg

SEQ ID NO: 277653 - RNA, 19 nt, Human
caggaaacaccuacugcua

SEQ ID NO: 277654 - RNA, 22 nt, Human
uuuccaaagcugaguugagcaa

SEQ ID NO: 277655 - RNA, 22 nt, Human
aggcuucugagcauggaguuuu

SEQ ID NO: 277656 - RNA, 23 nt, Human
ugagucuacucaccacaacuggg

SEQ ID NO: 277657 - RNA, 17 nt, Human
aaggagcugagagaugg

SEQ ID NO: 277658 - RNA, 22 nt, Human
uggcauuucaguauuuucauaa

SEQ ID NO: 277659 - RNA, 22 nt, Human
uagaaagaucuguaggcaagag

SEQ ID NO: 277660 - RNA, 22 nt, Human
auaguuuucuaugcacuguuau

SEQ ID NO: 277661 - RNA, 22 nt, Human
auccuguggggcggcugcaggg

SEQ ID NO: 277662 - RNA, 22 nt, Human
guccucugagggggcugcacgc

SEQ ID NO: 277663 - RNA, 22 nt, Human
cagcagagcauuugguaggagg

SEQ ID NO: 277664 - RNA, 17 nt, Human
aggcuggcucacaggga

SEQ ID NO: 277665 - RNA, 22 nt, Human
ugcucuauuaauuuuaacgaug

SEQ ID NO: 277666 - RNA, 22 nt, Human
agccaggauuggcugagccuua

SEQ ID NO: 277667 - RNA, 22 nt, Human
ggaggccaaggcagguggaucg

SEQ ID NO: 277668 - RNA, 22 nt, Human
acuguagagaaucugagaaaaa

SEQ ID NO: 277669 - RNA, 22 nt, Human
ggcugcaagacaagguugguuu

SEQ ID NO: 277670 - RNA, 22 nt, Human
ccagcccugaacccugcugcau

SEQ ID NO: 277671 - RNA, 21 nt, Human
uuucccagcagagauagcugg

SEQ ID NO: 277672 - RNA, 22 nt, Human
aggcugagccacggggcuggcu

SEQ ID NO: 277673 - RNA, 22 nt, Human
gucagagcccuucccugauuuu

SEQ ID NO: 277674 - RNA, 22 nt, Human
agugggggccaacgagggcagc

SEQ ID NO: 277675 - RNA, 22 nt, Human
acacaaauuguaggauaauugc

SEQ ID NO: 277676 - RNA, 22 nt, Human
ccugggaggcagagguugcagu

SEQ ID NO: 277677 - RNA, 22 nt, Human
ggcuuauguuugucaagcaauc

SEQ ID NO: 277678 - RNA, 22 nt, Human
ccccuuccaggaagcagaaucg

SEQ ID NO: 277679 - RNA, 22 nt, Human
gaggguggcuccucccugggcc

SEQ ID NO: 277680 - RNA, 23 nt, Human
aaccuagacuacuuacuaugugg

SEQ ID NO: 277681 - RNA, 22 nt, Human
uuuacagaugaggaaacugaga

SEQ ID NO: 277682 - RNA, 22 nt, Human
aagucauguggaagaauaaccu

SEQ ID NO: 277683 - RNA, 22 nt, Human
guuuuuucaugaguaguuaucu

SEQ ID NO: 277684 - RNA, 21 nt, Human
ccugggcugugguuuggagac

SEQ ID NO: 277685 - RNA, 21 nt, Human
caaaaggauaggaaauuaggg

SEQ ID NO: 277686 - RNA, 22 nt, Human
guccugggaacuggacagcuaa

SEQ ID NO: 277687 - RNA, 22 nt, Human
auuuauugguuugcauggugaa

SEQ ID NO: 277688 - RNA, 23 nt, Human
ucuuuucaaugguucuuuaugug

SEQ ID NO: 277689 - RNA, 16 nt, Human
ugaggucuuauuagca

SEQ ID NO: 277690 - RNA, 22 nt, Human
agggagacacaugaggaaguca

SEQ ID NO: 277691 - RNA, 22 nt, Human
caggcugcggucggcucugguc

SEQ ID NO: 277692 - RNA, 22 nt, Human
cucagcuaguaacguacauguc

SEQ ID NO: 277693 - RNA, 22 nt, Human
uccauauacaacuuaaucuuua

SEQ ID NO: 277694 - RNA, 22 nt, Human
acccauacacacauauuuaugu

SEQ ID NO: 277695 - RNA, 22 nt, Human
acauuucuuccuaauuaucccu

SEQ ID NO: 277696 - RNA, 22 nt, Human
ggagauggcuggcagguagaug

SEQ ID NO: 277697 - RNA, 22 nt, Human
uugcaacauuguaaguuuauau

SEQ ID NO: 277698 - RNA, 22 nt, Human
acaugacacaggccuggccaau

SEQ ID NO: 277699 - RNA, 22 nt, Human
auguuuguguuucccauucagg

SEQ ID NO: 277700 - RNA, 22 nt, Human
uggcagaguaggauggcccugu

SEQ ID NO: 277701 - RNA, 22 nt, Human
uguuuacuucaucgaguacuuc

SEQ ID NO: 277702 - RNA, 22 nt, Human
gucaggcuggggcugcugccag

SEQ ID NO: 277703 - RNA, 22 nt, Human
ucuguuuuguaccagauacagc

SEQ ID NO: 277704 - RNA, 22 nt, Human
gccgugcgugcgcaggugcugu

SEQ ID NO: 277705 - RNA, 22 nt, Human
ucugaaaauguugacuuuguuu

SEQ ID NO: 277706 - RNA, 22 nt, Human
aggaauguauugaccuguugca

SEQ ID NO: 277707 - RNA, 23 nt, Human
gggaccugguaggaggugauugg

SEQ ID NO: 277708 - RNA, 22 nt, Human
acucccuccaaaucugcacagu

SEQ ID NO: 277709 - RNA, 22 nt, Human
uccugcagagucccacugauuu

SEQ ID NO: 277710 - RNA, 22 nt, Human
ggaugcugacuuuggagcaugg

SEQ ID NO: 277711 - RNA, 22 nt, Human
ggcccagagacgugcaauguac

SEQ ID NO: 277712 - RNA, 22 nt, Human
ucuuccucuucugcugagaagu

SEQ ID NO: 277713 - RNA, 22 nt, Human
cuuauguauaauguuccacaua

SEQ ID NO: 277714 - RNA, 22 nt, Human
aaggcuggcaauauauuuguua

SEQ ID NO: 277715 - RNA, 22 nt, Human
auauuuucacagaacuugcaaa

SEQ ID NO: 277716 - RNA, 21 nt, Human
gugcaugcgccgcugagaugc

SEQ ID NO: 277717 - RNA, 22 nt, Human
gccuggagggcucuagagaggc

SEQ ID NO: 277718 - RNA, 16 nt, Human
guaaaggcagggaauu

SEQ ID NO: 277719 - RNA, 22 nt, Human
gacagagaggcugagcaguaca

SEQ ID NO: 277720 - RNA, 20 nt, Human
agcugcaacagacuguaugg

SEQ ID NO: 277721 - RNA, 22 nt, Human
cugcccaggaaccagaggggca

SEQ ID NO: 277722 - RNA, 21 nt, Human
ugcacagggcccaggagagcc

SEQ ID NO: 277723 - RNA, 22 nt, Human
guggauggagcuggaagccauu

SEQ ID NO: 277724 - RNA, 22 nt, Human
gugagcuucugacagaugcacc

SEQ ID NO: 277725 - RNA, 20 nt, Human
aggcuggcacuccuggccag

SEQ ID NO: 277726 - RNA, 22 nt, Human
cuguggcuuuggggcggaggac

SEQ ID NO: 277727 - RNA, 22 nt, Human
aacaguuacccuuaagaucuuu

SEQ ID NO: 277728 - RNA, 22 nt, Human
ggaaggcuugaguucccagguc

SEQ ID NO: 277729 - RNA, 22 nt, Human
auucucugaagucuuucagggc

SEQ ID NO: 277730 - RNA, 22 nt, Human
guccagccacucaccuuccagc

SEQ ID NO: 277731 - RNA, 22 nt, Human
cuucuggaggacacuggcccca

SEQ ID NO: 277732 - RNA, 22 nt, Human
gcagcagugcgggcagcuacag

SEQ ID NO: 277733 - RNA, 22 nt, Human
uggcugccaugacgccugggga

SEQ ID NO: 277734 - RNA, 22 nt, Human
uuucacaacugcuuauuugaga

SEQ ID NO: 277735 - RNA, 22 nt, Human
agccagaaaaacaccaagagga

SEQ ID NO: 277736 - RNA, 22 nt, Human
ugugugaccuggggugagauag

SEQ ID NO: 277737 - RNA, 22 nt, Human
caggguggugaauagcuauagu

SEQ ID NO: 277738 - RNA, 22 nt, Human
augggugugaaaauggucaucu

SEQ ID NO: 277739 - RNA, 22 nt, Human
acagugcugucuaucucacuaa

SEQ ID NO: 277740 - RNA, 22 nt, Human
gcccaggagguggaggugcagu

SEQ ID NO: 277741 - RNA, 19 nt, Human
cuuggcuuagcuucuuagc

SEQ ID NO: 277742 - RNA, 22 nt, Human
cacugucuauuaauauaacuua

SEQ ID NO: 277743 - RNA, 22 nt, Human
agcagcugccagagagaguucc

SEQ ID NO: 277744 - RNA, 17 nt, Human
caaggccagcaucuuca

SEQ ID NO: 277745 - RNA, 22 nt, Human
cuuuacuugcuuuguuacaaaa

SEQ ID NO: 277746 - RNA, 22 nt, Human
gcagcugggccccagccucucc

SEQ ID NO: 277747 - RNA, 22 nt, Human
cugagcugggaguagagacucu

SEQ ID NO: 277748 - RNA, 22 nt, Human
acaaauuuauugaagggcauau

SEQ ID NO: 277749 - RNA, 22 nt, Human
uuuauuuauaagccacuugcug

SEQ ID NO: 277750 - RNA, 22 nt, Human
agucacauggcagagagaaguu

SEQ ID NO: 277751 - RNA, 22 nt, Human
uauuugcaacauaaaacucuga

SEQ ID NO: 277752 - RNA, 22 nt, Human
acaagauuuggcugaaacucca

SEQ ID NO: 277753 - RNA, 22 nt, Human
ugcagggccccucugcaugagu

SEQ ID NO: 277754 - RNA, 22 nt, Human
guuucgucaggcuuauucuauc

SEQ ID NO: 277755 - RNA, 22 nt, Human
uggcuggagagggucccaugag

SEQ ID NO: 277756 - RNA, 22 nt, Human
auuacaaguuucaguguuuugc

SEQ ID NO: 277757 - RNA, 22 nt, Human
cugggcuccuaaccauccaggu

SEQ ID NO: 277758 - RNA, 22 nt, Human
uguacauacauagauauacaca

SEQ ID NO: 277759 - RNA, 22 nt, Human
gccuggcugaggccucugcuaa

SEQ ID NO: 277760 - RNA, 22 nt, Human
uugcaaauauuguuuaccuuuc

SEQ ID NO: 277761 - RNA, 21 nt, Human
uccagggaacuucucaggaau

SEQ ID NO: 277762 - RNA, 22 nt, Human
uccugguguuacuaaauugaaa

SEQ ID NO: 277763 - RNA, 22 nt, Human
uggcaguguuucuaaggggcuc

SEQ ID NO: 277764 - RNA, 20 nt, Human
acugccuugguucaguaggu

SEQ ID NO: 277765 - RNA, 22 nt, Human
cuuuggaauaauuuccuggagu

SEQ ID NO: 277766 - RNA, 22 nt, Human
uguucuuuagcagaccauguug

SEQ ID NO: 277767 - RNA, 22 nt, Human
ccuccuggugggcgcuucuggc

SEQ ID NO: 277768 - RNA, 22 nt, Human
cagaggccuggcuuggacaccu

SEQ ID NO: 277769 - RNA, 22 nt, Human
cuccagauuccguuuauucagg

SEQ ID NO: 277770 - RNA, 22 nt, Human
uuccuggcucacagcagugggg

SEQ ID NO: 277771 - RNA, 22 nt, Human
aaaagcaucucaaaggagcuuc

SEQ ID NO: 277772 - RNA, 22 nt, Human
ugcagauacaguauguggaagc

SEQ ID NO: 277773 - RNA, 22 nt, Human
cacaguggcaaaggggcuuggg

SEQ ID NO: 277774 - RNA, 22 nt, Human
ugggccuccgcauggcccagcg

SEQ ID NO: 277775 - RNA, 22 nt, Human
acuuucaagaacuucuuuaaug

SEQ ID NO: 277776 - RNA, 22 nt, Human
agaaaauaaauugaugguggaa

SEQ ID NO: 277777 - RNA, 22 nt, Human
agcuuccugucuucugcacaaa

SEQ ID NO: 277778 - RNA, 22 nt, Human
gauaagcagcagccguuauagg

SEQ ID NO: 277779 - RNA, 22 nt, Human
gggcuuggcucauaaguggaug

SEQ ID NO: 277780 - RNA, 23 nt, Human
gaaaggcucugggacccccaacu

SEQ ID NO: 277781 - RNA, 22 nt, Human
caggaaauuuauguucuacuua

SEQ ID NO: 277782 - RNA, 22 nt, Human
ucuuugcaugugcuucuuggcc

SEQ ID NO: 277783 - RNA, 22 nt, Human
auccugggcagugugucacucu

SEQ ID NO: 277784 - RNA, 22 nt, Human
ccacugccaugggcuaggcaug

SEQ ID NO: 277785 - RNA, 21 nt, Human
ggaacuuucaugaaucuagca

SEQ ID NO: 277786 - RNA, 22 nt, Human
ccuuugguaauucuguguagag

SEQ ID NO: 277787 - RNA, 22 nt, Human
uacuguuagagccagaaaccua

SEQ ID NO: 277788 - RNA, 21 nt, Human
ucugugcugccgucaacaucc

SEQ ID NO: 277789 - RNA, 22 nt, Human
aggcuggcuuggcucuccugug

SEQ ID NO: 277790 - RNA, 22 nt, Human
ccgaggcuccuccccgagucug

SEQ ID NO: 277791 - RNA, 22 nt, Human
ugucaaaaagcugggacaagca

SEQ ID NO: 277792 - RNA, 22 nt, Human
cuggcucuuucagccgcuggag

SEQ ID NO: 277793 - RNA, 22 nt, Human
ugcccaggguuucuaagagcag

SEQ ID NO: 277794 - RNA, 18 nt, Human
gcuuucugugcagcggag

SEQ ID NO: 277795 - RNA, 22 nt, Human
uccuccagcuacuaggcaaaua

SEQ ID NO: 277796 - RNA, 15 nt, Human
gaggccaggcaugug

SEQ ID NO: 277797 - RNA, 22 nt, Human
ugaaguucacugagaguucacc

SEQ ID NO: 277798 - RNA, 22 nt, Human
uuucuaacagcaaauguuuauc

SEQ ID NO: 277799 - RNA, 22 nt, Human
ucccagggacccagccugauac

SEQ ID NO: 277800 - RNA, 22 nt, Human
ucacagaagaaguagauugcau

SEQ ID NO: 277801 - RNA, 22 nt, Human
aguuuuaagaugcgcuucuguu

SEQ ID NO: 277802 - RNA, 22 nt, Human
caggccuuuuuuccugcagugu

SEQ ID NO: 277803 - RNA, 22 nt, Human
guccucugacucagccuuggga

SEQ ID NO: 277804 - RNA, 22 nt, Human
aggaggacucucugagccagcc

SEQ ID NO: 277805 - RNA, 22 nt, Human
cacugucacguucugaaacugu

SEQ ID NO: 277806 - RNA, 22 nt, Human
ucagagcugggugcuucuuccu

SEQ ID NO: 277807 - RNA, 22 nt, Human
ugcagcagcagggaggaggcuc

SEQ ID NO: 277808 - RNA, 22 nt, Human
gaaggcuuagaaacaagggagc

SEQ ID NO: 277809 - RNA, 22 nt, Human
ccuuaccugauugcuggcaucc

SEQ ID NO: 277810 - RNA, 23 nt, Human
ggcugcucuuuucaugcuguuuc

SEQ ID NO: 277811 - RNA, 22 nt, Human
aaauaggggaccaggaaaggag

SEQ ID NO: 277812 - RNA, 22 nt, Human
agaucauaugcaguaaugaacu

SEQ ID NO: 277813 - RNA, 22 nt, Human
aucuuuuaugagcguucugaca

SEQ ID NO: 277814 - RNA, 22 nt, Human
aaaagugaugggauggcacuuc

SEQ ID NO: 277815 - RNA, 22 nt, Human
agagccuggcucccagcuaccg

SEQ ID NO: 277816 - RNA, 22 nt, Human
gagcaacaaauuagggggauuu

SEQ ID NO: 277817 - RNA, 22 nt, Human
uguaacaguagauaaggucuug

SEQ ID NO: 277818 - RNA, 22 nt, Human
gcuuagcagugugugcuuuuga

SEQ ID NO: 277819 - RNA, 22 nt, Human
uuggcgcccaggacgccgccgc

SEQ ID NO: 277820 - RNA, 21 nt, Human
uggcucugaaagagugcugca

SEQ ID NO: 277821 - RNA, 19 nt, Human
ucaugucucucaucuguga

SEQ ID NO: 277822 - RNA, 22 nt, Human
aggaagccuggaguccugccca

SEQ ID NO: 277823 - RNA, 22 nt, Human
aaaguuuuauaugcugcagcga

SEQ ID NO: 277824 - RNA, 22 nt, Human
agagccaggaucuguuuugggg

SEQ ID NO: 277825 - RNA, 19 nt, Human
uguacauauagagcucagu

SEQ ID NO: 277826 - RNA, 22 nt, Human
ugggagcagcagggagaugcgg

SEQ ID NO: 277827 - RNA, 22 nt, Human
cuggguucuauuuuuggcuuca

SEQ ID NO: 277828 - RNA, 22 nt, Human
cuggcuggcaaguagaacacaa

SEQ ID NO: 277829 - RNA, 17 nt, Human
cacaggugugguuugag

SEQ ID NO: 277830 - RNA, 22 nt, Human
ugugcugguacaugugaggaug

SEQ ID NO: 277831 - RNA, 22 nt, Human
uguguucagaauuugcugcuuu

SEQ ID NO: 277832 - RNA, 22 nt, Human
ggccucugcuuaugcugaugac

SEQ ID NO: 277833 - RNA, 22 nt, Human
aauguauuauacauaauuugug

SEQ ID NO: 277834 - RNA, 22 nt, Human
uugcuguaaguaucuuucuacc

SEQ ID NO: 277835 - RNA, 22 nt, Human
accaggaggcuacacuguccca

SEQ ID NO: 277836 - RNA, 22 nt, Human
auguggauagcacaggaauggu

SEQ ID NO: 277837 - RNA, 22 nt, Human
caggcuguggaucaggagccuu

SEQ ID NO: 277838 - RNA, 22 nt, Human
gauucaaagacagacucauuuc

SEQ ID NO: 277839 - RNA, 22 nt, Human
ugcaggcaccauucugccucuc

SEQ ID NO: 277840 - RNA, 22 nt, Human
caaugaaauugagauccagaga

SEQ ID NO: 277841 - RNA, 22 nt, Human
ucugaagagucuugcaagaaag

SEQ ID NO: 277842 - RNA, 22 nt, Human
cuccaggaguggccuggacacc

SEQ ID NO: 277843 - RNA, 22 nt, Human
gcugcccugucugcagcaggac

SEQ ID NO: 277844 - RNA, 22 nt, Human
ugugucugaacuaguugcucuc

SEQ ID NO: 277845 - RNA, 22 nt, Human
uucccuucuaguuuugagagac

SEQ ID NO: 277846 - RNA, 17 nt, Human
aggcuggccuucacagu

SEQ ID NO: 277847 - RNA, 22 nt, Human
ucaaaugaggcugaugaaugug

SEQ ID NO: 277848 - RNA, 22 nt, Human
ucaggcuguuagccaccuccuc

SEQ ID NO: 277849 - RNA, 22 nt, Human
uugagaugggcuuuauguucag

SEQ ID NO: 277850 - RNA, 22 nt, Human
agagcaggcauaaagcuuugaa

SEQ ID NO: 277851 - RNA, 22 nt, Human
ccuggcuccaaagcugugacuc

SEQ ID NO: 277852 - RNA, 22 nt, Human
ccaggcuggagugcaauggugc

SEQ ID NO: 277853 - RNA, 22 nt, Human
uugcuuuauuuggcaugccacu

SEQ ID NO: 277854 - RNA, 22 nt, Human
gugcaaaaguaauugcaguuuu

SEQ ID NO: 277855 - RNA, 22 nt, Human
ggggccagguccagcuuccaaa

SEQ ID NO: 277856 - RNA, 22 nt, Human
cuggagcuuauugggagcagaa

SEQ ID NO: 277857 - RNA, 21 nt, Human
ugaggccugccagucucagaa

SEQ ID NO: 277858 - RNA, 22 nt, Human
caaagugagagaauggcagaaa

SEQ ID NO: 277859 - RNA, 22 nt, Human
gguguccacucagcccguccug

SEQ ID NO: 277860 - RNA, 22 nt, Human
aguuaacucugaaaagacauuu

SEQ ID NO: 277861 - RNA, 22 nt, Human
aaaugucuuucaauagagaaau

SEQ ID NO: 277862 - RNA, 22 nt, Human
ucggagcuguagaugaaacccu

SEQ ID NO: 277863 - RNA, 22 nt, Human
uguuauauaacuuacaaccugu

SEQ ID NO: 277864 - RNA, 22 nt, Human
cugagcaggacagugggagacc

SEQ ID NO: 277865 - RNA, 22 nt, Human
cacuuucuguguugugcaaaaa

SEQ ID NO: 277866 - RNA, 22 nt, Human
caggauggcagagaaaagggug

SEQ ID NO: 277867 - RNA, 20 nt, Human
aguuacgcuauuacucuccu

SEQ ID NO: 277868 - RNA, 22 nt, Human
aguccuuccggcagauuucacu

SEQ ID NO: 277869 - RNA, 22 nt, Human
uuauuuaaaagugguaagauuc

SEQ ID NO: 277870 - RNA, 22 nt, Human
acaugaaacuguugcauuagaa

SEQ ID NO: 277871 - RNA, 22 nt, Human
aacaugugucuggcuagauugu

SEQ ID NO: 277872 - RNA, 22 nt, Human
ugaaaauauaguuuuccagacu

SEQ ID NO: 277873 - RNA, 19 nt, Human
aaaaggaauauucuuuggg

SEQ ID NO: 277874 - RNA, 22 nt, Human
cagacacacaagcaaucuaagu

SEQ ID NO: 277875 - RNA, 22 nt, Human
gagaggcuggguuggagaucga

SEQ ID NO: 277876 - RNA, 22 nt, Human
aaggcuggucagauguggugaa

SEQ ID NO: 277877 - RNA, 22 nt, Human
uacagugcgggugcgggccucu

SEQ ID NO: 277878 - RNA, 18 nt, Human
ucauuuguuuugcaugaa

SEQ ID NO: 277879 - RNA, 22 nt, Human
uuuacagaaugucaauuucuau

SEQ ID NO: 277880 - RNA, 22 nt, Human
gcaggcaccacggcucaggucu

SEQ ID NO: 277881 - RNA, 22 nt, Human
uccaggcugauccaugaagaau

SEQ ID NO: 277882 - RNA, 22 nt, Human
gcuggccugggcucaagaccag

SEQ ID NO: 277883 - RNA, 22 nt, Human
uggcccugcuuaugucucucuu

SEQ ID NO: 277884 - RNA, 22 nt, Human
aggagccaggaaaccugcucug

SEQ ID NO: 277885 - RNA, 22 nt, Human
ugaaccuuuugcuaagaaguua

SEQ ID NO: 277886 - RNA, 22 nt, Human
acauucaacauggcuggucuag

SEQ ID NO: 277887 - RNA, 22 nt, Human
uguggggacugaguggaggcuu

SEQ ID NO: 277888 - RNA, 22 nt, Human
uuugaagcaccaaaggagaaaa

SEQ ID NO: 277889 - RNA, 22 nt, Human
uuuccaggcagaggaguuguga

SEQ ID NO: 277890 - RNA, 18 nt, Human
aguaaagcuuauuacaug

SEQ ID NO: 277891 - RNA, 22 nt, Human
gaauucaguuaucuaauucaag

SEQ ID NO: 277892 - RNA, 22 nt, Human
cuauuuaucuauuucugaauga

SEQ ID NO: 277893 - RNA, 22 nt, Human
ucugggugaugaaaugcacugu

SEQ ID NO: 277894 - RNA, 22 nt, Human
uaaagacacccagggagggacu

SEQ ID NO: 277895 - RNA, 22 nt, Human
gagguccagagcagguucagug

SEQ ID NO: 277896 - RNA, 22 nt, Human
caaagcaguauuggauucuuua

SEQ ID NO: 277897 - RNA, 22 nt, Human
caggcuacuggggcuuggaugg

SEQ ID NO: 277898 - RNA, 22 nt, Human
cuccagaggaugcaggugaggg

SEQ ID NO: 277899 - RNA, 22 nt, Human
aaguguauaacgaccuacagga

SEQ ID NO: 277900 - RNA, 22 nt, Human
ggcauggacgucucugaggcca

SEQ ID NO: 277901 - RNA, 22 nt, Human
agacauagggaggcauauaaau

SEQ ID NO: 277902 - RNA, 22 nt, Human
uuaaauggggaugaguagaugg

SEQ ID NO: 277903 - RNA, 18 nt, Human
guucaucuuuuucuaaag

SEQ ID NO: 277904 - RNA, 22 nt, Human
uaaggcuuuggucaccauggag

SEQ ID NO: 277905 - RNA, 22 nt, Human
aaggaagauauaucaagcuuaa

SEQ ID NO: 277906 - RNA, 22 nt, Human
aaaaagacuuccaacucaggag

SEQ ID NO: 277907 - RNA, 22 nt, Human
aacagcuguauacuguagcugu

SEQ ID NO: 277908 - RNA, 22 nt, Human
uuuccaggaaguaaggauaauc

SEQ ID NO: 277909 - RNA, 22 nt, Human
agucacugcuuugucccugugu

SEQ ID NO: 277910 - RNA, 17 nt, Human
ugaaacaccaagacugu

SEQ ID NO: 277911 - RNA, 22 nt, Human
uacauuccacaagcauugcuuu

SEQ ID NO: 277912 - RNA, 22 nt, Human
gccugcagggccugggccuacc

SEQ ID NO: 277913 - RNA, 22 nt, Human
gaggaggaaguucucuguaggc

SEQ ID NO: 277914 - RNA, 22 nt, Human
gccagcccagcuccaggggaaa

SEQ ID NO: 277915 - RNA, 22 nt, Human
uggcagaguggaccauacucaa

SEQ ID NO: 277916 - RNA, 22 nt, Human
uaaaacacauaaacucucuauu

SEQ ID NO: 277917 - RNA, 22 nt, Human
ucaggucuauagaagaggaggg

SEQ ID NO: 277918 - RNA, 22 nt, Human
uuguccuguuuagggauaagga

SEQ ID NO: 277919 - RNA, 23 nt, Human
uggaaucagccuuuuuuccaagg

SEQ ID NO: 277920 - RNA, 22 nt, Human
gcagguggugggggagccguuc

SEQ ID NO: 277921 - RNA, 19 nt, Human
cuccuggcucugucauuuu

SEQ ID NO: 277922 - RNA, 22 nt, Human
agaacucucgcuggaucagacu

SEQ ID NO: 277923 - RNA, 22 nt, Human
uuauguacaauguuaauguaaa

SEQ ID NO: 277924 - RNA, 23 nt, Human
cccuggccuuggggcacaggcug

SEQ ID NO: 277925 - RNA, 22 nt, Human
agaaaugugaauuucauuuccu

SEQ ID NO: 277926 - RNA, 22 nt, Human
gacacagggggauguguggacg

SEQ ID NO: 277927 - RNA, 22 nt, Human
ucugaagaacugaguaaacaug

SEQ ID NO: 277928 - RNA, 22 nt, Human
aauaucagcucugucacuuacu

SEQ ID NO: 277929 - RNA, 22 nt, Human
uccugggcagaaugggauggcu

SEQ ID NO: 277930 - RNA, 22 nt, Human
ggaggagcacuucugagcucag

SEQ ID NO: 277931 - RNA, 22 nt, Human
gcuggcugcagauuuuagaggu

SEQ ID NO: 277932 - RNA, 22 nt, Human
accagccccaccgggacugcag

SEQ ID NO: 277933 - RNA, 22 nt, Human
aagagggaggugcgggugcaga

SEQ ID NO: 277934 - RNA, 22 nt, Human
aaaaaggcuaagcaucuugugc

SEQ ID NO: 277935 - RNA, 22 nt, Human
gcugcaggcauuuuccugggca

SEQ ID NO: 277936 - RNA, 22 nt, Human
aagucucuuccucugccaaaga

SEQ ID NO: 277937 - RNA, 21 nt, Human
agcuguuugaagcuauauugg

SEQ ID NO: 277938 - RNA, 20 nt, Human
gagcccucugcacuagcgcc

SEQ ID NO: 277939 - RNA, 22 nt, Human
uuuggaaugaaacagcagagcc

SEQ ID NO: 277940 - RNA, 22 nt, Human
ucucugaacuuccuggaaaggc

SEQ ID NO: 277941 - RNA, 22 nt, Human
cugcacaguggacagugaagau

SEQ ID NO: 277942 - RNA, 22 nt, Human
uucaguguauauuuuuugagua

SEQ ID NO: 277943 - RNA, 22 nt, Human
uccuggacuggcucagcacccu

SEQ ID NO: 277944 - RNA, 22 nt, Human
uuauuuucagcuaggaaagcca

SEQ ID NO: 277945 - RNA, 22 nt, Human
cugaauuagaugaaaaaggcuc

SEQ ID NO: 277946 - RNA, 22 nt, Human
caguacaagaggccaccugccc

SEQ ID NO: 277947 - RNA, 22 nt, Human
cucuccaggacuuuggcccaau

SEQ ID NO: 277948 - RNA, 22 nt, Human
guggccaggucagggacuugug

SEQ ID NO: 277949 - RNA, 22 nt, Human
acuagaacuucuaacuaagguc

SEQ ID NO: 277950 - RNA, 22 nt, Human
auacuguaucacuugugaguga

SEQ ID NO: 277951 - RNA, 22 nt, Human
gggggcuaccgucucuggagcu

SEQ ID NO: 277952 - RNA, 22 nt, Human
gcaggacuugaauccaggcagu

SEQ ID NO: 277953 - RNA, 22 nt, Human
uccagccuaggggaacagcugc

SEQ ID NO: 277954 - RNA, 22 nt, Human
cuggcugcaggaaggagugggc

SEQ ID NO: 277955 - RNA, 23 nt, Human
cacugcagcguggucuggcagga

SEQ ID NO: 277956 - RNA, 22 nt, Human
auagcacuuauuguaugcugag

SEQ ID NO: 277957 - RNA, 22 nt, Human
uguguguauaugcauuuaucua

SEQ ID NO: 277958 - RNA, 22 nt, Human
acugggccgcgcugcagagggc

SEQ ID NO: 277959 - RNA, 22 nt, Human
uuaucaugacuucaagcaucca

SEQ ID NO: 277960 - RNA, 17 nt, Human
caagagagaugacugga

SEQ ID NO: 277961 - RNA, 19 nt, Human
gcuucuguuugggcuuaga

SEQ ID NO: 277962 - RNA, 19 nt, Human
aucuuuagggauguggcuu

SEQ ID NO: 277963 - RNA, 22 nt, Human
ggggcuguugaaguuaguugag

SEQ ID NO: 277964 - RNA, 22 nt, Human
aggagacaucuaacuguagguu

SEQ ID NO: 277965 - RNA, 22 nt, Human
ucaggcuguaaauggugugggu

SEQ ID NO: 277966 - RNA, 22 nt, Human
agaaugcaguuugaaauaaggu

SEQ ID NO: 277967 - RNA, 22 nt, Human
acacaguguccuucuacuugcc

SEQ ID NO: 277968 - RNA, 22 nt, Human
cuggaucuguuugugcuugugg

SEQ ID NO: 277969 - RNA, 22 nt, Human
aguacaaugucugacacaguag

SEQ ID NO: 277970 - RNA, 22 nt, Human
uuaugacauaugaguacaagua

SEQ ID NO: 277971 - RNA, 22 nt, Human
auuguacauaaaauguaugucu

SEQ ID NO: 277972 - RNA, 22 nt, Human
uguguuaaguauuugauacacu

SEQ ID NO: 277973 - RNA, 22 nt, Human
auuuuccuccaugugagcaguu

SEQ ID NO: 277974 - RNA, 22 nt, Human
aacuguagcaaagaacagcucu

SEQ ID NO: 277975 - RNA, 20 nt, Human
uuuccacuguaauguaugau

SEQ ID NO: 277976 - RNA, 22 nt, Human
cugggucuuuuucuuccauuga

SEQ ID NO: 277977 - RNA, 22 nt, Human
gggcuguguaucaguuaucuau

SEQ ID NO: 277978 - RNA, 22 nt, Human
acaacagugugguggaaggagc

SEQ ID NO: 277979 - RNA, 22 nt, Human
ccagcuggaagagugcagaacu

SEQ ID NO: 277980 - RNA, 22 nt, Human
aauuaacuaauuugguacaaga

SEQ ID NO: 277981 - RNA, 17 nt, Human
ccaggucuccuugcuuu

SEQ ID NO: 277982 - RNA, 18 nt, Human
gccagcccuccaaccucc

SEQ ID NO: 277983 - RNA, 22 nt, Human
ccagggcucugcuucugccaug

SEQ ID NO: 277984 - RNA, 20 nt, Human
ccucaagcagacugacagcu

SEQ ID NO: 277985 - RNA, 22 nt, Human
uuuuacaggucauagguauagu

SEQ ID NO: 277986 - RNA, 22 nt, Human
aauucccaccuucucucuuuug

SEQ ID NO: 277987 - RNA, 22 nt, Human
uggaugaggcuggguuaggcag

SEQ ID NO: 277988 - RNA, 22 nt, Human
uaaaugugcacuuuacuuuuca

SEQ ID NO: 277989 - RNA, 22 nt, Human
ucaggaaagguuuguugaaugg

SEQ ID NO: 277990 - RNA, 22 nt, Human
ccugaagagugaauguggcagu

SEQ ID NO: 277991 - RNA, 22 nt, Human
aaauguguuugauaggaauauu

SEQ ID NO: 277992 - RNA, 22 nt, Human
cccaguuguugccggcucugga

SEQ ID NO: 277993 - RNA, 22 nt, Human
cuggguucuuggcacagcagga

SEQ ID NO: 277994 - RNA, 22 nt, Human
gguuucaacuaaaucaagaagg

SEQ ID NO: 277995 - RNA, 22 nt, Human
uuucuucacaggguauugggug

SEQ ID NO: 277996 - RNA, 22 nt, Human
gacagccaugcacuucugcugu

SEQ ID NO: 277997 - RNA, 18 nt, Human
gguugauaacuugugauu

SEQ ID NO: 277998 - RNA, 22 nt, Human
cagaauuuagaaaacaacauaa

SEQ ID NO: 277999 - RNA, 23 nt, Human
uggccugcagaguuucugcuggg

SEQ ID NO: 278000 - RNA, 22 nt, Human
ggcuuugccuggaauuuccuug

SEQ ID NO: 278001 - RNA, 22 nt, Human
uacuuuagaaggaaauaaguuc

SEQ ID NO: 278002 - RNA, 22 nt, Human
cccugggaaguauuccagcuau

SEQ ID NO: 278003 - RNA, 22 nt, Human
guuuaacauuguaccaacaccu

SEQ ID NO: 278004 - RNA, 22 nt, Human
uucucagaauugacugggagca

SEQ ID NO: 278005 - RNA, 22 nt, Human
uuguauuuccuauaaccuuucu

SEQ ID NO: 278006 - RNA, 22 nt, Human
ugaaugaauccuaacaaagaca

SEQ ID NO: 278007 - RNA, 22 nt, Human
ucagcagggcugggagcuguga

SEQ ID NO: 278008 - RNA, 22 nt, Human
cacuugauggaagagcagaaga

SEQ ID NO: 278009 - RNA, 22 nt, Human
uuccaggaugcugcugcuuuuu

SEQ ID NO: 278010 - RNA, 22 nt, Human
ccuggaggagcgcugaccagcu

SEQ ID NO: 278011 - RNA, 21 nt, Human
gggcgaggccugauguggcuc

SEQ ID NO: 278012 - RNA, 22 nt, Human
acagcagaguggagaugagcac

SEQ ID NO: 278013 - RNA, 22 nt, Human
ugagagggcccagagcacacca

SEQ ID NO: 278014 - RNA, 22 nt, Human
caagcagagguuuauguauuag

SEQ ID NO: 278015 - RNA, 22 nt, Human
aggauagaagccccauguucuu

SEQ ID NO: 278016 - RNA, 23 nt, Human
agcccugcugagacccagcuccc

SEQ ID NO: 278017 - RNA, 22 nt, Human
aucucuggguccauagaagaga

SEQ ID NO: 278018 - RNA, 22 nt, Human
ucucuuaaaagauuuuaaugac

SEQ ID NO: 278019 - RNA, 22 nt, Human
gaaauuauugcuagagacugca

SEQ ID NO: 278020 - RNA, 22 nt, Human
cucuuaaaaacuugauauauuu

SEQ ID NO: 278021 - RNA, 22 nt, Human
ugugaagguuuuuaugggauau

SEQ ID NO: 278022 - RNA, 20 nt, Human
ugucagugccugaggcacag

SEQ ID NO: 278023 - RNA, 20 nt, Human
cucugaggcugagaagggag

SEQ ID NO: 278024 - RNA, 22 nt, Human
caguagcuucaguugaggccug

SEQ ID NO: 278025 - RNA, 22 nt, Human
gcugguuaggugagggugcgcc

SEQ ID NO: 278026 - RNA, 22 nt, Human
uggcagggccugaaucuuauac

SEQ ID NO: 278027 - RNA, 22 nt, Human
uagacagauguuuucuggcugu

SEQ ID NO: 278028 - RNA, 22 nt, Human
aaguuuuacugaggacacaugu

SEQ ID NO: 278029 - RNA, 22 nt, Human
ugaggccuuuucugucuggcua

SEQ ID NO: 278030 - RNA, 22 nt, Human
aauugcuuuaguuaccauagug

SEQ ID NO: 278031 - RNA, 22 nt, Human
cugcaggaaggggacggagugg

SEQ ID NO: 278032 - RNA, 22 nt, Human
acaggccacaguggagucucug

SEQ ID NO: 278033 - RNA, 22 nt, Human
uuugaaucugauauggcagcau

SEQ ID NO: 278034 - RNA, 22 nt, Human
aaggagcucccggcagaccagg

SEQ ID NO: 278035 - RNA, 22 nt, Human
acauucucuccaugucuucuuu

SEQ ID NO: 278036 - RNA, 18 nt, Human
gagaaggccacuuguuuu

SEQ ID NO: 278037 - RNA, 22 nt, Human
auugaacagaaaaacucagaga

SEQ ID NO: 278038 - RNA, 23 nt, Human
uggucugaagccucagguuccuc

SEQ ID NO: 278039 - RNA, 20 nt, Human
uacaauacacaugcauauga

SEQ ID NO: 278040 - RNA, 22 nt, Human
ggcucaggacugcagcguagag

SEQ ID NO: 278041 - RNA, 22 nt, Human
cggggcugaggcaacgcggaga

SEQ ID NO: 278042 - RNA, 23 nt, Human
agaaaagcuuggacacauggccu

SEQ ID NO: 278043 - RNA, 22 nt, Human
ccaggucaagcuccccuguggu

SEQ ID NO: 278044 - RNA, 22 nt, Human
gggcccaggccuccuuccuucc

SEQ ID NO: 278045 - RNA, 22 nt, Human
gaggcagcugaaggagugacag

SEQ ID NO: 278046 - RNA, 19 nt, Human
ucaagauggauggcuccca

SEQ ID NO: 278047 - RNA, 22 nt, Human
acauacuuaugcuaaaaauaua

SEQ ID NO: 278048 - RNA, 22 nt, Human
cccauggcaauaaggucacagg

SEQ ID NO: 278049 - RNA, 22 nt, Human
aguggcuggcauaggaacagac

SEQ ID NO: 278050 - RNA, 22 nt, Human
uguaccagaugucuaaagccau

SEQ ID NO: 278051 - RNA, 21 nt, Human
uagaggcaggagggacugcag

SEQ ID NO: 278052 - RNA, 22 nt, Human
acuggacagaggaaauauggag

SEQ ID NO: 278053 - RNA, 22 nt, Human
uccuagaagauggaucagagaa

SEQ ID NO: 278054 - RNA, 22 nt, Human
aagagcuccaggcaaugcgguc

SEQ ID NO: 278055 - RNA, 22 nt, Human
caggcagcucuaauggaaagug

SEQ ID NO: 278056 - RNA, 19 nt, Human
uccaggcugagagucagcu

SEQ ID NO: 278057 - RNA, 22 nt, Human
ggugcaugguggaggugacccu

SEQ ID NO: 278058 - RNA, 22 nt, Human
ggagaguggauuccagcuguau

SEQ ID NO: 278059 - RNA, 22 nt, Human
uuccauaaaggugauaguauac

SEQ ID NO: 278060 - RNA, 22 nt, Human
accugaauugauuugaccugua

SEQ ID NO: 278061 - RNA, 22 nt, Human
cauuuguuggucagauuguagu

SEQ ID NO: 278062 - RNA, 22 nt, Human
uucuuguauauaaaaaucauuu

SEQ ID NO: 278063 - RNA, 22 nt, Human
acguucaaugucagucaacuuu

SEQ ID NO: 278064 - RNA, 22 nt, Human
uccucuccauauuuucugauuu

SEQ ID NO: 278065 - RNA, 22 nt, Human
aguuucuugaagacugauguuu

SEQ ID NO: 278066 - RNA, 22 nt, Human
ccaggcugggcggggaaccugg

SEQ ID NO: 278067 - RNA, 22 nt, Human
uccugaggacccugucaggggc

SEQ ID NO: 278068 - RNA, 22 nt, Human
uggcucagugaagagauaacuu

SEQ ID NO: 278069 - RNA, 21 nt, Human
uggcacagcaagugggcucau

SEQ ID NO: 278070 - RNA, 22 nt, Human
gggugguguauuagagcugcag

SEQ ID NO: 278071 - RNA, 22 nt, Human
uuuggagagaugaaguucugug

SEQ ID NO: 278072 - RNA, 22 nt, Human
auuugaaccacucagaacucau

SEQ ID NO: 278073 - RNA, 22 nt, Human
uuucauaaacaguagaagacua

SEQ ID NO: 278074 - RNA, 22 nt, Human
cagagacaaccugguagagaaa

SEQ ID NO: 278075 - RNA, 22 nt, Human
aguguccucuauuaugacuuua

SEQ ID NO: 278076 - RNA, 22 nt, Human
acccagggagugcuccuguucu

SEQ ID NO: 278077 - RNA, 22 nt, Human
aaagauuuaugaaguucaauua

SEQ ID NO: 278078 - RNA, 22 nt, Human
uccaggcuuuuucaugcugucu

SEQ ID NO: 278079 - RNA, 22 nt, Human
gccucaguaaccuuaggggaua

SEQ ID NO: 278080 - RNA, 21 nt, Human
agguacuaaugaaaagugauu

SEQ ID NO: 278081 - RNA, 22 nt, Human
ucaggugggucuacaauuaguu

SEQ ID NO: 278082 - RNA, 22 nt, Human
uugggccugggguagugucgga

SEQ ID NO: 278083 - RNA, 22 nt, Human
ccugcagguuucccccggacgg

SEQ ID NO: 278084 - RNA, 22 nt, Human
ugguaacacaggcauuaaaguu

SEQ ID NO: 278085 - RNA, 21 nt, Human
uguaaguuucaucugaauugg

SEQ ID NO: 278086 - RNA, 22 nt, Human
uugugucccuggagcuucugug

SEQ ID NO: 278087 - RNA, 22 nt, Human
aaaagucugcuuucuauuauca

SEQ ID NO: 278088 - RNA, 22 nt, Human
aguguauugucucacaguucuu

SEQ ID NO: 278089 - RNA, 22 nt, Human
cuggaggagcauggacuggagu

SEQ ID NO: 278090 - RNA, 20 nt, Human
acacacuuugaucuugagcc

SEQ ID NO: 278091 - RNA, 22 nt, Human
aacuguacgauaauaaauuugu

SEQ ID NO: 278092 - RNA, 22 nt, Human
ucaggccacggcucacugagac

SEQ ID NO: 278093 - RNA, 22 nt, Human
ggaguaggccccgggagagagu

SEQ ID NO: 278094 - RNA, 22 nt, Human
aaguuucuggaccuuaccugcu

SEQ ID NO: 278095 - RNA, 22 nt, Human
ccuguucuguagugaguuugag

SEQ ID NO: 278096 - RNA, 22 nt, Human
ugcccagcacccagcaugaugc

SEQ ID NO: 278097 - RNA, 22 nt, Human
acaguuaauaaguaguaaguca

SEQ ID NO: 278098 - RNA, 21 nt, Human
ugucugauguauuuuuugccu

SEQ ID NO: 278099 - RNA, 22 nt, Human
ggagucugucaccuguuucucu

SEQ ID NO: 278100 - RNA, 22 nt, Human
uccaggcuaauuuugcauuguu

SEQ ID NO: 278101 - RNA, 22 nt, Human
accuguuuucagaaaaugcaga

SEQ ID NO: 278102 - RNA, 22 nt, Human
cuagaaaucucuguuuacauca

SEQ ID NO: 278103 - RNA, 22 nt, Human
uggccagugauuaaugacgcuu

SEQ ID NO: 278104 - RNA, 22 nt, Human
aaagguuauuauuacuauuguc

SEQ ID NO: 278105 - RNA, 22 nt, Human
cacauaaauggugccauguuuu

SEQ ID NO: 278106 - RNA, 20 nt, Human
aguaggcaaaggaaagaucu

SEQ ID NO: 278107 - RNA, 22 nt, Human
uggcagagugcggcauccccug

SEQ ID NO: 278108 - RNA, 22 nt, Human
aagaaaccuagucuggagcagc

SEQ ID NO: 278109 - RNA, 22 nt, Human
agaggcaugaucuuauaauuua

SEQ ID NO: 278110 - RNA, 22 nt, Human
cagagccaggucuugaacucag

SEQ ID NO: 278111 - RNA, 22 nt, Human
ggcucuggugugaagcagccuc

SEQ ID NO: 278112 - RNA, 22 nt, Human
auggcagauccacaguuugaag

SEQ ID NO: 278113 - RNA, 21 nt, Human
cagaggccuaucacagacucc

SEQ ID NO: 278114 - RNA, 21 nt, Human
agggaaagaaaaugagcuaau

SEQ ID NO: 278115 - RNA, 22 nt, Human
aaaggucuucucaaacauccca

SEQ ID NO: 278116 - RNA, 22 nt, Human
guuuuccuguugaguaguauuc

SEQ ID NO: 278117 - RNA, 22 nt, Human
aaggcagccuuuguuugauuga

SEQ ID NO: 278118 - RNA, 22 nt, Human
agaauccuugacucaggcugag

SEQ ID NO: 278119 - RNA, 22 nt, Human
uggggcuagaauccugcaggaa

SEQ ID NO: 278120 - RNA, 22 nt, Human
ccuagagugauugagagcauca

SEQ ID NO: 278121 - RNA, 22 nt, Human
acauuucuuagccuaguuccag

SEQ ID NO: 278122 - RNA, 22 nt, Human
aagaacauuuuguagaaugaca

SEQ ID NO: 278123 - RNA, 22 nt, Human
gacccagccugguuuuuauagg

SEQ ID NO: 278124 - RNA, 22 nt, Human
gggcaauucacaggguuguuau

SEQ ID NO: 278125 - RNA, 22 nt, Human
ucaggacacuuggcacaagguc

SEQ ID NO: 278126 - RNA, 22 nt, Human
cucagagcugaggccagggaca

SEQ ID NO: 278127 - RNA, 23 nt, Human
agauuguuauucccaguucaugu

SEQ ID NO: 278128 - RNA, 22 nt, Human
acacugagcaucucuagaggca

SEQ ID NO: 278129 - RNA, 22 nt, Human
uguuuucuauuaccugagauug

SEQ ID NO: 278130 - RNA, 22 nt, Human
ucuuguccuaagagcuggauuc

SEQ ID NO: 278131 - RNA, 22 nt, Human
gcagcuuugaagacuuauuugc

SEQ ID NO: 278132 - RNA, 22 nt, Human
gaacuggugaagugaagggcag

SEQ ID NO: 278133 - RNA, 22 nt, Human
uugcaagguuucucucugccua

SEQ ID NO: 278134 - RNA, 22 nt, Human
cuugggugcuggaggcugccgc

SEQ ID NO: 278135 - RNA, 22 nt, Human
uacagauaacugaaugcagacu

SEQ ID NO: 278136 - RNA, 22 nt, Human
cuuggaggaaggggcucuucug

SEQ ID NO: 278137 - RNA, 22 nt, Human
uugauuucaaaauauaugcuug

SEQ ID NO: 278138 - RNA, 22 nt, Human
ugcagccuuuagaaguucagau

SEQ ID NO: 278139 - RNA, 22 nt, Human
ugucuuuagaccucucuggccu

SEQ ID NO: 278140 - RNA, 22 nt, Human
cucuuccucucaugcggucaua

SEQ ID NO: 278141 - RNA, 22 nt, Human
ugcaaacaggagaguaaguaua

SEQ ID NO: 278142 - RNA, 22 nt, Human
aaaagcagaccacgcuuugugg

SEQ ID NO: 278143 - RNA, 22 nt, Human
agcuggaacccgggugggcagc

SEQ ID NO: 278144 - RNA, 22 nt, Human
ucuggcuccacuuucuucauuu

SEQ ID NO: 278145 - RNA, 22 nt, Human
gacauuagacuaauguagcauu

SEQ ID NO: 278146 - RNA, 22 nt, Human
cucuagaacugauugggaagaa

SEQ ID NO: 278147 - RNA, 22 nt, Human
uugcaaagaauuuuacauucua

SEQ ID NO: 278148 - RNA, 20 nt, Human
agagugggugucacaggcug

SEQ ID NO: 278149 - RNA, 22 nt, Human
gaauucuuuucuuucugaaagu

SEQ ID NO: 278150 - RNA, 22 nt, Human
ugcugcauuugcaguccuuuaa

SEQ ID NO: 278151 - RNA, 22 nt, Human
aaaggacaugucaauaucaggc

SEQ ID NO: 278152 - RNA, 22 nt, Human
cgugacagggucuggcugguca

SEQ ID NO: 278153 - RNA, 22 nt, Human
agcugcaagucuguguggggag

SEQ ID NO: 278154 - RNA, 22 nt, Human
ucacagccuggucacucugccc

SEQ ID NO: 278155 - RNA, 22 nt, Human
aggagcuccagcccagggaagu

SEQ ID NO: 278156 - RNA, 21 nt, Human
ggauuuuaaaaacugcaccug

SEQ ID NO: 278157 - RNA, 22 nt, Human
uguccaggcacugggacucuag

SEQ ID NO: 278158 - RNA, 22 nt, Human
agacacagcuaccauaauacca

SEQ ID NO: 278159 - RNA, 22 nt, Human
ggcuccugggaugggacugagc

SEQ ID NO: 278160 - RNA, 21 nt, Human
uguaugcacgcacaugcacac

SEQ ID NO: 278161 - RNA, 22 nt, Human
agcauauaggaaauguugaauc

SEQ ID NO: 278162 - RNA, 22 nt, Human
cugagggaagggguacauggcu

SEQ ID NO: 278163 - RNA, 22 nt, Human
gguucaguggaauguguugacc

SEQ ID NO: 278164 - RNA, 22 nt, Human
ugcugaggacuaaaggagauga

SEQ ID NO: 278165 - RNA, 22 nt, Human
uucaacaaguaguacacacagu

SEQ ID NO: 278166 - RNA, 22 nt, Human
auuguacaaugcugagguuugg

SEQ ID NO: 278167 - RNA, 22 nt, Human
cagcaggcuguggaaauccugg

SEQ ID NO: 278168 - RNA, 23 nt, Human
gcaguuaguccacuuugcagaga

SEQ ID NO: 278169 - RNA, 22 nt, Human
uggcuccagguugaacuuuggg

SEQ ID NO: 278170 - RNA, 22 nt, Human
uuuuuguagucauuagaagagg

SEQ ID NO: 278171 - RNA, 22 nt, Human
agucuccacaacagcccugaua

SEQ ID NO: 278172 - RNA, 22 nt, Human
uuauuacagucccagggaguag

SEQ ID NO: 278173 - RNA, 22 nt, Human
uacagagaggugacccuugggc

SEQ ID NO: 278174 - RNA, 22 nt, Human
aaaguguugggauuacaggugu

SEQ ID NO: 278175 - RNA, 22 nt, Human
ucugcugucuaugcaaguccuu

SEQ ID NO: 278176 - RNA, 22 nt, Human
aagaacaguguccugggacucg

SEQ ID NO: 278177 - RNA, 22 nt, Human
cucuccucagaacaggcccucu

SEQ ID NO: 278178 - RNA, 22 nt, Human
uccaggcuggccucgcgugaca

SEQ ID NO: 278179 - RNA, 22 nt, Human
aggaagagcaucuuugggucug

SEQ ID NO: 278180 - RNA, 22 nt, Human
guguucuuuugcuucacagaaa

SEQ ID NO: 278181 - RNA, 22 nt, Human
agaguuucuugugagcacugac

SEQ ID NO: 278182 - RNA, 22 nt, Human
auggucuugugagaguaacagu

SEQ ID NO: 278183 - RNA, 22 nt, Human
gcugccuucuucugacucuauu

SEQ ID NO: 278184 - RNA, 22 nt, Human
gaacuggugagaguucacggga

SEQ ID NO: 278185 - RNA, 21 nt, Human
aggaagaucuggaggucggcg

SEQ ID NO: 278186 - RNA, 22 nt, Human
ggcugcagauagccagccacca

SEQ ID NO: 278187 - RNA, 22 nt, Human
cuugaaugaaaccaacugauga

SEQ ID NO: 278188 - RNA, 22 nt, Human
aggcccuguaagguguggagau

SEQ ID NO: 278189 - RNA, 22 nt, Human
cauuucuaccaaaugugacugg

SEQ ID NO: 278190 - RNA, 22 nt, Human
agcuggccauugugaguggccu

SEQ ID NO: 278191 - RNA, 22 nt, Human
caauucaaaugcauaguucaca

SEQ ID NO: 278192 - RNA, 22 nt, Human
auuuaauuuggagagagaaacc

SEQ ID NO: 278193 - RNA, 22 nt, Human
cugcagggcagaagggcauaga

SEQ ID NO: 278194 - RNA, 22 nt, Human
cacuaaguugguguuaauuagu

SEQ ID NO: 278195 - RNA, 22 nt, Human
aagacacaaagcuucccuuuuc

SEQ ID NO: 278196 - RNA, 22 nt, Human
cugugggagaggugccuggauu

SEQ ID NO: 278197 - RNA, 22 nt, Human
agcggcugcucuuuucagaucc

SEQ ID NO: 278198 - RNA, 22 nt, Human
gagcccaggaugguguauggcu

SEQ ID NO: 278199 - RNA, 22 nt, Human
acucagaggaaacccuccuagg

SEQ ID NO: 278200 - RNA, 22 nt, Human
cacaguccagacuccuggaguu

SEQ ID NO: 278201 - RNA, 22 nt, Human
ccagggcacuuaggcccagccc

SEQ ID NO: 278202 - RNA, 22 nt, Human
uggagcaggugggaugucguga

SEQ ID NO: 278203 - RNA, 22 nt, Human
aaugggagguaguaugggaggu

SEQ ID NO: 278204 - RNA, 22 nt, Human
cccagugucugggccugcaggg

SEQ ID NO: 278205 - RNA, 20 nt, Human
ugaaggcagguaagaaagau

SEQ ID NO: 278206 - RNA, 22 nt, Human
agacacagugcugggugcugag

SEQ ID NO: 278207 - RNA, 22 nt, Human
cuguuuucccuggaguucagca

SEQ ID NO: 278208 - RNA, 22 nt, Human
ucauggggugacagaagggagg

SEQ ID NO: 278209 - RNA, 23 nt, Human
ucccugggcccgugccagcggug

SEQ ID NO: 278210 - RNA, 21 nt, Human
uccuggcaggcccaggacccu

SEQ ID NO: 278211 - RNA, 22 nt, Human
ugacaggugcugggggcagugu

SEQ ID NO: 278212 - RNA, 22 nt, Human
acagucuaaucuuguguucugu

SEQ ID NO: 278213 - RNA, 22 nt, Human
ccagaggaucaguacuggcugg

SEQ ID NO: 278214 - RNA, 22 nt, Human
uauaauuuuaagugguaaauua

SEQ ID NO: 278215 - RNA, 22 nt, Human
acacauuaaccuuugaaauucu

SEQ ID NO: 278216 - RNA, 22 nt, Human
acugguguugauuuggaagggg

SEQ ID NO: 278217 - RNA, 22 nt, Human
ucucuguaucccagaaccaaaa

SEQ ID NO: 278218 - RNA, 22 nt, Human
aagucagugcuagcuaauggcu

SEQ ID NO: 278219 - RNA, 22 nt, Human
uccucagaaaccccugugaggu

SEQ ID NO: 278220 - RNA, 22 nt, Human
uaguuuguagaaaucuagaaau

SEQ ID NO: 278221 - RNA, 22 nt, Human
cugcagggagcagauggcgugu

SEQ ID NO: 278222 - RNA, 22 nt, Human
gcacaauuccaugggacagccc

SEQ ID NO: 278223 - RNA, 22 nt, Human
ccuggcucccggaacagggucu

SEQ ID NO: 278224 - RNA, 20 nt, Human
cucugggcugcacccucgcc

SEQ ID NO: 278225 - RNA, 22 nt, Human
agcacugugauuuauaacauuu

SEQ ID NO: 278226 - RNA, 22 nt, Human
cagccaucccagccugugguuc

SEQ ID NO: 278227 - RNA, 22 nt, Human
caaaggcuucaucucagagcag

SEQ ID NO: 278228 - RNA, 22 nt, Human
ggccuuugcguccacgccgcuu

SEQ ID NO: 278229 - RNA, 22 nt, Human
cuuuaacaaaugacucuugucu

SEQ ID NO: 278230 - RNA, 22 nt, Human
guuuaauucccacaccugcccu

SEQ ID NO: 278231 - RNA, 22 nt, Human
acaugccaucacuuucauuccu

SEQ ID NO: 278232 - RNA, 19 nt, Human
agaggcaagggcucaugac

SEQ ID NO: 278233 - RNA, 22 nt, Human
ucuggaagacagugagcccgcu

SEQ ID NO: 278234 - RNA, 22 nt, Human
gaaauuaagcaggggucugugg

SEQ ID NO: 278235 - RNA, 23 nt, Human
acuuuauugaccccaggucaguu

SEQ ID NO: 278236 - RNA, 16 nt, Human
uggcagguuuuuaucu

SEQ ID NO: 278237 - RNA, 22 nt, Human
uaugcaacagcauuauuacaau

SEQ ID NO: 278238 - RNA, 22 nt, Human
uguuucauuaguacugacaaua

SEQ ID NO: 278239 - RNA, 22 nt, Human
ucugcuguucucaugcugauuu

SEQ ID NO: 278240 - RNA, 22 nt, Human
gcuguucagggcacucaugggc

SEQ ID NO: 278241 - RNA, 22 nt, Human
agucaaaggguauuuggauuga

SEQ ID NO: 278242 - RNA, 21 nt, Human
acauuacagggugaugugucu

SEQ ID NO: 278243 - RNA, 19 nt, Human
ccuagagcaguaccuggua

SEQ ID NO: 278244 - RNA, 22 nt, Human
cagaggcccagugagagggcug

SEQ ID NO: 278245 - RNA, 22 nt, Human
auucuucagaauaucuggcacu

SEQ ID NO: 278246 - RNA, 22 nt, Human
uggccucagauuauugcacagu

SEQ ID NO: 278247 - RNA, 22 nt, Human
aggcuggaugugccucaccgag

SEQ ID NO: 278248 - RNA, 20 nt, Human
gugguauucaguaacaguga

SEQ ID NO: 278249 - RNA, 22 nt, Human
aagcccuggcccaaccuugauu

SEQ ID NO: 278250 - RNA, 22 nt, Human
ucccugggccuccugcuaugca

SEQ ID NO: 278251 - RNA, 19 nt, Human
gagguucacgcgcuggaug

SEQ ID NO: 278252 - RNA, 22 nt, Human
uucuaaagugcaaucugacaga

SEQ ID NO: 278253 - RNA, 22 nt, Human
agucaggaagcuggagcugggg

SEQ ID NO: 278254 - RNA, 22 nt, Human
auccauuauugggccaauaaag

SEQ ID NO: 278255 - RNA, 20 nt, Human
gagcacaguaaugacugcua

SEQ ID NO: 278256 - RNA, 22 nt, Human
caagucaaugauuauaagaguc

SEQ ID NO: 278257 - RNA, 19 nt, Human
ucagaggauuuggcuauga

SEQ ID NO: 278258 - RNA, 22 nt, Human
uggcuucuugggaugggucauu

SEQ ID NO: 278259 - RNA, 22 nt, Human
cucagagggaggacugggcugg

SEQ ID NO: 278260 - RNA, 22 nt, Human
caggaaacauaugugcuugagg

SEQ ID NO: 278261 - RNA, 22 nt, Human
auguaacacccacuuuuauagc

SEQ ID NO: 278262 - RNA, 22 nt, Human
cuccauauggcccugggaccug

SEQ ID NO: 278263 - RNA, 22 nt, Human
cacuugaacccgggaggcugag

SEQ ID NO: 278264 - RNA, 22 nt, Human
uaugagcuuuggaaugagaaac

SEQ ID NO: 278265 - RNA, 21 nt, Human
ccuguggauuuuaaaauugga

SEQ ID NO: 278266 - RNA, 22 nt, Human
uggaggcaacugaagauguagu

SEQ ID NO: 278267 - RNA, 22 nt, Human
gaggcagcugaagcuucaaaga

SEQ ID NO: 278268 - RNA, 22 nt, Human
acaaaugagaauguagacagag

SEQ ID NO: 278269 - RNA, 22 nt, Human
ccucaagaacaauccaccauua

SEQ ID NO: 278270 - RNA, 22 nt, Human
guuagggaucaggaacaagagc

SEQ ID NO: 278271 - RNA, 22 nt, Human
auccaggaaggauggcauugag

SEQ ID NO: 278272 - RNA, 22 nt, Human
ugucauuuggacuuugguauua

SEQ ID NO: 278273 - RNA, 22 nt, Human
gaagcuugagaacuacuguccu

SEQ ID NO: 278274 - RNA, 22 nt, Human
gagggggcucccugaagccagu

SEQ ID NO: 278275 - RNA, 22 nt, Human
auguacaagcuguuuuacugca

SEQ ID NO: 278276 - RNA, 22 nt, Human
cuauuuucauucuuacauuguc

SEQ ID NO: 278277 - RNA, 18 nt, Human
aggucugaggaagagccu

SEQ ID NO: 278278 - RNA, 21 nt, Human
uuuagggaggauauuuaacuu

SEQ ID NO: 278279 - RNA, 22 nt, Human
ugugugugcaggagagcaggug

SEQ ID NO: 278280 - RNA, 22 nt, Human
caggcagccaggggaccugucc

SEQ ID NO: 278281 - RNA, 22 nt, Human
aacuguaauuuuuacauaguaa

SEQ ID NO: 278282 - RNA, 22 nt, Human
guccuguguguugccggcugaa

SEQ ID NO: 278283 - RNA, 22 nt, Human
uggcucuguggucuuagcaugc

SEQ ID NO: 278284 - RNA, 16 nt, Human
uugaaugacugugugc

SEQ ID NO: 278285 - RNA, 22 nt, Human
cagcugccuucugcgggaaguc

SEQ ID NO: 278286 - RNA, 22 nt, Human
gcaaggcagcgcggaguagcua

SEQ ID NO: 278287 - RNA, 22 nt, Human
agcuuagaagugugcugagagg

SEQ ID NO: 278288 - RNA, 23 nt, Human
gagcucagguagggcucgcccgc

SEQ ID NO: 278289 - RNA, 22 nt, Human
uauauauaugcacacacaccua

SEQ ID NO: 278290 - RNA, 22 nt, Human
uaagacacaguccgcacucucu

SEQ ID NO: 278291 - RNA, 22 nt, Human
ggcagccccaucagagacgcug

SEQ ID NO: 278292 - RNA, 22 nt, Human
aagcugcagcacagagaggugg

SEQ ID NO: 278293 - RNA, 22 nt, Human
aauuucaagucuugaagaagua

SEQ ID NO: 278294 - RNA, 19 nt, Human
agcuccaggccuggaugcu

SEQ ID NO: 278295 - RNA, 22 nt, Human
agcccugcacaggucuguggcu

SEQ ID NO: 278296 - RNA, 22 nt, Human
cacagaaaaaggcuugaaaauc

SEQ ID NO: 278297 - RNA, 22 nt, Human
gggaaacuguccaguucucccc

SEQ ID NO: 278298 - RNA, 22 nt, Human
gaguaaaaguuggauuacaaag

SEQ ID NO: 278299 - RNA, 21 nt, Human
ucaggcagugcaaauacaugg

SEQ ID NO: 278300 - RNA, 22 nt, Human
gaguccaggauuugagcucugu

SEQ ID NO: 278301 - RNA, 20 nt, Human
gccuagggucacuucaguga

SEQ ID NO: 278302 - RNA, 22 nt, Human
ggaccaggcugagcaccugccu

SEQ ID NO: 278303 - RNA, 22 nt, Human
gggagaaggaggacugugcugu

SEQ ID NO: 278304 - RNA, 22 nt, Human
ugcagagaccacugugccuucc

SEQ ID NO: 278305 - RNA, 22 nt, Human
uuaaacagguuuuugaauggcc

SEQ ID NO: 278306 - RNA, 22 nt, Human
cacagcuaccugcaugccugcu

SEQ ID NO: 278307 - RNA, 22 nt, Human
aagugauuuuccuacuugcuaa

SEQ ID NO: 278308 - RNA, 22 nt, Human
caggcaacguccuuagagaugc

SEQ ID NO: 278309 - RNA, 22 nt, Human
gggacagacccaugggccaggu

SEQ ID NO: 278310 - RNA, 22 nt, Human
cuguucacacacuuguacucuc

SEQ ID NO: 278311 - RNA, 22 nt, Human
cagagccaaaccucagggcccg

SEQ ID NO: 278312 - RNA, 22 nt, Human
augaggcaggauuaagcuauca

SEQ ID NO: 278313 - RNA, 22 nt, Human
uucgcagggagacaggcucucu

SEQ ID NO: 278314 - RNA, 22 nt, Human
guuugccugccgacgcucucau

SEQ ID NO: 278315 - RNA, 22 nt, Human
augcuuggaugcugccauggga

SEQ ID NO: 278316 - RNA, 22 nt, Human
uuuacauggaauauugucuugu

SEQ ID NO: 278317 - RNA, 22 nt, Human
uggcuucuuuccacuguccugu

SEQ ID NO: 278318 - RNA, 22 nt, Human
uagaaguuaggaaauaggaaua

SEQ ID NO: 278319 - RNA, 22 nt, Human
aucuguggaaauuggcaagugc

SEQ ID NO: 278320 - RNA, 17 nt, Human
uuucugcaugauuggac

SEQ ID NO: 278321 - RNA, 22 nt, Human
ggcucagcacagggcuggcauc

SEQ ID NO: 278322 - RNA, 22 nt, Human
ccagcucuggcuucuugcuggg

SEQ ID NO: 278323 - RNA, 18 nt, Human
cauaauuuucuuucuuua

SEQ ID NO: 278324 - RNA, 22 nt, Human
uuucaaauggaucccucagccu

SEQ ID NO: 278325 - RNA, 22 nt, Human
uucugucugauggugccagaac

SEQ ID NO: 278326 - RNA, 21 nt, Human
gucauccaccucucgggcucu

SEQ ID NO: 278327 - RNA, 22 nt, Human
cuguggcucucugcaggguccc

SEQ ID NO: 278328 - RNA, 22 nt, Human
aauaauuacccaucuuuuugua

SEQ ID NO: 278329 - RNA, 22 nt, Human
acaaaugaacauauaagcuuga

SEQ ID NO: 278330 - RNA, 22 nt, Human
ugcagggccagacuggguugga

SEQ ID NO: 278331 - RNA, 22 nt, Human
uccuguccacagcccugaccuc

SEQ ID NO: 278332 - RNA, 22 nt, Human
cugucucuguugccuguaggug

SEQ ID NO: 278333 - RNA, 22 nt, Human
uacaaguguaagcuugugagac

SEQ ID NO: 278334 - RNA, 22 nt, Human
gccaccagggggcuccagugag

SEQ ID NO: 278335 - RNA, 22 nt, Human
gagggggcuagcgcagugccca

SEQ ID NO: 278336 - RNA, 23 nt, Human
cauggaaaacugaaagcugaccu

SEQ ID NO: 278337 - RNA, 22 nt, Human
uacacauguauuuauguguaca

SEQ ID NO: 278338 - RNA, 19 nt, Human
uccaguguagcuggucauu

SEQ ID NO: 278339 - RNA, 20 nt, Human
uggcuccagccuccccuacc

SEQ ID NO: 278340 - RNA, 22 nt, Human
uguaaaugaaguaugcuuuacu

SEQ ID NO: 278341 - RNA, 22 nt, Human
auuuuuuauauaccaagguggg

SEQ ID NO: 278342 - RNA, 22 nt, Human
gcaggcagagagggguuuccag

SEQ ID NO: 278343 - RNA, 20 nt, Human
uuuauugagcacguacugug

SEQ ID NO: 278344 - RNA, 22 nt, Human
uugaaagauagugaagccagcc

SEQ ID NO: 278345 - RNA, 22 nt, Human
acauuuaaguuaaaaccucagu

SEQ ID NO: 278346 - RNA, 22 nt, Human
cggccaggcacaguggcccacg

SEQ ID NO: 278347 - RNA, 22 nt, Human
aauucccacuauaugccaagca

SEQ ID NO: 278348 - RNA, 22 nt, Human
cuuucucaaugccggaaggcac

SEQ ID NO: 278349 - RNA, 22 nt, Human
ucuugccucuuccccuuuccau

SEQ ID NO: 278350 - RNA, 22 nt, Human
ugagcccuggagcccucuguua

SEQ ID NO: 278351 - RNA, 22 nt, Human
agaagccauugaagcagaccuc

SEQ ID NO: 278352 - RNA, 19 nt, Human
ccauuguaaagaaaaaugu

SEQ ID NO: 278353 - RNA, 22 nt, Human
acagauugaucuugagaauuau

SEQ ID NO: 278354 - RNA, 22 nt, Human
ccugcaggggagagacuucuag

SEQ ID NO: 278355 - RNA, 22 nt, Human
acaagauuuuaugacucuuuuu

SEQ ID NO: 278356 - RNA, 22 nt, Human
agagagcugacuuuggagucag

SEQ ID NO: 278357 - RNA, 22 nt, Human
gagcuggcacagaaggaucuua

SEQ ID NO: 278358 - RNA, 22 nt, Human
augguauucucagcaccuagca

SEQ ID NO: 278359 - RNA, 22 nt, Human
uuccagcagcgugggagaagua

SEQ ID NO: 278360 - RNA, 22 nt, Human
uagguuuaggagugaaggugaa

SEQ ID NO: 278361 - RNA, 22 nt, Human
ucugggaacagccuggcugugu

SEQ ID NO: 278362 - RNA, 23 nt, Human
gugagucuugccuuugcugugga

SEQ ID NO: 278363 - RNA, 22 nt, Human
ggacucagcagccaggaguggc

SEQ ID NO: 278364 - RNA, 22 nt, Human
uucuuugggcucagagagggag

SEQ ID NO: 278365 - RNA, 22 nt, Human
agcuuugaaguauuuggucucc

SEQ ID NO: 278366 - RNA, 18 nt, Human
uggcugcuggaguagggu

SEQ ID NO: 278367 - RNA, 22 nt, Human
ggguccagaguugaagagguua

SEQ ID NO: 278368 - RNA, 22 nt, Human
agcuccaggaucugaaaguucg

SEQ ID NO: 278369 - RNA, 22 nt, Human
ccugcucccgggacgcguucac

SEQ ID NO: 278370 - RNA, 22 nt, Human
gaggcugccccuuccucagcug

SEQ ID NO: 278371 - RNA, 22 nt, Human
cugggccugccaccaucuuagg

SEQ ID NO: 278372 - RNA, 22 nt, Human
aaugguuuguaccuguccuugg

SEQ ID NO: 278373 - RNA, 22 nt, Human
gugggaagucucucggaggaag

SEQ ID NO: 278374 - RNA, 20 nt, Human
cuagaacugagaaauuuaaa

SEQ ID NO: 278375 - RNA, 19 nt, Human
gauauaaagagauggugaa

SEQ ID NO: 278376 - RNA, 22 nt, Human
guggcugcuaagucuccuuccu

SEQ ID NO: 278377 - RNA, 22 nt, Human
gugcauuauucuuaccuuucuu

SEQ ID NO: 278378 - RNA, 22 nt, Human
ggaggaagcccucggugcccca

SEQ ID NO: 278379 - RNA, 22 nt, Human
agggagcuuuaccccagaucac

SEQ ID NO: 278380 - RNA, 22 nt, Human
aggcucugaucagguggcugug

SEQ ID NO: 278381 - RNA, 22 nt, Human
gucauucaacugcacauuaggu

SEQ ID NO: 278382 - RNA, 22 nt, Human
augaaauucaucugagaaugcu

SEQ ID NO: 278383 - RNA, 17 nt, Human
ucuagagcacuuugaga

SEQ ID NO: 278384 - RNA, 22 nt, Human
aauguuuugcauuaguuuucua

SEQ ID NO: 278385 - RNA, 22 nt, Human
ucuuuccauggccacacagucu

SEQ ID NO: 278386 - RNA, 22 nt, Human
cuguuaaauagacugcagugca

SEQ ID NO: 278387 - RNA, 22 nt, Human
cugccuugguuucuagcagggc

SEQ ID NO: 278388 - RNA, 22 nt, Human
agucaacaccugguucuauuac

SEQ ID NO: 278389 - RNA, 22 nt, Human
auuaaagaaacccagcauguga

SEQ ID NO: 278390 - RNA, 22 nt, Human
cagcacaguuucccccaugagc

SEQ ID NO: 278391 - RNA, 22 nt, Human
uaaggcuaucugaguuuaugug

SEQ ID NO: 278392 - RNA, 17 nt, Human
gcccucagcuuuaacca

SEQ ID NO: 278393 - RNA, 22 nt, Human
cuugaauccaaaugggagauga

SEQ ID NO: 278394 - RNA, 22 nt, Human
aagcaccacccucccaaccugu

SEQ ID NO: 278395 - RNA, 22 nt, Human
cccugggauggauuggcaggaa

SEQ ID NO: 278396 - RNA, 22 nt, Human
cauuuagaaacuguuuuuaaca

SEQ ID NO: 278397 - RNA, 22 nt, Human
caguuaaaaugugcuauaagaa

SEQ ID NO: 278398 - RNA, 22 nt, Human
uccuagaggaugguaggaagcu

SEQ ID NO: 278399 - RNA, 22 nt, Human
cagcaugaaaaguguugcuauc

SEQ ID NO: 278400 - RNA, 22 nt, Human
gggcagguggccucuuguacua

SEQ ID NO: 278401 - RNA, 22 nt, Human
aacaagcagaugcaaugcacuu

SEQ ID NO: 278402 - RNA, 19 nt, Human
uggagcagggcccuuguuu

SEQ ID NO: 278403 - RNA, 22 nt, Human
gcugccuggcuuuaguccacuu

SEQ ID NO: 278404 - RNA, 22 nt, Human
ccaggaagccugugucucugga

SEQ ID NO: 278405 - RNA, 22 nt, Human
cggcugugucuucacaggagcc

SEQ ID NO: 278406 - RNA, 22 nt, Human
uccaugcaaacaguggcuagcu

SEQ ID NO: 278407 - RNA, 22 nt, Human
ccuggggccccgagccagaagc

SEQ ID NO: 278408 - RNA, 22 nt, Human
acuuagauuccugguaccuccg

SEQ ID NO: 278409 - RNA, 22 nt, Human
ggaaagagaaguugggaggaau

SEQ ID NO: 278410 - RNA, 22 nt, Human
uuaguacauagaugaugguuga

SEQ ID NO: 278411 - RNA, 22 nt, Human
gagcaguuauuuuuagacauga

SEQ ID NO: 278412 - RNA, 22 nt, Human
uuuaucuuuaggacuuugcaga

SEQ ID NO: 278413 - RNA, 22 nt, Human
aaagugcauucgaaaguccauc

SEQ ID NO: 278414 - RNA, 22 nt, Human
cccaugcugaguggccugagau

SEQ ID NO: 278415 - RNA, 22 nt, Human
aagaaagauaagguuugcuugg

SEQ ID NO: 278416 - RNA, 22 nt, Human
agcaggagagcagugcgugguc

SEQ ID NO: 278417 - RNA, 20 nt, Human
ucugagaccuuuccacaccc

SEQ ID NO: 278418 - RNA, 22 nt, Human
ccuggcugcuauagcagcaugu

SEQ ID NO: 278419 - RNA, 22 nt, Human
aagcagccacuggccaguuaua

SEQ ID NO: 278420 - RNA, 22 nt, Human
agcaaaagauagauuaacaaga

SEQ ID NO: 278421 - RNA, 22 nt, Human
auuuagaacuuuguuugccaau

SEQ ID NO: 278422 - RNA, 22 nt, Human
uaggccaggacagagcuuccag

SEQ ID NO: 278423 - RNA, 22 nt, Human
agggcccucuggcaggccaggc

SEQ ID NO: 278424 - RNA, 21 nt, Human
ugcuucucuagaucaacuacu

SEQ ID NO: 278425 - RNA, 22 nt, Human
uucaacaauuaaguaucagccu

SEQ ID NO: 278426 - RNA, 22 nt, Human
uuauauaaagauaacuuuucuu

SEQ ID NO: 278427 - RNA, 22 nt, Human
ccagaagugucuaucaagaugu

SEQ ID NO: 278428 - RNA, 22 nt, Human
ggcuguggggaccaacaggacu

SEQ ID NO: 278429 - RNA, 22 nt, Human
uagggcuggguacacucuugcc

SEQ ID NO: 278430 - RNA, 22 nt, Human
gccaggucaccucacucaucca

SEQ ID NO: 278431 - RNA, 22 nt, Human
cagccaggauggagaacuguug

SEQ ID NO: 278432 - RNA, 22 nt, Human
ucagagcaaauuccugugagcc

SEQ ID NO: 278433 - RNA, 22 nt, Human
uacuuccuguuuccaugucugu

SEQ ID NO: 278434 - RNA, 22 nt, Human
cuaaucaucuuucucuuaaagc

SEQ ID NO: 278435 - RNA, 22 nt, Human
aagcccauaaaaagaggucccu

SEQ ID NO: 278436 - RNA, 22 nt, Human
auucagcaugcaauuagguaau

SEQ ID NO: 278437 - RNA, 22 nt, Human
aggaggugcuagagaagauguu

SEQ ID NO: 278438 - RNA, 22 nt, Human
acuguaaaauacauaaguauug

SEQ ID NO: 278439 - RNA, 22 nt, Human
gacuuucuaaugcucuguagau

SEQ ID NO: 278440 - RNA, 22 nt, Human
agaggagguggugaugcuuuaa

SEQ ID NO: 278441 - RNA, 22 nt, Human
gcucagggagagagggcagccg

SEQ ID NO: 278442 - RNA, 22 nt, Human
ugggacacacaaggucagcucu

SEQ ID NO: 278443 - RNA, 22 nt, Human
uuugaagacauuugaauacuuu

SEQ ID NO: 278444 - RNA, 22 nt, Human
ugaggccugcauugaacuagaa

SEQ ID NO: 278445 - RNA, 22 nt, Human
uugcuuuauguguaugacuuga

SEQ ID NO: 278446 - RNA, 21 nt, Human
gggguuggcaagagcagagac

SEQ ID NO: 278447 - RNA, 22 nt, Human
cccacaucccuuccccgcugug

SEQ ID NO: 278448 - RNA, 19 nt, Human
uucacauuuuuguggcacu

SEQ ID NO: 278449 - RNA, 22 nt, Human
aaugucagccugaaagcuauuc

SEQ ID NO: 278450 - RNA, 22 nt, Human
gggucugggcaggcgcuuccuc

SEQ ID NO: 278451 - RNA, 18 nt, Human
gcucagcuaugggagguu

SEQ ID NO: 278452 - RNA, 22 nt, Human
ggggaccuuuccauuucugaga

SEQ ID NO: 278453 - RNA, 22 nt, Human
cagaaucuucuuaauuggcaca

SEQ ID NO: 278454 - RNA, 22 nt, Human
ucauuguauacuuuauuuauga

SEQ ID NO: 278455 - RNA, 22 nt, Human
uuuccucacucaugucaucagu

SEQ ID NO: 278456 - RNA, 22 nt, Human
aacagaaucuuggguucuuuuc

SEQ ID NO: 278457 - RNA, 22 nt, Human
uuagagaaaggguuugauuccg

SEQ ID NO: 278458 - RNA, 22 nt, Human
uagcugggucucuguuuucuca

SEQ ID NO: 278459 - RNA, 22 nt, Human
uguuggaaaagaauuaacuagg

SEQ ID NO: 278460 - RNA, 22 nt, Human
uuuggcaagugggaaauuagua

SEQ ID NO: 278461 - RNA, 22 nt, Human
aguggccaccaugccagcucuc

SEQ ID NO: 278462 - RNA, 22 nt, Human
aucuuuuacauuacugcccaga

SEQ ID NO: 278463 - RNA, 22 nt, Human
cacagcagaaaguguaggagga

SEQ ID NO: 278464 - RNA, 22 nt, Human
aguccugugcaaaugcaucuga

SEQ ID NO: 278465 - RNA, 22 nt, Human
ucuucuggaucgaucacauugu

SEQ ID NO: 278466 - RNA, 16 nt, Human
uccaguuuucagcacu

SEQ ID NO: 278467 - RNA, 22 nt, Human
agcagcuggaacuaauaguggu

SEQ ID NO: 278468 - RNA, 21 nt, Human
ugacauuuccaauauaaagcc

SEQ ID NO: 278469 - RNA, 22 nt, Human
auagcaauuugcccaauuaccu

SEQ ID NO: 278470 - RNA, 22 nt, Human
aauauuaguuucucaagagaga

SEQ ID NO: 278471 - RNA, 22 nt, Human
ucuccagguggcuugggcuucu

SEQ ID NO: 278472 - RNA, 22 nt, Human
ucuuccuugcuccuugucacuu

SEQ ID NO: 278473 - RNA, 22 nt, Human
uugcaaucugcaaagcugugga

SEQ ID NO: 278474 - RNA, 21 nt, Human
aacaaagggaugcucaucuuu

SEQ ID NO: 278475 - RNA, 22 nt, Human
uggagaugaacauggugauguu

SEQ ID NO: 278476 - RNA, 22 nt, Human
uucaaggagauuggagucuacu

SEQ ID NO: 278477 - RNA, 22 nt, Human
ccugggcucugaggagggaguc

SEQ ID NO: 278478 - RNA, 19 nt, Human
uucacaagugaugucucuc

SEQ ID NO: 278479 - RNA, 22 nt, Human
cuucacagucacccugcugugu

SEQ ID NO: 278480 - RNA, 22 nt, Human
aucuggaauccuuguggacaau

SEQ ID NO: 278481 - RNA, 22 nt, Human
cuugggaguagaggcaggagca

SEQ ID NO: 278482 - RNA, 23 nt, Human
ucuccuggcugcacuguggccac

SEQ ID NO: 278483 - RNA, 22 nt, Human
ugggaagggucugaaucugaga

SEQ ID NO: 278484 - RNA, 22 nt, Human
uauguucaucuggugcaucagu

SEQ ID NO: 278485 - RNA, 22 nt, Human
cagaagaggacuggguagcuca

SEQ ID NO: 278486 - RNA, 20 nt, Human
cagaggcauuuucagacucu

SEQ ID NO: 278487 - RNA, 18 nt, Human
aggacacauucuucccuc

SEQ ID NO: 278488 - RNA, 20 nt, Human
uuuuuccuucucuacaggca

SEQ ID NO: 278489 - RNA, 22 nt, Human
gcaacuuaggaguuagagcaug

SEQ ID NO: 278490 - RNA, 22 nt, Human
cugggaagaaauugugggaggc

SEQ ID NO: 278491 - RNA, 22 nt, Human
accaggcacucuuguggcagug

SEQ ID NO: 278492 - RNA, 22 nt, Human
uugguuuaguaccugccagcgu

SEQ ID NO: 278493 - RNA, 22 nt, Human
aacaauaacuagacaugccaug

SEQ ID NO: 278494 - RNA, 22 nt, Human
ugauguguggcaguuaaacugu

SEQ ID NO: 278495 - RNA, 22 nt, Human
ucuguucuucuccacuguaugu

SEQ ID NO: 278496 - RNA, 22 nt, Human
ugaggcagggagaguggauaug

SEQ ID NO: 278497 - RNA, 22 nt, Human
cagcuagcuucccugcagugcu

SEQ ID NO: 278498 - RNA, 22 nt, Human
cagguacacucccuugugcuga

SEQ ID NO: 278499 - RNA, 20 nt, Human
acccagcucugugcccuggg

SEQ ID NO: 278500 - RNA, 22 nt, Human
agggaccugcucacugccuggc

SEQ ID NO: 278501 - RNA, 22 nt, Human
augguacaaaauguauaaaguc

SEQ ID NO: 278502 - RNA, 22 nt, Human
uggcagagucugggcuugggca

SEQ ID NO: 278503 - RNA, 17 nt, Human
uuaucuacugcuacugu

SEQ ID NO: 278504 - RNA, 22 nt, Human
ugauguucuguauaucauauag

SEQ ID NO: 278505 - RNA, 22 nt, Human
acuauuuacucaaaugagguug

SEQ ID NO: 278506 - RNA, 22 nt, Human
acugucuucaaaugaauauauu

SEQ ID NO: 278507 - RNA, 19 nt, Human
ucagugucccuguuaauau

SEQ ID NO: 278508 - RNA, 22 nt, Human
gauucuugggccuucugaaguu

SEQ ID NO: 278509 - RNA, 20 nt, Human
uuacucauaggaccacaagc

SEQ ID NO: 278510 - RNA, 22 nt, Human
cugcaggagggcuggggaagcc

SEQ ID NO: 278511 - RNA, 22 nt, Human
cuggaagaccccccaggacuca

SEQ ID NO: 278512 - RNA, 22 nt, Human
cauuaucucuucuauaugcuag

SEQ ID NO: 278513 - RNA, 22 nt, Human
cuagagcuauucaagguuuuau

SEQ ID NO: 278514 - RNA, 22 nt, Human
auuuauugagacuuaacaaccc

SEQ ID NO: 278515 - RNA, 22 nt, Human
ucaguguccauaaauaaaguuu

SEQ ID NO: 278516 - RNA, 22 nt, Human
agaaccuucagcuugcaacaag

SEQ ID NO: 278517 - RNA, 22 nt, Human
agauccaugugauuuggaguuc

SEQ ID NO: 278518 - RNA, 22 nt, Human
gccaggcuguggggaacuugaa

SEQ ID NO: 278519 - RNA, 22 nt, Human
gcucaggucuuacccaugccug

SEQ ID NO: 278520 - RNA, 18 nt, Human
ggcacuggugaugcagag

SEQ ID NO: 278521 - RNA, 22 nt, Human
ugucuccaugugauaguggccu

SEQ ID NO: 278522 - RNA, 22 nt, Human
cucugaagaugguaccagcuuu

SEQ ID NO: 278523 - RNA, 22 nt, Human
gaaugauauuauuucgugcugg

SEQ ID NO: 278524 - RNA, 22 nt, Human
cagagacauucuccccauugga

SEQ ID NO: 278525 - RNA, 22 nt, Human
aagaauuaucugaaagcugugu

SEQ ID NO: 278526 - RNA, 22 nt, Human
cugcauuagucaugcuuugcag

SEQ ID NO: 278527 - RNA, 22 nt, Human
auacaucuagagucauaaaaac

SEQ ID NO: 278528 - RNA, 22 nt, Human
aucuccagcaauggggagcucu

SEQ ID NO: 278529 - RNA, 22 nt, Human
uucaagcagagauauuucaaga

SEQ ID NO: 278530 - RNA, 19 nt, Human
cagagccuucagugacucc

SEQ ID NO: 278531 - RNA, 22 nt, Human
agcuggccuucggugucacugg

SEQ ID NO: 278532 - RNA, 22 nt, Human
cagcacugugauaacugagcca

SEQ ID NO: 278533 - RNA, 22 nt, Human
uccuuagagauacugucuugaa

SEQ ID NO: 278534 - RNA, 22 nt, Human
ucccagccggugccuggguccc

SEQ ID NO: 278535 - RNA, 22 nt, Human
aacacuguaucagucuucaaua

SEQ ID NO: 278536 - RNA, 22 nt, Human
ugcugagguuguggagugcauu

SEQ ID NO: 278537 - RNA, 22 nt, Human
gagucagaagaaacuauuuaca

SEQ ID NO: 278538 - RNA, 22 nt, Human
aaacaaacauagguuugaaagu

SEQ ID NO: 278539 - RNA, 22 nt, Human
agcacagaauggcuuggaagcc

SEQ ID NO: 278540 - RNA, 22 nt, Human
aguuuacauauuugucggaguc

SEQ ID NO: 278541 - RNA, 22 nt, Human
uauacagauaucuaagauguaa

SEQ ID NO: 278542 - RNA, 22 nt, Human
ucuaagaucuacuauacaugug

SEQ ID NO: 278543 - RNA, 22 nt, Human
ucucugaugcugccagggaaaa

SEQ ID NO: 278544 - RNA, 22 nt, Human
gccaggcuggugcaaggauauu

SEQ ID NO: 278545 - RNA, 22 nt, Human
acugaaagauaaaucaguuagc

SEQ ID NO: 278546 - RNA, 22 nt, Human
aggaccagaggccagagucagc

SEQ ID NO: 278547 - RNA, 22 nt, Human
gucauuccuauccauuugauac

SEQ ID NO: 278548 - RNA, 22 nt, Human
gcccucuguuauugcauccuua

SEQ ID NO: 278549 - RNA, 22 nt, Human
aagcugaagacacagcuccagu

SEQ ID NO: 278550 - RNA, 22 nt, Human
agucaacauuugagaugcaaug

SEQ ID NO: 278551 - RNA, 22 nt, Human
guacaauaacuagucuuauagu

SEQ ID NO: 278552 - RNA, 19 nt, Human
ucacagacagagcaaucac

SEQ ID NO: 278553 - RNA, 22 nt, Human
cauuuaguuuugcaguagcagg

SEQ ID NO: 278554 - RNA, 23 nt, Human
auauaaacaccagauagauugua

SEQ ID NO: 278555 - RNA, 22 nt, Human
ccagugcauugccgugucuagg

SEQ ID NO: 278556 - RNA, 22 nt, Human
uuuuuggcagcucagaaacuuc

SEQ ID NO: 278557 - RNA, 22 nt, Human
uguuuacuuuuaauuaccuguc

SEQ ID NO: 278558 - RNA, 22 nt, Human
gaagagcugacagugucauccu

SEQ ID NO: 278559 - RNA, 22 nt, Human
caauaacugcuaaauucccugu

SEQ ID NO: 278560 - RNA, 18 nt, Human
auccuagaccauacacag

SEQ ID NO: 278561 - RNA, 22 nt, Human
augguuuauugcuuuaaugaaa

SEQ ID NO: 278562 - RNA, 22 nt, Human
uuaaauugucauuugagcaaug

SEQ ID NO: 278563 - RNA, 22 nt, Human
auguagcagauauuugugcaca

SEQ ID NO: 278564 - RNA, 22 nt, Human
uauuucuauuccccaggcaagu

SEQ ID NO: 278565 - RNA, 22 nt, Human
ccaagcuggacagcagcaagga

SEQ ID NO: 278566 - RNA, 22 nt, Human
uggcaagagggaugcaagguuu

SEQ ID NO: 278567 - RNA, 22 nt, Human
uaauuagaguuugguaaacaau

SEQ ID NO: 278568 - RNA, 22 nt, Human
uucauugaaauacagucuugac

SEQ ID NO: 278569 - RNA, 22 nt, Human
cucugaggucuaggaccauggc

SEQ ID NO: 278570 - RNA, 22 nt, Human
caggcuucgcucugugggcagg

SEQ ID NO: 278571 - RNA, 22 nt, Human
guacacauagguuacugauuaa

SEQ ID NO: 278572 - RNA, 22 nt, Human
agcugaaaauuagugauaguuu

SEQ ID NO: 278573 - RNA, 22 nt, Human
gcuacaagucuugucauucauu

SEQ ID NO: 278574 - RNA, 22 nt, Human
auaaacagccugcccaaauugg

SEQ ID NO: 278575 - RNA, 22 nt, Human
aguacauacuucaaauguacuu

SEQ ID NO: 278576 - RNA, 22 nt, Human
agugucagcuaauuauucauga

SEQ ID NO: 278577 - RNA, 22 nt, Human
cuccuggccccagaucccaauc

SEQ ID NO: 278578 - RNA, 18 nt, Human
gaaaugugauucuagggc

SEQ ID NO: 278579 - RNA, 22 nt, Human
gaggacagagccgccuggcaag

SEQ ID NO: 278580 - RNA, 22 nt, Human
uuagaaucuaacauucuuaucu

SEQ ID NO: 278581 - RNA, 22 nt, Human
uguaaaagacauuucuaagcaa

SEQ ID NO: 278582 - RNA, 22 nt, Human
uggcugugggauaugugacuga

SEQ ID NO: 278583 - RNA, 22 nt, Human
acaacugucaguaaagaauauu

SEQ ID NO: 278584 - RNA, 22 nt, Human
auuaaauuuucacuaggcuccc

SEQ ID NO: 278585 - RNA, 22 nt, Human
uuuuugcuccacaacuuugaag

SEQ ID NO: 278586 - RNA, 22 nt, Human
guaacacucuaaagggaugcac

SEQ ID NO: 278587 - RNA, 22 nt, Human
augugcuggcuaacuggauggg

SEQ ID NO: 278588 - RNA, 22 nt, Human
gccccaccugcuaccuuccagc

SEQ ID NO: 278589 - RNA, 22 nt, Human
ucagauauucucuaagaacaau

SEQ ID NO: 278590 - RNA, 22 nt, Human
gaguucuucuauauaguaugag

SEQ ID NO: 278591 - RNA, 22 nt, Human
auacuucucaugggcucugagc

SEQ ID NO: 278592 - RNA, 21 nt, Human
uccuggcccacucuaucccca

SEQ ID NO: 278593 - RNA, 22 nt, Human
aggaccuguaccucagcaucua

SEQ ID NO: 278594 - RNA, 22 nt, Human
cacagaggaaaggcaguuggua

SEQ ID NO: 278595 - RNA, 21 nt, Human
agaugcaguuugcaggugggu

SEQ ID NO: 278596 - RNA, 22 nt, Human
uauaguuucaugagcuuuuuaa

SEQ ID NO: 278597 - RNA, 22 nt, Human
acugggcuccaaggaccuggag

SEQ ID NO: 278598 - RNA, 22 nt, Human
uucugugauugacauguggcuu

SEQ ID NO: 278599 - RNA, 22 nt, Human
ccucuggggguccucagagucu

SEQ ID NO: 278600 - RNA, 19 nt, Human
gaauuuuaggacuucagca

SEQ ID NO: 278601 - RNA, 23 nt, Human
cauguacacacagcuguacagug

SEQ ID NO: 278602 - RNA, 22 nt, Human
guccugugugacuucccaaaug

SEQ ID NO: 278603 - RNA, 22 nt, Human
ugcucuguccagugcaccauca

SEQ ID NO: 278604 - RNA, 22 nt, Human
gccagagugccaucagugccau

SEQ ID NO: 278605 - RNA, 22 nt, Human
ugcccugccaagacugaguggu

SEQ ID NO: 278606 - RNA, 22 nt, Human
augcaaaaguaguugcaguuuu

SEQ ID NO: 278607 - RNA, 19 nt, Human
uacauuccacacaaucucu

SEQ ID NO: 278608 - RNA, 22 nt, Human
gccaccuggacucagagccagg

SEQ ID NO: 278609 - RNA, 22 nt, Human
cagggagcggagucccaugccu

SEQ ID NO: 278610 - RNA, 22 nt, Human
cuucagcuuucagcuucccuga

SEQ ID NO: 278611 - RNA, 22 nt, Human
cugaaaaauauguuuuggagaa

SEQ ID NO: 278612 - RNA, 22 nt, Human
caaggcaggcaguucacuugag

SEQ ID NO: 278613 - RNA, 22 nt, Human
gaguuacacaaaauuucuauuu

SEQ ID NO: 278614 - RNA, 20 nt, Human
uacagccccugcuucuguug

SEQ ID NO: 278615 - RNA, 22 nt, Human
uugacagcuacggagcagcugu

SEQ ID NO: 278616 - RNA, 22 nt, Human
gcagacccugaacugggcaugg

SEQ ID NO: 278617 - RNA, 22 nt, Human
cuguccuggagggcauaggacg

SEQ ID NO: 278618 - RNA, 22 nt, Human
cagcccagcagacuguuaccac

SEQ ID NO: 278619 - RNA, 22 nt, Human
uacaugaagaaaauuaagcagu

SEQ ID NO: 278620 - RNA, 17 nt, Human
uccaugagacaugaaga

SEQ ID NO: 278621 - RNA, 22 nt, Human
agcaguccaacugagguggcau

SEQ ID NO: 278622 - RNA, 22 nt, Human
cagcugagaguagaaauggagg

SEQ ID NO: 278623 - RNA, 22 nt, Human
cuccuucuccucgggaggccag

SEQ ID NO: 278624 - RNA, 22 nt, Human
uccagggacaguauagaggauc

SEQ ID NO: 278625 - RNA, 22 nt, Human
uauagcaauucagaauacaugu

SEQ ID NO: 278626 - RNA, 21 nt, Human
ucagggcagcugcucuucaga

SEQ ID NO: 278627 - RNA, 22 nt, Human
guuuacuguuaaccaacgaaug

SEQ ID NO: 278628 - RNA, 22 nt, Human
uacagggauuguuuuaaucacc

SEQ ID NO: 278629 - RNA, 22 nt, Human
agaucagacuuugugacuagga

SEQ ID NO: 278630 - RNA, 22 nt, Human
aacuuucuauagguugggauuu

SEQ ID NO: 278631 - RNA, 22 nt, Human
cauugaaaaacguugacugagu

SEQ ID NO: 278632 - RNA, 22 nt, Human
ugugcaugacagcauacaaacg

SEQ ID NO: 278633 - RNA, 22 nt, Human
gaaacagauuaacagcauauuu

SEQ ID NO: 278634 - RNA, 20 nt, Human
gccugcagguuggaugggau

SEQ ID NO: 278635 - RNA, 22 nt, Human
acaugcuuuucccacaauuaua

SEQ ID NO: 278636 - RNA, 22 nt, Human
cucuuaguaaugccaugaagca

SEQ ID NO: 278637 - RNA, 22 nt, Human
gucuuccacauuucaagaggcu

SEQ ID NO: 278638 - RNA, 22 nt, Human
aagguggugcuucugcuccucu

SEQ ID NO: 278639 - RNA, 22 nt, Human
aaaauucauagaacuguacgcu

SEQ ID NO: 278640 - RNA, 21 nt, Human
aucugaaagguuaguguugag

SEQ ID NO: 278641 - RNA, 22 nt, Human
cuugccaaauuaacauacagaa

SEQ ID NO: 278642 - RNA, 22 nt, Human
gggaccagugucugugagaaaa

SEQ ID NO: 278643 - RNA, 19 nt, Human
uuccuggcucuucuguuuu

SEQ ID NO: 278644 - RNA, 22 nt, Human
aacauugaguucuacuuccauu

SEQ ID NO: 278645 - RNA, 22 nt, Human
ugccuguguugauuacuuuguc

SEQ ID NO: 278646 - RNA, 22 nt, Human
gcuuaggaugaaugcuguagaa

SEQ ID NO: 278647 - RNA, 23 nt, Human
ggaauguuuaccugugaauguca

SEQ ID NO: 278648 - RNA, 22 nt, Human
cuuagaugaagucacagaaccc

SEQ ID NO: 278649 - RNA, 22 nt, Human
uauauuguuggugggaauauaa

SEQ ID NO: 278650 - RNA, 22 nt, Human
gugaggcagaaguucccuuuua

SEQ ID NO: 278651 - RNA, 22 nt, Human
uagggaugagccaguggguagu

SEQ ID NO: 278652 - RNA, 22 nt, Human
uuagcaauugauucucauaagc

SEQ ID NO: 278653 - RNA, 22 nt, Human
auagauauuagcaaaauuuuau

SEQ ID NO: 278654 - RNA, 22 nt, Human
gugcccugguccccagcauaua

SEQ ID NO: 278655 - RNA, 22 nt, Human
uuccugaacauuucuaaguuga

SEQ ID NO: 278656 - RNA, 22 nt, Human
caaggcuucacguccccagugc

SEQ ID NO: 278657 - RNA, 22 nt, Human
gagaaacuuggaguuauucugg

SEQ ID NO: 278658 - RNA, 18 nt, Human
ggagcccagaggugaguu

SEQ ID NO: 278659 - RNA, 22 nt, Human
uggagcagcauucauccagcag

SEQ ID NO: 278660 - RNA, 22 nt, Human
guaggcagguggaggagugaag

SEQ ID NO: 278661 - RNA, 22 nt, Human
ucugccugagaaguggggugcc

SEQ ID NO: 278662 - RNA, 22 nt, Human
uuacugaggguguaucuuagug

SEQ ID NO: 278663 - RNA, 22 nt, Human
ugugccugauggucacguggcc

SEQ ID NO: 278664 - RNA, 22 nt, Human
cucuccacuguccuuugcuggu

SEQ ID NO: 278665 - RNA, 22 nt, Human
uugcaaaguucccuacacaugu

SEQ ID NO: 278666 - RNA, 22 nt, Human
augaggucaucuugaaguaggg

SEQ ID NO: 278667 - RNA, 22 nt, Human
ugguccaggcacccuucuagag

SEQ ID NO: 278668 - RNA, 18 nt, Human
auuucuacuacuauaaag

SEQ ID NO: 278669 - RNA, 22 nt, Human
uuagcucuuuguagcuauuucu

SEQ ID NO: 278670 - RNA, 22 nt, Human
gcagcucagggagagggcacca

SEQ ID NO: 278671 - RNA, 20 nt, Human
aaacuaaagguguuugguuu

SEQ ID NO: 278672 - RNA, 21 nt, Human
uguuuaauacauauuugugga

SEQ ID NO: 278673 - RNA, 22 nt, Human
ccaggccucuggcugcuuaguc

SEQ ID NO: 278674 - RNA, 22 nt, Human
ugagcccuccaaacccaggauu

SEQ ID NO: 278675 - RNA, 23 nt, Human
gggaccagcuagggcugugaccu

SEQ ID NO: 278676 - RNA, 22 nt, Human
auauauauugcccaggcugguu

SEQ ID NO: 278677 - RNA, 18 nt, Human
augcccuguugacuucag

SEQ ID NO: 278678 - RNA, 22 nt, Human
accaggaaaaacacuguguugg

SEQ ID NO: 278679 - RNA, 22 nt, Human
ucccaggcaggugacaggggga

SEQ ID NO: 278680 - RNA, 22 nt, Human
gguauacugcaugacauugggg

SEQ ID NO: 278681 - RNA, 22 nt, Human
agcugccacugagggugcacag

SEQ ID NO: 278682 - RNA, 22 nt, Human
uuacaagguaaguuguuaaguc

SEQ ID NO: 278683 - RNA, 22 nt, Human
acagaacuggaauuggaacuca

SEQ ID NO: 278684 - RNA, 19 nt, Human
ggcauccacgaaugcagag

SEQ ID NO: 278685 - RNA, 22 nt, Human
gagcauuuuugucugcauuuua

SEQ ID NO: 278686 - RNA, 22 nt, Human
ugcuuugcaggaacccuaagca

SEQ ID NO: 278687 - RNA, 22 nt, Human
uuacagaagagaaagaauucag

SEQ ID NO: 278688 - RNA, 22 nt, Human
uaggaaacaaaguggaugaaau

SEQ ID NO: 278689 - RNA, 22 nt, Human
cugugaauugaauaugacuaug

SEQ ID NO: 278690 - RNA, 22 nt, Human
gggaucuuucugaugcuguggc

SEQ ID NO: 278691 - RNA, 22 nt, Human
ggcagcugagaucaugcuguug

SEQ ID NO: 278692 - RNA, 22 nt, Human
uucauagacccagaacucauua

SEQ ID NO: 278693 - RNA, 22 nt, Human
aaugacaauauuaauuuggagg

SEQ ID NO: 278694 - RNA, 22 nt, Human
uuuccccagguagauagauaau

SEQ ID NO: 278695 - RNA, 21 nt, Human
cgguggcucccgggauggcuc

SEQ ID NO: 278696 - RNA, 22 nt, Human
auacucagcugcuagacagaag

SEQ ID NO: 278697 - RNA, 22 nt, Human
ccucaggauccgcaggugcagu

SEQ ID NO: 278698 - RNA, 22 nt, Human
gucaggucuuggaagauaggcu

SEQ ID NO: 278699 - RNA, 22 nt, Human
ugagaggcuagaucagcucugu

SEQ ID NO: 278700 - RNA, 20 nt, Human
agauuuaccuuugagccuuc

SEQ ID NO: 278701 - RNA, 22 nt, Human
agccagaggaagccuggcccuc

SEQ ID NO: 278702 - RNA, 22 nt, Human
aaaaggcuaauuaaguuuugga

SEQ ID NO: 278703 - RNA, 19 nt, Human
gccaggcuccauagccggc

SEQ ID NO: 278704 - RNA, 22 nt, Human
uacaguauggaaaauguauagu

SEQ ID NO: 278705 - RNA, 22 nt, Human
aaugaguucugguucauuuuau

SEQ ID NO: 278706 - RNA, 22 nt, Human
gcauggcugcucccuggcugca

SEQ ID NO: 278707 - RNA, 22 nt, Human
aggcugaggcuuuccuuggaga

SEQ ID NO: 278708 - RNA, 22 nt, Human
caggaagcuggucagauccugu

SEQ ID NO: 278709 - RNA, 21 nt, Human
auuuccacauaaucauaagac

SEQ ID NO: 278710 - RNA, 22 nt, Human
agcucagggcaaagacucaaau

SEQ ID NO: 278711 - RNA, 22 nt, Human
uccugggguuuagagggaagug

SEQ ID NO: 278712 - RNA, 22 nt, Human
ucccagggcagcuguccagaag

SEQ ID NO: 278713 - RNA, 22 nt, Human
aucauguuccagaaacagugau

SEQ ID NO: 278714 - RNA, 22 nt, Human
cagccacuucgagcuuccugau

SEQ ID NO: 278715 - RNA, 22 nt, Human
aguuuggaagaauuuggucugu

SEQ ID NO: 278716 - RNA, 22 nt, Human
auugcugacaccaaguaguagc

SEQ ID NO: 278717 - RNA, 22 nt, Human
auucuugauauagauaguuaau

SEQ ID NO: 278718 - RNA, 22 nt, Human
uuacacuucuaaaaaaagcagg

SEQ ID NO: 278719 - RNA, 22 nt, Human
agcuccuugaauuaaugcugcu

SEQ ID NO: 278720 - RNA, 22 nt, Human
aagcacuaggucacacaaguua

SEQ ID NO: 278721 - RNA, 22 nt, Human
auaaucuuguauuuccuaaagu

SEQ ID NO: 278722 - RNA, 22 nt, Human
auagcacaauauuaccuuuaug

SEQ ID NO: 278723 - RNA, 22 nt, Human
gaagucuugaaacacaaacuag

SEQ ID NO: 278724 - RNA, 22 nt, Human
ucugggcucugcgaagcccuuc

SEQ ID NO: 278725 - RNA, 22 nt, Human
gcaccaggagaaucacguuaga

SEQ ID NO: 278726 - RNA, 22 nt, Human
aagcuguuguucauccugaauu

SEQ ID NO: 278727 - RNA, 22 nt, Human
gcaguccuagggugcucugcag

SEQ ID NO: 278728 - RNA, 22 nt, Human
agggaccaaucaccgacaggcu

SEQ ID NO: 278729 - RNA, 22 nt, Human
gggcuggcgggaaaggcaauuc

SEQ ID NO: 278730 - RNA, 22 nt, Human
cagacacaccaggcccauucug

SEQ ID NO: 278731 - RNA, 22 nt, Human
aacaaauggggccuuguaugaa

SEQ ID NO: 278732 - RNA, 22 nt, Human
aauaagcaagccugugugcaag

SEQ ID NO: 278733 - RNA, 22 nt, Human
uacaggaggauuaucaaaggau

SEQ ID NO: 278734 - RNA, 22 nt, Human
ugccugcuuucugggcugccau

SEQ ID NO: 278735 - RNA, 22 nt, Human
ugacagggaaagguccucuuuu

SEQ ID NO: 278736 - RNA, 22 nt, Human
guguggccguguauccauggcu

SEQ ID NO: 278737 - RNA, 22 nt, Human
uccugggcaaagaggggcagug

SEQ ID NO: 278738 - RNA, 22 nt, Human
cagacagaccugcaagggcaca

SEQ ID NO: 278739 - RNA, 22 nt, Human
uugcccugaagaacgucccaga

SEQ ID NO: 278740 - RNA, 22 nt, Human
uuuuuccuuagggguuacucac

SEQ ID NO: 278741 - RNA, 22 nt, Human
ucacaggcucuagggauuaaga

SEQ ID NO: 278742 - RNA, 22 nt, Human
agaagacagagucuacauucua

SEQ ID NO: 278743 - RNA, 22 nt, Human
guccucuguguaggcugcagac

SEQ ID NO: 278744 - RNA, 22 nt, Human
caguuaacugagcucugugaga

SEQ ID NO: 278745 - RNA, 22 nt, Human
uccuggccuugcuccugaugcc

SEQ ID NO: 278746 - RNA, 21 nt, Human
gcagcaugagaaagccccaaa

SEQ ID NO: 278747 - RNA, 22 nt, Human
acuccaggcaucugcuucugcu

SEQ ID NO: 278748 - RNA, 22 nt, Human
uugaggcagggcaugguggccc

SEQ ID NO: 278749 - RNA, 22 nt, Human
uggaaugagcuggcuaauaacc

SEQ ID NO: 278750 - RNA, 22 nt, Human
gagacaguguccauccaggggc

SEQ ID NO: 278751 - RNA, 22 nt, Human
ugcaaagaagccuuugccuucu

SEQ ID NO: 278752 - RNA, 22 nt, Human
uucguuuaguccacaaaugcau

SEQ ID NO: 278753 - RNA, 22 nt, Human
aagaaucuuaauccagaaaccu

SEQ ID NO: 278754 - RNA, 21 nt, Human
cugggcuuucucucaaagaca

SEQ ID NO: 278755 - RNA, 22 nt, Human
accucagagggauguuacaggc

SEQ ID NO: 278756 - RNA, 22 nt, Human
cuuuacaaagcaauuuugucuc

SEQ ID NO: 278757 - RNA, 22 nt, Human
auuucuuccucugucaguaacu

SEQ ID NO: 278758 - RNA, 22 nt, Human
cccaggagagggaaccaaaugu

SEQ ID NO: 278759 - RNA, 22 nt, Human
uccaggaggcagggcugugccc

SEQ ID NO: 278760 - RNA, 22 nt, Human
gcugaaauguuuaauuugggag

SEQ ID NO: 278761 - RNA, 22 nt, Human
ugucagcauuuaaggaguaagg

SEQ ID NO: 278762 - RNA, 22 nt, Human
uuagaaucagaagagagguauu

SEQ ID NO: 278763 - RNA, 17 nt, Human
gcagccucuugguagug

SEQ ID NO: 278764 - RNA, 22 nt, Human
aggaccauccuaagguaggcaa

SEQ ID NO: 278765 - RNA, 22 nt, Human
uauuuguugaguuguuaugucu

SEQ ID NO: 278766 - RNA, 22 nt, Human
agucagagagcucucagcauag

SEQ ID NO: 278767 - RNA, 18 nt, Human
aaguuccacaagagaucu

SEQ ID NO: 278768 - RNA, 22 nt, Human
uaggcaggugugcacugcccac

SEQ ID NO: 278769 - RNA, 22 nt, Human
ucuagaaacagguuucuagaaa

SEQ ID NO: 278770 - RNA, 22 nt, Human
uuuaauauucugcauucuccuu

SEQ ID NO: 278771 - RNA, 22 nt, Human
uauuuugcaaaccugaguuuga

SEQ ID NO: 278772 - RNA, 22 nt, Human
ucccagcacagggcagauguga

SEQ ID NO: 278773 - RNA, 22 nt, Human
uggagcagcugaacagaguuga

SEQ ID NO: 278774 - RNA, 22 nt, Human
ccucagagguuuucauucugua

SEQ ID NO: 278775 - RNA, 22 nt, Human
cagccccucacagagcuguccu

SEQ ID NO: 278776 - RNA, 22 nt, Human
ucugcaccucugaaauugguca

SEQ ID NO: 278777 - RNA, 20 nt, Human
ucacacaugguaagcuauga

SEQ ID NO: 278778 - RNA, 22 nt, Human
ucacagugugaaggucagucac

SEQ ID NO: 278779 - RNA, 19 nt, Human
agaggccucagcagcuggc

SEQ ID NO: 278780 - RNA, 22 nt, Human
auuugcauaucugauagacuaa

SEQ ID NO: 278781 - RNA, 22 nt, Human
uaagaacauaaauucauacggg

SEQ ID NO: 278782 - RNA, 22 nt, Human
ggguaagcugcuuuaucucucu

SEQ ID NO: 278783 - RNA, 22 nt, Human
acagggaaggauuuagugggaa

SEQ ID NO: 278784 - RNA, 22 nt, Human
cacuaaaacuacauuggaaaca

SEQ ID NO: 278785 - RNA, 22 nt, Human
ucuggcucucaacaaauauuua

SEQ ID NO: 278786 - RNA, 22 nt, Human
ggcucagguugggucacaugac

SEQ ID NO: 278787 - RNA, 22 nt, Human
gguggcugcaauggcuaacuuc

SEQ ID NO: 278788 - RNA, 20 nt, Human
agucacaugcauacacaagu

SEQ ID NO: 278789 - RNA, 20 nt, Human
uuuaucugugggaguggaga

SEQ ID NO: 278790 - RNA, 22 nt, Human
uuuacuugauauggagcugagg

SEQ ID NO: 278791 - RNA, 22 nt, Human
uuuggaauuaugcuuaaaguuu

SEQ ID NO: 278792 - RNA, 22 nt, Human
gccugcagccagggaguucucu

SEQ ID NO: 278793 - RNA, 22 nt, Human
uaacagagguagaauucaaggu

SEQ ID NO: 278794 - RNA, 22 nt, Human
uaggccagauuacuagaguagg

SEQ ID NO: 278795 - RNA, 22 nt, Human
uccuagaauaaucuuugacugc

SEQ ID NO: 278796 - RNA, 22 nt, Human
cuagggaacaagaugcccaggg

SEQ ID NO: 278797 - RNA, 22 nt, Human
uuuucccaucuacaaagcaggg

SEQ ID NO: 278798 - RNA, 22 nt, Human
aaaguuuccugcuaagugcuau

SEQ ID NO: 278799 - RNA, 20 nt, Human
ucagauuuuucuaacuuuga

SEQ ID NO: 278800 - RNA, 22 nt, Human
ugauuuuuagcuauucugaaga

SEQ ID NO: 278801 - RNA, 19 nt, Human
uacaagcuuuuuuggcagg

SEQ ID NO: 278802 - RNA, 22 nt, Human
aggcuggagacccgccaagaaa

SEQ ID NO: 278803 - RNA, 22 nt, Human
gagggagccgccacagacuggg

SEQ ID NO: 278804 - RNA, 22 nt, Human
cggcaggugugcucacucugcc

SEQ ID NO: 278805 - RNA, 22 nt, Human
uuguuaaaaugcauauucuggu

SEQ ID NO: 278806 - RNA, 22 nt, Human
aguuuucuguucuacaauuuga

SEQ ID NO: 278807 - RNA, 22 nt, Human
uuccaugccucuauuuagaauu

SEQ ID NO: 278808 - RNA, 22 nt, Human
gcugcuuuacugaagagauaug

SEQ ID NO: 278809 - RNA, 22 nt, Human
gcacacacuguuuuccucacau

SEQ ID NO: 278810 - RNA, 22 nt, Human
aggcaguguguagcuggaagag

SEQ ID NO: 278811 - RNA, 22 nt, Human
agaccacuaaaacuuucucuau

SEQ ID NO: 278812 - RNA, 23 nt, Human
cuucuggcucuauaucagaauuc

SEQ ID NO: 278813 - RNA, 22 nt, Human
gcagcagguccgcaucaucauc

SEQ ID NO: 278814 - RNA, 22 nt, Human
aaaugcuacauacacaucaggg

SEQ ID NO: 278815 - RNA, 22 nt, Human
ggaauguuugcucccuucaggg

SEQ ID NO: 278816 - RNA, 22 nt, Human
acgauguggccugaaucaggca

SEQ ID NO: 278817 - RNA, 22 nt, Human
cugugauggucaggcccuaucu

SEQ ID NO: 278818 - RNA, 22 nt, Human
cugggcucugcggugucgcucu

SEQ ID NO: 278819 - RNA, 22 nt, Human
ccuccuguugucaccaggcgug

SEQ ID NO: 278820 - RNA, 19 nt, Human
acucaggcaaugagaaaca

SEQ ID NO: 278821 - RNA, 22 nt, Human
ggucacaggggagaagagugau

SEQ ID NO: 278822 - RNA, 22 nt, Human
ucaugcaucugggcuggcuggu

SEQ ID NO: 278823 - RNA, 22 nt, Human
gcagaugccagaucaugcaggg

SEQ ID NO: 278824 - RNA, 22 nt, Human
cauuucuacagcuucuucagaa

SEQ ID NO: 278825 - RNA, 22 nt, Human
ucuuuggauuaaaauauuugua

SEQ ID NO: 278826 - RNA, 22 nt, Human
ccaggcaccauguucuuaggac

SEQ ID NO: 278827 - RNA, 22 nt, Human
aaagucaguuggccagaucacu

SEQ ID NO: 278828 - RNA, 22 nt, Human
caaauacucuggauguguuugu

SEQ ID NO: 278829 - RNA, 22 nt, Human
cugggaaagugugcuccccucc

SEQ ID NO: 278830 - RNA, 22 nt, Human
ggaugucuaggguuuaugugcc

SEQ ID NO: 278831 - RNA, 22 nt, Human
cagcagccuacaaugcacagaa

SEQ ID NO: 278832 - RNA, 22 nt, Human
aagucacuugauuguugacaga

SEQ ID NO: 278833 - RNA, 22 nt, Human
gcccuagcgccagcucagcacc

SEQ ID NO: 278834 - RNA, 22 nt, Human
caguacauuucauaugauucua

SEQ ID NO: 278835 - RNA, 22 nt, Human
caggugcugcagggcuggcguc

SEQ ID NO: 278836 - RNA, 22 nt, Human
agauauuuguaucuugcuauug

SEQ ID NO: 278837 - RNA, 22 nt, Human
ccagacaguuccuugagguuca

SEQ ID NO: 278838 - RNA, 22 nt, Human
ugggcuuccuggagccugugcu

SEQ ID NO: 278839 - RNA, 22 nt, Human
caggagcaugcugaugccagaa

SEQ ID NO: 278840 - RNA, 19 nt, Human
uagaaugcccacuuaaaaa

SEQ ID NO: 278841 - RNA, 22 nt, Human
aacuuacaaggaugauagcugc

SEQ ID NO: 278842 - RNA, 20 nt, Human
cccugcagccaugggagugg

SEQ ID NO: 278843 - RNA, 22 nt, Human
gcaggcuuugacuuggggcaac

SEQ ID NO: 278844 - RNA, 22 nt, Human
auugcaaauaacuguacugaau

SEQ ID NO: 278845 - RNA, 22 nt, Human
aaaaguauuggccaccauuucu

SEQ ID NO: 278846 - RNA, 22 nt, Human
ccagugugauuguugcaagaau

SEQ ID NO: 278847 - RNA, 22 nt, Human
ucacuccucauugcugcccauu

SEQ ID NO: 278848 - RNA, 20 nt, Human
augagucuacacacuggcuu

SEQ ID NO: 278849 - RNA, 22 nt, Human
cauuuucagcacccaucugaaa

SEQ ID NO: 278850 - RNA, 22 nt, Human
acagagcuuaggaugacuccca

SEQ ID NO: 278851 - RNA, 22 nt, Human
gauacaagacuaauaggaaaca

SEQ ID NO: 278852 - RNA, 22 nt, Human
gcugacaguuguaccugccccu

SEQ ID NO: 278853 - RNA, 22 nt, Human
caaggccaguuucuccuaguca

SEQ ID NO: 278854 - RNA, 22 nt, Human
gccauauacccacugucuccau

SEQ ID NO: 278855 - RNA, 22 nt, Human
gcagugacagacaacuguuuga

SEQ ID NO: 278856 - RNA, 22 nt, Human
guggucagaaaucucaguggca

SEQ ID NO: 278857 - RNA, 22 nt, Human
uuuguacagugauguuguaugc

SEQ ID NO: 278858 - RNA, 22 nt, Human
ggagcccuucuauuccauggag

SEQ ID NO: 278859 - RNA, 22 nt, Human
gaggugucacuauuuugcuuau

SEQ ID NO: 278860 - RNA, 22 nt, Human
cucugaggagaaagagcuuggu

SEQ ID NO: 278861 - RNA, 22 nt, Human
ccaggagagcucucguucagug

SEQ ID NO: 278862 - RNA, 22 nt, Human
cagugucaccaggcgagucucc

SEQ ID NO: 278863 - RNA, 20 nt, Human
cuuuagaagaacccaagcau

SEQ ID NO: 278864 - RNA, 22 nt, Human
augaggauguuaguggacugga

SEQ ID NO: 278865 - RNA, 22 nt, Human
cuggaucugaacaucgguauca

SEQ ID NO: 278866 - RNA, 19 nt, Human
agcuccuguucagcagcuc

SEQ ID NO: 278867 - RNA, 22 nt, Human
aacacagaagugccaagagcca

SEQ ID NO: 278868 - RNA, 22 nt, Human
cacacagaugguaagggaggga

SEQ ID NO: 278869 - RNA, 22 nt, Human
gaugaggucauguuuuacauau

SEQ ID NO: 278870 - RNA, 22 nt, Human
aauucuuguuguuaguauauuu

SEQ ID NO: 278871 - RNA, 22 nt, Human
agcuuuaugcuuccuacaagcu

SEQ ID NO: 278872 - RNA, 22 nt, Human
ccacgacgagucaucagggcga

SEQ ID NO: 278873 - RNA, 22 nt, Human
cagcuugggaguuugguuuuau

SEQ ID NO: 278874 - RNA, 22 nt, Human
ucuauuuucuugccaaaacugc

SEQ ID NO: 278875 - RNA, 22 nt, Human
cagagagaaucuuggcagcuga

SEQ ID NO: 278876 - RNA, 22 nt, Human
acccugggcacaccauuucccc

SEQ ID NO: 278877 - RNA, 21 nt, Human
ggcacugcugggccaucugcu

SEQ ID NO: 278878 - RNA, 20 nt, Human
ucauacacaugagcaugcag

SEQ ID NO: 278879 - RNA, 22 nt, Human
ugcaaaaauugcuggaaucuuu

SEQ ID NO: 278880 - RNA, 22 nt, Human
uuuguguuaaauguuaaauuca

SEQ ID NO: 278881 - RNA, 22 nt, Human
gaauuugggguguguuauuuca

SEQ ID NO: 278882 - RNA, 22 nt, Human
ugaggacaugagugggacagag

SEQ ID NO: 278883 - RNA, 22 nt, Human
uuauuuacaacucuucucuucc

SEQ ID NO: 278884 - RNA, 22 nt, Human
uucuguggcugggagccuggcu

SEQ ID NO: 278885 - RNA, 23 nt, Human
ucuguucaaggcuuucuccuuga

SEQ ID NO: 278886 - RNA, 22 nt, Human
agggaggaccaaugugugguua

SEQ ID NO: 278887 - RNA, 22 nt, Human
ccaggcagagggauccccaucc

SEQ ID NO: 278888 - RNA, 22 nt, Human
gaauauauuauucagcuuuuca

SEQ ID NO: 278889 - RNA, 22 nt, Human
ggcagagacaccgaaugacucu

SEQ ID NO: 278890 - RNA, 17 nt, Human
uucagaagcauuuuggc

SEQ ID NO: 278891 - RNA, 22 nt, Human
ugccagaacagcucaucuggcc

SEQ ID NO: 278892 - RNA, 22 nt, Human
ugauuuucaugggugaucuuug

SEQ ID NO: 278893 - RNA, 22 nt, Human
gcuggccccgagugcuacgcuc

SEQ ID NO: 278894 - RNA, 21 nt, Human
cacauuugaaccucacagcaa

SEQ ID NO: 278895 - RNA, 22 nt, Human
acuggggaauggaacugggaau

SEQ ID NO: 278896 - RNA, 22 nt, Human
cacagcugcccccucucuaacu

SEQ ID NO: 278897 - RNA, 22 nt, Human
aagcauggagcaauagaaugac

SEQ ID NO: 278898 - RNA, 22 nt, Human
uuccuuucacguuuuaaugcac

SEQ ID NO: 278899 - RNA, 22 nt, Human
gauuaguugauuaagagucaga

SEQ ID NO: 278900 - RNA, 20 nt, Human
ggccugagcauggcuggcag

SEQ ID NO: 278901 - RNA, 22 nt, Human
agcuaggagauuuugugaggcu

SEQ ID NO: 278902 - RNA, 22 nt, Human
ggcugagaguuuccucuggggc

SEQ ID NO: 278903 - RNA, 22 nt, Human
caggugcugcguggcggagcug

SEQ ID NO: 278904 - RNA, 22 nt, Human
ucugccuucuuuuagucaucuu

SEQ ID NO: 278905 - RNA, 19 nt, Human
uggcugggcgugccuccgu

SEQ ID NO: 278906 - RNA, 22 nt, Human
aacaucucuguauuuuauagac

SEQ ID NO: 278907 - RNA, 22 nt, Human
ggcuuuauaggguagaggauca

SEQ ID NO: 278908 - RNA, 22 nt, Human
uguuuagaugcaaagucucaca

SEQ ID NO: 278909 - RNA, 22 nt, Human
cauacuuugggauaagagugga

SEQ ID NO: 278910 - RNA, 17 nt, Human
cuacaguguguuuccug

SEQ ID NO: 278911 - RNA, 22 nt, Human
ugcaagagcccaaacuauauac

SEQ ID NO: 278912 - RNA, 21 nt, Human
uccaggccucaggaagggaug

SEQ ID NO: 278913 - RNA, 21 nt, Human
ugcaggcugugcgcuccugcc

SEQ ID NO: 278914 - RNA, 22 nt, Human
ugggaucugcaguuuaacaaaa

SEQ ID NO: 278915 - RNA, 22 nt, Human
gcuguacauucuguggguuugg

SEQ ID NO: 278916 - RNA, 17 nt, Human
uacauguguaucugauu

SEQ ID NO: 278917 - RNA, 22 nt, Human
aaccuguucccugguccuugac

SEQ ID NO: 278918 - RNA, 22 nt, Human
ucauucacuuugaaauaaacga

SEQ ID NO: 278919 - RNA, 22 nt, Human
aggcuggcucggcuuuucuguc

SEQ ID NO: 278920 - RNA, 22 nt, Human
ggcugcaggaacgacggagggg

SEQ ID NO: 278921 - RNA, 22 nt, Human
uuauacacugcagaaccagcau

SEQ ID NO: 278922 - RNA, 22 nt, Human
agugauuucaucauuuuaucaa

SEQ ID NO: 278923 - RNA, 19 nt, Human
uuagaagccauagguacag

SEQ ID NO: 278924 - RNA, 22 nt, Human
cuuaacagcaagaucuguguca

SEQ ID NO: 278925 - RNA, 22 nt, Human
agagggaaugugauugcaccau

SEQ ID NO: 278926 - RNA, 22 nt, Human
uccaggaccucccaggcuagag

SEQ ID NO: 278927 - RNA, 21 nt, Human
gugguucuagagaaacagaau

SEQ ID NO: 278928 - RNA, 22 nt, Human
uacagcaaagaaacccucaguc

SEQ ID NO: 278929 - RNA, 22 nt, Human
cugguguccgcaacgggcagcg

SEQ ID NO: 278930 - RNA, 22 nt, Human
uuucucaaccucaacacuauuu

SEQ ID NO: 278931 - RNA, 22 nt, Human
ugcugaaagucccaaaucucau

SEQ ID NO: 278932 - RNA, 22 nt, Human
gcaguaggaguuuccagggugg

SEQ ID NO: 278933 - RNA, 22 nt, Human
ugacaagauagauugaguuuua

SEQ ID NO: 278934 - RNA, 22 nt, Human
uggaggaggaugcauuuguugu

SEQ ID NO: 278935 - RNA, 22 nt, Human
cuacuguuguguuuuaaaggua

SEQ ID NO: 278936 - RNA, 22 nt, Human
acauucauuccaggucagucag

SEQ ID NO: 278937 - RNA, 22 nt, Human
gccugagaucaggagaaagcca

SEQ ID NO: 278938 - RNA, 22 nt, Human
cagcugaguguuggcauguuca

SEQ ID NO: 278939 - RNA, 22 nt, Human
cuuacagcauuguucagaggcu

SEQ ID NO: 278940 - RNA, 22 nt, Human
ugguagcaacaucucaguggcu

SEQ ID NO: 278941 - RNA, 22 nt, Human
gauggggaugagaagugagcag

SEQ ID NO: 278942 - RNA, 22 nt, Human
cugaggccuggugaggugguga

SEQ ID NO: 278943 - RNA, 22 nt, Human
gaaguucaggugggaauugagc

SEQ ID NO: 278944 - RNA, 22 nt, Human
auuucacaaagaacagaugcag

SEQ ID NO: 278945 - RNA, 22 nt, Human
uuugaacagggaauguuccaca

SEQ ID NO: 278946 - RNA, 22 nt, Human
ucugaaauguucucuuguuuug

SEQ ID NO: 278947 - RNA, 22 nt, Human
agugacugguuuugacaggaau

SEQ ID NO: 278948 - RNA, 22 nt, Human
acauguaacauauauguagcau

SEQ ID NO: 278949 - RNA, 22 nt, Human
ucugaggaaagagagugggaug

SEQ ID NO: 278950 - RNA, 22 nt, Human
ggcucucagggaaaggccuccc

SEQ ID NO: 278951 - RNA, 22 nt, Human
cugggagcggcugucacugguu

SEQ ID NO: 278952 - RNA, 22 nt, Human
ugcaauaaagugcuauaaaucc

SEQ ID NO: 278953 - RNA, 22 nt, Human
uugucgggcuuacgcagggcca

SEQ ID NO: 278954 - RNA, 22 nt, Human
agcuggucuuaaauguguccag

SEQ ID NO: 278955 - RNA, 22 nt, Human
acucuuauuuugaaguaauaau

SEQ ID NO: 278956 - RNA, 22 nt, Human
ugguuuuugguuuaacacuaug

SEQ ID NO: 278957 - RNA, 22 nt, Human
ugccugugaaaacccugggguu

SEQ ID NO: 278958 - RNA, 19 nt, Human
agcuggggcgguguguguu

SEQ ID NO: 278959 - RNA, 22 nt, Human
cccuggagcuagucugagcaga

SEQ ID NO: 278960 - RNA, 22 nt, Human
ugcaugcaaagugucugcuuug

SEQ ID NO: 278961 - RNA, 22 nt, Human
ucaggggcagccggggaagcca

SEQ ID NO: 278962 - RNA, 22 nt, Human
ccugccaggagcuggugcugca

SEQ ID NO: 278963 - RNA, 18 nt, Human
gccugcucugcucucccc

SEQ ID NO: 278964 - RNA, 22 nt, Human
ccacaucuaagccuucaugaua

SEQ ID NO: 278965 - RNA, 22 nt, Human
ccaggaaggaucguuugggagu

SEQ ID NO: 278966 - RNA, 22 nt, Human
ucucaggcauucccacauagaa

SEQ ID NO: 278967 - RNA, 22 nt, Human
acuccugguuuguguccuggcu

SEQ ID NO: 278968 - RNA, 22 nt, Human
agauugggguccagacuccuga

SEQ ID NO: 278969 - RNA, 22 nt, Human
ugagcagagacuucaagggcag

SEQ ID NO: 278970 - RNA, 18 nt, Human
gugacguuuuggaugauu

SEQ ID NO: 278971 - RNA, 22 nt, Human
ucagguguaucauggaguugaa

SEQ ID NO: 278972 - RNA, 22 nt, Human
auccuuuauaagacuuguauuc

SEQ ID NO: 278973 - RNA, 21 nt, Human
uuccagaaaucucuuucuuca

SEQ ID NO: 278974 - RNA, 22 nt, Human
gacagggacacagccagugagg

SEQ ID NO: 278975 - RNA, 22 nt, Human
auugcuaggaacagguugcacc

SEQ ID NO: 278976 - RNA, 22 nt, Human
gcugaaauucagauuccuaggc

SEQ ID NO: 278977 - RNA, 22 nt, Human
ggguccagguuuagucauuugu

SEQ ID NO: 278978 - RNA, 22 nt, Human
aggcaagauuaggaccagaaga

SEQ ID NO: 278979 - RNA, 22 nt, Human
caugcuaaccagagacauaaag

SEQ ID NO: 278980 - RNA, 22 nt, Human
gagcccagcuguccuuggcaaa

SEQ ID NO: 278981 - RNA, 22 nt, Human
cuacagugucgugugguuucug

SEQ ID NO: 278982 - RNA, 20 nt, Human
ugcuggggacauacagggug

SEQ ID NO: 278983 - RNA, 20 nt, Human
cucagugcuuucauugccuc

SEQ ID NO: 278984 - RNA, 22 nt, Human
agguucugguaagcuguugcuu

SEQ ID NO: 278985 - RNA, 22 nt, Human
uaaagcuguuagaguaguaaga

SEQ ID NO: 278986 - RNA, 22 nt, Human
uggaaagaggaagugcccagca

SEQ ID NO: 278987 - RNA, 22 nt, Human
uuugaaguguaugaaaauacag

SEQ ID NO: 278988 - RNA, 22 nt, Human
cugugagacugauagggaagag

SEQ ID NO: 278989 - RNA, 22 nt, Human
uggagaguggauaugggagcaa

SEQ ID NO: 278990 - RNA, 22 nt, Human
ucaaaggaauuugauuuugaug

SEQ ID NO: 278991 - RNA, 22 nt, Human
cuuccccaggaccucugcuaaa

SEQ ID NO: 278992 - RNA, 22 nt, Human
uuuggccucaugaauuucuugc

SEQ ID NO: 278993 - RNA, 22 nt, Human
ucucauuggaaaagaguuuaau

SEQ ID NO: 278994 - RNA, 22 nt, Human
uggcagagucaucacaucugga

SEQ ID NO: 278995 - RNA, 22 nt, Human
uggaaacuagccuuuuagguug

SEQ ID NO: 278996 - RNA, 22 nt, Human
ccuggaaaaugccacuuucaca

SEQ ID NO: 278997 - RNA, 19 nt, Human
gcaggccucuugggaauua

SEQ ID NO: 278998 - RNA, 22 nt, Human
caaguauuuuaaggacuagugg

SEQ ID NO: 278999 - RNA, 22 nt, Human
ugaucaaagccaaaguugagau

SEQ ID NO: 279000 - RNA, 22 nt, Human
ugugggaaaugggaguggaaga

SEQ ID NO: 279001 - RNA, 22 nt, Human
gccaggaagcaguuagaugggu

SEQ ID NO: 279002 - RNA, 22 nt, Human
cccaggaguuugaguucagcau

SEQ ID NO: 279003 - RNA, 22 nt, Human
ccugugcaugccaggguacacc

SEQ ID NO: 279004 - RNA, 22 nt, Human
guguguucagcaagagguaagg

SEQ ID NO: 279005 - RNA, 22 nt, Human
agugacuacugauuuuuacuuu

SEQ ID NO: 279006 - RNA, 22 nt, Human
agaaaucaugucuuauuucuau

SEQ ID NO: 279007 - RNA, 22 nt, Human
ggcagcucugcuccuuggcucc

SEQ ID NO: 279008 - RNA, 22 nt, Human
aauacauauggaauuccauguu

SEQ ID NO: 279009 - RNA, 22 nt, Human
ccaggcauggggagagccagau

SEQ ID NO: 279010 - RNA, 22 nt, Human
agauauuaggaggauucauaau

SEQ ID NO: 279011 - RNA, 22 nt, Human
aagacaccauuugacaguggca

SEQ ID NO: 279012 - RNA, 22 nt, Human
cagagcacacaugcauagagug

SEQ ID NO: 279013 - RNA, 17 nt, Human
agcaaaaguaucaaagc

SEQ ID NO: 279014 - RNA, 22 nt, Human
ucaguguccggagccugagugc

SEQ ID NO: 279015 - RNA, 22 nt, Human
agaaaucauuuuaggcuugaug

SEQ ID NO: 279016 - RNA, 22 nt, Human
agaaggccaauagggugcacug

SEQ ID NO: 279017 - RNA, 22 nt, Human
agugcaacagaagcaggcuggc

SEQ ID NO: 279018 - RNA, 22 nt, Human
ggcaccagggacaauccucuuc

SEQ ID NO: 279019 - RNA, 22 nt, Human
uucugggcuugaaaguuuaaua

SEQ ID NO: 279020 - RNA, 22 nt, Human
aggcuccacggucacuggcucu

SEQ ID NO: 279021 - RNA, 22 nt, Human
uacaaguuccauuuugaaagug

SEQ ID NO: 279022 - RNA, 23 nt, Human
ugcagagggacugaagccagcuu

SEQ ID NO: 279023 - RNA, 22 nt, Human
acugcacugauuuaucauccca

SEQ ID NO: 279024 - RNA, 22 nt, Human
cccaggucccggggccagcugc

SEQ ID NO: 279025 - RNA, 20 nt, Human
uuucugugagaaacacuguu

SEQ ID NO: 279026 - RNA, 22 nt, Human
aagagcaucuauuucacagugg

SEQ ID NO: 279027 - RNA, 22 nt, Human
cggcucagacuucccaagaaca

SEQ ID NO: 279028 - RNA, 22 nt, Human
gcaggagaacaaagcaagcugc

SEQ ID NO: 279029 - RNA, 22 nt, Human
uuaggaaaaucaugagagauga

SEQ ID NO: 279030 - RNA, 23 nt, Human
ucugcccucugccuguuuuugua

SEQ ID NO: 279031 - RNA, 22 nt, Human
ucuaaaucccaacaugauauca

SEQ ID NO: 279032 - RNA, 22 nt, Human
uaucuuuugaguucucaagaug

SEQ ID NO: 279033 - RNA, 22 nt, Human
ccucagaagcucaaggacauug

SEQ ID NO: 279034 - RNA, 22 nt, Human
cacacgagcccuggagccagca

SEQ ID NO: 279035 - RNA, 22 nt, Human
uggcuucugggguggccugcau

SEQ ID NO: 279036 - RNA, 22 nt, Human
agcuuuauucaugauuucaggg

SEQ ID NO: 279037 - RNA, 22 nt, Human
cugaggagcaaccccgugcccu

SEQ ID NO: 279038 - RNA, 22 nt, Human
ugucaacacaccuaucucaauu

SEQ ID NO: 279039 - RNA, 22 nt, Human
cuucuuuacuuucuagaaauaa

SEQ ID NO: 279040 - RNA, 22 nt, Human
uguguucuccuacagauaagga

SEQ ID NO: 279041 - RNA, 22 nt, Human
aggugcaggagcugugcaggga

SEQ ID NO: 279042 - RNA, 22 nt, Human
cacaaggacuggauggaguggg

SEQ ID NO: 279043 - RNA, 22 nt, Human
uuagauacauucucauuuguuu

SEQ ID NO: 279044 - RNA, 22 nt, Human
uggcugagggggcaguucagga

SEQ ID NO: 279045 - RNA, 22 nt, Human
ucaauuucuugguuugauaaua

SEQ ID NO: 279046 - RNA, 22 nt, Human
gaauuguauugauuuuucagag

SEQ ID NO: 279047 - RNA, 21 nt, Human
ccucagagacagauacgggug

SEQ ID NO: 279048 - RNA, 22 nt, Human
gcccaugccccuccuucuggca

SEQ ID NO: 279049 - RNA, 22 nt, Human
aaugucaaagugcuuugcaaac

SEQ ID NO: 279050 - RNA, 22 nt, Human
cacccagcuuuugcauccuccg

SEQ ID NO: 279051 - RNA, 21 nt, Human
gacaaugcagucuuuuuugga

SEQ ID NO: 279052 - RNA, 22 nt, Human
aaauuauuaugccccucuauaa

SEQ ID NO: 279053 - RNA, 22 nt, Human
uagcagcauuaauuccauuugc

SEQ ID NO: 279054 - RNA, 22 nt, Human
ucccagcuacucuagaggcuga

SEQ ID NO: 279055 - RNA, 22 nt, Human
uagaacuuccaauucagggcug

SEQ ID NO: 279056 - RNA, 22 nt, Human
caugccauuaacauuagcuagc

SEQ ID NO: 279057 - RNA, 22 nt, Human
auuucacaucuaucucagauuu

SEQ ID NO: 279058 - RNA, 22 nt, Human
ggcuggcuugccaagcucaggg

SEQ ID NO: 279059 - RNA, 22 nt, Human
uuaaaaccuagagaucagacag

SEQ ID NO: 279060 - RNA, 22 nt, Human
agcugguuuaggaaaagguagg

SEQ ID NO: 279061 - RNA, 22 nt, Human
ccucagaauaguccucagauca

SEQ ID NO: 279062 - RNA, 22 nt, Human
cagauucacuaauagcuggccu

SEQ ID NO: 279063 - RNA, 22 nt, Human
uagcagaggaaaagagaacauu

SEQ ID NO: 279064 - RNA, 22 nt, Human
uuuauugcauacacaaauguca

SEQ ID NO: 279065 - RNA, 22 nt, Human
acagugcagugugaugaguauu

SEQ ID NO: 279066 - RNA, 22 nt, Human
guacaacaggauugauguacca

SEQ ID NO: 279067 - RNA, 22 nt, Human
agaaaucccaaggcaucaacca

SEQ ID NO: 279068 - RNA, 22 nt, Human
caaggcuuauuuuccuccuucc

SEQ ID NO: 279069 - RNA, 21 nt, Human
ugcaauauauauuugccugaa

SEQ ID NO: 279070 - RNA, 14 nt, Human
aggaauguccuagg

SEQ ID NO: 279071 - RNA, 22 nt, Human
gugagacacgugugugaccugg

SEQ ID NO: 279072 - RNA, 22 nt, Human
auggcugcaguccgugcccugg

SEQ ID NO: 279073 - RNA, 22 nt, Human
cuggacaggcuggggacugcaa

SEQ ID NO: 279074 - RNA, 22 nt, Human
ugaccacacgucuggaauugug

SEQ ID NO: 279075 - RNA, 22 nt, Human
ccuuuuggccaggucagugcag

SEQ ID NO: 279076 - RNA, 22 nt, Human
agacugggguucuggcaaggag

SEQ ID NO: 279077 - RNA, 22 nt, Human
ugaacccaggagguugcaguga

SEQ ID NO: 279078 - RNA, 22 nt, Human
gcuggcuucccuaccugcaccu

SEQ ID NO: 279079 - RNA, 22 nt, Human
aagucaggacuuaugcuaccug

SEQ ID NO: 279080 - RNA, 22 nt, Human
ccagagguccugcucacuggug

SEQ ID NO: 279081 - RNA, 22 nt, Human
uggcucaguuccaucaucugga

SEQ ID NO: 279082 - RNA, 22 nt, Human
uuuguuaaggaguauugcuucu

SEQ ID NO: 279083 - RNA, 22 nt, Human
cucuucuuuccaucccuagcca

SEQ ID NO: 279084 - RNA, 22 nt, Human
uuugcuuccuaguuggguaaua

SEQ ID NO: 279085 - RNA, 22 nt, Human
ucucugaagagucagacauaac

SEQ ID NO: 279086 - RNA, 22 nt, Human
uccuucuuucccccuagucauu

SEQ ID NO: 279087 - RNA, 22 nt, Human
ucugagguggacgauggagccu

SEQ ID NO: 279088 - RNA, 22 nt, Human
agcuuuauagaaaggaucagug

SEQ ID NO: 279089 - RNA, 22 nt, Human
gcuuggcuggaaauagguugag

SEQ ID NO: 279090 - RNA, 22 nt, Human
ucucuucauagugacacccauc

SEQ ID NO: 279091 - RNA, 22 nt, Human
ggcucaccauuuucacucucug

SEQ ID NO: 279092 - RNA, 22 nt, Human
uuuaaauuuagaagaaacacug

SEQ ID NO: 279093 - RNA, 22 nt, Human
ugccuggcuaauuuuuguaucc

SEQ ID NO: 279094 - RNA, 22 nt, Human
gagucaggaguccugugugaga

SEQ ID NO: 279095 - RNA, 22 nt, Human
gcugugugcugggcauggcacu

SEQ ID NO: 279096 - RNA, 22 nt, Human
uuucucugccaguuauuuuccu

SEQ ID NO: 279097 - RNA, 22 nt, Human
caauucaauggcaaaguauugu

SEQ ID NO: 279098 - RNA, 22 nt, Human
uucauacaguggcugcacucca

SEQ ID NO: 279099 - RNA, 22 nt, Human
cccaggucuaugccagcucuga

SEQ ID NO: 279100 - RNA, 22 nt, Human
uauauuaacacccacuugccuc

SEQ ID NO: 279101 - RNA, 22 nt, Human
ccaccaggacagcccugagggg

SEQ ID NO: 279102 - RNA, 22 nt, Human
aggcacuguacuagguacaggg

SEQ ID NO: 279103 - RNA, 22 nt, Human
aggcugcagaggugcugccaga

SEQ ID NO: 279104 - RNA, 22 nt, Human
ggugacugguuuaucuggcagu

SEQ ID NO: 279105 - RNA, 22 nt, Human
agcagagcugggauccuggguc

SEQ ID NO: 279106 - RNA, 22 nt, Human
uguucuuuggcuuccuuuccgu

SEQ ID NO: 279107 - RNA, 22 nt, Human
aggcaguggcugagaccagggg

SEQ ID NO: 279108 - RNA, 22 nt, Human
aaagacuaagaagaguauuauu

SEQ ID NO: 279109 - RNA, 22 nt, Human
aaggucuguggccaccucuggg

SEQ ID NO: 279110 - RNA, 22 nt, Human
gcuggaggcuggagugcagugg

SEQ ID NO: 279111 - RNA, 22 nt, Human
gaaccacaagauucaaaggggu

SEQ ID NO: 279112 - RNA, 22 nt, Human
agcaaaguaugugcugggagcu

SEQ ID NO: 279113 - RNA, 22 nt, Human
ucucaaauuuguuagauaaaau

SEQ ID NO: 279114 - RNA, 22 nt, Human
agguccugacuccacguucuag

SEQ ID NO: 279115 - RNA, 22 nt, Human
gcagaaguaccucguucuaguu

SEQ ID NO: 279116 - RNA, 22 nt, Human
cuccauugaacauccucucaga

SEQ ID NO: 279117 - RNA, 22 nt, Human
uacagcacaaagggccuuuacc

SEQ ID NO: 279118 - RNA, 22 nt, Human
aggcuguguuuccccuggagcu

SEQ ID NO: 279119 - RNA, 22 nt, Human
gcuuccaccuacuaaaugccac

SEQ ID NO: 279120 - RNA, 22 nt, Human
ggcccucccggugaugaagagc

SEQ ID NO: 279121 - RNA, 22 nt, Human
cuggcucauccagguguugcuc

SEQ ID NO: 279122 - RNA, 22 nt, Human
cuugauugcuucuacgugacug

SEQ ID NO: 279123 - RNA, 22 nt, Human
uuaaauaguaggucuauuuugg

SEQ ID NO: 279124 - RNA, 22 nt, Human
gugacagggagugauauagcag

SEQ ID NO: 279125 - RNA, 22 nt, Human
augagguggucuucaguagguc

SEQ ID NO: 279126 - RNA, 22 nt, Human
cuggccugaggccgccuucaga

SEQ ID NO: 279127 - RNA, 22 nt, Human
gucuccagaagccuagacagcc

SEQ ID NO: 279128 - RNA, 20 nt, Human
auagaaguauuauguaaugu

SEQ ID NO: 279129 - RNA, 20 nt, Human
ccuucucuggaauugccucc

SEQ ID NO: 279130 - RNA, 22 nt, Human
uuucuacauucaaaaacuacca

SEQ ID NO: 279131 - RNA, 20 nt, Human
cuuuaguuauuaacagcacu

SEQ ID NO: 279132 - RNA, 22 nt, Human
cuguuucuccacacucuuccca

SEQ ID NO: 279133 - RNA, 22 nt, Human
gagguuggugaggggacacggu

SEQ ID NO: 279134 - RNA, 22 nt, Human
uggcacugacagggugcucaag

SEQ ID NO: 279135 - RNA, 22 nt, Human
cacugaaacagguauugcuggu

SEQ ID NO: 279136 - RNA, 22 nt, Human
uaaaguguguauauacauaugg

SEQ ID NO: 279137 - RNA, 19 nt, Human
agguuacaggugucacaga

SEQ ID NO: 279138 - RNA, 22 nt, Human
agcuccagaagccugcaaggua

SEQ ID NO: 279139 - RNA, 22 nt, Human
gccuccugaagugcugggauua

SEQ ID NO: 279140 - RNA, 22 nt, Human
aggucacacuuggaucauagaa

SEQ ID NO: 279141 - RNA, 22 nt, Human
ugaauaaauugagagcgaaugu

SEQ ID NO: 279142 - RNA, 22 nt, Human
ugcugaggcauuuggacagagu

SEQ ID NO: 279143 - RNA, 19 nt, Human
ucccucccuguaaucucac

SEQ ID NO: 279144 - RNA, 22 nt, Human
gcuuugcugggugcuucaugua

SEQ ID NO: 279145 - RNA, 22 nt, Human
uuuguacauguaagauugcauc

SEQ ID NO: 279146 - RNA, 21 nt, Human
gcauuaaaagcaguuguuggu

SEQ ID NO: 279147 - RNA, 22 nt, Human
auccuggcgggggaacugccca

SEQ ID NO: 279148 - RNA, 22 nt, Human
aaagcugggcuagguuuguuuc

SEQ ID NO: 279149 - RNA, 22 nt, Human
aguuugaaaguauugacagaag

SEQ ID NO: 279150 - RNA, 22 nt, Human
ugggcacagaauagauggccca

SEQ ID NO: 279151 - RNA, 22 nt, Human
guacacuugacucauaggaaau

SEQ ID NO: 279152 - RNA, 22 nt, Human
uacauagcaaggaaaugacaga

SEQ ID NO: 279153 - RNA, 22 nt, Human
uuccagaagccuccauauuacu

SEQ ID NO: 279154 - RNA, 22 nt, Human
uuuguaaaggccugaauuucag

SEQ ID NO: 279155 - RNA, 22 nt, Human
agcaugcacaugacuggcuuaa

SEQ ID NO: 279156 - RNA, 22 nt, Human
ccuagaauuauaaacuuauuag

SEQ ID NO: 279157 - RNA, 22 nt, Human
cuucucggccguguggaugcgc

SEQ ID NO: 279158 - RNA, 22 nt, Human
ucaggagguaggacauacuggu

SEQ ID NO: 279159 - RNA, 22 nt, Human
ucucugggccuguuuucucauc

SEQ ID NO: 279160 - RNA, 22 nt, Human
cuucagagugacucagcaucuu

SEQ ID NO: 279161 - RNA, 22 nt, Human
aaagcucuuuuccaaguauuga

SEQ ID NO: 279162 - RNA, 17 nt, Human
uccuggauccauggugg

SEQ ID NO: 279163 - RNA, 22 nt, Human
gucagccugcacucagggagcg

SEQ ID NO: 279164 - RNA, 22 nt, Human
agugugagggguucuuugauau

SEQ ID NO: 279165 - RNA, 22 nt, Human
agacuccucggaccaaucagcg

SEQ ID NO: 279166 - RNA, 22 nt, Human
aagugcugagacuacaggcaug

SEQ ID NO: 279167 - RNA, 22 nt, Human
cacaguuuugcccagggcuucu

SEQ ID NO: 279168 - RNA, 22 nt, Human
uagaaagacuguccagauuuca

SEQ ID NO: 279169 - RNA, 22 nt, Human
acagggccuuauauccagaagg

SEQ ID NO: 279170 - RNA, 19 nt, Human
caaaugggacaggaaggca

SEQ ID NO: 279171 - RNA, 18 nt, Human
aggcccuggccucgaaca

SEQ ID NO: 279172 - RNA, 23 nt, Human
agcagcagcaauuaaguggauau

SEQ ID NO: 279173 - RNA, 22 nt, Human
uauuccaguccuauccucuuuu

SEQ ID NO: 279174 - RNA, 22 nt, Human
acaauuuauccauuguauaguu

SEQ ID NO: 279175 - RNA, 22 nt, Human
uaacuagaagaaugcaccaaga

SEQ ID NO: 279176 - RNA, 21 nt, Human
cagcaaaucauugggcagacu

SEQ ID NO: 279177 - RNA, 22 nt, Human
ugcaggcucugugugugccugg

SEQ ID NO: 279178 - RNA, 22 nt, Human
cugcuguaaugagucagcaucu

SEQ ID NO: 279179 - RNA, 22 nt, Human
aggccagcucuacccuuggacu

SEQ ID NO: 279180 - RNA, 22 nt, Human
uggggccugagguggagcugca

SEQ ID NO: 279181 - RNA, 22 nt, Human
auaaagcuuugaaauggagaua

SEQ ID NO: 279182 - RNA, 21 nt, Human
aguugcauaggccagccaucc

SEQ ID NO: 279183 - RNA, 22 nt, Human
uccuagaaagaugucuuuucac

SEQ ID NO: 279184 - RNA, 22 nt, Human
uggaccagggucccagaguaug

SEQ ID NO: 279185 - RNA, 22 nt, Human
ugcccugggaacacagaugcca

SEQ ID NO: 279186 - RNA, 22 nt, Human
ugagacagucaccaggcaggcc

SEQ ID NO: 279187 - RNA, 22 nt, Human
uaguccagguuaaucccugccu

SEQ ID NO: 279188 - RNA, 22 nt, Human
caucuaccuccacccuauauau

SEQ ID NO: 279189 - RNA, 22 nt, Human
agaggcuucucggauggggcag

SEQ ID NO: 279190 - RNA, 22 nt, Human
aggcaccuugagagcaggagcu

SEQ ID NO: 279191 - RNA, 22 nt, Human
gcucuggcuaguuaccucuuac

SEQ ID NO: 279192 - RNA, 22 nt, Human
uuugaagauaaauauggagaaa

SEQ ID NO: 279193 - RNA, 22 nt, Human
aacaggcuccuugugaauggau

SEQ ID NO: 279194 - RNA, 22 nt, Human
uuggccuccacauuuuccaggu

SEQ ID NO: 279195 - RNA, 22 nt, Human
uuuaucuguuguacauuuaugc

SEQ ID NO: 279196 - RNA, 22 nt, Human
gugcaaaagcaguugugguuuu

SEQ ID NO: 279197 - RNA, 22 nt, Human
accuguuuuagucuuuaaucau

SEQ ID NO: 279198 - RNA, 22 nt, Human
aaauucauuuuucuuagugugc

SEQ ID NO: 279199 - RNA, 22 nt, Human
cucuuugaaauccaucacugcu

SEQ ID NO: 279200 - RNA, 22 nt, Human
cucuccccgguacgagcggccg

SEQ ID NO: 279201 - RNA, 19 nt, Human
agucuggaguaaaaggaau

SEQ ID NO: 279202 - RNA, 23 nt, Human
ccaaagucgaagucuaguccaga

SEQ ID NO: 279203 - RNA, 22 nt, Human
ucaggugucuugugggauuuua

SEQ ID NO: 279204 - RNA, 22 nt, Human
cagcacaucugauuauaugacu

SEQ ID NO: 279205 - RNA, 23 nt, Human
ugcccucccaaugcuucggucac

SEQ ID NO: 279206 - RNA, 22 nt, Human
cuucagugauauaggcuucucc

SEQ ID NO: 279207 - RNA, 19 nt, Human
ccaggccugcgggcguugg

SEQ ID NO: 279208 - RNA, 20 nt, Human
ugcuucauuaugugagauag

SEQ ID NO: 279209 - RNA, 22 nt, Human
ggcuggguuugacuccuggcuu

SEQ ID NO: 279210 - RNA, 20 nt, Human
aaauuacugccacacauuuc

SEQ ID NO: 279211 - RNA, 22 nt, Human
uucuuuugggaauuacguaugc

SEQ ID NO: 279212 - RNA, 22 nt, Human
ugcaggagcugcuguccugcuc

SEQ ID NO: 279213 - RNA, 22 nt, Human
gcaggcagucaucuuucauauu

SEQ ID NO: 279214 - RNA, 19 nt, Human
uuucuuuuccccucagcac

SEQ ID NO: 279215 - RNA, 17 nt, Human
uuagcaaaauagcacuu

SEQ ID NO: 279216 - RNA, 22 nt, Human
ucuguaaaucuacuaagagcuc

SEQ ID NO: 279217 - RNA, 19 nt, Human
caggagagcaugcacuuug

SEQ ID NO: 279218 - RNA, 22 nt, Human
cagcugcuuacuagcuguguga

SEQ ID NO: 279219 - RNA, 22 nt, Human
agcugcugccgguggccacccu

SEQ ID NO: 279220 - RNA, 22 nt, Human
uggagaggagcaccauggccau

SEQ ID NO: 279221 - RNA, 22 nt, Human
guccaaugguaaauccaaauaa

SEQ ID NO: 279222 - RNA, 22 nt, Human
acaggcugcccgcuccccaccu

SEQ ID NO: 279223 - RNA, 22 nt, Human
cuuuucuuacucccgcaaggca

SEQ ID NO: 279224 - RNA, 22 nt, Human
ucuaaacauugguauggagcag

SEQ ID NO: 279225 - RNA, 22 nt, Human
acuguccagaagauagaaauau

SEQ ID NO: 279226 - RNA, 22 nt, Human
uucuagaagcucuaggggagaa

SEQ ID NO: 279227 - RNA, 22 nt, Human
uuucauguuacaguguaaaagu

SEQ ID NO: 279228 - RNA, 22 nt, Human
cucuguggguauuuauauguau

SEQ ID NO: 279229 - RNA, 22 nt, Human
uucuaaauguaaauaguaugau

SEQ ID NO: 279230 - RNA, 17 nt, Human
gggcagggacuccuggg

SEQ ID NO: 279231 - RNA, 22 nt, Human
cagcaggcccagaguuucaugg

SEQ ID NO: 279232 - RNA, 20 nt, Human
guuuauacagaagaccccaa

SEQ ID NO: 279233 - RNA, 22 nt, Human
uccuggugguuugaaaacugaa

SEQ ID NO: 279234 - RNA, 21 nt, Human
uggagcugccacuuguccucc

SEQ ID NO: 279235 - RNA, 21 nt, Human
uuucaauguguucuuuguagu

SEQ ID NO: 279236 - RNA, 22 nt, Human
ccccucuugugggcucagguca

SEQ ID NO: 279237 - RNA, 22 nt, Human
ugucucaucucuuaaccccacu

SEQ ID NO: 279238 - RNA, 22 nt, Human
agagcuccugcauucuucccug

SEQ ID NO: 279239 - RNA, 22 nt, Human
ggcaucuucaaaauugccaaau

SEQ ID NO: 279240 - RNA, 22 nt, Human
uucuucaacaaggacacuguua

SEQ ID NO: 279241 - RNA, 22 nt, Human
uuuggcucuaguaaauauaacc

SEQ ID NO: 279242 - RNA, 22 nt, Human
acauguguguauacguauuuau

SEQ ID NO: 279243 - RNA, 22 nt, Human
uuacauauugucuauuguucaa

SEQ ID NO: 279244 - RNA, 22 nt, Human
gacaaaacacauuaguuuaaaa

SEQ ID NO: 279245 - RNA, 22 nt, Human
ggggaggaagcucucaguucca

SEQ ID NO: 279246 - RNA, 22 nt, Human
ccagaaagguaaacacuggauu

SEQ ID NO: 279247 - RNA, 22 nt, Human
gcagagccagaauggccaggac

SEQ ID NO: 279248 - RNA, 18 nt, Human
aagucucugaaagcuuuu

SEQ ID NO: 279249 - RNA, 22 nt, Human
uuugacuccagagcccauuuuu

SEQ ID NO: 279250 - RNA, 22 nt, Human
uugaggcauuacuguaaugaga

SEQ ID NO: 279251 - RNA, 21 nt, Human
agcuccaggcuccugggguuc

SEQ ID NO: 279252 - RNA, 22 nt, Human
ucaggaacauuuaaccacaggg

SEQ ID NO: 279253 - RNA, 22 nt, Human
aaacaucaccauuuuaccuaau

SEQ ID NO: 279254 - RNA, 22 nt, Human
uucuuuuuaucuucccauaaga

SEQ ID NO: 279255 - RNA, 20 nt, Human
ccaccuggccaaggcugugc

SEQ ID NO: 279256 - RNA, 22 nt, Human
caaauacuuacugaaccugugc

SEQ ID NO: 279257 - RNA, 22 nt, Human
gggccugggaacuugcauuuag

SEQ ID NO: 279258 - RNA, 22 nt, Human
agggcacuucagucagacugag

SEQ ID NO: 279259 - RNA, 22 nt, Human
ccucaguguuaggauaagagaa

SEQ ID NO: 279260 - RNA, 21 nt, Human
agagaauugccuuagauguuc

SEQ ID NO: 279261 - RNA, 22 nt, Human
ucuaaacuaggguuaaaggaaa

SEQ ID NO: 279262 - RNA, 21 nt, Human
aggcagcgugagggccacuca

SEQ ID NO: 279263 - RNA, 22 nt, Human
ccacaggaccagaggagaucac

SEQ ID NO: 279264 - RNA, 22 nt, Human
gggugcaggggacccuagggac

SEQ ID NO: 279265 - RNA, 22 nt, Human
caggccugggcuucggggcuga

SEQ ID NO: 279266 - RNA, 22 nt, Human
ccaggaaggcaggccuccccgc

SEQ ID NO: 279267 - RNA, 22 nt, Human
uguggggccaaagcccagccac

SEQ ID NO: 279268 - RNA, 22 nt, Human
ugaaagcagauagcucuguugu

SEQ ID NO: 279269 - RNA, 22 nt, Human
uacaaacuaacaugucucaucc

SEQ ID NO: 279270 - RNA, 20 nt, Human
uuucacagucccuguuuccu

SEQ ID NO: 279271 - RNA, 22 nt, Human
ucucucuuuuuaaucauguaau

SEQ ID NO: 279272 - RNA, 22 nt, Human
ugcugagggcuguuaaggaagc

SEQ ID NO: 279273 - RNA, 22 nt, Human
ucucuggccccauggcugagcu

SEQ ID NO: 279274 - RNA, 22 nt, Human
aagggcuggaucucucugagca

SEQ ID NO: 279275 - RNA, 22 nt, Human
aaaaucuggcaacacuaaguuu

SEQ ID NO: 279276 - RNA, 22 nt, Human
auucuuuacauuggcuucuucc

SEQ ID NO: 279277 - RNA, 22 nt, Human
cugcugggucuaugcaagugga

SEQ ID NO: 279278 - RNA, 22 nt, Human
gccucagagcuacacacacgca

SEQ ID NO: 279279 - RNA, 22 nt, Human
augggcagagcuggugggaggc

SEQ ID NO: 279280 - RNA, 22 nt, Human
guuauaaaaugcacaguuguuu

SEQ ID NO: 279281 - RNA, 22 nt, Human
gaggccugguuuccagcauccu

SEQ ID NO: 279282 - RNA, 22 nt, Human
agugugucugaucacuugugag

SEQ ID NO: 279283 - RNA, 22 nt, Human
uauuuuacuuuaaagcgagaga

SEQ ID NO: 279284 - RNA, 22 nt, Human
gucuggcucaguccuagcugua

SEQ ID NO: 279285 - RNA, 22 nt, Human
uacagagaguacagcauccaca

SEQ ID NO: 279286 - RNA, 22 nt, Human
uaggcuccaagagcgaacucag

SEQ ID NO: 279287 - RNA, 22 nt, Human
aauguugauguuuucagugagc

SEQ ID NO: 279288 - RNA, 22 nt, Human
guggcgaggggagguccuggcg

SEQ ID NO: 279289 - RNA, 22 nt, Human
aagauguugucguuagugauga

SEQ ID NO: 279290 - RNA, 22 nt, Human
gaacagagcugacuacaaggca

SEQ ID NO: 279291 - RNA, 22 nt, Human
caugcuucacacacugaaugac

SEQ ID NO: 279292 - RNA, 23 nt, Human
ugugacagggucauugaaaaggg

SEQ ID NO: 279293 - RNA, 23 nt, Human
aucuaaaguguuaaauagcuggg

SEQ ID NO: 279294 - RNA, 22 nt, Human
caaugauuuuuccauugcagga

SEQ ID NO: 279295 - RNA, 22 nt, Human
ggcagcagcaagguuggagcug

SEQ ID NO: 279296 - RNA, 22 nt, Human
uaugcacauuaucuaauccauu

SEQ ID NO: 279297 - RNA, 22 nt, Human
gcagggacaacugugcaccuga

SEQ ID NO: 279298 - RNA, 22 nt, Human
caagcuggaguuccucagagug

SEQ ID NO: 279299 - RNA, 22 nt, Human
uccuggcacccuuggguuggag

SEQ ID NO: 279300 - RNA, 22 nt, Human
ucuacagugagucauucaaaca

SEQ ID NO: 279301 - RNA, 22 nt, Human
aaauccuaagcagaggaauuua

SEQ ID NO: 279302 - RNA, 22 nt, Human
aaggcuuuugacgguugccucu

SEQ ID NO: 279303 - RNA, 22 nt, Human
ccagaggagggcucugaugagg

SEQ ID NO: 279304 - RNA, 22 nt, Human
uguguucuuaaaagcagugaua

SEQ ID NO: 279305 - RNA, 22 nt, Human
ucacaugucagucuuaaacaga

SEQ ID NO: 279306 - RNA, 22 nt, Human
uugcaaaaaccacaauuacuuu

SEQ ID NO: 279307 - RNA, 22 nt, Human
cagcagcugcaaauggaaacag

SEQ ID NO: 279308 - RNA, 22 nt, Human
ccuuuuauacucagugauauca

SEQ ID NO: 279309 - RNA, 22 nt, Human
aggaauguauuauuccuucugg

SEQ ID NO: 279310 - RNA, 22 nt, Human
gacuguguccaugugcuggauu

SEQ ID NO: 279311 - RNA, 22 nt, Human
cucugagcccgcugcagcccca

SEQ ID NO: 279312 - RNA, 22 nt, Human
ccacuggagacuggucucugug

SEQ ID NO: 279313 - RNA, 22 nt, Human
auuagaauuaugcuugcuaaug

SEQ ID NO: 279314 - RNA, 22 nt, Human
cagugagggaagaucucagcac

SEQ ID NO: 279315 - RNA, 22 nt, Human
uggcucaggcuugaaaauagau

SEQ ID NO: 279316 - RNA, 22 nt, Human
ucuguucauaguaguguauaug

SEQ ID NO: 279317 - RNA, 22 nt, Human
ggaggggcugagcaacuuucag

SEQ ID NO: 279318 - RNA, 22 nt, Human
cagggcagaacauauagauagu

SEQ ID NO: 279319 - RNA, 22 nt, Human
uauaauaugaggcaggagugau

SEQ ID NO: 279320 - RNA, 22 nt, Human
ggcuuuagggcaggcaguguua

SEQ ID NO: 279321 - RNA, 22 nt, Human
ggaggaugccaagcugugcaca

SEQ ID NO: 279322 - RNA, 22 nt, Human
guuuaucauuauuauuagcaac

SEQ ID NO: 279323 - RNA, 22 nt, Human
cucugccauuuaucagaacugu

SEQ ID NO: 279324 - RNA, 22 nt, Human
aauaauguugacgauagucuua

SEQ ID NO: 279325 - RNA, 22 nt, Human
agacccugguaaacacuccagg

SEQ ID NO: 279326 - RNA, 22 nt, Human
gaggcccagcagcgcaggucuu

SEQ ID NO: 279327 - RNA, 22 nt, Human
cauuagaacuaagauguccagg

SEQ ID NO: 279328 - RNA, 22 nt, Human
ugcuggggucauggggcgcccg

SEQ ID NO: 279329 - RNA, 22 nt, Human
gggauggggagcuggaaagggg

SEQ ID NO: 279330 - RNA, 22 nt, Human
gcugcccugacuccagcagccu

SEQ ID NO: 279331 - RNA, 22 nt, Human
caucugcugacuugacaaguac

SEQ ID NO: 279332 - RNA, 22 nt, Human
aagaauaaguagaugggagaag

SEQ ID NO: 279333 - RNA, 22 nt, Human
auuuaguuuaggaaaaguaggu

SEQ ID NO: 279334 - RNA, 22 nt, Human
ccuguucaaugcccuggcuuca

SEQ ID NO: 279335 - RNA, 22 nt, Human
agaaacauccugcuuuccauuu

SEQ ID NO: 279336 - RNA, 22 nt, Human
acaaaugacuauuugguacagg

SEQ ID NO: 279337 - RNA, 22 nt, Human
uaaaugugagugaugcggugaa

SEQ ID NO: 279338 - RNA, 22 nt, Human
uauauaauuuguaaaagcaccu

SEQ ID NO: 279339 - RNA, 23 nt, Human
agugcaugcuugacuuagcaagc

SEQ ID NO: 279340 - RNA, 22 nt, Human
uaaugauauuucccauuucucu

SEQ ID NO: 279341 - RNA, 22 nt, Human
acuuccuguaaauagaauucca

SEQ ID NO: 279342 - RNA, 22 nt, Human
agcugccacauggugucacugu

SEQ ID NO: 279343 - RNA, 22 nt, Human
gcagcagagaacacaaugaugg

SEQ ID NO: 279344 - RNA, 22 nt, Human
uaugcagcaccacucacugcag

SEQ ID NO: 279345 - RNA, 22 nt, Human
guggccauaggaggucagauga

SEQ ID NO: 279346 - RNA, 22 nt, Human
ucccuaguagacccagaucauu

SEQ ID NO: 279347 - RNA, 22 nt, Human
guacauuuugagguuaaaacaa

SEQ ID NO: 279348 - RNA, 21 nt, Human
accuccuggcauccuguuccc

SEQ ID NO: 279349 - RNA, 22 nt, Human
cagagacauccauuuuauaugc

SEQ ID NO: 279350 - RNA, 22 nt, Human
ggugcagggagaggcaggcccc

SEQ ID NO: 279351 - RNA, 22 nt, Human
agaaaugaagcaggaguuauua

SEQ ID NO: 279352 - RNA, 22 nt, Human
gaaaucuugcucauugugacaa

SEQ ID NO: 279353 - RNA, 21 nt, Human
accuucaagccagaggugguc

SEQ ID NO: 279354 - RNA, 22 nt, Human
guguggggaggagagagcccuu

SEQ ID NO: 279355 - RNA, 22 nt, Human
ugaauacacuaaaaaucacuuu

SEQ ID NO: 279356 - RNA, 22 nt, Human
acaugacauaguagaaaagccc

SEQ ID NO: 279357 - RNA, 19 nt, Human
uucugggcagcacaugaau

SEQ ID NO: 279358 - RNA, 22 nt, Human
uacuuucuuucccaagaggugg

SEQ ID NO: 279359 - RNA, 22 nt, Human
ucaucugaggcaccagagcaua

SEQ ID NO: 279360 - RNA, 22 nt, Human
cagggccuggagcugggccugc

SEQ ID NO: 279361 - RNA, 22 nt, Human
aaugucuuucucauaacagaua

SEQ ID NO: 279362 - RNA, 20 nt, Human
aauguauuguuuuguuucag

SEQ ID NO: 279363 - RNA, 22 nt, Human
gaauacauaucagauguguuuc

SEQ ID NO: 279364 - RNA, 22 nt, Human
ugagggggguaaucacuggguu

SEQ ID NO: 279365 - RNA, 22 nt, Human
gaaguucuuuauagcaguguga

SEQ ID NO: 279366 - RNA, 22 nt, Human
ccuuuggucaccuccacucuua

SEQ ID NO: 279367 - RNA, 22 nt, Human
cugagacccagacaccugagga

SEQ ID NO: 279368 - RNA, 22 nt, Human
guggguccgcuugguuccggug

SEQ ID NO: 279369 - RNA, 14 nt, Human
gcaggcagaucauu

SEQ ID NO: 279370 - RNA, 22 nt, Human
uauagcacacaguuuauaaaag

SEQ ID NO: 279371 - RNA, 22 nt, Human
cuucagaagccugcagccuuug

SEQ ID NO: 279372 - RNA, 22 nt, Human
uccaggcaugguguaauuuugc

SEQ ID NO: 279373 - RNA, 22 nt, Human
ugagaaagccuuuagucccagg

SEQ ID NO: 279374 - RNA, 22 nt, Human
uggccucugcacugggcucccc

SEQ ID NO: 279375 - RNA, 22 nt, Human
caggcccucaggcaagggcucu

SEQ ID NO: 279376 - RNA, 22 nt, Human
ccugggcuuugagggcaggaug

SEQ ID NO: 279377 - RNA, 17 nt, Human
aggggagagugggaaga

SEQ ID NO: 279378 - RNA, 22 nt, Human
uacaauuacucagcucugcugu

SEQ ID NO: 279379 - RNA, 18 nt, Human
ccaaggccccugcugggg

SEQ ID NO: 279380 - RNA, 22 nt, Human
ggucaaagggugagauggcagg

SEQ ID NO: 279381 - RNA, 23 nt, Human
gggcuccagucucugcucaguug

SEQ ID NO: 279382 - RNA, 22 nt, Human
accucaagugauccacucaccu

SEQ ID NO: 279383 - RNA, 22 nt, Human
agcaggaggguuuuguagaguc

SEQ ID NO: 279384 - RNA, 22 nt, Human
ggagucugcggcagacacugua

SEQ ID NO: 279385 - RNA, 20 nt, Human
gggguugacccucuuggacu

SEQ ID NO: 279386 - RNA, 22 nt, Human
ccagccacagcuuccagcuccu

SEQ ID NO: 279387 - RNA, 22 nt, Human
ucuucagagauguaacauaugg

SEQ ID NO: 279388 - RNA, 22 nt, Human
cacacuugcuucagagucaagu

SEQ ID NO: 279389 - RNA, 22 nt, Human
accucagagaccucucaggugc

SEQ ID NO: 279390 - RNA, 22 nt, Human
cuagaugccaauuuuuauggau

SEQ ID NO: 279391 - RNA, 22 nt, Human
ccucaggcaggaaacugucccg

SEQ ID NO: 279392 - RNA, 22 nt, Human
agcuccuggacgaacagggagu

SEQ ID NO: 279393 - RNA, 22 nt, Human
agucuguguauauucacugccc

SEQ ID NO: 279394 - RNA, 18 nt, Human
ggucaggggcggagagaa

SEQ ID NO: 279395 - RNA, 22 nt, Human
cucaccccacuaccccuuggug

SEQ ID NO: 279396 - RNA, 22 nt, Human
cacaguaugaucuaaaguaagu

SEQ ID NO: 279397 - RNA, 22 nt, Human
acauuucugcaucucagagcua

SEQ ID NO: 279398 - RNA, 22 nt, Human
uuugucaaguuugcaaauacgu

SEQ ID NO: 279399 - RNA, 22 nt, Human
ucugagagcucuggggccccuu

SEQ ID NO: 279400 - RNA, 22 nt, Human
gcauucuugguggagugcuaaa

SEQ ID NO: 279401 - RNA, 22 nt, Human
aaacacuguacaaucugcaggg

SEQ ID NO: 279402 - RNA, 22 nt, Human
ugucauguaaagaguaaauggu

SEQ ID NO: 279403 - RNA, 22 nt, Human
uguacagauugaucauggagag

SEQ ID NO: 279404 - RNA, 23 nt, Human
ucuguuuugcaacaugugacaag

SEQ ID NO: 279405 - RNA, 22 nt, Human
acauucuucagcuuugucaggc

SEQ ID NO: 279406 - RNA, 22 nt, Human
acacagcuucaaagucuaauuc

SEQ ID NO: 279407 - RNA, 22 nt, Human
cauccaggcaccacaaccagcu

SEQ ID NO: 279408 - RNA, 22 nt, Human
acauuugucuucuuucagauua

SEQ ID NO: 279409 - RNA, 22 nt, Human
ugucauuuaguccucugugugu

SEQ ID NO: 279410 - RNA, 22 nt, Human
cugccucuccccagaguggccc

SEQ ID NO: 279411 - RNA, 22 nt, Human
uuacaaaguucugaguucaaac

SEQ ID NO: 279412 - RNA, 20 nt, Human
aauaaacuacugagagaugu

SEQ ID NO: 279413 - RNA, 22 nt, Human
ucaaggcaaaguaaauauucaa

SEQ ID NO: 279414 - RNA, 21 nt, Human
aguuggaggcaguuuggcaau

SEQ ID NO: 279415 - RNA, 22 nt, Human
uccuguccugaggcuccaggcc

SEQ ID NO: 279416 - RNA, 22 nt, Human
cuuuuaaugagcauugcugucu

SEQ ID NO: 279417 - RNA, 22 nt, Human
cacaucucagggcuacaggcag

SEQ ID NO: 279418 - RNA, 22 nt, Human
acaaacuaccuacagauguuca

SEQ ID NO: 279419 - RNA, 22 nt, Human
ccucuuccuucucacuguggaa

SEQ ID NO: 279420 - RNA, 22 nt, Human
gcuggcuugauaguuucugcuu

SEQ ID NO: 279421 - RNA, 22 nt, Human
ggcucugggaaauggucuuccu

SEQ ID NO: 279422 - RNA, 22 nt, Human
uguccugggucaaauccugguc

SEQ ID NO: 279423 - RNA, 22 nt, Human
gcauccaggacuauaugaugau

SEQ ID NO: 279424 - RNA, 22 nt, Human
ggaccaguuucaaacuguacca

SEQ ID NO: 279425 - RNA, 22 nt, Human
ucaucugaacaugcagccugug

SEQ ID NO: 279426 - RNA, 22 nt, Human
agugcacaccuuaguacaaagu

SEQ ID NO: 279427 - RNA, 22 nt, Human
gugcugugugauccaugcuggc

SEQ ID NO: 279428 - RNA, 22 nt, Human
ucucugaaggggagcuguuuaa

SEQ ID NO: 279429 - RNA, 22 nt, Human
ucuaaagagaaccuuuucucau

SEQ ID NO: 279430 - RNA, 22 nt, Human
aauagaaaggaggggcucuugu

SEQ ID NO: 279431 - RNA, 22 nt, Human
gcauuagauauccuugaaguua

SEQ ID NO: 279432 - RNA, 22 nt, Human
ugcccacauggugccauggcca

SEQ ID NO: 279433 - RNA, 22 nt, Human
aacucagaauagggugcagggc

SEQ ID NO: 279434 - RNA, 22 nt, Human
augguuuaguuagggcuuuuca

SEQ ID NO: 279435 - RNA, 19 nt, Human
cugaggcaaguggugguca

SEQ ID NO: 279436 - RNA, 22 nt, Human
gguccugggaagaugcucauga

SEQ ID NO: 279437 - RNA, 22 nt, Human
cuauuauuuccucaucuauaaa

SEQ ID NO: 279438 - RNA, 22 nt, Human
gcagcuuuggagguggaacucu

SEQ ID NO: 279439 - RNA, 22 nt, Human
acaggugggcuuaagagucggc

SEQ ID NO: 279440 - RNA, 22 nt, Human
aaguugaagcaugaaccaaggu

SEQ ID NO: 279441 - RNA, 22 nt, Human
cagcuucuaaagugugaagcca

SEQ ID NO: 279442 - RNA, 21 nt, Human
uuagaguugccauuauaugua

SEQ ID NO: 279443 - RNA, 22 nt, Human
uuccauaugaaaaagcuguugc

SEQ ID NO: 279444 - RNA, 22 nt, Human
cuuaauuuuuguaguagaugga

SEQ ID NO: 279445 - RNA, 22 nt, Human
uaaagugcuggauuugaguaaa

SEQ ID NO: 279446 - RNA, 22 nt, Human
uccagagaucacacugggcagg

SEQ ID NO: 279447 - RNA, 23 nt, Human
agucucagcuggaaacauguguc

SEQ ID NO: 279448 - RNA, 22 nt, Human
ucacucugcaggaaggagcagc

SEQ ID NO: 279449 - RNA, 22 nt, Human
cugggcaggauacuucauggga

SEQ ID NO: 279450 - RNA, 22 nt, Human
uauuucaucuggaacaagguaa

SEQ ID NO: 279451 - RNA, 22 nt, Human
agagggaaaaacucaugucauu

SEQ ID NO: 279452 - RNA, 20 nt, Human
cagggcucugggccuggccu

SEQ ID NO: 279453 - RNA, 22 nt, Human
gaucuuuagccaagacacacca

SEQ ID NO: 279454 - RNA, 22 nt, Human
aaagaggcaaucaauguagcaa

SEQ ID NO: 279455 - RNA, 22 nt, Human
gccuucccuggcuaggcaagca

SEQ ID NO: 279456 - RNA, 22 nt, Human
uauacacauccuccaaagauag

SEQ ID NO: 279457 - RNA, 22 nt, Human
aggcucagcugguggugaucgc

SEQ ID NO: 279458 - RNA, 22 nt, Human
cugccuggcauagucuggucga

SEQ ID NO: 279459 - RNA, 22 nt, Human
aguaacucuccuuugacauauu

SEQ ID NO: 279460 - RNA, 19 nt, Human
auucuuguuaagugucauc

SEQ ID NO: 279461 - RNA, 22 nt, Human
cuggcuggaaguuagagaacuu

SEQ ID NO: 279462 - RNA, 22 nt, Human
ucuccauuuuauagauaaugaa

SEQ ID NO: 279463 - RNA, 22 nt, Human
gagggcaggggucuugcacggu

SEQ ID NO: 279464 - RNA, 22 nt, Human
ugcauucaguuggucagcuuuu

SEQ ID NO: 279465 - RNA, 22 nt, Human
gagcugggaguuauagcauguu

SEQ ID NO: 279466 - RNA, 22 nt, Human
aggagacauacuauaggaauau

SEQ ID NO: 279467 - RNA, 22 nt, Human
aggccucacucucagagcuucu

SEQ ID NO: 279468 - RNA, 22 nt, Human
gaaauugugcauuuagcaacac

SEQ ID NO: 279469 - RNA, 22 nt, Human
cccaggcacaccccgaacggaa

SEQ ID NO: 279470 - RNA, 20 nt, Human
cuccugugccucucugggcc

SEQ ID NO: 279471 - RNA, 22 nt, Human
cagcagugucuccagcaucaca

SEQ ID NO: 279472 - RNA, 19 nt, Human
caguuacaggcacuguggg

SEQ ID NO: 279473 - RNA, 22 nt, Human
gguuucuagcagagucucuuua

SEQ ID NO: 279474 - RNA, 22 nt, Human
uuagcuuucagccuuucucacc

SEQ ID NO: 279475 - RNA, 22 nt, Human
cuggaaagugcuuuucugagag

SEQ ID NO: 279476 - RNA, 18 nt, Human
aaauguacuguccauggc

SEQ ID NO: 279477 - RNA, 22 nt, Human
ccagccuggggaggcagcuucu

SEQ ID NO: 279478 - RNA, 22 nt, Human
cugagggguauccaagggguaa

SEQ ID NO: 279479 - RNA, 21 nt, Human
guucaugucagcauuaaggga

SEQ ID NO: 279480 - RNA, 22 nt, Human
aacuuuauuguuaggggcuaaa

SEQ ID NO: 279481 - RNA, 22 nt, Human
cagagacauuaagugccaugau

SEQ ID NO: 279482 - RNA, 22 nt, Human
uaggauaugugaaaucauauua

SEQ ID NO: 279483 - RNA, 22 nt, Human
aggcuucaguagggagcauguc

SEQ ID NO: 279484 - RNA, 22 nt, Human
agucuucuggguguuuccagag

SEQ ID NO: 279485 - RNA, 22 nt, Human
caggguggcacaucacagcauu

SEQ ID NO: 279486 - RNA, 22 nt, Human
cauuauugccagccauacugaa

SEQ ID NO: 279487 - RNA, 22 nt, Human
gaucacaugaguuaucuaacuu

SEQ ID NO: 279488 - RNA, 22 nt, Human
gaggagacaguggagccgcuac

SEQ ID NO: 279489 - RNA, 22 nt, Human
guuuauuauucaacuucauguu

SEQ ID NO: 279490 - RNA, 21 nt, Human
cagaggggcuagccuggcugc

SEQ ID NO: 279491 - RNA, 22 nt, Human
uuagaaaaaggcuguggucuua

SEQ ID NO: 279492 - RNA, 22 nt, Human
ugaggcaggagaaucacaugaa

SEQ ID NO: 279493 - RNA, 21 nt, Human
gagccuucccucugcccuuuc

SEQ ID NO: 279494 - RNA, 22 nt, Human
gccagcuggcugcaggucccag

SEQ ID NO: 279495 - RNA, 22 nt, Human
agaggaaggaugcauauccaaa

SEQ ID NO: 279496 - RNA, 22 nt, Human
ugugcuucucacaucacuguug

SEQ ID NO: 279497 - RNA, 15 nt, Human
cauaucacugggaau

SEQ ID NO: 279498 - RNA, 17 nt, Human
ggagccaggagcccacc

SEQ ID NO: 279499 - RNA, 22 nt, Human
cugcccuguaucuucucccaau

SEQ ID NO: 279500 - RNA, 22 nt, Human
uggcagagccuugccaaacucc

SEQ ID NO: 279501 - RNA, 23 nt, Human
acugggcugaaauuaaagguguc

SEQ ID NO: 279502 - RNA, 22 nt, Human
ucuaccuggaguccguuguuaa

SEQ ID NO: 279503 - RNA, 22 nt, Human
uaaagcaagacacacccauagc

SEQ ID NO: 279504 - RNA, 22 nt, Human
ucacaauggcauaguauaaaau

SEQ ID NO: 279505 - RNA, 22 nt, Human
ugaacuuuugcacagaggauuu

SEQ ID NO: 279506 - RNA, 23 nt, Human
agaguggccuacucacacucauu

SEQ ID NO: 279507 - RNA, 22 nt, Human
ucucagcucagcuuccacagag

SEQ ID NO: 279508 - RNA, 22 nt, Human
uagcuauuuagcccagauaagu

SEQ ID NO: 279509 - RNA, 23 nt, Human
uggcucucucagugcugcagagg

SEQ ID NO: 279510 - RNA, 22 nt, Human
cagcugaguuacucugaggucu

SEQ ID NO: 279511 - RNA, 22 nt, Human
uggcuacucaacauguacucau

SEQ ID NO: 279512 - RNA, 22 nt, Human
acauuucuuccacaugcugcug

SEQ ID NO: 279513 - RNA, 22 nt, Human
ucucuguucauggcacuauguc

SEQ ID NO: 279514 - RNA, 22 nt, Human
uuaucuugguguuuuaguaauu

SEQ ID NO: 279515 - RNA, 22 nt, Human
cuguacaucccgagagccagua

SEQ ID NO: 279516 - RNA, 22 nt, Human
uaauuacagguccaaaacaauc

SEQ ID NO: 279517 - RNA, 22 nt, Human
gcucagggcgcgagggacgugg

SEQ ID NO: 279518 - RNA, 22 nt, Human
gcugcuguuccuccaguggauc

SEQ ID NO: 279519 - RNA, 22 nt, Human
gccuguccuugugaggucccag

SEQ ID NO: 279520 - RNA, 22 nt, Human
ucuccugcucagaacagccuca

SEQ ID NO: 279521 - RNA, 22 nt, Human
agauaaauuccuaagauuucag

SEQ ID NO: 279522 - RNA, 22 nt, Human
uaaagguuuauucaacaaaaua

SEQ ID NO: 279523 - RNA, 22 nt, Human
ucugaaauagaagugucuuucu

SEQ ID NO: 279524 - RNA, 22 nt, Human
agucacagguucuugggauuag

SEQ ID NO: 279525 - RNA, 22 nt, Human
gaagugacagaagggaugggca

SEQ ID NO: 279526 - RNA, 22 nt, Human
auuauuagugauguuguuacug

SEQ ID NO: 279527 - RNA, 22 nt, Human
cuuaagaauauugaaguugugg

SEQ ID NO: 279528 - RNA, 22 nt, Human
uaauuucacugauaugaaguca

SEQ ID NO: 279529 - RNA, 22 nt, Human
ugucaacauuggcugacaguug

SEQ ID NO: 279530 - RNA, 22 nt, Human
aaacacacagaaaugaaugagg

SEQ ID NO: 279531 - RNA, 22 nt, Human
aacccacaagcagcuguagccc

SEQ ID NO: 279532 - RNA, 22 nt, Human
aacagacaacuccuguggcuca

SEQ ID NO: 279533 - RNA, 22 nt, Human
guggcagaaauauucuugcucu

SEQ ID NO: 279534 - RNA, 22 nt, Human
acuucucuucauagguggcaau

SEQ ID NO: 279535 - RNA, 22 nt, Human
uggcacuuuacacccauuuggc

SEQ ID NO: 279536 - RNA, 22 nt, Human
aaauacauuuacagucguggcu

SEQ ID NO: 279537 - RNA, 22 nt, Human
uucaguauacauuaucuaauug

SEQ ID NO: 279538 - RNA, 22 nt, Human
cuggagagaaaugacaaagcua

SEQ ID NO: 279539 - RNA, 22 nt, Human
gcuuggcuccuggcucacaggu

SEQ ID NO: 279540 - RNA, 22 nt, Human
aggaauguuuacacgacagaaa

SEQ ID NO: 279541 - RNA, 22 nt, Human
cugucuguguggacacggcugc

SEQ ID NO: 279542 - RNA, 22 nt, Human
ccagcucucagcgggagacuca

SEQ ID NO: 279543 - RNA, 22 nt, Human
auaauuaggucuuauaacgucu

SEQ ID NO: 279544 - RNA, 22 nt, Human
cagcuggcgggcagagccgcca

SEQ ID NO: 279545 - RNA, 22 nt, Human
aguccauacauugagaauaaca

SEQ ID NO: 279546 - RNA, 20 nt, Human
cugcagggugagugggcgau

SEQ ID NO: 279547 - RNA, 22 nt, Human
gcugugcuugcaugagugucug

SEQ ID NO: 279548 - RNA, 22 nt, Human
uaaaugccauucguuucauaca

SEQ ID NO: 279549 - RNA, 22 nt, Human
cagagaaacucagauagcugau

SEQ ID NO: 279550 - RNA, 22 nt, Human
ucuuccucccuacagagcucag

SEQ ID NO: 279551 - RNA, 22 nt, Human
guagccagaucugcugugucug

SEQ ID NO: 279552 - RNA, 22 nt, Human
agcaggcaguguagagccuuca

SEQ ID NO: 279553 - RNA, 22 nt, Human
guagggacuuguuuuacuagua

SEQ ID NO: 279554 - RNA, 22 nt, Human
uaagugauuuguaguauacuau

SEQ ID NO: 279555 - RNA, 22 nt, Human
aaagccuucugucuagcagaua

SEQ ID NO: 279556 - RNA, 22 nt, Human
gcccggcagucacacacccagg

SEQ ID NO: 279557 - RNA, 22 nt, Human
ugaaggccacuuccugugagcu

SEQ ID NO: 279558 - RNA, 22 nt, Human
gccaucugcgcgguguccagcu

SEQ ID NO: 279559 - RNA, 22 nt, Human
gagcccagucugcuccugcgcc

SEQ ID NO: 279560 - RNA, 22 nt, Human
agcagggcuguguagguaauga

SEQ ID NO: 279561 - RNA, 22 nt, Human
uacugucuuuccauccuugccu

SEQ ID NO: 279562 - RNA, 22 nt, Human
ucuagaauacugugacaugcca

SEQ ID NO: 279563 - RNA, 22 nt, Human
cagcuuguuaccgagggagggu

SEQ ID NO: 279564 - RNA, 22 nt, Human
acaguaccaggccaaaccauga

SEQ ID NO: 279565 - RNA, 22 nt, Human
agaggggcgggaacucaaccuc

SEQ ID NO: 279566 - RNA, 22 nt, Human
ucauaaaacacaccagguaguu

SEQ ID NO: 279567 - RNA, 22 nt, Human
auggcuugcagagaaaagaggu

SEQ ID NO: 279568 - RNA, 22 nt, Human
ccucagagccuccagaaggaau

SEQ ID NO: 279569 - RNA, 22 nt, Human
gucuggugggauuccaaguggc

SEQ ID NO: 279570 - RNA, 22 nt, Human
ucuucuaguaggccaagaagcu

SEQ ID NO: 279571 - RNA, 19 nt, Human
uuguacagcaaccaacccu

SEQ ID NO: 279572 - RNA, 22 nt, Human
aaagcugccaaggagaauacua

SEQ ID NO: 279573 - RNA, 22 nt, Human
accaggcuguugggcccagugu

SEQ ID NO: 279574 - RNA, 23 nt, Human
agucagugcgggauggucagggg

SEQ ID NO: 279575 - RNA, 22 nt, Human
uggccuuccuggugacucauga

SEQ ID NO: 279576 - RNA, 22 nt, Human
caauccaguuucugucagcuac

SEQ ID NO: 279577 - RNA, 22 nt, Human
ggccuuagugagguccugaugc

SEQ ID NO: 279578 - RNA, 22 nt, Human
ugcccagagccugagaggauua

SEQ ID NO: 279579 - RNA, 22 nt, Human
guguggcaccuccuuuccagcu

SEQ ID NO: 279580 - RNA, 22 nt, Human
gaggagcucaugaaagcggugu

SEQ ID NO: 279581 - RNA, 22 nt, Human
ucccuggggaagggcaagcaag

SEQ ID NO: 279582 - RNA, 22 nt, Human
uuauucacucauuuaacauuau

SEQ ID NO: 279583 - RNA, 22 nt, Human
cuuaacagagagaaguguugcu

SEQ ID NO: 279584 - RNA, 22 nt, Human
aggcucagucuguucaugcacu

SEQ ID NO: 279585 - RNA, 22 nt, Human
caguucuggaggcuccacaucu

SEQ ID NO: 279586 - RNA, 22 nt, Human
auuuaaauuuucugauggagag

SEQ ID NO: 279587 - RNA, 22 nt, Human
cucagcuccagcccucagcagc

SEQ ID NO: 279588 - RNA, 22 nt, Human
aucaucaugcccacuugagacu

SEQ ID NO: 279589 - RNA, 18 nt, Human
agggccagcugugaguag

SEQ ID NO: 279590 - RNA, 22 nt, Human
uggcuccuuuccgggucuccag

SEQ ID NO: 279591 - RNA, 22 nt, Human
cagauuuagaguggggcuugga

SEQ ID NO: 279592 - RNA, 22 nt, Human
uuucaaagacagccauauuugu

SEQ ID NO: 279593 - RNA, 22 nt, Human
cuugccugaggaacagagggua

SEQ ID NO: 279594 - RNA, 22 nt, Human
agggcaugaagcaguggacagc

SEQ ID NO: 279595 - RNA, 22 nt, Human
cugcucuguuucuuagcugggu

SEQ ID NO: 279596 - RNA, 22 nt, Human
uuaagugucauaauuuccaaga

SEQ ID NO: 279597 - RNA, 22 nt, Human
cucaaauguuuccacuucugcu

SEQ ID NO: 279598 - RNA, 22 nt, Human
cuggcacaguuaacauaugcua

SEQ ID NO: 279599 - RNA, 22 nt, Human
uacagcuaggcaaaaaugacau

SEQ ID NO: 279600 - RNA, 22 nt, Human
gguggcugaagcagucuucggg

SEQ ID NO: 279601 - RNA, 22 nt, Human
agcugaggccugauuucgccgu

SEQ ID NO: 279602 - RNA, 22 nt, Human
cauguaaaccauugugagcauc

SEQ ID NO: 279603 - RNA, 22 nt, Human
ccuggugcccccaagccagcug

SEQ ID NO: 279604 - RNA, 18 nt, Human
aacaugcauuagaacugc

SEQ ID NO: 279605 - RNA, 23 nt, Human
auuuuuagccucucugagcugag

SEQ ID NO: 279606 - RNA, 22 nt, Human
uuccuucuuugugguagaaagu

SEQ ID NO: 279607 - RNA, 22 nt, Human
acagauacaaauauacaaauac

SEQ ID NO: 279608 - RNA, 22 nt, Human
gaacaaacauuuuuggcaguau

SEQ ID NO: 279609 - RNA, 22 nt, Human
gaggcagaaguugcagugagca

SEQ ID NO: 279610 - RNA, 22 nt, Human
caucuuuguuuuggauauaauc

SEQ ID NO: 279611 - RNA, 22 nt, Human
cucuagcugaggucacugcuau

SEQ ID NO: 279612 - RNA, 22 nt, Human
gaccuggaggauccucuucuug

SEQ ID NO: 279613 - RNA, 22 nt, Human
auuacagaaagcaauauugagu

SEQ ID NO: 279614 - RNA, 22 nt, Human
uuauaacacugccuugucacca

SEQ ID NO: 279615 - RNA, 22 nt, Human
gacccaggguggucaccugaaa

SEQ ID NO: 279616 - RNA, 22 nt, Human
ggguggaagccagagaggucau

SEQ ID NO: 279617 - RNA, 18 nt, Human
ugaucuuugaguauaaug

SEQ ID NO: 279618 - RNA, 22 nt, Human
cacagggaggcagccaugcucc

SEQ ID NO: 279619 - RNA, 22 nt, Human
cucuguagaaacagggcagaag

SEQ ID NO: 279620 - RNA, 22 nt, Human
cucugggcaccaaagagcagcu

SEQ ID NO: 279621 - RNA, 22 nt, Human
ccaggguuucuucucuguauag

SEQ ID NO: 279622 - RNA, 22 nt, Human
cuagggaguggcagagcuggga

SEQ ID NO: 279623 - RNA, 22 nt, Human
uagggaugaugucuaaaaucau

SEQ ID NO: 279624 - RNA, 22 nt, Human
agaacaaggcuguuuccaaugc

SEQ ID NO: 279625 - RNA, 22 nt, Human
acaagucucaacagcagccagc

SEQ ID NO: 279626 - RNA, 22 nt, Human
cucccaggacuggcucuaacug

SEQ ID NO: 279627 - RNA, 22 nt, Human
cuguugcuaaguagugcaggua

SEQ ID NO: 279628 - RNA, 22 nt, Human
acauauauguaaaguacuuugu

SEQ ID NO: 279629 - RNA, 22 nt, Human
uaaaugcaagugcuccugggag

SEQ ID NO: 279630 - RNA, 22 nt, Human
agaaagugccucccuugggagc

SEQ ID NO: 279631 - RNA, 22 nt, Human
ggcuccagcuaaugguuucuau

SEQ ID NO: 279632 - RNA, 22 nt, Human
cugcagagguugguucuaagau

SEQ ID NO: 279633 - RNA, 22 nt, Human
cagcccucaaaccacuuccagg

SEQ ID NO: 279634 - RNA, 22 nt, Human
aagucugccuaaccuucauguu

SEQ ID NO: 279635 - RNA, 22 nt, Human
uaugaaauugccauuuuuaugg

SEQ ID NO: 279636 - RNA, 22 nt, Human
uucuuguuccaugaaagacaga

SEQ ID NO: 279637 - RNA, 17 nt, Human
augcaggugugaggggc

SEQ ID NO: 279638 - RNA, 22 nt, Human
ucaggcagaaaaaucacuaauu

SEQ ID NO: 279639 - RNA, 22 nt, Human
auaguguuagagccaguauguu

SEQ ID NO: 279640 - RNA, 22 nt, Human
aaugccuuggagagccuagagg

SEQ ID NO: 279641 - RNA, 22 nt, Human
uccucagugcuagccaacugcc

SEQ ID NO: 279642 - RNA, 22 nt, Human
gggagggguugcauguuugagu

SEQ ID NO: 279643 - RNA, 22 nt, Human
ugcucaggcccugggccauccu

SEQ ID NO: 279644 - RNA, 22 nt, Human
cuagaaucccaaauggacuggg

SEQ ID NO: 279645 - RNA, 18 nt, Human
auggcuucugaguggagg

SEQ ID NO: 279646 - RNA, 22 nt, Human
cuuccuucaauauaauuuuuac

SEQ ID NO: 279647 - RNA, 22 nt, Human
ugaaugaucuccgauuaguccu

SEQ ID NO: 279648 - RNA, 22 nt, Human
ugagccuggccugcagagacca

SEQ ID NO: 279649 - RNA, 22 nt, Human
uaugcacauauaaccugcacug

SEQ ID NO: 279650 - RNA, 22 nt, Human
gcucugagcacugugcggcugg

SEQ ID NO: 279651 - RNA, 22 nt, Human
ugacuugucucuuugggagaca

SEQ ID NO: 279652 - RNA, 22 nt, Human
uggugcagacaggagccccgcu

SEQ ID NO: 279653 - RNA, 22 nt, Human
ggugcugaauucuggaggaggc

SEQ ID NO: 279654 - RNA, 22 nt, Human
ucacaucugccuccauagcacc

SEQ ID NO: 279655 - RNA, 22 nt, Human
gagacauucuuaggaacaaugu

SEQ ID NO: 279656 - RNA, 22 nt, Human
cuucaaauacaaguagauuaug

SEQ ID NO: 279657 - RNA, 22 nt, Human
cuccuuccugguuagcaccuua

SEQ ID NO: 279658 - RNA, 22 nt, Human
cccugccaggguccugacagac

SEQ ID NO: 279659 - RNA, 22 nt, Human
uugauuucuuacucuuccaagg

SEQ ID NO: 279660 - RNA, 18 nt, Human
ucuagaaacuucucuccu

SEQ ID NO: 279661 - RNA, 22 nt, Human
agcagguggucuguugcugcug

SEQ ID NO: 279662 - RNA, 22 nt, Human
uggaggagaacucccuggcuac

SEQ ID NO: 279663 - RNA, 22 nt, Human
ugcucagacuuaagaagaucag

SEQ ID NO: 279664 - RNA, 22 nt, Human
aaggcaguacuuuauguccaua

SEQ ID NO: 279665 - RNA, 22 nt, Human
caagagcuacccugugccauau

SEQ ID NO: 279666 - RNA, 22 nt, Human
gcuacagagcucugugaagaga

SEQ ID NO: 279667 - RNA, 22 nt, Human
ggcugcccucgucuacugccca

SEQ ID NO: 279668 - RNA, 22 nt, Human
cuuuggaaaguaagcagcuaga

SEQ ID NO: 279669 - RNA, 22 nt, Human
ucaugcucaucauuagagugac

SEQ ID NO: 279670 - RNA, 22 nt, Human
uucaucaccuugguagcacucc

SEQ ID NO: 279671 - RNA, 22 nt, Human
agcaaagauguccggggcaagc

SEQ ID NO: 279672 - RNA, 22 nt, Human
aggaagcuuagugaaaggacca

SEQ ID NO: 279673 - RNA, 22 nt, Human
aaggugggcagaucacaagguc

SEQ ID NO: 279674 - RNA, 22 nt, Human
aaacauucaaagcaggaugugu

SEQ ID NO: 279675 - RNA, 19 nt, Human
uaggccagaaguuuuccac

SEQ ID NO: 279676 - RNA, 22 nt, Human
ucucccaguggugcagaaagca

SEQ ID NO: 279677 - RNA, 22 nt, Human
acuguaacacaaugguaucugu

SEQ ID NO: 279678 - RNA, 22 nt, Human
aggugccaggagggaauuuagg

SEQ ID NO: 279679 - RNA, 22 nt, Human
uaguacacucuguaaguuuaaa

SEQ ID NO: 279680 - RNA, 22 nt, Human
uggguccacaaacaucagauau

SEQ ID NO: 279681 - RNA, 22 nt, Human
uacagcccaagaaguuuauacg

SEQ ID NO: 279682 - RNA, 17 nt, Human
ccugagugggagaggaa

SEQ ID NO: 279683 - RNA, 22 nt, Human
aacuuuggguaaugcuucaauu

SEQ ID NO: 279684 - RNA, 22 nt, Human
gucacaggcaguaacuaggacc

SEQ ID NO: 279685 - RNA, 22 nt, Human
auaaaggcaacaccaggguaug

SEQ ID NO: 279686 - RNA, 22 nt, Human
augggaagguuuugagagcggg

SEQ ID NO: 279687 - RNA, 22 nt, Human
gauacacaaguggaaggagacg

SEQ ID NO: 279688 - RNA, 22 nt, Human
uuacaguuuaccaagaauauug

SEQ ID NO: 279689 - RNA, 22 nt, Human
agaguggcuucuuugacaugcu

SEQ ID NO: 279690 - RNA, 22 nt, Human
ugacucuuggugauuacugggu

SEQ ID NO: 279691 - RNA, 22 nt, Human
caauguaucaagaagcaucagu

SEQ ID NO: 279692 - RNA, 18 nt, Human
accaggaagcuucuuguc

SEQ ID NO: 279693 - RNA, 22 nt, Human
uaaagauaagacaucaacugag

SEQ ID NO: 279694 - RNA, 22 nt, Human
ggcaggaaaacaaugagccagg

SEQ ID NO: 279695 - RNA, 22 nt, Human
ugcagaagacacaagguaacgu

SEQ ID NO: 279696 - RNA, 22 nt, Human
gcuuucugcucuguaaaauggg

SEQ ID NO: 279697 - RNA, 22 nt, Human
ugcacaggugagacucaggaag

SEQ ID NO: 279698 - RNA, 22 nt, Human
gcacugguuacccugaguggcu

SEQ ID NO: 279699 - RNA, 22 nt, Human
uuucagaaggggagaaagguca

SEQ ID NO: 279700 - RNA, 22 nt, Human
cagauguaauuacucaagucaa

SEQ ID NO: 279701 - RNA, 22 nt, Human
ccucucccaggcgcggcggcag

SEQ ID NO: 279702 - RNA, 22 nt, Human
ucuccuggaagaauaccacacu

SEQ ID NO: 279703 - RNA, 16 nt, Human
cagcuuuaugucagug

SEQ ID NO: 279704 - RNA, 22 nt, Human
uaagauguggaaucacagcuuc

SEQ ID NO: 279705 - RNA, 22 nt, Human
agcccagccacuauuaaauguu

SEQ ID NO: 279706 - RNA, 22 nt, Human
guuucauacagauuauucaugg

SEQ ID NO: 279707 - RNA, 22 nt, Human
gagcucagaggauucuggggag

SEQ ID NO: 279708 - RNA, 17 nt, Human
cccagggaccacugcuu

SEQ ID NO: 279709 - RNA, 22 nt, Human
ccuuaggggugacagaaauacc

SEQ ID NO: 279710 - RNA, 21 nt, Human
ugaagggguggcagugugcuu

SEQ ID NO: 279711 - RNA, 22 nt, Human
ugagugaaaaauuugccuggag

SEQ ID NO: 279712 - RNA, 22 nt, Human
aguaaagcagaguugcaguaca

SEQ ID NO: 279713 - RNA, 20 nt, Human
aaauuuaggaaauuuuacgc

SEQ ID NO: 279714 - RNA, 19 nt, Human
gacaauuagagaucacuca

SEQ ID NO: 279715 - RNA, 22 nt, Human
cugcacugaagaaaggagcucu

SEQ ID NO: 279716 - RNA, 22 nt, Human
ucaggagguguaacgaauacag

SEQ ID NO: 279717 - RNA, 22 nt, Human
uuccugcagcaaggagaagcug

SEQ ID NO: 279718 - RNA, 22 nt, Human
ucagggacugcagagggaagcu

SEQ ID NO: 279719 - RNA, 22 nt, Human
aagacuuucccucaucagaacg

SEQ ID NO: 279720 - RNA, 22 nt, Human
cagaaacugcuuguggucaucu

SEQ ID NO: 279721 - RNA, 22 nt, Human
cagagcaugucaacuagcuuua

SEQ ID NO: 279722 - RNA, 22 nt, Human
gcugagucuugccugugcuguc

SEQ ID NO: 279723 - RNA, 22 nt, Human
ucucaaauggcaaauguggguc

SEQ ID NO: 279724 - RNA, 22 nt, Human
uguuuucuuccuaauugcucau

SEQ ID NO: 279725 - RNA, 22 nt, Human
aucucccaaacucauuucuuca

SEQ ID NO: 279726 - RNA, 22 nt, Human
aacuagaaaucacuacagguau

SEQ ID NO: 279727 - RNA, 22 nt, Human
aggaacacccccuuccuaccag

SEQ ID NO: 279728 - RNA, 22 nt, Human
agcugcagaucaauaggcucac

SEQ ID NO: 279729 - RNA, 21 nt, Human
accaggccaggaggcuggcac

SEQ ID NO: 279730 - RNA, 22 nt, Human
caagauuuggcaacuuugucau

SEQ ID NO: 279731 - RNA, 22 nt, Human
uaauuauagccgcuauuuugcu

SEQ ID NO: 279732 - RNA, 22 nt, Human
uauguacauguuaaagggcaaa

SEQ ID NO: 279733 - RNA, 22 nt, Human
caggcugggcugguguuagagu

SEQ ID NO: 279734 - RNA, 22 nt, Human
cagcugguuggaagggagcuga

SEQ ID NO: 279735 - RNA, 22 nt, Human
gauuucuaguucauuaucuauu

SEQ ID NO: 279736 - RNA, 22 nt, Human
gacccugguguccagguccugc

SEQ ID NO: 279737 - RNA, 22 nt, Human
cugggaagaagugggcuacauu

SEQ ID NO: 279738 - RNA, 22 nt, Human
agcagcaguccuuuguguaauu

SEQ ID NO: 279739 - RNA, 20 nt, Human
cuuuuucuccagcucugagc

SEQ ID NO: 279740 - RNA, 22 nt, Human
ccaggugucauggauaaugggu

SEQ ID NO: 279741 - RNA, 22 nt, Human
ucauuguagggcauuuagagag

SEQ ID NO: 279742 - RNA, 22 nt, Human
agggccuugcugucugaagcug

SEQ ID NO: 279743 - RNA, 22 nt, Human
ucugggucuaucccaugccuuu

SEQ ID NO: 279744 - RNA, 22 nt, Human
uaagugguugcuuguuuucauu

SEQ ID NO: 279745 - RNA, 22 nt, Human
ugaggccaaugacccugggcag

SEQ ID NO: 279746 - RNA, 22 nt, Human
agguccugaggguucgucugca

SEQ ID NO: 279747 - RNA, 22 nt, Human
ucagcuuauauuuuuaguguaa

SEQ ID NO: 279748 - RNA, 22 nt, Human
caggcacaggggaaugucuuuu

SEQ ID NO: 279749 - RNA, 22 nt, Human
gaggccuggcugucagucccca

SEQ ID NO: 279750 - RNA, 22 nt, Human
ucccaggaauugaagccagugu

SEQ ID NO: 279751 - RNA, 22 nt, Human
uuuaugaaccacucuacaccuu

SEQ ID NO: 279752 - RNA, 22 nt, Human
gcagcuguggugcugagauagg

SEQ ID NO: 279753 - RNA, 22 nt, Human
uaugaguuguggcuuagucaca

SEQ ID NO: 279754 - RNA, 22 nt, Human
auggaucuaccuucaggcucug

SEQ ID NO: 279755 - RNA, 22 nt, Human
cagcagagcuuauguuggguca

SEQ ID NO: 279756 - RNA, 22 nt, Human
auuuccuauacaguuguccaua

SEQ ID NO: 279757 - RNA, 22 nt, Human
aauuagggaaguauuuaguagu

SEQ ID NO: 279758 - RNA, 22 nt, Human
guauuaggaaauaugaagaaag

SEQ ID NO: 279759 - RNA, 22 nt, Human
gccaaaucuugcacacucuugu

SEQ ID NO: 279760 - RNA, 18 nt, Human
gaggccugagaaccaggu

SEQ ID NO: 279761 - RNA, 22 nt, Human
guaaaggcccauucaaacagcu

SEQ ID NO: 279762 - RNA, 22 nt, Human
acccaggguuccugggucccag

SEQ ID NO: 279763 - RNA, 21 nt, Human
acagacagggccagugucccc

SEQ ID NO: 279764 - RNA, 22 nt, Human
uagggcuggcgugcucagggaa

SEQ ID NO: 279765 - RNA, 22 nt, Human
uggcucuggugcgggcuccugc

SEQ ID NO: 279766 - RNA, 22 nt, Human
aagcagcauuguaaccaaugcc

SEQ ID NO: 279767 - RNA, 21 nt, Human
agcugaaaaguuguuuacaag

SEQ ID NO: 279768 - RNA, 22 nt, Human
gggcuuaaggccagugugcuuu

SEQ ID NO: 279769 - RNA, 22 nt, Human
gcagggagguuugcugaccugg

SEQ ID NO: 279770 - RNA, 22 nt, Human
ugcaggguauccuugucucugc

SEQ ID NO: 279771 - RNA, 22 nt, Human
aaucuuacaccgaauuuaaacu

SEQ ID NO: 279772 - RNA, 22 nt, Human
auguacaauucuccuugguagg

SEQ ID NO: 279773 - RNA, 22 nt, Human
aucauaaaccacuuuguaaucu

SEQ ID NO: 279774 - RNA, 18 nt, Human
uuggaccugugucagggc

SEQ ID NO: 279775 - RNA, 22 nt, Human
ugggaagaagcagagaacugga

SEQ ID NO: 279776 - RNA, 22 nt, Human
acuacacugcccuggggaucaa

SEQ ID NO: 279777 - RNA, 22 nt, Human
cuggucaccuccuucccagcua

SEQ ID NO: 279778 - RNA, 22 nt, Human
guguccugggggacuucagguu

SEQ ID NO: 279779 - RNA, 22 nt, Human
ccugggcuuucaaaaccagccu

SEQ ID NO: 279780 - RNA, 22 nt, Human
uauuaagauacguaguuguaaa

SEQ ID NO: 279781 - RNA, 22 nt, Human
acaaauggaacaaugaagacug

SEQ ID NO: 279782 - RNA, 22 nt, Human
agggccugagcuggcugaccuc

SEQ ID NO: 279783 - RNA, 22 nt, Human
ucaggaucaggggccuuuccuu

SEQ ID NO: 279784 - RNA, 19 nt, Human
cuuuagacacaccuggaca

SEQ ID NO: 279785 - RNA, 22 nt, Human
ugagaaaagguugagaugauaa

SEQ ID NO: 279786 - RNA, 22 nt, Human
ugcuuuauuaagagagaaauuu

SEQ ID NO: 279787 - RNA, 22 nt, Human
guuucucugucuguuacauugg

SEQ ID NO: 279788 - RNA, 22 nt, Human
aaggcaguuaauuuggcuagaa

SEQ ID NO: 279789 - RNA, 20 nt, Human
cagccuccacucacucagcu

SEQ ID NO: 279790 - RNA, 22 nt, Human
ucuaaaaaagucuguucacuug

SEQ ID NO: 279791 - RNA, 22 nt, Human
uaauuuuaugacaguguauuuu

SEQ ID NO: 279792 - RNA, 19 nt, Human
agggaaggauucugucauu

SEQ ID NO: 279793 - RNA, 22 nt, Human
aaagcugcccuacacggaagca

SEQ ID NO: 279794 - RNA, 23 nt, Human
agggaaaguaguaauggccuuug

SEQ ID NO: 279795 - RNA, 22 nt, Human
aaggccagcuuguagggcuggu

SEQ ID NO: 279796 - RNA, 20 nt, Human
agaggcuuccuugggaggag

SEQ ID NO: 279797 - RNA, 22 nt, Human
cccaggcugaguuagagguguc

SEQ ID NO: 279798 - RNA, 22 nt, Human
aagcccugaccugagaguccgu

SEQ ID NO: 279799 - RNA, 22 nt, Human
cuuucagaagccggaagggcag

SEQ ID NO: 279800 - RNA, 22 nt, Human
auuuacagaagcauguaauagc

SEQ ID NO: 279801 - RNA, 22 nt, Human
gcagagugggagcccagggcug

SEQ ID NO: 279802 - RNA, 22 nt, Human
uccuggccacacauuaauagug

SEQ ID NO: 279803 - RNA, 22 nt, Human
uccugggcccuccggaucaggu

SEQ ID NO: 279804 - RNA, 22 nt, Human
gaaugauagagcugccuucgga

SEQ ID NO: 279805 - RNA, 22 nt, Human
gcagggaccucacuacccccag

SEQ ID NO: 279806 - RNA, 22 nt, Human
cacaugaggugacuuccaagcu

SEQ ID NO: 279807 - RNA, 22 nt, Human
auucaacuagugauuguguuau

SEQ ID NO: 279808 - RNA, 22 nt, Human
ucugcagaagcucacuaaaucc

SEQ ID NO: 279809 - RNA, 22 nt, Human
aguggcaguggaaagcacacgg

SEQ ID NO: 279810 - RNA, 22 nt, Human
cucuggcuuuaaggaugccaca

SEQ ID NO: 279811 - RNA, 22 nt, Human
gcaucuaagguggauaacuucu

SEQ ID NO: 279812 - RNA, 22 nt, Human
gcugggugauucauuuccauaa

SEQ ID NO: 279813 - RNA, 22 nt, Human
gagcaguaggagaacccugagc

SEQ ID NO: 279814 - RNA, 22 nt, Human
ugagcugggaagagcagccaga

SEQ ID NO: 279815 - RNA, 18 nt, Human
aaggucugucugguaggu

SEQ ID NO: 279816 - RNA, 22 nt, Human
ccuggcacugaccaggcacuga

SEQ ID NO: 279817 - RNA, 22 nt, Human
aguguucuaacaacugcuuuca

SEQ ID NO: 279818 - RNA, 21 nt, Human
ggaagcaguggcggcaacucc

SEQ ID NO: 279819 - RNA, 22 nt, Human
agcuggagaauguggaugaucc

SEQ ID NO: 279820 - RNA, 22 nt, Human
uuugaaaauuuaagugcuacac

SEQ ID NO: 279821 - RNA, 22 nt, Human
agaaggcucauuugacugcauu

SEQ ID NO: 279822 - RNA, 22 nt, Human
gccucagaaaguggcagguagg

SEQ ID NO: 279823 - RNA, 22 nt, Human
gcucaggcuggauugcaguggc

SEQ ID NO: 279824 - RNA, 22 nt, Human
gcugccugggcaggaggcgcug

SEQ ID NO: 279825 - RNA, 22 nt, Human
agccuauuccaggaugagcuca

SEQ ID NO: 279826 - RNA, 22 nt, Human
ucuucuccauaaucaacacucu

SEQ ID NO: 279827 - RNA, 21 nt, Human
gcugccaccgcgugcuccagg

SEQ ID NO: 279828 - RNA, 22 nt, Human
ucuggagggcccacauccacaa

SEQ ID NO: 279829 - RNA, 18 nt, Human
agggcugaugaguuuggg

SEQ ID NO: 279830 - RNA, 22 nt, Human
cuguccagucagaacgucauua

SEQ ID NO: 279831 - RNA, 22 nt, Human
uauacuucccugcagaguaaag

SEQ ID NO: 279832 - RNA, 22 nt, Human
guuucacauaauuuuaaauugu

SEQ ID NO: 279833 - RNA, 22 nt, Human
uuccuggagaguuuucccaaag

SEQ ID NO: 279834 - RNA, 22 nt, Human
ggcucuggagauguccgaccug

SEQ ID NO: 279835 - RNA, 22 nt, Human
ugcaacaguggggcaugcugaa

SEQ ID NO: 279836 - RNA, 23 nt, Human
uagaucuucaucuaauucuguag

SEQ ID NO: 279837 - RNA, 22 nt, Human
caggaucccuggccuccgccca

SEQ ID NO: 279838 - RNA, 22 nt, Human
agaauuguugggguaauaaaag

SEQ ID NO: 279839 - RNA, 22 nt, Human
cagcuuauucaguaagcacaua

SEQ ID NO: 279840 - RNA, 22 nt, Human
acaauaguaagguauauuguca

SEQ ID NO: 279841 - RNA, 22 nt, Human
guauagaaggaucuggugaauu

SEQ ID NO: 279842 - RNA, 22 nt, Human
ucauagaaauaucacgucuuuu

SEQ ID NO: 279843 - RNA, 22 nt, Human
cagggcugugcccaucuucccc

SEQ ID NO: 279844 - RNA, 22 nt, Human
cuugcuuuugcugaugauuaag

SEQ ID NO: 279845 - RNA, 22 nt, Human
aaguucaaggugauaguggcag

SEQ ID NO: 279846 - RNA, 22 nt, Human
cccaggcugauguucagcgggu

SEQ ID NO: 279847 - RNA, 22 nt, Human
cagggccagccauccugcuggg

SEQ ID NO: 279848 - RNA, 22 nt, Human
auuuaagacugacuucaccagu

SEQ ID NO: 279849 - RNA, 22 nt, Human
cagcaggcaggugggccaaguc

SEQ ID NO: 279850 - RNA, 22 nt, Human
accauagacuggaggaucuccu

SEQ ID NO: 279851 - RNA, 22 nt, Human
gggugcugggaggcugacaucu

SEQ ID NO: 279852 - RNA, 22 nt, Human
uugcauuucacuuucaguaggc

SEQ ID NO: 279853 - RNA, 22 nt, Human
uccuccagcuguauccugccug

SEQ ID NO: 279854 - RNA, 19 nt, Human
ccagagguuugcugggccu

SEQ ID NO: 279855 - RNA, 22 nt, Human
caguguggagggagagagccug

SEQ ID NO: 279856 - RNA, 22 nt, Human
agcuuuauauuuaaugaauucu

SEQ ID NO: 279857 - RNA, 22 nt, Human
gagcccugagaguugugaggcc

SEQ ID NO: 279858 - RNA, 22 nt, Human
cagugcagacguggagggggca

SEQ ID NO: 279859 - RNA, 22 nt, Human
ggccucugguucacagggagga

SEQ ID NO: 279860 - RNA, 22 nt, Human
uucagaaagugaaucuuguuau

SEQ ID NO: 279861 - RNA, 23 nt, Human
gggaagcuccauggaggugcugg

SEQ ID NO: 279862 - RNA, 22 nt, Human
uagaacuucuuacagcuaaguu

SEQ ID NO: 279863 - RNA, 22 nt, Human
gcauguuuugcaacaagugacc

SEQ ID NO: 279864 - RNA, 22 nt, Human
cuuggggcuuuguguguaggau

SEQ ID NO: 279865 - RNA, 22 nt, Human
aggacagaccuaggacuggagc

SEQ ID NO: 279866 - RNA, 22 nt, Human
accuacauggcuuuaaguaagu

SEQ ID NO: 279867 - RNA, 18 nt, Human
uuaaggauaagcagacua

SEQ ID NO: 279868 - RNA, 22 nt, Human
cuugcuggugucgugccuucac

SEQ ID NO: 279869 - RNA, 22 nt, Human
aaguaaauaucuguuuauagca

SEQ ID NO: 279870 - RNA, 22 nt, Human
uuuccuaguucuaagaaaugua

SEQ ID NO: 279871 - RNA, 22 nt, Human
ggaaucuucagccaugccaaga

SEQ ID NO: 279872 - RNA, 22 nt, Human
uguggggaagaguaugacuugg

SEQ ID NO: 279873 - RNA, 22 nt, Human
gcuggcucugcacccaggccuc

SEQ ID NO: 279874 - RNA, 22 nt, Human
cggcagagcccugagucagccu

SEQ ID NO: 279875 - RNA, 22 nt, Human
gggcuaagcagagugggaacag

SEQ ID NO: 279876 - RNA, 22 nt, Human
ugaggccaagccuccucugcca

SEQ ID NO: 279877 - RNA, 22 nt, Human
uucacagcucauacuguucuca

SEQ ID NO: 279878 - RNA, 22 nt, Human
caucugcaggggaagccaguuu

SEQ ID NO: 279879 - RNA, 22 nt, Human
uccugcagccauuagaggucaa

SEQ ID NO: 279880 - RNA, 22 nt, Human
ucacagcucacuguagccucga

SEQ ID NO: 279881 - RNA, 18 nt, Human
cuaagaggucguuucuca

SEQ ID NO: 279882 - RNA, 22 nt, Human
aggccagggcacugcucuuuag

SEQ ID NO: 279883 - RNA, 22 nt, Human
ucacagcugggguuuuggcagc

SEQ ID NO: 279884 - RNA, 22 nt, Human
caaagaagagauuuacagagcu

SEQ ID NO: 279885 - RNA, 22 nt, Human
acaggaaaugaaaugguaucua

SEQ ID NO: 279886 - RNA, 22 nt, Human
cagaggccuggcuuggacaccu

SEQ ID NO: 279887 - RNA, 22 nt, Human
uucagcacuggacagcgagucu

SEQ ID NO: 279888 - RNA, 22 nt, Human
agccaccaccacugaaagguua

SEQ ID NO: 279889 - RNA, 22 nt, Human
auuggagccccagaagcaaggu

SEQ ID NO: 279890 - RNA, 22 nt, Human
ccugcagacacuuguccagcaa

SEQ ID NO: 279891 - RNA, 22 nt, Human
aggaaaugccgcggcucucuuu

SEQ ID NO: 279892 - RNA, 22 nt, Human
gaggcucagagggacuuucaag

SEQ ID NO: 279893 - RNA, 22 nt, Human
ugcagugaugcuucuggcucag

SEQ ID NO: 279894 - RNA, 22 nt, Human
uucacagcuaagagcuaaguaa

SEQ ID NO: 279895 - RNA, 22 nt, Human
uggccagucuuagcugugccug

SEQ ID NO: 279896 - RNA, 22 nt, Human
ggcuacagcgggguggagacgg

SEQ ID NO: 279897 - RNA, 22 nt, Human
cucugcaggcacccaggguggg

SEQ ID NO: 279898 - RNA, 22 nt, Human
uggcagccugcgugaaggagcu

SEQ ID NO: 279899 - RNA, 21 nt, Human
auucaaagaagaggaaggccc

SEQ ID NO: 279900 - RNA, 22 nt, Human
aggccagugguucucugugucc

SEQ ID NO: 279901 - RNA, 22 nt, Human
uucacagaauugucuugacugg

SEQ ID NO: 279902 - RNA, 22 nt, Human
cagaggccccauuggcugugcg

SEQ ID NO: 279903 - RNA, 22 nt, Human
ugcgggucccagggucacaggc

SEQ ID NO: 279904 - RNA, 22 nt, Human
ggcucacgcaauuaucccggcc

SEQ ID NO: 279905 - RNA, 22 nt, Human
ggacucucaggcugucggcuuc

SEQ ID NO: 279906 - RNA, 22 nt, Human
gggagccagcagggcauggagc

SEQ ID NO: 279907 - RNA, 20 nt, Human
aggaaggagaaucugagcaa

SEQ ID NO: 279908 - RNA, 22 nt, Human
gaaggaagcugucuggaugugu

SEQ ID NO: 279909 - RNA, 22 nt, Human
cacagcuaccugcaugccugcu

SEQ ID NO: 279910 - RNA, 22 nt, Human
gcagucauggguagaacucaag

SEQ ID NO: 279911 - RNA, 22 nt, Human
uggagccagcaggacucagagg

SEQ ID NO: 279912 - RNA, 20 nt, Human
aaaaacaguaaugcugaaga

SEQ ID NO: 279913 - RNA, 22 nt, Human
caggaaauucccagaaggacug

SEQ ID NO: 279914 - RNA, 22 nt, Human
cuucagagugacucagcaucuu

SEQ ID NO: 279915 - RNA, 22 nt, Human
aggccagaacagcucugcacca

SEQ ID NO: 279916 - RNA, 22 nt, Human
aguaucagaugugauuaaaggg

SEQ ID NO: 279917 - RNA, 22 nt, Human
agccucucuguuagucacuggg

SEQ ID NO: 279918 - RNA, 22 nt, Human
ucucucugcagcccgggacacu

SEQ ID NO: 279919 - RNA, 22 nt, Hepatitis D virus
acugguccccaauguucaaagu

SEQ ID NO: 279920 - RNA, 22 nt, Hepatitis D virus
agggagagccacuuuucucucg

SEQ ID NO: 279921 - RNA, 21 nt, Hepatitis D virus
cuagagagauuuguggguccc

SEQ ID NO: 279922 - RNA, 22 nt, Hepatitis D virus
cuagagagauuuguggguccca

SEQ ID NO: 279923 - RNA, 22 nt, Human
gagcugaaucagagauauuauu

SEQ ID NO: 279924 - RNA, 22 nt, Human
cuggugcacuacagccuggaac

SEQ ID NO: 279925 - RNA, 23 nt, Human
aagaaucucagaauuagaaauac

SEQ ID NO: 279926 - RNA, 22 nt, Human
guuuacaguggcuucauuggau

SEQ ID NO: 279927 - RNA, 22 nt, Human
aauuaucagauauaaaacugca

SEQ ID NO: 279928 - RNA, 22 nt, Human
gauguguccuuuucuccaucca

SEQ ID NO: 279929 - RNA, 22 nt, Human
cugggguggauggguccaaguu

SEQ ID NO: 279930 - RNA, 22 nt, Human
ucucugaaggggagcuguuuaa

SEQ ID NO: 279931 - RNA, 20 nt, Human
gcuguggccgugccagacuc

SEQ ID NO: 279932 - RNA, 22 nt, Human
guguuuguuuagugcagagaga

SEQ ID NO: 279933 - RNA, 22 nt, Human
uuacagugacaguugcuaugau

SEQ ID NO: 279934 - RNA, 21 nt, Human
uguguaauauguauaagaaua

SEQ ID NO: 279935 - RNA, 22 nt, Human
aaucuauaugcuuuucacauac

SEQ ID NO: 279936 - RNA, 22 nt, Human
aagcagagguagggugugcagu

SEQ ID NO: 279937 - RNA, 22 nt, Human
uuuaagacuuagauuuauuggg

SEQ ID NO: 279938 - RNA, 22 nt, Human
acuguucauccuuuuugaacaa

SEQ ID NO: 279939 - RNA, 22 nt, Human
cagagcacugcuuggaggauuu

SEQ ID NO: 279940 - RNA, 22 nt, Human
uauuucccagggagcaacaagc

SEQ ID NO: 279941 - RNA, 22 nt, Human
ccagggcaauaggaacacuuuu

SEQ ID NO: 279942 - RNA, 22 nt, Human
ggaacacagugccuuacaaacu

SEQ ID NO: 279943 - RNA, 19 nt, Human
ccauuguaaagaaaaaugu

SEQ ID NO: 279944 - RNA, 22 nt, Human
uaagagaauguuguggcuaggu

SEQ ID NO: 279945 - RNA, 22 nt, Human
aguauacauauauuagccuucg

SEQ ID NO: 279946 - RNA, 19 nt, Human
uccuggcauuuguaggaaa

SEQ ID NO: 279947 - RNA, 22 nt, Human
ucagagaguuacacaaauuguu

SEQ ID NO: 279948 - RNA, 22 nt, Human
aaugacagagcacugaacuugg

SEQ ID NO: 279949 - RNA, 22 nt, Human
caggaaaucagaacucaagugg

SEQ ID NO: 279950 - RNA, 23 nt, Human
acagugugguggacaaggagcag

SEQ ID NO: 279951 - RNA, 18 nt, Human
ccuggaggucuucggggu

SEQ ID NO: 279952 - RNA, 22 nt, Human
aauuucuucagcucuaaaaugg

SEQ ID NO: 279953 - RNA, 22 nt, Human
cagauggauuuuguaggcugau

SEQ ID NO: 279954 - RNA, 22 nt, Human
augcagaagcagaacuuacaca

SEQ ID NO: 279955 - RNA, 22 nt, Human
gaggcacauauauacagagccc

SEQ ID NO: 279956 - RNA, 22 nt, Human
gcauguguuagagugugcaugc

SEQ ID NO: 279957 - RNA, 22 nt, Human
acagggauuaugacugacagcc

SEQ ID NO: 279958 - RNA, 22 nt, Human
uuggauccaucucaggcauagg

SEQ ID NO: 279959 - RNA, 22 nt, Human
ugcaggugugugcaagggaggg

SEQ ID NO: 279960 - RNA, 22 nt, Human
uccuggguccugggaagcccug

SEQ ID NO: 279961 - RNA, 22 nt, Human
uccucagaagaaccccuagauu

SEQ ID NO: 279962 - RNA, 22 nt, Human
gaaauauuucucuugagccccu

SEQ ID NO: 279963 - RNA, 22 nt, Human
uugcuuuaagguaucuggagaa

SEQ ID NO: 279964 - RNA, 22 nt, Human
gaggcugcggggaggagccugc

SEQ ID NO: 279965 - RNA, 22 nt, Human
cucugcccccagcuggugcuug

SEQ ID NO: 279966 - RNA, 22 nt, Human
acuuccuuguacugacuccauu

SEQ ID NO: 279967 - RNA, 22 nt, Human
gcagggcaucccugagcgggug

SEQ ID NO: 279968 - RNA, 22 nt, Human
ucuguucauuugccucggcucu

SEQ ID NO: 279969 - RNA, 22 nt, Human
aagguuaaauagguauuuucca

SEQ ID NO: 279970 - RNA, 22 nt, Human
auuccaguuggguucuaauaca

SEQ ID NO: 279971 - RNA, 22 nt, Human
gagaaacugaauauuuaacggg

SEQ ID NO: 279972 - RNA, 22 nt, Human
uacagauaacugaaugcagacu

SEQ ID NO: 279973 - RNA, 22 nt, Human
uagaaaacuaauacaugcuuga

SEQ ID NO: 279974 - RNA, 22 nt, Human
ccuggagggcgccgcacagucc

SEQ ID NO: 279975 - RNA, 22 nt, Human
uuacagcagcagggacagacua

SEQ ID NO: 279976 - RNA, 22 nt, Human
uuccugugccucaggucucagc

SEQ ID NO: 279977 - RNA, 20 nt, Human
caccuucaaauuuccuggca

SEQ ID NO: 279978 - RNA, 22 nt, Human
auuuucagagacaucuggacuu

SEQ ID NO: 279979 - RNA, 22 nt, Human
aguguuugucccguuagaaaug

SEQ ID NO: 279980 - RNA, 22 nt, Human
ucaacuaaggcacaaucucuaa

SEQ ID NO: 279981 - RNA, 22 nt, Human
gcagcuuucuugcccuaaucuu

SEQ ID NO: 279982 - RNA, 22 nt, Human
ucuucaaauccuacagugucug

SEQ ID NO: 279983 - RNA, 20 nt, Human
uacauucaaaacaaacucug

SEQ ID NO: 279984 - RNA, 22 nt, Human
ccuguggcuuccacgaccuaau

SEQ ID NO: 279985 - RNA, 18 nt, Human
ucauuuguuuugcaugaa

SEQ ID NO: 279986 - RNA, 22 nt, Human
accugcagguguuuccacacuu

SEQ ID NO: 279987 - RNA, 22 nt, Human
ugacaagaucacagucaagugu

SEQ ID NO: 279988 - RNA, 22 nt, Human
caucuuuuggccuauucugagg

SEQ ID NO: 279989 - RNA, 22 nt, Human
caaaaugugagucccaccucaa

SEQ ID NO: 279990 - RNA, 22 nt, Human
ggacaggugcaaagggcacaug

SEQ ID NO: 279991 - RNA, 20 nt, Human
agaaaaaguguggaaauuuc

SEQ ID NO: 279992 - RNA, 22 nt, Human
uagagaaacagaaccaacaggg

SEQ ID NO: 279993 - RNA, 22 nt, Human
uauuugaagggagaaagugcca

SEQ ID NO: 279994 - RNA, 22 nt, Human
uuuaaauguucaugauacugaa

SEQ ID NO: 279995 - RNA, 22 nt, Human
acuuaaaaccagacagcgucau

SEQ ID NO: 279996 - RNA, 22 nt, Human
aauuaacuaauuugguacaaga

SEQ ID NO: 279997 - RNA, 22 nt, Human
gcaggugugaaugugaauuaag

SEQ ID NO: 279998 - RNA, 22 nt, Human
cuuauugaaagccccugugccu

SEQ ID NO: 279999 - RNA, 22 nt, Human
guacuucccugggaggcaagca

SEQ ID NO: 280000 - RNA, 22 nt, Human
agaggggaguccuaaucugauu

SEQ ID NO: 280001 - RNA, 22 nt, Human
acugcugagagcaaucccaaac

SEQ ID NO: 280002 - RNA, 22 nt, Human
uagcuuuagaaauauucucaga

SEQ ID NO: 280003 - RNA, 22 nt, Human
ccuagagcucugcuuuaucuaa

SEQ ID NO: 280004 - RNA, 22 nt, Human
cuucacauguuggaguccuuug

SEQ ID NO: 280005 - RNA, 22 nt, Human
gcugccagucuaaugggaaaca

SEQ ID NO: 280006 - RNA, 22 nt, Human
ccucaagucaauucugucucgc

SEQ ID NO: 280007 - RNA, 22 nt, Human
agguggggaggagugucucuuu

SEQ ID NO: 280008 - RNA, 22 nt, Human
accuguuuucagaaaaugcaga

SEQ ID NO: 280009 - RNA, 22 nt, Human
uuagagaaccaaugaauagucu

SEQ ID NO: 280010 - RNA, 22 nt, Human
aauguuuuauagcucaagcaau

SEQ ID NO: 280011 - RNA, 22 nt, Human
ccuggcagcccagagcgccgcu

SEQ ID NO: 280012 - RNA, 22 nt, Human
ucagaaauguaagcugaugacu

SEQ ID NO: 280013 - RNA, 22 nt, Human
ugacagguucguuagucauguu

SEQ ID NO: 280014 - RNA, 18 nt, Human
auggucucauacugggag

SEQ ID NO: 280015 - RNA, 22 nt, Human
aaguguuuaaauuauuugcagg

SEQ ID NO: 280016 - RNA, 22 nt, Human
caaauuuaagugaggucuuugu

SEQ ID NO: 280017 - RNA, 22 nt, Human
gugguacagcugaaaggcuugc

SEQ ID NO: 280018 - RNA, 22 nt, Human
uaauuucacugauaugaaguca

SEQ ID NO: 280019 - RNA, 22 nt, Human
ucuguucauacagaguauagua

SEQ ID NO: 280020 - RNA, 22 nt, Human
cccugcagaccaaugccauaga

SEQ ID NO: 280021 - RNA, 22 nt, Human
agauaacucauuuuguauaucc

SEQ ID NO: 280022 - RNA, 22 nt, Human
gaugggcguggcgcguuuggug

SEQ ID NO: 280023 - RNA, 22 nt, Human
uccuggugcugacacccauagc

SEQ ID NO: 280024 - RNA, 22 nt, Human
guuggcaaguguuccuuccucu

SEQ ID NO: 280025 - RNA, 22 nt, Human
ccaggcagcaaauuuucugaau

SEQ ID NO: 280026 - RNA, 22 nt, Human
acacauaagccuaaucaucucc

SEQ ID NO: 280027 - RNA, 22 nt, Human
gcugugcccagcuccagcucug

SEQ ID NO: 280028 - RNA, 22 nt, Human
ggcaggcaggagcgugcuuggg

SEQ ID NO: 280029 - RNA, 22 nt, Human
cauuuguucugauuucaaaagg

SEQ ID NO: 280030 - RNA, 22 nt, Human
gcuuuaaugaagucacgcaaag

SEQ ID NO: 280031 - RNA, 22 nt, Human
aguacacaagacacauuuaaaa

SEQ ID NO: 280032 - RNA, 21 nt, Human
gcauucuucaugugauucaga

SEQ ID NO: 280033 - RNA, 22 nt, Human
ucuccugggaggacaaggaagg

SEQ ID NO: 280034 - RNA, 22 nt, Human
ccaugacauuuuaauuuucacu

SEQ ID NO: 280035 - RNA, 22 nt, Human
agaaaauaaauugaugguggaa

SEQ ID NO: 280036 - RNA, 22 nt, Human
guacacauauauuaaaaauugu

SEQ ID NO: 280037 - RNA, 22 nt, Human
gugaggucuuugggaggugauu

SEQ ID NO: 280038 - RNA, 22 nt, Human
uccaggcaucuguauuuuuuaa

SEQ ID NO: 280039 - RNA, 20 nt, Human
ccugucuccucuuaccuggc

SEQ ID NO: 280040 - RNA, 22 nt, Human
uuauuuucagcuaggaaagcca

SEQ ID NO: 280041 - RNA, 22 nt, Human
auugaaaaugacauuugugccc

SEQ ID NO: 280042 - RNA, 22 nt, Human
gacagguggguaccuuuaugga

SEQ ID NO: 280043 - RNA, 22 nt, Human
ccugaaaugacuccagcugagu

SEQ ID NO: 280044 - RNA, 21 nt, Human
uuucauugaaugagauaaggu

SEQ ID NO: 280045 - RNA, 22 nt, Human
caugacaaaucagaggggcuug

SEQ ID NO: 280046 - RNA, 22 nt, Human
uuccuucuuccuuuaguaacca

SEQ ID NO: 280047 - RNA, 22 nt, Human
cugcagggaacugaggcccaga

SEQ ID NO: 280048 - RNA, 23 nt, Human
aaauucaguccuucaacucugag

SEQ ID NO: 280049 - RNA, 22 nt, Human
ugcaaacaucaauggccugagc

SEQ ID NO: 280050 - RNA, 22 nt, Human
auuuguagugaagugaaaauaa

SEQ ID NO: 280051 - RNA, 22 nt, Human
uuuucauugagcaccugaguaa

SEQ ID NO: 280052 - RNA, 22 nt, Human
caauacuuccuuguuagaggca

SEQ ID NO: 280053 - RNA, 22 nt, Human
caggguggaagcuguagagugg

SEQ ID NO: 280054 - RNA, 22 nt, Human
uuguuuugcuaaagggucauca

SEQ ID NO: 280055 - RNA, 22 nt, Human
caguuucccugcuugaaaacgu

SEQ ID NO: 280056 - RNA, 22 nt, Human
aaguguuuggggaucauuuuaa

SEQ ID NO: 280057 - RNA, 22 nt, Human
cuggcaguauuaagagaaguga

SEQ ID NO: 280058 - RNA, 22 nt, Human
ucuuuccuagaggcugaugagu

SEQ ID NO: 280059 - RNA, 22 nt, Human
gccugagcuuuaauuuucuugu

SEQ ID NO: 280060 - RNA, 22 nt, Human
acuggcagugucguuuacauga

SEQ ID NO: 280061 - RNA, 22 nt, Human
auuagauauuugcuguuggauu

SEQ ID NO: 280062 - RNA, 22 nt, Human
acagcaugagagaugaacauuc

SEQ ID NO: 280063 - RNA, 22 nt, Human
ucugucuucuucauugccuaua

SEQ ID NO: 280064 - RNA, 22 nt, Human
gcuuuacauaaacauuuauuau

SEQ ID NO: 280065 - RNA, 22 nt, Human
ucgccaucgucggacacaguga

SEQ ID NO: 280066 - RNA, 22 nt, Human
uucaggaauauaggcauugaca

SEQ ID NO: 280067 - RNA, 22 nt, Human
uguuauugucgcugcacuggga

SEQ ID NO: 280068 - RNA, 22 nt, Human
uaaagguagugugacauauugu

SEQ ID NO: 280069 - RNA, 22 nt, Human
agugucuguuacgcuugcagaa

SEQ ID NO: 280070 - RNA, 22 nt, Human
gcacuggaaauaccuagaugaa

SEQ ID NO: 280071 - RNA, 22 nt, Human
gcaggaggagcauuaacugagc

SEQ ID NO: 280072 - RNA, 22 nt, Human
cugcagagcagccaguccccca

SEQ ID NO: 280073 - RNA, 22 nt, Human
ggacaguugguugggcucuugu

SEQ ID NO: 280074 - RNA, 22 nt, Human
ucuguggccuguguccaagugc

SEQ ID NO: 280075 - RNA, 22 nt, Human
gaugccuggcacccagcaagga

SEQ ID NO: 280076 - RNA, 22 nt, Human
aagucucugguugcuugcaugg

SEQ ID NO: 280077 - RNA, 22 nt, Human
acacaugaguucucaucuugug

SEQ ID NO: 280078 - RNA, 22 nt, Human
acacagcaacuugcaguaugga

SEQ ID NO: 280079 - RNA, 21 nt, Human
ccuggccaaucugauaggguu

SEQ ID NO: 280080 - RNA, 22 nt, Human
aaggugucacugggacaggaaa

SEQ ID NO: 280081 - RNA, 22 nt, Human
ugcuuuauggagcccaucucau

SEQ ID NO: 280082 - RNA, 23 nt, Human
ccagugauugccuggaaggaggu

SEQ ID NO: 280083 - RNA, 22 nt, Human
uuccauuuauucuuguccagau

SEQ ID NO: 280084 - RNA, 22 nt, Human
aagacaggaacauagcaaaucc

SEQ ID NO: 280085 - RNA, 22 nt, Human
aguguacaucagaacauaucaa

SEQ ID NO: 280086 - RNA, 22 nt, Human
uaugagaaaggagaaugacuuu

SEQ ID NO: 280087 - RNA, 22 nt, Human
augcagcuauuugagcauguca

SEQ ID NO: 280088 - RNA, 22 nt, Human
gcuagaaaucgacuucagaauu

SEQ ID NO: 280089 - RNA, 22 nt, Human
cacuguggcaaccugugcccaa

SEQ ID NO: 280090 - RNA, 22 nt, Human
cugcaggggccucgagcacagg

SEQ ID NO: 280091 - RNA, 22 nt, Human
acaaagauucauuugcauuauu

SEQ ID NO: 280092 - RNA, 22 nt, Human
ucagugcagggugggagagaga

SEQ ID NO: 280093 - RNA, 22 nt, Human
aacauuuccggccuuuuguucu

SEQ ID NO: 280094 - RNA, 22 nt, Human
agcugcaaaccaggccggcgcg

SEQ ID NO: 280095 - RNA, 22 nt, Human
agagccaggcaggcaauguuga

SEQ ID NO: 280096 - RNA, 22 nt, Human
gcguccagggaaggcccagcug

SEQ ID NO: 280097 - RNA, 22 nt, Human
aagcaaagugaauuuugccaag

SEQ ID NO: 280098 - RNA, 22 nt, Human
gcuuuacauuuuggaaagguga

SEQ ID NO: 280099 - RNA, 22 nt, Human
uuccuucucuguggggaaggca

SEQ ID NO: 280100 - RNA, 22 nt, Human
augauguugauaaauuacuuua

SEQ ID NO: 280101 - RNA, 22 nt, Human
auuguacagaugagguaaguga

SEQ ID NO: 280102 - RNA, 22 nt, Human
uacugucuaauaagauugaugg

SEQ ID NO: 280103 - RNA, 22 nt, Human
uuacauauuauccaaaacugcu

SEQ ID NO: 280104 - RNA, 22 nt, Human
agucaguucauggcucuguccu

SEQ ID NO: 280105 - RNA, 22 nt, Human
ggccagaaguuggaaaagagcc

SEQ ID NO: 280106 - RNA, 22 nt, Human
agacaauauauaauuuuaguug

SEQ ID NO: 280107 - RNA, 22 nt, Human
agaucuuuagaagauagaauca

SEQ ID NO: 280108 - RNA, 22 nt, Human
aaagccuuuucuguuuaacaca

SEQ ID NO: 280109 - RNA, 22 nt, Human
aucauuccacauguaccacuag

SEQ ID NO: 280110 - RNA, 22 nt, Human
ucuuagaaugucaacugauguu

SEQ ID NO: 280111 - RNA, 22 nt, Human
agugcaggcucgcuugugaggc

SEQ ID NO: 280112 - RNA, 22 nt, Human
accuucaacucaaaguguccca

SEQ ID NO: 280113 - RNA, 22 nt, Human
aguacaaaaugcagcaucauca

SEQ ID NO: 280114 - RNA, 22 nt, Human
uguuggaaaagaauuaacuagg

SEQ ID NO: 280115 - RNA, 22 nt, Human
uguuucuaggucaauaauuuuu

SEQ ID NO: 280116 - RNA, 22 nt, Human
ggagaggguagggguccugccc

SEQ ID NO: 280117 - RNA, 22 nt, Human
acugaaugaggggugaucuggg

SEQ ID NO: 280118 - RNA, 22 nt, Human
gcagcuuuggagguggaacucu

SEQ ID NO: 280119 - RNA, 22 nt, Human
gacaaaaguguuuugaacaagg

SEQ ID NO: 280120 - RNA, 22 nt, Human
cagagucagagcaccugggauu

SEQ ID NO: 280121 - RNA, 22 nt, Human
gccugcagccucagagaauuuu

SEQ ID NO: 280122 - RNA, 22 nt, Human
aguccuggcauauagguccuca

SEQ ID NO: 280123 - RNA, 22 nt, Human
uuccuucuagcccaaguauugg

SEQ ID NO: 280124 - RNA, 22 nt, Human
uccugagguggauugagcagag

SEQ ID NO: 280125 - RNA, 22 nt, Human
aagggcagccugacucacgguc

SEQ ID NO: 280126 - RNA, 22 nt, Human
auugcuggcaucagugacaaua

SEQ ID NO: 280127 - RNA, 22 nt, Human
ccuccuggagcauuggugagga

SEQ ID NO: 280128 - RNA, 22 nt, Human
cuguguccauuuaucauuguca

SEQ ID NO: 280129 - RNA, 22 nt, Human
ccuggcagacugugagggcagg

SEQ ID NO: 280130 - RNA, 22 nt, Human
aaaagucuacaagcuucaacaa

SEQ ID NO: 280131 - RNA, 21 nt, Human
acagcaagccuucacaugagu

SEQ ID NO: 280132 - RNA, 23 nt, Human
uggaaucagccuuuuuuccaagg

SEQ ID NO: 280133 - RNA, 22 nt, Human
uccuggccuugcgucuugggag

SEQ ID NO: 280134 - RNA, 22 nt, Human
agccuugaaccaauuguuuagc

SEQ ID NO: 280135 - RNA, 22 nt, Human
auuuauugguuugcauggugaa

SEQ ID NO: 280136 - RNA, 22 nt, Human
gacagaggagaagaugcugugg

SEQ ID NO: 280137 - RNA, 22 nt, Human
ugucauuuccugaaugcugagu

SEQ ID NO: 280138 - RNA, 18 nt, Human
ugaccugcgcuucacggu

SEQ ID NO: 280139 - RNA, 22 nt, Human
gaaaaaugcuccaaaucugugg

SEQ ID NO: 280140 - RNA, 22 nt, Human
aagagaugauggcagccagagg

SEQ ID NO: 280141 - RNA, 22 nt, Human
ccagcuuuccugcgaguugauu

SEQ ID NO: 280142 - RNA, 22 nt, Human
ccuucucucugaagaccccaaa

SEQ ID NO: 280143 - RNA, 22 nt, Human
gguguccuuugggggcuccgag

SEQ ID NO: 280144 - RNA, 22 nt, Human
uauugauaugcagaacugacuu

SEQ ID NO: 280145 - RNA, 22 nt, Human
ugcaaaaaggcagacuggugau

SEQ ID NO: 280146 - RNA, 22 nt, Human
accaggcagcaccaaagccggu

SEQ ID NO: 280147 - RNA, 22 nt, Human
ugacauguaagauggaaaagcg

SEQ ID NO: 280148 - RNA, 22 nt, Human
ucuuuggcuugucuccucaguu

SEQ ID NO: 280149 - RNA, 22 nt, Human
uggcaaagcuagacauucccuc

SEQ ID NO: 280150 - RNA, 22 nt, Human
guaucuaugauccuuuauaucu

SEQ ID NO: 280151 - RNA, 22 nt, Human
gaguuagagccauagagcacgg

SEQ ID NO: 280152 - RNA, 22 nt, Human
aagucauuaucucuucuaaucu

SEQ ID NO: 280153 - RNA, 22 nt, Human
ugucuuucugacccaagguagu

SEQ ID NO: 280154 - RNA, 22 nt, Human
gagcuuuaagggcacuggucuu

SEQ ID NO: 280155 - RNA, 22 nt, Human
auuuuacauaaggaagguuuaa

SEQ ID NO: 280156 - RNA, 22 nt, Human
augcuuuuccaggagaaauaua

SEQ ID NO: 280157 - RNA, 22 nt, Human
uggagggaacccaggcugcucu

SEQ ID NO: 280158 - RNA, 22 nt, Human
ugacugaaauggcgacagugaa

SEQ ID NO: 280159 - RNA, 22 nt, Human
aauucuauaggcaagcuauuuu

SEQ ID NO: 280160 - RNA, 22 nt, Human
uauuuugcguugagucagauuu

SEQ ID NO: 280161 - RNA, 23 nt, Human
gcccagagaggcucaccaggaau

SEQ ID NO: 280162 - RNA, 22 nt, Human
uacacacaugcauuugccuuau

SEQ ID NO: 280163 - RNA, 22 nt, Human
gcuccuggccagcacagggccc

SEQ ID NO: 280164 - RNA, 20 nt, Human
acaguguuuuugaguagagc

SEQ ID NO: 280165 - RNA, 22 nt, Human
ccuccuggcccugggccuggaa

SEQ ID NO: 280166 - RNA, 22 nt, Human
gccugagaaggauaggaagcga

SEQ ID NO: 280167 - RNA, 22 nt, Human
gggagagguuacccgagcaacu

SEQ ID NO: 280168 - RNA, 22 nt, Human
uguguucaaucaccaaagguau

SEQ ID NO: 280169 - RNA, 22 nt, Human
uggaaaauuaguagugaaaggc

SEQ ID NO: 280170 - RNA, 22 nt, Human
cagggcuagugacaccccaguc

SEQ ID NO: 280171 - RNA, 22 nt, Human
gacagacacagggccaugauug

SEQ ID NO: 280172 - RNA, 22 nt, Human
gagggcucacugagaaagcagu

SEQ ID NO: 280173 - RNA, 22 nt, Human
agcuguggaguaggggguugga

SEQ ID NO: 280174 - RNA, 22 nt, Human
augcacuacuuggcuuuacuga

SEQ ID NO: 280175 - RNA, 22 nt, Human
uggagagaugucuguucaaggu

SEQ ID NO: 280176 - RNA, 22 nt, Human
uccaggcauuggagagauaaug

SEQ ID NO: 280177 - RNA, 22 nt, Human
cuagugagucugaaugaguugc

SEQ ID NO: 280178 - RNA, 22 nt, Human
aaucucuugggaggaaugaauu

SEQ ID NO: 280179 - RNA, 22 nt, Human
uggccaguggacuaaguucuga

SEQ ID NO: 280180 - RNA, 22 nt, Human
uguguucauuuaacuguucuuu

SEQ ID NO: 280181 - RNA, 22 nt, Human
cucaaaauccauaaaaucaggu

SEQ ID NO: 280182 - RNA, 22 nt, Human
cucagagagggcaccagggcca

SEQ ID NO: 280183 - RNA, 22 nt, Human
agcaggugacagggcuguggug

SEQ ID NO: 280184 - RNA, 22 nt, Human
acuguuuucuuagcucccugcu

SEQ ID NO: 280185 - RNA, 22 nt, Human
aggcuagaggcuucuggcuuca

SEQ ID NO: 280186 - RNA, 22 nt, Human
uucugucuucucgguuguuuac

SEQ ID NO: 280187 - RNA, 22 nt, Human
uuccugugugcucucauuuagu

SEQ ID NO: 280188 - RNA, 19 nt, Human
uccuccuuacuuccucuug

SEQ ID NO: 280189 - RNA, 22 nt, Human
agacacugaaucagagggacau

SEQ ID NO: 280190 - RNA, 21 nt, Human
augucaaaugcuuuauuuuau

SEQ ID NO: 280191 - RNA, 20 nt, Human
uuucuguaaggcauuaaucu

SEQ ID NO: 280192 - RNA, 22 nt, Human
ccugugacucugucugaugguc

SEQ ID NO: 280193 - RNA, 22 nt, Human
agcuuuaucacaauauuggcua

SEQ ID NO: 280194 - RNA, 22 nt, Human
cagcagagcugugugggaaggg

SEQ ID NO: 280195 - RNA, 22 nt, Human
uuaguucuugggugaacuuuug

SEQ ID NO: 280196 - RNA, 22 nt, Human
ucuguuaugcauaagcaucagu

SEQ ID NO: 280197 - RNA, 22 nt, Human
auuguuaugaaaauaagauguu

SEQ ID NO: 280198 - RNA, 22 nt, Human
auagcaagguaugacuggagcc

SEQ ID NO: 280199 - RNA, 22 nt, Human
acccaugaguguaucuuuaaaa

SEQ ID NO: 280200 - RNA, 22 nt, Human
gauggucuguauuaaacagaug

SEQ ID NO: 280201 - RNA, 22 nt, Human
uacaaagaggcagcuccauuuu

SEQ ID NO: 280202 - RNA, 15 nt, Human
gggcaggucuggggc

SEQ ID NO: 280203 - RNA, 22 nt, Human
ucucugugugccuucaucugcc

SEQ ID NO: 280204 - RNA, 22 nt, Human
aguaccaugcuuccugacuggu

SEQ ID NO: 280205 - RNA, 22 nt, Human
ccagguccuguuuucaccacag

SEQ ID NO: 280206 - RNA, 22 nt, Human
auugcugaacuuauaaaugaau

SEQ ID NO: 280207 - RNA, 22 nt, Human
auacuucucaugggcucugagc

SEQ ID NO: 280208 - RNA, 22 nt, Human
ucaggugucuaucuaaccuggu

SEQ ID NO: 280209 - RNA, 22 nt, Human
uuuucuguauuauugugcuuca

SEQ ID NO: 280210 - RNA, 22 nt, Human
aucuacccacugaacacaauau

SEQ ID NO: 280211 - RNA, 22 nt, Human
gucauucuuaacaacucaguag

SEQ ID NO: 280212 - RNA, 22 nt, Human
uuguauuuauauugaauagcuu

SEQ ID NO: 280213 - RNA, 22 nt, Human
uuguuuacaaguuacucagucu

SEQ ID NO: 280214 - RNA, 22 nt, Human
uuaguugauguucuggagguag

SEQ ID NO: 280215 - RNA, 22 nt, Human
cacugucugcuucgacucuuca

SEQ ID NO: 280216 - RNA, 22 nt, Human
guaggcagguggaggagugaag

SEQ ID NO: 280217 - RNA, 22 nt, Human
ucugaagauuaccagcuaaaug

SEQ ID NO: 280218 - RNA, 22 nt, Human
ccucugccaccucccacgaggc

SEQ ID NO: 280219 - RNA, 22 nt, Human
ucuauuuucuugccaaaacugc

SEQ ID NO: 280220 - RNA, 22 nt, Human
ugaguaggugguuaagcaugga

SEQ ID NO: 280221 - RNA, 23 nt, Human
uaugaacugcauugcuggugugu

SEQ ID NO: 280222 - RNA, 22 nt, Human
uuuauguuugacaaugaucugg

SEQ ID NO: 280223 - RNA, 23 nt, Human
uagucaguauguaagucuaauug

SEQ ID NO: 280224 - RNA, 22 nt, Human
aaacacauuagcccuguggaaa

SEQ ID NO: 280225 - RNA, 22 nt, Human
auuauaaauauuuucuaggggu

SEQ ID NO: 280226 - RNA, 22 nt, Human
agcuuuggcccuggagguuacu

SEQ ID NO: 280227 - RNA, 22 nt, Human
agcagugccgcaucuugugacc

SEQ ID NO: 280228 - RNA, 22 nt, Human
uccuggacucaggaccacagga

SEQ ID NO: 280229 - RNA, 22 nt, Human
acagcagcuaaccccugggcca

SEQ ID NO: 280230 - RNA, 22 nt, Human
uaauaauuggcaauguugagca

SEQ ID NO: 280231 - RNA, 22 nt, Human
cuggucaccuccuucccagcua

SEQ ID NO: 280232 - RNA, 22 nt, Human
uuuacagcaacagugcagaggu

SEQ ID NO: 280233 - RNA, 22 nt, Human
caguggcaaguccgguauugaa

SEQ ID NO: 280234 - RNA, 22 nt, Human
ucuccuggaagaauaccacacu

SEQ ID NO: 280235 - RNA, 22 nt, Human
aauuagagaucgcaauaacggg

SEQ ID NO: 280236 - RNA, 22 nt, Human
uccugcagccacugcaggcaga

SEQ ID NO: 280237 - RNA, 22 nt, Human
cccagcccaucucaaaggucua

SEQ ID NO: 280238 - RNA, 22 nt, Human
guugggaaggcaagaaguagaa

SEQ ID NO: 280239 - RNA, 22 nt, Human
uggugaggucauagagaacugu

SEQ ID NO: 280240 - RNA, 22 nt, Human
acagcaugucuaguuaaauacu

SEQ ID NO: 280241 - RNA, 22 nt, Human
uuuaucugaggaaagcagacaa

SEQ ID NO: 280242 - RNA, 22 nt, Human
guccugguccugccuccccaug

SEQ ID NO: 280243 - RNA, 22 nt, Human
cuggccucauagccaagcugug

SEQ ID NO: 280244 - RNA, 22 nt, Human
acaguuaaauauuucuacuggg

SEQ ID NO: 280245 - RNA, 22 nt, Human
uucuguauuuaguuugaggaca

SEQ ID NO: 280246 - RNA, 19 nt, Human
guagggacagugguucuga

SEQ ID NO: 280247 - RNA, 22 nt, Human
augacaagaguguucagggaga

SEQ ID NO: 280248 - RNA, 22 nt, Human
auuucuguauccugcugucaga

SEQ ID NO: 280249 - RNA, 22 nt, Human
uuccugaaugcuguugugcugu

SEQ ID NO: 280250 - RNA, 22 nt, Human
uagaagcaguaauagaaauagg

SEQ ID NO: 280251 - RNA, 22 nt, Human
uccuggcugccgucguccugcg

SEQ ID NO: 280252 - RNA, 22 nt, Human
ggcucccugccuguccucaguc

SEQ ID NO: 280253 - RNA, 22 nt, Human
aagucucugauguguguuaggu

SEQ ID NO: 280254 - RNA, 22 nt, Human
uggaugucauaguuggauauac

SEQ ID NO: 280255 - RNA, 17 nt, Human
gccugcaggcccgcaga

SEQ ID NO: 280256 - RNA, 22 nt, Human
ggucacaugguugagcuugauc

SEQ ID NO: 280257 - RNA, 22 nt, Human
aagcaaacaggagaagagcugu

SEQ ID NO: 280258 - RNA, 22 nt, Human
acuugaauuauauuucuagaga

SEQ ID NO: 280259 - RNA, 22 nt, Human
cccagccuacucugccauagca

SEQ ID NO: 280260 - RNA, 22 nt, Human
ugucccagcagcuggguucucu

SEQ ID NO: 280261 - RNA, 19 nt, Human
acagugcaugggaccuggu

SEQ ID NO: 280262 - RNA, 22 nt, Human
uccugagugguuguuuucuucc

SEQ ID NO: 280263 - RNA, 22 nt, Human
aaagccuugagauccuauaguu

SEQ ID NO: 280264 - RNA, 22 nt, Human
ucugaaauggcagcgggaauga

SEQ ID NO: 280265 - RNA, 22 nt, Human
cucaaggccaguucuucugacu

SEQ ID NO: 280266 - RNA, 22 nt, Human
ucagggcuccggaaguggccuc

SEQ ID NO: 280267 - RNA, 22 nt, Human
auuguauuagcacaauacaauu

SEQ ID NO: 280268 - RNA, 22 nt, Human
cuuucuggaguggaaagguauu

SEQ ID NO: 280269 - RNA, 22 nt, Human
guucuucaggccauccucccag

SEQ ID NO: 280270 - RNA, 22 nt, Human
uugaacauuggcaauuucauau

SEQ ID NO: 280271 - RNA, 22 nt, Human
gugcaggggccuccccuugcug

SEQ ID NO: 280272 - RNA, 22 nt, Human
uuccugguggcuuugccaacug

SEQ ID NO: 280273 - RNA, 21 nt, Human
uccugcagaaugccuuccuac

SEQ ID NO: 280274 - RNA, 22 nt, Human
aaagaaggaccuggaggaggau

SEQ ID NO: 280275 - RNA, 22 nt, Human
ugcuauuugugagugucuucgu

SEQ ID NO: 280276 - RNA, 22 nt, Human
uguuuucugaugguuaaugagu

SEQ ID NO: 280277 - RNA, 19 nt, Human
cuguuauugucagagcucc

SEQ ID NO: 280278 - RNA, 22 nt, Human
ccugcaagagcggagaagccag

SEQ ID NO: 280279 - RNA, 22 nt, Human
cucagauguagaaagauuguga

SEQ ID NO: 280280 - RNA, 22 nt, Human
aaagcugccaaggagaauacua

SEQ ID NO: 280281 - RNA, 21 nt, Human
aggcugcaugcaugagugugg

SEQ ID NO: 280282 - RNA, 22 nt, Human
ucaggugggaccugcuaggaca

SEQ ID NO: 280283 - RNA, 22 nt, Human
ccaggcaggcgauggugcagug

SEQ ID NO: 280284 - RNA, 22 nt, Human
cucugagggcucgagggacgcg

SEQ ID NO: 280285 - RNA, 22 nt, Human
auugcuggaugagcucuuggau

SEQ ID NO: 280286 - RNA, 22 nt, Human
uuuuggcucuugguaggucaga

SEQ ID NO: 280287 - RNA, 22 nt, Human
caugacauccugaagcugcaca

SEQ ID NO: 280288 - RNA, 22 nt, Human
gccacccccaaguagguggucu

SEQ ID NO: 280289 - RNA, 23 nt, Human
uuucagaagugguccuaggaagc

SEQ ID NO: 280290 - RNA, 23 nt, Human
ccugcaaagaaacaagccaccug

SEQ ID NO: 280291 - RNA, 21 nt, Human
aguugcugcugcugcagguga

SEQ ID NO: 280292 - RNA, 22 nt, Human
ucugagcaccuuauauucuuga

SEQ ID NO: 280293 - RNA, 22 nt, Human
auuuucaucgcuagguuggccu

SEQ ID NO: 280294 - RNA, 22 nt, Human
uuguguccucuaaucucaccac

SEQ ID NO: 280295 - RNA, 22 nt, Human
acagauuuuaaaugacacuccc

SEQ ID NO: 280296 - RNA, 22 nt, Human
acugucuugcuaugagcuccca

SEQ ID NO: 280297 - RNA, 22 nt, Human
uagggaugaaguugcuauuuac

SEQ ID NO: 280298 - RNA, 22 nt, Human
agugauuugggugucagaaagu

SEQ ID NO: 280299 - RNA, 22 nt, Human
uucauucccaagaguaaacaua

SEQ ID NO: 280300 - RNA, 22 nt, Human
aaauuauuacaagcuaguuggc

SEQ ID NO: 280301 - RNA, 21 nt, Human
cuuggcugcagugacaggcau

SEQ ID NO: 280302 - RNA, 22 nt, Human
uuguacuaucaccaugucaugu

SEQ ID NO: 280303 - RNA, 22 nt, Human
uggcaggguacaccuuaacacc

SEQ ID NO: 280304 - RNA, 22 nt, Human
gcagacagccagacugcacugg

SEQ ID NO: 280305 - RNA, 20 nt, Human
uauuggaucuaagaaauggg

SEQ ID NO: 280306 - RNA, 22 nt, Human
aggcugugagagguggcuccca

SEQ ID NO: 280307 - RNA, 22 nt, Human
agcuccuggaggugcgcacucg

SEQ ID NO: 280308 - RNA, 22 nt, Human
gucucugugucugagagagccc

SEQ ID NO: 280309 - RNA, 22 nt, Human
uuccugugugaccgagacagug

SEQ ID NO: 280310 - RNA, 22 nt, Human
auauuaaauggauuuugggagc

SEQ ID NO: 280311 - RNA, 22 nt, Human
aaaguuuggauccagcaaaaga

SEQ ID NO: 280312 - RNA, 22 nt, Human
agagggaaggacagauguuuca

SEQ ID NO: 280313 - RNA, 22 nt, Human
uuucugaauaacucuaugauau

SEQ ID NO: 280314 - RNA, 22 nt, Human
ggggaccuucccagagcaguug

SEQ ID NO: 280315 - RNA, 22 nt, Human
gaagugaagguuacucuagauu

SEQ ID NO: 280316 - RNA, 22 nt, Human
uccugcaggccagaggggugag

SEQ ID NO: 280317 - RNA, 22 nt, Human
ugagaucauugacuuguuccug

SEQ ID NO: 280318 - RNA, 22 nt, Human
acagggcagaaauguugcaucu

SEQ ID NO: 280319 - RNA, 22 nt, Human
aaagugauuuaaguaccucagg

SEQ ID NO: 280320 - RNA, 22 nt, Human
ugacauguccaggugguccugu

SEQ ID NO: 280321 - RNA, 22 nt, Human
ugguccugcccacgcccaucug

SEQ ID NO: 280322 - RNA, 22 nt, Human
agcucccaggcagucaugagga

SEQ ID NO: 280323 - RNA, 22 nt, Human
uuagggacagcucuguagguga

SEQ ID NO: 280324 - RNA, 22 nt, Human
ucaguuagggccucagaagaca

SEQ ID NO: 280325 - RNA, 22 nt, Human
cuggcccucggaguccagcugc

SEQ ID NO: 280326 - RNA, 22 nt, Human
cagacaggaaguucagaagaaa

SEQ ID NO: 280327 - RNA, 22 nt, Human
auagaaacagaggucaggcauu

SEQ ID NO: 280328 - RNA, 22 nt, Human
ccaggcuccccaggaggcccuu

SEQ ID NO: 280329 - RNA, 22 nt, Human
uaguauuuccuguaagcuauag

SEQ ID NO: 280330 - RNA, 22 nt, Human
acaguuugcccugacauucucc

SEQ ID NO: 280331 - RNA, 22 nt, Human
ucuagaccuggcacugcccugu

SEQ ID NO: 280332 - RNA, 22 nt, Human
acacauuucucuuuuuguaagu

SEQ ID NO: 280333 - RNA, 22 nt, Human
cauuugaaugagauugcuguaa

SEQ ID NO: 280334 - RNA, 19 nt, Human
uagguguccgccggaggug

SEQ ID NO: 280335 - RNA, 22 nt, Human
ucuagaaauuuugccuuguauu

SEQ ID NO: 280336 - RNA, 22 nt, Human
aagcuguggcuuggaggaaaca

SEQ ID NO: 280337 - RNA, 22 nt, Human
auuaucuauguagaaugauuuu

SEQ ID NO: 280338 - RNA, 22 nt, Human
ucacugugaauguuaucaucuu

SEQ ID NO: 280339 - RNA, 22 nt, Human
auuauacauuuuguguagagau

SEQ ID NO: 280340 - RNA, 22 nt, Human
agggcagccaugagccuucagg

SEQ ID NO: 280341 - RNA, 22 nt, Human
aagguggucuuacugaugguau

SEQ ID NO: 280342 - RNA, 22 nt, Human
uacagacaaagugcuauagggu

SEQ ID NO: 280343 - RNA, 22 nt, Human
uaauuuuacuuccugagcaccu

SEQ ID NO: 280344 - RNA, 22 nt, Human
uguuggaauaagugcuugaagg

SEQ ID NO: 280345 - RNA, 22 nt, Human
gaggcugcccaacuggagugga

SEQ ID NO: 280346 - RNA, 22 nt, Human
ugcauggaggaagaugaaugca

SEQ ID NO: 280347 - RNA, 22 nt, Human
ugggugagccacaggaguuguc

SEQ ID NO: 280348 - RNA, 22 nt, Human
caugugguucaaguacuccaca

SEQ ID NO: 280349 - RNA, 22 nt, Human
cuuuuacacucaucugggaggg

SEQ ID NO: 280350 - RNA, 22 nt, Human
uuguagaaaauuagaugcaugg

SEQ ID NO: 280351 - RNA, 22 nt, Human
agcuuugguugaggggagugug

SEQ ID NO: 280352 - RNA, 22 nt, Human
agucaguuguggagauuuaacu

SEQ ID NO: 280353 - RNA, 22 nt, Human
uucuucuugaaacuuuagguug

SEQ ID NO: 280354 - RNA, 22 nt, Human
uucacauugaaggugcuuucuu

SEQ ID NO: 280355 - RNA, 22 nt, Human
aucaguuuuuauuaauguagcu

SEQ ID NO: 280356 - RNA, 22 nt, Human
uuucaaauaccauaaaccuaau

SEQ ID NO: 280357 - RNA, 22 nt, Human
agacagacacaugguaacagau

SEQ ID NO: 280358 - RNA, 22 nt, Human
acuuccuugucaggugcaucau

SEQ ID NO: 280359 - RNA, 22 nt, Human
ccugggugaaaucucuccugca

SEQ ID NO: 280360 - RNA, 22 nt, Human
gccaaaucacagggccaaaagc

SEQ ID NO: 280361 - RNA, 22 nt, Human
aagaaaugcacacaacugcugg

SEQ ID NO: 280362 - RNA, 22 nt, Human
aguugacucucaagauccuguu

SEQ ID NO: 280363 - RNA, 22 nt, Human
cuguguccugcgucaagccaau

SEQ ID NO: 280364 - RNA, 22 nt, Human
uucccuuccucacucuacuugu

SEQ ID NO: 280365 - RNA, 22 nt, Human
aagucagagcaacugagacauu

SEQ ID NO: 280366 - RNA, 22 nt, Human
cacaauauuggccgggcugguc

SEQ ID NO: 280367 - RNA, 22 nt, Human
ucuucacauggaacaugaagcu

SEQ ID NO: 280368 - RNA, 22 nt, Human
gaauuugaaaagugaugggaau

SEQ ID NO: 280369 - RNA, 18 nt, Human
ggcagggaaaagauaggg

SEQ ID NO: 280370 - RNA, 22 nt, Human
uccugcagacauuuacaccuuu

SEQ ID NO: 280371 - RNA, 22 nt, Human
gagaauguuaauguugaaguau

SEQ ID NO: 280372 - RNA, 22 nt, Human
auguuucaccagcaaauuaccu

SEQ ID NO: 280373 - RNA, 22 nt, Human
ugucauuuaguccucugugugu

SEQ ID NO: 280374 - RNA, 22 nt, Human
uacauguauguguacgugcaug

SEQ ID NO: 280375 - RNA, 22 nt, Human
guccuucuuuucaucccugguu

SEQ ID NO: 280376 - RNA, 22 nt, Human
gagcuuuaggagaaggagguca

SEQ ID NO: 280377 - RNA, 22 nt, Human
aggcugugcucagccaauggga

SEQ ID NO: 280378 - RNA, 22 nt, Human
gcccccagcucucaagcucaaa

SEQ ID NO: 280379 - RNA, 22 nt, Human
gagacaggauuuaaccaaagcu

SEQ ID NO: 280380 - RNA, 22 nt, Human
uuccugaauugagcuuuagaaa

SEQ ID NO: 280381 - RNA, 23 nt, Human
gcccacccucagcguccucacgg

SEQ ID NO: 280382 - RNA, 22 nt, Human
ccauaaucauguaaguaaauuc

SEQ ID NO: 280383 - RNA, 22 nt, Human
ugugugucagucuuguuuaggg

SEQ ID NO: 280384 - RNA, 22 nt, Human
aaaaugaagcaaaggcauucag

SEQ ID NO: 280385 - RNA, 22 nt, Human
uuuuacaggugaaaaaugaaga

SEQ ID NO: 280386 - RNA, 22 nt, Human
uuugcagugucagcuucugugu

SEQ ID NO: 280387 - RNA, 22 nt, Human
auucuucagcaggggacacuau

SEQ ID NO: 280388 - RNA, 18 nt, Human
aagcugggaaggagacag

SEQ ID NO: 280389 - RNA, 22 nt, Human
gacaggugaaacagcaagguaa

SEQ ID NO: 280390 - RNA, 22 nt, Human
gucuggaagaacuagggauguu

SEQ ID NO: 280391 - RNA, 22 nt, Human
uuuuacaggucauagguauagu

SEQ ID NO: 280392 - RNA, 22 nt, Human
acuguccuuuuaaugcagccgu

SEQ ID NO: 280393 - RNA, 22 nt, Human
ugucucaggggcauugaaauaa

SEQ ID NO: 280394 - RNA, 22 nt, Human
gaaacugaguaggcuagagcac

SEQ ID NO: 280395 - RNA, 22 nt, Human
cuuucagucaguuaacucagaa

SEQ ID NO: 280396 - RNA, 22 nt, Human
gggagaaguggaaaucucauua

SEQ ID NO: 280397 - RNA, 22 nt, Human
caggaagucgcagagcuggggg

SEQ ID NO: 280398 - RNA, 22 nt, Human
aaauaacagucagggacaacau

SEQ ID NO: 280399 - RNA, 22 nt, Human
uacuucaaccuucucuauuaga

SEQ ID NO: 280400 - RNA, 22 nt, Human
aagggcucuucuauuuauggcc

SEQ ID NO: 280401 - RNA, 22 nt, Human
cuggcagguuuggugucuggug

SEQ ID NO: 280402 - RNA, 22 nt, Human
ugacuuccugcacucaggugau

SEQ ID NO: 280403 - RNA, 22 nt, Human
cauggcugaacacucagugacu

SEQ ID NO: 280404 - RNA, 22 nt, Human
ggaugggaacuugguagggcau

SEQ ID NO: 280405 - RNA, 21 nt, Human
cccaggaggcugagaagagca

SEQ ID NO: 280406 - RNA, 22 nt, Human
uccugaagaugaaaagagaggu

SEQ ID NO: 280407 - RNA, 22 nt, Human
aagauauucaaagauuuauuag

SEQ ID NO: 280408 - RNA, 22 nt, Human
uccaggcaagggaggagcaugg

SEQ ID NO: 280409 - RNA, 22 nt, Human
uuccagaaaucuuucagcucaa

SEQ ID NO: 280410 - RNA, 22 nt, Human
cacaguaugaucuaaaguaagu

SEQ ID NO: 280411 - RNA, 22 nt, Human
ggcccaguguggguggauguug

SEQ ID NO: 280412 - RNA, 22 nt, Human
accugauguauagauucuagau

SEQ ID NO: 280413 - RNA, 21 nt, Human
uccaggagcacgggacuagga

SEQ ID NO: 280414 - RNA, 22 nt, Human
ucaguaguuuugaucugagcag

SEQ ID NO: 280415 - RNA, 22 nt, Human
uuucuuuugcccuguggguuag

SEQ ID NO: 280416 - RNA, 22 nt, Human
aagcaaagacaguuugagugga

SEQ ID NO: 280417 - RNA, 22 nt, Human
uuaucacuuaugagcuuuuugc

SEQ ID NO: 280418 - RNA, 22 nt, Human
cuacauaaauuuaucacagacu

SEQ ID NO: 280419 - RNA, 22 nt, Human
uuuacaguaagguggaugguac

SEQ ID NO: 280420 - RNA, 22 nt, Human
uuccaugaaagugaaauggagc

SEQ ID NO: 280421 - RNA, 22 nt, Human
ggggaggaccuuuccaaggcuu

SEQ ID NO: 280422 - RNA, 20 nt, Human
ggggcagguuuuuauggcua

SEQ ID NO: 280423 - RNA, 22 nt, Human
cuguccucuguccucagcagga

SEQ ID NO: 280424 - RNA, 22 nt, Human
agauuuuaguguagaggacuug

SEQ ID NO: 280425 - RNA, 22 nt, Human
cugggugucaggagacaugaug

SEQ ID NO: 280426 - RNA, 19 nt, Human
uguacauauagagcucagu

SEQ ID NO: 280427 - RNA, 22 nt, Human
uuugcauuuguucaaguauuga

SEQ ID NO: 280428 - RNA, 22 nt, Human
uuccuggugaccucacugguag

SEQ ID NO: 280429 - RNA, 22 nt, Human
ucagugucuucucuuuccuacc

SEQ ID NO: 280430 - RNA, 22 nt, Human
ugauuucucuuggcaauauguu

SEQ ID NO: 280431 - RNA, 22 nt, Human
gagggcaagaguuggaaacggu

SEQ ID NO: 280432 - RNA, 22 nt, Human
caagggcuucaaguggccaaga

SEQ ID NO: 280433 - RNA, 22 nt, Human
uccuggcugaguucccaagucg

SEQ ID NO: 280434 - RNA, 22 nt, Human
caguguuucugaguuccagcuc

SEQ ID NO: 280435 - RNA, 22 nt, Human
aaauuagaucaguggauuuucu

SEQ ID NO: 280436 - RNA, 22 nt, Human
agaucauaugaaaaauuucaag

SEQ ID NO: 280437 - RNA, 22 nt, Human
aagggcuccacuugaaucacac

SEQ ID NO: 280438 - RNA, 22 nt, Human
caggggcaagaaugcugucagc

SEQ ID NO: 280439 - RNA, 22 nt, Human
uccaggaggaggaaggcugcca

SEQ ID NO: 280440 - RNA, 22 nt, Human
acccaggguagagugcaguggc

SEQ ID NO: 280441 - RNA, 22 nt, Human
gcaugcagacagucugagacca

SEQ ID NO: 280442 - RNA, 22 nt, Human
auuuccaugaaggcagauuuua

SEQ ID NO: 280443 - RNA, 22 nt, Human
uauuuaguuaucuuucauaaaa

SEQ ID NO: 280444 - RNA, 22 nt, Human
ucaggaaagaagaugcucagug

SEQ ID NO: 280445 - RNA, 22 nt, Human
aaguaaaagcuuuaccaugcgc

SEQ ID NO: 280446 - RNA, 22 nt, Human
cguuuauuuugaagauuccacu

SEQ ID NO: 280447 - RNA, 22 nt, Human
aauauaaugcuguuuuaugcca

SEQ ID NO: 280448 - RNA, 22 nt, Human
augcuauuuaccacacaucauu

SEQ ID NO: 280449 - RNA, 23 nt, Human
aguuuccacccaggguagaaggg

SEQ ID NO: 280450 - RNA, 22 nt, Human
gaggcugcuuugaugacaggag

SEQ ID NO: 280451 - RNA, 22 nt, Human
gggcugcuguguuccugaggca

SEQ ID NO: 280452 - RNA, 22 nt, Human
acaauguguuuuuauacauuug

SEQ ID NO: 280453 - RNA, 22 nt, Human
ucugaaauagaagugucuuucu

SEQ ID NO: 280454 - RNA, 22 nt, Human
uauuggugaugacuugaggcca

SEQ ID NO: 280455 - RNA, 23 nt, Human
ugccguguuagaaauguuuuaca

SEQ ID NO: 280456 - RNA, 22 nt, Human
gguguccuugcuccuucagcuu

SEQ ID NO: 280457 - RNA, 22 nt, Human
cccagccucuguuugcuccucu

SEQ ID NO: 280458 - RNA, 22 nt, Human
gcauggcuccugucuuacuccc

SEQ ID NO: 280459 - RNA, 20 nt, Human
augccucuaauuuugcaaac

SEQ ID NO: 280460 - RNA, 22 nt, Human
aagagcaucgguggagccccca

SEQ ID NO: 280461 - RNA, 22 nt, Human
ugcagggauuguuggcauccau

SEQ ID NO: 280462 - RNA, 22 nt, Human
aaagcauaguucaucuguccau

SEQ ID NO: 280463 - RNA, 22 nt, Human
gugcccaguugaggccaggacu

SEQ ID NO: 280464 - RNA, 22 nt, Human
ucugucauuuuguaucuacaug

SEQ ID NO: 280465 - RNA, 22 nt, Human
acaugccagccucagcagcagu

SEQ ID NO: 280466 - RNA, 22 nt, Human
ccagggcauguccaagacuuag

SEQ ID NO: 280467 - RNA, 21 nt, Human
acuguucaucuguucagaagc

SEQ ID NO: 280468 - RNA, 22 nt, Human
uauguauagagucuuuuaaauu

SEQ ID NO: 280469 - RNA, 22 nt, Human
ucuuugaauccuuuacaucuga

SEQ ID NO: 280470 - RNA, 21 nt, Human
uuuuauugaugaauggccacu

SEQ ID NO: 280471 - RNA, 22 nt, Human
ucagagaccuagcaagaaauug

SEQ ID NO: 280472 - RNA, 22 nt, Human
auguuuacugguuuauagaaua

SEQ ID NO: 280473 - RNA, 22 nt, Human
cccugagaagaucauugccacg

SEQ ID NO: 280474 - RNA, 21 nt, Human
agaagggauugugguaaagau

SEQ ID NO: 280475 - RNA, 22 nt, Human
auauauuuugcggucacguggc

SEQ ID NO: 280476 - RNA, 22 nt, Human
uuucuugucuuuaguaucuggc

SEQ ID NO: 280477 - RNA, 22 nt, Human
aucuggcugagcgaggcccaca

SEQ ID NO: 280478 - RNA, 22 nt, Human
acccagcuguuucccgugucau

SEQ ID NO: 280479 - RNA, 22 nt, Human
ugucagagcaaugagguucagc

SEQ ID NO: 280480 - RNA, 22 nt, Human
uugcuuuaaaauggcuaagucu

SEQ ID NO: 280481 - RNA, 22 nt, Human
uuuggacuuagccugcagaauu

SEQ ID NO: 280482 - RNA, 23 nt, Human
cuguccugccauccacagcggcc

SEQ ID NO: 280483 - RNA, 23 nt, Human
uggcuaaacaguggagaaagcuu

SEQ ID NO: 280484 - RNA, 22 nt, Human
gcuuuuccugacuuuccauuag

SEQ ID NO: 280485 - RNA, 18 nt, Human
uguggcugguccacacug

SEQ ID NO: 280486 - RNA, 22 nt, Human
gcuaaauaaucuucuucugaca

SEQ ID NO: 280487 - RNA, 22 nt, Human
cacuuuauauucuaagacggcc

SEQ ID NO: 280488 - RNA, 22 nt, Human
uugccauuuauacugcaaguca

SEQ ID NO: 280489 - RNA, 22 nt, Human
uccaugaggaccaaauucguag

SEQ ID NO: 280490 - RNA, 22 nt, Human
auauuuuggggugaugugcauc

SEQ ID NO: 280491 - RNA, 21 nt, Human
uucugggaaaugagcuggggc

SEQ ID NO: 280492 - RNA, 22 nt, Human
uuacaauaguuccuucuuuugu

SEQ ID NO: 280493 - RNA, 22 nt, Human
aucuguucuucaaaauauuaca

SEQ ID NO: 280494 - RNA, 18 nt, Human
uccaaaaucauguauuuu

SEQ ID NO: 280495 - RNA, 22 nt, Human
ggagaaggcacacccaccucug

SEQ ID NO: 280496 - RNA, 22 nt, Human
aagcaucuucuaucaguuagac

SEQ ID NO: 280497 - RNA, 22 nt, Human
ucuacccagagcuaugaccuga

SEQ ID NO: 280498 - RNA, 22 nt, Human
uuuagggacaagggucuggggu

SEQ ID NO: 280499 - RNA, 22 nt, Human
ucugggaaaugcuguuccuugu

SEQ ID NO: 280500 - RNA, 22 nt, Human
agugagguaauuagagcugcug

SEQ ID NO: 280501 - RNA, 22 nt, Human
uagaaagcaaaauccuaccaag

SEQ ID NO: 280502 - RNA, 21 nt, Human
guagggacagagaguugguga

SEQ ID NO: 280503 - RNA, 21 nt, Human
ucccacugccacagcuucagg

SEQ ID NO: 280504 - RNA, 22 nt, Human
gggugggagaaaugaguaucua

SEQ ID NO: 280505 - RNA, 22 nt, Human
cauuugaauuguucugugggaa

SEQ ID NO: 280506 - RNA, 23 nt, Human
ucagagaacucgggcagaugacc

SEQ ID NO: 280507 - RNA, 22 nt, Human
cugcuaaaccucucugagagcu

SEQ ID NO: 280508 - RNA, 22 nt, Human
uccucagcauggaaucuggacu

SEQ ID NO: 280509 - RNA, 20 nt, Human
agcccuguuuccuggagaga

SEQ ID NO: 280510 - RNA, 22 nt, Human
gcacuggagauacagagaugaa

SEQ ID NO: 280511 - RNA, 22 nt, Human
gcuuggcuccuggcucacaggu

SEQ ID NO: 280512 - RNA, 22 nt, Human
uaguuuacucaucuauaaaaug

SEQ ID NO: 280513 - RNA, 23 nt, Human
guuccuucauguggucauugguu

SEQ ID NO: 280514 - RNA, 22 nt, Human
uggcuugguaaggaccagcagg

SEQ ID NO: 280515 - RNA, 22 nt, Human
gaauguuuaaggaaggcguggc

SEQ ID NO: 280516 - RNA, 22 nt, Human
agaagcuuccuacauuguucuu

SEQ ID NO: 280517 - RNA, 21 nt, Human
uauuugcugccaucuuugagg

SEQ ID NO: 280518 - RNA, 22 nt, Human
uagauaaaagggcaaagggcau

SEQ ID NO: 280519 - RNA, 22 nt, Human
gauucuuugacaggguguuggg

SEQ ID NO: 280520 - RNA, 21 nt, Human
ugucugauguauuuuuugccu

SEQ ID NO: 280521 - RNA, 22 nt, Human
gagacaggccaggugguacuua

SEQ ID NO: 280522 - RNA, 22 nt, Human
auuagcuuaucacacaagcugc

SEQ ID NO: 280523 - RNA, 22 nt, Human
cuguaaauaugaagaauauaug

SEQ ID NO: 280524 - RNA, 22 nt, Human
aucugucuggaggccuggcaug

SEQ ID NO: 280525 - RNA, 22 nt, Human
uuccugccccugagagcuccca

SEQ ID NO: 280526 - RNA, 22 nt, Human
aagggcagaaagggacgcuuug

SEQ ID NO: 280527 - RNA, 22 nt, Human
aagcugcagcacagagaggugg

SEQ ID NO: 280528 - RNA, 22 nt, Human
ucucccucauuccugcuuccau

SEQ ID NO: 280529 - RNA, 22 nt, Human
gccaggcagauaugugagcuua

SEQ ID NO: 280530 - RNA, 22 nt, Human
ugauugacuuuagaauagcacu

SEQ ID NO: 280531 - RNA, 22 nt, Human
aauaagauugacacaaguaccu

SEQ ID NO: 280532 - RNA, 22 nt, Human
gguggcucggccagugcaggcc

SEQ ID NO: 280533 - RNA, 22 nt, Human
acauguguaaggucucucaguc

SEQ ID NO: 280534 - RNA, 22 nt, Human
uucuucuucauuucugacgaug

SEQ ID NO: 280535 - RNA, 22 nt, Human
guuuuacaagguuaaucagcag

SEQ ID NO: 280536 - RNA, 22 nt, Human
caugacaaauaaaccuuugcca

SEQ ID NO: 280537 - RNA, 22 nt, Human
agggcugacagugaggagucaa

SEQ ID NO: 280538 - RNA, 22 nt, Human
uaacugugugaacgugaucauu

SEQ ID NO: 280539 - RNA, 22 nt, Human
uuuuccagagcugucucuugca

SEQ ID NO: 280540 - RNA, 22 nt, Human
cccuucaagcucucuggguuuu

SEQ ID NO: 280541 - RNA, 22 nt, Human
uagguggugggauaugagcauc

SEQ ID NO: 280542 - RNA, 22 nt, Human
acccagggagugcuccuguucu

SEQ ID NO: 280543 - RNA, 22 nt, Human
cuguggcuuucucugccuccuu

SEQ ID NO: 280544 - RNA, 22 nt, Human
cccaaggccuucaagccagcuc

SEQ ID NO: 280545 - RNA, 22 nt, Human
guccugagucaagugugggcag

SEQ ID NO: 280546 - RNA, 22 nt, Human
cauuuuaccuagaagcugaaag

SEQ ID NO: 280547 - RNA, 22 nt, Human
uuggcugaaugaggucaccuuu

SEQ ID NO: 280548 - RNA, 22 nt, Human
gucauuccuuauguugauucag

SEQ ID NO: 280549 - RNA, 23 nt, Human
guaaaauacgcagugcaguguga

SEQ ID NO: 280550 - RNA, 22 nt, Human
ucagaucuggugaaguuauagu

SEQ ID NO: 280551 - RNA, 22 nt, Human
gcuguggcccuuggcaucugcg

SEQ ID NO: 280552 - RNA, 22 nt, Human
ucacaacaggaaggaccagcug

SEQ ID NO: 280553 - RNA, 22 nt, Human
acauagaaccuggcacauagua

SEQ ID NO: 280554 - RNA, 22 nt, Human
ccuccuggugggcgcuucuggc

SEQ ID NO: 280555 - RNA, 22 nt, Human
cuggauguaaagggugaagaaa

SEQ ID NO: 280556 - RNA, 22 nt, Human
uaauguaaacacagagacagaa

SEQ ID NO: 280557 - RNA, 22 nt, Human
gcagacagaugagggugcuggg

SEQ ID NO: 280558 - RNA, 21 nt, Human
ccugggagaucagcugccuuc

SEQ ID NO: 280559 - RNA, 22 nt, Human
gcaucuaaauaaacgugggagu

SEQ ID NO: 280560 - RNA, 22 nt, Human
ccagcuuuuccucucauugcuu

SEQ ID NO: 280561 - RNA, 22 nt, Human
auuuaucucuggaaacuaagca

SEQ ID NO: 280562 - RNA, 22 nt, Human
auucuucagaauaucuggcacu

SEQ ID NO: 280563 - RNA, 22 nt, Human
uucucuuagcuguaaagucaau

SEQ ID NO: 280564 - RNA, 22 nt, Human
uugaaagacuucuccugugaaa

SEQ ID NO: 280565 - RNA, 22 nt, Human
uugggcucaggaguuugagacc

SEQ ID NO: 280566 - RNA, 23 nt, Human
ucaguuaacuguguuaccugugc

SEQ ID NO: 280567 - RNA, 22 nt, Human
uuauucagauuggcuacaggau

SEQ ID NO: 280568 - RNA, 22 nt, Human
uccuucaaaaguugagagagcc

SEQ ID NO: 280569 - RNA, 22 nt, Human
auccugaagcaugaaugucaaa

SEQ ID NO: 280570 - RNA, 22 nt, Human
gcccagcuuuucacuuccacac

SEQ ID NO: 280571 - RNA, 22 nt, Human
uuuguacacugucuacuaugaa

SEQ ID NO: 280572 - RNA, 22 nt, Human
uaugugucugucgugcauaaau

SEQ ID NO: 280573 - RNA, 22 nt, Human
guauacauagaugaugaacaag

SEQ ID NO: 280574 - RNA, 22 nt, Human
acuuuuaaggggccuugauuua

SEQ ID NO: 280575 - RNA, 22 nt, Human
uuuaauuguuguggguacauag

SEQ ID NO: 280576 - RNA, 22 nt, Human
ugucuuuauauauuuggaaaau

SEQ ID NO: 280577 - RNA, 22 nt, Human
uauuauugcaaguauauaaagu

SEQ ID NO: 280578 - RNA, 22 nt, Human
aucucccagccacagcauucuu

SEQ ID NO: 280579 - RNA, 22 nt, Human
aucagaaauagucauguuacuu

SEQ ID NO: 280580 - RNA, 22 nt, Human
gagcagugagugaauguugccu

SEQ ID NO: 280581 - RNA, 22 nt, Human
uagcagggagggccagugucaa

SEQ ID NO: 280582 - RNA, 22 nt, Human
caggauggcagagaaaagggug

SEQ ID NO: 280583 - RNA, 22 nt, Human
ccugccugacagagaagguuca

SEQ ID NO: 280584 - RNA, 22 nt, Human
cacauaauaaauguuccugaug

SEQ ID NO: 280585 - RNA, 22 nt, Human
uagacacaucaaggaucaguuu

SEQ ID NO: 280586 - RNA, 22 nt, Human
auaauauaauccuacuucccau

SEQ ID NO: 280587 - RNA, 22 nt, Human
uggguacuccuauuaguucagu

SEQ ID NO: 280588 - RNA, 22 nt, Human
aagcaccacccucccaaccugu

SEQ ID NO: 280589 - RNA, 22 nt, Human
gugcauuugugcaugcacaugu

SEQ ID NO: 280590 - RNA, 22 nt, Human
uauugcugaggauugaggcuug

SEQ ID NO: 280591 - RNA, 22 nt, Human
cuguccuccagacgacaguccc

SEQ ID NO: 280592 - RNA, 22 nt, Human
gcaucugauccaauagauauau

SEQ ID NO: 280593 - RNA, 22 nt, Human
uuugacucauugauuuucucug

SEQ ID NO: 280594 - RNA, 22 nt, Human
gcuuuggucagguguccagccc

SEQ ID NO: 280595 - RNA, 17 nt, Human
uuuuggugaguuguuuc

SEQ ID NO: 280596 - RNA, 22 nt, Human
aguaaaaauugaggugcaaaau

SEQ ID NO: 280597 - RNA, 22 nt, Human
aagggauguaaacaugaauaag

SEQ ID NO: 280598 - RNA, 22 nt, Human
ugauagaagcagaagcauacca

SEQ ID NO: 280599 - RNA, 22 nt, Human
aguuuauuuuugauaagucuug

SEQ ID NO: 280600 - RNA, 22 nt, Human
ugcuggguagaaguauuagucu

SEQ ID NO: 280601 - RNA, 20 nt, Human
auacacauucauagaaaaau

SEQ ID NO: 280602 - RNA, 22 nt, Human
uagugaaaugauaacagagcag

SEQ ID NO: 280603 - RNA, 22 nt, Human
caugccagguuugaguaucuug

SEQ ID NO: 280604 - RNA, 22 nt, Human
uguggcugcaaaggaaggcugc

SEQ ID NO: 280605 - RNA, 22 nt, Human
gccacugugguccucccaugau

SEQ ID NO: 280606 - RNA, 21 nt, Human
uuucucaguugugugagcagc

SEQ ID NO: 280607 - RNA, 22 nt, Human
gacccaggguauccagagcugc

SEQ ID NO: 280608 - RNA, 22 nt, Human
uaacagaguaacagguauguaa

SEQ ID NO: 280609 - RNA, 22 nt, Human
uuugcaguagacaucuuauuuu

SEQ ID NO: 280610 - RNA, 18 nt, Human
gguggcucagucaugggg

SEQ ID NO: 280611 - RNA, 22 nt, Human
ugcaaauagccugaugaaagaa

SEQ ID NO: 280612 - RNA, 22 nt, Human
ggcuacuagacuuugauacuag

SEQ ID NO: 280613 - RNA, 22 nt, Human
ccuggcuccugccucugcaggg

SEQ ID NO: 280614 - RNA, 20 nt, Human
aucuucuuggccagcuugcu

SEQ ID NO: 280615 - RNA, 22 nt, Human
ccauagcaagaggagcagaaau

SEQ ID NO: 280616 - RNA, 22 nt, Human
cugcugccccugagcucagccu

SEQ ID NO: 280617 - RNA, 20 nt, Human
ugcagggcugccucccagcu

SEQ ID NO: 280618 - RNA, 22 nt, Human
uuuccagauuaagauaccacuu

SEQ ID NO: 280619 - RNA, 22 nt, Human
cagugucuuucagacucagaaa

SEQ ID NO: 280620 - RNA, 22 nt, Human
uggaagggaacagguggguguu

SEQ ID NO: 280621 - RNA, 22 nt, Human
cuuuacagauaggaacuacuca

SEQ ID NO: 280622 - RNA, 20 nt, Human
agacccucuggacugggccc

SEQ ID NO: 280623 - RNA, 22 nt, Human
uuugacuccuguguuucuggaa

SEQ ID NO: 280624 - RNA, 22 nt, Human
ugggugggagcacccugucugg

SEQ ID NO: 280625 - RNA, 22 nt, Human
agauuuuaguuuggggaggugc

SEQ ID NO: 280626 - RNA, 22 nt, Human
aacacuuuuuaguaaagauuga

SEQ ID NO: 280627 - RNA, 17 nt, Human
ugauaguucauuuuaag

SEQ ID NO: 280628 - RNA, 22 nt, Human
aaggccagacaggaccacaucu

SEQ ID NO: 280629 - RNA, 22 nt, Human
uuccauacgacugaggucucgg

SEQ ID NO: 280630 - RNA, 22 nt, Human
caggcauaaucucaucuuguuu

SEQ ID NO: 280631 - RNA, 22 nt, Human
agcccaggucucaaaguacagg

SEQ ID NO: 280632 - RNA, 22 nt, Human
ugaauagagcugcaguggacau

SEQ ID NO: 280633 - RNA, 22 nt, Human
uauuugcaacauaaaacucuga

SEQ ID NO: 280634 - RNA, 22 nt, Human
uuggaacaugccgggguccagg

SEQ ID NO: 280635 - RNA, 22 nt, Human
augaaaugaaguuggccuggcu

SEQ ID NO: 280636 - RNA, 22 nt, Human
agcaggugguaggcagucagca

SEQ ID NO: 280637 - RNA, 22 nt, Human
acugccaaugguaguuugaugg

SEQ ID NO: 280638 - RNA, 22 nt, Human
ggccugacugaccugauucuaa

SEQ ID NO: 280639 - RNA, 18 nt, Human
guuaauuuugaaguucau

SEQ ID NO: 280640 - RNA, 22 nt, Human
uuauuagguuauucucuguacu

SEQ ID NO: 280641 - RNA, 22 nt, Human
cccaggcagagagcuggugagc

SEQ ID NO: 280642 - RNA, 22 nt, Human
uaugaaaagguggccaauguag

SEQ ID NO: 280643 - RNA, 22 nt, Human
aacagcuucaucacauggcaua

SEQ ID NO: 280644 - RNA, 22 nt, Human
ccucugcccuuuuccuguauca

SEQ ID NO: 280645 - RNA, 22 nt, Human
uugcauuguaggauguuagaag

SEQ ID NO: 280646 - RNA, 23 nt, Human
gggaccugguaggaggugauugg

SEQ ID NO: 280647 - RNA, 22 nt, Human
uuucuuguuucauggugucuca

SEQ ID NO: 280648 - RNA, 22 nt, Human
uucucugaucuugcuagacuga

SEQ ID NO: 280649 - RNA, 22 nt, Human
cccagcagggucucugugucua

SEQ ID NO: 280650 - RNA, 22 nt, Human
uccuggaggagauccaaucuga

SEQ ID NO: 280651 - RNA, 21 nt, Human
aaaugaaugugguagugcaag

SEQ ID NO: 280652 - RNA, 22 nt, Human
gggugguggccagcagugggca

SEQ ID NO: 280653 - RNA, 22 nt, Human
acaaguuucauuguuuagaacc

SEQ ID NO: 280654 - RNA, 22 nt, Human
cacaaaugguuguagacauuaa

SEQ ID NO: 280655 - RNA, 22 nt, Human
gguuccaccuggcgagggguau

SEQ ID NO: 280656 - RNA, 22 nt, Human
ucacaagaauuuguagaugaaa

SEQ ID NO: 280657 - RNA, 22 nt, Human
cccaggcauuuucaacuuuagu

SEQ ID NO: 280658 - RNA, 22 nt, Human
cugaaggauuagagagcacuua

SEQ ID NO: 280659 - RNA, 22 nt, Human
aaaauugguuccuuucugaggc

SEQ ID NO: 280660 - RNA, 22 nt, Human
uucacauuagugguucuauaua

SEQ ID NO: 280661 - RNA, 22 nt, Human
auauauauugcccaggcugguu

SEQ ID NO: 280662 - RNA, 22 nt, Human
aaugaugaguucuaauagaccc

SEQ ID NO: 280663 - RNA, 21 nt, Human
aaaaguuugacaggaaaggga

SEQ ID NO: 280664 - RNA, 22 nt, Human
uacacaguauaugggaucacag

SEQ ID NO: 280665 - RNA, 22 nt, Human
uggcucaggaucuaagcagaau

SEQ ID NO: 280666 - RNA, 22 nt, Human
gggaccuggacaugugugugcu

SEQ ID NO: 280667 - RNA, 22 nt, Human
cauguguccacccuugaacaca

SEQ ID NO: 280668 - RNA, 20 nt, Human
gcacaguuugggaaccaugg

SEQ ID NO: 280669 - RNA, 22 nt, Human
augcaucuuaucaaaaauuaua

SEQ ID NO: 280670 - RNA, 22 nt, Human
cggcuggugucgggcacagcaa

SEQ ID NO: 280671 - RNA, 20 nt, Human
aaugucuugagacauuucag

SEQ ID NO: 280672 - RNA, 22 nt, Human
auuuauuggaugcuuacuuggg

SEQ ID NO: 280673 - RNA, 22 nt, Human
uuccuguggccuuacaucugug

SEQ ID NO: 280674 - RNA, 22 nt, Human
uucugugacuccucagagauuu

SEQ ID NO: 280675 - RNA, 22 nt, Human
uuuuagcacuaagugauaugcu

SEQ ID NO: 280676 - RNA, 22 nt, Human
uuaguuagucccugguaccuuu

SEQ ID NO: 280677 - RNA, 22 nt, Human
guucuucaaagugacaacuaaa

SEQ ID NO: 280678 - RNA, 22 nt, Human
aguuaaaucauuacugacagag

SEQ ID NO: 280679 - RNA, 22 nt, Human
auugcugggaauauuuagccca

SEQ ID NO: 280680 - RNA, 22 nt, Human
ucgcuugaacccaggaagugga

SEQ ID NO: 280681 - RNA, 22 nt, Human
auuagagguacaaaccuucacu

SEQ ID NO: 280682 - RNA, 22 nt, Human
aagugauuuagucuuauaaagg

SEQ ID NO: 280683 - RNA, 17 nt, Human
agacagguuauaguuga

SEQ ID NO: 280684 - RNA, 22 nt, Human
ucagguguggaccgaggucaga

SEQ ID NO: 280685 - RNA, 22 nt, Human
uguuuugguuuaaguauaugaa

SEQ ID NO: 280686 - RNA, 22 nt, Human
auguuacaauccaacaaaauua

SEQ ID NO: 280687 - RNA, 22 nt, Human
cuuuaugguaaguauagaugac

SEQ ID NO: 280688 - RNA, 22 nt, Human
ucucucuuuuuaaucauguaau

SEQ ID NO: 280689 - RNA, 22 nt, Human
acauguguguauacguauuuau

SEQ ID NO: 280690 - RNA, 22 nt, Human
accagucuuguugccaugucug

SEQ ID NO: 280691 - RNA, 22 nt, Human
caguuuuaaauuuugaaugucu

SEQ ID NO: 280692 - RNA, 22 nt, Human
uuuacauugcauuagguauuau

SEQ ID NO: 280693 - RNA, 22 nt, Human
aaggaccuauauugucagagga

SEQ ID NO: 280694 - RNA, 22 nt, Human
gucuacuuuugucaucauugca

SEQ ID NO: 280695 - RNA, 21 nt, Human
uccagaggaggacagacucag

SEQ ID NO: 280696 - RNA, 22 nt, Human
ggccugaggccaccagcagccc

SEQ ID NO: 280697 - RNA, 22 nt, Human
guguguccaggcgggagucaag

SEQ ID NO: 280698 - RNA, 22 nt, Human
uccuggcacccuuggguuggag

SEQ ID NO: 280699 - RNA, 19 nt, Human
caugugucaauacuguacc

SEQ ID NO: 280700 - RNA, 22 nt, Human
uagggcaggugaagaaaagcua

SEQ ID NO: 280701 - RNA, 23 nt, Human
aguccuuuuuauaaaauugagga

SEQ ID NO: 280702 - RNA, 22 nt, Human
uugacccagcuuuccccacaau

SEQ ID NO: 280703 - RNA, 17 nt, Human
accaggcaacacgccca

SEQ ID NO: 280704 - RNA, 22 nt, Human
ugcaggugugggcaggggagca

SEQ ID NO: 280705 - RNA, 22 nt, Human
aaugaguuauuagguguaagug

SEQ ID NO: 280706 - RNA, 22 nt, Human
caggcuggagugcaauggcaca

SEQ ID NO: 280707 - RNA, 22 nt, Human
cuccuggaugcaggcugucugc

SEQ ID NO: 280708 - RNA, 22 nt, Human
aaaugaacaucaagaauagccu

SEQ ID NO: 280709 - RNA, 22 nt, Human
aucauucuaguccuuauggucu

SEQ ID NO: 280710 - RNA, 22 nt, Human
ugaauaauuccuuuuugucaag

SEQ ID NO: 280711 - RNA, 22 nt, Human
uggagcagggcaucacugugcg

SEQ ID NO: 280712 - RNA, 22 nt, Human
uacaagcucacaaauuuuuaag

SEQ ID NO: 280713 - RNA, 22 nt, Human
ccugagcuuuaaaagccaugua

SEQ ID NO: 280714 - RNA, 22 nt, Human
acaauacaggcuucuggacuua

SEQ ID NO: 280715 - RNA, 22 nt, Human
uuuacaauugguuuucucuaau

SEQ ID NO: 280716 - RNA, 22 nt, Human
ugacauuucuuguugauauaaa

SEQ ID NO: 280717 - RNA, 22 nt, Human
aaaccaucagauaauucauacu

SEQ ID NO: 280718 - RNA, 22 nt, Human
aggaggcuuuugcaggugccac

SEQ ID NO: 280719 - RNA, 22 nt, Human
acuguccauucacucauauuca

SEQ ID NO: 280720 - RNA, 22 nt, Human
uuugacucccaaacugugauuu

SEQ ID NO: 280721 - RNA, 22 nt, Human
ucuccgaucacagguuuucaau

SEQ ID NO: 280722 - RNA, 22 nt, Human
aggagggaauaagaaagaguca

SEQ ID NO: 280723 - RNA, 22 nt, Human
uagcugaugaauaauuauucuu

SEQ ID NO: 280724 - RNA, 22 nt, Human
cagagucaugggccgucaggca

SEQ ID NO: 280725 - RNA, 22 nt, Human
agcaccaucggguucuugcuuu

SEQ ID NO: 280726 - RNA, 20 nt, Human
cugaacacagaauaagcaca

SEQ ID NO: 280727 - RNA, 22 nt, Human
uuccugugcuuauucuucucug

SEQ ID NO: 280728 - RNA, 22 nt, Human
ugcagguggauucaauguggga

SEQ ID NO: 280729 - RNA, 22 nt, Human
ugaccaggauacugcagggaug

SEQ ID NO: 280730 - RNA, 22 nt, Human
agcaguccaacugagguggcau

SEQ ID NO: 280731 - RNA, 22 nt, Human
caaguccaagaucaagaagcca

SEQ ID NO: 280732 - RNA, 22 nt, Human
uaugcaaaguccuaagaaagaa

SEQ ID NO: 280733 - RNA, 22 nt, Human
cagcugucucagggaggugauc

SEQ ID NO: 280734 - RNA, 22 nt, Human
gacccagugacucgucucugug

SEQ ID NO: 280735 - RNA, 22 nt, Human
gauuuuacugucuguguaucuc

SEQ ID NO: 280736 - RNA, 22 nt, Human
uuucuuuguaguagcauaauca

SEQ ID NO: 280737 - RNA, 18 nt, Human
ucugagguggacgaggag

SEQ ID NO: 280738 - RNA, 22 nt, Human
gggaacagagugccagacugac

SEQ ID NO: 280739 - RNA, 19 nt, Human
uuaaagugcgagaagucuu

SEQ ID NO: 280740 - RNA, 22 nt, Human
aaggaaagacaggacggaauuc

SEQ ID NO: 280741 - RNA, 16 nt, Human
agcagguguauagugu

SEQ ID NO: 280742 - RNA, 22 nt, Human
acuuuuuaguuuccucaaacau

SEQ ID NO: 280743 - RNA, 22 nt, Human
aguaaaauuguauuggaaaaca

SEQ ID NO: 280744 - RNA, 18 nt, Human
ucccuucucccuugccuc

SEQ ID NO: 280745 - RNA, 22 nt, Human
uacugucugcuucuuauagcuu

SEQ ID NO: 280746 - RNA, 22 nt, Human
gacaggcugugauggccgggag

SEQ ID NO: 280747 - RNA, 22 nt, Human
agucaguuuucuccagggggcu

SEQ ID NO: 280748 - RNA, 22 nt, Human
cucacagcauggaauuuucugg

SEQ ID NO: 280749 - RNA, 19 nt, Human
cucuggagcagacacugga

SEQ ID NO: 280750 - RNA, 22 nt, Human
ggaaaaauagaguauacuuuaa

SEQ ID NO: 280751 - RNA, 19 nt, Human
gcagguggauguggucagc

SEQ ID NO: 280752 - RNA, 22 nt, Human
uuugacuccugccuucuccugu

SEQ ID NO: 280753 - RNA, 22 nt, Human
cuccuggcacucaguguggaag

SEQ ID NO: 280754 - RNA, 22 nt, Human
gccacugcacuccagcccaggc

SEQ ID NO: 280755 - RNA, 20 nt, Human
ccaggccugggccugcucua

SEQ ID NO: 280756 - RNA, 23 nt, Human
agcuucugguucaggucaagcag

SEQ ID NO: 280757 - RNA, 22 nt, Human
caggauggucagaugcauuguc

SEQ ID NO: 280758 - RNA, 22 nt, Human
ucaguuuaagaugacuaacaau

SEQ ID NO: 280759 - RNA, 22 nt, Human
gcccucucuucugcagccucca

SEQ ID NO: 280760 - RNA, 22 nt, Human
auuuauuaugggauuuggcaca

SEQ ID NO: 280761 - RNA, 20 nt, Human
uucugcuugcaaauaucaag

SEQ ID NO: 280762 - RNA, 22 nt, Human
ucugagauuuguauggugagac

SEQ ID NO: 280763 - RNA, 22 nt, Human
agcaaacagaugucuccuuuag

SEQ ID NO: 280764 - RNA, 22 nt, Human
cccaggcacaccccgaacggaa

SEQ ID NO: 280765 - RNA, 22 nt, Human
cugcccucgggcccucccauag

SEQ ID NO: 280766 - RNA, 22 nt, Human
aggcagguccccuggaaggcac

SEQ ID NO: 280767 - RNA, 22 nt, Human
uuugacucuugcuuugguggcu

SEQ ID NO: 280768 - RNA, 22 nt, Human
ccacugccuauuugcagggccc

SEQ ID NO: 280769 - RNA, 22 nt, Human
uccaggcuggagugcaguggcg

SEQ ID NO: 280770 - RNA, 22 nt, Human
gacagacaugggacuucauacu

SEQ ID NO: 280771 - RNA, 22 nt, Human
cacagcauucacagaaagacau

SEQ ID NO: 280772 - RNA, 22 nt, Human
uugaagagaaucagaagguuga

SEQ ID NO: 280773 - RNA, 22 nt, Human
aucagagacaaaaccagcacuu

SEQ ID NO: 280774 - RNA, 22 nt, Human
ggugccagaguggcccaggggc

SEQ ID NO: 280775 - RNA, 22 nt, Human
ucccaaggugcucggcaacagg

SEQ ID NO: 280776 - RNA, 22 nt, Human
cagugaggaagcugucuggacc

SEQ ID NO: 280777 - RNA, 22 nt, Human
auaugcagagagcaugaauagg

SEQ ID NO: 280778 - RNA, 22 nt, Human
uuugacauuaaggaacauauau

SEQ ID NO: 280779 - RNA, 22 nt, Human
cugaggugagaggaggccaugu

SEQ ID NO: 280780 - RNA, 22 nt, Human
uuuauauguuuguacaauuaag

SEQ ID NO: 280781 - RNA, 22 nt, Human
gccugggugaauuugauccuaa

SEQ ID NO: 280782 - RNA, 22 nt, Human
uugguacagaugagguauucuc

SEQ ID NO: 280783 - RNA, 22 nt, Human
aagcuuuaugaucucucagcua

SEQ ID NO: 280784 - RNA, 22 nt, Human
uuucugaggaauuaauacagaa

SEQ ID NO: 280785 - RNA, 22 nt, Human
cuggauguccagguagaaguuu

SEQ ID NO: 280786 - RNA, 22 nt, Human
ugcuauuuggcacuuuugaccu

SEQ ID NO: 280787 - RNA, 22 nt, Human
ccagccacagcuuccagcuccu

SEQ ID NO: 280788 - RNA, 22 nt, Human
uuuuauugggaguccucuacug

SEQ ID NO: 280789 - RNA, 22 nt, Human
aaguccagugauacuggcagga

SEQ ID NO: 280790 - RNA, 18 nt, Human
ccauguguuccuuuuggg

SEQ ID NO: 280791 - RNA, 22 nt, Human
ugcucuucaccauuacaucaug

SEQ ID NO: 280792 - RNA, 22 nt, Human
aaguccaugaucaagauguggc

SEQ ID NO: 280793 - RNA, 22 nt, Human
uauugcugccaggacccuaucc

SEQ ID NO: 280794 - RNA, 22 nt, Human
ucuucucuguggccugguggug

SEQ ID NO: 280795 - RNA, 22 nt, Human
ugagucagugacaugaacuugu

SEQ ID NO: 280796 - RNA, 22 nt, Human
aacaaugugaagugcuguucag

SEQ ID NO: 280797 - RNA, 22 nt, Human
acucacuuuccauucaagcacc

SEQ ID NO: 280798 - RNA, 22 nt, Human
auucuucaaagagugucaaagu

SEQ ID NO: 280799 - RNA, 22 nt, Human
uccugcagccuugggcuggagc

SEQ ID NO: 280800 - RNA, 22 nt, Human
aagcccugucacccugacuuca

SEQ ID NO: 280801 - RNA, 22 nt, Human
ucuguggcauagugcuugggaa

SEQ ID NO: 280802 - RNA, 22 nt, Human
cacucugugauugcagcauucc

SEQ ID NO: 280803 - RNA, 22 nt, Human
uucauacaguggcugcacucca

SEQ ID NO: 280804 - RNA, 22 nt, Human
cauuuguuaaugcugcuuuuaa

SEQ ID NO: 280805 - RNA, 22 nt, Human
aaggugcuguggacuugggagc

SEQ ID NO: 280806 - RNA, 22 nt, Human
aggacaguccgggguccuccac

SEQ ID NO: 280807 - RNA, 22 nt, Human
acccuccaggcugcagcuccug

SEQ ID NO: 280808 - RNA, 22 nt, Human
ucccacccauccugcaucucuu

SEQ ID NO: 280809 - RNA, 19 nt, Human
agguggucuaggcuggaga

SEQ ID NO: 280810 - RNA, 22 nt, Human
uauacaguuugaguucuugcau

SEQ ID NO: 280811 - RNA, 22 nt, Human
agaaaaaucuuggcgcuugucu

SEQ ID NO: 280812 - RNA, 22 nt, Human
uucagcaaacacgaugcuuguu

SEQ ID NO: 280813 - RNA, 19 nt, Human
cucagcaagauagaaaugg

SEQ ID NO: 280814 - RNA, 22 nt, Human
cugugaccuccaggaaggggug

SEQ ID NO: 280815 - RNA, 22 nt, Human
agccagaggaacuugaugacug

SEQ ID NO: 280816 - RNA, 22 nt, Human
aaaguccuagcgauccacagaa

SEQ ID NO: 280817 - RNA, 22 nt, Human
uucacauuauaaucaguucugc

SEQ ID NO: 280818 - RNA, 22 nt, Human
uugcuugacuuuguguaccugu

SEQ ID NO: 280819 - RNA, 23 nt, Human
aacugucuugcaagugugauacc

SEQ ID NO: 280820 - RNA, 22 nt, Human
auugauaucaguuugcugauug

SEQ ID NO: 280821 - RNA, 22 nt, Human
cugggcugcuguccacuagggu

SEQ ID NO: 280822 - RNA, 19 nt, Human
ggcaagcacaaaagcuuug

SEQ ID NO: 280823 - RNA, 22 nt, Human
agggaccugcucacugccuggc

SEQ ID NO: 280824 - RNA, 22 nt, Human
cucauggcagagucaccugucc

SEQ ID NO: 280825 - RNA, 22 nt, Human
ccugcucccgggacgcguucac

SEQ ID NO: 280826 - RNA, 22 nt, Human
uuuccucacucaugucaucagu

SEQ ID NO: 280827 - RNA, 22 nt, Human
agagccagagaccuggguucac

SEQ ID NO: 280828 - RNA, 22 nt, Human
cagaagcagaacacuagauuua

SEQ ID NO: 280829 - RNA, 22 nt, Human
guuuacauugcuguuugugucu

SEQ ID NO: 280830 - RNA, 22 nt, Human
gagcagugaugggaggacguca

SEQ ID NO: 280831 - RNA, 18 nt, Human
ucagagagaauaguaauu

SEQ ID NO: 280832 - RNA, 22 nt, Human
uacugucuuuccauccuugccu

SEQ ID NO: 280833 - RNA, 22 nt, Human
gcuguguaucagaugccacggg

SEQ ID NO: 280834 - RNA, 22 nt, Human
ggcagggcaggaaagucaggaa

SEQ ID NO: 280835 - RNA, 22 nt, Human
ucucugaagauauuuauuauua

SEQ ID NO: 280836 - RNA, 22 nt, Human
uuugaaauguaucaguauaggu

SEQ ID NO: 280837 - RNA, 22 nt, Human
gguuucaacuaaaucaagaagg

SEQ ID NO: 280838 - RNA, 22 nt, Human
ucuccuggcucuaaaaggcugu

SEQ ID NO: 280839 - RNA, 22 nt, Human
ccuccuggauggauuuggugga

SEQ ID NO: 280840 - RNA, 22 nt, Human
ggguuucaugguucucacaaug

SEQ ID NO: 280841 - RNA, 22 nt, Human
uuuagaauuggcuagugggaau

SEQ ID NO: 280842 - RNA, 21 nt, Human
cagugaggcccuccuguuccc

SEQ ID NO: 280843 - RNA, 22 nt, Human
gaggccuggugugucucccgcu

SEQ ID NO: 280844 - RNA, 22 nt, Human
cccagagauguccugagugaua

SEQ ID NO: 280845 - RNA, 16 nt, Human
ccuggaggucacuuca

SEQ ID NO: 280846 - RNA, 22 nt, Human
gcccagguuggagagcaguggc

SEQ ID NO: 280847 - RNA, 20 nt, Human
ugagccaggcuaggaagggc

SEQ ID NO: 280848 - RNA, 22 nt, Human
aggaaaaauaaggcagcagggc

SEQ ID NO: 280849 - RNA, 22 nt, Human
cuuaaauuuucaucuacaagaa

SEQ ID NO: 280850 - RNA, 22 nt, Human
caaacauuugacuucucucagg

SEQ ID NO: 280851 - RNA, 22 nt, Human
gccugcagcaugcuaggucuug

SEQ ID NO: 280852 - RNA, 20 nt, Human
auaaaauaacugccacaaga

SEQ ID NO: 280853 - RNA, 22 nt, Human
uuucacauaucaacucuauccu

SEQ ID NO: 280854 - RNA, 22 nt, Human
uucuguaucuuucuucaagauu

SEQ ID NO: 280855 - RNA, 20 nt, Human
ucagugucaguagccacuac

SEQ ID NO: 280856 - RNA, 22 nt, Human
augcacaagaggcuagaaaaga

SEQ ID NO: 280857 - RNA, 22 nt, Human
gcagccacucucauuccacgug

SEQ ID NO: 280858 - RNA, 22 nt, Human
agugcuuuauguuguugugcaa

SEQ ID NO: 280859 - RNA, 22 nt, Human
ggugcaggagcggggugcucgg

SEQ ID NO: 280860 - RNA, 23 nt, Human
aaguucuuagguugauacuaaug

SEQ ID NO: 280861 - RNA, 22 nt, Human
gagaacacaugcagacugggua

SEQ ID NO: 280862 - RNA, 22 nt, Human
ugcuggguuaccuaagccuaaa

SEQ ID NO: 280863 - RNA, 22 nt, Human
agacagagauacuauguuguca

SEQ ID NO: 280864 - RNA, 22 nt, Human
cacaugacucuggcuacccaga

SEQ ID NO: 280865 - RNA, 23 nt, Human
auuucuaggggauuuucuggugc

SEQ ID NO: 280866 - RNA, 22 nt, Human
cucccagagaccaagcugagaa

SEQ ID NO: 280867 - RNA, 22 nt, Human
ugcagggcccuugggguugaac

SEQ ID NO: 280868 - RNA, 19 nt, Human
uggccagguacugucugcu

SEQ ID NO: 280869 - RNA, 22 nt, Human
uacccagcaaucccuagagguu

SEQ ID NO: 280870 - RNA, 22 nt, Human
acagacagacagauugcauaug

SEQ ID NO: 280871 - RNA, 22 nt, Human
gucauuccuauccauuugauac

SEQ ID NO: 280872 - RNA, 21 nt, Human
augugaaauaucaucagagca

SEQ ID NO: 280873 - RNA, 22 nt, Human
caggugguugagagcuguaggc

SEQ ID NO: 280874 - RNA, 22 nt, Human
agaaauaugcugauuagaugaa

SEQ ID NO: 280875 - RNA, 22 nt, Human
agcauaaaggcacuagaaagag

SEQ ID NO: 280876 - RNA, 22 nt, Human
uuucugcauuguccucuugguu

SEQ ID NO: 280877 - RNA, 22 nt, Human
cagcuauugauaaauguugggg

SEQ ID NO: 280878 - RNA, 22 nt, Human
augaaauucaucugagaaugcu

SEQ ID NO: 280879 - RNA, 22 nt, Human
auauuagguuggugcaaaagua

SEQ ID NO: 280880 - RNA, 22 nt, Human
uucccagaaugaauggauggag

SEQ ID NO: 280881 - RNA, 22 nt, Human
ugacauguguaaucagcuccgu

SEQ ID NO: 280882 - RNA, 22 nt, Human
uuauuuaaugugaucugaagag

SEQ ID NO: 280883 - RNA, 22 nt, Human
ucaggaaaguguucucagagga

SEQ ID NO: 280884 - RNA, 22 nt, Human
agggcugacaaauggcagugac

SEQ ID NO: 280885 - RNA, 22 nt, Human
cacaucugaaaagaugcacaag

SEQ ID NO: 280886 - RNA, 22 nt, Human
gagcugaacaucauggaaaggc

SEQ ID NO: 280887 - RNA, 22 nt, Human
cagggaugagcagauggagcaa

SEQ ID NO: 280888 - RNA, 22 nt, Human
ucuguucagaagaggugaaagu

SEQ ID NO: 280889 - RNA, 22 nt, Human
uaaaguuauaaauuaccuguca

SEQ ID NO: 280890 - RNA, 22 nt, Human
ugcaaacaccacagagacaauu

SEQ ID NO: 280891 - RNA, 22 nt, Human
ggagcaguuguugagcaagcca

SEQ ID NO: 280892 - RNA, 22 nt, Human
accagagcuuacaugcuagaaa

SEQ ID NO: 280893 - RNA, 22 nt, Human
cagucucucuuguagugcagcu

SEQ ID NO: 280894 - RNA, 22 nt, Human
ccugagucuuggcuucuuggcu

SEQ ID NO: 280895 - RNA, 22 nt, Human
uucauagagcagcucacugaau

SEQ ID NO: 280896 - RNA, 22 nt, Human
cauaauccugguguagcccucu

SEQ ID NO: 280897 - RNA, 22 nt, Human
gcugaaauucagauuccuaggc

SEQ ID NO: 280898 - RNA, 22 nt, Human
uccaugcagaguccaggccuca

SEQ ID NO: 280899 - RNA, 22 nt, Human
uauccaaaggaacaaucacagc

SEQ ID NO: 280900 - RNA, 23 nt, Human
ucugucuuguuuaggccacuguu

SEQ ID NO: 280901 - RNA, 22 nt, Human
acuguagucuaaauauagucuu

SEQ ID NO: 280902 - RNA, 22 nt, Human
uuuuccuuucaucaggacaaag

SEQ ID NO: 280903 - RNA, 22 nt, Human
guuaaacaauaacuggcacaca

SEQ ID NO: 280904 - RNA, 22 nt, Human
aguuuuauuccaaugugcagca

SEQ ID NO: 280905 - RNA, 22 nt, Human
ugacccaucaggccacaugagg

SEQ ID NO: 280906 - RNA, 22 nt, Human
aggcagcccugugcuggaugcu

SEQ ID NO: 280907 - RNA, 22 nt, Human
uccaggcuagguuuacaggaca

SEQ ID NO: 280908 - RNA, 22 nt, Human
agggauguuaguugugagcuca

SEQ ID NO: 280909 - RNA, 22 nt, Human
auucuucacaccuguuccuguu

SEQ ID NO: 280910 - RNA, 22 nt, Human
uccugcagcugcagaccugggg

SEQ ID NO: 280911 - RNA, 22 nt, Human
uuaaagaggcagguuaaauaau

SEQ ID NO: 280912 - RNA, 23 nt, Human
uugauuucaaaugcagagaacac

SEQ ID NO: 280913 - RNA, 22 nt, Human
aggcuugguuaauucuguguga

SEQ ID NO: 280914 - RNA, 22 nt, Human
cccagagggcugaggauaugaa

SEQ ID NO: 280915 - RNA, 22 nt, Human
gggccugaggcccagacacugg

SEQ ID NO: 280916 - RNA, 22 nt, Human
acaugucuaaguacucaacaaa

SEQ ID NO: 280917 - RNA, 22 nt, Human
acuuugcagggcuugauaucca

SEQ ID NO: 280918 - RNA, 22 nt, Human
gugggguagaucuuucucagga

SEQ ID NO: 280919 - RNA, 23 nt, Human
guaggaauuuucacuuccucuug

SEQ ID NO: 280920 - RNA, 22 nt, Human
gagagaaaagggggaauugauu

SEQ ID NO: 280921 - RNA, 22 nt, Human
aaaauugaagugaucaggaacu

SEQ ID NO: 280922 - RNA, 22 nt, Human
ugagcaggagauaaacagguag

SEQ ID NO: 280923 - RNA, 22 nt, Human
agcugaaaggguguuggagugu

SEQ ID NO: 280924 - RNA, 22 nt, Human
uaaaagauaucuuagggauuug

SEQ ID NO: 280925 - RNA, 22 nt, Human
auucaaauuaaguuaauucagc

SEQ ID NO: 280926 - RNA, 22 nt, Human
uuucagaaacgauuaugaacac

SEQ ID NO: 280927 - RNA, 22 nt, Human
agcccaugcaacaggccuagcg

SEQ ID NO: 280928 - RNA, 22 nt, Human
agguguccaauccugguuggau

SEQ ID NO: 280929 - RNA, 22 nt, Human
agcagguggccacgaggaggag

SEQ ID NO: 280930 - RNA, 22 nt, Human
aggccaggccuuucuccauucc

SEQ ID NO: 280931 - RNA, 22 nt, Human
guccugaggcaggauggguuuc

SEQ ID NO: 280932 - RNA, 20 nt, Human
aggccaggaaauguaguucu

SEQ ID NO: 280933 - RNA, 22 nt, Human
uugagcaggauggcuaugcaca

SEQ ID NO: 280934 - RNA, 22 nt, Human
agucucucacagaggauucucc

SEQ ID NO: 280935 - RNA, 22 nt, Human
agaccuggauuccaauccuacc

SEQ ID NO: 280936 - RNA, 22 nt, Human
auaacagauacucucugugagg

SEQ ID NO: 280937 - RNA, 22 nt, Human
ccagccccgggaaccuggccgu

SEQ ID NO: 280938 - RNA, 22 nt, Human
uagccauuuuuauuaaugcugg

SEQ ID NO: 280939 - RNA, 22 nt, Human
caggcuugagggcaggcccagu

SEQ ID NO: 280940 - RNA, 22 nt, Human
uagggauggaugaugccuggca

SEQ ID NO: 280941 - RNA, 22 nt, Human
cuccuggcuuucccagaccagg

SEQ ID NO: 280942 - RNA, 22 nt, Human
auauuacauaaacaugagugaa

SEQ ID NO: 280943 - RNA, 22 nt, Human
aggagggauagaaaaauacuug

SEQ ID NO: 280944 - RNA, 22 nt, Human
aaccccgcucaggcugggugag

SEQ ID NO: 280945 - RNA, 22 nt, Human
uagaaucuaguucauucauuug

SEQ ID NO: 280946 - RNA, 22 nt, Human
ucccagccaggcucuaccacuu

SEQ ID NO: 280947 - RNA, 22 nt, Human
uauuccagugugaucuuuguag

SEQ ID NO: 280948 - RNA, 22 nt, Human
ucuguucaugaaauaucuuuuu

SEQ ID NO: 280949 - RNA, 22 nt, Human
uuccuggccucucucugagcag

SEQ ID NO: 280950 - RNA, 19 nt, Human
uugcuggagaaaaaggaga

SEQ ID NO: 280951 - RNA, 22 nt, Human
ccuggcagcgugccgagcugcg

SEQ ID NO: 280952 - RNA, 22 nt, Human
caaaauguucuggcaccuuuaa

SEQ ID NO: 280953 - RNA, 22 nt, Human
uacacaugacaguggacugaga

SEQ ID NO: 280954 - RNA, 22 nt, Human
gagaaaaucuugggucaagaau

SEQ ID NO: 280955 - RNA, 20 nt, Human
ccaagagcaugcaugaggaa

SEQ ID NO: 280956 - RNA, 22 nt, Human
uuucauguauuucccaaagcuu

SEQ ID NO: 280957 - RNA, 22 nt, Human
cugccugcucaccagggcucug

SEQ ID NO: 280958 - RNA, 22 nt, Human
uuacaguuuauccaggaagagc

SEQ ID NO: 280959 - RNA, 22 nt, Human
uuuagcuuuugugucagauaag

SEQ ID NO: 280960 - RNA, 22 nt, Human
cagguggcuuauuagggucagu

SEQ ID NO: 280961 - RNA, 22 nt, Human
uacaacaugugguccuuuauga

SEQ ID NO: 280962 - RNA, 22 nt, Human
gguguccugucagcuagaguga

SEQ ID NO: 280963 - RNA, 22 nt, Human
uuagaaagcuuuccauagucaa

SEQ ID NO: 280964 - RNA, 22 nt, Human
gaaggagagggucaaggauaau

SEQ ID NO: 280965 - RNA, 22 nt, Human
uacaugcaauuaagagggugaa

SEQ ID NO: 280966 - RNA, 22 nt, Human
ucuccugggugcuuuaucagaa

SEQ ID NO: 280967 - RNA, 22 nt, Human
uacagacagacuucccacccuc

SEQ ID NO: 280968 - RNA, 22 nt, Human
ucucugaacuuccuggaaaggc

SEQ ID NO: 280969 - RNA, 22 nt, Human
cuuucccuuagccccauucuau

SEQ ID NO: 280970 - RNA, 22 nt, Human
gugugggaaggcuaggaugcug

SEQ ID NO: 280971 - RNA, 20 nt, Human
uagacuuuucaucaaccuua

SEQ ID NO: 280972 - RNA, 22 nt, Human
uagcuuuagugaaaaauaucag

SEQ ID NO: 280973 - RNA, 22 nt, Human
aauggcuucugaagcacacuuu

SEQ ID NO: 280974 - RNA, 22 nt, Human
agcugucaggcagaacugagcu

SEQ ID NO: 280975 - RNA, 22 nt, Human
auacagauguugaauguuauau

SEQ ID NO: 280976 - RNA, 22 nt, Human
guuuaaauaauuaggggccugu

SEQ ID NO: 280977 - RNA, 22 nt, Human
ggcucccacccauagggcgagu

SEQ ID NO: 280978 - RNA, 20 nt, Human
ucuguucaaaucuuaguucc

SEQ ID NO: 280979 - RNA, 22 nt, Human
ugcaagcaaguuuuugaagugg

SEQ ID NO: 280980 - RNA, 22 nt, Human
gugauuuugagaccuauauagu

SEQ ID NO: 280981 - RNA, 22 nt, Human
uuuuucaucugauugauaacuc

SEQ ID NO: 280982 - RNA, 22 nt, Human
cuuaaauucuuaaugcccucau

SEQ ID NO: 280983 - RNA, 20 nt, Human
gauaaauugucucuuaagug

SEQ ID NO: 280984 - RNA, 19 nt, Human
ugguggaggugcaccugac

SEQ ID NO: 280985 - RNA, 22 nt, Human
agugugaguaauucagggaggg

SEQ ID NO: 280986 - RNA, 22 nt, Human
gggaccugccaaggccacccag

SEQ ID NO: 280987 - RNA, 22 nt, Human
aggagcugugaaugggaggggu

SEQ ID NO: 280988 - RNA, 22 nt, Human
uugcuuuauuuggcaugccacu

SEQ ID NO: 280989 - RNA, 22 nt, Human
gccuccggagucacagugucuu

SEQ ID NO: 280990 - RNA, 22 nt, Human
aagggcucccaacucaucuuuu

SEQ ID NO: 280991 - RNA, 22 nt, Human
cuucuucauaggcaguccuguu

SEQ ID NO: 280992 - RNA, 22 nt, Human
ucauuuguugaacuuuagugcg

SEQ ID NO: 280993 - RNA, 16 nt, Human
aauugcuucuugcugc

SEQ ID NO: 280994 - RNA, 22 nt, Human
cacuugauggaagagcagaaga

SEQ ID NO: 280995 - RNA, 22 nt, Human
accugccuauggagccacaugg

SEQ ID NO: 280996 - RNA, 22 nt, Human
acacuaauuaagcugcuuuacu

SEQ ID NO: 280997 - RNA, 22 nt, Human
uguuccaauaaggaguugaaau

SEQ ID NO: 280998 - RNA, 22 nt, Human
accugccagaauccaagccaca

SEQ ID NO: 280999 - RNA, 22 nt, Human
cagggaugaccagagggaugug

SEQ ID NO: 281000 - RNA, 22 nt, Human
uaguuaggguucugcagagaca

SEQ ID NO: 281001 - RNA, 22 nt, Human
gcugucuugcucacucuugcag

SEQ ID NO: 281002 - RNA, 22 nt, Human
aaaacuuagcuaggcaaguuuu

SEQ ID NO: 281003 - RNA, 22 nt, Human
guuaaauaaccucauguccguu

SEQ ID NO: 281004 - RNA, 22 nt, Human
auggcuugauagaaagcuaguu

SEQ ID NO: 281005 - RNA, 22 nt, Human
ggacaaaauccaaacuucuuag

SEQ ID NO: 281006 - RNA, 20 nt, Human
ucauuacagugcuaagaugu

SEQ ID NO: 281007 - RNA, 18 nt, Human
ucuguggcagcagugcac

SEQ ID NO: 281008 - RNA, 22 nt, Human
guggaggaagggauucagacca

SEQ ID NO: 281009 - RNA, 22 nt, Human
uguccagugauucucaugagcc

SEQ ID NO: 281010 - RNA, 22 nt, Human
ucucuuaauuuuggaauagugu

SEQ ID NO: 281011 - RNA, 22 nt, Human
gcuccugggcucuaccuugcua

SEQ ID NO: 281012 - RNA, 22 nt, Human
gagggggaaagucccuggaguc

SEQ ID NO: 281013 - RNA, 20 nt, Human
uuccuggggaaugauagaag

SEQ ID NO: 281014 - RNA, 17 nt, Human
aggccucccuccaggcc

SEQ ID NO: 281015 - RNA, 22 nt, Human
guagcuauuuaugauacucaug

SEQ ID NO: 281016 - RNA, 19 nt, Human
aucagcaagguaggaugug

SEQ ID NO: 281017 - RNA, 22 nt, Human
ucaugaacaucucaaauaacca

SEQ ID NO: 281018 - RNA, 22 nt, Human
uacagacauuuacuccacuccu

SEQ ID NO: 281019 - RNA, 22 nt, Human
ccaggcuguaagagugauguug

SEQ ID NO: 281020 - RNA, 22 nt, Human
uacaaaaaauugauacugacga

SEQ ID NO: 281021 - RNA, 22 nt, Human
ucauggcuggaagcucaguuag

SEQ ID NO: 281022 - RNA, 22 nt, Human
caaauggcuggcauccuucuac

SEQ ID NO: 281023 - RNA, 22 nt, Human
cacauaauugaacgugaugagu

SEQ ID NO: 281024 - RNA, 22 nt, Human
agcaugaaaggcgugccaacuu

SEQ ID NO: 281025 - RNA, 22 nt, Human
uugcugaugguauuaugcuagu

SEQ ID NO: 281026 - RNA, 18 nt, Human
ucuagaaacccagacucu

SEQ ID NO: 281027 - RNA, 22 nt, Human
ucuguucauaguaguguauaug

SEQ ID NO: 281028 - RNA, 22 nt, Human
uucuggcucgauucucugaccg

SEQ ID NO: 281029 - RNA, 22 nt, Human
gagaaaugcaugcaugucauca

SEQ ID NO: 281030 - RNA, 21 nt, Human
ucuguucaaggaacuacggau

SEQ ID NO: 281031 - RNA, 22 nt, Human
ucugugccaucagucuccagag

SEQ ID NO: 281032 - RNA, 21 nt, Human
agacagagugcagucuacaua

SEQ ID NO: 281033 - RNA, 22 nt, Human
agggaaaggcugaugcuguggg

SEQ ID NO: 281034 - RNA, 22 nt, Human
uccagcucaaagugcuccuguc

SEQ ID NO: 281035 - RNA, 22 nt, Human
aaagugaggacuugaguacugu

SEQ ID NO: 281036 - RNA, 23 nt, Human
acuugauuauuguugauagauuc

SEQ ID NO: 281037 - RNA, 22 nt, Human
acuugguucuaacuaguguaua

SEQ ID NO: 281038 - RNA, 22 nt, Human
agacauauauugcaauucacug

SEQ ID NO: 281039 - RNA, 17 nt, Human
agagggaaaaugcgguu

SEQ ID NO: 281040 - RNA, 22 nt, Human
gcaccugcuggggcugaugaga

SEQ ID NO: 281041 - RNA, 22 nt, Human
gaguuaaaaaugccuccaugga

SEQ ID NO: 281042 - RNA, 22 nt, Human
ucccacaccugucuauuccuag

SEQ ID NO: 281043 - RNA, 22 nt, Human
agugcaugccuuccuguggaug

SEQ ID NO: 281044 - RNA, 22 nt, Human
uccaggcauguugggaagauga

SEQ ID NO: 281045 - RNA, 22 nt, Human
uuucuuuccaugagccuaugua

SEQ ID NO: 281046 - RNA, 22 nt, Human
caggaggcagcgcucucaggac

SEQ ID NO: 281047 - RNA, 19 nt, Human
ccagagagcuagguacaga

SEQ ID NO: 281048 - RNA, 19 nt, Human
gcgaggaagucacuguggu

SEQ ID NO: 281049 - RNA, 22 nt, Human
gggucccuggaauuacuugaca

SEQ ID NO: 281050 - RNA, 22 nt, Human
ccuggcaagugggcucccagau

SEQ ID NO: 281051 - RNA, 22 nt, Human
cuuucuuauaccugucagggcc

SEQ ID NO: 281052 - RNA, 22 nt, Human
ugguucagagaguugcugacca

SEQ ID NO: 281053 - RNA, 22 nt, Human
gcugcagggagcuggaaggcuc

SEQ ID NO: 281054 - RNA, 22 nt, Human
acaagacugugcucuaagagug

SEQ ID NO: 281055 - RNA, 22 nt, Human
cagaugaaggccugaaugucua

SEQ ID NO: 281056 - RNA, 22 nt, Human
augugcaacuuuucugucuuuu

SEQ ID NO: 281057 - RNA, 22 nt, Human
gcagacaggauuggguuaauag

SEQ ID NO: 281058 - RNA, 22 nt, Human
uuacagaucaucaagguauaau

SEQ ID NO: 281059 - RNA, 22 nt, Human
uaagaaacauuuuuaugacagu

SEQ ID NO: 281060 - RNA, 22 nt, Human
gcugcaaaccugccaccuggug

SEQ ID NO: 281061 - RNA, 22 nt, Human
uuacagugaaguaccauuaaaa

SEQ ID NO: 281062 - RNA, 22 nt, Human
uuuauuagugcuuguaucacug

SEQ ID NO: 281063 - RNA, 22 nt, Human
ugugcacauucuaggacuagua

SEQ ID NO: 281064 - RNA, 22 nt, Human
ucuucagauggccaguuguccc

SEQ ID NO: 281065 - RNA, 22 nt, Human
acagcuguauccccagagcuca

SEQ ID NO: 281066 - RNA, 22 nt, Human
uguuucaaagaaagaaaauaua

SEQ ID NO: 281067 - RNA, 22 nt, Human
uccuggcauaauggcuuugcuc

SEQ ID NO: 281068 - RNA, 22 nt, Human
uggaaagucucuuuugacugua

SEQ ID NO: 281069 - RNA, 18 nt, Human
uguuaaaugaagauuugc

SEQ ID NO: 281070 - RNA, 22 nt, Human
ucuggaugaaagggcuauauau

SEQ ID NO: 281071 - RNA, 22 nt, Human
uauacacauuacaguuucagga

SEQ ID NO: 281072 - RNA, 22 nt, Human
uuuuuauaacucuuuugugaca

SEQ ID NO: 281073 - RNA, 22 nt, Human
cuccuacacauagaugcuuuca

SEQ ID NO: 281074 - RNA, 22 nt, Human
uggccagguugggcuuugcagc

SEQ ID NO: 281075 - RNA, 22 nt, Human
aaggcagcuucaccacagcauu

SEQ ID NO: 281076 - RNA, 23 nt, Human
agagcaucaugaugcuaagucug

SEQ ID NO: 281077 - RNA, 22 nt, Human
guuuuauaugucucugcugaca

SEQ ID NO: 281078 - RNA, 22 nt, Human
ucaugccaguuaaaggcuguga

SEQ ID NO: 281079 - RNA, 22 nt, Human
ucugaaauggggcugaagcacu

SEQ ID NO: 281080 - RNA, 22 nt, Human
aguaaaauuucugcugaggaga

SEQ ID NO: 281081 - RNA, 22 nt, Human
aaauccuaaugacaaguuuagu

SEQ ID NO: 281082 - RNA, 22 nt, Human
gagggcagagucuaaugaugca

SEQ ID NO: 281083 - RNA, 22 nt, Human
uauguacaagcacacaugugac

SEQ ID NO: 281084 - RNA, 22 nt, Human
uucaguuucuaaagauguuccu

SEQ ID NO: 281085 - RNA, 22 nt, Human
uggcaaauauuuuguuuuguaa

SEQ ID NO: 281086 - RNA, 22 nt, Human
uccaggcaguuuuccagguugu

SEQ ID NO: 281087 - RNA, 22 nt, Human
ucccagggccgcaaacgaguuu

SEQ ID NO: 281088 - RNA, 22 nt, Human
uacaaaguaauguauaauaucg

SEQ ID NO: 281089 - RNA, 22 nt, Human
uauuccaaaaucccaaacugcc

SEQ ID NO: 281090 - RNA, 22 nt, Human
aaagucuuuauuuuguaucuuu

SEQ ID NO: 281091 - RNA, 22 nt, Human
ggcaggcagaaaaauagaauau

SEQ ID NO: 281092 - RNA, 22 nt, Human
ugaugaaaguucaguagugaau

SEQ ID NO: 281093 - RNA, 22 nt, Human
uagcuuuaauaagcugcugaau

SEQ ID NO: 281094 - RNA, 22 nt, Human
cagcccugagagaaccaucuau

SEQ ID NO: 281095 - RNA, 22 nt, Human
ugucaaguuguggcaugucuaa

SEQ ID NO: 281096 - RNA, 22 nt, Human
ucagguguuuaaggauagugau

SEQ ID NO: 281097 - RNA, 22 nt, Human
uugguaaaaucauagugguaac

SEQ ID NO: 281098 - RNA, 22 nt, Human
agcaaagaaauggaggcucaga

SEQ ID NO: 281099 - RNA, 22 nt, Human
ugggcagcagcaaagccagacu

SEQ ID NO: 281100 - RNA, 22 nt, Human
gacagacagggguucuccugga

SEQ ID NO: 281101 - RNA, 22 nt, Human
ccagcuuuauagcuucaaagga

SEQ ID NO: 281102 - RNA, 22 nt, Human
auucagcaguuccugcuucagu

SEQ ID NO: 281103 - RNA, 22 nt, Human
cagggaugggauggagucaguu

SEQ ID NO: 281104 - RNA, 22 nt, Human
gugcaugcaaauuacuguaaag

SEQ ID NO: 281105 - RNA, 19 nt, Human
gcaugcagaguaagaaggu

SEQ ID NO: 281106 - RNA, 22 nt, Human
ugugacccccgucacggcugcu

SEQ ID NO: 281107 - RNA, 22 nt, Human
uacaugugcacgugugacuuug

SEQ ID NO: 281108 - RNA, 20 nt, Human
agagagagguaaauugagca

SEQ ID NO: 281109 - RNA, 22 nt, Human
uuagugguaaggaugaaauuuc

SEQ ID NO: 281110 - RNA, 22 nt, Human
gaaaguuucucacacaugcaga

SEQ ID NO: 281111 - RNA, 22 nt, Human
uaguuaaagauucuguuaagag

SEQ ID NO: 281112 - RNA, 22 nt, Human
aguuaaaugucaguagcuuaac

SEQ ID NO: 281113 - RNA, 22 nt, Human
ccacaggauccaagggaaggca

SEQ ID NO: 281114 - RNA, 20 nt, Human
cuacuuuaggcacugagaau

SEQ ID NO: 281115 - RNA, 22 nt, Human
ggccucucaugcccagagccaa

SEQ ID NO: 281116 - RNA, 22 nt, Human
ccacagcugaccgcaggugagc

SEQ ID NO: 281117 - RNA, 22 nt, Human
aauaauaguugcaaaguguuua

SEQ ID NO: 281118 - RNA, 22 nt, Human
uguuucuuuguagauauucuuu

SEQ ID NO: 281119 - RNA, 22 nt, Human
uuagaaaggggugaaucaaugg

SEQ ID NO: 281120 - RNA, 22 nt, Human
uaccuguuuuaaagcuaaaagg

SEQ ID NO: 281121 - RNA, 22 nt, Human
uaguauagauugaagcagauca

SEQ ID NO: 281122 - RNA, 22 nt, Human
augcagaagacugaaaagcuga

SEQ ID NO: 281123 - RNA, 22 nt, Human
uuugcugucagccgcuauuuuc

SEQ ID NO: 281124 - RNA, 21 nt, Human
gccugcaguuuugaagcccuu

SEQ ID NO: 281125 - RNA, 22 nt, Human
gcuuuucuccuuagugucccug

SEQ ID NO: 281126 - RNA, 22 nt, Human
ucuggaugaagacccagaggcu

SEQ ID NO: 281127 - RNA, 21 nt, Human
uuggaacaagcagcaguuugc

SEQ ID NO: 281128 - RNA, 22 nt, Human
ccugucucuuucaaucugagag

SEQ ID NO: 281129 - RNA, 22 nt, Human
caugccauuucuucucuuuaug

SEQ ID NO: 281130 - RNA, 22 nt, Human
gacagacaaauguuuuuaacuu

SEQ ID NO: 281131 - RNA, 22 nt, Human
uuucauugagaauauaagauuu

SEQ ID NO: 281132 - RNA, 22 nt, Human
aaugaccugggugucauuucau

SEQ ID NO: 281133 - RNA, 22 nt, Human
ugucugucugcacagcucaugg

SEQ ID NO: 281134 - RNA, 23 nt, Human
caggugguagagaaaaauccaga

SEQ ID NO: 281135 - RNA, 22 nt, Human
acauguaaaaauuaagguaaga

SEQ ID NO: 281136 - RNA, 22 nt, Human
gucugcccucacgccagcuggg

SEQ ID NO: 281137 - RNA, 22 nt, Human
agaagggaacucagagaugauu

SEQ ID NO: 281138 - RNA, 22 nt, Human
uacagucaacauugaugaugau

SEQ ID NO: 281139 - RNA, 22 nt, Human
cagggaugcugcuuaggcaguu

SEQ ID NO: 281140 - RNA, 19 nt, Human
gccagcagaaugaugaggc

SEQ ID NO: 281141 - RNA, 22 nt, Human
augauucuuuuggauagaugau

SEQ ID NO: 281142 - RNA, 23 nt, Human
acuauaaaguuguucugauuuac

SEQ ID NO: 281143 - RNA, 22 nt, Human
aaagcugcccuugugaaacaag

SEQ ID NO: 281144 - RNA, 22 nt, Human
acagacagauuuugucugaugu

SEQ ID NO: 281145 - RNA, 22 nt, Human
uggaaaacaaagcucucauuau

SEQ ID NO: 281146 - RNA, 22 nt, Human
cagccagguucaaguccuuaua

SEQ ID NO: 281147 - RNA, 22 nt, Human
gccaggcaggugucggagcccu

SEQ ID NO: 281148 - RNA, 22 nt, Human
aaagugguucuuacauccgugg

SEQ ID NO: 281149 - RNA, 22 nt, Human
agugucacagacccaaucagga

SEQ ID NO: 281150 - RNA, 22 nt, Human
uagaauaugauuaauuuucuua

SEQ ID NO: 281151 - RNA, 23 nt, Human
ccaaagucgaagucuaguccaga

SEQ ID NO: 281152 - RNA, 22 nt, Human
ugcagggaagcaaggguggcuc

SEQ ID NO: 281153 - RNA, 19 nt, Human
gugaggaguguuuacagaa

SEQ ID NO: 281154 - RNA, 22 nt, Human
cuggcacucauaggccaguuca

SEQ ID NO: 281155 - RNA, 22 nt, Human
uccaggcacgaggcccugugca

SEQ ID NO: 281156 - RNA, 22 nt, Human
acaguuuauaaaaauaaugagg

SEQ ID NO: 281157 - RNA, 22 nt, Human
ucauaaauucuggugcugugag

SEQ ID NO: 281158 - RNA, 22 nt, Human
agacaugucaccaauucuuacu

SEQ ID NO: 281159 - RNA, 22 nt, Human
cacaguuugguauagaagugau

SEQ ID NO: 281160 - RNA, 22 nt, Human
ucuguggccugccuccucauuu

SEQ ID NO: 281161 - RNA, 22 nt, Human
ugagcccuaauuuacaacaucu

SEQ ID NO: 281162 - RNA, 22 nt, Human
gacauaauaaucugaccuagau

SEQ ID NO: 281163 - RNA, 22 nt, Human
agcagggcaguuaaaggguccu

SEQ ID NO: 281164 - RNA, 22 nt, Human
uuccuggcugaacugaacuccu

SEQ ID NO: 281165 - RNA, 22 nt, Human
ggcauccaguucugaucaacaa

SEQ ID NO: 281166 - RNA, 22 nt, Human
ucuucacaugaccuucaugucu

SEQ ID NO: 281167 - RNA, 22 nt, Human
uaaggaggcugcugugaagaaa

SEQ ID NO: 281168 - RNA, 22 nt, Human
gggcugacaguuuccccugaaa

SEQ ID NO: 281169 - RNA, 20 nt, Human
cauuugaaucuccauucugc

SEQ ID NO: 281170 - RNA, 22 nt, Human
uuccucagggaggcuagcagua

SEQ ID NO: 281171 - RNA, 22 nt, Human
aauuucagaccauuugcaauua

SEQ ID NO: 281172 - RNA, 22 nt, Human
caggcugccgugaagcaggccu

SEQ ID NO: 281173 - RNA, 22 nt, Human
ccuggcagcgccgaagcuggcc

SEQ ID NO: 281174 - RNA, 22 nt, Human
gguuacauggaagaaauauaau

SEQ ID NO: 281175 - RNA, 18 nt, Human
uggcaggaaaugcacuuu

SEQ ID NO: 281176 - RNA, 22 nt, Human
uagcuuuaggcacguuugaauu

SEQ ID NO: 281177 - RNA, 17 nt, Human
ccagagaguaguuagga

SEQ ID NO: 281178 - RNA, 22 nt, Human
gaauguuaaugcacuucuagcu

SEQ ID NO: 281179 - RNA, 21 nt, Human
cuguuucuugugaagugacac

SEQ ID NO: 281180 - RNA, 20 nt, Human
cagcuuuagaucuuugauua

SEQ ID NO: 281181 - RNA, 22 nt, Human
aauccugaccugggcaugcuug

SEQ ID NO: 281182 - RNA, 22 nt, Human
aucucagaucuacagaucuaca

SEQ ID NO: 281183 - RNA, 22 nt, Human
auacauauaugguacuuccugg

SEQ ID NO: 281184 - RNA, 20 nt, Human
cagaacaugagcaucgagcc

SEQ ID NO: 281185 - RNA, 22 nt, Human
agauggucuaguugaaccauau

SEQ ID NO: 281186 - RNA, 22 nt, Human
ggaaagcucagaucuuguugga

SEQ ID NO: 281187 - RNA, 22 nt, Human
caggugucaaaauacuaagugg

SEQ ID NO: 281188 - RNA, 22 nt, Human
gcaaauucuuaacuggacugug

SEQ ID NO: 281189 - RNA, 22 nt, Human
gcugccacauuuucaggacuaa

SEQ ID NO: 281190 - RNA, 22 nt, Human
aaggaccugauuuugagcaucu

SEQ ID NO: 281191 - RNA, 22 nt, Human
acugaauuagggaacacugaac

SEQ ID NO: 281192 - RNA, 22 nt, Human
auaucuguguuucccuuuugcu

SEQ ID NO: 281193 - RNA, 18 nt, Human
uccucucuuuccccaggg

SEQ ID NO: 281194 - RNA, 22 nt, Human
acacacaauuaguuuuaugcuu

SEQ ID NO: 281195 - RNA, 22 nt, Human
aagcaaaggcaggagcuuguga

SEQ ID NO: 281196 - RNA, 22 nt, Human
ucuucagacuccaaauguuuua

SEQ ID NO: 281197 - RNA, 22 nt, Human
ucauggcucuaaagacauagau

SEQ ID NO: 281198 - RNA, 22 nt, Human
caugcuguccugccagggaugg

SEQ ID NO: 281199 - RNA, 22 nt, Human
agccaugcaccuuacucuugcu

SEQ ID NO: 281200 - RNA, 22 nt, Human
uuuauaaacaguaccacggugc

SEQ ID NO: 281201 - RNA, 22 nt, Human
guccaugacugugacucacaug

SEQ ID NO: 281202 - RNA, 22 nt, Human
gguaggaguauuuugcagcagu

SEQ ID NO: 281203 - RNA, 22 nt, Human
gggcuggacaucuaagguagcu

SEQ ID NO: 281204 - RNA, 22 nt, Human
cuauuaggcuuccauuucaugc

SEQ ID NO: 281205 - RNA, 22 nt, Human
aucuuuacaguguaagugcaga

SEQ ID NO: 281206 - RNA, 22 nt, Human
cagaugaacucuauccuguggc

SEQ ID NO: 281207 - RNA, 22 nt, Human
cagauaauaauaugacuucacu

SEQ ID NO: 281208 - RNA, 18 nt, Human
cuggauuaagacagugcu

SEQ ID NO: 281209 - RNA, 22 nt, Human
caugaguuuuuuaguucaugca

SEQ ID NO: 281210 - RNA, 21 nt, Human
acagaugggaugagcacacug

SEQ ID NO: 281211 - RNA, 22 nt, Human
acuggcagagggaaaaccauuc

SEQ ID NO: 281212 - RNA, 22 nt, Human
ucagagaaugugaauauuaaac

SEQ ID NO: 281213 - RNA, 22 nt, Human
uggaccugggguggccuccucu

SEQ ID NO: 281214 - RNA, 22 nt, Human
aagcuguguauuacagaauauu

SEQ ID NO: 281215 - RNA, 22 nt, Human
ugacgucaacugcaaaggccuu

SEQ ID NO: 281216 - RNA, 22 nt, Human
ccaggugucauggauaaugggu

SEQ ID NO: 281217 - RNA, 21 nt, Human
ggaaaacuuuccuugucugaa

SEQ ID NO: 281218 - RNA, 22 nt, Human
aaguucuugaagacuuuaaaua

SEQ ID NO: 281219 - RNA, 21 nt, Human
ggcaggugggucucuguugcu

SEQ ID NO: 281220 - RNA, 22 nt, Human
cagugcagccaaggacaggcac

SEQ ID NO: 281221 - RNA, 22 nt, Human
ccuggcagggcugcaguaaugg

SEQ ID NO: 281222 - RNA, 22 nt, Human
uccugagcacagagacaaggaa

SEQ ID NO: 281223 - RNA, 22 nt, Human
uucucuucccacuuucuguauu

SEQ ID NO: 281224 - RNA, 22 nt, Human
cucugcaggcacccaggguggg

SEQ ID NO: 281225 - RNA, 22 nt, Human
ccagcaucuaugugcuguugau

SEQ ID NO: 281226 - RNA, 21 nt, Human
aauucccagaaacagcacaag

SEQ ID NO: 281227 - RNA, 22 nt, Human
uugaggaggaaaaggggguacc

SEQ ID NO: 281228 - RNA, 22 nt, Human
aguguuagugaaagguguuuau

SEQ ID NO: 281229 - RNA, 21 nt, Human
cugugaccuuucuuuccuccu

SEQ ID NO: 281230 - RNA, 22 nt, Human
ggcaggcaggucuucauggccc

SEQ ID NO: 281231 - RNA, 22 nt, Human
aaaugaguuuccucaauguccu

SEQ ID NO: 281232 - RNA, 22 nt, Human
agaagcugcguuuauuuaaauc

SEQ ID NO: 281233 - RNA, 19 nt, Human
uccugaaaacuucuggaau

SEQ ID NO: 281234 - RNA, 22 nt, Human
ucccaggcugggggccugaagu

SEQ ID NO: 281235 - RNA, 22 nt, Human
gaggugucacuauuuugcuuau

SEQ ID NO: 281236 - RNA, 22 nt, Human
ccacagcaccgcugccaguccc

SEQ ID NO: 281237 - RNA, 22 nt, Human
aaagcuauuuauuacagagaau

SEQ ID NO: 281238 - RNA, 19 nt, Human
guucuuucauaguaagagc

SEQ ID NO: 281239 - RNA, 22 nt, Human
auuuugaugcuaucuaaugaau

SEQ ID NO: 281240 - RNA, 22 nt, Human
agacagacuugaaaauguucuu

SEQ ID NO: 281241 - RNA, 22 nt, Human
cuuugcaauagaggcacacaug

SEQ ID NO: 281242 - RNA, 22 nt, Human
gcagggcagcucacugugguuc

SEQ ID NO: 281243 - RNA, 22 nt, Human
ggcuuuaugcagggauagaaau

SEQ ID NO: 281244 - RNA, 21 nt, Human
uccugcagggcagcagagugg

SEQ ID NO: 281245 - RNA, 22 nt, Human
uucauagugcuuaauuugauaa

SEQ ID NO: 281246 - RNA, 22 nt, Human
gugccaaaagcuauaauuuggu

SEQ ID NO: 281247 - RNA, 22 nt, Human
ccagggcaacgcugucucagag

SEQ ID NO: 281248 - RNA, 22 nt, Human
agcuuccuugaauucuguagaa

SEQ ID NO: 281249 - RNA, 22 nt, Human
auuuaagacugacuucaccagu

SEQ ID NO: 281250 - RNA, 22 nt, Human
cucaggaguaguucagcagcug

SEQ ID NO: 281251 - RNA, 22 nt, Human
cuccugugcaugcaucucccua

SEQ ID NO: 281252 - RNA, 20 nt, Human
aaaauauguauaacucuucu

SEQ ID NO: 281253 - RNA, 22 nt, Human
gucaguuacagccacggcgggu

SEQ ID NO: 281254 - RNA, 22 nt, Human
gggaccagaagaaggaugguga

SEQ ID NO: 281255 - RNA, 22 nt, Human
cuuacauacugagaaaauaucc

SEQ ID NO: 281256 - RNA, 16 nt, Human
gcuggagggagggguu

SEQ ID NO: 281257 - RNA, 22 nt, Human
ugugggaggauucagaauuggg

SEQ ID NO: 281258 - RNA, 22 nt, Human
uaaaauguguuucuguaugguu

SEQ ID NO: 281259 - RNA, 22 nt, Human
augcuuagguuaaauuuguaau

SEQ ID NO: 281260 - RNA, 22 nt, Human
uuucuucauucaccuucacccc

SEQ ID NO: 281261 - RNA, 22 nt, Human
cagcucauuccucaaucuagga

SEQ ID NO: 281262 - RNA, 22 nt, Human
guuauugagacauagaguuaug

SEQ ID NO: 281263 - RNA, 22 nt, Human
aaugucuucccuggcaggccaa

SEQ ID NO: 281264 - RNA, 21 nt, Human
uuacuucugcuuguuauuguc

SEQ ID NO: 281265 - RNA, 22 nt, Human
gagccuccuccuggugugccga

SEQ ID NO: 281266 - RNA, 22 nt, Human
gcccagggugcuuagaacccau

SEQ ID NO: 281267 - RNA, 22 nt, Human
gugccccagacacgcauguggg

SEQ ID NO: 281268 - RNA, 20 nt, Human
cucuuaaauguaaaguaggc

SEQ ID NO: 281269 - RNA, 22 nt, Human
aaaaguguucaggaagaauaau

SEQ ID NO: 281270 - RNA, 22 nt, Human
uuauacacugcagaaccagcau

SEQ ID NO: 281271 - RNA, 22 nt, Human
cuggcugaucucaaucauggcu

SEQ ID NO: 281272 - RNA, 22 nt, Human
ggaggggucucuagcgaggaga

SEQ ID NO: 281273 - RNA, 22 nt, Human
aaacuaaaccuggcuuaguaag

SEQ ID NO: 281274 - RNA, 22 nt, Human
uguggggcugugguguucuucu

SEQ ID NO: 281275 - RNA, 22 nt, Human
agagccaguuguuaagcacuua

SEQ ID NO: 281276 - RNA, 19 nt, Human
ccugggucugcagcauuca

SEQ ID NO: 281277 - RNA, 22 nt, Human
cuguccucaacccauccuucuc

SEQ ID NO: 281278 - RNA, 22 nt, Human
ugcagggaggccccgcagcccu

SEQ ID NO: 281279 - RNA, 22 nt, Human
ucagugugaguaccaugcucag

SEQ ID NO: 281280 - RNA, 22 nt, Human
uucucagugaaguuuagaacau

SEQ ID NO: 281281 - RNA, 22 nt, Human
ucagcauguucuuaggucacag

SEQ ID NO: 281282 - RNA, 22 nt, Human
caggcuugauuauucagacaau

SEQ ID NO: 281283 - RNA, 22 nt, Human
acacugucugggacucaggagu

SEQ ID NO: 281284 - RNA, 22 nt, Human
aucuguaaagauaaucauaugu

SEQ ID NO: 281285 - RNA, 22 nt, Human
uccuggccaugcaagaugagga

SEQ ID NO: 281286 - RNA, 22 nt, Human
gggguuaacaguauugcucaug

SEQ ID NO: 281287 - RNA, 22 nt, Human
uugcccagaguccacagcguac

SEQ ID NO: 281288 - RNA, 22 nt, Human
acagagcaugcucaguguguga

SEQ ID NO: 281289 - RNA, 22 nt, Human
cccaugccuucugacucacagg

SEQ ID NO: 281290 - RNA, 22 nt, Human
ucucagugagcuuuucuauguu

SEQ ID NO: 281291 - RNA, 22 nt, Human
uauacacacaugcuccggccuu

SEQ ID NO: 281292 - RNA, 22 nt, Human
gucacaggccuggaugaggggc

SEQ ID NO: 281293 - RNA, 18 nt, Human
uggcagggaggaaauaua

SEQ ID NO: 281294 - RNA, 22 nt, Human
cuauuauuauguuaacuggacu

SEQ ID NO: 281295 - RNA, 22 nt, Human
uccauucuuuuuaccucucaga

SEQ ID NO: 281296 - RNA, 14 nt, Human
gcaggcagaucacu

SEQ ID NO: 281297 - RNA, 22 nt, Human
gaaagcacaguucugaccaugu

SEQ ID NO: 281298 - RNA, 22 nt, Human
ccaguuuagguacuaggcucua

SEQ ID NO: 281299 - RNA, 22 nt, Human
agagggcugcugcacagugcuc

SEQ ID NO: 281300 - RNA, 22 nt, Human
ugggguggaacccuucugcugg

SEQ ID NO: 281301 - RNA, 22 nt, Human
cagcaugaugagugcaguuugg

SEQ ID NO: 281302 - RNA, 22 nt, Human
ccuggcagguggcgcccucggc

SEQ ID NO: 281303 - RNA, 22 nt, Human
uguccuggagacacaagguggu

SEQ ID NO: 281304 - RNA, 22 nt, Human
uuguccugugauuucagggccu

SEQ ID NO: 281305 - RNA, 22 nt, Human
cagagccuggcgaugucaugga

SEQ ID NO: 281306 - RNA, 22 nt, Human
auguccuuuuauuuaaagcagg

SEQ ID NO: 281307 - RNA, 22 nt, Human
cugcucuucacacuacacccgu

SEQ ID NO: 281308 - RNA, 19 nt, Human
cuguugcuggggcucucuu

SEQ ID NO: 281309 - RNA, 22 nt, Human
aggaggaaggcuucauuagguu

SEQ ID NO: 281310 - RNA, 22 nt, Human
agagcugaauuuggguggugga

SEQ ID NO: 281311 - RNA, 22 nt, Human
cugccucuauaggaguccacca

SEQ ID NO: 281312 - RNA, 22 nt, Human
uccucccaacuuuuccaucuca

SEQ ID NO: 281313 - RNA, 22 nt, Human
ggaggacacuggcucugccuuc

SEQ ID NO: 281314 - RNA, 22 nt, Human
uagggcagcugcaucaggcacu

SEQ ID NO: 281315 - RNA, 22 nt, Human
ucacacuaagacaaaauaauuu

SEQ ID NO: 281316 - RNA, 22 nt, Human
uuguuaaagaugcagauuccau

SEQ ID NO: 281317 - RNA, 22 nt, Human
accaggcagagcugggccuuaa

SEQ ID NO: 281318 - RNA, 22 nt, Human
uucuagaaacuggagcaaacag

SEQ ID NO: 281319 - RNA, 22 nt, Human
acggggcuagagaagguuucuu

SEQ ID NO: 281320 - RNA, 22 nt, Human
uucuaguuaaaguauguauuag

SEQ ID NO: 281321 - RNA, 22 nt, Human
auagucagugucuauaucguug

SEQ ID NO: 281322 - RNA, 22 nt, Human
ccugcagaaaggguccccagga

SEQ ID NO: 281323 - RNA, 22 nt, Human
gauuuuauuagcccaaacuuug

SEQ ID NO: 281324 - RNA, 22 nt, Human
acugaggacagugaggagggcu

SEQ ID NO: 281325 - RNA, 22 nt, Human
ccagagaguaaacauuuuccgg

SEQ ID NO: 281326 - RNA, 22 nt, Human
ggaaguuguaugaucggggaau

SEQ ID NO: 281327 - RNA, 22 nt, Human
uggccuggggaagaccaugggc

SEQ ID NO: 281328 - RNA, 22 nt, Human
uccaaggacauuguucuaguug

SEQ ID NO: 281329 - RNA, 22 nt, Human
uuguguccuaagcaccagaugg

SEQ ID NO: 281330 - RNA, 22 nt, Human
auucuucaccauggauaauuug

SEQ ID NO: 281331 - RNA, 22 nt, Human
ugguggggccagacuucagcuc

SEQ ID NO: 281332 - RNA, 22 nt, Human
uuggcaaaauuuaaagaaguga

SEQ ID NO: 281333 - RNA, 22 nt, Human
aagcauuuuguuuuaagaauga

SEQ ID NO: 281334 - RNA, 22 nt, Human
uggcagguuuccuccucauagu

SEQ ID NO: 281335 - RNA, 22 nt, Human
cagagcauaauugacaugaggu

SEQ ID NO: 281336 - RNA, 22 nt, Human
ccguggcuucccaggcggaugu

SEQ ID NO: 281337 - RNA, 15 nt, Human
cuccaugauuuugca

SEQ ID NO: 281338 - RNA, 22 nt, Human
aaauuaagggugagaagaguug

SEQ ID NO: 281339 - RNA, 22 nt, Human
agaggggaggcgaaccagaguc

SEQ ID NO: 281340 - RNA, 22 nt, Human
ccuggcccacauggcuucuccc

SEQ ID NO: 281341 - RNA, 22 nt, Human
uagguagauacauguguuggcu

SEQ ID NO: 281342 - RNA, 21 nt, Human
acauuacagggugaugugucu

SEQ ID NO: 281343 - RNA, 22 nt, Human
caggccuggcccccggcacacc

SEQ ID NO: 281344 - RNA, 22 nt, Human
cucuggaagugauggcagguca

SEQ ID NO: 281345 - RNA, 19 nt, Human
cucucacucgccacauccu

SEQ ID NO: 281346 - RNA, 22 nt, Human
cuucaguuagccaauucagguc

SEQ ID NO: 281347 - RNA, 22 nt, Human
uggccaggggaguuccccucca

SEQ ID NO: 281348 - RNA, 22 nt, Human
cuucucaguugcaagugucaga

SEQ ID NO: 281349 - RNA, 22 nt, Human
caaagauaugacauggaaaaug

SEQ ID NO: 281350 - RNA, 22 nt, Human
ggaccugaacauaaaacgaggc

SEQ ID NO: 281351 - RNA, 22 nt, Human
guuuauuaacugucaagugauu

SEQ ID NO: 281352 - RNA, 22 nt, Human
gcucucagaagagccaggcuac

SEQ ID NO: 281353 - RNA, 22 nt, Human
agggcacuugaggcugggccug

SEQ ID NO: 281354 - RNA, 23 nt, Human
uguuuucuuguccugguauaauu

SEQ ID NO: 281355 - RNA, 22 nt, Human
ugaggaggugggcacacagagu

SEQ ID NO: 281356 - RNA, 17 nt, Human
gccuucucugcccucac

SEQ ID NO: 281357 - RNA, 22 nt, Human
guccugagaugucacaagguuu

SEQ ID NO: 281358 - RNA, 22 nt, Human
uccuuccuggggucucugcugc

SEQ ID NO: 281359 - RNA, 20 nt, Human
ccugggcucaaagcauccuc

SEQ ID NO: 281360 - RNA, 22 nt, Human
cucagagaaccuaagcggagga

SEQ ID NO: 281361 - RNA, 22 nt, Human
uugagguaguacuuauuauugg

SEQ ID NO: 281362 - RNA, 22 nt, Human
agugcaggagccuggccagagc

SEQ ID NO: 281363 - RNA, 22 nt, Human
ccaucagauuagcaaaauccag

SEQ ID NO: 281364 - RNA, 22 nt, Human
aggcaguggcugagaccagggg

SEQ ID NO: 281365 - RNA, 20 nt, Human
cugcuccacccggcucucag

SEQ ID NO: 281366 - RNA, 22 nt, Human
guccacugcugugugcuucacc

SEQ ID NO: 281367 - RNA, 22 nt, Human
uuguauuggcaaagaacuugag

SEQ ID NO: 281368 - RNA, 21 nt, Human
ugucuuuaggaccuguuaaau

SEQ ID NO: 281369 - RNA, 22 nt, Human
agugugagauuaaaccgaauca

SEQ ID NO: 281370 - RNA, 22 nt, Human
acaguauuugcgauacugauga

SEQ ID NO: 281371 - RNA, 22 nt, Human
gacagagauugaaucaggaaau

SEQ ID NO: 281372 - RNA, 22 nt, Human
ggagaagggccaauuccaugua

SEQ ID NO: 281373 - RNA, 17 nt, Human
agacagaccucugcauc

SEQ ID NO: 281374 - RNA, 22 nt, Human
ucuggcucauacaagccugcaa

SEQ ID NO: 281375 - RNA, 22 nt, Human
auuucauagauuguaaaucccu

SEQ ID NO: 281376 - RNA, 22 nt, Human
cauucccacguguucuuugcuu

SEQ ID NO: 281377 - RNA, 18 nt, Human
acaggcugugggaauggu

SEQ ID NO: 281378 - RNA, 22 nt, Human
cccagcuugcgggcggcaggag

SEQ ID NO: 281379 - RNA, 23 nt, Human
uuucuguuggguauauauccaag

SEQ ID NO: 281380 - RNA, 22 nt, Human
auauuaggugcucaauacaugc

SEQ ID NO: 281381 - RNA, 22 nt, Human
gcagguguggauuugcauccag

SEQ ID NO: 281382 - RNA, 22 nt, Human
agagccagccuucucagcuuac

SEQ ID NO: 281383 - RNA, 22 nt, Human
agaggccggccgagcccauggg

SEQ ID NO: 281384 - RNA, 22 nt, Human
ucugggaauuuauuggcacuuu

SEQ ID NO: 281385 - RNA, 22 nt, Human
uccaggaguuugagacugcagu

SEQ ID NO: 281386 - RNA, 22 nt, Human
uuuguucaacaggugaaauaga

SEQ ID NO: 281387 - RNA, 22 nt, Human
ucucuguguguuggcuguauau

SEQ ID NO: 281388 - RNA, 22 nt, Human
acuguccaagcaugccuggcuu

SEQ ID NO: 281389 - RNA, 22 nt, Human
cuguccugggggugguccuugc

SEQ ID NO: 281390 - RNA, 22 nt, Human
ugagagaguaauugagugguaa

SEQ ID NO: 281391 - RNA, 22 nt, Human
acacuuggagcaacacuuaugg

SEQ ID NO: 281392 - RNA, 22 nt, Human
caugacaauauguucuuucauu

SEQ ID NO: 281393 - RNA, 22 nt, Human
uuucucucuggcccugauuguc

SEQ ID NO: 281394 - RNA, 17 nt, Human
uccuuucuuuaccuguu

SEQ ID NO: 281395 - RNA, 22 nt, Human
gcagucuaucuugugauuuaac

SEQ ID NO: 281396 - RNA, 23 nt, Human
ucuagaaaaugaaagaaugcagu

SEQ ID NO: 281397 - RNA, 23 nt, Human
uugcugccugagccuuccucugg

SEQ ID NO: 281398 - RNA, 20 nt, Human
agcauacaucauaagaaacc

SEQ ID NO: 281399 - RNA, 22 nt, Human
gaggcauaaaucacaguguuca

SEQ ID NO: 281400 - RNA, 22 nt, Human
uugccuauuguucuuacauguu

SEQ ID NO: 281401 - RNA, 22 nt, Human
auuuugacugcauuacagaaca

SEQ ID NO: 281402 - RNA, 22 nt, Human
uagggcaggggaggaaucugaa

SEQ ID NO: 281403 - RNA, 22 nt, Human
ccaggagcagaguagguguuca

SEQ ID NO: 281404 - RNA, 22 nt, Human
gaaacuguuucuggcuuuggug

SEQ ID NO: 281405 - RNA, 22 nt, Human
gaucauuugcaggaaacauuaa

SEQ ID NO: 281406 - RNA, 22 nt, Human
cauuuguuaaccaguguggauu

SEQ ID NO: 281407 - RNA, 22 nt, Human
aagcugugcaggaacugcuugc

SEQ ID NO: 281408 - RNA, 22 nt, Human
guuucuuuugugaucaccaacc

SEQ ID NO: 281409 - RNA, 22 nt, Human
uucuucaguguagcaacuguau

SEQ ID NO: 281410 - RNA, 22 nt, Human
aggagccaugagcaggaggcaa

SEQ ID NO: 281411 - RNA, 22 nt, Human
acagucucuccacacugcaggg

SEQ ID NO: 281412 - RNA, 22 nt, Human
uauuuccauguuagaacuaagu

SEQ ID NO: 281413 - RNA, 22 nt, Human
aguccaaagcagaugagggcca

SEQ ID NO: 281414 - RNA, 22 nt, Human
cuuuccaaugucacuaugaauc

SEQ ID NO: 281415 - RNA, 22 nt, Human
aucagaguguaaguucuuuccu

SEQ ID NO: 281416 - RNA, 22 nt, Human
ucucuuucuauaugugagucuu

SEQ ID NO: 281417 - RNA, 22 nt, Human
cacaguuucuauaggucagaau

SEQ ID NO: 281418 - RNA, 22 nt, Human
aggcccugcccagugccacaag

SEQ ID NO: 281419 - RNA, 20 nt, Human
auucaccaaaucaucccagg

SEQ ID NO: 281420 - RNA, 22 nt, Human
ucaagaaacugugcuacagagu

SEQ ID NO: 281421 - RNA, 22 nt, Human
aaucugcacaauucaguuucag

SEQ ID NO: 281422 - RNA, 22 nt, Human
uucuacaugagaaaauguauuu

SEQ ID NO: 281423 - RNA, 21 nt, Human
agacaugugaacuaaagguga

SEQ ID NO: 281424 - RNA, 22 nt, Human
guacaaguucuacucuauaaau

SEQ ID NO: 281425 - RNA, 22 nt, Human
ugcuauuuuggucuacagcacu

SEQ ID NO: 281426 - RNA, 22 nt, Human
agugccccaugggugccugggg

SEQ ID NO: 281427 - RNA, 20 nt, Human
agcaaaaugcaagauuuuca

SEQ ID NO: 281428 - RNA, 22 nt, Human
uuugcauuaguuuagauuucaa

SEQ ID NO: 281429 - RNA, 22 nt, Human
gaucuucuagcagaaguaauuu

SEQ ID NO: 281430 - RNA, 22 nt, Human
agcugcaggauuauggaaugga

SEQ ID NO: 281431 - RNA, 22 nt, Human
auguuaaagauggugggaaauu

SEQ ID NO: 281432 - RNA, 22 nt, Human
ugcucccaaaccugacaggcuc

SEQ ID NO: 281433 - RNA, 22 nt, Human
acugagcacucacuuuuguuau

SEQ ID NO: 281434 - RNA, 22 nt, Human
cagagcagugaggaguugugua

SEQ ID NO: 281435 - RNA, 22 nt, Human
aaugcauauguaggcaagcagu

SEQ ID NO: 281436 - RNA, 22 nt, Human
caggcucagucagaaaauguau

SEQ ID NO: 281437 - RNA, 22 nt, Human
uaaaauguagcuucuaggcugg

SEQ ID NO: 281438 - RNA, 22 nt, Human
auuuauuaagcaucugcuaugu

SEQ ID NO: 281439 - RNA, 22 nt, Human
agaaauguggaucguuuuaaaa

SEQ ID NO: 281440 - RNA, 22 nt, Human
agcucccagaagccagagucgg

SEQ ID NO: 281441 - RNA, 22 nt, Human
ugugcauguauugauuuguacc

SEQ ID NO: 281442 - RNA, 22 nt, Human
gaacaucaugaagaaaacauau

SEQ ID NO: 281443 - RNA, 22 nt, Human
ugucaguucaauuauaguaauu

SEQ ID NO: 281444 - RNA, 22 nt, Human
aguauaaagugguuuucagcac

SEQ ID NO: 281445 - RNA, 22 nt, Human
ucccaguggugggugcacauuu

SEQ ID NO: 281446 - RNA, 22 nt, Human
cagcuuugccaaguaaggucuu

SEQ ID NO: 281447 - RNA, 17 nt, Human
cucuggaauuggugaag

SEQ ID NO: 281448 - RNA, 22 nt, Human
gccaggcuccaggcccuccuga

SEQ ID NO: 281449 - RNA, 22 nt, Human
agcugugggauuugggugugcc

SEQ ID NO: 281450 - RNA, 22 nt, Human
uugguuuguucaccaucaagca

SEQ ID NO: 281451 - RNA, 21 nt, Human
acagcuggugcagggcgggga

SEQ ID NO: 281452 - RNA, 22 nt, Human
auucaacuagugauuguguuau

SEQ ID NO: 281453 - RNA, 22 nt, Human
ugcuuuauucaggguuuacccc

SEQ ID NO: 281454 - RNA, 22 nt, Human
accaaggaguuugguauuuuag

SEQ ID NO: 281455 - RNA, 22 nt, Human
aacauuucauuggaagcuaugu

SEQ ID NO: 281456 - RNA, 22 nt, Human
cagcugucuggggagugcucgc

SEQ ID NO: 281457 - RNA, 22 nt, Human
uccaggcaaagugcugggcugc

SEQ ID NO: 281458 - RNA, 22 nt, Human
ugcccugggaacacagaugcca

SEQ ID NO: 281459 - RNA, 22 nt, Human
ggcugaguugagaggauuacuu

SEQ ID NO: 281460 - RNA, 22 nt, Human
cagcacaguuugcuuggcagag

SEQ ID NO: 281461 - RNA, 22 nt, Human
guacaaauguacacuuguauaa

SEQ ID NO: 281462 - RNA, 22 nt, Human
cuuuaguuauuuagacuacagu

SEQ ID NO: 281463 - RNA, 22 nt, Human
gcacagaggaagcacagacucu

SEQ ID NO: 281464 - RNA, 22 nt, Human
cauggcugaggcagaggacuga

SEQ ID NO: 281465 - RNA, 22 nt, Human
uuacagugcucuucaagacuuc

SEQ ID NO: 281466 - RNA, 22 nt, Human
ccugcaggcugcaggccaguuc

SEQ ID NO: 281467 - RNA, 21 nt, Human
cccaccccauaaggcagaacc

SEQ ID NO: 281468 - RNA, 20 nt, Human
uccaggccuuguucucagau

SEQ ID NO: 281469 - RNA, 22 nt, Human
auaaugagcuuuugaauacuga

SEQ ID NO: 281470 - RNA, 22 nt, Human
cagcaugaaaaguguugcuauc

SEQ ID NO: 281471 - RNA, 22 nt, Human
auucugggaacuuugucucuca

SEQ ID NO: 281472 - RNA, 21 nt, Human
cucugcugucuaccagcuguu

SEQ ID NO: 281473 - RNA, 22 nt, Human
cagaagcaaguagugauucuuu

SEQ ID NO: 281474 - RNA, 22 nt, Human
gguuucacaauuuagagcagug

SEQ ID NO: 281475 - RNA, 22 nt, Human
ucucagggugaggaaagaauuu

SEQ ID NO: 281476 - RNA, 22 nt, Human
uuccuggcacauaguuagugcu

SEQ ID NO: 281477 - RNA, 22 nt, Human
gcuccaggaggaugaccuuccu

SEQ ID NO: 281478 - RNA, 22 nt, Human
cagugggacaugggcacugggc

SEQ ID NO: 281479 - RNA, 22 nt, Human
gacacuguuauggugagguaag

SEQ ID NO: 281480 - RNA, 22 nt, Human
cccaguggggagcugagguuca

SEQ ID NO: 281481 - RNA, 22 nt, Human
aauguuauuucugcauaguagu

SEQ ID NO: 281482 - RNA, 22 nt, Human
cuauuguuucuaugcucugagg

SEQ ID NO: 281483 - RNA, 22 nt, Human
ucuauuuuguuuccagcucuac

SEQ ID NO: 281484 - RNA, 22 nt, Human
caaauucagaaaauugguagag

SEQ ID NO: 281485 - RNA, 22 nt, Human
auggaaugugaacaugauggca

SEQ ID NO: 281486 - RNA, 22 nt, Human
uagggaugauggagccuaugua

SEQ ID NO: 281487 - RNA, 22 nt, Human
acagugucaugucguguucccc

SEQ ID NO: 281488 - RNA, 22 nt, Human
ucugugucccuucuaauuucag

SEQ ID NO: 281489 - RNA, 22 nt, Human
ccucucagccggacugucaggc

SEQ ID NO: 281490 - RNA, 22 nt, Human
gcugguccagggccucuguggg

SEQ ID NO: 281491 - RNA, 22 nt, Human
uugaggaguacaaagcaugcuu

SEQ ID NO: 281492 - RNA, 20 nt, Human
ugucuucauuauggugcccu

SEQ ID NO: 281493 - RNA, 22 nt, Human
ccaaagcaagucacaugaucaa

SEQ ID NO: 281494 - RNA, 22 nt, Human
ugagcucuguuagggcuggaac

SEQ ID NO: 281495 - RNA, 22 nt, Human
agcccuaacucccaguaucuug

SEQ ID NO: 281496 - RNA, 22 nt, Human
cuuguaaaugcagauucugauu

SEQ ID NO: 281497 - RNA, 22 nt, Human
ugguuaaaugggaagagcaaca

SEQ ID NO: 281498 - RNA, 22 nt, Human
uggaaagacauguccuucauua

SEQ ID NO: 281499 - RNA, 21 nt, Human
aguuuugagaguggguagugu

SEQ ID NO: 281500 - RNA, 22 nt, Human
uacaaaugaaccaacuuugaug

SEQ ID NO: 281501 - RNA, 22 nt, Human
uaccugcaaaguuccuuuugcc

SEQ ID NO: 281502 - RNA, 22 nt, Human
cuugaaaugacaggagcacauc

SEQ ID NO: 281503 - RNA, 22 nt, Human
uggucaggggcuucugagcugu

SEQ ID NO: 281504 - RNA, 22 nt, Human
aggcaucuaacagagaucuuua

SEQ ID NO: 281505 - RNA, 20 nt, Human
uuugacucaggccuuuagcc

SEQ ID NO: 281506 - RNA, 22 nt, Human
uacauaauugucuuuguccuca

SEQ ID NO: 281507 - RNA, 20 nt, Human
aaaaucucccagaaacuuau

SEQ ID NO: 281508 - RNA, 22 nt, Human
cuuccucugccucccgugcuca

SEQ ID NO: 281509 - RNA, 22 nt, Human
uggcucagagcagggacucugg

SEQ ID NO: 281510 - RNA, 22 nt, Human
ucauuauuuuggacuggagugu

SEQ ID NO: 281511 - RNA, 22 nt, Human
auguuuauggagcagguauuag

SEQ ID NO: 281512 - RNA, 22 nt, Human
ucccacacuugaaacaaggcug

SEQ ID NO: 281513 - RNA, 22 nt, Human
aaagcucuuuuccaaguauuga

SEQ ID NO: 281514 - RNA, 22 nt, Human
ccucuccaguuuuaacgugacc

SEQ ID NO: 281515 - RNA, 22 nt, Human
ugguccugagaauccuguccuc

SEQ ID NO: 281516 - RNA, 22 nt, Human
uaugugucuuuaucuggcucuu

SEQ ID NO: 281517 - RNA, 22 nt, Human
ugggaccugcuccuggaaugag

SEQ ID NO: 281518 - RNA, 22 nt, Human
cuguugucuucauugucauauc

SEQ ID NO: 281519 - RNA, 22 nt, Human
aaacaauguuccuauauuagag

SEQ ID NO: 281520 - RNA, 21 nt, Human
auauuguagguaaagugcagg

SEQ ID NO: 281521 - RNA, 19 nt, Human
aggcuuggauuguggccaa

SEQ ID NO: 281522 - RNA, 22 nt, Human
uuugucaucccuuuugaaacug

SEQ ID NO: 281523 - RNA, 22 nt, Human
ucuggcagcuauccucuggcca

SEQ ID NO: 281524 - RNA, 22 nt, Human
auauauaucgaguucaugucuc

SEQ ID NO: 281525 - RNA, 23 nt, Human
ucugucuguguaugugcagaaag

SEQ ID NO: 281526 - RNA, 22 nt, Human
auguuaaauaaucccuuaaagc

SEQ ID NO: 281527 - RNA, 22 nt, Human
acagcuuuuuacuaauagauug

SEQ ID NO: 281528 - RNA, 22 nt, Human
guuugaaugcaguaugcauuuu

SEQ ID NO: 281529 - RNA, 22 nt, Human
uagaaaagaauuuuauuugaua

SEQ ID NO: 281530 - RNA, 22 nt, Human
agauuuaaauuugcuacaauuc

SEQ ID NO: 281531 - RNA, 22 nt, Human
cuacauuaaauuggcuuacuua

SEQ ID NO: 281532 - RNA, 22 nt, Human
agcaaagcaccauauggcaguu

SEQ ID NO: 281533 - RNA, 22 nt, Human
cuggcuggucaugucaugagcc

SEQ ID NO: 281534 - RNA, 22 nt, Human
uucugcuuuuagcuaaacuaua

SEQ ID NO: 281535 - RNA, 22 nt, Human
uacugucuuuuccuaaaugggu

SEQ ID NO: 281536 - RNA, 22 nt, Human
cagacaggagacuggaucaugg

SEQ ID NO: 281537 - RNA, 22 nt, Human
gcuccaggagagggaagcagau

SEQ ID NO: 281538 - RNA, 22 nt, Human
acccagccauguucaguucucu

SEQ ID NO: 281539 - RNA, 19 nt, Human
acagccuguugguggggcu

SEQ ID NO: 281540 - RNA, 22 nt, Human
uuuuauugucaaugaagacaga

SEQ ID NO: 281541 - RNA, 22 nt, Human
aaucuucacagaaaaaugucug

SEQ ID NO: 281542 - RNA, 22 nt, Human
ugucauuuauucucuuauucua

SEQ ID NO: 281543 - RNA, 22 nt, Human
agcugaaucucaggcauccuuu

SEQ ID NO: 281544 - RNA, 22 nt, Human
uauuggauagcuugugcagaau

SEQ ID NO: 281545 - RNA, 22 nt, Human
uggcaguggauaggggagcggu

SEQ ID NO: 281546 - RNA, 22 nt, Human
aucaaaguaucucaauauggua

SEQ ID NO: 281547 - RNA, 22 nt, Human
uggcaggguggcaacuuuuggu

SEQ ID NO: 281548 - RNA, 22 nt, Human
aguugacauccagagacauucu

SEQ ID NO: 281549 - RNA, 22 nt, Human
ccaggaggucugaguguggaca

SEQ ID NO: 281550 - RNA, 23 nt, Human
uucuuuauaaaucaaugggaugu

SEQ ID NO: 281551 - RNA, 22 nt, Human
guuaucaugcuucaucaucacu

SEQ ID NO: 281552 - RNA, 23 nt, Human
ccugucugugcuggguggacaca

SEQ ID NO: 281553 - RNA, 22 nt, Human
aauucaaauuacaauaguuguu

SEQ ID NO: 281554 - RNA, 22 nt, Human
auuucccuccagggaaagcuua

SEQ ID NO: 281555 - RNA, 22 nt, Human
uugucuggucaaaucacuugua

SEQ ID NO: 281556 - RNA, 22 nt, Human
uuagcucagaaaauuuaaacuu

SEQ ID NO: 281557 - RNA, 22 nt, Human
uuuucuguaagaggacuuuaau

SEQ ID NO: 281558 - RNA, 22 nt, Human
cacaggaggcaaugguaagauu

SEQ ID NO: 281559 - RNA, 23 nt, Human
uggccaggcauaaaggugggugg

SEQ ID NO: 281560 - RNA, 22 nt, Human
ugucaaaaccagcaauuuuguu

SEQ ID NO: 281561 - RNA, 22 nt, Human
aaguguauauaugacuuauaaa

SEQ ID NO: 281562 - RNA, 22 nt, Human
ggcuuuauuaagcaggguaagu

SEQ ID NO: 281563 - RNA, 22 nt, Human
ugcauggacucaucagacaaga

SEQ ID NO: 281564 - RNA, 22 nt, Human
ggcccaguguaccccaggcagu

SEQ ID NO: 281565 - RNA, 22 nt, Human
uuuuauuggagugauaccaagc

SEQ ID NO: 281566 - RNA, 22 nt, Human
uuuuagaagugccuauccuaug

SEQ ID NO: 281567 - RNA, 22 nt, Human
gcuuccagcaaacacuggcugc

SEQ ID NO: 281568 - RNA, 21 nt, Human
acaugucuggucauuuuuagc

SEQ ID NO: 281569 - RNA, 22 nt, Human
ccaggcaggcuagaauguaaau

SEQ ID NO: 281570 - RNA, 22 nt, Human
cagaggcagccgggggagaacg

SEQ ID NO: 281571 - RNA, 22 nt, Human
auucuucaccugagucagucua

SEQ ID NO: 281572 - RNA, 22 nt, Human
acagauuuaggacuguagcgau

SEQ ID NO: 281573 - RNA, 22 nt, Human
cuccuggcaguuccccuuguca

SEQ ID NO: 281574 - RNA, 21 nt, Human
ucuuucugaaaucucagucug

SEQ ID NO: 281575 - RNA, 22 nt, Human
aguaggcagaaguggcauucgg

SEQ ID NO: 281576 - RNA, 23 nt, Human
gucuuuauaguggggcacuuugu

SEQ ID NO: 281577 - RNA, 22 nt, Human
ccagguggugccucuguucgca

SEQ ID NO: 281578 - RNA, 22 nt, Human
uccugugccaucucuagagacu

SEQ ID NO: 281579 - RNA, 22 nt, Human
cucuccacucagcgucaugucc

SEQ ID NO: 281580 - RNA, 22 nt, Human
ugacccauuaaccacuuucccu

SEQ ID NO: 281581 - RNA, 22 nt, Human
aaugucucaccguaaauguaac

SEQ ID NO: 281582 - RNA, 22 nt, Human
gcaugugucaucugccuuucgu

SEQ ID NO: 281583 - RNA, 22 nt, Human
uauugagaacccucaggaggca

SEQ ID NO: 281584 - RNA, 22 nt, Human
uguuccuguuuaaugugcucau

SEQ ID NO: 281585 - RNA, 22 nt, Human
agggaccuugauggguuuggga

SEQ ID NO: 281586 - RNA, 22 nt, Human
cucuggccuggggccugcuccc

SEQ ID NO: 281587 - RNA, 22 nt, Human
cccagcuugcaaauggguugcu

SEQ ID NO: 281588 - RNA, 22 nt, Human
acauguaaaagauaaauuaaca

SEQ ID NO: 281589 - RNA, 22 nt, Human
cucuuaaagaauguuccagcug

SEQ ID NO: 281590 - RNA, 22 nt, Human
uuaugauuuagaaagauucacu

SEQ ID NO: 281591 - RNA, 22 nt, Human
uauugcuggaaaauggugugau

SEQ ID NO: 281592 - RNA, 22 nt, Human
caguucuuuguggggaguucuc

SEQ ID NO: 281593 - RNA, 22 nt, Human
acuucuaugcacagagcuugga

SEQ ID NO: 281594 - RNA, 22 nt, Human
ccugccagugccucccacuggu

SEQ ID NO: 281595 - RNA, 22 nt, Human
auugcuugaauuaccauguaau

SEQ ID NO: 281596 - RNA, 22 nt, Human
ucccacaggagccugaguccca

SEQ ID NO: 281597 - RNA, 22 nt, Human
uuuccuaagguagugauaauuu

SEQ ID NO: 281598 - RNA, 22 nt, Human
uuccuaaucacgaacauuauuu

SEQ ID NO: 281599 - RNA, 22 nt, Human
cagggcaguuugugccuaugag

SEQ ID NO: 281600 - RNA, 22 nt, Human
agagccagcauuugacacuggc

SEQ ID NO: 281601 - RNA, 22 nt, Human
agcccugauuaaccuuggcuuu

SEQ ID NO: 281602 - RNA, 21 nt, Human
aaauuucugcaagccucaacu

SEQ ID NO: 281603 - RNA, 22 nt, Human
uuccucucaacaugccugccgg

SEQ ID NO: 281604 - RNA, 22 nt, Human
gagccugaugaaacaggcagac

SEQ ID NO: 281605 - RNA, 22 nt, Human
uuguacaaguuuugagcuuaag

SEQ ID NO: 281606 - RNA, 22 nt, Human
gccaaaucuugcacacucuugu

SEQ ID NO: 281607 - RNA, 22 nt, Human
auuauauaggacuugcccuucc

SEQ ID NO: 281608 - RNA, 22 nt, Human
guuauucuaccacuauguacag

SEQ ID NO: 281609 - RNA, 22 nt, Human
auccucaguguuucugacaucu

SEQ ID NO: 281610 - RNA, 22 nt, Human
uguacauagaaaggauacagcu

SEQ ID NO: 281611 - RNA, 22 nt, Human
cuucuucaucuguaaaacuugg

SEQ ID NO: 281612 - RNA, 22 nt, Human
uccuggcaaagcaaguuaugaa

SEQ ID NO: 281613 - RNA, 22 nt, Human
cucuuuccaggguaccccaggu

SEQ ID NO: 281614 - RNA, 20 nt, Human
agcucuuacuuugcagcagc

SEQ ID NO: 281615 - RNA, 22 nt, Human
cucccagguugauucuuucccu

SEQ ID NO: 281616 - RNA, 22 nt, Human
caaaagcaguucuaucugaguu

SEQ ID NO: 281617 - RNA, 22 nt, Human
acagguguacaaugcaugacag

SEQ ID NO: 281618 - RNA, 22 nt, Human
cccagagguuccuuagggacca

SEQ ID NO: 281619 - RNA, 22 nt, Human
auuuguuaauuaugaggcauac

SEQ ID NO: 281620 - RNA, 22 nt, Human
gauuuucauuauagcuaguuuc

SEQ ID NO: 281621 - RNA, 22 nt, Human
auugucagugggauuugucaac

SEQ ID NO: 281622 - RNA, 22 nt, Human
gugggugucaguaucuuuaacg

SEQ ID NO: 281623 - RNA, 22 nt, Human
caauuucuaacauuccauggau

SEQ ID NO: 281624 - RNA, 22 nt, Human
auguucuauaucauuauuguga

SEQ ID NO: 281625 - RNA, 22 nt, Human
agucucagaaaagaagcaugga

SEQ ID NO: 281626 - RNA, 22 nt, Human
agaaucagaugaagacuccugc

SEQ ID NO: 281627 - RNA, 22 nt, Human
gcagccuuuggaauuagagacu

SEQ ID NO: 281628 - RNA, 22 nt, Human
ccccagggaagcuuugcuuacu

SEQ ID NO: 281629 - RNA, 18 nt, Human
aggcuugggcccagcagc

SEQ ID NO: 281630 - RNA, 22 nt, Human
agagccagguguagucucggag

SEQ ID NO: 281631 - RNA, 22 nt, Human
aaaacaggugucagcaaacuau

SEQ ID NO: 281632 - RNA, 22 nt, Human
auugggaugccggcugauaaga

SEQ ID NO: 281633 - RNA, 22 nt, Human
uguuaaauguauuauguguucu

SEQ ID NO: 281634 - RNA, 22 nt, Human
agucccaacagcuuacaaggaa

SEQ ID NO: 281635 - RNA, 22 nt, Human
auagcacaauauuaccuuuaug

SEQ ID NO: 281636 - RNA, 21 nt, Human
gccuggcuucacaggcacuga

SEQ ID NO: 281637 - RNA, 22 nt, Human
agcugaaauuuuacugaguaua

SEQ ID NO: 281638 - RNA, 22 nt, Human
agggccagcacuccuggcagga

SEQ ID NO: 281639 - RNA, 22 nt, Human
acaguuaucuuugaaauagaga

SEQ ID NO: 281640 - RNA, 22 nt, Human
cucccuucaggagaggcucaca

SEQ ID NO: 281641 - RNA, 22 nt, Human
auauuucuggggguguguuucu

SEQ ID NO: 281642 - RNA, 22 nt, Human
ccaaggcuccucagcuggucuu

SEQ ID NO: 281643 - RNA, 22 nt, Human
uccugugaagaauagcacucaa

SEQ ID NO: 281644 - RNA, 22 nt, Human
cacaugacacuauuuuguucua

SEQ ID NO: 281645 - RNA, 22 nt, Human
ggagcccugcugacaugggugu

SEQ ID NO: 281646 - RNA, 22 nt, Human
uucaugaaaguguaucuugugg

SEQ ID NO: 281647 - RNA, 22 nt, Human
uucagauguggcuuugucaggc

SEQ ID NO: 281648 - RNA, 22 nt, Human
gagaaagauuguccuucagggg

SEQ ID NO: 281649 - RNA, 22 nt, Human
uugcacuccagcccgagcaaca

SEQ ID NO: 281650 - RNA, 22 nt, Human
aagcaaagugcuuugccuccag

SEQ ID NO: 281651 - RNA, 22 nt, Human
uauuccaagcacagcaacccag

SEQ ID NO: 281652 - RNA, 22 nt, Human
aacaguuugccugaaauguauu

SEQ ID NO: 281653 - RNA, 22 nt, Human
agguagggaagaaggcaugaaa

SEQ ID NO: 281654 - RNA, 22 nt, Human
agagccagcaacucuagcccug

SEQ ID NO: 281655 - RNA, 23 nt, Human
ucagggacaugaugugucauauc

SEQ ID NO: 281656 - RNA, 19 nt, Human
auuuuucuuccucugugca

SEQ ID NO: 281657 - RNA, 22 nt, Human
guauuaggaggaacacaggccu

SEQ ID NO: 281658 - RNA, 22 nt, Human
auaguacaagggaagagugaag

SEQ ID NO: 281659 - RNA, 22 nt, Human
ucuucacaggagccugccugcc

SEQ ID NO: 281660 - RNA, 22 nt, Human
caggacaauggucauacuggau

SEQ ID NO: 281661 - RNA, 21 nt, Human
aaauacagaaacuuguuuuca

SEQ ID NO: 281662 - RNA, 22 nt, Human
ccagggcaaaugagaucauagc

SEQ ID NO: 281663 - RNA, 22 nt, Human
acagggcagugucuugaaaaau

SEQ ID NO: 281664 - RNA, 22 nt, Human
auguuuuacccuuugcacaaac

SEQ ID NO: 281665 - RNA, 22 nt, Human
ugugaaaagcaggcuacuuucu

SEQ ID NO: 281666 - RNA, 22 nt, Human
ucuggcaguggaugagggcagc

SEQ ID NO: 281667 - RNA, 22 nt, Human
acauucuucuugugaauuuacu

SEQ ID NO: 281668 - RNA, 22 nt, Human
aggaccauccuaagguaggcaa

SEQ ID NO: 281669 - RNA, 22 nt, Human
cuguuguauuauucaauauuau

SEQ ID NO: 281670 - RNA, 22 nt, Human
gccacagguacuaugggagaga

SEQ ID NO: 281671 - RNA, 22 nt, Human
cgucuuccucuuacgaugcgcu

SEQ ID NO: 281672 - RNA, 22 nt, Human
ucuggaggcaggcugccaggau

SEQ ID NO: 281673 - RNA, 22 nt, Human
ccuggcucuagaggccacuccu

SEQ ID NO: 281674 - RNA, 17 nt, Human
uugggagagaaagguau

SEQ ID NO: 281675 - RNA, 22 nt, Human
ucccagagcaguacuccaggag

SEQ ID NO: 281676 - RNA, 22 nt, Human
aauugcuuugaagaagggagcg

SEQ ID NO: 281677 - RNA, 22 nt, Human
ugguaucguguuggcacucagu

SEQ ID NO: 281678 - RNA, 21 nt, Human
auggugagauacugggugugg

SEQ ID NO: 281679 - RNA, 22 nt, Human
uccuuucccuuuccauccuggc

SEQ ID NO: 281680 - RNA, 22 nt, Human
ugcagggcuccuggcuccaauc

SEQ ID NO: 281681 - RNA, 22 nt, Human
ucguuaaaugcuaaaacugaca

SEQ ID NO: 281682 - RNA, 22 nt, Human
cuggcuugcagcucaucauaaa

SEQ ID NO: 281683 - RNA, 22 nt, Human
uggcaaagaccgcaauuacuuu

SEQ ID NO: 281684 - RNA, 22 nt, Human
acuuagauaacaaaccuguggu

SEQ ID NO: 281685 - RNA, 22 nt, Human
uucaguaugauuccuccaguag

SEQ ID NO: 281686 - RNA, 22 nt, Human
uguccuuuacugauugcuucug

SEQ ID NO: 281687 - RNA, 22 nt, Human
aggcagggcucauuucuuaggc

SEQ ID NO: 281688 - RNA, 22 nt, Human
acugucuuguguuaaagaacca

SEQ ID NO: 281689 - RNA, 22 nt, Human
auuugggaaugugcauuauacu

SEQ ID NO: 281690 - RNA, 22 nt, Human
ccuuccaagugcugcuuuuucc

SEQ ID NO: 281691 - RNA, 22 nt, Human
acagucuucaugcuagaauggc

SEQ ID NO: 281692 - RNA, 22 nt, Human
augucugcggcccaggccaggg

SEQ ID NO: 281693 - RNA, 22 nt, Human
ugggaccugaagcagguuggca

SEQ ID NO: 281694 - RNA, 22 nt, Human
uucuauuaauauguuaauucug

SEQ ID NO: 281695 - RNA, 21 nt, Human
cuguccaguaauuccuggcac

SEQ ID NO: 281696 - RNA, 19 nt, Human
ucucaauucuccccacugc

SEQ ID NO: 281697 - RNA, 22 nt, Human
ugguggcuucugaggauggcga

SEQ ID NO: 281698 - RNA, 22 nt, Human
ccuucuccccucugcagggugu

SEQ ID NO: 281699 - RNA, 22 nt, Human
ggacagguucagcaguuuauaa

SEQ ID NO: 281700 - RNA, 22 nt, Human
agaaaugucaggaaagaagucc

SEQ ID NO: 281701 - RNA, 22 nt, Human
uaugaaauugccauuuuuaugg

SEQ ID NO: 281702 - RNA, 22 nt, Human
cugaggagaaaugggaugguuc

SEQ ID NO: 281703 - RNA, 23 nt, Human
cuccccaguguccucaugcaucu

SEQ ID NO: 281704 - RNA, 22 nt, Human
agacuucuuugugagcauuuuc

SEQ ID NO: 281705 - RNA, 19 nt, Human
ucuugcagccccagcaggc

SEQ ID NO: 281706 - RNA, 22 nt, Human
ggcucacgcaauuaucccggcc

SEQ ID NO: 281707 - RNA, 22 nt, Human
cagugagguagacagcuuuuuc

SEQ ID NO: 281708 - RNA, 22 nt, Human
ucugggaaguccucugucaugc

SEQ ID NO: 281709 - RNA, 22 nt, Human
ugguucagauauggagcuggga

SEQ ID NO: 281710 - RNA, 22 nt, Human
aacaggcaauuuaggacucuuu

SEQ ID NO: 281711 - RNA, 22 nt, Human
uggguggagaaguggaccugcu

SEQ ID NO: 281712 - RNA, 22 nt, Human
ucuucauuuuacaggcagaccu

SEQ ID NO: 281713 - RNA, 22 nt, Human
uauuaaauauaucuguuaguug

SEQ ID NO: 281714 - RNA, 22 nt, Human
agugugagccuacaggccaaag

SEQ ID NO: 281715 - RNA, 22 nt, Human
ggccuugacaguuaagagaccu

SEQ ID NO: 281716 - RNA, 22 nt, Human
uggcagguagucagaggcgaca

SEQ ID NO: 281717 - RNA, 22 nt, Human
ucuguucaugucuuuuuaagug

SEQ ID NO: 281718 - RNA, 22 nt, Human
ggcaggugacggggaugaguau

SEQ ID NO: 281719 - RNA, 22 nt, Human
gccgggaccaaggccacggagc

SEQ ID NO: 281720 - RNA, 19 nt, Human
uuucuguuugcuucugguu

SEQ ID NO: 281721 - RNA, 22 nt, Human
gggaacuucagaaagucgcugc

SEQ ID NO: 281722 - RNA, 22 nt, Human
aggccuuaccauagcuguagca

SEQ ID NO: 281723 - RNA, 22 nt, Human
uuuagggaagaagcccauggcc

SEQ ID NO: 281724 - RNA, 22 nt, Human
ccuagaugggauggcggccggg

SEQ ID NO: 281725 - RNA, 22 nt, Human
agagggugaaugagauagaaaa

SEQ ID NO: 281726 - RNA, 22 nt, Human
uucacugcuacauccaggugcc

SEQ ID NO: 281727 - RNA, 22 nt, Human
uuuuugaaggcugaugugauua

SEQ ID NO: 281728 - RNA, 22 nt, Human
cccagcagccagaaugaggagc

SEQ ID NO: 281729 - RNA, 22 nt, Human
cuucucagcuuagguaugguuu

SEQ ID NO: 281730 - RNA, 22 nt, Human
cucuggaagaauacacuuagaa

SEQ ID NO: 281731 - RNA, 22 nt, Human
cugagcccucuguuuucccucu

SEQ ID NO: 281732 - RNA, 22 nt, Human
guuuauaaggcccaauauuucu

SEQ ID NO: 281733 - RNA, 22 nt, Human
uaucuauuauguucuauguguc

SEQ ID NO: 281734 - RNA, 22 nt, Human
aacaugauggggaagaacaaga

SEQ ID NO: 281735 - RNA, 22 nt, Human
cagacagcaggccuggaugugu

SEQ ID NO: 281736 - RNA, 21 nt, Human
cccaggagaagaaaagaugca

SEQ ID NO: 281737 - RNA, 22 nt, Human
acagcuggcaggggggcaugaa

SEQ ID NO: 281738 - RNA, 22 nt, Human
uagggaugacgaaaggacagag

SEQ ID NO: 281739 - RNA, 22 nt, Human
uuuuacaccucagaugagcaga

SEQ ID NO: 281740 - RNA, 22 nt, Human
aagcaccugcaguugacaaaaa

SEQ ID NO: 281741 - RNA, 22 nt, Human
ucuguucaguugauguaguuuu

SEQ ID NO: 281742 - RNA, 22 nt, Human
uagcacaguucacuaugauaca

SEQ ID NO: 281743 - RNA, 22 nt, Human
ucccaaggccaggcaucuagaa

SEQ ID NO: 281744 - RNA, 22 nt, Human
agacugaauaacaagcaaauaa

SEQ ID NO: 281745 - RNA, 22 nt, Human
ugaaugauacagaauuauguag

SEQ ID NO: 281746 - RNA, 22 nt, Human
ccaaguacagauuccuccacug

SEQ ID NO: 281747 - RNA, 22 nt, Human
auuccacagcucagccucucuu

SEQ ID NO: 281748 - RNA, 22 nt, Human
auaaagauuucuuuuucucuac

SEQ ID NO: 281749 - RNA, 23 nt, Human
uggaccugaaccagugccucugu

SEQ ID NO: 281750 - RNA, 22 nt, Human
auaugauuccacuauuguaugg

SEQ ID NO: 281751 - RNA, 22 nt, Human
gcuuccagaccccagucccuca

SEQ ID NO: 281752 - RNA, 22 nt, Human
uccaggaggccucauuuccugu

SEQ ID NO: 281753 - RNA, 22 nt, Human
uauuccuaagucccaacuacau

SEQ ID NO: 281754 - RNA, 22 nt, Human
ggguguagacacauguucaucu

SEQ ID NO: 281755 - RNA, 22 nt, Human
ugcaugaaauauuuucuguagg

SEQ ID NO: 281756 - RNA, 22 nt, Human
cagagcacagagcuugggacaa

SEQ ID NO: 281757 - RNA, 22 nt, Human
agagccaggcucuaccuggguu

SEQ ID NO: 281758 - RNA, 22 nt, Human
uuggguuuucccuugaaacuga

SEQ ID NO: 281759 - RNA, 22 nt, Human
ggcaggugaggcaugugccugg

SEQ ID NO: 281760 - RNA, 22 nt, Human
cucugagaagaguucaaguaaa

SEQ ID NO: 281761 - RNA, 22 nt, Human
ucuggagggggaugccucaucc

SEQ ID NO: 281762 - RNA, 22 nt, Human
agcuguuuccauaaaugagaca

SEQ ID NO: 281763 - RNA, 22 nt, Human
aauuagggagccaucauaaggu

SEQ ID NO: 281764 - RNA, 22 nt, Human
caucuguugcuuccuaacaagu

SEQ ID NO: 281765 - RNA, 22 nt, Human
auuagaaugcaggguucauugu

SEQ ID NO: 281766 - RNA, 22 nt, Human
uggcuucauucuccugugaaua

SEQ ID NO: 281767 - RNA, 19 nt, Human
ugacagguuuuauguguuu

SEQ ID NO: 281768 - RNA, 22 nt, Human
cugcaggggaccaaagucugac

SEQ ID NO: 281769 - RNA, 22 nt, Human
uuguguccauuugagucaugug

SEQ ID NO: 281770 - RNA, 22 nt, Human
ucugaaauuguuaguaaaaaug

SEQ ID NO: 281771 - RNA, 22 nt, Human
aaacuacaucucauggaugagg

SEQ ID NO: 281772 - RNA, 22 nt, Human
guguguccucauaagauggagg

SEQ ID NO: 281773 - RNA, 22 nt, Human
uucacauuugcccuuaugugug

SEQ ID NO: 281774 - RNA, 22 nt, Human
cugauugagaaggaaggggauc

SEQ ID NO: 281775 - RNA, 22 nt, Human
acaauaguaagguauauuguca

SEQ ID NO: 281776 - RNA, 22 nt, Human
auaaguaggaaaauuugaauau

SEQ ID NO: 281777 - RNA, 22 nt, Human
gcugggugauucauuuccauaa

SEQ ID NO: 281778 - RNA, 22 nt, Human
aauguugaggauaucagaaaau

SEQ ID NO: 281779 - RNA, 22 nt, Human
aggcaguuuaggcagcgauuua

SEQ ID NO: 281780 - RNA, 22 nt, Human
agcauuccacacugaagucugc

SEQ ID NO: 281781 - RNA, 22 nt, Human
gaugccuguggugagcacacau

SEQ ID NO: 281782 - RNA, 22 nt, Human
gagguucugggggucugccugg

SEQ ID NO: 281783 - RNA, 22 nt, Human
acuagaaauguauugguagcug

SEQ ID NO: 281784 - RNA, 22 nt, Human
ggcaggugugagcuguaaagga

SEQ ID NO: 281785 - RNA, 22 nt, Human
ugaggaauggcuuaauguggga

SEQ ID NO: 281786 - RNA, 22 nt, Human
acuaggaaggcauaugggcaga

SEQ ID NO: 281787 - RNA, 22 nt, Human
cccugccuuguuggagccuaug

SEQ ID NO: 281788 - RNA, 20 nt, Human
ucuggccccuuccuguccug

SEQ ID NO: 281789 - RNA, 22 nt, Human
ccuggcucugcgugcagcuccg

SEQ ID NO: 281790 - RNA, 22 nt, Human
cuccagugcacccagaggauuu

SEQ ID NO: 281791 - RNA, 22 nt, Human
ccugugggagcccaggcagaua

SEQ ID NO: 281792 - RNA, 22 nt, Human
ucuuccuucgcccuugcuguuu

SEQ ID NO: 281793 - RNA, 22 nt, Human
ucccagaggaaauggcagcuga

SEQ ID NO: 281794 - RNA, 22 nt, Human
ccugaggucagccauucuugcc

SEQ ID NO: 281795 - RNA, 22 nt, Human
ggccugagggugggcucucagu

SEQ ID NO: 281796 - RNA, 22 nt, Human
agccuucaguaaauccacugug

SEQ ID NO: 281797 - RNA, 22 nt, Human
auguauacgugcaggucacagg

SEQ ID NO: 281798 - RNA, 22 nt, Human
uuucuacagcuggugcaacuuu

SEQ ID NO: 281799 - RNA, 20 nt, Human
ggcucuggaaucuggugggc

SEQ ID NO: 281800 - RNA, 22 nt, Human
acaauacuauuuucaguauccu

SEQ ID NO: 281801 - RNA, 22 nt, Human
ugcugccaucucaacugcccuu

SEQ ID NO: 281802 - RNA, 22 nt, Human
acauguuugccugcaggcuuag

SEQ ID NO: 281803 - RNA, 22 nt, Human
cccaguggcccagcauguggug

SEQ ID NO: 281804 - RNA, 22 nt, Human
uggaaugagcuggcuaauaacc

SEQ ID NO: 281805 - RNA, 22 nt, Human
ucuuaaaccacaaaauucagag

SEQ ID NO: 281806 - RNA, 22 nt, Human
auauuacacacgguaucacggg

SEQ ID NO: 281807 - RNA, 20 nt, Human
ucccucccuccagcucuggg

SEQ ID NO: 281808 - RNA, 22 nt, Human
ucucuucacauuccuggcaaac

SEQ ID NO: 281809 - RNA, 22 nt, Human
aguggcagaucucuggucugga

SEQ ID NO: 281810 - RNA, 22 nt, Human
uaauaaaugaaagugcuggcau

SEQ ID NO: 281811 - RNA, 22 nt, Human
uucuuugcccuuaaugaaauaa

SEQ ID NO: 281812 - RNA, 22 nt, Human
ccagagagagaggucaauggca

SEQ ID NO: 281813 - RNA, 22 nt, Human
ccagcauggcaccugagaugag

SEQ ID NO: 281814 - RNA, 22 nt, Human
acagcuggaguguuggugaggu

SEQ ID NO: 281815 - RNA, 22 nt, Human
aagaaauggcuucaucugagua

SEQ ID NO: 281816 - RNA, 22 nt, Human
aaaguauuugugauuuuuacca

SEQ ID NO: 281817 - RNA, 22 nt, Human
ucuggaggccauagggaaggau

SEQ ID NO: 281818 - RNA, 22 nt, Human
acagguggggcacuuggagccu

SEQ ID NO: 281819 - RNA, 22 nt, Human
uccuuccugcucuaacauucag

SEQ ID NO: 281820 - RNA, 22 nt, Human
cuauuagguuggugcaaaagua

SEQ ID NO: 281821 - RNA, 22 nt, Human
auugcagauucuucucagggag

SEQ ID NO: 281822 - RNA, 22 nt, Human
ggggagaauuaccaaaagcgcu

SEQ ID NO: 281823 - RNA, 20 nt, Human
uugagcuuuuaguacagaca

SEQ ID NO: 281824 - RNA, 22 nt, Human
aggcccugagaaaaucccugca

SEQ ID NO: 281825 - RNA, 22 nt, Human
acauucccuuggcuugaagcag

SEQ ID NO: 281826 - RNA, 23 nt, Human
gguuccaggaacacagccugaug

SEQ ID NO: 281827 - RNA, 22 nt, Human
gggugacauuaggaagauagac

SEQ ID NO: 281828 - RNA, 22 nt, Human
uuuguguuguuuuaagccacua

SEQ ID NO: 281829 - RNA, 22 nt, Human
uagguucagagaacugaaaaua

SEQ ID NO: 281830 - RNA, 22 nt, Human
ucccucucuggcuggggugcgg

SEQ ID NO: 281831 - RNA, 22 nt, Human
cauucccuuggggaguucaugc

SEQ ID NO: 281832 - RNA, 22 nt, Human
ggccacugcccuggcuacaccg

SEQ ID NO: 281833 - RNA, 22 nt, Human
ugcuggagcccaggcggccuuu

SEQ ID NO: 281834 - RNA, 22 nt, Human
cagguacauucguagacccauu

SEQ ID NO: 281835 - RNA, 23 nt, Human
uugagcucaguagcucugcuggu

SEQ ID NO: 281836 - RNA, 22 nt, Human
ucugaacauccagcaaugcaca

SEQ ID NO: 281837 - RNA, 20 nt, Human
cccagccccuaccuguugcc

SEQ ID NO: 281838 - RNA, 17 nt, Human
uccuggcaguccccugg

SEQ ID NO: 281839 - RNA, 22 nt, Human
ugguacaaucacagcucacugu

SEQ ID NO: 281840 - RNA, 22 nt, Human
cugaggagagguggccuguguu

SEQ ID NO: 281841 - RNA, 22 nt, Human
auuguaaauagugccacaauaa

SEQ ID NO: 281842 - RNA, 22 nt, Human
ucugaaaugcaggcaauuugcu

SEQ ID NO: 281843 - RNA, 22 nt, Human
ugcaggaauauugaugaacuua

SEQ ID NO: 281844 - RNA, 22 nt, Human
uaugaaggauacaccucugauu

SEQ ID NO: 281845 - RNA, 22 nt, Human
uuuaauguauucuuuggaacca

SEQ ID NO: 281846 - RNA, 19 nt, Human
aaagcagaggagcaucuga

SEQ ID NO: 281847 - RNA, 22 nt, Human
uuacuuuguucucaagauaugu

SEQ ID NO: 281848 - RNA, 22 nt, Human
agugucagccugggcaaggaac

SEQ ID NO: 281849 - RNA, 22 nt, Human
agagcauccaucggccaggacc

SEQ ID NO: 281850 - RNA, 22 nt, Human
ucuuagcacagcuauauaaguu

SEQ ID NO: 281851 - RNA, 22 nt, Human
cacacacaguuuuguauucugu

SEQ ID NO: 281852 - RNA, 22 nt, Human
uucacacugucccggguggaaa

SEQ ID NO: 281853 - RNA, 22 nt, Human
uuggagguuugaaaauaugugu

SEQ ID NO: 281854 - RNA, 18 nt, Human
cuguucuagaacuccugu

SEQ ID NO: 281855 - RNA, 22 nt, Human
aagggcagagggaaucccacau

SEQ ID NO: 281856 - RNA, 20 nt, Human
auauaauaaauuuugguuac

SEQ ID NO: 281857 - RNA, 22 nt, Human
cuucucagcaugguuacuguga

SEQ ID NO: 281858 - RNA, 22 nt, Human
aggcuucccagcugagcucagc

SEQ ID NO: 281859 - RNA, 22 nt, Human
cccaggcagugcugaucccuca

SEQ ID NO: 281860 - RNA, 22 nt, Human
uugcuuuauauucaagagagga

SEQ ID NO: 281861 - RNA, 22 nt, Human
uccaugcaaacaguggcuagcu

SEQ ID NO: 281862 - RNA, 22 nt, Human
ccaggagagcauugcacagagg

SEQ ID NO: 281863 - RNA, 22 nt, Human
gcucaaagguugauagcugugc

SEQ ID NO: 281864 - RNA, 22 nt, Human
augacugcucugggcucccaug

SEQ ID NO: 281865 - RNA, 22 nt, Human
aaguuucugauauuguuaaagc

SEQ ID NO: 281866 - RNA, 22 nt, Human
uuugcaguguucaucaguauuu

SEQ ID NO: 281867 - RNA, 22 nt, Human
uuugacaaaggaaaaaugcaca

SEQ ID NO: 281868 - RNA, 22 nt, Human
ccugggugaugugcugcccucg

SEQ ID NO: 281869 - RNA, 22 nt, Human
guucucccuguccccugagcuu

SEQ ID NO: 281870 - RNA, 22 nt, Human
caguguggagggagagagccug

SEQ ID NO: 281871 - RNA, 22 nt, Human
uaugugucccugcuacucaaca

SEQ ID NO: 281872 - RNA, 22 nt, Human
ggauggcagacagugaguggcu

SEQ ID NO: 281873 - RNA, 22 nt, Human
uaaauuagagccagguaaguuu

SEQ ID NO: 281874 - RNA, 22 nt, Human
gggagggacacaaagaguuccc

SEQ ID NO: 281875 - RNA, 22 nt, Human
ggucuggaagcgcaguaggcug

SEQ ID NO: 281876 - RNA, 22 nt, Human
uauugguaucugagacagaguu

SEQ ID NO: 281877 - RNA, 22 nt, Human
auucacauuuagacaucaggua

SEQ ID NO: 281878 - RNA, 22 nt, Human
ugcuccugcugcaugcaucucc

SEQ ID NO: 281879 - RNA, 23 nt, Human
cucccuggaguuucuggaagaug

SEQ ID NO: 281880 - RNA, 22 nt, Human
ucuggguguagggccuggcaac

SEQ ID NO: 281881 - RNA, 22 nt, Human
ccuggcacaagagcagcauugg

SEQ ID NO: 281882 - RNA, 22 nt, Human
ggugggugcagggggcuucuua

SEQ ID NO: 281883 - RNA, 22 nt, Human
uuauuaggaacucaggauuuuu

SEQ ID NO: 281884 - RNA, 22 nt, Human
uucaauuuagugauguuguugg

SEQ ID NO: 281885 - RNA, 22 nt, Human
uuaaauuagucaagcuucucug

SEQ ID NO: 281886 - RNA, 22 nt, Human
aucuucaaggaaaaaauacagu

SEQ ID NO: 281887 - RNA, 22 nt, Human
uauuaagauacguaguuguaaa

SEQ ID NO: 281888 - RNA, 22 nt, Human
ggagaaggugcuggucacugug

SEQ ID NO: 281889 - RNA, 22 nt, Human
ggagggaagugaguucucagcu

SEQ ID NO: 281890 - RNA, 21 nt, Human
uggccaaaaccauauuauuaa

SEQ ID NO: 281891 - RNA, 22 nt, Human
agauugaauauagagauucuug

SEQ ID NO: 281892 - RNA, 22 nt, Human
uuuuguguugccauguuaagca

SEQ ID NO: 281893 - RNA, 22 nt, Human
ucaaaguaagaauuuauuacaa

SEQ ID NO: 281894 - RNA, 22 nt, Human
acaacacagcaaaaccccaucu

SEQ ID NO: 281895 - RNA, 21 nt, Human
ugaagggguggcagugugcuu

SEQ ID NO: 281896 - RNA, 22 nt, Human
uucaugaaacuuaacuguuggg

SEQ ID NO: 281897 - RNA, 22 nt, Human
cuccuggccacguucuugcugg

SEQ ID NO: 281898 - RNA, 22 nt, Human
gggcccuggccgaaucccucug

SEQ ID NO: 281899 - RNA, 22 nt, Human
auagacaaucccccauccuacc

SEQ ID NO: 281900 - RNA, 22 nt, Human
uuccuggcugaucuaccaaagu

SEQ ID NO: 281901 - RNA, 22 nt, Human
agagugauucuaguuagggaau

SEQ ID NO: 281902 - RNA, 22 nt, Human
ucuaauccuugcuaccugggug

SEQ ID NO: 281903 - RNA, 22 nt, Human
agauaaguacuguuauuauugc

SEQ ID NO: 281904 - RNA, 21 nt, Human
auacacauacacauaaaugug

SEQ ID NO: 281905 - RNA, 21 nt, Human
uuuucuggaguaugucuccuc

SEQ ID NO: 281906 - RNA, 22 nt, Human
cugggaggcagucucucuagaa

SEQ ID NO: 281907 - RNA, 22 nt, Human
uuuacaggguucaagaaugaaa

SEQ ID NO: 281908 - RNA, 22 nt, Human
ccagggcauguaacuaauggug

SEQ ID NO: 281909 - RNA, 22 nt, Human
uccuguuuccaauuuguugggu

SEQ ID NO: 281910 - RNA, 22 nt, Human
ucauuguauacuuuauuuauga

SEQ ID NO: 281911 - RNA, 22 nt, Human
uugcuuuaaugagauuuugcca

SEQ ID NO: 281912 - RNA, 18 nt, Human
ucagagagcagcuuuauu

SEQ ID NO: 281913 - RNA, 22 nt, Human
gugcccaguaaaugaaagcuuu

SEQ ID NO: 281914 - RNA, 22 nt, Human
uuccuggggggauagauuucac

SEQ ID NO: 281915 - RNA, 22 nt, Human
ggcaggugcuaagagagguaaa

SEQ ID NO: 281916 - RNA, 22 nt, Human
aauauugagaaccagcauguuu

SEQ ID NO: 281917 - RNA, 22 nt, Human
acuuucauuugugaagacugua

SEQ ID NO: 281918 - RNA, 22 nt, Human
gcugccaguguggcaugaugca

SEQ ID NO: 281919 - RNA, 22 nt, Human
ucuggcaggaccaugaagcgua

SEQ ID NO: 281920 - RNA, 22 nt, Human
uuugcaauuugugcugcaaaug

SEQ ID NO: 281921 - RNA, 21 nt, Human
ccaagagcaaugcuaaggaga

SEQ ID NO: 281922 - RNA, 22 nt, Human
ugauaacucucaguuucucaug

SEQ ID NO: 281923 - RNA, 22 nt, Human
gcauccaggacuauaugaugau

SEQ ID NO: 281924 - RNA, 22 nt, Human
acuuagauuccugguaccuccg

SEQ ID NO: 281925 - RNA, 22 nt, Human
ugauucacagacuucacaaggc

SEQ ID NO: 281926 - RNA, 22 nt, Human
uuuguguuuaugaaguuauucu

SEQ ID NO: 281927 - RNA, 22 nt, Human
gacauaauccuccucaccuacu

SEQ ID NO: 281928 - RNA, 22 nt, Human
uucuugccugcccugugucgua

SEQ ID NO: 281929 - RNA, 22 nt, Human
ugcaggugguacuucuuuuucu

SEQ ID NO: 281930 - RNA, 22 nt, Human
augcaggaguuggaaaaaauga

SEQ ID NO: 281931 - RNA, 20 nt, Human
agaucuuuucuauagaagug

SEQ ID NO: 281932 - RNA, 22 nt, Human
cgcagguguguuuucaggacua

SEQ ID NO: 281933 - RNA, 22 nt, Human
acugaagaacgcaucagugguu

SEQ ID NO: 281934 - RNA, 22 nt, Human
guuauuaguaagacucgcacau

SEQ ID NO: 281935 - RNA, 22 nt, Human
gucuuuauuacaaauccuuuuc

SEQ ID NO: 281936 - RNA, 22 nt, Human
ugggaccagauaaagggagguc

SEQ ID NO: 281937 - RNA, 22 nt, Human
gggucugggcaggcgcuuccuc

SEQ ID NO: 281938 - RNA, 22 nt, Human
acuacaguacuauaucuauagg

SEQ ID NO: 281939 - RNA, 22 nt, Human
agugugagugcucauguccauc

SEQ ID NO: 281940 - RNA, 22 nt, Human
ggcaggcauuagagauucccag

SEQ ID NO: 281941 - RNA, 22 nt, Human
uaguucuagccagugaaaugua

SEQ ID NO: 281942 - RNA, 23 nt, Human
gaggccuggcccugccacaucuc

SEQ ID NO: 281943 - RNA, 22 nt, Human
uuuccaugaucguuauagaacu

SEQ ID NO: 281944 - RNA, 22 nt, Human
ggagggagcauccccuugcuga

SEQ ID NO: 281945 - RNA, 22 nt, Human
ucugucauguuuccauuacaug

SEQ ID NO: 281946 - RNA, 22 nt, Human
gcuccuggcuucacugacauca

SEQ ID NO: 281947 - RNA, 22 nt, Human
ccagccacgaagcucccuucau

SEQ ID NO: 281948 - RNA, 22 nt, Human
ugagcccuggcucuuucacuua

SEQ ID NO: 281949 - RNA, 22 nt, Human
uaggcugcucaccaggcucaga

SEQ ID NO: 281950 - RNA, 22 nt, Human
uuucuucagagagagcuuuccc

SEQ ID NO: 281951 - RNA, 22 nt, Human
gccuggcaaggcccuguugacu

SEQ ID NO: 281952 - RNA, 22 nt, Human
acuagaaagaaguuuuuugaga

SEQ ID NO: 281953 - RNA, 22 nt, Human
agggccagagucuguguagaua

SEQ ID NO: 281954 - RNA, 22 nt, Human
cagugcaggcugggggcccugc

SEQ ID NO: 281955 - RNA, 21 nt, Human
agguggucugcagcagcugaa

SEQ ID NO: 281956 - RNA, 22 nt, Human
auaguacagagggcuacugguu

SEQ ID NO: 281957 - RNA, 22 nt, Human
ucaagcagcagaucaagagcua

SEQ ID NO: 281958 - RNA, 22 nt, Human
cugggugaguugaugaaggaga

SEQ ID NO: 281959 - RNA, 22 nt, Human
uagggauggcagcauguagcuu

SEQ ID NO: 281960 - RNA, 22 nt, Human
augaggaggccaguaagagccu

SEQ ID NO: 281961 - RNA, 22 nt, Human
uacaguuacuguuauaugugcu

SEQ ID NO: 281962 - RNA, 22 nt, Human
augaagggugucccugugagca

SEQ ID NO: 281963 - RNA, 22 nt, Human
uguguaaauuuauuuacauaaa

SEQ ID NO: 281964 - RNA, 22 nt, Human
aagugcuguuucugaugaaugc

SEQ ID NO: 281965 - RNA, 21 nt, Human
uauuuauuaauuuguaaggcu

SEQ ID NO: 281966 - RNA, 22 nt, Human
uucacauuucucugcuguuuga

SEQ ID NO: 281967 - RNA, 23 nt, Human
cuucuggcucuauaucagaauuc

SEQ ID NO: 281968 - RNA, 22 nt, Human
acaugauuuuuaaagagauaau

SEQ ID NO: 281969 - RNA, 23 nt, Human
agcucugaaauagggaaagagga

SEQ ID NO: 281970 - RNA, 22 nt, Human
uaucagauuuagaggagucaua

SEQ ID NO: 281971 - RNA, 22 nt, Human
aaagcagaggugauaugacuua

SEQ ID NO: 281972 - RNA, 23 nt, Human
auuuuuugucuuuguaacuagau

SEQ ID NO: 281973 - RNA, 22 nt, Human
uuuuuauaccaccucucacuua

SEQ ID NO: 281974 - RNA, 23 nt, Human
uuccugagugcuggagagagugc

SEQ ID NO: 281975 - RNA, 22 nt, Human
auacuuuuaauuccuucugagu

SEQ ID NO: 281976 - RNA, 22 nt, Human
cuguccugaaagggagauuggg

SEQ ID NO: 281977 - RNA, 22 nt, Human
ucuuccugaaacccuguuccag

SEQ ID NO: 281978 - RNA, 22 nt, Human
cuggcucugagcccaccuccag

SEQ ID NO: 281979 - RNA, 15 nt, Human
agacagacaguggga

SEQ ID NO: 281980 - RNA, 22 nt, Human
ucuuccaagguugcacacuauc

SEQ ID NO: 281981 - RNA, 22 nt, Human
auuuacagaaacuuaaucauag

SEQ ID NO: 281982 - RNA, 22 nt, Human
ccuggcucuggggcggacagcu

SEQ ID NO: 281983 - RNA, 22 nt, Human
uuccaggaagauucaacaaaag

SEQ ID NO: 281984 - RNA, 22 nt, Human
ugguucaguugcacaggcuguu

SEQ ID NO: 281985 - RNA, 22 nt, Human
uaaacauuuguuauucuuguuu

SEQ ID NO: 281986 - RNA, 22 nt, Human
uuaagcauggaagugaaauaau

SEQ ID NO: 281987 - RNA, 22 nt, Human
acuccuggguugcaguccucaa

SEQ ID NO: 281988 - RNA, 22 nt, Human
cgcaggugaacuguucugcagu

SEQ ID NO: 281989 - RNA, 22 nt, Human
auggguuucccucugaaauuau

SEQ ID NO: 281990 - RNA, 22 nt, Human
ucccagggacuggaugaugcag

SEQ ID NO: 281991 - RNA, 22 nt, Human
acagaugaguuaaagcagagug

SEQ ID NO: 281992 - RNA, 22 nt, Human
ccugguccuuacgucauugcuu

SEQ ID NO: 281993 - RNA, 22 nt, Human
acaaaugucuccucuuuuguua

SEQ ID NO: 281994 - RNA, 22 nt, Human
uuccuggcuugucacaucuacg

SEQ ID NO: 281995 - RNA, 22 nt, Human
uuccugggcucuggcuggccua

SEQ ID NO: 281996 - RNA, 22 nt, Human
acacaugauuaaugccaagcau

SEQ ID NO: 281997 - RNA, 22 nt, Human
ugcagggcaguuuguuucggca

SEQ ID NO: 281998 - RNA, 22 nt, Human
uucacaauagcuggcaucaucu

SEQ ID NO: 281999 - RNA, 22 nt, Human
aaauuccagaaacucaguauau

SEQ ID NO: 282000 - RNA, 22 nt, Human
uauacacauauacguuugugug

SEQ ID NO: 282001 - RNA, 22 nt, Human
cauuuucagcacccaucugaaa

SEQ ID NO: 282002 - RNA, 22 nt, Human
gcccaagcuccgccuccugucg

SEQ ID NO: 282003 - RNA, 22 nt, Human
aagauuuucagugccuaaaaca

SEQ ID NO: 282004 - RNA, 22 nt, Human
uuuucauuguuccucgagcauu

SEQ ID NO: 282005 - RNA, 22 nt, Human
gcaaagcagucuucugugccua

SEQ ID NO: 282006 - RNA, 22 nt, Human
aagauguugucguuagugauga

SEQ ID NO: 282007 - RNA, 22 nt, Human
augaugaaacuaggaacuagag

SEQ ID NO: 282008 - RNA, 22 nt, Human
gggauggaggguagagcaagug

SEQ ID NO: 282009 - RNA, 22 nt, Human
cacacaugacccacuuuuaccg

SEQ ID NO: 282010 - RNA, 22 nt, Human
gggugggguguaucggauccua

SEQ ID NO: 282011 - RNA, 18 nt, Human
ucuguccuuccauucuuc

SEQ ID NO: 282012 - RNA, 22 nt, Human
uuauuuacaacucuucucuucc

SEQ ID NO: 282013 - RNA, 22 nt, Human
uggcagggccuaccccaauauc

SEQ ID NO: 282014 - RNA, 22 nt, Human
aaggugguuguaggcuggucug

SEQ ID NO: 282015 - RNA, 22 nt, Human
gaaggaggcuccccaaagucug

SEQ ID NO: 282016 - RNA, 22 nt, Human
ucccacccccuccaaggaggaa

SEQ ID NO: 282017 - RNA, 22 nt, Human
ugucuucagcagucaucugggg

SEQ ID NO: 282018 - RNA, 22 nt, Human
cuguacaaaguagcugcuggga

SEQ ID NO: 282019 - RNA, 22 nt, Human
guuacaaaugccaaagcugaga

SEQ ID NO: 282020 - RNA, 22 nt, Human
ggcacugggagaggugagacgg

SEQ ID NO: 282021 - RNA, 22 nt, Human
cuggguccugcucucccuaaga

SEQ ID NO: 282022 - RNA, 22 nt, Human
uuuacuguguccaucugugacu

SEQ ID NO: 282023 - RNA, 22 nt, Human
ggcuccaggcuccuauuucacu

SEQ ID NO: 282024 - RNA, 22 nt, Human
uuuucuuuaaucugguggggug

SEQ ID NO: 282025 - RNA, 22 nt, Human
ggaauguuuuucauugcucucu

SEQ ID NO: 282026 - RNA, 22 nt, Human
gcaggcaguuugcuuuucccuc

SEQ ID NO: 282027 - RNA, 22 nt, Human
gugggugugauaagaccaaggg

SEQ ID NO: 282028 - RNA, 18 nt, Human
uuccaugauuccuuucac

SEQ ID NO: 282029 - RNA, 22 nt, Human
ucucaacuuugagaaacauugu

SEQ ID NO: 282030 - RNA, 22 nt, Human
guacacauagguuacugauuaa

SEQ ID NO: 282031 - RNA, 22 nt, Human
acauguguaagaugugauauau

SEQ ID NO: 282032 - RNA, 22 nt, Human
cuguccugaguucuuggagguc

SEQ ID NO: 282033 - RNA, 22 nt, Human
uauguguccuaagcaaucaucc

SEQ ID NO: 282034 - RNA, 22 nt, Human
uaauuucuagggacuaaggugc

SEQ ID NO: 282035 - RNA, 22 nt, Human
auguuacaaauccuacagguag

SEQ ID NO: 282036 - RNA, 22 nt, Human
acuguggcaaaagaacauugga

SEQ ID NO: 282037 - RNA, 22 nt, Human
aauuaacagagggcuuauuacu

SEQ ID NO: 282038 - RNA, 22 nt, Human
agacagacagagaauuuaaaua

SEQ ID NO: 282039 - RNA, 22 nt, Human
acuuguuuggucucauguuuaa

SEQ ID NO: 282040 - RNA, 22 nt, Human
acuuucauuuguaauaaacuuc

SEQ ID NO: 282041 - RNA, 22 nt, Human
aauugcuuuacaagccguuuaa

SEQ ID NO: 282042 - RNA, 22 nt, Human
auguguccugcugugucacaca

SEQ ID NO: 282043 - RNA, 22 nt, Human
aggaggugcuguuuguccugga

SEQ ID NO: 282044 - RNA, 22 nt, Human
ccucuccagcggccucagggcc

SEQ ID NO: 282045 - RNA, 22 nt, Human
auugcugguagucagugucccu

SEQ ID NO: 282046 - RNA, 22 nt, Human
ggagggggacugacacugauuu

SEQ ID NO: 282047 - RNA, 22 nt, Human
aaggugguaauagugcaggauu

SEQ ID NO: 282048 - RNA, 22 nt, Human
aggcaggugcuuaugacuugcu

SEQ ID NO: 282049 - RNA, 22 nt, Human
uuugacuccuuugugaaaagag

SEQ ID NO: 282050 - RNA, 22 nt, Human
uccuagaaucuuuguaagauug

SEQ ID NO: 282051 - RNA, 22 nt, Human
auucuucacauggauaggaucu

SEQ ID NO: 282052 - RNA, 22 nt, Human
gagcuccacuuagcaaggccac

SEQ ID NO: 282053 - RNA, 22 nt, Human
aggaauguaaaucuagauuuua

SEQ ID NO: 282054 - RNA, 22 nt, Human
gaggacagagccgccuggcaag

SEQ ID NO: 282055 - RNA, 22 nt, Human
accuucaagauugugggucaau

SEQ ID NO: 282056 - RNA, 22 nt, Human
uguacuuaugagauccuagucg

SEQ ID NO: 282057 - RNA, 22 nt, Human
ccaggccauucccagaguugcu

SEQ ID NO: 282058 - RNA, 22 nt, Human
uuccaggagccacacaggggcg

SEQ ID NO: 282059 - RNA, 22 nt, Human
uuaguguuagggccuguuaccu

SEQ ID NO: 282060 - RNA, 22 nt, Human
uucacauuucauaccacagcuu

SEQ ID NO: 282061 - RNA, 22 nt, Human
gaaucauuuauuuuugacagca

SEQ ID NO: 282062 - RNA, 22 nt, Human
uuuacagucuauguugaauuaa

SEQ ID NO: 282063 - RNA, 19 nt, Human
uuccuggcucuucuguuuu

SEQ ID NO: 282064 - RNA, 22 nt, Human
cugcaggacgaccgccucaucu

SEQ ID NO: 282065 - RNA, 22 nt, Human
aauucccacuauaugccaagca

SEQ ID NO: 282066 - RNA, 22 nt, Human
caaaagcaaagucccugaaugu

SEQ ID NO: 282067 - RNA, 17 nt, Human
uccaugagacaugaaga

SEQ ID NO: 282068 - RNA, 22 nt, Human
auucacaugauguauguagggc

SEQ ID NO: 282069 - RNA, 22 nt, Human
auuuaaugucgagcuauuguag

SEQ ID NO: 282070 - RNA, 22 nt, Human
cacccccaccugugggcuccug

SEQ ID NO: 282071 - RNA, 22 nt, Human
gacugucuuuugaauaaaaaug

SEQ ID NO: 282072 - RNA, 22 nt, Human
gugaaaaaucaucaugacuuga

SEQ ID NO: 282073 - RNA, 22 nt, Human
gggagggaaagcuugaucuguc

SEQ ID NO: 282074 - RNA, 22 nt, Human
gaacaaauucucaucaacuugu

SEQ ID NO: 282075 - RNA, 22 nt, Human
aggaaugucugagaaagaggca

SEQ ID NO: 282076 - RNA, 22 nt, Human
uguguccucagggaagcagaga

SEQ ID NO: 282077 - RNA, 22 nt, Human
cugugugugucugcagcauacu

SEQ ID NO: 282078 - RNA, 22 nt, Human
aagacagaagugauuugaugug

SEQ ID NO: 282079 - RNA, 22 nt, Human
uuugcaaauaccaugaaacuug

SEQ ID NO: 282080 - RNA, 22 nt, Human
uuuauuggauggauggauggau

SEQ ID NO: 282081 - RNA, 22 nt, Human
cagguaguccacagugagggag

SEQ ID NO: 282082 - RNA, 22 nt, Human
aaauuucuugaggcucucuagc

SEQ ID NO: 282083 - RNA, 18 nt, Human
acuguggcucagaguugc

SEQ ID NO: 282084 - RNA, 22 nt, Human
cugugucccaguaccuugggua

SEQ ID NO: 282085 - RNA, 22 nt, Human
gcugaaaugggcacugaaggcc

SEQ ID NO: 282086 - RNA, 22 nt, Human
gaauuagacaugcuuugcuuuu

SEQ ID NO: 282087 - RNA, 22 nt, Human
ugaggugguuuguaucacuggg

SEQ ID NO: 282088 - RNA, 22 nt, Human
uacaagcuuuuguguauaaaug

SEQ ID NO: 282089 - RNA, 22 nt, Human
gaggcugguaggaaaggaaaca

SEQ ID NO: 282090 - RNA, 22 nt, Human
augagagguuucgucagaggaa

SEQ ID NO: 282091 - RNA, 22 nt, Human
aguucgagaucugcugaugaga

SEQ ID NO: 282092 - RNA, 22 nt, Human
augauucuggcaaauuuauuau

SEQ ID NO: 282093 - RNA, 22 nt, Human
uccaggaggugaggggaccaaa

SEQ ID NO: 282094 - RNA, 22 nt, Human
uuaagcauaauuaaagugaaau

SEQ ID NO: 282095 - RNA, 17 nt, Human
ugggguccccgauggug

SEQ ID NO: 282096 - RNA, 22 nt, Human
caguguuuguauagaauaugca

SEQ ID NO: 282097 - RNA, 22 nt, Human
ggagcccucaccggcgagugcc

SEQ ID NO: 282098 - RNA, 22 nt, Human
uggcagugucuuaucaggagug

SEQ ID NO: 282099 - RNA, 22 nt, Human
ggcaggugcugggagcaucuca

SEQ ID NO: 282100 - RNA, 20 nt, Human
accagagcucucaguaugug

SEQ ID NO: 282101 - RNA, 22 nt, Human
cauucacauucuucuuacuguu

SEQ ID NO: 282102 - RNA, 22 nt, Human
cucccuggugacucccaaagcu

SEQ ID NO: 282103 - RNA, 22 nt, Human
agaucugaguggcugcauguaa

SEQ ID NO: 282104 - RNA, 22 nt, Human
ccugagagccagugccugccca

SEQ ID NO: 282105 - RNA, 22 nt, Human
ugucaacugugaugucaacacu

SEQ ID NO: 282106 - RNA, 22 nt, Human
auuugcuuucagguauaaaagg

SEQ ID NO: 282107 - RNA, 22 nt, Human
aggaccuguaccucagcaucua

SEQ ID NO: 282108 - RNA, 22 nt, Human
ucacauucuuuauuugccaucc

SEQ ID NO: 282109 - RNA, 19 nt, Human
ucagugucccuguuaauau

SEQ ID NO: 282110 - RNA, 22 nt, Human
aggugggguguuggauguuuau

SEQ ID NO: 282111 - RNA, 22 nt, Human
gccuggcacaguagggacccaa

SEQ ID NO: 282112 - RNA, 22 nt, Human
augguacauaguuuaaauaagg

SEQ ID NO: 282113 - RNA, 22 nt, Human
cuggaaauuggagaugauguuu

SEQ ID NO: 282114 - RNA, 22 nt, Human
uaacaagucauuuuaaauuaug

SEQ ID NO: 282115 - RNA, 22 nt, Human
aguuuacauauuugucggaguc

SEQ ID NO: 282116 - RNA, 22 nt, Human
aaggccuccgccaauggcagag

SEQ ID NO: 282117 - RNA, 22 nt, Human
uccuggauuaauagggagcugu

SEQ ID NO: 282118 - RNA, 22 nt, Human
ccugagccugcagccgagcaga

SEQ ID NO: 282119 - RNA, 22 nt, Human
gccuccugacuuacacugagcu

SEQ ID NO: 282120 - RNA, 22 nt, Human
uccuggcccaaucugcccauga

SEQ ID NO: 282121 - RNA, 22 nt, Human
gggauugaauugggggaucaca

SEQ ID NO: 282122 - RNA, 22 nt, Human
agaaugcaagauaaacuuuauu

SEQ ID NO: 282123 - RNA, 22 nt, Human
aucuuagagagucguguuuugu

SEQ ID NO: 282124 - RNA, 22 nt, Human
agauaaugucaaauucugucug

SEQ ID NO: 282125 - RNA, 22 nt, Human
ucuggcagaaggcagaaauuca

SEQ ID NO: 282126 - RNA, 22 nt, Human
auccuggcccucaugaccccuu

SEQ ID NO: 282127 - RNA, 22 nt, Human
uucuucagucccacuagccaca

SEQ ID NO: 282128 - RNA, 22 nt, Human
uaggaaauacuguaaguuuggg

SEQ ID NO: 282129 - RNA, 23 nt, Human
ggagaggggugugggcaucuuua

SEQ ID NO: 282130 - RNA, 22 nt, Human
augacaagggaggguccugcua

SEQ ID NO: 282131 - RNA, 21 nt, Human
uggacauuauggagagaguag

SEQ ID NO: 282132 - RNA, 22 nt, Human
guucuucagauuccauuucagu

SEQ ID NO: 282133 - RNA, 22 nt, Human
uugaaaucaccacuagcauuug

SEQ ID NO: 282134 - RNA, 22 nt, Human
acugaaauauuuagaagugaag

SEQ ID NO: 282135 - RNA, 22 nt, Human
ugacagacuuuacuucuccuau

SEQ ID NO: 282136 - RNA, 22 nt, Human
ggaaaacaagagaaugauguuu

SEQ ID NO: 282137 - RNA, 22 nt, Human
augguacaaaauguauaaaguc

SEQ ID NO: 282138 - RNA, 22 nt, Human
aggccaggaauccuugucccag

SEQ ID NO: 282139 - RNA, 22 nt, Human
agaacagaggccuuauguuuca

SEQ ID NO: 282140 - RNA, 20 nt, Human
cugaagaguggccugaucug

SEQ ID NO: 282141 - RNA, 22 nt, Human
ugcagggcagcuagggagcuuu

SEQ ID NO: 282142 - RNA, 21 nt, Human
ucugggcccaugcugccucac

SEQ ID NO: 282143 - RNA, 22 nt, Human
cagagacuggagugcaguggcg

SEQ ID NO: 282144 - RNA, 21 nt, Human
ucuguggcggacucuaggccc

SEQ ID NO: 282145 - RNA, 22 nt, Human
gugaggugccuaauaccgugac

SEQ ID NO: 282146 - RNA, 22 nt, Human
gcuguggcaauguuuauaauua

SEQ ID NO: 282147 - RNA, 22 nt, Human
gcccaguuucagcucugccuuu

SEQ ID NO: 282148 - RNA, 22 nt, Human
uaauuacagguccaaaacaauc

SEQ ID NO: 282149 - RNA, 22 nt, Human
uggagcaggaagucuauggcug

SEQ ID NO: 282150 - RNA, 22 nt, Human
ccuuccucauccauuucucuug

SEQ ID NO: 282151 - RNA, 22 nt, Human
cagaggcauacucccagucuug

SEQ ID NO: 282152 - RNA, 22 nt, Human
cuccaguggcaaguccgggcgg

SEQ ID NO: 282153 - RNA, 22 nt, Human
uccugcagcucugagaagcauc

SEQ ID NO: 282154 - RNA, 23 nt, Human
auguuuuaugucucuagcugcca

SEQ ID NO: 282155 - RNA, 22 nt, Human
cauucauuuacuuucaacagcu

SEQ ID NO: 282156 - RNA, 22 nt, Human
gaaaauguuagcuucauaguca

SEQ ID NO: 282157 - RNA, 23 nt, Human
auaaauuacuaucucccuagagc

SEQ ID NO: 282158 - RNA, 22 nt, Human
caagcagguuugcuauuuucuu

SEQ ID NO: 282159 - RNA, 22 nt, Human
gaggugucugcuguguucaaag

SEQ ID NO: 282160 - RNA, 14 nt, Human
gcaggcagaucacc

SEQ ID NO: 282161 - RNA, 22 nt, Human
ucuugcacuucaugaauauguu

SEQ ID NO: 282162 - RNA, 22 nt, Human
uugugagaugauuugaaagugu

SEQ ID NO: 282163 - RNA, 22 nt, Human
aaacuuucauguaucucuuuca

SEQ ID NO: 282164 - RNA, 21 nt, Human
cugcaucugagucauuaugcc

SEQ ID NO: 282165 - RNA, 22 nt, Human
uucccucuccuacucaggaaag

SEQ ID NO: 282166 - RNA, 22 nt, Human
ggaggacaggggcugcagcaca

SEQ ID NO: 282167 - RNA, 22 nt, Human
gaaaguuuauagguuauauaau

SEQ ID NO: 282168 - RNA, 22 nt, Human
ucucugcagcuaagaaauuaau

SEQ ID NO: 282169 - RNA, 22 nt, Human
cagggaugcuguuaaacauccu

SEQ ID NO: 282170 - RNA, 22 nt, Human
uauauguagucagucagaguaa

SEQ ID NO: 282171 - RNA, 22 nt, Human
uucucagaaaauguagagaaaa

SEQ ID NO: 282172 - RNA, 22 nt, Human
guuagaauaaaaggucagagag

SEQ ID NO: 282173 - RNA, 22 nt, Human
gcuggcagaauuucuucuugcu

SEQ ID NO: 282174 - RNA, 22 nt, Human
ucccagggucaguggugaggcc

SEQ ID NO: 282175 - RNA, 22 nt, Human
ugcaggugagugcaggggcuca

SEQ ID NO: 282176 - RNA, 22 nt, Human
caaagcuggaaaaggaggcugg

SEQ ID NO: 282177 - RNA, 22 nt, Human
caauuucaugccauguauugcu

SEQ ID NO: 282178 - RNA, 20 nt, Human
auuugggacgauuggccacc

SEQ ID NO: 282179 - RNA, 22 nt, Human
ugagccaggcucaagugauccu

SEQ ID NO: 282180 - RNA, 22 nt, Human
cacaagauggucacauaagugc

SEQ ID NO: 282181 - RNA, 22 nt, Human
uggaggcaacugaagauguagu

SEQ ID NO: 282182 - RNA, 22 nt, Human
cugaaauuauuguuuaaucaaa

SEQ ID NO: 282183 - RNA, 22 nt, Human
ggcaggcacugugauagauucu

SEQ ID NO: 282184 - RNA, 22 nt, Human
uagagaauggccuugaaguagu

SEQ ID NO: 282185 - RNA, 22 nt, Human
gugcugugcgcuuuuucuguau

SEQ ID NO: 282186 - RNA, 22 nt, Human
ggcagacuguaauaggagaauu

SEQ ID NO: 282187 - RNA, 22 nt, Human
ccacguguagguggacaggauc

SEQ ID NO: 282188 - RNA, 22 nt, Human
agaauucugacaauagaauugg

SEQ ID NO: 282189 - RNA, 22 nt, Human
uccucagucacgguagcacauu

SEQ ID NO: 282190 - RNA, 22 nt, Human
accucaagaauguauaacacag

SEQ ID NO: 282191 - RNA, 22 nt, Human
cucugcugcuuugccaguggaa

SEQ ID NO: 282192 - RNA, 22 nt, Human
agcuaggacagguagagauggg

SEQ ID NO: 282193 - RNA, 22 nt, Human
ccagggcauccucacaucgcag

SEQ ID NO: 282194 - RNA, 22 nt, Human
acaucuggaaaguuacuugaga

SEQ ID NO: 282195 - RNA, 22 nt, Human
ccagguggacaaggcuuucaca

SEQ ID NO: 282196 - RNA, 22 nt, Human
uuuuggaauuuauacaguaaug

SEQ ID NO: 282197 - RNA, 22 nt, Human
auggccugcagugcugccacag

SEQ ID NO: 282198 - RNA, 22 nt, Human
ucuggcagagucagugcacaca

SEQ ID NO: 282199 - RNA, 22 nt, Human
aggcuugggacugcuuaggagc

SEQ ID NO: 282200 - RNA, 18 nt, Human
uuauuggugcugcuguuc

SEQ ID NO: 282201 - RNA, 22 nt, Human
cucuggccugcuuccucaggua

SEQ ID NO: 282202 - RNA, 22 nt, Human
agacacagugcugggugcugag

SEQ ID NO: 282203 - RNA, 22 nt, Human
cugcagggcagaagggcauaga

SEQ ID NO: 282204 - RNA, 22 nt, Human
acacagauauuuugaauacaua

SEQ ID NO: 282205 - RNA, 22 nt, Human
uucaacaaguaguacacacagu

SEQ ID NO: 282206 - RNA, 18 nt, Human
cugaaggauccaggugua

SEQ ID NO: 282207 - RNA, 20 nt, Human
auuagcucaggugaggucau

SEQ ID NO: 282208 - RNA, 22 nt, Human
aauucuagcauugugaaaauau

SEQ ID NO: 282209 - RNA, 22 nt, Human
auuugguuacucaguugucuga

SEQ ID NO: 282210 - RNA, 22 nt, Human
ucagugucauaucaagaagaug

SEQ ID NO: 282211 - RNA, 22 nt, Human
gccuguuugagaauagucaggg

SEQ ID NO: 282212 - RNA, 22 nt, Human
gagucuaaguagaaugugaaaa

SEQ ID NO: 282213 - RNA, 22 nt, Human
uggcagggugccaguugcgagu

SEQ ID NO: 282214 - RNA, 22 nt, Human
ucaguucuuuauuucacaguga

SEQ ID NO: 282215 - RNA, 22 nt, Human
ccugagagagaagcgaccuggu

SEQ ID NO: 282216 - RNA, 22 nt, Human
uuaaaauagccagugccccucu

SEQ ID NO: 282217 - RNA, 22 nt, Human
uccaugaguuugaggaaaagag

SEQ ID NO: 282218 - RNA, 22 nt, Human
accaggcagucaccguccagga

SEQ ID NO: 282219 - RNA, 22 nt, Human
uuauuaggaaaaggucagaugu

SEQ ID NO: 282220 - RNA, 22 nt, Human
guggaggagaggcgccuugcgg

SEQ ID NO: 282221 - RNA, 22 nt, Human
cacauaaucaccaaguccuuuc

SEQ ID NO: 282222 - RNA, 21 nt, Human
cagacaugagucucagcuuug

SEQ ID NO: 282223 - RNA, 22 nt, Human
uugguacaugcagauauuuagu

SEQ ID NO: 282224 - RNA, 22 nt, Human
auaaaaggaaagccuguuguga

SEQ ID NO: 282225 - RNA, 22 nt, Human
gagguguccuagaaguauucag

SEQ ID NO: 282226 - RNA, 22 nt, Human
gagcucagguggucaaaacaau

SEQ ID NO: 282227 - RNA, 22 nt, Human
augcuuuauuauuuugcaggga

SEQ ID NO: 282228 - RNA, 22 nt, Human
gaaagauauuuauuggcaacag

SEQ ID NO: 282229 - RNA, 22 nt, Human
gaauaauauugacuuugcaggc

SEQ ID NO: 282230 - RNA, 19 nt, Human
ucucuggggacacuuucac

SEQ ID NO: 282231 - RNA, 22 nt, Human
agggaagaaaauccaucgcugc

SEQ ID NO: 282232 - RNA, 22 nt, Human
gcugucuucacuuccugguuuc

SEQ ID NO: 282233 - RNA, 22 nt, Human
acacaaguucuaaagauugcgc

SEQ ID NO: 282234 - RNA, 22 nt, Human
acagggcaccugagguaggaag

SEQ ID NO: 282235 - RNA, 22 nt, Human
ggcagguggacgugcuaaagcu

SEQ ID NO: 282236 - RNA, 22 nt, Human
gucuuuaugguaugaaaacuga

SEQ ID NO: 282237 - RNA, 22 nt, Human
agaaggaguguacaggucaugc

SEQ ID NO: 282238 - RNA, 22 nt, Human
ggaagugaggaaauauuuuguu

SEQ ID NO: 282239 - RNA, 22 nt, Human
gacuuuaugaagagaugaccaa

SEQ ID NO: 282240 - RNA, 22 nt, Human
uuucuuuaauucucacagcaau

SEQ ID NO: 282241 - RNA, 22 nt, Human
aaagccuucuucggucugugau

SEQ ID NO: 282242 - RNA, 22 nt, Human
uaacacauagauauuuuaacuu

SEQ ID NO: 282243 - RNA, 22 nt, Human
uagagcuagcuucaaaaugcga

SEQ ID NO: 282244 - RNA, 22 nt, Human
ccagggcaugggaagaacugaa

SEQ ID NO: 282245 - RNA, 22 nt, Human
cagacagguagggacagaacau

SEQ ID NO: 282246 - RNA, 18 nt, Human
ucaaaauauuucugugga

SEQ ID NO: 282247 - RNA, 22 nt, Human
ucuguuuaaugggaaugauacu

SEQ ID NO: 282248 - RNA, 22 nt, Human
auccaugaagguacuucucagg

SEQ ID NO: 282249 - RNA, 22 nt, Human
uacaguuauaugugauaaguaa

SEQ ID NO: 282250 - RNA, 22 nt, Human
uacuuuauauuguggcuggcca

SEQ ID NO: 282251 - RNA, 22 nt, Human
gacuuuaaaaguuugugcuugg

SEQ ID NO: 282252 - RNA, 22 nt, Human
agggaagaggaccagagucucu

SEQ ID NO: 282253 - RNA, 22 nt, Human
aggcucaguauagcuggcaagu

SEQ ID NO: 282254 - RNA, 21 nt, Human
caguguggugaccagggucuc

SEQ ID NO: 282255 - RNA, 22 nt, Human
gcugcucucauagauggcuuca

SEQ ID NO: 282256 - RNA, 22 nt, Human
gguuuauuaaugugaacuguau

SEQ ID NO: 282257 - RNA, 22 nt, Human
ucaagaaagggcuucaccagga

SEQ ID NO: 282258 - RNA, 22 nt, Human
agcagggcuuugcagacuuggg

SEQ ID NO: 282259 - RNA, 22 nt, Human
gccaggcagccacccucugcga

SEQ ID NO: 282260 - RNA, 22 nt, Human
agcauacaggucugaaacagcu

SEQ ID NO: 282261 - RNA, 22 nt, Human
ucaauaaauagcuuggcucagc

SEQ ID NO: 282262 - RNA, 23 nt, Human
aguuucuuugagacuugcccugu

SEQ ID NO: 282263 - RNA, 22 nt, Human
aguggcaaagucuucagaaguu

SEQ ID NO: 282264 - RNA, 22 nt, Human
aggggagaauuucaacucaggu

SEQ ID NO: 282265 - RNA, 22 nt, Human
gcauggcuucugccaggcaccu

SEQ ID NO: 282266 - RNA, 22 nt, Human
uuguguuucuggccaagaugga

SEQ ID NO: 282267 - RNA, 23 nt, Human
uuucaacuccugccauuauuucu

SEQ ID NO: 282268 - RNA, 22 nt, Human
uucucugagauagacuaagugg

SEQ ID NO: 282269 - RNA, 22 nt, Human
uacauucccccaauuaccaaug

SEQ ID NO: 282270 - RNA, 22 nt, Human
aaaguucuaaaacucuuuguga

SEQ ID NO: 282271 - RNA, 22 nt, Human
guaaacauuacugugcuguaua

SEQ ID NO: 282272 - RNA, 22 nt, Human
ccagcccuuagauaaaccuggc

SEQ ID NO: 282273 - RNA, 22 nt, Human
ucagguggcugguugcuggcua

SEQ ID NO: 282274 - RNA, 22 nt, Human
caacauuugaguaaagaaaugg

SEQ ID NO: 282275 - RNA, 22 nt, Human
auccuggcgccacacggcucua

SEQ ID NO: 282276 - RNA, 22 nt, Human
uuugaaaauuagacacaggcua

SEQ ID NO: 282277 - RNA, 22 nt, Human
ugccuccaccauugcucacuuu

SEQ ID NO: 282278 - RNA, 22 nt, Human
augauauuuuaguaaagugaua

SEQ ID NO: 282279 - RNA, 22 nt, Human
ccagguggaaggucugugcucu

SEQ ID NO: 282280 - RNA, 22 nt, Human
uagggcucugagaguucagccu

SEQ ID NO: 282281 - RNA, 22 nt, Human
ugggccaguccagccccaggga

SEQ ID NO: 282282 - RNA, 22 nt, Human
ugggcuccguugccuggggcag

SEQ ID NO: 282283 - RNA, 22 nt, Human
uauuuccaaaagccuauuauga

SEQ ID NO: 282284 - RNA, 22 nt, Human
uuucgucaauuguaacaaaugu

SEQ ID NO: 282285 - RNA, 22 nt, Human
gcuccuggcauccugcuuuuaa

SEQ ID NO: 282286 - RNA, 22 nt, Human
gcagagaaggauugaaaccaga

SEQ ID NO: 282287 - RNA, 22 nt, Human
cugcccacaguucucugccaug

SEQ ID NO: 282288 - RNA, 22 nt, Human
cucuuccucucaugcggucaua

SEQ ID NO: 282289 - RNA, 22 nt, Human
agauaauuauuuacuucaaagu

SEQ ID NO: 282290 - RNA, 22 nt, Human
agagagcauggcacagaggggu

SEQ ID NO: 282291 - RNA, 22 nt, Human
uaaggcacccuucugaguagag

SEQ ID NO: 282292 - RNA, 22 nt, Human
ggcucuggugggaagguuagau

SEQ ID NO: 282293 - RNA, 22 nt, Human
uccacacacauuucuaugugca

SEQ ID NO: 282294 - RNA, 22 nt, Human
uacagacauucaauuuugaccc

SEQ ID NO: 282295 - RNA, 22 nt, Human
cucuucuuggcccccaugaggg

SEQ ID NO: 282296 - RNA, 22 nt, Human
gcuggccuugugucugaggaag

SEQ ID NO: 282297 - RNA, 22 nt, Human
ggcacagaguuggcagagcugc

SEQ ID NO: 282298 - RNA, 22 nt, Human
aacuugguaaauugugucagau

SEQ ID NO: 282299 - RNA, 22 nt, Human
ugaagcuuuaggauggguucau

SEQ ID NO: 282300 - RNA, 22 nt, Human
acagucauuagauacaaugucu

SEQ ID NO: 282301 - RNA, 22 nt, Human
ugagaugcaggagaugggacug

SEQ ID NO: 282302 - RNA, 22 nt, Human
caaauucacaugauugcuucug

SEQ ID NO: 282303 - RNA, 22 nt, Human
ugaaagcaggcgggcuacuuua

SEQ ID NO: 282304 - RNA, 22 nt, Human
gcaggggcuaaggacacagaga

SEQ ID NO: 282305 - RNA, 22 nt, Human
ucagucuucccuccagugcaac

SEQ ID NO: 282306 - RNA, 22 nt, Human
cagguggcuucucccuaggcca

SEQ ID NO: 282307 - RNA, 22 nt, Human
acugagaacucaagagaaaagg

SEQ ID NO: 282308 - RNA, 22 nt, Human
uucugagcugcaacacuaacau

SEQ ID NO: 282309 - RNA, 22 nt, Human
ccagcuuuucagaaucugccug

SEQ ID NO: 282310 - RNA, 22 nt, Human
auuugaaguaaguaaugaguau

SEQ ID NO: 282311 - RNA, 22 nt, Human
cauaaaagccaccuauuuaaag

SEQ ID NO: 282312 - RNA, 22 nt, Human
caggaguccaucuggccuggug

SEQ ID NO: 282313 - RNA, 22 nt, Human
uucugcuuagagggcauuugca

SEQ ID NO: 282314 - RNA, 22 nt, Human
agggagacacaugaggaaguca

SEQ ID NO: 282315 - RNA, 22 nt, Human
ucaggugguccuaagugccauc

SEQ ID NO: 282316 - RNA, 22 nt, Human
ccucuuccugcacugacauuuu

SEQ ID NO: 282317 - RNA, 22 nt, Human
cuagagaaucuuuuaagaagug

SEQ ID NO: 282318 - RNA, 22 nt, Human
agaguacugccucaguuaugaa

SEQ ID NO: 282319 - RNA, 20 nt, Human
ucagggcaugggacagcccc

SEQ ID NO: 282320 - RNA, 20 nt, Human
ccagcucugugguuagauac

SEQ ID NO: 282321 - RNA, 22 nt, Human
aagagcuggauggaaucuggga

SEQ ID NO: 282322 - RNA, 22 nt, Human
uucugugauuccuccagccagc

SEQ ID NO: 282323 - RNA, 22 nt, Human
agcaaacaguuucuggggaucu

SEQ ID NO: 282324 - RNA, 18 nt, Human
ggacaucaucaggugcuu

SEQ ID NO: 282325 - RNA, 22 nt, Human
uugaggagaagacuuugcuucc

SEQ ID NO: 282326 - RNA, 22 nt, Human
acaaggaggauauguuuaaggg

SEQ ID NO: 282327 - RNA, 22 nt, Human
gucucuaucauagcugaacccu

SEQ ID NO: 282328 - RNA, 22 nt, Human
cuguauuucuuggacaguugcu

SEQ ID NO: 282329 - RNA, 22 nt, Human
guacccagaggcaugaucccag

SEQ ID NO: 282330 - RNA, 18 nt, Human
gcagcuuuugauucaccc

SEQ ID NO: 282331 - RNA, 22 nt, Human
cuggguguagcccaguaugagg

SEQ ID NO: 282332 - RNA, 21 nt, Human
ccuuuacaauuuugcauuccu

SEQ ID NO: 282333 - RNA, 19 nt, Human
accaggcuuauggucagug

SEQ ID NO: 282334 - RNA, 22 nt, Human
aagaaucauuguaaaguucugu

SEQ ID NO: 282335 - RNA, 22 nt, Human
gacagacaggaggcauucaggg

SEQ ID NO: 282336 - RNA, 23 nt, Human
ucuccaggccuuacuccaggccu

SEQ ID NO: 282337 - RNA, 22 nt, Human
uuuuacagucagucaaacucag

SEQ ID NO: 282338 - RNA, 22 nt, Human
ccagguggcccugcccuacucu

SEQ ID NO: 282339 - RNA, 22 nt, Human
aaagugguuuuucagacuuuga

SEQ ID NO: 282340 - RNA, 22 nt, Human
aaggcagaggaaggucuaguuu

SEQ ID NO: 282341 - RNA, 22 nt, Human
gaggagcugggacccugucauc

SEQ ID NO: 282342 - RNA, 22 nt, Human
ucagguguagguuguucaguuu

SEQ ID NO: 282343 - RNA, 22 nt, Human
uucuucaaauagcagggaguca

SEQ ID NO: 282344 - RNA, 22 nt, Human
uguuccugaggcaugugucaau

SEQ ID NO: 282345 - RNA, 22 nt, Human
guuuauuggguauuguggagcc

SEQ ID NO: 282346 - RNA, 22 nt, Human
uuauuccauagaagucaaggaa

SEQ ID NO: 282347 - RNA, 22 nt, Human
uaggauuuuuuggauucuggau

SEQ ID NO: 282348 - RNA, 22 nt, Human
agucucagcaagcauggcuagu

SEQ ID NO: 282349 - RNA, 17 nt, Human
acagggcagaaacagcu

SEQ ID NO: 282350 - RNA, 22 nt, Human
aaauguguguauguacauauau

SEQ ID NO: 282351 - RNA, 22 nt, Human
uuuuaauugcaauuaugguccc

SEQ ID NO: 282352 - RNA, 22 nt, Human
ucacuggcaacuugugcucccu

SEQ ID NO: 282353 - RNA, 22 nt, Human
ucaguuaacggaaaggggugug

SEQ ID NO: 282354 - RNA, 22 nt, Human
ggcugcaagacaagguugguuu

SEQ ID NO: 282355 - RNA, 22 nt, Human
ccaaggaggccccaggucagcu

SEQ ID NO: 282356 - RNA, 22 nt, Human
ggcuugaucacauaggucuccc

SEQ ID NO: 282357 - RNA, 22 nt, Human
cucuguguucagccuagcagaa

SEQ ID NO: 282358 - RNA, 22 nt, Human
auagacaacacuuauuauuccu

SEQ ID NO: 282359 - RNA, 22 nt, Human
ccaaaugugccuguuucaacaa

SEQ ID NO: 282360 - RNA, 22 nt, Human
caagggcucuaagucacaagau

SEQ ID NO: 282361 - RNA, 22 nt, Human
uucauuuuuaccgcgugucaaa

SEQ ID NO: 282362 - RNA, 22 nt, Human
ggagucugcucccagacaugau

SEQ ID NO: 282363 - RNA, 22 nt, Human
acauauaagggaucagugacag

SEQ ID NO: 282364 - RNA, 22 nt, Human
cuggcccagagagcagagcuua

SEQ ID NO: 282365 - RNA, 22 nt, Human
acaauguuuuuguucaaagagu

SEQ ID NO: 282366 - RNA, 22 nt, Human
aaaacuaaauacgcuuugccuc

SEQ ID NO: 282367 - RNA, 21 nt, Human
aagcuuccaaacugcuggacu

SEQ ID NO: 282368 - RNA, 22 nt, Human
uuuccucuuugugacacagcug

SEQ ID NO: 282369 - RNA, 22 nt, Human
gucuucuuuaaccuacuaaagc

SEQ ID NO: 282370 - RNA, 22 nt, Human
augguacagauaauacaugcug

SEQ ID NO: 282371 - RNA, 22 nt, Human
ugcacacacucugcauauacuu

SEQ ID NO: 282372 - RNA, 22 nt, Human
uaaagcuguucagugcagaaag

SEQ ID NO: 282373 - RNA, 15 nt, Human
ggcagguggaucacu

SEQ ID NO: 282374 - RNA, 20 nt, Human
ucugucucugagcuagacuu

SEQ ID NO: 282375 - RNA, 22 nt, Human
cauaauuuuuuuaagucagaac

SEQ ID NO: 282376 - RNA, 22 nt, Human
gagucaggaugcaaggggaugg

SEQ ID NO: 282377 - RNA, 22 nt, Human
uggcagguggcacagccuggga

SEQ ID NO: 282378 - RNA, 22 nt, Human
ccagagcaauucucacagaacu

SEQ ID NO: 282379 - RNA, 22 nt, Human
uauuucuuucagguauguguug

SEQ ID NO: 282380 - RNA, 22 nt, Human
aucugaagaggucauggcugac

SEQ ID NO: 282381 - RNA, 23 nt, Human
uugaggagcagcgcuuuuuaccg

SEQ ID NO: 282382 - RNA, 22 nt, Human
agcagcaaguguaacugaauau

SEQ ID NO: 282383 - RNA, 22 nt, Human
cagggauggcugucaggaugua

SEQ ID NO: 282384 - RNA, 22 nt, Human
uccugucugcucacagagcugg

SEQ ID NO: 282385 - RNA, 22 nt, Human
cucuccagccuuuagcccacgc

SEQ ID NO: 282386 - RNA, 22 nt, Human
guaagccuggaauuuuugacuu

SEQ ID NO: 282387 - RNA, 22 nt, Human
uuugucauaucacacaauuuug

SEQ ID NO: 282388 - RNA, 22 nt, Human
gaggugucaggguagucaugau

SEQ ID NO: 282389 - RNA, 22 nt, Human
augugucuuugagacucugcua

SEQ ID NO: 282390 - RNA, 22 nt, Human
cucaggagguuuccugucuagg

SEQ ID NO: 282391 - RNA, 22 nt, Human
ccaugccccaccaggacgcugc

SEQ ID NO: 282392 - RNA, 22 nt, Human
augccaggccccacgcugggca

SEQ ID NO: 282393 - RNA, 22 nt, Human
uccuucaacuuuuuacuugccc

SEQ ID NO: 282394 - RNA, 23 nt, Human
ucugccagugugugccaggagcc

SEQ ID NO: 282395 - RNA, 22 nt, Human
ucuccucccaggcucuuccagg

SEQ ID NO: 282396 - RNA, 22 nt, Human
gaaggggaguggcuagugugug

SEQ ID NO: 282397 - RNA, 22 nt, Human
gugcaguguguaauccaggaac

SEQ ID NO: 282398 - RNA, 22 nt, Human
cgguggucauaaguggcuggcg

SEQ ID NO: 282399 - RNA, 22 nt, Human
agauguuuguguuaucuccauu

SEQ ID NO: 282400 - RNA, 22 nt, Human
uucuguuuauaauuugcaguug

SEQ ID NO: 282401 - RNA, 22 nt, Human
ccaggugugguggcauacaccu

SEQ ID NO: 282402 - RNA, 22 nt, Human
gugcagggagcccagaaggucc

SEQ ID NO: 282403 - RNA, 22 nt, Human
ucccagaggucucugcugguuc

SEQ ID NO: 282404 - RNA, 22 nt, Human
uguguccugugcaaggggauga

SEQ ID NO: 282405 - RNA, 22 nt, Human
uuugacucugggugcuuuuucg

SEQ ID NO: 282406 - RNA, 22 nt, Human
cugcaucugcauaaucaacuuc

SEQ ID NO: 282407 - RNA, 22 nt, Human
uccaaggagcagauccagagga

SEQ ID NO: 282408 - RNA, 22 nt, Human
caugcucacuuuuauacuguaa

SEQ ID NO: 282409 - RNA, 17 nt, Human
ggaggcaacagacaggg

SEQ ID NO: 282410 - RNA, 22 nt, Human
agucugucagucauucuaacaa

SEQ ID NO: 282411 - RNA, 22 nt, Human
cacugucuguguguccuugggg

SEQ ID NO: 282412 - RNA, 22 nt, Human
cuuuacuucucaaaauaaagca

SEQ ID NO: 282413 - RNA, 22 nt, Human
auucuucacuguuucagaauga

SEQ ID NO: 282414 - RNA, 22 nt, Human
agcagguggucuguugcugcug

SEQ ID NO: 282415 - RNA, 22 nt, Human
gugggggacccaggugcugucc

SEQ ID NO: 282416 - RNA, 18 nt, Human
aaaggcugaauauagaag

SEQ ID NO: 282417 - RNA, 22 nt, Human
gcauggcucuggccucagugug

SEQ ID NO: 282418 - RNA, 22 nt, Human
ugggugugcccagauggugucc

SEQ ID NO: 282419 - RNA, 22 nt, Human
ucugaaaucuaaugcucugugg

SEQ ID NO: 282420 - RNA, 22 nt, Human
cuccaggcuggauccaagucaa

SEQ ID NO: 282421 - RNA, 22 nt, Human
accugagacuugggaugggaau

SEQ ID NO: 282422 - RNA, 22 nt, Human
ccauucauacaauuuuguucua

SEQ ID NO: 282423 - RNA, 22 nt, Human
cauucggagguaguugagguua

SEQ ID NO: 282424 - RNA, 22 nt, Human
uauuuaaaaagaggccagcugg

SEQ ID NO: 282425 - RNA, 22 nt, Human
uuugcuuuugugcucuaguggu

SEQ ID NO: 282426 - RNA, 22 nt, Human
gcugagguggcugccuuaguaa

SEQ ID NO: 282427 - RNA, 22 nt, Human
gagauggccagugccaggacaa

SEQ ID NO: 282428 - RNA, 22 nt, Human
gggaccugggccagaggacagu

SEQ ID NO: 282429 - RNA, 22 nt, Human
aaucugaauauuuauguguauu

SEQ ID NO: 282430 - RNA, 22 nt, Human
cacagcauuaacugggacagcu

SEQ ID NO: 282431 - RNA, 22 nt, Human
cuuuuucuucuaggugugccug

SEQ ID NO: 282432 - RNA, 22 nt, Human
cuccucagcugggaggaguccc

SEQ ID NO: 282433 - RNA, 22 nt, Human
ucacauucauggugcuaauaaa

SEQ ID NO: 282434 - RNA, 22 nt, Human
aacauucuauuuugcuaaaaca

SEQ ID NO: 282435 - RNA, 22 nt, Human
gaggccuggguuggaggugcau

SEQ ID NO: 282436 - RNA, 22 nt, Human
ucuguuucuucuucuguuauau

SEQ ID NO: 282437 - RNA, 22 nt, Human
uggugcagacaggagccccgcu

SEQ ID NO: 282438 - RNA, 18 nt, Human
ugaacagaugaguugaag

SEQ ID NO: 282439 - RNA, 22 nt, Human
agcugcaaccuuagcuauaggc

SEQ ID NO: 282440 - RNA, 22 nt, Human
ucaguguuuguggcaaauguua

SEQ ID NO: 282441 - RNA, 22 nt, Human
acauuucaguaaguguuaauuu

SEQ ID NO: 282442 - RNA, 22 nt, Human
ugggguccagugccuggcaagg

SEQ ID NO: 282443 - RNA, 21 nt, Human
uccuugcuauuuuccucagcu

SEQ ID NO: 282444 - RNA, 22 nt, Human
ggcaggcaggagcucugucucc

SEQ ID NO: 282445 - RNA, 22 nt, Human
cagagcugauuggauccagaga

SEQ ID NO: 282446 - RNA, 22 nt, Human
ccucuuccagcuguugcuucca

SEQ ID NO: 282447 - RNA, 22 nt, Human
uucuuuucuuggcaggaguaga

SEQ ID NO: 282448 - RNA, 22 nt, Human
guaagccugagaaacaccaccu

SEQ ID NO: 282449 - RNA, 22 nt, Human
cuggaggaccccugccuggaag

SEQ ID NO: 282450 - RNA, 22 nt, Human
ggcaggugcuugucgaaggccu

SEQ ID NO: 282451 - RNA, 22 nt, Human
ucccagagacagagccuccucc

SEQ ID NO: 282452 - RNA, 22 nt, Human
guuuuuaucuaauagcaguuau

SEQ ID NO: 282453 - RNA, 22 nt, Human
gccaggcacaguucuaggugcu

SEQ ID NO: 282454 - RNA, 22 nt, Human
agagccaggccaggccggggca

SEQ ID NO: 282455 - RNA, 22 nt, Human
caguagacacauuaauauggaa

SEQ ID NO: 282456 - RNA, 22 nt, Human
gaggcaggcacuguuaucagca

SEQ ID NO: 282457 - RNA, 22 nt, Human
ggggcugagucagugggaagag

SEQ ID NO: 282458 - RNA, 22 nt, Human
acuguaaaauacauaaguauug

SEQ ID NO: 282459 - RNA, 22 nt, Human
ugccuucacugagcuuauggga

SEQ ID NO: 282460 - RNA, 22 nt, Human
aggaauguaacaggaguaaaaa

SEQ ID NO: 282461 - RNA, 23 nt, Human
uuguccugccgaucucugagaau

SEQ ID NO: 282462 - RNA, 22 nt, Human
uacaugagggcacucugcaucu

SEQ ID NO: 282463 - RNA, 22 nt, Human
gaggagcucugcuccauccuuc

SEQ ID NO: 282464 - RNA, 22 nt, Human
cuggguguagauggaaguuugg

SEQ ID NO: 282465 - RNA, 22 nt, Human
aggaaagauggaaggaggauaa

SEQ ID NO: 282466 - RNA, 22 nt, Human
gcuagaaacuguuuaaucucuu

SEQ ID NO: 282467 - RNA, 22 nt, Human
guucuucagcauuagaagucau

SEQ ID NO: 282468 - RNA, 18 nt, Human
ugcuuuaugcuuauauaa

SEQ ID NO: 282469 - RNA, 22 nt, Human
ggcugccacgucgaggguccaa

SEQ ID NO: 282470 - RNA, 22 nt, Human
gagguucagcugcugccuggua

SEQ ID NO: 282471 - RNA, 23 nt, Human
aaggcauuggcuucucucauuuc

SEQ ID NO: 282472 - RNA, 22 nt, Human
ccugagagagugagcccugaca

SEQ ID NO: 282473 - RNA, 22 nt, Human
cuucucccgaagccgguucugc

SEQ ID NO: 282474 - RNA, 22 nt, Human
gacacuuuaggauuuaaaaguc

SEQ ID NO: 282475 - RNA, 22 nt, Human
ucccaggcaaaggcagcucauu

SEQ ID NO: 282476 - RNA, 22 nt, Human
ucagagagugcaaaauauagcu

SEQ ID NO: 282477 - RNA, 22 nt, Human
uguacauuuagagcucaauaga

SEQ ID NO: 282478 - RNA, 22 nt, Human
aagaaaugcagaaaugugcugg

SEQ ID NO: 282479 - RNA, 22 nt, Human
gggaggaaagagaaguggucca

SEQ ID NO: 282480 - RNA, 22 nt, Human
augggugugaaaauggucaucu

SEQ ID NO: 282481 - RNA, 22 nt, Human
auugucaucgauguuagccagu

SEQ ID NO: 282482 - RNA, 22 nt, Human
ucaguguccauaaauaaaguuu

SEQ ID NO: 282483 - RNA, 22 nt, Human
uucaagcagagauauuucaaga

SEQ ID NO: 282484 - RNA, 22 nt, Human
ucucuguacaguacaugccgug

SEQ ID NO: 282485 - RNA, 22 nt, Human
aaggcauaugcauagaagacag

SEQ ID NO: 282486 - RNA, 22 nt, Human
agguagaaggaccagaauuuau

SEQ ID NO: 282487 - RNA, 17 nt, Human
ucuguucaagugagagg

SEQ ID NO: 282488 - RNA, 22 nt, Human
ggacaugugcaacuucuuugga

SEQ ID NO: 282489 - RNA, 22 nt, Human
ugguggggucaucgucagaugc

SEQ ID NO: 282490 - RNA, 22 nt, Human
caauguuuuuccuuccuuaaua

SEQ ID NO: 282491 - RNA, 23 nt, Human
ggccucuguguucugcccacaug

SEQ ID NO: 282492 - RNA, 22 nt, Human
guggcagugaaggucauagcau

SEQ ID NO: 282493 - RNA, 22 nt, Human
uagacaggaaacauuaggaugg

SEQ ID NO: 282494 - RNA, 22 nt, Human
ucaguaaaguucuuucuugcug

SEQ ID NO: 282495 - RNA, 22 nt, Human
guuggugaguuucugaucacaa

SEQ ID NO: 282496 - RNA, 21 nt, Human
cuggaggcagguggugccagg

SEQ ID NO: 282497 - RNA, 21 nt, Human
agucucucuaauaaaugcuug

SEQ ID NO: 282498 - RNA, 22 nt, Human
uccugguaggcuaugucauguc

SEQ ID NO: 282499 - RNA, 22 nt, Human
caaauuuaaguuagaaagcaau

SEQ ID NO: 282500 - RNA, 22 nt, Human
ugcagggcaguggagguugagu

SEQ ID NO: 282501 - RNA, 22 nt, Human
cugggaggcaccgcgucgugcu

SEQ ID NO: 282502 - RNA, 22 nt, Human
uuuaagcuguggcauuaauucu

SEQ ID NO: 282503 - RNA, 22 nt, Human
caggcauagguaggauguuucu

SEQ ID NO: 282504 - RNA, 22 nt, Human
ucuuccuugccuugcuucauca

SEQ ID NO: 282505 - RNA, 22 nt, Human
agggauggaagacuugaagacc

SEQ ID NO: 282506 - RNA, 22 nt, Human
uggaagggguuacgcagcagga

SEQ ID NO: 282507 - RNA, 17 nt, Human
gcucagaguacacgugu

SEQ ID NO: 282508 - RNA, 22 nt, Human
gcccaggauucuuucuuccuua

SEQ ID NO: 282509 - RNA, 21 nt, Human
uaaaagaugacaagacagcuc

SEQ ID NO: 282510 - RNA, 21 nt, Human
agcugcaagagcaacaucuuu

SEQ ID NO: 282511 - RNA, 20 nt, Human
ucccaggcuccacccuagac

SEQ ID NO: 282512 - RNA, 22 nt, Human
agcccagaugguagcccuagaa

SEQ ID NO: 282513 - RNA, 22 nt, Human
aauggaauaccuagguggccca

SEQ ID NO: 282514 - RNA, 22 nt, Human
auuucacaaagaacagaugcag

SEQ ID NO: 282515 - RNA, 22 nt, Human
ucagggaagaaaugggacuuua

SEQ ID NO: 282516 - RNA, 18 nt, Human
uccagagagggagaagug

SEQ ID NO: 282517 - RNA, 22 nt, Human
caaaugauacuguuuuuagucu

SEQ ID NO: 282518 - RNA, 22 nt, Human
cagcuucuggcguggagccuga

SEQ ID NO: 282519 - RNA, 22 nt, Human
uuacauguuuacggauacacuu

SEQ ID NO: 282520 - RNA, 22 nt, Human
uccucaguggggcauucauuau

SEQ ID NO: 282521 - RNA, 22 nt, Human
gauuagaugacuaaugagcugu

SEQ ID NO: 282522 - RNA, 22 nt, Human
ugagggacucccggcccugcca

SEQ ID NO: 282523 - RNA, 22 nt, Human
guggcagucgcugacagauaca

SEQ ID NO: 282524 - RNA, 22 nt, Human
uagaaaugugauaauagcuuaa

SEQ ID NO: 282525 - RNA, 22 nt, Human
auccaugauuaguaggauaaag

SEQ ID NO: 282526 - RNA, 22 nt, Human
aguuugaaaguauugacagaag

SEQ ID NO: 282527 - RNA, 22 nt, Human
aucucccaaacucauuucuuca

SEQ ID NO: 282528 - RNA, 22 nt, Human
auuuaugacaaccaaagaguga

SEQ ID NO: 282529 - RNA, 22 nt, Human
aggaguuuggggauuagucagg

SEQ ID NO: 282530 - RNA, 22 nt, Human
cccugagcgugaggaggaagua

SEQ ID NO: 282531 - RNA, 20 nt, Human
aaaugcuguaauguuuggga

SEQ ID NO: 282532 - RNA, 22 nt, Human
uuguucaugguuguaaguuuga

SEQ ID NO: 282533 - RNA, 22 nt, Human
uuugacucagcaaauucacagg

SEQ ID NO: 282534 - RNA, 22 nt, Human
aguauugugacucaaguauucu

SEQ ID NO: 282535 - RNA, 22 nt, Human
auauauuugagaauauucauga

SEQ ID NO: 282536 - RNA, 22 nt, Human
ugcuuuauggauuuguguccug

SEQ ID NO: 282537 - RNA, 22 nt, Human
cuuagggaauugggaggaugcc

SEQ ID NO: 282538 - RNA, 22 nt, Human
agggacccauagagagaccagu

SEQ ID NO: 282539 - RNA, 22 nt, Human
uggcuuuaggagcuauauaccu

SEQ ID NO: 282540 - RNA, 22 nt, Human
agcugcaagauuucuuuuguau

SEQ ID NO: 282541 - RNA, 22 nt, Human
gccuggcaggccucaugagggg

SEQ ID NO: 282542 - RNA, 22 nt, Human
cccaggaguaagugacauuguu

SEQ ID NO: 282543 - RNA, 22 nt, Human
ggagccugaaaagucugcauuu

SEQ ID NO: 282544 - RNA, 22 nt, Human
gacaagauuaaccauaguuaag

SEQ ID NO: 282545 - RNA, 22 nt, Human
uccauucuaugcuuacauuuau

SEQ ID NO: 282546 - RNA, 22 nt, Human
auucagcagccauggcuucuga

SEQ ID NO: 282547 - RNA, 22 nt, Human
gacauggauacuugauaagggg

SEQ ID NO: 282548 - RNA, 22 nt, Human
uccaggcaggguuaaggguccu

SEQ ID NO: 282549 - RNA, 22 nt, Human
agguggcuucuggccaggugug

SEQ ID NO: 282550 - RNA, 18 nt, Human
uuucacagauucaugacu

SEQ ID NO: 282551 - RNA, 22 nt, Human
uuccuggggcgacuguaucuga

SEQ ID NO: 282552 - RNA, 22 nt, Human
uguccuggaaaaauggagaguu

SEQ ID NO: 282553 - RNA, 22 nt, Human
gaaagcagcuaagucuuaugau

SEQ ID NO: 282554 - RNA, 18 nt, Human
uuggcuuugagaacuggu

SEQ ID NO: 282555 - RNA, 22 nt, Human
gaucaguaagugaauaaugagu

SEQ ID NO: 282556 - RNA, 22 nt, Human
aacaugaaaagcccagagaggu

SEQ ID NO: 282557 - RNA, 22 nt, Human
aaaauucauagaacuguacgcu

SEQ ID NO: 282558 - RNA, 22 nt, Human
auguacuaugcagucaacuguu

SEQ ID NO: 282559 - RNA, 19 nt, Human
cucuggagaacaauagugc

SEQ ID NO: 282560 - RNA, 22 nt, Human
cuguccugguacuuugagguuc

SEQ ID NO: 282561 - RNA, 22 nt, Human
uuaggaaaggaacauugaaacg

SEQ ID NO: 282562 - RNA, 22 nt, Human
uagaaagcguuaaaucuacaga

SEQ ID NO: 282563 - RNA, 22 nt, Human
ucugaagacauaugauauggug

SEQ ID NO: 282564 - RNA, 22 nt, Human
uugcuaauuuaacuaccuuguu

SEQ ID NO: 282565 - RNA, 22 nt, Human
cagggcucccaaauaucucuuc

SEQ ID NO: 282566 - RNA, 22 nt, Human
uuaggagaugguccucuaggga

SEQ ID NO: 282567 - RNA, 22 nt, Human
cuggugcaagauucccugcuuc

SEQ ID NO: 282568 - RNA, 22 nt, Human
cugucugucaaguucaucucca

SEQ ID NO: 282569 - RNA, 22 nt, Human
agggcucugagcuggaccaccu

SEQ ID NO: 282570 - RNA, 22 nt, Human
uguccucacaugguggggagag

SEQ ID NO: 282571 - RNA, 22 nt, Human
uuugaaauuaagauauugucca

SEQ ID NO: 282572 - RNA, 22 nt, Human
agggaaugcuccguauaaaucu

SEQ ID NO: 282573 - RNA, 22 nt, Human
uauuucaggggguacaagaaga

SEQ ID NO: 282574 - RNA, 22 nt, Human
aaaauacuguggaguguugaaa

SEQ ID NO: 282575 - RNA, 22 nt, Human
aaauaucauucuggugcacaga

SEQ ID NO: 282576 - RNA, 17 nt, Human
uaggugguugcuggucu

SEQ ID NO: 282577 - RNA, 22 nt, Human
uaguuaggaauagcagcgacuc

SEQ ID NO: 282578 - RNA, 22 nt, Human
uucuaacucuacacuagcuuug

SEQ ID NO: 282579 - RNA, 22 nt, Human
uuuccuuccauguugggcaaaa

SEQ ID NO: 282580 - RNA, 22 nt, Human
ccaaagucagugcucagucguc

SEQ ID NO: 282581 - RNA, 20 nt, Human
agcauuugaaauaugacuau

SEQ ID NO: 282582 - RNA, 22 nt, Human
gccaggcauuauuccgaucccu

SEQ ID NO: 282583 - RNA, 22 nt, Human
gacaugugcugucucuuaaauu

SEQ ID NO: 282584 - RNA, 22 nt, Human
gcuguucagggcacucaugggc

SEQ ID NO: 282585 - RNA, 22 nt, Human
gccucugggguggagcccagca

SEQ ID NO: 282586 - RNA, 22 nt, Human
uuauuuaauuuucucacucaga

SEQ ID NO: 282587 - RNA, 22 nt, Human
uauuuucaccauguaucccugu

SEQ ID NO: 282588 - RNA, 20 nt, Human
uuuauugagcacguacugug

SEQ ID NO: 282589 - RNA, 22 nt, Human
accugcagcuaaagauguaggg

SEQ ID NO: 282590 - RNA, 22 nt, Human
aagugucugcaaaaugacagag

SEQ ID NO: 282591 - RNA, 22 nt, Human
cugggucuaaaaauucucagau

SEQ ID NO: 282592 - RNA, 19 nt, Human
ucuguggcaccugggaggg

SEQ ID NO: 282593 - RNA, 22 nt, Human
guaugaaagcaucauuccugcu

SEQ ID NO: 282594 - RNA, 22 nt, Human
uagcacccauggaaucugcugg

SEQ ID NO: 282595 - RNA, 21 nt, Human
ucugaugguagaugagaugug

SEQ ID NO: 282596 - RNA, 22 nt, Human
cauucccugucucuucaauccu

SEQ ID NO: 282597 - RNA, 22 nt, Human
acuuuguuuucaugaaacagcu

SEQ ID NO: 282598 - RNA, 22 nt, Human
gaguaaaaguuggauuacaaag

SEQ ID NO: 282599 - RNA, 22 nt, Human
cagcaggacguccaagugcuau

SEQ ID NO: 282600 - RNA, 22 nt, Human
ucuguucagaaauggaagugcc

SEQ ID NO: 282601 - RNA, 22 nt, Human
accaggcacucuuguggcagug

SEQ ID NO: 282602 - RNA, 22 nt, Human
caguuucuguuuuaaauagcag

SEQ ID NO: 282603 - RNA, 16 nt, Human
ucagugucagcuccug

SEQ ID NO: 282604 - RNA, 22 nt, Human
gggcagguggccucuuguacua

SEQ ID NO: 282605 - RNA, 20 nt, Human
aggaggggauagaaucaaag

SEQ ID NO: 282606 - RNA, 22 nt, Human
uuuacagcacugaagccagggg

SEQ ID NO: 282607 - RNA, 21 nt, Human
ucuuuucucagcuuugugguu

SEQ ID NO: 282608 - RNA, 22 nt, Human
ccuggccacccagccuuggcca

SEQ ID NO: 282609 - RNA, 22 nt, Human
auuuuagauuuaagaauaaggu

SEQ ID NO: 282610 - RNA, 22 nt, Human
ucugagcuauguaagacuugga

SEQ ID NO: 282611 - RNA, 22 nt, Human
gggagggaucugcuaggcaaug

SEQ ID NO: 282612 - RNA, 22 nt, Human
auucagcaaacauuuauugugu

SEQ ID NO: 282613 - RNA, 22 nt, Human
uccaggcaucccccaggacaga

SEQ ID NO: 282614 - RNA, 22 nt, Human
cauuccaaguauauacaugaua

SEQ ID NO: 282615 - RNA, 22 nt, Human
cuugccagcacuuggccagcug

SEQ ID NO: 282616 - RNA, 22 nt, Human
cagucuaagacucacgccaaga

SEQ ID NO: 282617 - RNA, 22 nt, Human
uacccaggggcugagcagaggu

SEQ ID NO: 282618 - RNA, 19 nt, Human
cuguuucugagcuugcuuu

SEQ ID NO: 282619 - RNA, 16 nt, Human
uccaggcauaucugag

SEQ ID NO: 282620 - RNA, 22 nt, Human
agcuuacaguucaaugacaaag

SEQ ID NO: 282621 - RNA, 22 nt, Human
uggaggaaucagggcuuaggcu

SEQ ID NO: 282622 - RNA, 22 nt, Human
cuuuacagccuccagaaggaac

SEQ ID NO: 282623 - RNA, 22 nt, Human
uacagugcuagaaccugcugua

SEQ ID NO: 282624 - RNA, 22 nt, Human
ugucauuuucugguuaguuaau

SEQ ID NO: 282625 - RNA, 23 nt, Human
ugguggggucuuggagacagcac

SEQ ID NO: 282626 - RNA, 23 nt, Human
ugagggacaugguggcuucugag

SEQ ID NO: 282627 - RNA, 22 nt, Human
agcagggcucacauuaguggau

SEQ ID NO: 282628 - RNA, 22 nt, Human
uuacauucccagugugcagcau

SEQ ID NO: 282629 - RNA, 21 nt, Human
agagccugagaucuuccagca

SEQ ID NO: 282630 - RNA, 22 nt, Human
uucauucacccaggaaacaucu

SEQ ID NO: 282631 - RNA, 22 nt, Human
auuuccagcagcauauuugucu

SEQ ID NO: 282632 - RNA, 22 nt, Human
ugguuuaccccuguccuauauc

SEQ ID NO: 282633 - RNA, 22 nt, Human
acuugaaaccuuggcaaacaau

SEQ ID NO: 282634 - RNA, 22 nt, Human
acuuuacucuucauaugugaca

SEQ ID NO: 282635 - RNA, 22 nt, Human
agcagggcucuguggagggugg

SEQ ID NO: 282636 - RNA, 22 nt, Human
caguaucugucaguaaucaggu

SEQ ID NO: 282637 - RNA, 22 nt, Human
agagguugggucugaggugaga

SEQ ID NO: 282638 - RNA, 22 nt, Human
cauucuuacacaauauuuuaau

SEQ ID NO: 282639 - RNA, 22 nt, Human
uccuggcagaaauggggcugug

SEQ ID NO: 282640 - RNA, 22 nt, Human
cacuggcccagccaggccuguu

SEQ ID NO: 282641 - RNA, 22 nt, Human
cagaagcauugacuccuugcuc

SEQ ID NO: 282642 - RNA, 18 nt, Human
agugaguuguugaaagaa

SEQ ID NO: 282643 - RNA, 22 nt, Human
cucucuggaauuaaagcccaau

SEQ ID NO: 282644 - RNA, 22 nt, Human
agaaaaagaaaguggauuuguc

SEQ ID NO: 282645 - RNA, 22 nt, Human
auguguccauuaucaguucugg

SEQ ID NO: 282646 - RNA, 18 nt, Human
ugccauccccagucaagu

SEQ ID NO: 282647 - RNA, 22 nt, Human
aagaugcagcuuuacaauaagg

SEQ ID NO: 282648 - RNA, 22 nt, Human
uauuuuacaugauccagaguug

SEQ ID NO: 282649 - RNA, 22 nt, Human
agcaaagcuaucucuauggaga

SEQ ID NO: 282650 - RNA, 22 nt, Human
augguacaaugauggauagugg

SEQ ID NO: 282651 - RNA, 22 nt, Human
uauccuguuuugcacaauuaua

SEQ ID NO: 282652 - RNA, 22 nt, Human
acccagagaacugugccuugag

SEQ ID NO: 282653 - RNA, 22 nt, Human
ggaaacacaugaucagacaucu

SEQ ID NO: 282654 - RNA, 22 nt, Human
ugcuccagugagcuggccaucc

SEQ ID NO: 282655 - RNA, 22 nt, Human
ggaggauuugucaucugaagau

SEQ ID NO: 282656 - RNA, 22 nt, Human
gauggcuuaagaguaaaaggca

SEQ ID NO: 282657 - RNA, 22 nt, Human
uauauauaugcacacacaccua

SEQ ID NO: 282658 - RNA, 22 nt, Human
acaugccaucacuuucauuccu

SEQ ID NO: 282659 - RNA, 22 nt, Human
augagugugaaguuagcucagu

SEQ ID NO: 282660 - RNA, 22 nt, Human
auuucucaguguacauuauguu

SEQ ID NO: 282661 - RNA, 22 nt, Human
ccauggcaauggucagucuauu

SEQ ID NO: 282662 - RNA, 22 nt, Human
aaacaaacauagguuugaaagu

SEQ ID NO: 282663 - RNA, 22 nt, Human
cugggugauuccuguccaggca

SEQ ID NO: 282664 - RNA, 22 nt, Human
ugguacaacuguauuaggcaaa

SEQ ID NO: 282665 - RNA, 22 nt, Human
cuaugaaaugucagauucugca

SEQ ID NO: 282666 - RNA, 20 nt, Human
uccaggagaacugggagccg

SEQ ID NO: 282667 - RNA, 22 nt, Human
gguggggcccuggcacugguau

SEQ ID NO: 282668 - RNA, 18 nt, Human
ugcuggcaacuacuauug

SEQ ID NO: 282669 - RNA, 22 nt, Human
gaggagaagcuaagaaacacag

SEQ ID NO: 282670 - RNA, 22 nt, Human
acaaggaggucuggggggcccu

SEQ ID NO: 282671 - RNA, 22 nt, Human
ugauaacuuuaauuugaucuga

SEQ ID NO: 282672 - RNA, 22 nt, Human
agaaaugaaaccaaagccuaga

SEQ ID NO: 282673 - RNA, 22 nt, Human
guucauauucuaaguaacuggc

SEQ ID NO: 282674 - RNA, 22 nt, Human
aaacuguugugguuuaucauua

SEQ ID NO: 282675 - RNA, 22 nt, Human
uacauguauguguuaauaucug

SEQ ID NO: 282676 - RNA, 22 nt, Human
cugcaucuuagucaaaaucugu

SEQ ID NO: 282677 - RNA, 22 nt, Human
gaacaacuccaagggacaucau

SEQ ID NO: 282678 - RNA, 22 nt, Human
ucauuuguucaucugcucuucu

SEQ ID NO: 282679 - RNA, 22 nt, Human
uuuaguagaaugauacagggca

SEQ ID NO: 282680 - RNA, 22 nt, Human
aauaucucaccaugacaaagca

SEQ ID NO: 282681 - RNA, 21 nt, Human
cccugcaggccagggcugagc

SEQ ID NO: 282682 - RNA, 22 nt, Human
aguggcagagcaggugcuggaa

SEQ ID NO: 282683 - RNA, 22 nt, Human
uuguaaauaguaguaagaugcc

SEQ ID NO: 282684 - RNA, 22 nt, Human
agcagggcaaagucaggcuaac

SEQ ID NO: 282685 - RNA, 19 nt, Human
aagcauggugccucaccuc

SEQ ID NO: 282686 - RNA, 22 nt, Human
cccaguguuccuugaggggcug

SEQ ID NO: 282687 - RNA, 22 nt, Human
auggucaguugcagcuaauguu

SEQ ID NO: 282688 - RNA, 22 nt, Human
uuuguucugaaaacucaagucc

SEQ ID NO: 282689 - RNA, 22 nt, Human
ggcuguugacagacauagguuu

SEQ ID NO: 282690 - RNA, 22 nt, Human
cacacauuucagaugcuacaau

SEQ ID NO: 282691 - RNA, 22 nt, Human
auccagagagguuaggugacau

SEQ ID NO: 282692 - RNA, 22 nt, Human
cagagcaacacccuuuacaucg

SEQ ID NO: 282693 - RNA, 22 nt, Human
uuuuaaaucuccaguugacccc

SEQ ID NO: 282694 - RNA, 22 nt, Human
aggaauguggccuagggaggag

SEQ ID NO: 282695 - RNA, 22 nt, Human
aaacaccagucccaguauacac

SEQ ID NO: 282696 - RNA, 22 nt, Human
aauuuacaguugcugaugguac

SEQ ID NO: 282697 - RNA, 22 nt, Human
uggccugacugucaggcuguau

SEQ ID NO: 282698 - RNA, 17 nt, Human
acaggccugcuugcacu

SEQ ID NO: 282699 - RNA, 23 nt, Human
uguuuguuucuaugagagauagc

SEQ ID NO: 282700 - RNA, 22 nt, Human
gcauuuaaauuugaacuucaga

SEQ ID NO: 282701 - RNA, 22 nt, Human
uaguauuuuagaaaaccaugaa

SEQ ID NO: 282702 - RNA, 22 nt, Human
ccaguguauuauuugagaaauu

SEQ ID NO: 282703 - RNA, 22 nt, Human
auauuauucuaguaacagugau

SEQ ID NO: 282704 - RNA, 22 nt, Human
gggcagguuggcaucccgggca

SEQ ID NO: 282705 - RNA, 22 nt, Human
uuagagaauuccaaaugacuac

SEQ ID NO: 282706 - RNA, 22 nt, Human
cagccuucaaggcuuagcucag

SEQ ID NO: 282707 - RNA, 22 nt, Human
aaaugaguuugccucuagauag

SEQ ID NO: 282708 - RNA, 22 nt, Human
ugagcaguaacagcucacaggg

SEQ ID NO: 282709 - RNA, 22 nt, Human
gggggucccaagcugggcugcu

SEQ ID NO: 282710 - RNA, 22 nt, Human
auuuauugagccuuuccuaugu

SEQ ID NO: 282711 - RNA, 22 nt, Human
cauguuucugagaaaaguagga

SEQ ID NO: 282712 - RNA, 22 nt, Human
uaugcuauucuucagaguguuc

SEQ ID NO: 282713 - RNA, 22 nt, Human
auaguacagauccauuaauuau

SEQ ID NO: 282714 - RNA, 22 nt, Human
uuucacauuggcuucuauuucu

SEQ ID NO: 282715 - RNA, 22 nt, Human
agcucagaacugcagacaugug

SEQ ID NO: 282716 - RNA, 22 nt, Human
cauuccuauuaugucccuagug

SEQ ID NO: 282717 - RNA, 22 nt, Human
uucaucaauguguuuaauaaug

SEQ ID NO: 282718 - RNA, 22 nt, Human
aauaacuggcacauaucacaua

SEQ ID NO: 282719 - RNA, 22 nt, Human
cugagggucaacuugauuguau

SEQ ID NO: 282720 - RNA, 22 nt, Human
auggcagggacuguggcccuug

SEQ ID NO: 282721 - RNA, 22 nt, Human
gcagagcagugcuugcccagcg

SEQ ID NO: 282722 - RNA, 22 nt, Human
uaguguauguucagcuuauaug

SEQ ID NO: 282723 - RNA, 22 nt, Human
agacaugacagauaguugcuag

SEQ ID NO: 282724 - RNA, 22 nt, Human
caagauuuuaucuccguuucug

SEQ ID NO: 282725 - RNA, 22 nt, Human
uuaguuuucucaucuaucucac

SEQ ID NO: 282726 - RNA, 22 nt, Human
acaugccaucuuugucaggagu

SEQ ID NO: 282727 - RNA, 22 nt, Human
uucaauuucauaauaucuagcu

SEQ ID NO: 282728 - RNA, 22 nt, Human
cagauuuacucccugcugcugc

SEQ ID NO: 282729 - RNA, 22 nt, Human
ugauuucauaguauauacauga

SEQ ID NO: 282730 - RNA, 17 nt, Human
cuuguuuuccacuggga

SEQ ID NO: 282731 - RNA, 22 nt, Human
ggaaggggugucgcccauggau

SEQ ID NO: 282732 - RNA, 22 nt, Human
gcugggugucacggggcucgug

SEQ ID NO: 282733 - RNA, 22 nt, Human
uccugggaccaggcaccuacug

SEQ ID NO: 282734 - RNA, 22 nt, Human
gugugucccuuggaaccucagc

SEQ ID NO: 282735 - RNA, 22 nt, Human
uagaaacauucaguugcagucc

SEQ ID NO: 282736 - RNA, 21 nt, Human
aacugagaccagcuaaagugg

SEQ ID NO: 282737 - RNA, 22 nt, Human
cugagcccgggugcucuacccc

SEQ ID NO: 282738 - RNA, 21 nt, Human
ucuggguguaaaucuuauuug

SEQ ID NO: 282739 - RNA, 22 nt, Human
cacuuuuaaauggguccguguu

SEQ ID NO: 282740 - RNA, 22 nt, Human
agaucuuuaaaaguuauuauua

SEQ ID NO: 282741 - RNA, 22 nt, Human
cagugcagaacacauggaaaau

SEQ ID NO: 282742 - RNA, 22 nt, Human
auauauaugcugauggcugcca

SEQ ID NO: 282743 - RNA, 22 nt, Human
agucaaagaugaccgaguuccu

SEQ ID NO: 282744 - RNA, 22 nt, Human
ggccgugcuccaaagucaucgu

SEQ ID NO: 282745 - RNA, 22 nt, Human
uauuucuuguuauucucguuga

SEQ ID NO: 282746 - RNA, 22 nt, Human
uacaguuccucucguggaggug

SEQ ID NO: 282747 - RNA, 22 nt, Human
cacagcaaagacacucucaacu

SEQ ID NO: 282748 - RNA, 22 nt, Human
agacugaaguaagaaugcagcu

SEQ ID NO: 282749 - RNA, 22 nt, Human
cacaaaugugcagaaaugugag

SEQ ID NO: 282750 - RNA, 22 nt, Human
gcaggcagagucaauuugaucc

SEQ ID NO: 282751 - RNA, 22 nt, Human
aguccuuugggaaaaaugacua

SEQ ID NO: 282752 - RNA, 22 nt, Human
caugccauuuacuuggaggaga

SEQ ID NO: 282753 - RNA, 22 nt, Human
cccagccugugacagccguccu

SEQ ID NO: 282754 - RNA, 22 nt, Human
ugucauuuucagcuuaugcuuc

SEQ ID NO: 282755 - RNA, 22 nt, Human
uuuaagaaguuauguuauaaau

SEQ ID NO: 282756 - RNA, 22 nt, Human
agcccggcuuccccgguugcua

SEQ ID NO: 282757 - RNA, 22 nt, Human
auuuacauaauagacuuuaggu

SEQ ID NO: 282758 - RNA, 22 nt, Human
uuccugugaagccgguggucuc

SEQ ID NO: 282759 - RNA, 22 nt, Human
uuacauguacugguuugacuua

SEQ ID NO: 282760 - RNA, 22 nt, Human
ucuucugugagaauucaagcaa

SEQ ID NO: 282761 - RNA, 22 nt, Human
gagcuggaggcagugcugaggu

SEQ ID NO: 282762 - RNA, 22 nt, Human
cuucuuuaauguauacaaaaga

SEQ ID NO: 282763 - RNA, 22 nt, Human
gggcgagggcgaaagcgagagc

SEQ ID NO: 282764 - RNA, 22 nt, Human
aaacaaugaaauauuuuuaugg

SEQ ID NO: 282765 - RNA, 22 nt, Human
aaggugucaaacuagaagaugu

SEQ ID NO: 282766 - RNA, 22 nt, Human
uguauugaauuguguuauaucu

SEQ ID NO: 282767 - RNA, 22 nt, Human
gaugagguuuuugaaaugugga

SEQ ID NO: 282768 - RNA, 22 nt, Human
uuacaguuuaguccaagccaga

SEQ ID NO: 282769 - RNA, 22 nt, Human
aacugucuaaggagaauaugaa

SEQ ID NO: 282770 - RNA, 22 nt, Human
cugagccagggccacacaugga

SEQ ID NO: 282771 - RNA, 22 nt, Human
gcaggugggagccgcugccuga

SEQ ID NO: 282772 - RNA, 23 nt, Human
ccacuagcaccuguucaacuucu

SEQ ID NO: 282773 - RNA, 19 nt, Human
gcugggugggguccacagc

SEQ ID NO: 282774 - RNA, 22 nt, Human
uuuugcuuuuguaacacagugu

SEQ ID NO: 282775 - RNA, 19 nt, Human
acccaggguugauguccag

SEQ ID NO: 282776 - RNA, 22 nt, Human
agcagggcuugccgcuuguccu

SEQ ID NO: 282777 - RNA, 22 nt, Human
ucucacaagcucaaggauuagu

SEQ ID NO: 282778 - RNA, 22 nt, Human
ugucagugccaacuuugcuggu

SEQ ID NO: 282779 - RNA, 22 nt, Human
uuauagaauccaguuguuguau

SEQ ID NO: 282780 - RNA, 22 nt, Human
caagauaauuuauucugaguuu

SEQ ID NO: 282781 - RNA, 22 nt, Human
uggccucugggaaagcagauuc

SEQ ID NO: 282782 - RNA, 22 nt, Human
gaccuggugcuagcuggugugu

SEQ ID NO: 282783 - RNA, 22 nt, Human
agacuacauaugccacaugaag

SEQ ID NO: 282784 - RNA, 22 nt, Human
gggcaggugugcagagcuguug

SEQ ID NO: 282785 - RNA, 22 nt, Human
ucacagaaaagcugagcaucag

SEQ ID NO: 282786 - RNA, 22 nt, Human
cuauugcuuuugugugcuccca

SEQ ID NO: 282787 - RNA, 22 nt, Human
cuauuucaaggcccagauauga

SEQ ID NO: 282788 - RNA, 17 nt, Human
aggcagcucagaacauc

SEQ ID NO: 282789 - RNA, 22 nt, Human
ccuggcucuucgggaguuuguu

SEQ ID NO: 282790 - RNA, 19 nt, Human
guuucauuaagauaggaaa

SEQ ID NO: 282791 - RNA, 22 nt, Human
ugguggcuaccagguccugggg

SEQ ID NO: 282792 - RNA, 22 nt, Human
uccugaugauauugcucuuucu

SEQ ID NO: 282793 - RNA, 20 nt, Human
agugcauggagggagagggc

SEQ ID NO: 282794 - RNA, 22 nt, Human
uucuucagagaguagaagcaag

SEQ ID NO: 282795 - RNA, 22 nt, Human
ugucucagggcagcagcagggg

SEQ ID NO: 282796 - RNA, 20 nt, Human
ucacuggccagaguagcccu

SEQ ID NO: 282797 - RNA, 22 nt, Human
gcuuccaaaucuguucaaaaug

SEQ ID NO: 282798 - RNA, 22 nt, Human
uuuuaucauuacccagcugaaa

SEQ ID NO: 282799 - RNA, 22 nt, Human
aggcucugguucaucaugaugg

SEQ ID NO: 282800 - RNA, 22 nt, Human
ugagaaaacaguuuguaauaau

SEQ ID NO: 282801 - RNA, 22 nt, Human
uuguacaaaggauuuggaagag

SEQ ID NO: 282802 - RNA, 22 nt, Human
uuuucauuguaaaucaggaaac

SEQ ID NO: 282803 - RNA, 22 nt, Human
agugugaguaauugagucuguc

SEQ ID NO: 282804 - RNA, 22 nt, Human
uuguaagaauaugaauacaaau

SEQ ID NO: 282805 - RNA, 22 nt, Human
cucuuaaagcuuccaguuucaa

SEQ ID NO: 282806 - RNA, 22 nt, Human
uccuaguucucugccagucgcu

SEQ ID NO: 282807 - RNA, 22 nt, Human
cuugaagaaaguauguugggau

SEQ ID NO: 282808 - RNA, 22 nt, Human
ggcuaccagauaaauuacagag

SEQ ID NO: 282809 - RNA, 22 nt, Human
aggaaugugaccacuagacucu

SEQ ID NO: 282810 - RNA, 22 nt, Human
agggcuccuaugaugcucugcc

SEQ ID NO: 282811 - RNA, 22 nt, Human
uuaaaagggauguuaucuguaa

SEQ ID NO: 282812 - RNA, 22 nt, Human
uuccugugguccagagucaucc

SEQ ID NO: 282813 - RNA, 22 nt, Human
cagaagucacccucagaauaac

SEQ ID NO: 282814 - RNA, 22 nt, Human
aacaaccaaaaagaugaaugua

SEQ ID NO: 282815 - RNA, 22 nt, Human
aggaaagccaaucucucuugac

SEQ ID NO: 282816 - RNA, 22 nt, Human
aaagugguuuaugauauuccaa

SEQ ID NO: 282817 - RNA, 22 nt, Human
agaugguccaugcacagauaug

SEQ ID NO: 282818 - RNA, 22 nt, Human
cuugcuucauuagugucuuagu

SEQ ID NO: 282819 - RNA, 22 nt, Human
uuugggaacucuaucauggaaa

SEQ ID NO: 282820 - RNA, 23 nt, Human
uccaugagaugugggcuucuagu

SEQ ID NO: 282821 - RNA, 22 nt, Human
augcaccugaacuccaucagcu

SEQ ID NO: 282822 - RNA, 20 nt, Human
cugcaggguuagaggcucca

SEQ ID NO: 282823 - RNA, 22 nt, Human
cagcuugugcaaagguccuggg

SEQ ID NO: 282824 - RNA, 22 nt, Human
accuugaugccuuuccaagaug

SEQ ID NO: 282825 - RNA, 17 nt, Human
uccuggcucugccacug

SEQ ID NO: 282826 - RNA, 22 nt, Human
caagggccaucugagggcacug

SEQ ID NO: 282827 - RNA, 21 nt, Human
uaacacauuuugguacuuugg

SEQ ID NO: 282828 - RNA, 17 nt, Human
ccugcccagagacagau

SEQ ID NO: 282829 - RNA, 22 nt, Human
caguguaucauuagugugauga

SEQ ID NO: 282830 - RNA, 22 nt, Human
aggaauguauuauuccuucugg

SEQ ID NO: 282831 - RNA, 22 nt, Human
agcccuugguauuuuccgaucc

SEQ ID NO: 282832 - RNA, 19 nt, Human
cuggguccuguucuuuuac

SEQ ID NO: 282833 - RNA, 17 nt, Human
ccugucuuguuucugcc

SEQ ID NO: 282834 - RNA, 19 nt, Human
uuuacagggaauggagacc

SEQ ID NO: 282835 - RNA, 22 nt, Human
ucagagaguuggaaagaauuaa

SEQ ID NO: 282836 - RNA, 22 nt, Human
gagccagggcugugagcugagc

SEQ ID NO: 282837 - RNA, 22 nt, Human
uuuagcuucaguucuagcuucu

SEQ ID NO: 282838 - RNA, 22 nt, Human
ugauuuccuaggucuggagaag

SEQ ID NO: 282839 - RNA, 22 nt, Human
ugcaaaaacugcaauugcuuuu

SEQ ID NO: 282840 - RNA, 21 nt, Human
uucucaguguccauguuaguu

SEQ ID NO: 282841 - RNA, 22 nt, Human
aaauacagauuccagggucuua

SEQ ID NO: 282842 - RNA, 21 nt, Human
uucuucaguuuaauauaaaau

SEQ ID NO: 282843 - RNA, 22 nt, Human
agcuuuauuaacucuccaggug

SEQ ID NO: 282844 - RNA, 22 nt, Human
uuaagucaauaucaaucucagc

SEQ ID NO: 282845 - RNA, 22 nt, Human
aaguuuuugguagagaaaagua

SEQ ID NO: 282846 - RNA, 20 nt, Human
aggaaaaauggaaacuggag

SEQ ID NO: 282847 - RNA, 22 nt, Human
auguuucagauacagaucaaau

SEQ ID NO: 282848 - RNA, 22 nt, Human
ggcagggaguggagacucccua

SEQ ID NO: 282849 - RNA, 20 nt, Human
uagggaugccaguacuucuc

SEQ ID NO: 282850 - RNA, 19 nt, Human
uccugcagguggcuugcag

SEQ ID NO: 282851 - RNA, 20 nt, Human
uccugcaguuccuaggaggg

SEQ ID NO: 282852 - RNA, 22 nt, Human
uuuauauguauugacuuugaug

SEQ ID NO: 282853 - RNA, 22 nt, Human
uccuucucugguuuuuacugua

SEQ ID NO: 282854 - RNA, 22 nt, Human
uuagccauucugauagguaugu

SEQ ID NO: 282855 - RNA, 22 nt, Human
gugcagcugccgaucagauagg

SEQ ID NO: 282856 - RNA, 22 nt, Human
acaaucuggaaaaguuaacuau

SEQ ID NO: 282857 - RNA, 22 nt, Human
cagggcagugaagaacacacgu

SEQ ID NO: 282858 - RNA, 22 nt, Human
acauucccaccaacaguguaaa

SEQ ID NO: 282859 - RNA, 22 nt, Human
auugaguaccuccagauucaua

SEQ ID NO: 282860 - RNA, 22 nt, Human
ggcaguggaggacccugugucu

SEQ ID NO: 282861 - RNA, 22 nt, Human
agcugcaaguguugccuccuac

SEQ ID NO: 282862 - RNA, 22 nt, Human
uuccuuucccuugcuucugugc

SEQ ID NO: 282863 - RNA, 22 nt, Human
ucuguucaucucaugggagaau

SEQ ID NO: 282864 - RNA, 22 nt, Human
uuguauuucgaugcacguguag

SEQ ID NO: 282865 - RNA, 22 nt, Human
cacuggcccauaaaggccuggg

SEQ ID NO: 282866 - RNA, 22 nt, Human
guacuaagucaggagaagaauu

SEQ ID NO: 282867 - RNA, 22 nt, Human
uaagguuucuaguuucuaaacu

SEQ ID NO: 282868 - RNA, 22 nt, Human
aggcagguuggugagaagacug

SEQ ID NO: 282869 - RNA, 22 nt, Human
cuggguaaguuccuaaggcuca

SEQ ID NO: 282870 - RNA, 22 nt, Human
agggccaguucuaccucugaau

SEQ ID NO: 282871 - RNA, 21 nt, Human
uaaaugugagcagggcugggc

SEQ ID NO: 282872 - RNA, 22 nt, Human
uccugcaguuacaucccagcca

SEQ ID NO: 282873 - RNA, 22 nt, Human
cucagccaugggguggaucagc

SEQ ID NO: 282874 - RNA, 22 nt, Human
uuucugauauacuguagaaucc

SEQ ID NO: 282875 - RNA, 22 nt, Human
uuacaguagcuuuauuuggagu

SEQ ID NO: 282876 - RNA, 22 nt, Human
gagcaaacaucagugaugucug

SEQ ID NO: 282877 - RNA, 22 nt, Human
gauccugugguuuuccugugca

SEQ ID NO: 282878 - RNA, 22 nt, Human
caggaaaugcuaucauagcuga

SEQ ID NO: 282879 - RNA, 22 nt, Human
gacccuguuucuacaaauaauu

SEQ ID NO: 282880 - RNA, 23 nt, Human
cuuucauugugguuucacagagc

SEQ ID NO: 282881 - RNA, 22 nt, Human
uuuguacaauuagcagaggcua

SEQ ID NO: 282882 - RNA, 22 nt, Human
auugaaaaauucacaauucugg

SEQ ID NO: 282883 - RNA, 22 nt, Human
cuuccuuccuuccccgaaaugc

SEQ ID NO: 282884 - RNA, 22 nt, Human
gggguacuggcuggagccccac

SEQ ID NO: 282885 - RNA, 22 nt, Human
aguggcuucauuucugccagaa

SEQ ID NO: 282886 - RNA, 22 nt, Human
auacauacauguaugcacauac

SEQ ID NO: 282887 - RNA, 22 nt, Human
ccugggucuucagucugcuggu

SEQ ID NO: 282888 - RNA, 22 nt, Human
agagauggagagcacuggggcu

SEQ ID NO: 282889 - RNA, 22 nt, Human
uggcagggugggcuucagcccc

SEQ ID NO: 282890 - RNA, 22 nt, Human
aagucacauucugagguauugg

SEQ ID NO: 282891 - RNA, 22 nt, Human
cagcuccucuggccagcccugc

SEQ ID NO: 282892 - RNA, 22 nt, Human
ucuggcagugaagucaugaggu

SEQ ID NO: 282893 - RNA, 22 nt, Human
uggcaaagauuaccacaucuac

SEQ ID NO: 282894 - RNA, 22 nt, Human
ucuuuccaaggacucuguagca

SEQ ID NO: 282895 - RNA, 22 nt, Human
guuuauuauacaacaaaagcua

SEQ ID NO: 282896 - RNA, 22 nt, Human
uccucuggcucuuucccuagga

SEQ ID NO: 282897 - RNA, 22 nt, Human
ucaugcagagccagucaggaua

SEQ ID NO: 282898 - RNA, 22 nt, Human
aguacaaagugcuccugguucu

SEQ ID NO: 282899 - RNA, 22 nt, Human
cacccagcacagagggaggcga

SEQ ID NO: 282900 - RNA, 22 nt, Human
aggcucugaggcagauuuucgu

SEQ ID NO: 282901 - RNA, 22 nt, Human
uuaguuuauaauucauuucugu

SEQ ID NO: 282902 - RNA, 22 nt, Human
aaggcucucugauggcagcagu

SEQ ID NO: 282903 - RNA, 22 nt, Human
augucucugccccagagagcuu

SEQ ID NO: 282904 - RNA, 22 nt, Human
guucagcagcagugauuuugug

SEQ ID NO: 282905 - RNA, 22 nt, Human
ugagcccuugacaucgcccacu

SEQ ID NO: 282906 - RNA, 22 nt, Human
gaggcuggaggucaaagaugaa

SEQ ID NO: 282907 - RNA, 22 nt, Human
cucugaccauucccuugauuuu

SEQ ID NO: 282908 - RNA, 22 nt, Human
cauauaaauacaacauguguua

SEQ ID NO: 282909 - RNA, 22 nt, Human
ucagacagcuugggauaacuga

SEQ ID NO: 282910 - RNA, 22 nt, Human
ucauuuguggaagugauugugg

SEQ ID NO: 282911 - RNA, 22 nt, Human
gagaugguugcaauaguuuaaa

SEQ ID NO: 282912 - RNA, 18 nt, Human
cuguccaguagacucugc

SEQ ID NO: 282913 - RNA, 22 nt, Human
aucugaaaagcuuuaaugagcu

SEQ ID NO: 282914 - RNA, 22 nt, Human
caucacagggggcuagaagucu

SEQ ID NO: 282915 - RNA, 22 nt, Human
cuggcaggcagacuucugcaag

SEQ ID NO: 282916 - RNA, 21 nt, Human
uccuggccagggcacuaggca

SEQ ID NO: 282917 - RNA, 22 nt, Human
gagucucugcuauguuuucucu

SEQ ID NO: 282918 - RNA, 22 nt, Human
caugcuguugaauaugacauug

SEQ ID NO: 282919 - RNA, 22 nt, Human
uccuggcuccagcagcucuucc

SEQ ID NO: 282920 - RNA, 20 nt, Human
ucccaggcugggcuccagcu

SEQ ID NO: 282921 - RNA, 22 nt, Human
cuaaauuauuugcacauuagag

SEQ ID NO: 282922 - RNA, 22 nt, Human
gaaugaaucuguaagugacaag

SEQ ID NO: 282923 - RNA, 22 nt, Human
uggaauguaaacucugugaggg

SEQ ID NO: 282924 - RNA, 19 nt, Human
gauuuaaacguggcucuau

SEQ ID NO: 282925 - RNA, 22 nt, Human
aguggagaccccacuucuacau

SEQ ID NO: 282926 - RNA, 22 nt, Human
guggcaguuuugacaucacaaa

SEQ ID NO: 282927 - RNA, 21 nt, Human
uuacaaagcaagugcuguguc

SEQ ID NO: 282928 - RNA, 23 nt, Human
aagugguuuugaacccggacccu

SEQ ID NO: 282929 - RNA, 22 nt, Human
uauuuagaaugcguguacgugu

SEQ ID NO: 282930 - RNA, 22 nt, Human
uuauugaguuguaagagcucuu

SEQ ID NO: 282931 - RNA, 22 nt, Human
cagucacuggaauagcugagga

SEQ ID NO: 282932 - RNA, 22 nt, Human
acagggcagcaacuuugugccu

SEQ ID NO: 282933 - RNA, 22 nt, Human
uacaugugaucagaaagugaaa

SEQ ID NO: 282934 - RNA, 22 nt, Human
auuucugugcaguaaaugguga

SEQ ID NO: 282935 - RNA, 22 nt, Human
ucuccuggccgggcuguccccu

SEQ ID NO: 282936 - RNA, 22 nt, Human
gcuguacaaggccucugccauc

SEQ ID NO: 282937 - RNA, 22 nt, Human
cacagguguccaauaccugcuu

SEQ ID NO: 282938 - RNA, 22 nt, Human
aagggcucacccaacucacuuc

SEQ ID NO: 282939 - RNA, 18 nt, Human
uggaggaaucacaauggc

SEQ ID NO: 282940 - RNA, 22 nt, Human
acuuuacaggcacuucaaguau

SEQ ID NO: 282941 - RNA, 22 nt, Human
gacaagcucuuguuucaugguu

SEQ ID NO: 282942 - RNA, 22 nt, Human
gcagagugguuucagaguugag

SEQ ID NO: 282943 - RNA, 22 nt, Human
cauuuacaauguacagguugug

SEQ ID NO: 282944 - RNA, 22 nt, Human
auagcaaaaggcaccagaguga

SEQ ID NO: 282945 - RNA, 22 nt, Human
aguguaugcagguuuucaaugu

SEQ ID NO: 282946 - RNA, 22 nt, Human
uucuauugggaagugugagagu

SEQ ID NO: 282947 - RNA, 22 nt, Human
gcagggcagggcaagaacuggg

SEQ ID NO: 282948 - RNA, 22 nt, Human
uuucugcauauguauguaugga

SEQ ID NO: 282949 - RNA, 22 nt, Human
ucaguguccugugcggugcagc

SEQ ID NO: 282950 - RNA, 22 nt, Human
gagggaugugccugaaggcagg

SEQ ID NO: 282951 - RNA, 22 nt, Human
agcuccaggauaagacaggugc

SEQ ID NO: 282952 - RNA, 22 nt, Human
ccuggcucugguucccucagcu

SEQ ID NO: 282953 - RNA, 22 nt, Human
cagcaggugucuagcaaggguc

SEQ ID NO: 282954 - RNA, 22 nt, Human
aguauucuggaauucuauguga

SEQ ID NO: 282955 - RNA, 22 nt, Human
uuaagacaguguauuuguuuuc

SEQ ID NO: 282956 - RNA, 22 nt, Human
agcagggcuuuggcuggcuuuc

SEQ ID NO: 282957 - RNA, 22 nt, Human
cuccugcaagccuccccaagca

SEQ ID NO: 282958 - RNA, 22 nt, Human
gugaacaggagaaagugaugga

SEQ ID NO: 282959 - RNA, 22 nt, Human
agcaagcagaaaugccauggca

SEQ ID NO: 282960 - RNA, 22 nt, Human
aaaguguugggauuacaggcau

SEQ ID NO: 282961 - RNA, 22 nt, Human
auccuucuucugcuagugucua

SEQ ID NO: 282962 - RNA, 17 nt, Human
ccaggcuccaucacugu

SEQ ID NO: 282963 - RNA, 22 nt, Human
uaaugucuaugggccagauaau

SEQ ID NO: 282964 - RNA, 22 nt, Human
aggagccaugagugacaucaca

SEQ ID NO: 282965 - RNA, 22 nt, Human
uggcaggaaccaggaggcucuc

SEQ ID NO: 282966 - RNA, 22 nt, Human
gggcuccaccuagggacacugg

SEQ ID NO: 282967 - RNA, 20 nt, Human
ucuggcucuuugcuccuccc

SEQ ID NO: 282968 - RNA, 22 nt, Human
guccuggcccaggaguacacau

SEQ ID NO: 282969 - RNA, 22 nt, Human
aagauuuacuuucuuuguaaua

SEQ ID NO: 282970 - RNA, 22 nt, Human
uuucuguaaguggcaaauaaug

SEQ ID NO: 282971 - RNA, 20 nt, Human
uauuuugcaauuaugguuca

SEQ ID NO: 282972 - RNA, 20 nt, Human
acuguucaagggccuggugg

SEQ ID NO: 282973 - RNA, 22 nt, Human
ggggagaauuacauggcgugga

SEQ ID NO: 282974 - RNA, 22 nt, Human
caaauguauaaauguacuuucu

SEQ ID NO: 282975 - RNA, 22 nt, Human
agcuggcaguaugacuggugac

SEQ ID NO: 282976 - RNA, 22 nt, Human
ugcuuaaaaugaugauuauuuu

SEQ ID NO: 282977 - RNA, 22 nt, Human
auuuucugaguccagaauuuac

SEQ ID NO: 282978 - RNA, 22 nt, Human
uuccuucuggaagcuucagggg

SEQ ID NO: 282979 - RNA, 22 nt, Human
ggagcugaggaauagcuuugau

SEQ ID NO: 282980 - RNA, 22 nt, Human
aggcugugaaauguggcaagga

SEQ ID NO: 282981 - RNA, 22 nt, Human
aggccugggcaagaaggggcgu

SEQ ID NO: 282982 - RNA, 22 nt, Human
acaguuuaucgauucaccuacc

SEQ ID NO: 282983 - RNA, 22 nt, Human
ccuuccuggagcccaugcagau

SEQ ID NO: 282984 - RNA, 22 nt, Human
ggcagugggaaauaagugagaa

SEQ ID NO: 282985 - RNA, 22 nt, Human
ccugggugcccggcccuucucu

SEQ ID NO: 282986 - RNA, 22 nt, Human
aacaucuacuaagugccaggca

SEQ ID NO: 282987 - RNA, 22 nt, Human
uagacaggagucaggcuagaau

SEQ ID NO: 282988 - RNA, 22 nt, Human
uagcaaaaacugcaguuacuuu

SEQ ID NO: 282989 - RNA, 20 nt, Human
agcuaggagaaagcauggag

SEQ ID NO: 282990 - RNA, 20 nt, Human
ugccccaggccugcaccugc

SEQ ID NO: 282991 - RNA, 22 nt, Human
guucucucagcgauagugaugg

SEQ ID NO: 282992 - RNA, 22 nt, Human
uccuggacaagcccuucacccu

SEQ ID NO: 282993 - RNA, 22 nt, Human
ccuuccuuugcaucauuucuag

SEQ ID NO: 282994 - RNA, 22 nt, Human
uuccuggcauagagagggcaca

SEQ ID NO: 282995 - RNA, 22 nt, Human
ucagcugugauccaucuaucua

SEQ ID NO: 282996 - RNA, 22 nt, Human
agagccaggaugucuucugggg

SEQ ID NO: 282997 - RNA, 17 nt, Human
aauugcuuguacuccca

SEQ ID NO: 282998 - RNA, 22 nt, Human
ugcugagggagggguuuuccag

SEQ ID NO: 282999 - RNA, 22 nt, Human
aagaugcaugcugaagcuggcu

SEQ ID NO: 283000 - RNA, 22 nt, Human
aaaggaggaauggagagaugcu

SEQ ID NO: 283001 - RNA, 22 nt, Human
ucauucuugcguaugccauggu

SEQ ID NO: 283002 - RNA, 22 nt, Human
accuucaaugaaaauaauaguc

SEQ ID NO: 283003 - RNA, 19 nt, Human
agugcaugggcgaggugca

SEQ ID NO: 283004 - RNA, 22 nt, Human
ugcuggcuccucgaggcuucgu

SEQ ID NO: 283005 - RNA, 22 nt, Human
cccagcccacgguccugggugg

SEQ ID NO: 283006 - RNA, 22 nt, Human
ucaggcccuucucccaggacuc

SEQ ID NO: 283007 - RNA, 22 nt, Human
uaucuuuugaguucucaagaug

SEQ ID NO: 283008 - RNA, 22 nt, Human
aagggcagcuauuaucgucauc

SEQ ID NO: 283009 - RNA, 22 nt, Human
cuggguggagccuggucaucug

SEQ ID NO: 283010 - RNA, 22 nt, Human
cauuuauugguuaggccagcag

SEQ ID NO: 283011 - RNA, 22 nt, Human
agaaaagguugaaaguaggauu

SEQ ID NO: 283012 - RNA, 22 nt, Human
gagcaguaggagaacccugagc

SEQ ID NO: 283013 - RNA, 22 nt, Human
ugccccagacucugcucaccuc

SEQ ID NO: 283014 - RNA, 22 nt, Human
aauagaauguaaucuaauacau

SEQ ID NO: 283015 - RNA, 22 nt, Human
caugcagcagaauaaugacuau

SEQ ID NO: 283016 - RNA, 20 nt, Human
ccacccugcuaagaauacac

SEQ ID NO: 283017 - RNA, 22 nt, Human
guauucuuaaggauugagcaaa

SEQ ID NO: 283018 - RNA, 22 nt, Human
aguguccuacagcuccugccug

SEQ ID NO: 283019 - RNA, 22 nt, Human
acagggcaugugcaagagacau

SEQ ID NO: 283020 - RNA, 22 nt, Human
ccaggcacuggcuggguucuuu

SEQ ID NO: 283021 - RNA, 22 nt, Human
uuuacagaucuguugauuuguu

SEQ ID NO: 283022 - RNA, 20 nt, Human
uguguccaucaucugggcac

SEQ ID NO: 283023 - RNA, 22 nt, Human
cuggaaugccucccugucagag

SEQ ID NO: 283024 - RNA, 22 nt, Human
uggaggaaaaaaccaggcagag

SEQ ID NO: 283025 - RNA, 22 nt, Human
ucuggcagcaagucuguuucuc

SEQ ID NO: 283026 - RNA, 22 nt, Human
agccuugaacacugacugaagg

SEQ ID NO: 283027 - RNA, 22 nt, Human
accugcagccacuucucuccuu

SEQ ID NO: 283028 - RNA, 22 nt, Human
ucugucuuugagaucucagccu

SEQ ID NO: 283029 - RNA, 22 nt, Human
ucagggacagggugcugcugcg

SEQ ID NO: 283030 - RNA, 22 nt, Human
aauucuuggaaacauuacugga

SEQ ID NO: 283031 - RNA, 22 nt, Human
gaaacuuuggcuaaaagccaga

SEQ ID NO: 283032 - RNA, 22 nt, Human
aggagggacaccaauauauguu

SEQ ID NO: 283033 - RNA, 22 nt, Human
caggaagggggauccuuggaag

SEQ ID NO: 283034 - RNA, 22 nt, Human
aauuagggaaaauuuacuugua

SEQ ID NO: 283035 - RNA, 22 nt, Human
gaauguaagugggcagaagaca

SEQ ID NO: 283036 - RNA, 22 nt, Human
cacuuuauaugcauuaccucau

SEQ ID NO: 283037 - RNA, 22 nt, Human
cagggacaauggcagagccuga

SEQ ID NO: 283038 - RNA, 22 nt, Human
ggcaggcugggagucaucagag

SEQ ID NO: 283039 - RNA, 22 nt, Human
ggccugaucuuugacccucauc

SEQ ID NO: 283040 - RNA, 22 nt, Human
ugucuuuagaaagaagcagaca

SEQ ID NO: 283041 - RNA, 22 nt, Human
uacauguuuacuccaagucagg

SEQ ID NO: 283042 - RNA, 22 nt, Human
cuggcaggaagaggaaagguca

SEQ ID NO: 283043 - RNA, 22 nt, Human
aaauuauucucauguguuucuu

SEQ ID NO: 283044 - RNA, 22 nt, Human
agccuauuccaggaugagcuca

SEQ ID NO: 283045 - RNA, 22 nt, Human
ugcaaacagccuugaaagaggg

SEQ ID NO: 283046 - RNA, 22 nt, Human
ugggguccucucacuuggaggg

SEQ ID NO: 283047 - RNA, 22 nt, Human
guggcagugccguuugguucag

SEQ ID NO: 283048 - RNA, 22 nt, Human
uauuugauagagauaaaugaua

SEQ ID NO: 283049 - RNA, 22 nt, Human
uauuucauucuuuaucaggagc

SEQ ID NO: 283050 - RNA, 21 nt, Human
gcucuccagggccagcccagg

SEQ ID NO: 283051 - RNA, 22 nt, Human
uugaggagcaggaugggaggcu

SEQ ID NO: 283052 - RNA, 20 nt, Human
gcauguguauggaaggggga

SEQ ID NO: 283053 - RNA, 22 nt, Human
uuugggaacaaugaggaucuga

SEQ ID NO: 283054 - RNA, 22 nt, Human
gggggaugcucaggaggcugcu

SEQ ID NO: 283055 - RNA, 22 nt, Human
cuguccugauggugccacuggu

SEQ ID NO: 283056 - RNA, 17 nt, Human
auacaguuuauuuuaca

SEQ ID NO: 283057 - RNA, 22 nt, Human
acauucuugaagugaaguuuau

SEQ ID NO: 283058 - RNA, 22 nt, Human
cuugucuugcacacgguugcca

SEQ ID NO: 283059 - RNA, 22 nt, Human
aaggccaucuacuuacggaauu

SEQ ID NO: 283060 - RNA, 21 nt, Human
ucugccagcugaagaggugga

SEQ ID NO: 283061 - RNA, 22 nt, Human
aaauucaauuaacuuucaugcu

SEQ ID NO: 283062 - RNA, 22 nt, Human
ucuggcagaucuucccacguuu

SEQ ID NO: 283063 - RNA, 22 nt, Human
gacauguugaagaauauuugga

SEQ ID NO: 283064 - RNA, 22 nt, Human
auggcuggauuugauccauggg

SEQ ID NO: 283065 - RNA, 22 nt, Human
acuccagguuuuuucacugaag

SEQ ID NO: 283066 - RNA, 22 nt, Human
ugcucccaggcauucucuguug

SEQ ID NO: 283067 - RNA, 22 nt, Human
ccaggcccaggguacugaccaa

SEQ ID NO: 283068 - RNA, 22 nt, Human
agggaauucacuggaacgcccu

SEQ ID NO: 283069 - RNA, 22 nt, Human
acuucaaauuuucagaagaaau

SEQ ID NO: 283070 - RNA, 22 nt, Human
gacccagcuaaccaggugggga

SEQ ID NO: 283071 - RNA, 22 nt, Human
uccaguggcaccuuggcccuca

SEQ ID NO: 283072 - RNA, 22 nt, Human
ugaaggagaauuaauaggcauu

SEQ ID NO: 283073 - RNA, 22 nt, Human
acagguguagguacauuugcau

SEQ ID NO: 283074 - RNA, 22 nt, Human
aaagaaggaugggagaaauccu

SEQ ID NO: 283075 - RNA, 22 nt, Human
caugagauaauuuuucuccagu

SEQ ID NO: 283076 - RNA, 22 nt, Human
uggccaggccucuuggugccca

SEQ ID NO: 283077 - RNA, 22 nt, Human
ugguggcagcugagugucaggu

SEQ ID NO: 283078 - RNA, 22 nt, Human
gccuggguccacugaucaugcu

SEQ ID NO: 283079 - RNA, 22 nt, Human
cuucuuaaucccuuauauauuu

SEQ ID NO: 283080 - RNA, 22 nt, Human
auguaaauuguacugacacacg

SEQ ID NO: 283081 - RNA, 22 nt, Human
ggcaaaguuuucaucucauaac

SEQ ID NO: 283082 - RNA, 22 nt, Human
aauucccauuugcagaaaauca

SEQ ID NO: 283083 - RNA, 22 nt, Human
agugucugaucaguugacuaga

SEQ ID NO: 283084 - RNA, 22 nt, Human
cagggcagaacauauagauagu

SEQ ID NO: 283085 - RNA, 22 nt, Human
uauuagggaacugcaagacuaa

SEQ ID NO: 283086 - RNA, 22 nt, Human
uuccagaagccuccauauuacu

SEQ ID NO: 283087 - RNA, 22 nt, Human
ucccuucuggcagcagugugag

SEQ ID NO: 283088 - RNA, 22 nt, Human
auucagagcacuggguagaauu

SEQ ID NO: 283089 - RNA, 22 nt, Human
aagggcaggcacccacccucac

SEQ ID NO: 283090 - RNA, 19 nt, Human
uuuaaagugacugguauuu

SEQ ID NO: 283091 - RNA, 22 nt, Human
guggaggaaaagaaguugggug

SEQ ID NO: 283092 - RNA, 21 nt, Human
ucauuuuuauugcuaccuugc

SEQ ID NO: 283093 - RNA, 22 nt, Human
aaaacugaaccuugagaucuuu

SEQ ID NO: 283094 - RNA, 20 nt, Human
auguccagugacuggaccau

SEQ ID NO: 283095 - RNA, 22 nt, Human
uccaggaaagugggaugugugu

SEQ ID NO: 283096 - RNA, 22 nt, Human
ucuaacuugaacucaugacugu

SEQ ID NO: 283097 - RNA, 22 nt, Human
aguguguccagaaaucuguauu

SEQ ID NO: 283098 - RNA, 20 nt, Human
uccaggcagcucagaguguc

SEQ ID NO: 283099 - RNA, 22 nt, Human
ucacauucuagaauguuaucgu

SEQ ID NO: 283100 - RNA, 22 nt, Human
cucccaagauaaauaaggcagu

SEQ ID NO: 283101 - RNA, 22 nt, Human
gcaggcagaucaccugucagga

SEQ ID NO: 283102 - RNA, 22 nt, Human
uggcaaaguaucugucccagcu

SEQ ID NO: 283103 - RNA, 22 nt, Human
cuucaguuaguuucaugugagc

SEQ ID NO: 283104 - RNA, 22 nt, Human
guuacaaaggucauaaaagugu

SEQ ID NO: 283105 - RNA, 22 nt, Human
auuucaguagaaaaucuugauu

SEQ ID NO: 283106 - RNA, 22 nt, Human
ugccuaguaggguuguuguagg

SEQ ID NO: 283107 - RNA, 22 nt, Human
gacagaaggcaucuagggcacg

SEQ ID NO: 283108 - RNA, 17 nt, Human
ccaggagcgugggucuc

SEQ ID NO: 283109 - RNA, 22 nt, Human
cacaggugucucuaguagcguu

SEQ ID NO: 283110 - RNA, 22 nt, Human
aaauuucaguuaccuuuacguu

SEQ ID NO: 283111 - RNA, 22 nt, Human
ucagggcaucucuuaaguggug

SEQ ID NO: 283112 - RNA, 22 nt, Human
auucucuuuguauaacaucuug

SEQ ID NO: 283113 - RNA, 22 nt, Human
cccaagagguggagguugcagu

SEQ ID NO: 283114 - RNA, 22 nt, Human
cagugagggcccccuuccaggu

SEQ ID NO: 283115 - RNA, 21 nt, Human
acucugaaaauuaauaguuau

SEQ ID NO: 283116 - RNA, 22 nt, Human
auuauuagugauguuguuacug

SEQ ID NO: 283117 - RNA, 20 nt, Human
ucuggcaggugaacgagcug

SEQ ID NO: 283118 - RNA, 22 nt, Human
acacauauauacauauuugugc

SEQ ID NO: 283119 - RNA, 22 nt, Human
ugucuucaucuccaugcacaga

SEQ ID NO: 283120 - RNA, 22 nt, Human
caugcagccugugaacaguguc

SEQ ID NO: 283121 - RNA, 18 nt, Human
caaauagcaugauguccu

SEQ ID NO: 283122 - RNA, 22 nt, Human
aaaagcagaucuccaaagucua

SEQ ID NO: 283123 - RNA, 22 nt, Human
uuugacucuugcccaguuuggc

SEQ ID NO: 283124 - RNA, 22 nt, Human
caaggcauuguguaagcacuug

SEQ ID NO: 283125 - RNA, 20 nt, Human
aauuagauguuuaaucaaua

SEQ ID NO: 283126 - RNA, 22 nt, Human
acuuuucuaagcaauggucuug

SEQ ID NO: 283127 - RNA, 22 nt, Human
auguaacacccacuuuuauagc

SEQ ID NO: 283128 - RNA, 22 nt, Human
uguguccugguguuaauuuuau

SEQ ID NO: 283129 - RNA, 22 nt, Human
ucagacaggccucuccagccuc

SEQ ID NO: 283130 - RNA, 21 nt, Human
ugcuuuaugggaaaaauguca

SEQ ID NO: 283131 - RNA, 22 nt, Human
auuuccaugaauucccacucau

SEQ ID NO: 283132 - RNA, 22 nt, Human
uucauaguguuuccuuccagug

SEQ ID NO: 283133 - RNA, 22 nt, Human
ggugccaggcuguagucagggu

SEQ ID NO: 283134 - RNA, 22 nt, Human
gguuucaaaguggacaguuagu

SEQ ID NO: 283135 - RNA, 22 nt, Human
acaagugugugcaguuuguaaa

SEQ ID NO: 283136 - RNA, 22 nt, Human
caguuaaaagaagucuaucuua

SEQ ID NO: 283137 - RNA, 23 nt, Human
cagcuuucagggcuuuagggaag

SEQ ID NO: 283138 - RNA, 22 nt, Human
uucacauuaagccuccuccuac

SEQ ID NO: 283139 - RNA, 22 nt, Human
cugaaggauuuaguucuuugcu

SEQ ID NO: 283140 - RNA, 22 nt, Human
cuuaaagaguauuuaauauaau

SEQ ID NO: 283141 - RNA, 22 nt, Human
aggcucugacgucacacguggc

SEQ ID NO: 283142 - RNA, 23 nt, Human
aaaaaaccauguaggcacucagu

SEQ ID NO: 283143 - RNA, 22 nt, Human
ucaagcugcaucagugcaguga

SEQ ID NO: 283144 - RNA, 22 nt, Human
uucuaacucuguuauguguuuc

SEQ ID NO: 283145 - RNA, 22 nt, Human
aauuugcaugaugagaacaaua

SEQ ID NO: 283146 - RNA, 22 nt, Human
uggugcagguguugaugcagga

SEQ ID NO: 283147 - RNA, 22 nt, Human
auuuacagaagcauguaauagc

SEQ ID NO: 283148 - RNA, 22 nt, Human
cuucucccugggggcucuuuau

SEQ ID NO: 283149 - RNA, 22 nt, Human
cuccagggaggagcacggguuc

SEQ ID NO: 283150 - RNA, 22 nt, Human
aggcccagcuggacaaacugcu

SEQ ID NO: 283151 - RNA, 22 nt, Human
auugcuuuguacaugccuagca

SEQ ID NO: 283152 - RNA, 22 nt, Human
uuuaagcuaaugucauaauuag

SEQ ID NO: 283153 - RNA, 22 nt, Human
acagcuuuuaugggaccagcca

SEQ ID NO: 283154 - RNA, 22 nt, Human
uuuuagcuguugauuguucccc

SEQ ID NO: 283155 - RNA, 22 nt, Human
agaaguuugguccuauaaacuc

SEQ ID NO: 283156 - RNA, 22 nt, Human
uuuauugacccaaagcgagagu

SEQ ID NO: 283157 - RNA, 22 nt, Human
uucaguuucguuaucuaugaga

SEQ ID NO: 283158 - RNA, 22 nt, Human
ggcaggugaucuagagucaaua

SEQ ID NO: 283159 - RNA, 22 nt, Human
ccaggccuagccccugagggua

SEQ ID NO: 283160 - RNA, 22 nt, Human
cugaaaaacgggauuuggcugg

SEQ ID NO: 283161 - RNA, 22 nt, Human
auguguccuuguucccauucca

SEQ ID NO: 283162 - RNA, 22 nt, Human
acacugcucacuucuucccuug

SEQ ID NO: 283163 - RNA, 22 nt, Human
cuguggcuggcucaucauaggu

SEQ ID NO: 283164 - RNA, 22 nt, Human
aaagauucgagcgauguauaaa

SEQ ID NO: 283165 - RNA, 22 nt, Human
ucagcuuuuuggauugcccaag

SEQ ID NO: 283166 - RNA, 22 nt, Human
ggaagaaaaugggcaacaggug

SEQ ID NO: 283167 - RNA, 22 nt, Human
cuuuaguuuaagaacaugauga

SEQ ID NO: 283168 - RNA, 22 nt, Human
uucuuucuuuguaguccugaac

SEQ ID NO: 283169 - RNA, 22 nt, Human
uccaggcaaagccuuguagacg

SEQ ID NO: 283170 - RNA, 22 nt, Human
uacagucucuuugagugauugu

SEQ ID NO: 283171 - RNA, 22 nt, Human
uguagaaagaauauguuucaua

SEQ ID NO: 283172 - RNA, 22 nt, Human
ccuggacucaggcugugggcac

SEQ ID NO: 283173 - RNA, 22 nt, Human
ccucccucccucuuaugguuua

SEQ ID NO: 283174 - RNA, 22 nt, Human
uccagaggggcagcccugugcu

SEQ ID NO: 283175 - RNA, 21 nt, Human
ucacguggucacaugagcuuu

SEQ ID NO: 283176 - RNA, 22 nt, Human
cuccaggccauggcugcggagg

SEQ ID NO: 283177 - RNA, 22 nt, Human
aguucaguaguccuucauugua

SEQ ID NO: 283178 - RNA, 22 nt, Human
cacagguggcuucuuucaucuu

SEQ ID NO: 283179 - RNA, 22 nt, Human
agcugugugcccaugguggagg

SEQ ID NO: 283180 - RNA, 22 nt, Human
gcaaaaaaugcuuguugcuuag

SEQ ID NO: 283181 - RNA, 22 nt, Human
ugcuuaaaauaguucauuuuug

SEQ ID NO: 283182 - RNA, 22 nt, Human
cagcuuuccagagaccugcccc

SEQ ID NO: 283183 - RNA, 22 nt, Human
auaucaguaucuauguauuugu

SEQ ID NO: 283184 - RNA, 19 nt, Human
gcagagugggguggagggu

SEQ ID NO: 283185 - RNA, 22 nt, Human
ccuggcagaauauuaaagugca

SEQ ID NO: 283186 - RNA, 22 nt, Human
uuuccuuccaaaugcccgggag

SEQ ID NO: 283187 - RNA, 22 nt, Human
ccuccugggagagcacggaggg

SEQ ID NO: 283188 - RNA, 23 nt, Human
ugcaggugauuaauccaguuuca

SEQ ID NO: 283189 - RNA, 22 nt, Human
ucuauaaaacucaagagcaauu

SEQ ID NO: 283190 - RNA, 22 nt, Human
uuacagucagugaauggaaggg

SEQ ID NO: 283191 - RNA, 22 nt, Human
ucuguggcacgauugcacugca

SEQ ID NO: 283192 - RNA, 22 nt, Human
cuucuuuaccaagagauagagu

SEQ ID NO: 283193 - RNA, 22 nt, Human
gucacaggcaguaacuaggacc

SEQ ID NO: 283194 - RNA, 22 nt, Human
ucugaaauuuuaguuauagaaa

SEQ ID NO: 283195 - RNA, 22 nt, Human
caaaguccuagaacagugcuug

SEQ ID NO: 283196 - RNA, 22 nt, Human
auguuuuauauuuugcagcagu

SEQ ID NO: 283197 - RNA, 22 nt, Human
uugugcaauuuaaaaucuuccu

SEQ ID NO: 283198 - RNA, 22 nt, Human
cacaugaugguggaagccauag

SEQ ID NO: 283199 - RNA, 22 nt, Human
ucuaacuugugaguauagauga

SEQ ID NO: 283200 - RNA, 22 nt, Human
ugguaaaaaccgcaauuacauu

SEQ ID NO: 283201 - RNA, 22 nt, Human
ccagagagucgaugggggacac

SEQ ID NO: 283202 - RNA, 22 nt, Human
cauuuuacugacucuugaauua

SEQ ID NO: 283203 - RNA, 22 nt, Human
uccagagagaaaaacaagcuuu

SEQ ID NO: 283204 - RNA, 22 nt, Human
auguccucaaaacugauugcag

SEQ ID NO: 283205 - RNA, 22 nt, Human
ucuuuacacaagacaagaauaa

SEQ ID NO: 283206 - RNA, 21 nt, Human
cacauuccaugggucuauuua

SEQ ID NO: 283207 - RNA, 22 nt, Human
acaggcaggcuucggccagagc

SEQ ID NO: 283208 - RNA, 22 nt, Human
auacacauauauacacguuuaa

SEQ ID NO: 283209 - RNA, 22 nt, Human
gaaugaagcaggucacacaguu

SEQ ID NO: 283210 - RNA, 22 nt, Human
uagagucagagaaucauuacag

SEQ ID NO: 283211 - RNA, 22 nt, Human
gguucccggaucuccgaguccc

SEQ ID NO: 283212 - RNA, 22 nt, Human
auuuuacuuugugaauauugac

SEQ ID NO: 283213 - RNA, 22 nt, Human
cacaguuucaauaauuauucuu

SEQ ID NO: 283214 - RNA, 22 nt, Human
uugcuggcaauuuagagauuuc

SEQ ID NO: 283215 - RNA, 22 nt, Human
ucuacaaagaagaauuaauguc

SEQ ID NO: 283216 - RNA, 23 nt, Human
uccucccaaauuucagccucauu

SEQ ID NO: 283217 - RNA, 21 nt, Human
agcaacucugacuagaugagg

SEQ ID NO: 283218 - RNA, 22 nt, Human
gcacacuuaauacucacugugc

SEQ ID NO: 283219 - RNA, 22 nt, Human
ucucuuaaaagauuuuaaugac

SEQ ID NO: 283220 - RNA, 21 nt, Human
uuucugaaggcaacaucuauc

SEQ ID NO: 283221 - RNA, 22 nt, Human
caaguuuugauuuugcaguaaa

SEQ ID NO: 283222 - RNA, 22 nt, Human
cacagccuuacugagauccacu

SEQ ID NO: 283223 - RNA, 22 nt, Human
uuucagaaagcugaacauauga

SEQ ID NO: 283224 - RNA, 22 nt, Human
uucuuuaucaguuacucauagg

SEQ ID NO: 283225 - RNA, 22 nt, Human
cuggaggaccacagaagcuggu

SEQ ID NO: 283226 - RNA, 22 nt, Human
gaguuaauucgaauauucuagc

SEQ ID NO: 283227 - RNA, 22 nt, Human
ggcaggcaaggcagccugguga

SEQ ID NO: 283228 - RNA, 22 nt, Human
auccuggacaguuuccccuauu

SEQ ID NO: 283229 - RNA, 22 nt, Human
cugaagaggacgcagcagcaag

SEQ ID NO: 283230 - RNA, 22 nt, Human
cuggcugggagcgagcugcuca

SEQ ID NO: 283231 - RNA, 22 nt, Human
ugauuuuacuuagcaugauguu

SEQ ID NO: 283232 - RNA, 22 nt, Human
uuucuucucuaaucucaaugau

SEQ ID NO: 283233 - RNA, 22 nt, Human
uucuggauaugggagagggagc

SEQ ID NO: 283234 - RNA, 22 nt, Human
cagcuguccuuccuggugggcg

SEQ ID NO: 283235 - RNA, 22 nt, Human
ucuggagaaaguugaguuugug

SEQ ID NO: 283236 - RNA, 22 nt, Human
auuucuuucuggccacgguuuu

SEQ ID NO: 283237 - RNA, 22 nt, Human
cagagaaaaaauccugcucuca

SEQ ID NO: 283238 - RNA, 22 nt, Human
accaaggagaaggugcaagcuu

SEQ ID NO: 283239 - RNA, 19 nt, Human
gggcucucgagcaaccaac

SEQ ID NO: 283240 - RNA, 22 nt, Human
gagcuucauauguugcagagaa

SEQ ID NO: 283241 - RNA, 17 nt, Human
cuaaauacuugcguuuc

SEQ ID NO: 283242 - RNA, 22 nt, Human
ucucuucuauuugagacuauuu

SEQ ID NO: 283243 - RNA, 22 nt, Human
agaaguuguagguuugcauauu

SEQ ID NO: 283244 - RNA, 22 nt, Human
auuaagggccaauccuccagcc

SEQ ID NO: 283245 - RNA, 22 nt, Human
gucugcccugcugaucucaccc

SEQ ID NO: 283246 - RNA, 22 nt, Human
aggcacagauuuggggaaagca

SEQ ID NO: 283247 - RNA, 22 nt, Human
gcagcuuucuacuuccuacagc

SEQ ID NO: 283248 - RNA, 22 nt, Human
caguguauaaacuuuaacauag

SEQ ID NO: 283249 - RNA, 22 nt, Human
ccuuaggggugacagaaauacc

SEQ ID NO: 283250 - RNA, 22 nt, Human
cauguuuaauugcgauguuuga

SEQ ID NO: 283251 - RNA, 22 nt, Human
uccaggcacagaguuggucagu

SEQ ID NO: 283252 - RNA, 18 nt, Human
ucuguguucugucauugc

SEQ ID NO: 283253 - RNA, 22 nt, Human
uuuauugaacacuugcacuggc

SEQ ID NO: 283254 - RNA, 23 nt, Human
uuuguucaucauuagagucuagc

SEQ ID NO: 283255 - RNA, 23 nt, Human
aucauucuccaaucuggagcagg

SEQ ID NO: 283256 - RNA, 22 nt, Human
uuuuaguuuggauuucuaaagc

SEQ ID NO: 283257 - RNA, 22 nt, Human
cagaaagcgggaugcagcaugu

SEQ ID NO: 283258 - RNA, 22 nt, Human
gcagguguggagaguggucggg

SEQ ID NO: 283259 - RNA, 22 nt, Human
ccuggcucccugcacagggcuc

SEQ ID NO: 283260 - RNA, 22 nt, Human
auauuagggucucuaaauucua

SEQ ID NO: 283261 - RNA, 22 nt, Human
cagcuucuccggccuggugcgg

SEQ ID NO: 283262 - RNA, 21 nt, Human
gcaguuuauguaauaugcacu

SEQ ID NO: 283263 - RNA, 22 nt, Human
auuauuauuguugauguuaggg

SEQ ID NO: 283264 - RNA, 22 nt, Human
gccaggcauguccucugcagaa

SEQ ID NO: 283265 - RNA, 22 nt, Human
uagcacccaccucgugggguuu

SEQ ID NO: 283266 - RNA, 22 nt, Human
agggaagaagcugguaguaggu

SEQ ID NO: 283267 - RNA, 22 nt, Human
uaaauucagugaguaauuucug

SEQ ID NO: 283268 - RNA, 20 nt, Human
uuucuggguacucucccucu

SEQ ID NO: 283269 - RNA, 19 nt, Human
ggcauccagaacuaccagu

SEQ ID NO: 283270 - RNA, 21 nt, Human
ccuggcugcacaguugcuggu

SEQ ID NO: 283271 - RNA, 18 nt, Human
agauuuugagaaauacaa

SEQ ID NO: 283272 - RNA, 22 nt, Human
aaaugucaaggugauagaugca

SEQ ID NO: 283273 - RNA, 22 nt, Human
acagauuuuauuauucagguau

SEQ ID NO: 283274 - RNA, 22 nt, Human
uuacuaaguuuuaugcaacuua

SEQ ID NO: 283275 - RNA, 22 nt, Human
ccauuugugauguggcagcauc

SEQ ID NO: 283276 - RNA, 22 nt, Human
gucugucucccugugacugaga

SEQ ID NO: 283277 - RNA, 22 nt, Human
uauuaaagagagaaucaucauc

SEQ ID NO: 283278 - RNA, 22 nt, Human
ucuuugguugcacugcaggugu

SEQ ID NO: 283279 - RNA, 22 nt, Human
uacaccauuuucugcaguguuu

SEQ ID NO: 283280 - RNA, 22 nt, Human
ucuggcagugauuucugugauc

SEQ ID NO: 283281 - RNA, 22 nt, Human
ucaacuaacucuauuauuugaa

SEQ ID NO: 283282 - RNA, 22 nt, Human
uuuauacuccacucugcaagcg

SEQ ID NO: 283283 - RNA, 22 nt, Human
cagagucauugacuuccaggag

SEQ ID NO: 283284 - RNA, 22 nt, Human
ucccaggaauugaagccagugu

SEQ ID NO: 283285 - RNA, 22 nt, Human
aacuugaaacuguuccagaaaa

SEQ ID NO: 283286 - RNA, 22 nt, Human
aggcucagaggugagcaucugc

SEQ ID NO: 283287 - RNA, 22 nt, Human
cuccucaaggucucaggaauaa

SEQ ID NO: 283288 - RNA, 22 nt, Human
aggacacagugguggggaaaag

SEQ ID NO: 283289 - RNA, 22 nt, Human
cuucucagaggccagaagcuau

SEQ ID NO: 283290 - RNA, 22 nt, Human
aauguuaauucacagccaaaua

SEQ ID NO: 283291 - RNA, 22 nt, Human
uguuuucuagaaacaaugccua

SEQ ID NO: 283292 - RNA, 22 nt, Human
ccaggugggaggaaagcagaga

SEQ ID NO: 283293 - RNA, 22 nt, Human
gagggcagaaaauuaugcggug

SEQ ID NO: 283294 - RNA, 22 nt, Human
caugcuuuucaaucuaucuuaa

SEQ ID NO: 283295 - RNA, 22 nt, Human
ggaggccaaggcagguggaucg

SEQ ID NO: 283296 - RNA, 22 nt, Human
uagcuguccagugagucccuuu

SEQ ID NO: 283297 - RNA, 22 nt, Human
gcuggcagagacaagaagacua

SEQ ID NO: 283298 - RNA, 22 nt, Human
auuucucagcacuuccuaucuc

SEQ ID NO: 283299 - RNA, 22 nt, Human
cauuagggccaccauaacaaaa

SEQ ID NO: 283300 - RNA, 22 nt, Human
uccuguuuaggcuguggucugg

SEQ ID NO: 283301 - RNA, 22 nt, Human
aaggugucacuguuucuggccu

SEQ ID NO: 283302 - RNA, 22 nt, Human
accuguuuguguuuggacugca

SEQ ID NO: 283303 - RNA, 22 nt, Human
auuuccugcaggggcugguggg

SEQ ID NO: 283304 - RNA, 22 nt, Human
uuccugagucgccgagucuaug

SEQ ID NO: 283305 - RNA, 22 nt, Human
uuauuuugccacaggugaccuu

SEQ ID NO: 283306 - RNA, 22 nt, Human
uccuggcagcccgcaggugcug

SEQ ID NO: 283307 - RNA, 22 nt, Human
cccaggcugcguauccacaaua

SEQ ID NO: 283308 - RNA, 22 nt, Human
uagggcucugcucaucaguugu

SEQ ID NO: 283309 - RNA, 22 nt, Human
cagagacaggagugcucccagu

SEQ ID NO: 283310 - RNA, 20 nt, Human
uugauucaagggcugaugga

SEQ ID NO: 283311 - RNA, 22 nt, Human
gggcuuggcuggggccaccaga

SEQ ID NO: 283312 - RNA, 22 nt, Human
gggcagguacaagaugcuucuu

SEQ ID NO: 283313 - RNA, 22 nt, Human
cugaaggagaaggccacuguuc

SEQ ID NO: 283314 - RNA, 22 nt, Human
cauguuaauaugcauugaguac

SEQ ID NO: 283315 - RNA, 22 nt, Human
accaaggagccacauacaaccu

SEQ ID NO: 283316 - RNA, 22 nt, Human
ccuggcucugggaucuucgcuu

SEQ ID NO: 283317 - RNA, 22 nt, Human
aagucucuaagacugugccauc

SEQ ID NO: 283318 - RNA, 22 nt, Human
uuuuuuguagcaagcgcagaua

SEQ ID NO: 283319 - RNA, 22 nt, Human
acugcacuucacccugggugac

SEQ ID NO: 283320 - RNA, 21 nt, Human
ggcugguguuuagcugugaua

SEQ ID NO: 283321 - RNA, 22 nt, Human
cuccuacauaacccagcgaacu

SEQ ID NO: 283322 - RNA, 22 nt, Human
cagcuuuccccgugccucagcc

SEQ ID NO: 283323 - RNA, 19 nt, Human
ucuguggcuguggggagga

SEQ ID NO: 283324 - RNA, 22 nt, Human
uucugucuguaaacuucucaau

SEQ ID NO: 283325 - RNA, 22 nt, Human
cugcaaaauuguucuuugcucc

SEQ ID NO: 283326 - RNA, 22 nt, Human
uuacuuuggauggucaagaaag

SEQ ID NO: 283327 - RNA, 22 nt, Human
uuccugguuggauucugauuaa

SEQ ID NO: 283328 - RNA, 22 nt, Human
uguuuuggaacaaaagcuauuc

SEQ ID NO: 283329 - RNA, 22 nt, Human
uuuacaguuccaugugauaggc

SEQ ID NO: 283330 - RNA, 22 nt, Human
guggcaguucugugucucuugu

SEQ ID NO: 283331 - RNA, 22 nt, Human
guaaacaugcuguguacucagc

SEQ ID NO: 283332 - RNA, 22 nt, Human
auuacaaaagaagggagaaggu

SEQ ID NO: 283333 - RNA, 22 nt, Human
ucagcacuuugaagcagaagga

SEQ ID NO: 283334 - RNA, 22 nt, Human
uuuauugaguaucuacuaugug

SEQ ID NO: 283335 - RNA, 22 nt, Human
ugaacaaacugcauucuucacu

SEQ ID NO: 283336 - RNA, 23 nt, Human
guccagaacccaggcuggggugg

SEQ ID NO: 283337 - RNA, 22 nt, Human
aggcucucuagaaacugugccu

SEQ ID NO: 283338 - RNA, 22 nt, Human
acugugccuuucacuugcacuu

SEQ ID NO: 283339 - RNA, 22 nt, Human
ucuggcagggguucugcacuug

SEQ ID NO: 283340 - RNA, 22 nt, Human
ucuguacuuccuuuaaacuuua

SEQ ID NO: 283341 - RNA, 22 nt, Human
ggucucugacuuagagauggau

SEQ ID NO: 283342 - RNA, 17 nt, Human
auccuucuguucuuucu

SEQ ID NO: 283343 - RNA, 22 nt, Human
agucugcuuccuggagaacuca

SEQ ID NO: 283344 - RNA, 22 nt, Human
uaguacaacucacuugauuuua

SEQ ID NO: 283345 - RNA, 22 nt, Human
uauguacaaucagcaguucaua

SEQ ID NO: 283346 - RNA, 19 nt, Human
aggcaggugcagagguccc

SEQ ID NO: 283347 - RNA, 22 nt, Human
acaaaagugagugugucucaga

SEQ ID NO: 283348 - RNA, 22 nt, Human
uucuuaaaacuuauggacaggu

SEQ ID NO: 283349 - RNA, 22 nt, Human
caguccucucacucaggccuuu

SEQ ID NO: 283350 - RNA, 22 nt, Human
cagguucugaggauggugccug

SEQ ID NO: 283351 - RNA, 22 nt, Human
acagguguggggcugugguacu

SEQ ID NO: 283352 - RNA, 22 nt, Human
cugugucccagccaggauaaug

SEQ ID NO: 283353 - RNA, 22 nt, Human
acaagcuuugugauaguagaga

SEQ ID NO: 283354 - RNA, 19 nt, Human
uaguacaaaagcagccaua

SEQ ID NO: 283355 - RNA, 22 nt, Human
uuuauugcccuguaguacagga

SEQ ID NO: 283356 - RNA, 22 nt, Human
cuagggacagaaagaggguaga

SEQ ID NO: 283357 - RNA, 21 nt, Human
ccauucuuagucaagugucuc

SEQ ID NO: 283358 - RNA, 22 nt, Human
cucuaggggcuggucagcgucu

SEQ ID NO: 283359 - RNA, 22 nt, Human
uaaggcauaaggccagaggcua

SEQ ID NO: 283360 - RNA, 22 nt, Human
uaaaggcuuuuacaggagugca

SEQ ID NO: 283361 - RNA, 22 nt, Human
gguaaaaaucacaaauacuuua

SEQ ID NO: 283362 - RNA, 22 nt, Human
accugccuaucagcugccugcu

SEQ ID NO: 283363 - RNA, 22 nt, Human
uugcugggugcuauuaugaaca

SEQ ID NO: 283364 - RNA, 22 nt, Human
uggucaaggcuuggagauagua

SEQ ID NO: 283365 - RNA, 22 nt, Human
aguaaagcagaguugcaguaca

SEQ ID NO: 283366 - RNA, 22 nt, Human
gcaggugguccccguggagugg

SEQ ID NO: 283367 - RNA, 22 nt, Human
uguuugcuuacuuguaugcugc

SEQ ID NO: 283368 - RNA, 22 nt, Human
cugggacauauugcuaguguug

SEQ ID NO: 283369 - RNA, 21 nt, Human
gggcaggucucugaugucaac

SEQ ID NO: 283370 - RNA, 22 nt, Human
cuuuuuguguaugcuacaguug

SEQ ID NO: 283371 - RNA, 22 nt, Human
gagggcuccauuccccgugccc

SEQ ID NO: 283372 - RNA, 22 nt, Human
cauuuguugguugcugucuuau

SEQ ID NO: 283373 - RNA, 22 nt, Human
uagguucacugucuugaggagc

SEQ ID NO: 283374 - RNA, 23 nt, Human
auaguuuucccugguucuugcca

SEQ ID NO: 283375 - RNA, 22 nt, Human
uugguaaauccccuuacacaaa

SEQ ID NO: 283376 - RNA, 22 nt, Human
auauaaguuaguggucauguuu

SEQ ID NO: 283377 - RNA, 22 nt, Human
ugcaggugcguuuucaagccuc

SEQ ID NO: 283378 - RNA, 22 nt, Human
aaauuagucgguuuaggaauuu

SEQ ID NO: 283379 - RNA, 22 nt, Human
ucuguaguagguuguaguucuu

SEQ ID NO: 283380 - RNA, 22 nt, Human
aguccagugucaaggugccauu

SEQ ID NO: 283381 - RNA, 22 nt, Human
ucagguggcuuggagggggacg

SEQ ID NO: 283382 - RNA, 22 nt, Human
gggugggacucuuuggccugag

SEQ ID NO: 283383 - RNA, 22 nt, Human
uugaggaguggcgcuggacuua

SEQ ID NO: 283384 - RNA, 22 nt, Human
ucagggcagaauccaaagaauu

SEQ ID NO: 283385 - RNA, 22 nt, Human
aggcaagauuaggaccagaaga

SEQ ID NO: 283386 - RNA, 23 nt, Human
cuguggcccugcuucaugcagcc

SEQ ID NO: 283387 - RNA, 22 nt, Human
uggacaugagcugagugggugu

SEQ ID NO: 283388 - RNA, 22 nt, Human
uugacaauguccuuugaauuuc

SEQ ID NO: 283389 - RNA, 22 nt, Human
uugcuauuuugagagucauagu

SEQ ID NO: 283390 - RNA, 22 nt, Human
guguccugagugaggccuggcc

SEQ ID NO: 283391 - RNA, 20 nt, Human
cccagagccauagccagaca

SEQ ID NO: 283392 - RNA, 21 nt, Human
aggcucucauccagggaccca

SEQ ID NO: 283393 - RNA, 22 nt, Human
augcuauacauaugacaucaca

SEQ ID NO: 283394 - RNA, 21 nt, Human
uccuuccuugagguccuuucc

SEQ ID NO: 283395 - RNA, 22 nt, Human
gggagggauuaguucugccugg

SEQ ID NO: 283396 - RNA, 22 nt, Human
gggaccuggggacuccuuguuc

SEQ ID NO: 283397 - RNA, 22 nt, Human
gucugccccacaggcucaguug

SEQ ID NO: 283398 - RNA, 22 nt, Human
aguggcaucaacuuuaucugua

SEQ ID NO: 283399 - RNA, 22 nt, Human
uuaauagugcuaaaccauugac

SEQ ID NO: 283400 - RNA, 22 nt, Human
aguuuucacacucaccaaaagg

SEQ ID NO: 283401 - RNA, 22 nt, Human
acagauguacacucauauauaa

SEQ ID NO: 283402 - RNA, 22 nt, Human
ggcaaacaccaggcgagggagc

SEQ ID NO: 283403 - RNA, 22 nt, Human
ugucagcaucauuuguugaagg

SEQ ID NO: 283404 - RNA, 22 nt, Human
acaagauucaaugaauugauug

SEQ ID NO: 283405 - RNA, 22 nt, Human
cuuuacauuaauuucuacugau

SEQ ID NO: 283406 - RNA, 22 nt, Human
cugccugcaggacaccucgcua

SEQ ID NO: 283407 - RNA, 22 nt, Human
ucugagguggacgauggagccu

SEQ ID NO: 283408 - RNA, 21 nt, Human
ucuggcaguggucuuucaaau

SEQ ID NO: 283409 - RNA, 22 nt, Human
aauuauguagccauaugaaaca

SEQ ID NO: 283410 - RNA, 22 nt, Human
cucagucugucuugucuguguu

SEQ ID NO: 283411 - RNA, 21 nt, Human
aacuuguauuucuccuuauuc

SEQ ID NO: 283412 - RNA, 22 nt, Human
cacccagcuuuugcauccuccg

SEQ ID NO: 283413 - RNA, 21 nt, Human
ccuccaggagcagagcccuga

SEQ ID NO: 283414 - RNA, 22 nt, Human
ccacaaaacugugugucaaaga

SEQ ID NO: 283415 - RNA, 22 nt, Human
aacaaagucguugccuagaaga

SEQ ID NO: 283416 - RNA, 22 nt, Human
gcgagugccgagagggcagggc

SEQ ID NO: 283417 - RNA, 22 nt, Human
uaguauuuauaaucaugcuuaa

SEQ ID NO: 283418 - RNA, 22 nt, Human
uucuauugacauucacuguaac

SEQ ID NO: 283419 - RNA, 22 nt, Human
ugcuuuauuuuaaauaugccau

SEQ ID NO: 283420 - RNA, 22 nt, Human
augguaaauuuuaccuuaugua

SEQ ID NO: 283421 - RNA, 22 nt, Human
uaggaaugauuggaauuccagg

SEQ ID NO: 283422 - RNA, 22 nt, Human
cuuuuguuaggagaaaacauca

SEQ ID NO: 283423 - RNA, 22 nt, Human
agugcagugaugaauaaugguu

SEQ ID NO: 283424 - RNA, 22 nt, Human
ccagcauucacacugguuccuu

SEQ ID NO: 283425 - RNA, 22 nt, Human
cuugcaugcauuugaagaucau

SEQ ID NO: 283426 - RNA, 19 nt, Human
uucauucucuuauuguugu

SEQ ID NO: 283427 - RNA, 22 nt, Human
ccaaggcuucccagagaugcuc

SEQ ID NO: 283428 - RNA, 23 nt, Human
ccugacccugucucccucacaug

SEQ ID NO: 283429 - RNA, 22 nt, Human
aucugguuuuggcugugucccu

SEQ ID NO: 283430 - RNA, 22 nt, Human
uggcccagugcuuaugcucuga

SEQ ID NO: 283431 - RNA, 22 nt, Human
ugaaaaugcacgcuggaaagca

SEQ ID NO: 283432 - RNA, 22 nt, Human
ggggugugaguagagcugggga

SEQ ID NO: 283433 - RNA, 22 nt, Human
accuacaucaagggagugguag

SEQ ID NO: 283434 - RNA, 22 nt, Human
uuuagaaugugacuguauuuga

SEQ ID NO: 283435 - RNA, 22 nt, Human
caguucuuaauaccaugugguu

SEQ ID NO: 283436 - RNA, 22 nt, Human
aaucugucccuuaacuagucau

SEQ ID NO: 283437 - RNA, 22 nt, Human
uugaaguuguaguucagugaag

SEQ ID NO: 283438 - RNA, 22 nt, Human
cuacccuugccugccaggugac

SEQ ID NO: 283439 - RNA, 22 nt, Human
ucaaaaguuucacauagagaua

SEQ ID NO: 283440 - RNA, 22 nt, Human
uccagggagcaagucaggccgg

SEQ ID NO: 283441 - RNA, 22 nt, Human
aaguuugucgaaauuaucagca

SEQ ID NO: 283442 - RNA, 22 nt, Human
ggagcugagacccaguggcuga

SEQ ID NO: 283443 - RNA, 22 nt, Human
ccugggucccagccaggcuuug

SEQ ID NO: 283444 - RNA, 22 nt, Human
auauugagaugaggauauuaac

SEQ ID NO: 283445 - RNA, 22 nt, Human
acaaguaccaaaugcucaagua

SEQ ID NO: 283446 - RNA, 22 nt, Human
uguggggcuuacaaaggcagau

SEQ ID NO: 283447 - RNA, 22 nt, Human
uuccuuccuccuccaguucugg

SEQ ID NO: 283448 - RNA, 22 nt, Human
ggcuuuauguuuuucauguggu

SEQ ID NO: 283449 - RNA, 22 nt, Human
aaggugguugcaauuaccauaa

SEQ ID NO: 283450 - RNA, 22 nt, Human
uccugguggucugugcuucuuc

SEQ ID NO: 283451 - RNA, 22 nt, Human
cuucuucaauagcaagcgcaua

SEQ ID NO: 283452 - RNA, 22 nt, Human
gagccagaaaagcugccugacu

SEQ ID NO: 283453 - RNA, 22 nt, Human
agcccugucucucacuccaggu

SEQ ID NO: 283454 - RNA, 22 nt, Human
cugagguagccauggcccaagu

SEQ ID NO: 283455 - RNA, 22 nt, Human
cucccaagcugugcugaacugu

SEQ ID NO: 283456 - RNA, 22 nt, Human
aaguuuuugauucuaagagaga

SEQ ID NO: 283457 - RNA, 22 nt, Human
uagggaugaugucuaaaaucau

SEQ ID NO: 283458 - RNA, 22 nt, Human
augccccaggaggugccaucca

SEQ ID NO: 283459 - RNA, 22 nt, Human
aggcuuggcucuccuaugagaa

SEQ ID NO: 283460 - RNA, 22 nt, Human
ucuuccugcuuggugugucugg

SEQ ID NO: 283461 - RNA, 22 nt, Human
uuugcuuguucaagauuucugu

SEQ ID NO: 283462 - RNA, 19 nt, Human
ccagagacauuggcaucuu

SEQ ID NO: 283463 - RNA, 22 nt, Human
uuguacaaaugcauauuccugg

SEQ ID NO: 283464 - RNA, 22 nt, Human
ucaaaaauggucuuugagcugc

SEQ ID NO: 283465 - RNA, 22 nt, Human
ugaaaauggccugaagaagcaa

SEQ ID NO: 283466 - RNA, 22 nt, Human
uucuuguucuccucauuuagag

SEQ ID NO: 283467 - RNA, 22 nt, Human
ggcaggcauggggucugccauu

SEQ ID NO: 283468 - RNA, 22 nt, Human
cugccugcucuauccaggccug

SEQ ID NO: 283469 - RNA, 22 nt, Human
uugcuuuacggcaaggccccag

SEQ ID NO: 283470 - RNA, 22 nt, Human
uggcacagacagaucaggaguc

SEQ ID NO: 283471 - RNA, 22 nt, Human
cccucuccuggcugcauggagc

SEQ ID NO: 283472 - RNA, 22 nt, Human
uccuggcagagggcggccucga

SEQ ID NO: 283473 - RNA, 22 nt, Human
acaugauauuaaugucuuauuu

SEQ ID NO: 283474 - RNA, 21 nt, Human
uuucugucucugccacuaguu

SEQ ID NO: 283475 - RNA, 22 nt, Human
gggccagcucugugauguaggg

SEQ ID NO: 283476 - RNA, 22 nt, Human
aagaguuuaauuuugucuagac

SEQ ID NO: 283477 - RNA, 22 nt, Human
gcagggcaggauuugaacccag

SEQ ID NO: 283478 - RNA, 22 nt, Human
ggcaggugggaacccuccccac

SEQ ID NO: 283479 - RNA, 22 nt, Human
gauagucaccucccuuaacuuu

SEQ ID NO: 283480 - RNA, 22 nt, Human
cucuuccuuucccuugagggug

SEQ ID NO: 283481 - RNA, 22 nt, Human
aaagagggacaggcgcagacac

SEQ ID NO: 283482 - RNA, 22 nt, Human
aggagggcuaggaaaaccagga

SEQ ID NO: 283483 - RNA, 22 nt, Human
gauucuuuacucagauuuuguu

SEQ ID NO: 283484 - RNA, 22 nt, Human
gaaaugauuuuaguuuaucaug

SEQ ID NO: 283485 - RNA, 22 nt, Human
cauccaggcaccacaaccagcu

SEQ ID NO: 283486 - RNA, 22 nt, Human
gggugggaacaggaugccagga

SEQ ID NO: 283487 - RNA, 20 nt, Human
gggugugugcagggccuggu

SEQ ID NO: 283488 - RNA, 22 nt, Human
aucuuccuucacuuucucccac

SEQ ID NO: 283489 - RNA, 22 nt, Human
ccaugccccaauacaggacacc

SEQ ID NO: 283490 - RNA, 22 nt, Human
cuuuuugucucuguccugauga

SEQ ID NO: 283491 - RNA, 22 nt, Human
auguguuuauaauuacucaauc

SEQ ID NO: 283492 - RNA, 22 nt, Human
gcuuuaaugcuucguggggcca

SEQ ID NO: 283493 - RNA, 19 nt, Human
ggacagacgcagagaucug

SEQ ID NO: 283494 - RNA, 22 nt, Human
gggaaugugaaacaguaaggga

SEQ ID NO: 283495 - RNA, 22 nt, Human
agggcuccgggcaggcgaugga

SEQ ID NO: 283496 - RNA, 22 nt, Human
ucucuguggguuucaccagcgc

SEQ ID NO: 283497 - RNA, 22 nt, Human
uaauuuuaacugugcuguuugg

SEQ ID NO: 283498 - RNA, 22 nt, Human
uucaaagugcuuuuaaccuuua

SEQ ID NO: 283499 - RNA, 22 nt, Human
aucuuucuaugguacuuucucc

SEQ ID NO: 283500 - RNA, 22 nt, Human
uagguuuacugaauuaguggaa

SEQ ID NO: 283501 - RNA, 22 nt, Human
uuucuuaggcucuaaaaugacu

SEQ ID NO: 283502 - RNA, 22 nt, Human
guucuucaguucaggcuguuca

SEQ ID NO: 283503 - RNA, 22 nt, Human
gcugucaccaaagcaggcacug

SEQ ID NO: 283504 - RNA, 22 nt, Human
gagggaugguaguugacacuga

SEQ ID NO: 283505 - RNA, 22 nt, Human
cuggaugugguaaugacuuuga

SEQ ID NO: 283506 - RNA, 22 nt, Human
cagcaugaucccaguugauugc

SEQ ID NO: 283507 - RNA, 22 nt, Human
uccaggcaaaaggaacugcuug

SEQ ID NO: 283508 - RNA, 22 nt, Human
uuacaguaauguauuauuuaac

SEQ ID NO: 283509 - RNA, 22 nt, Human
ucucuuaggagaaauucauaaa

SEQ ID NO: 283510 - RNA, 22 nt, Human
caguuaaagugcuuaucacaga

SEQ ID NO: 283511 - RNA, 22 nt, Human
aacaugcaugaagaaguuauau

SEQ ID NO: 283512 - RNA, 22 nt, Human
acaguuuaggaugagagaacac

SEQ ID NO: 283513 - RNA, 22 nt, Human
uaggugucuguccugggcugug

SEQ ID NO: 283514 - RNA, 22 nt, Human
gcuuccagacgaucauguaaga

SEQ ID NO: 283515 - RNA, 22 nt, Human
aggggagacuggaaucuaacau

SEQ ID NO: 283516 - RNA, 22 nt, Human
acauguguggccgcuguagaca

SEQ ID NO: 283517 - RNA, 22 nt, Human
ggagcugaugguagaagaauga

SEQ ID NO: 283518 - RNA, 22 nt, Human
auaauauuuggauaggacagua

SEQ ID NO: 283519 - RNA, 22 nt, Human
uuuuacaguuccaugcaaagcg

SEQ ID NO: 283520 - RNA, 22 nt, Human
gcacccaguuugucucaggguu

SEQ ID NO: 283521 - RNA, 22 nt, Human
aagaaaacguuuugaggaguuu

SEQ ID NO: 283522 - RNA, 22 nt, Human
ggccccaggccuuuggucuggc

SEQ ID NO: 283523 - RNA, 22 nt, Human
aaacugucauuuuauauaguua

SEQ ID NO: 283524 - RNA, 22 nt, Human
uaggugguugucugcuuuccua

SEQ ID NO: 283525 - RNA, 22 nt, Human
uccaggcucuaggcugcucucc

SEQ ID NO: 283526 - RNA, 22 nt, Human
uguuauugagguuacuuauaag

SEQ ID NO: 283527 - RNA, 22 nt, Human
aaagcaagaugcauccgucaag

SEQ ID NO: 283528 - RNA, 22 nt, Human
gugcaaaagcaguugugguuuu

SEQ ID NO: 283529 - RNA, 22 nt, Human
agagugaaguucaucgugcagc

SEQ ID NO: 283530 - RNA, 22 nt, Human
guuuuugucgaguuccuugacc

SEQ ID NO: 283531 - RNA, 19 nt, Human
ccaggccugcgggcguugg

SEQ ID NO: 283532 - RNA, 22 nt, Human
cagagucagcuagucuugggau

SEQ ID NO: 283533 - RNA, 22 nt, Human
uucuuucugucaugguguacug

SEQ ID NO: 283534 - RNA, 22 nt, Human
acgucuucguuggcagagauuu

SEQ ID NO: 283535 - RNA, 22 nt, Human
ucaacaauaggauauagcaggu

SEQ ID NO: 283536 - RNA, 22 nt, Human
ccuggcaggcuggggacagugc

SEQ ID NO: 283537 - RNA, 22 nt, Human
cuucauuaaccaaaaugcaaua

SEQ ID NO: 283538 - RNA, 22 nt, Human
cccaggcagccccagaagcuug

SEQ ID NO: 283539 - RNA, 22 nt, Human
auucugggcgccuauggcugca

SEQ ID NO: 283540 - RNA, 22 nt, Human
uguaaauugaaggaaauuugug

SEQ ID NO: 283541 - RNA, 23 nt, Human
ccuccugggcacaggccugaugg

SEQ ID NO: 283542 - RNA, 22 nt, Human
uacaaagucagaauaacaggug

SEQ ID NO: 283543 - RNA, 22 nt, Human
agaagcacaccugaccucuagc

SEQ ID NO: 283544 - RNA, 22 nt, Human
ugcuggcugccagguucccugu

SEQ ID NO: 283545 - RNA, 22 nt, Human
acagagcugggaucugaaccca

SEQ ID NO: 283546 - RNA, 22 nt, Human
cuguggcuuuuccggggagccu

SEQ ID NO: 283547 - RNA, 22 nt, Human
ugcuagugugugagauguucaa

SEQ ID NO: 283548 - RNA, 22 nt, Human
ucccugcccucagugcacccgg

SEQ ID NO: 283549 - RNA, 22 nt, Human
uuagcuuuuaagugugcuacau

SEQ ID NO: 283550 - RNA, 22 nt, Human
cuggaggaggaagucuacaaug

SEQ ID NO: 283551 - RNA, 22 nt, Human
aaaaaucuaugacugcuucucc

SEQ ID NO: 283552 - RNA, 22 nt, Human
auguccaggaucuauccccaga

SEQ ID NO: 283553 - RNA, 22 nt, Human
auuaguaguaguuagcagccuc

SEQ ID NO: 283554 - RNA, 23 nt, Human
gagugcagaauagacaugcagug

SEQ ID NO: 283555 - RNA, 22 nt, Human
aucagagauuguaguaugugca

SEQ ID NO: 283556 - RNA, 22 nt, Human
uggcacagcccagagcucuuga

SEQ ID NO: 283557 - RNA, 22 nt, Human
auguuucaugacugagcaaaau

SEQ ID NO: 283558 - RNA, 22 nt, Human
cugcccaccacaccugcuccug

SEQ ID NO: 283559 - RNA, 20 nt, Human
uggagggauuguuggcaaau

SEQ ID NO: 283560 - RNA, 22 nt, Human
caguuaaauuuggcuguuuucu

SEQ ID NO: 283561 - RNA, 22 nt, Human
acuggcaguuugagaaugcauu

SEQ ID NO: 283562 - RNA, 22 nt, Human
gggcucucgauuagacccuggg

SEQ ID NO: 283563 - RNA, 22 nt, Human
acagugcauaaaaacaacuuuu

SEQ ID NO: 283564 - RNA, 22 nt, Human
aaacuucagugaaugacuuaug

SEQ ID NO: 283565 - RNA, 22 nt, Human
ugacccauggucugaucauagg

SEQ ID NO: 283566 - RNA, 21 nt, Human
ccugucuuggacugaggcacc

SEQ ID NO: 283567 - RNA, 22 nt, Human
uggagcugacucacaccagcua

SEQ ID NO: 283568 - RNA, 22 nt, Human
uaauuucaccguugcuagaaau

SEQ ID NO: 283569 - RNA, 22 nt, Human
uuguacaaagauuucacagcuc

SEQ ID NO: 283570 - RNA, 18 nt, Human
uacuguggaucagggguu

SEQ ID NO: 283571 - RNA, 20 nt, Human
agucucucccagaaugagca

SEQ ID NO: 283572 - RNA, 22 nt, Human
ggcacugggaaugcagugauga

SEQ ID NO: 283573 - RNA, 22 nt, Human
ucaguaauauucuuuaaaauac

SEQ ID NO: 283574 - RNA, 22 nt, Human
agcagggcagcugaugcgcacg

SEQ ID NO: 283575 - RNA, 22 nt, Human
cccaggcacauccacucuguga

SEQ ID NO: 283576 - RNA, 22 nt, Human
accuccuggcuuaucauggaca

SEQ ID NO: 283577 - RNA, 22 nt, Human
aggaaugugccuagccucccug

SEQ ID NO: 283578 - RNA, 22 nt, Human
acccagggaccccgcugacgcc

SEQ ID NO: 283579 - RNA, 22 nt, Human
aguuauuuaaaaugauuguccu

SEQ ID NO: 283580 - RNA, 22 nt, Human
uucugaggcauagaggaugaga

SEQ ID NO: 283581 - RNA, 22 nt, Human
uuguaagucacaccagggcagg

SEQ ID NO: 283582 - RNA, 22 nt, Human
gugugucccuacaacagcuuca

SEQ ID NO: 283583 - RNA, 22 nt, Human
ucuacauuccuuuuauaauauc

SEQ ID NO: 283584 - RNA, 22 nt, Human
gaucugaagauaugaaauauuu

SEQ ID NO: 283585 - RNA, 22 nt, Human
auugcugacucaauaauugaag

SEQ ID NO: 283586 - RNA, 23 nt, Human
acugagcauuaguauuuuuauaa

SEQ ID NO: 283587 - RNA, 22 nt, Human
cauaaucccccauuugugacau

SEQ ID NO: 283588 - RNA, 23 nt, Human
agcugcaagacucccugucugag

SEQ ID NO: 283589 - RNA, 22 nt, Human
cuucuucaguugcauguauugg

SEQ ID NO: 283590 - RNA, 22 nt, Human
gcuuuacugagaugacacaggg

SEQ ID NO: 283591 - RNA, 22 nt, Human
ccagcccuugcugaaggguggc

SEQ ID NO: 283592 - RNA, 22 nt, Human
aggcucuguuugcugugguacc

SEQ ID NO: 283593 - RNA, 22 nt, Human
uucaaguuuacuuugaaguuua

SEQ ID NO: 283594 - RNA, 22 nt, Human
cugcugccggcgagccucccuu

SEQ ID NO: 283595 - RNA, 22 nt, Human
gccuguuucuaaucucauuucu

SEQ ID NO: 283596 - RNA, 22 nt, Human
gcagguggggcugcuaccagaa

SEQ ID NO: 283597 - RNA, 23 nt, Human
gcugugcacgagccacugccugu

SEQ ID NO: 283598 - RNA, 22 nt, Human
auguuaaaagucugagugggag

SEQ ID NO: 283599 - RNA, 22 nt, Human
aagaauguucuuguagucauga

SEQ ID NO: 283600 - RNA, 22 nt, Human
gcaaacaugugcucauuuugug

SEQ ID NO: 283601 - RNA, 22 nt, Human
aaaucucaggccucuauuuacu

SEQ ID NO: 283602 - RNA, 22 nt, Human
gaagaaagauuggcaugcuuca

SEQ ID NO: 283603 - RNA, 22 nt, Human
cucaggaggccauucucaaggu

SEQ ID NO: 283604 - RNA, 22 nt, Human
cuccugcaugguugugcuauug

SEQ ID NO: 283605 - RNA, 22 nt, Human
uuauuauagauuaugcaagauu

SEQ ID NO: 283606 - RNA, 22 nt, Human
agagccaaggcugagagcuauu

SEQ ID NO: 283607 - RNA, 22 nt, Human
uuuaaauuuguguuuagagggu

SEQ ID NO: 283608 - RNA, 22 nt, Human
cccagcugauuuuugcagagau

SEQ ID NO: 283609 - RNA, 20 nt, Human
augcaucugguaucuuuccu

SEQ ID NO: 283610 - RNA, 20 nt, Human
gucuuuauguuuuaugaccu

SEQ ID NO: 283611 - RNA, 21 nt, Human
ucuguuggaggccucucuucc

SEQ ID NO: 283612 - RNA, 22 nt, Human
guucuucaggcugugcucuaga

SEQ ID NO: 283613 - RNA, 22 nt, Human
auauguuuuuggaaagaacaca

SEQ ID NO: 283614 - RNA, 22 nt, Human
gggucucuccuccccagcugug

SEQ ID NO: 283615 - RNA, 22 nt, Human
cagcacaguacaaggcacggau

SEQ ID NO: 283616 - RNA, 22 nt, Human
aaccuuuugcaagugccuugac

SEQ ID NO: 283617 - RNA, 22 nt, Human
cuucuucccagcuucccucacc

SEQ ID NO: 283618 - RNA, 22 nt, Human
cuaggguggauuugugcagagu

SEQ ID NO: 283619 - RNA, 22 nt, Human
cagggaaaguucuuguccacuc

SEQ ID NO: 283620 - RNA, 19 nt, Human
cucagagaggggcagugcc

SEQ ID NO: 283621 - RNA, 22 nt, Human
cccaugagaccugguuuaaggc

SEQ ID NO: 283622 - RNA, 22 nt, Human
gcuguucaaaagccacaguuac

SEQ ID NO: 283623 - RNA, 22 nt, Human
gcugccacuuggucaugucaug

SEQ ID NO: 283624 - RNA, 22 nt, Human
gcaggcaggaaggacuaaguaa

SEQ ID NO: 283625 - RNA, 22 nt, Human
uugucauugggguuauuuguua

SEQ ID NO: 283626 - RNA, 20 nt, Human
aggaggaagaaagcacacug

SEQ ID NO: 283627 - RNA, 22 nt, Human
gcuguggccaacaaaccacuuu

SEQ ID NO: 283628 - RNA, 22 nt, Human
gguguccuucguccgcuggcau

SEQ ID NO: 283629 - RNA, 22 nt, Human
aggcacugacucaagggagcca

SEQ ID NO: 283630 - RNA, 22 nt, Human
aggcuggugcuuccuagggcag

SEQ ID NO: 283631 - RNA, 22 nt, Human
auugcuuucuuuggggaacugu

SEQ ID NO: 283632 - RNA, 22 nt, Human
ugccuacauuccuugcuuaugg

SEQ ID NO: 283633 - RNA, 22 nt, Human
uggcuggagcgcccuccucugc

SEQ ID NO: 283634 - RNA, 22 nt, Human
acuguucacagauuagucgaug

SEQ ID NO: 283635 - RNA, 22 nt, Human
uucaaaaugcacaaagggcuag

SEQ ID NO: 283636 - RNA, 23 nt, Human
uggcaaagcauucuuauaacagu

SEQ ID NO: 283637 - RNA, 22 nt, Human
uacagacaaagagcaugcggua

SEQ ID NO: 283638 - RNA, 22 nt, Human
uagaguccauuaaugcaaguuu

SEQ ID NO: 283639 - RNA, 22 nt, Human
gaggccuguagucauggaugua

SEQ ID NO: 283640 - RNA, 22 nt, Human
ccugagauuucauugucuggcc

SEQ ID NO: 283641 - RNA, 20 nt, Human
guaaaauauggucuuugggu

SEQ ID NO: 283642 - RNA, 22 nt, Human
agcugaaauucuuuguccucag

SEQ ID NO: 283643 - RNA, 22 nt, Human
gcuccuggugcaaaguuucuuc

SEQ ID NO: 283644 - RNA, 22 nt, Human
gcagguggagcaguagucuggu

SEQ ID NO: 283645 - RNA, 22 nt, Human
uuguguccuaacaucuaguuaa

SEQ ID NO: 283646 - RNA, 22 nt, Human
ucugggugucacuccugccugc

SEQ ID NO: 283647 - RNA, 22 nt, Human
augaugaaauuuucuaucaugu

SEQ ID NO: 283648 - RNA, 21 nt, Human
aaggcuggagaugcaggucug

SEQ ID NO: 283649 - RNA, 22 nt, Human
acagcaggcaugaaugacacug

SEQ ID NO: 283650 - RNA, 22 nt, Human
aggaccaacauagcagcagugg

SEQ ID NO: 283651 - RNA, 22 nt, Human
ucagugucccgucucuuaacuc

SEQ ID NO: 283652 - RNA, 22 nt, Human
gaagccucaacaucucugcguc

SEQ ID NO: 283653 - RNA, 22 nt, Human
uggcagguuaacuuacaacugu

SEQ ID NO: 283654 - RNA, 22 nt, Human
auuccacuccaauaagugucaa

SEQ ID NO: 283655 - RNA, 22 nt, Human
aaccugcauguuucuaaaagca

SEQ ID NO: 283656 - RNA, 22 nt, Human
uaaaagaucacuggcugcuuua

SEQ ID NO: 283657 - RNA, 22 nt, Human
acaaauguggacauggauaaug

SEQ ID NO: 283658 - RNA, 22 nt, Human
gucuucuuguuuugaaggaaau

SEQ ID NO: 283659 - RNA, 18 nt, Human
aggaaagaaaggcaggug

SEQ ID NO: 283660 - RNA, 22 nt, Human
gaagaaggaagaucaugcuuga

SEQ ID NO: 283661 - RNA, 22 nt, Human
guagaauauaugguuaguauug

SEQ ID NO: 283662 - RNA, 22 nt, Human
aaggcauaccugaauguuugug

SEQ ID NO: 283663 - RNA, 22 nt, Human
gcaggcagagguggaggagaca

SEQ ID NO: 283664 - RNA, 22 nt, Human
uuuguucuaacuucugcagaca

SEQ ID NO: 283665 - RNA, 22 nt, Human
agugugagaacggacuaauaaa

SEQ ID NO: 283666 - RNA, 22 nt, Human
ccauguguugagauuccagccu

SEQ ID NO: 283667 - RNA, 22 nt, Human
aacuuucagcaaguaauucugg

SEQ ID NO: 283668 - RNA, 22 nt, Human
acaaaaguguaggaauuccuua

SEQ ID NO: 283669 - RNA, 19 nt, Human
ccuguucuuggcugaggcu

SEQ ID NO: 283670 - RNA, 22 nt, Human
gcauguguugguuuaugcaugu

SEQ ID NO: 283671 - RNA, 22 nt, Human
uccuguuucaacccuuacacug

SEQ ID NO: 283672 - RNA, 22 nt, Human
cagacagggaccucgcuccaga

SEQ ID NO: 283673 - RNA, 22 nt, Human
uaagaaauuuaguuauagaaug

SEQ ID NO: 283674 - RNA, 22 nt, Human
aagcagguuaugaaauauagaa

SEQ ID NO: 283675 - RNA, 22 nt, Human
gcaggugucaguccccaaggug

SEQ ID NO: 283676 - RNA, 22 nt, Human
ucuggcucugacacuacuguua

SEQ ID NO: 283677 - RNA, 22 nt, Human
cagaugaggcaaccucauugcu

SEQ ID NO: 283678 - RNA, 22 nt, Human
uuccuucugaagccuuuguguu

SEQ ID NO: 283679 - RNA, 22 nt, Human
ucagcuuuggucacauugaguu

SEQ ID NO: 283680 - RNA, 22 nt, Human
ucaguuuaauacccagaugccu

SEQ ID NO: 283681 - RNA, 22 nt, Human
ugucuucaguaaaauacacuau

SEQ ID NO: 283682 - RNA, 22 nt, Human
cacaaggacuggauggaguggg

SEQ ID NO: 283683 - RNA, 22 nt, Human
ugucauuuuauguauguggucu

SEQ ID NO: 283684 - RNA, 22 nt, Human
ccauuugugguuuauuugcucu

SEQ ID NO: 283685 - RNA, 22 nt, Human
aggcuuggcugcacgccucgcu

SEQ ID NO: 283686 - RNA, 22 nt, Human
gaguaguugcugcagagaauac

SEQ ID NO: 283687 - RNA, 22 nt, Human
ucaacuuugaaaccauagugaa

SEQ ID NO: 283688 - RNA, 22 nt, Human
uaaacauguugacaucuuaccu

SEQ ID NO: 283689 - RNA, 22 nt, Human
ggccaggcugcccugggagcag

SEQ ID NO: 283690 - RNA, 22 nt, Human
ugcuucuuuaugauguaugauu

SEQ ID NO: 283691 - RNA, 20 nt, Human
ccuguucacugcgcaguuuc

SEQ ID NO: 283692 - RNA, 22 nt, Human
uuccuggcagaggccccgacag

SEQ ID NO: 283693 - RNA, 22 nt, Human
agcauuuagucuuuauugcagc

SEQ ID NO: 283694 - RNA, 22 nt, Human
cagaggcugacccugcuguugu

SEQ ID NO: 283695 - RNA, 22 nt, Human
ucugucuuuagaggccugugcu

SEQ ID NO: 283696 - RNA, 22 nt, Human
uguuuacaaggaguuuauauug

SEQ ID NO: 283697 - RNA, 22 nt, Human
ucuguugacuccuagcagccau

SEQ ID NO: 283698 - RNA, 17 nt, Human
uuucagauucacuuucu

SEQ ID NO: 283699 - RNA, 22 nt, Human
ugaaauucaaaacacauuuguc

SEQ ID NO: 283700 - RNA, 22 nt, Human
acaauauuguacccagaaguuu

SEQ ID NO: 283701 - RNA, 22 nt, Human
ugcauacacaagcauacaugua

SEQ ID NO: 283702 - RNA, 22 nt, Human
uucucccaucucagucuuacau

SEQ ID NO: 283703 - RNA, 19 nt, Human
auuguacauugaguuuggc

SEQ ID NO: 283704 - RNA, 22 nt, Human
guauucuugguuaucaaaauac

SEQ ID NO: 283705 - RNA, 22 nt, Human
uggauuaguuuaacaauguggc

SEQ ID NO: 283706 - RNA, 22 nt, Human
ggucacugagcuguaauucugu

SEQ ID NO: 283707 - RNA, 22 nt, Human
cuuggcugucauaagguccugg

SEQ ID NO: 283708 - RNA, 20 nt, Human
acccagcucugugcccuggg

SEQ ID NO: 283709 - RNA, 22 nt, Human
ccaggccuggccaggggaugcc

SEQ ID NO: 283710 - RNA, 22 nt, Human
gccagcauaguaagcagucauc

SEQ ID NO: 283711 - RNA, 22 nt, Human
uuguauguuucugugcacauga

SEQ ID NO: 283712 - RNA, 22 nt, Human
cauccagaguccaaggcugggc

SEQ ID NO: 283713 - RNA, 22 nt, Human
aaaugcuagggagaaacucucc

SEQ ID NO: 283714 - RNA, 22 nt, Human
uuuauuuaaagucguguguuaa

SEQ ID NO: 283715 - RNA, 22 nt, Human
uggccucaaucuguccuccagc

SEQ ID NO: 283716 - RNA, 22 nt, Human
aucuuucaguuucauaccaauu

SEQ ID NO: 283717 - RNA, 22 nt, Human
gaaggcuguuucugguagugau

SEQ ID NO: 283718 - RNA, 22 nt, Human
ucacacacauuugcugucugau

SEQ ID NO: 283719 - RNA, 22 nt, Human
ucuuuucuucuuaaugguuaau

SEQ ID NO: 283720 - RNA, 19 nt, Human
cacuuuauuucuguuuugu

SEQ ID NO: 283721 - RNA, 22 nt, Human
uucuggguuuacaucugacuuc

SEQ ID NO: 283722 - RNA, 22 nt, Human
gagccaccuucaacucaggaau

SEQ ID NO: 283723 - RNA, 22 nt, Human
uagacauuuucucaacaucucu

SEQ ID NO: 283724 - RNA, 22 nt, Human
ucuucuccaguucauccuacca

SEQ ID NO: 283725 - RNA, 22 nt, Human
cauaaguuggguaauauaauga

SEQ ID NO: 283726 - RNA, 22 nt, Human
acuguggcaaagaagcaggcuc

SEQ ID NO: 283727 - RNA, 22 nt, Human
gaggccuggcugggaggaggug

SEQ ID NO: 283728 - RNA, 22 nt, Human
uaacauuagguagacauaagcc

SEQ ID NO: 283729 - RNA, 22 nt, Human
acugaugaagaguaccacuguu

SEQ ID NO: 283730 - RNA, 22 nt, Human
ugcuccagugccugccccacag

SEQ ID NO: 283731 - RNA, 22 nt, Human
ugucauuuucauccuaaggagc

SEQ ID NO: 283732 - RNA, 22 nt, Human
uuacaaguacugaauaugauuu

SEQ ID NO: 283733 - RNA, 22 nt, Human
ugagaaaagguugagaugauaa

SEQ ID NO: 283734 - RNA, 22 nt, Human
uguuucuuacguuuuuagaggc

SEQ ID NO: 283735 - RNA, 22 nt, Human
uauguuuuuaagagaaugcauu

SEQ ID NO: 283736 - RNA, 22 nt, Human
gcaugcagaaaaugaacaacga

SEQ ID NO: 283737 - RNA, 22 nt, Human
aggaauguuuacacgacagaaa

SEQ ID NO: 283738 - RNA, 22 nt, Human
aaguuacagucagagguuaaca

SEQ ID NO: 283739 - RNA, 22 nt, Human
ccugcaccaggcccagcauggu

SEQ ID NO: 283740 - RNA, 22 nt, Human
gccuggcaggccugggccagca

SEQ ID NO: 283741 - RNA, 22 nt, Human
ugucauuuaauagauaugaugg

SEQ ID NO: 283742 - RNA, 22 nt, Human
guauuaggaaauaugaagaaag

SEQ ID NO: 283743 - RNA, 22 nt, Human
gaauggcugaaugucuuaaauu

SEQ ID NO: 283744 - RNA, 22 nt, Human
uuuuguguuguaaugucagcua

SEQ ID NO: 283745 - RNA, 22 nt, Human
cagagcaugucaacuagcuuua

SEQ ID NO: 283746 - RNA, 22 nt, Human
uaggagggggaacaaggcauac

SEQ ID NO: 283747 - RNA, 22 nt, Human
cacaauuuguuuuaucaguauu

SEQ ID NO: 283748 - RNA, 22 nt, Human
aggucucaauuccugcuccugu

SEQ ID NO: 283749 - RNA, 20 nt, Human
ucaaguuuugcuugacaaga

SEQ ID NO: 283750 - RNA, 22 nt, Human
ccaggcuucugauuccaggcac

SEQ ID NO: 283751 - RNA, 22 nt, Human
uucagcacuguuauggauuugc

SEQ ID NO: 283752 - RNA, 22 nt, Human
cuguguccugucuccuaaggug

SEQ ID NO: 283753 - RNA, 22 nt, Human
cugaggcagagggcagaccaga

SEQ ID NO: 283754 - RNA, 22 nt, Human
gagugcuugcauauuuauuguc

SEQ ID NO: 283755 - RNA, 22 nt, Human
ugauauuuaagcaaaaauaugg

SEQ ID NO: 283756 - RNA, 22 nt, Human
ugcaggugcagcgauacuguga

SEQ ID NO: 283757 - RNA, 22 nt, Human
ccuguucacugcacaguuuccg

SEQ ID NO: 283758 - RNA, 22 nt, Human
ccaggcugggcggggaaccugg

SEQ ID NO: 283759 - RNA, 22 nt, Human
uccuggcucgauugcuaccaau

SEQ ID NO: 283760 - RNA, 22 nt, Human
cuggguguuggguacugaccgu

SEQ ID NO: 283761 - RNA, 22 nt, Human
gacuguggucuguucuccaggu

SEQ ID NO: 283762 - RNA, 22 nt, Human
aacauucugguucuaaaaaccu

SEQ ID NO: 283763 - RNA, 22 nt, Human
aguuuaaaucauguuuuguaac

SEQ ID NO: 283764 - RNA, 22 nt, Human
uccagaccauggauggcugcaa

SEQ ID NO: 283765 - RNA, 22 nt, Human
gucuuucugccaugugaagaga

SEQ ID NO: 283766 - RNA, 22 nt, Human
gggcaaagugguggaggcaguu

SEQ ID NO: 283767 - RNA, 22 nt, Human
gaguuagaagacagaauguaaa

SEQ ID NO: 283768 - RNA, 22 nt, Human
ugcagggaugcuagagguaaga

SEQ ID NO: 283769 - RNA, 22 nt, Human
cauucauucacauuuugucuau

SEQ ID NO: 283770 - RNA, 22 nt, Human
uuuaguuauuguuacaguauga

SEQ ID NO: 283771 - RNA, 22 nt, Human
auucuucauuuacuguuacuug

SEQ ID NO: 283772 - RNA, 19 nt, Human
uuugcagugguuccuuugu

SEQ ID NO: 283773 - RNA, 22 nt, Human
ucuguauuuuaagaugcuguuu

SEQ ID NO: 283774 - RNA, 22 nt, Human
cagagacaaccugguagagaaa

SEQ ID NO: 283775 - RNA, 22 nt, Human
gacagguguguguauauuaggg

SEQ ID NO: 283776 - RNA, 22 nt, Human
uuucaguuguccuguuaauagc

SEQ ID NO: 283777 - RNA, 19 nt, Human
gcuucccaccagccagccc

SEQ ID NO: 283778 - RNA, 22 nt, Human
uauguagcaauagcaucauacu

SEQ ID NO: 283779 - RNA, 22 nt, Human
gauuuacaaagcucucuagugu

SEQ ID NO: 283780 - RNA, 18 nt, Human
acauuucuccuucugacc

SEQ ID NO: 283781 - RNA, 22 nt, Human
guggcagagauagaacuggaau

SEQ ID NO: 283782 - RNA, 22 nt, Human
agguggggcugggaaagauucc

SEQ ID NO: 283783 - RNA, 22 nt, Human
ucuggcuccugaguccaugcuc

SEQ ID NO: 283784 - RNA, 22 nt, Human
ucucucccaaaucugcagauag

SEQ ID NO: 283785 - RNA, 22 nt, Human
uauacacauaucuucuaggccu

SEQ ID NO: 283786 - RNA, 18 nt, Human
uggaggaaaaaucucaug

SEQ ID NO: 283787 - RNA, 22 nt, Human
cagcccugaaacaaccuccucu

SEQ ID NO: 283788 - RNA, 22 nt, Human
uaugaaaugauggggaaaauag

SEQ ID NO: 283789 - RNA, 22 nt, Human
aaauguaagucuuuguuucuua

SEQ ID NO: 283790 - RNA, 22 nt, Human
agcagguugugauacacucaga

SEQ ID NO: 283791 - RNA, 22 nt, Human
ggcaggugugagaucgaggcca

SEQ ID NO: 283792 - RNA, 22 nt, Human
gcaaagcaagauucagauguag

SEQ ID NO: 283793 - RNA, 22 nt, Human
guccaguguguuuaucuuggau

SEQ ID NO: 283794 - RNA, 22 nt, Human
ugacaaauucauauuucagagg

SEQ ID NO: 283795 - RNA, 22 nt, Human
agcuuugggauucaggcaggaa

SEQ ID NO: 283796 - RNA, 17 nt, Human
ugaaagaaucagggaga

SEQ ID NO: 283797 - RNA, 22 nt, Human
gugagcaggauuucauggugua

SEQ ID NO: 283798 - RNA, 22 nt, Human
uagaguaacacaaacgaauugg

SEQ ID NO: 283799 - RNA, 22 nt, Human
cugcaaaaguaauugcagguuu

SEQ ID NO: 283800 - RNA, 22 nt, Human
ucucagguggcccccaugagug

SEQ ID NO: 283801 - RNA, 22 nt, Human
agaaggaagccaggagggugca

SEQ ID NO: 283802 - RNA, 22 nt, Human
cccaggguggaugcaagcagca

SEQ ID NO: 283803 - RNA, 22 nt, Human
ugagccaggucucacucaccuu

SEQ ID NO: 283804 - RNA, 22 nt, Human
cccagagggaagggaaugaggu

SEQ ID NO: 283805 - RNA, 22 nt, Human
uuucauugaugggugauagaaa

SEQ ID NO: 283806 - RNA, 22 nt, Human
cuagagaacaacauucauaugg

SEQ ID NO: 283807 - RNA, 22 nt, Human
cacacaggaaaauuggaauuaa

SEQ ID NO: 283808 - RNA, 23 nt, Human
augcaggacuuauaagguaaggu

SEQ ID NO: 283809 - RNA, 22 nt, Human
guaaacaucagccacucuauuu

SEQ ID NO: 283810 - RNA, 22 nt, Human
uuucagaaaacuuaucaucagu

SEQ ID NO: 283811 - RNA, 22 nt, Human
aaguccuucccaagcauguacc

SEQ ID NO: 283812 - RNA, 22 nt, Human
uccaggcagagcaacaaaauau

SEQ ID NO: 283813 - RNA, 22 nt, Human
gccuggguuccaugaucuccag

SEQ ID NO: 283814 - RNA, 22 nt, Human
cuguugcucccagggagagggu

SEQ ID NO: 283815 - RNA, 22 nt, Human
cugggaggauucauugagguga

SEQ ID NO: 283816 - RNA, 22 nt, Human
aacugucuuauuuauauuucug

SEQ ID NO: 283817 - RNA, 22 nt, Human
caggugguuccauguuucauga

SEQ ID NO: 283818 - RNA, 22 nt, Human
uuuuauugguaaugauaaaagu

SEQ ID NO: 283819 - RNA, 22 nt, Human
ucagagaguccuggucauuugc

SEQ ID NO: 283820 - RNA, 22 nt, Human
acagguguaaaacccaggaugg

SEQ ID NO: 283821 - RNA, 20 nt, Human
cagaaagcauguuccagggc

SEQ ID NO: 283822 - RNA, 22 nt, Human
uggccuccccuaacagccucuu

SEQ ID NO: 283823 - RNA, 22 nt, Human
uuccuguguccuauuucgacuu

SEQ ID NO: 283824 - RNA, 22 nt, Human
ugacaggugaaauguccuuauu

SEQ ID NO: 283825 - RNA, 22 nt, Human
cugccugaguacaagucccaga

SEQ ID NO: 283826 - RNA, 22 nt, Human
auauucuuauccuuuucucugu

SEQ ID NO: 283827 - RNA, 22 nt, Human
acaacaaagacacuugaaauga

SEQ ID NO: 283828 - RNA, 22 nt, Human
ugggcaguggcugggccucucu

SEQ ID NO: 283829 - RNA, 22 nt, Human
aucauuuuauggcugagaggac

SEQ ID NO: 283830 - RNA, 22 nt, Human
caggugucagcagcacuguacu

SEQ ID NO: 283831 - RNA, 22 nt, Human
uagaaagcagaaaccaucagag

SEQ ID NO: 283832 - RNA, 22 nt, Human
caaauguaaauucuuuugaagc

SEQ ID NO: 283833 - RNA, 22 nt, Human
auuuaagauugcguauucaugu

SEQ ID NO: 283834 - RNA, 22 nt, Human
ugaaaaaccucaguccgcuuua

SEQ ID NO: 283835 - RNA, 22 nt, Human
gaacaaaucccuuccugucucc

SEQ ID NO: 283836 - RNA, 22 nt, Human
uacauguggccagaaauuugag

SEQ ID NO: 283837 - RNA, 22 nt, Human
ggaggcagaauagagugugggu

SEQ ID NO: 283838 - RNA, 22 nt, Human
cagcuuuauugagguauaauug

SEQ ID NO: 283839 - RNA, 23 nt, Human
ucauuccacaaauacuuaucuag

SEQ ID NO: 283840 - RNA, 22 nt, Human
ugccuugcacauaauauacauu

SEQ ID NO: 283841 - RNA, 17 nt, Human
uauacacagacagacug

SEQ ID NO: 283842 - RNA, 22 nt, Human
uuuauuuauaagccacuugcug

SEQ ID NO: 283843 - RNA, 22 nt, Human
aaugauuuggcaaaggaaucca

SEQ ID NO: 283844 - RNA, 22 nt, Human
gcccagggcagggcaagaguga

SEQ ID NO: 283845 - RNA, 22 nt, Human
gucuggcucuggaaggcaaagg

SEQ ID NO: 283846 - RNA, 22 nt, Human
uucaaacaguguagaauauaug

SEQ ID NO: 283847 - RNA, 22 nt, Human
ugucaaaaugacuuuacuacag

SEQ ID NO: 283848 - RNA, 22 nt, Human
ugagccagguuuuccaucauuc

SEQ ID NO: 283849 - RNA, 20 nt, Human
uucuaguuuggaguuauuaa

SEQ ID NO: 283850 - RNA, 22 nt, Human
uguacauacauagauauacaca

SEQ ID NO: 283851 - RNA, 22 nt, Human
uccuggagaauccugccaccug

SEQ ID NO: 283852 - RNA, 19 nt, Human
ccucaucuuggugugugca

SEQ ID NO: 283853 - RNA, 22 nt, Human
gagggcucuaccaaguaacucu

SEQ ID NO: 283854 - RNA, 22 nt, Human
uugggucuguuuagcugagaag

SEQ ID NO: 283855 - RNA, 20 nt, Human
gccaaggaggagaaacaggc

SEQ ID NO: 283856 - RNA, 23 nt, Human
guguguccauucgcacucuuagg

SEQ ID NO: 283857 - RNA, 22 nt, Human
cuggaagcuuguuugccagucu

SEQ ID NO: 283858 - RNA, 22 nt, Human
gcuuucagggucacugucaaca

SEQ ID NO: 283859 - RNA, 22 nt, Human
uuuacagaaugucaauuucuau

SEQ ID NO: 283860 - RNA, 22 nt, Human
uucugucucuguguuuacauua

SEQ ID NO: 283861 - RNA, 22 nt, Human
uuccagaacucaagaaaugccc

SEQ ID NO: 283862 - RNA, 22 nt, Human
aacaugugucuggcuagauugu

SEQ ID NO: 283863 - RNA, 22 nt, Human
cauaacaguggcuucagcaagu

SEQ ID NO: 283864 - RNA, 22 nt, Human
ccuggcagaaagaguuacaccu

SEQ ID NO: 283865 - RNA, 22 nt, Human
cuggaggaaaacaacugcagac

SEQ ID NO: 283866 - RNA, 19 nt, Human
ugacaagauaauagccuug

SEQ ID NO: 283867 - RNA, 22 nt, Human
acuggcuuugagggaauagcua

SEQ ID NO: 283868 - RNA, 22 nt, Human
cacuggaauauggcguugaacc

SEQ ID NO: 283869 - RNA, 22 nt, Human
cagaugcacauucucaucagca

SEQ ID NO: 283870 - RNA, 22 nt, Human
auaccuguguauccacaagcgu

SEQ ID NO: 283871 - RNA, 22 nt, Human
acaaagggggacugcagagggu

SEQ ID NO: 283872 - RNA, 22 nt, Human
agggcugcuuaccuggaauggc

SEQ ID NO: 283873 - RNA, 22 nt, Human
agucuuuacauguguuauauau

SEQ ID NO: 283874 - RNA, 19 nt, Human
ccuggaggugaagguucuc

SEQ ID NO: 283875 - RNA, 22 nt, Human
ugugccagccucuggcuguguc

SEQ ID NO: 283876 - RNA, 21 nt, Human
gcaggggauagaaauggucug

SEQ ID NO: 283877 - RNA, 22 nt, Human
uuucuaacagcaaauguuuauc

SEQ ID NO: 283878 - RNA, 19 nt, Human
ucaaaggcuuuuaggagac

SEQ ID NO: 283879 - RNA, 22 nt, Human
aaaguucuggagaaaauaauga

SEQ ID NO: 283880 - RNA, 22 nt, Human
uguuaaaaaugcagauuccuau

SEQ ID NO: 283881 - RNA, 22 nt, Human
ugaagggguucagcaugggggu

SEQ ID NO: 283882 - RNA, 19 nt, Human
aauagauuaauuauccucu

SEQ ID NO: 283883 - RNA, 22 nt, Human
gccuccggaguugcagugucuu

SEQ ID NO: 283884 - RNA, 22 nt, Human
ucuggcagcaagauaacaaugg

SEQ ID NO: 283885 - RNA, 22 nt, Human
caugaaugcuggguucauguaa

SEQ ID NO: 283886 - RNA, 22 nt, Human
cuuuauuccuacaagauuuucu

SEQ ID NO: 283887 - RNA, 22 nt, Human
uacauuccacaagcauugcuuu

SEQ ID NO: 283888 - RNA, 20 nt, Human
uaggugucuuugccagcuuu

SEQ ID NO: 283889 - RNA, 20 nt, Human
cuguggaauuuuaccaugcg

SEQ ID NO: 283890 - RNA, 22 nt, Human
uacacacagaggccaugggauu

SEQ ID NO: 283891 - RNA, 22 nt, Human
cuagggaccucagcuccuggag

SEQ ID NO: 283892 - RNA, 22 nt, Human
cucuucuuauggccguggcuga

SEQ ID NO: 283893 - RNA, 22 nt, Human
gcagggacgcagcacucuccgu

SEQ ID NO: 283894 - RNA, 22 nt, Human
ucccagggacaccaagcuguuu

SEQ ID NO: 283895 - RNA, 22 nt, Human
ucuggagaggggccuagaauuu

SEQ ID NO: 283896 - RNA, 22 nt, Human
uggcuucaagucuagguucuac

SEQ ID NO: 283897 - RNA, 21 nt, Human
gggugggguuccagccuuuuc

SEQ ID NO: 283898 - RNA, 22 nt, Human
aaagaaaccuaucagccacaug

SEQ ID NO: 283899 - RNA, 17 nt, Human
ucacugggccugcuccc

SEQ ID NO: 283900 - RNA, 22 nt, Human
ggagagcugacaucaugauguu

SEQ ID NO: 283901 - RNA, 22 nt, Human
uuuagggaauagaagaucugaa

SEQ ID NO: 283902 - RNA, 22 nt, Human
ugcaggugguccuuccucugcu

SEQ ID NO: 283903 - RNA, 22 nt, Human
cugguaaaugaugagaagcacc

SEQ ID NO: 283904 - RNA, 22 nt, Human
gaggccugaaaggggaccuaug

SEQ ID NO: 283905 - RNA, 22 nt, Human
aagucuuaaccaaauaaauguu

SEQ ID NO: 283906 - RNA, 22 nt, Human
ugcagaaauaacucauauugca

SEQ ID NO: 283907 - RNA, 22 nt, Human
gaaaauguuuguccggagcuga

SEQ ID NO: 283908 - RNA, 22 nt, Human
caguaaacacuagcauucuugg

SEQ ID NO: 283909 - RNA, 22 nt, Human
ucaaagcaucagucaauuuagg

SEQ ID NO: 283910 - RNA, 22 nt, Human
uccuggcuccuggagaccugcu

SEQ ID NO: 283911 - RNA, 22 nt, Human
aggcaggcccucuggaaaggua

SEQ ID NO: 283912 - RNA, 22 nt, Human
guuuauaaugucugugccaaaa

SEQ ID NO: 283913 - RNA, 22 nt, Human
cugagcaccccaggaccugcgc

SEQ ID NO: 283914 - RNA, 21 nt, Human
aucauucuggaaaauucaagc

SEQ ID NO: 283915 - RNA, 22 nt, Human
gugcaggguccuaauuguuaag

SEQ ID NO: 283916 - RNA, 22 nt, Human
uacuacaaggccgaagcucuca

SEQ ID NO: 283917 - RNA, 22 nt, Human
uucagcaaauggcuugagauaa

SEQ ID NO: 283918 - RNA, 22 nt, Human
uccugggucucuuccuuaguuc

SEQ ID NO: 283919 - RNA, 22 nt, Human
gaucaauacuauuaagaucaua

SEQ ID NO: 283920 - RNA, 22 nt, Human
acaggcaagaggaaagcaagua

SEQ ID NO: 283921 - RNA, 22 nt, Human
uuacuucuuacaaaagaaauau

SEQ ID NO: 283922 - RNA, 22 nt, Human
uuauuuaggagaaggaacccug

SEQ ID NO: 283923 - RNA, 23 nt, Human
gugacccaaggaccuuccagaau

SEQ ID NO: 283924 - RNA, 21 nt, Human
aggaauguguauauauacaau

SEQ ID NO: 283925 - RNA, 22 nt, Human
aaauuaacuaucacuuuuguga

SEQ ID NO: 283926 - RNA, 22 nt, Human
gcaggugguuaaggucccaugu

SEQ ID NO: 283927 - RNA, 20 nt, Human
ccuggcaggcggguuacuua

SEQ ID NO: 283928 - RNA, 22 nt, Human
aggagccauuuuccaagggcga

SEQ ID NO: 283929 - RNA, 22 nt, Human
acuguucauauucuuagaaauu

SEQ ID NO: 283930 - RNA, 22 nt, Human
cagguaaggucacauucugaag

SEQ ID NO: 283931 - RNA, 19 nt, Human
agaaucaucuugaagugau

SEQ ID NO: 283932 - RNA, 22 nt, Human
gaaccauuguugaaaagaauag

SEQ ID NO: 283933 - RNA, 22 nt, Human
aggcugugcaauuaggguaaga

SEQ ID NO: 283934 - RNA, 22 nt, Human
aggcugcuucaauggauaagau

SEQ ID NO: 283935 - RNA, 22 nt, Human
aaagcuuuucaguauguucaug

SEQ ID NO: 283936 - RNA, 22 nt, Human
uuuaauaucucacacuuccaug

SEQ ID NO: 283937 - RNA, 22 nt, Human
gcuaggcucggaagcagcaggg

SEQ ID NO: 283938 - RNA, 22 nt, Human
guuuuauuggaacacagccaug

SEQ ID NO: 283939 - RNA, 22 nt, Human
uccuggcaggucagcaggagca

SEQ ID NO: 283940 - RNA, 22 nt, Human
aaauauguaagauuagcacuag

SEQ ID NO: 283941 - RNA, 22 nt, Human
cauggcuuuuagcccuacauga

SEQ ID NO: 283942 - RNA, 22 nt, Human
acuguacuuuagaaaguguagu

SEQ ID NO: 283943 - RNA, 20 nt, Human
aacuuguucuaccuguuuca

SEQ ID NO: 283944 - RNA, 22 nt, Human
gaaucauuuagcucugcaugga

SEQ ID NO: 283945 - RNA, 22 nt, Human
cagagcacccaaggagcauuug

SEQ ID NO: 283946 - RNA, 22 nt, Human
uccacccugcuuuugucuuuga

SEQ ID NO: 283947 - RNA, 22 nt, Human
aaaguguuuuugagcuguaguu

SEQ ID NO: 283948 - RNA, 22 nt, Human
gacagacaggagcucacaggca

SEQ ID NO: 283949 - RNA, 22 nt, Human
uuucuggaaacggguucaagcu

SEQ ID NO: 283950 - RNA, 22 nt, Human
ccauguguucaauaagggaguu

SEQ ID NO: 283951 - RNA, 22 nt, Human
aguggcagguguuucguggugc

SEQ ID NO: 283952 - RNA, 22 nt, Human
ugggccaggucugugucagcug

SEQ ID NO: 283953 - RNA, 22 nt, Human
aauuucagagguagagauucua

SEQ ID NO: 283954 - RNA, 22 nt, Human
uauuccagaugaaaucauucag

SEQ ID NO: 283955 - RNA, 22 nt, Human
ucagagaguuuucacuagggug

SEQ ID NO: 283956 - RNA, 19 nt, Human
ugagccagggaggccaugc

SEQ ID NO: 283957 - RNA, 22 nt, Human
uucugucuucccacugaggagc

SEQ ID NO: 283958 - RNA, 22 nt, Human
cuguggaaauaaacaaugcuaa

SEQ ID NO: 283959 - RNA, 22 nt, Human
ugguuccacuaaccugagagcc

SEQ ID NO: 283960 - RNA, 22 nt, Human
agcucccagcuccuuugagaga

SEQ ID NO: 283961 - RNA, 22 nt, Human
cuuuuuguuguauaagcccuuu

SEQ ID NO: 283962 - RNA, 22 nt, Human
aauuuuacaaaauaccuccgau

SEQ ID NO: 283963 - RNA, 22 nt, Human
ucagacagagaaguacaaugag

SEQ ID NO: 283964 - RNA, 22 nt, Human
gacaagucaucuggggccugug

SEQ ID NO: 283965 - RNA, 18 nt, Human
augcuucugauagaagca

SEQ ID NO: 283966 - RNA, 23 nt, Human
gauugcuguaugcaggagcauuc

SEQ ID NO: 283967 - RNA, 22 nt, Human
ggcugcucaaggacucugaucg

SEQ ID NO: 283968 - RNA, 22 nt, Human
aguugcuggcaccugugaguau

SEQ ID NO: 283969 - RNA, 22 nt, Human
uggcugacaauguagcaguaac

SEQ ID NO: 283970 - RNA, 22 nt, Human
uuucagaugugugucucugaag

SEQ ID NO: 283971 - RNA, 22 nt, Human
uuuuggaacacagacauuagaa

SEQ ID NO: 283972 - RNA, 22 nt, Human
agguggggugagcugcagacua

SEQ ID NO: 283973 - RNA, 22 nt, Human
guacaaaaguuauugcgguuuu

SEQ ID NO: 283974 - RNA, 22 nt, Human
uaaugcuuaauuuucacaagcc

SEQ ID NO: 283975 - RNA, 22 nt, Human
uagaaagcugaguaauacauuu

SEQ ID NO: 283976 - RNA, 22 nt, Human
ucucccuggagcccugaagcau

SEQ ID NO: 283977 - RNA, 22 nt, Human
uggacaacauagugagaccuca

SEQ ID NO: 283978 - RNA, 22 nt, Human
aaggccagcccuaaugaugcuc

SEQ ID NO: 283979 - RNA, 22 nt, Human
gcuguggcuguacagagaccau

SEQ ID NO: 283980 - RNA, 22 nt, Human
auauuaaugggauuuagucagg

SEQ ID NO: 283981 - RNA, 22 nt, Human
aaaucaugaggacauuaugcca

SEQ ID NO: 283982 - RNA, 22 nt, Human
gguguccucacuauagcaaguc

SEQ ID NO: 283983 - RNA, 22 nt, Human
gacccagcuuaagucacauguu

SEQ ID NO: 283984 - RNA, 22 nt, Human
agugaaaacacuaguucuugcc

SEQ ID NO: 283985 - RNA, 22 nt, Human
aggucaaaaugcuuuucagguc

SEQ ID NO: 283986 - RNA, 22 nt, Human
uccccacacuuucacuccuggc

SEQ ID NO: 283987 - RNA, 22 nt, Human
ccagagagguagcuuacccucu

SEQ ID NO: 283988 - RNA, 22 nt, Human
cacuccagccucagugacagag

SEQ ID NO: 283989 - RNA, 19 nt, Human
cuucuucuuggcagccaag

SEQ ID NO: 283990 - RNA, 22 nt, Human
agaauacaguaugcaaaaagau

SEQ ID NO: 283991 - RNA, 22 nt, Human
agucaaagaagaugguuccaaa

SEQ ID NO: 283992 - RNA, 22 nt, Human
cccugcagaucagugagaacuu

SEQ ID NO: 283993 - RNA, 22 nt, Human
gccaggcagagccccgugcagc

SEQ ID NO: 283994 - RNA, 22 nt, Human
cugcagggugacguugcccacc

SEQ ID NO: 283995 - RNA, 22 nt, Human
cauuucaaugccuucaacauag

SEQ ID NO: 283996 - RNA, 22 nt, Human
gcagggcacagacagugccaag

SEQ ID NO: 283997 - RNA, 22 nt, Human
aggcagguuggggaaaagcacu

SEQ ID NO: 283998 - RNA, 22 nt, Human
aaauguguauaugaaacaugau

SEQ ID NO: 283999 - RNA, 22 nt, Human
gugcaaagugcauggggaaggg

SEQ ID NO: 284000 - RNA, 22 nt, Human
ugcaggcugcuggcaguagcuu

SEQ ID NO: 284001 - RNA, 22 nt, Human
cuggaauugcauaauauguccu

SEQ ID NO: 284002 - RNA, 22 nt, Human
uuagcuuuucacuugcauuauc

SEQ ID NO: 284003 - RNA, 22 nt, Human
aagugaugcuacgacuuugaca

SEQ ID NO: 284004 - RNA, 22 nt, Human
gauuaagagaaguuucuuaucg

SEQ ID NO: 284005 - RNA, 22 nt, Human
auugcuuuuccuuaacacaugc

SEQ ID NO: 284006 - RNA, 22 nt, Human
aggaguuauggcagaaucaaau

SEQ ID NO: 284007 - RNA, 22 nt, Human
auaaguuugucuuuguaaagau

SEQ ID NO: 284008 - RNA, 22 nt, Human
cuccuggcucgcccccagcuga

SEQ ID NO: 284009 - RNA, 22 nt, Human
gcagggcaaacccagguguuca

SEQ ID NO: 284010 - RNA, 22 nt, Human
uugugaguagugccgcaauaaa

SEQ ID NO: 284011 - RNA, 22 nt, Human
cacaguuucugaacacuuugca

SEQ ID NO: 284012 - RNA, 22 nt, Human
uaguuuacuguucacuuugccc

SEQ ID NO: 284013 - RNA, 22 nt, Human
uauuucagggagaauaaauuug

SEQ ID NO: 284014 - RNA, 22 nt, Human
agaggucagagcaggaaaggca

SEQ ID NO: 284015 - RNA, 22 nt, Human
acuuuauuuccuauugcaucca

SEQ ID NO: 284016 - RNA, 22 nt, Human
agugaggggcagcugagugggc

SEQ ID NO: 284017 - RNA, 22 nt, Human
uaggugucuaacaauaagugua

SEQ ID NO: 284018 - RNA, 22 nt, Human
uucuuuuaaugucuggcuuuca

SEQ ID NO: 284019 - RNA, 23 nt, Human
acuagaaaaugacuuucucccug

SEQ ID NO: 284020 - RNA, 20 nt, Human
ugauuucucuucuauuccuu

SEQ ID NO: 284021 - RNA, 22 nt, Human
uacagagaguacagcauccaca

SEQ ID NO: 284022 - RNA, 22 nt, Human
ccugagagggggcccuagaaau

SEQ ID NO: 284023 - RNA, 22 nt, Human
uuugacuccagagcccauuuuu

SEQ ID NO: 284024 - RNA, 22 nt, Human
acugucugcuggccccugguua

SEQ ID NO: 284025 - RNA, 22 nt, Human
ugauggaaauaaaagcauagcu

SEQ ID NO: 284026 - RNA, 22 nt, Human
agagggcuggacgcagguugga

SEQ ID NO: 284027 - RNA, 22 nt, Human
uaaugcuuuuccuucaaauaag

SEQ ID NO: 284028 - RNA, 19 nt, Human
ggggagaacuagagacagc

SEQ ID NO: 284029 - RNA, 22 nt, Human
uacauucagaagaauggacacg

SEQ ID NO: 284030 - RNA, 22 nt, Human
caguguucccugaacauauguu

SEQ ID NO: 284031 - RNA, 22 nt, Human
agauuucucuuucccuggcuga

SEQ ID NO: 284032 - RNA, 22 nt, Human
uauuuuacuuuaaagcgagaga

SEQ ID NO: 284033 - RNA, 19 nt, Human
ccuuccuccccagggccau

SEQ ID NO: 284034 - RNA, 22 nt, Human
auuucuguuugcuacuauaagu

SEQ ID NO: 284035 - RNA, 22 nt, Human
agucacauggacucaggaugac

SEQ ID NO: 284036 - RNA, 22 nt, Human
uggcccagggaguucauggugu

SEQ ID NO: 284037 - RNA, 22 nt, Human
caggauggucucgaucuccuga

SEQ ID NO: 284038 - RNA, 22 nt, Human
gagugaggcuggaaucauggcu

SEQ ID NO: 284039 - RNA, 23 nt, Human
auuuacagcugugugagcaaguu

SEQ ID NO: 284040 - RNA, 22 nt, Human
gaggagguggagucaugcagag

SEQ ID NO: 284041 - RNA, 22 nt, Human
auguuuguagguaagugacacu

SEQ ID NO: 284042 - RNA, 22 nt, Human
aagcugugaaaucucuagugca

SEQ ID NO: 284043 - RNA, 22 nt, Human
guggcagugggaugcuaucagg

SEQ ID NO: 284044 - RNA, 22 nt, Human
gucuagaauggaugagcauuuu

SEQ ID NO: 284045 - RNA, 22 nt, Human
ugcagggaaucuguggcuggac

SEQ ID NO: 284046 - RNA, 22 nt, Human
uuucuucucacccaggacagag

SEQ ID NO: 284047 - RNA, 22 nt, Human
gcuguggccgucagggaaaugg

SEQ ID NO: 284048 - RNA, 22 nt, Human
gcaggcagucaucuuucauauu

SEQ ID NO: 284049 - RNA, 22 nt, Human
uaaaaugacuuccuccaacauc

SEQ ID NO: 284050 - RNA, 22 nt, Human
auaguuuucuaugcacuguuau

SEQ ID NO: 284051 - RNA, 22 nt, Human
gcauucuuuagacugagagaua

SEQ ID NO: 284052 - RNA, 22 nt, Human
uuggcugagagcugcucugcag

SEQ ID NO: 284053 - RNA, 22 nt, Human
acuguucaaguuuuaugcugga

SEQ ID NO: 284054 - RNA, 22 nt, Human
agguggggaaaccagcgauccc

SEQ ID NO: 284055 - RNA, 22 nt, Human
auccaggcuuaaugggagccac

SEQ ID NO: 284056 - RNA, 22 nt, Human
aggcacaguggcccuguuuggg

SEQ ID NO: 284057 - RNA, 22 nt, Human
acagacuggaggagaauaguuu

SEQ ID NO: 284058 - RNA, 22 nt, Human
gcuauguucccuuuugcuauaa

SEQ ID NO: 284059 - RNA, 20 nt, Human
auguaaaagacagggaguag

SEQ ID NO: 284060 - RNA, 22 nt, Human
uuauuguuuacuaguuugcaga

SEQ ID NO: 284061 - RNA, 22 nt, Human
ucugacuugcaucuuaaaggag

SEQ ID NO: 284062 - RNA, 22 nt, Human
cuggaggagcauggacuggagu

SEQ ID NO: 284063 - RNA, 22 nt, Human
ccuggacaaugagaugucaggg

SEQ ID NO: 284064 - RNA, 22 nt, Human
uccuucaaagcuccuagugagc

SEQ ID NO: 284065 - RNA, 22 nt, Human
aaguaaaccacagagaagccac

SEQ ID NO: 284066 - RNA, 22 nt, Human
aagucucucugugugggauaag

SEQ ID NO: 284067 - RNA, 22 nt, Human
uaacuuuaguguaugagguaag

SEQ ID NO: 284068 - RNA, 20 nt, Human
aacacagauaccaaagguug

SEQ ID NO: 284069 - RNA, 22 nt, Human
uuccucaacaacuucccuacag

SEQ ID NO: 284070 - RNA, 22 nt, Human
uauuuuaaagugaagggucuug

SEQ ID NO: 284071 - RNA, 22 nt, Human
ugacaaagcaugauggugacag

SEQ ID NO: 284072 - RNA, 22 nt, Human
gagguucaguaaggaauacuga

SEQ ID NO: 284073 - RNA, 22 nt, Human
uccaggagguugagacugcagu

SEQ ID NO: 284074 - RNA, 22 nt, Human
agggaagaaucacugggauguu

SEQ ID NO: 284075 - RNA, 22 nt, Human
ugucacagagcgugcaacagaa

SEQ ID NO: 284076 - RNA, 22 nt, Human
aggcaaagcgauaccagagcua

SEQ ID NO: 284077 - RNA, 22 nt, Human
acuuccagugucugcugcuagc

SEQ ID NO: 284078 - RNA, 22 nt, Human
acacaugaaucacugguggaag

SEQ ID NO: 284079 - RNA, 22 nt, Human
agcauccaacuuugauuagaga

SEQ ID NO: 284080 - RNA, 22 nt, Human
uccuucuggaggcucuaagggg

SEQ ID NO: 284081 - RNA, 22 nt, Human
uaccucaaguuccaggaaagcg

SEQ ID NO: 284082 - RNA, 22 nt, Human
uaggugucagguauagaauuua

SEQ ID NO: 284083 - RNA, 22 nt, Human
cccugccuugggguccacaccg

SEQ ID NO: 284084 - RNA, 22 nt, Human
aggaaacuaauuaguagaauaa

SEQ ID NO: 284085 - RNA, 22 nt, Human
cagcauuuucuuaauguaggug

SEQ ID NO: 284086 - RNA, 22 nt, Human
auaaaagucugcuuauuugggc

SEQ ID NO: 284087 - RNA, 22 nt, Human
aggaaucagaauucuuagaauu

SEQ ID NO: 284088 - RNA, 22 nt, Human
uuuccauguguacuggccagaa

SEQ ID NO: 284089 - RNA, 22 nt, Human
agcagguggccuccugucuguc

SEQ ID NO: 284090 - RNA, 22 nt, Human
acacaugaggaaggccucaccc

SEQ ID NO: 284091 - RNA, 22 nt, Human
gauuuguuucaaguuagcaucu

SEQ ID NO: 284092 - RNA, 22 nt, Human
ugucucaucucuuaaccccacu

SEQ ID NO: 284093 - RNA, 22 nt, Human
cccagacauugcagggacuggu

SEQ ID NO: 284094 - RNA, 22 nt, Human
agaaagcacccugcacuuucug

SEQ ID NO: 284095 - RNA, 22 nt, Human
guuauugagguggagucucacu

SEQ ID NO: 284096 - RNA, 22 nt, Human
uccucaggaucuaggagugcuu

SEQ ID NO: 284097 - RNA, 23 nt, Human
cagaugagguuggcagcaugguc

SEQ ID NO: 284098 - RNA, 19 nt, Human
acauggcucuccagucugg

SEQ ID NO: 284099 - RNA, 22 nt, Human
uuccugagggccccagaggagg

SEQ ID NO: 284100 - RNA, 22 nt, Human
ugacagaccacugcaacucugu

SEQ ID NO: 284101 - RNA, 22 nt, Human
caauaauauccugugcuguuug

SEQ ID NO: 284102 - RNA, 22 nt, Human
agaggcuucucggauggggcag

SEQ ID NO: 284103 - RNA, 22 nt, Human
ucaaagagcuauucaguugugg

SEQ ID NO: 284104 - RNA, 18 nt, Human
ugagaggcuauuuuuugc

SEQ ID NO: 284105 - RNA, 22 nt, Human
uccaggagagguguggggacug

SEQ ID NO: 284106 - RNA, 22 nt, Human
augauucuggggcaaaagcugg

SEQ ID NO: 284107 - RNA, 22 nt, Human
aggaucaggcccucuaggguag

SEQ ID NO: 284108 - RNA, 22 nt, Human
uauguuuguuaucacaacuagg

SEQ ID NO: 284109 - RNA, 22 nt, Human
cauauuuauagaucuggcauuu

SEQ ID NO: 284110 - RNA, 22 nt, Human
gaauuuaaggaccaagcauuuu

SEQ ID NO: 284111 - RNA, 22 nt, Human
uuaauuuuaaccuguuuguguc

SEQ ID NO: 284112 - RNA, 22 nt, Human
uuugcugauauuuugcugauac

SEQ ID NO: 284113 - RNA, 23 nt, Human
uuuugacaggaggaagguguuga

SEQ ID NO: 284114 - RNA, 22 nt, Human
gggagcuguaagggacagguag

SEQ ID NO: 284115 - RNA, 20 nt, Human
agugacugggagaauggauu

SEQ ID NO: 284116 - RNA, 22 nt, Human
agacaggugcucgcccaagucc

SEQ ID NO: 284117 - RNA, 22 nt, Human
uacaugcauguguguaaauaua

SEQ ID NO: 284118 - RNA, 22 nt, Human
uuuaucuguuguacauuuaugc

SEQ ID NO: 284119 - RNA, 22 nt, Human
ugucucagguacaugcguccug

SEQ ID NO: 284120 - RNA, 22 nt, Human
uccaggcuagagugcaguggcc

SEQ ID NO: 284121 - RNA, 22 nt, Human
uuccucagcuguguccuggcga

SEQ ID NO: 284122 - RNA, 22 nt, Human
guagggacaugccauuaucuca

SEQ ID NO: 284123 - RNA, 22 nt, Human
cuuccagagauccaugaauacc

SEQ ID NO: 284124 - RNA, 22 nt, Human
ucauuucaaguucugacagcua

SEQ ID NO: 284125 - RNA, 23 nt, Human
uuucacagcuuuuauucugcauc

SEQ ID NO: 284126 - RNA, 22 nt, Human
acuucuuucacaauguuucuag

SEQ ID NO: 284127 - RNA, 22 nt, Human
auuaagacugcccauguuuuua

SEQ ID NO: 284128 - RNA, 22 nt, Human
acuugucuggcagaucaugcaa

SEQ ID NO: 284129 - RNA, 22 nt, Human
ugcagggaaaguguuggcagca

SEQ ID NO: 284130 - RNA, 22 nt, Human
aaacaaagcaucuugcuaugca

SEQ ID NO: 284131 - RNA, 22 nt, Human
aaaugucagaggaacauauuga

SEQ ID NO: 284132 - RNA, 22 nt, Human
ucccagccuuccagucugguuu

SEQ ID NO: 284133 - RNA, 22 nt, Human
uugcugaucugaaacguuacug

SEQ ID NO: 284134 - RNA, 22 nt, Human
ccaggagguggcaggacuugcc

SEQ ID NO: 284135 - RNA, 22 nt, Human
uucugucauccuuucuagaugu

SEQ ID NO: 284136 - RNA, 22 nt, Human
uaguuucuaaagcuuccuaggu

SEQ ID NO: 284137 - RNA, 20 nt, Human
uugauucccucuaaacucgc

SEQ ID NO: 284138 - RNA, 22 nt, Human
uugguacauuacaguuugauug

SEQ ID NO: 284139 - RNA, 23 nt, Human
uagggcagcugggagggacaugc

SEQ ID NO: 284140 - RNA, 22 nt, Human
uacaucuaucuagaugcucaga

SEQ ID NO: 284141 - RNA, 22 nt, Human
aguguggcugcguagggcucuc

SEQ ID NO: 284142 - RNA, 22 nt, Human
auuuaugauuagccuauuguug

SEQ ID NO: 284143 - RNA, 22 nt, Human
uguguguguuuacaguuucuca

SEQ ID NO: 284144 - RNA, 22 nt, Human
aauacauauggaauuccauguu

SEQ ID NO: 284145 - RNA, 22 nt, Human
agaugaaagauuuuuauagaga

SEQ ID NO: 284146 - RNA, 22 nt, Human
cacauucacuucucuguccacc

SEQ ID NO: 284147 - RNA, 22 nt, Human
auuuccuguaggggcuugcgaa

SEQ ID NO: 284148 - RNA, 22 nt, Human
auguccuuccugagaucccugu

SEQ ID NO: 284149 - RNA, 22 nt, Human
aauguuguuuuucugcaugucu

SEQ ID NO: 284150 - RNA, 21 nt, Human
uucaaaaugguguguuugucu

SEQ ID NO: 284151 - RNA, 22 nt, Human
uugcuuuaacuaguaaaugggg

SEQ ID NO: 284152 - RNA, 19 nt, Human
uccugcagaccagaccugu

SEQ ID NO: 284153 - RNA, 22 nt, Human
agugucaauucucaaaucucgg

SEQ ID NO: 284154 - RNA, 20 nt, Human
ucauuccaaauaguucagca

SEQ ID NO: 284155 - RNA, 22 nt, Human
ugcuguguaaaaggugauugaa

SEQ ID NO: 284156 - RNA, 22 nt, Human
agggaugauuucagugucugcc

SEQ ID NO: 284157 - RNA, 22 nt, Human
uugauacauuuuuaggauaaac

SEQ ID NO: 284158 - RNA, 20 nt, Human
ggcccagugaaccaggacgg

SEQ ID NO: 284159 - RNA, 22 nt, Human
ucucagguaagcuucuuugaug

SEQ ID NO: 284160 - RNA, 22 nt, Human
agaauauugaaaguucuugaca

SEQ ID NO: 284161 - RNA, 19 nt, Human
agaguauugaauuugcccu

SEQ ID NO: 284162 - RNA, 22 nt, Human
cucuucuugaaagaggaauuca

SEQ ID NO: 284163 - RNA, 22 nt, Human
ccuccuggccugugcagagccc

SEQ ID NO: 284164 - RNA, 22 nt, Human
cacaauguauauguauaucaaa

SEQ ID NO: 284165 - RNA, 22 nt, Human
ucaguguccggagccugagugc

SEQ ID NO: 284166 - RNA, 22 nt, Human
aauauaugugguauugaccagc

SEQ ID NO: 284167 - RNA, 22 nt, Human
gguuucaacuucaaccucucca

SEQ ID NO: 284168 - RNA, 22 nt, Human
ggagcugaguggguuuauugau

SEQ ID NO: 284169 - RNA, 22 nt, Human
ugggcagguuguuauuugacau

SEQ ID NO: 284170 - RNA, 22 nt, Human
uagaaaugaauguuuaaaaguc

SEQ ID NO: 284171 - RNA, 22 nt, Human
ucuuucuguaagcuccauggaa

SEQ ID NO: 284172 - RNA, 22 nt, Human
ucauguguugcacugaggaccu

SEQ ID NO: 284173 - RNA, 22 nt, Human
agggccaguaaauguuuccuca

SEQ ID NO: 284174 - RNA, 22 nt, Human
gagaggaacucccagugccugg

SEQ ID NO: 284175 - RNA, 22 nt, Human
uuccugugaagaucugggugcu

SEQ ID NO: 284176 - RNA, 19 nt, Human
gagacauguagauagaaga

SEQ ID NO: 284177 - RNA, 22 nt, Human
aggcaugacuuuggcugaagaa

SEQ ID NO: 284178 - RNA, 22 nt, Human
ugcuauauaauggaauuucuaa

SEQ ID NO: 284179 - RNA, 22 nt, Human
gcauacaaagguuuacaacuga

SEQ ID NO: 284180 - RNA, 20 nt, Human
ugacuucuucaugcuguacu

SEQ ID NO: 284181 - RNA, 19 nt, Human
ggcuucgaggcuggggaag

SEQ ID NO: 284182 - RNA, 22 nt, Human
aggccuccuggcuccaggccuu

SEQ ID NO: 284183 - RNA, 22 nt, Human
gauugagucugaggaugcugca

SEQ ID NO: 284184 - RNA, 22 nt, Human
ggcaggcaucaucaguugauca

SEQ ID NO: 284185 - RNA, 22 nt, Human
auugaaaaaugacuauugcuua

SEQ ID NO: 284186 - RNA, 22 nt, Human
ugcagggagcucuggggugcag

SEQ ID NO: 284187 - RNA, 22 nt, Human
uuucaaagaguuguaaauuacu

SEQ ID NO: 284188 - RNA, 22 nt, Human
caugcaaaggucaagaucagga

SEQ ID NO: 284189 - RNA, 22 nt, Human
gcaccugccugggacugaagau

SEQ ID NO: 284190 - RNA, 22 nt, Human
cuuguauuaggaagaaugcuuu

SEQ ID NO: 284191 - RNA, 23 nt, Human
aaccuagacuacuuacuaugugg

SEQ ID NO: 284192 - RNA, 22 nt, Human
caaucugaguugggaauguauu

SEQ ID NO: 284193 - RNA, 22 nt, Human
caagccuuggaaauccauucug

SEQ ID NO: 284194 - RNA, 22 nt, Human
ggucaaaguugaagaagggcau

SEQ ID NO: 284195 - RNA, 22 nt, Human
ggaugucuggucuauuucaagu

SEQ ID NO: 284196 - RNA, 22 nt, Human
agaaacaucauuggaacacaag

SEQ ID NO: 284197 - RNA, 18 nt, Human
acugaagaugcaagaccu

SEQ ID NO: 284198 - RNA, 22 nt, Human
ucauagaaauggaaaguauauu

SEQ ID NO: 284199 - RNA, 22 nt, Human
uccucuccauauuuucugauuu

SEQ ID NO: 284200 - RNA, 22 nt, Human
aggccagguuccucaaucuuga

SEQ ID NO: 284201 - RNA, 22 nt, Human
uuuucagugggcaaugauguga

SEQ ID NO: 284202 - RNA, 22 nt, Human
aauaaaauggucaguuuucuca

SEQ ID NO: 284203 - RNA, 22 nt, Human
cugaggcucccucgggucugcu

SEQ ID NO: 284204 - RNA, 23 nt, Human
aggcccugccugucccucuuuuu

SEQ ID NO: 284205 - RNA, 22 nt, Human
auauuauaaguuauuucaaguu

SEQ ID NO: 284206 - RNA, 22 nt, Human
cugccuggccacaacccagggu

SEQ ID NO: 284207 - RNA, 22 nt, Human
gugaggcaggcauucuccuuuc

SEQ ID NO: 284208 - RNA, 22 nt, Human
agaggggaaguaaugaaugaua

SEQ ID NO: 284209 - RNA, 22 nt, Human
acuaaagcucacagaguugaac

SEQ ID NO: 284210 - RNA, 22 nt, Human
cuuccuggcucggugccucacc

SEQ ID NO: 284211 - RNA, 22 nt, Human
aucagcaagcauuuauugagug

SEQ ID NO: 284212 - RNA, 22 nt, Human
cauaauccuugauucaaauaau

SEQ ID NO: 284213 - RNA, 22 nt, Human
uuucccaguucccugcucuaua

SEQ ID NO: 284214 - RNA, 22 nt, Human
caagaucuuccucaauagaccu

SEQ ID NO: 284215 - RNA, 22 nt, Human
ugaaagcagugccaugauuaug

SEQ ID NO: 284216 - RNA, 22 nt, Human
acuccuggggauccauuccuuu

SEQ ID NO: 284217 - RNA, 22 nt, Human
ucaaugauaguacaaucagccu

SEQ ID NO: 284218 - RNA, 22 nt, Human
ucugguaauaggcaauagcuug

SEQ ID NO: 284219 - RNA, 22 nt, Human
auaagguaaggguauugucaga

SEQ ID NO: 284220 - RNA, 22 nt, Human
aucaaaauggaagaauuuggcu

SEQ ID NO: 284221 - RNA, 22 nt, Human
uuucaggaaggugaggcacaug

SEQ ID NO: 284222 - RNA, 22 nt, Human
auuuauugaagcuuauuacguu

SEQ ID NO: 284223 - RNA, 22 nt, Human
ucugucuuugucaggaccagag

SEQ ID NO: 284224 - RNA, 22 nt, Human
ucccagggacugggcuaggcuu

SEQ ID NO: 284225 - RNA, 22 nt, Human
cuuuaagacucugcucuuggug

SEQ ID NO: 284226 - RNA, 22 nt, Human
gcccaguaguucaagguugcag

SEQ ID NO: 284227 - RNA, 22 nt, Human
uacacaguaaaugguaaauaca

SEQ ID NO: 284228 - RNA, 22 nt, Human
uguuucaggaccuaucuuuuag

SEQ ID NO: 284229 - RNA, 22 nt, Human
ucagcuuucucucgccaucagg

SEQ ID NO: 284230 - RNA, 23 nt, Human
gaggcagcuccugcagugcccug

SEQ ID NO: 284231 - RNA, 22 nt, Human
ucagguggagaccuccuuggcc

SEQ ID NO: 284232 - RNA, 21 nt, Human
cauuuacaugacagauugguu

SEQ ID NO: 284233 - RNA, 22 nt, Human
gcuuggcuugggcucagaggcc

SEQ ID NO: 284234 - RNA, 22 nt, Human
ggguggcacugauaaugagacg

SEQ ID NO: 284235 - RNA, 22 nt, Human
gggcaggggucaguggccccaa

SEQ ID NO: 284236 - RNA, 22 nt, Human
gcugucuuguauguuguaggac

SEQ ID NO: 284237 - RNA, 22 nt, Human
acugaggagaaauuugagugaa

SEQ ID NO: 284238 - RNA, 22 nt, Human
gccugaagaacagcugugagga

SEQ ID NO: 284239 - RNA, 22 nt, Human
aguguucacucuguggagccca

SEQ ID NO: 284240 - RNA, 22 nt, Human
accuuuauagcugauuaugaca

SEQ ID NO: 284241 - RNA, 22 nt, Human
acaaauuuggugagaguaaaua

SEQ ID NO: 284242 - RNA, 22 nt, Human
auguguuuguccugcagaaaua

SEQ ID NO: 284243 - RNA, 22 nt, Human
gccuguuuuugcuucguuuaag

SEQ ID NO: 284244 - RNA, 22 nt, Human
uuccaugaaggagacugagaag

SEQ ID NO: 284245 - RNA, 22 nt, Human
ggaagaaagguggacaacaggu

SEQ ID NO: 284246 - RNA, 22 nt, Human
auaaacugguaggaaaacagua

SEQ ID NO: 284247 - RNA, 22 nt, Human
ugcagggccccucugcaugagu

SEQ ID NO: 284248 - RNA, 22 nt, Human
cacagcugaaguagccaugugg

SEQ ID NO: 284249 - RNA, 22 nt, Human
guuucuuucuauugacugaaca

SEQ ID NO: 284250 - RNA, 22 nt, Human
ggaaagcuuuguuuuccucacc

SEQ ID NO: 284251 - RNA, 17 nt, Human
ucuccuggcucuaucag

SEQ ID NO: 284252 - RNA, 22 nt, Human
uucaguguggugcacaguuuug

SEQ ID NO: 284253 - RNA, 23 nt, Human
uuuuaauuuggacauaagaagau

SEQ ID NO: 284254 - RNA, 22 nt, Human
aagugccaucauagcauggcug

SEQ ID NO: 284255 - RNA, 22 nt, Human
guucacaucccagaaagagcau

SEQ ID NO: 284256 - RNA, 22 nt, Human
aguguccuggggcccuaaggcc

SEQ ID NO: 284257 - RNA, 22 nt, Human
agcaggagcugugggaagaugg

SEQ ID NO: 284258 - RNA, 22 nt, Human
aaggaggguucccagguccugg

SEQ ID NO: 284259 - RNA, 22 nt, Human
ugagauguaagguaugcuuacu

SEQ ID NO: 284260 - RNA, 22 nt, Human
ucugcaugaugaacaaaugagc

SEQ ID NO: 284261 - RNA, 22 nt, Human
gccugcagacguguuuuccuca

SEQ ID NO: 284262 - RNA, 22 nt, Human
ucugucuuagcaucuuugcuca

SEQ ID NO: 284263 - RNA, 22 nt, Human
uuuagaauguuagcguuaaagg

SEQ ID NO: 284264 - RNA, 23 nt, Human
uuaggcacuuaguagggccagag

SEQ ID NO: 284265 - RNA, 19 nt, Human
aggaggccaugccacuaga

SEQ ID NO: 284266 - RNA, 20 nt, Human
gcuguggcaaagcuuugugu

SEQ ID NO: 284267 - RNA, 22 nt, Human
cuuuacaauucaagggaacucu

SEQ ID NO: 284268 - RNA, 22 nt, Human
ucagggauugcaaaauucaucc

SEQ ID NO: 284269 - RNA, 20 nt, Human
ugcccagcaagagugcaguu

SEQ ID NO: 284270 - RNA, 22 nt, Human
uuaaaauuuccccaccauguau

SEQ ID NO: 284271 - RNA, 22 nt, Human
uguccugcaagcccuaaugaau

SEQ ID NO: 284272 - RNA, 22 nt, Human
gcagacagggcuacagagguac

SEQ ID NO: 284273 - RNA, 22 nt, Human
acauuucagauguaaugugaug

SEQ ID NO: 284274 - RNA, 22 nt, Human
uuucuucuugaguaaccagauu

SEQ ID NO: 284275 - RNA, 22 nt, Human
caauaauugcuuuccagaguua

SEQ ID NO: 284276 - RNA, 22 nt, Human
gcaaggaccuuugagcgugcca

SEQ ID NO: 284277 - RNA, 22 nt, Human
ugaugucuaguacauacaagag

SEQ ID NO: 284278 - RNA, 22 nt, Human
agucuagggugggguccacagg

SEQ ID NO: 284279 - RNA, 22 nt, Human
ugucagugucuaugaagaauuu

SEQ ID NO: 284280 - RNA, 22 nt, Human
agccaagaggagccuaaagcga

SEQ ID NO: 284281 - RNA, 22 nt, Human
gaagcuucguggcucuucaaau

SEQ ID NO: 284282 - RNA, 22 nt, Human
cauaauccuguccuggauucuu

SEQ ID NO: 284283 - RNA, 22 nt, Human
aaguagcauuuucaaaauguau

SEQ ID NO: 284284 - RNA, 18 nt, Human
ugcuggguaacuguaugg

SEQ ID NO: 284285 - RNA, 22 nt, Human
uauucacagcugccgcacucag

SEQ ID NO: 284286 - RNA, 22 nt, Human
caagauuuccaacccuggguaa

SEQ ID NO: 284287 - RNA, 22 nt, Human
auaugagagaggaaagauuuua

SEQ ID NO: 284288 - RNA, 22 nt, Human
ucacugggagaugugggaaggg

SEQ ID NO: 284289 - RNA, 22 nt, Human
uuucuuuguuguuaucacauca

SEQ ID NO: 284290 - RNA, 22 nt, Human
aguuucagaauuuaugcagaca

SEQ ID NO: 284291 - RNA, 22 nt, Human
auguauuugcuuguuauggauu

SEQ ID NO: 284292 - RNA, 22 nt, Human
aggccaggacacuuaaguaaga

SEQ ID NO: 284293 - RNA, 22 nt, Human
auuuugcacacuaugcagcuuu

SEQ ID NO: 284294 - RNA, 22 nt, Human
acuggcagggggagccccgaga

SEQ ID NO: 284295 - RNA, 22 nt, Human
guccugugugacuucccaaaug

SEQ ID NO: 284296 - RNA, 22 nt, Human
agcuccuggcaaggucauggug

SEQ ID NO: 284297 - RNA, 22 nt, Human
uagggaugacuaugauucccac

SEQ ID NO: 284298 - RNA, 22 nt, Human
ggucuccuugggaaagcaggaa

SEQ ID NO: 284299 - RNA, 23 nt, Human
ucaauuaucaauggaaagaaguu

SEQ ID NO: 284300 - RNA, 22 nt, Human
gggcuggaggagauccagaggc

SEQ ID NO: 284301 - RNA, 22 nt, Human
uguuuucauuugauguaacaaa

SEQ ID NO: 284302 - RNA, 22 nt, Human
uacauucauaugugugcauaca

SEQ ID NO: 284303 - RNA, 22 nt, Human
acaaauuuguguaguuauggca

SEQ ID NO: 284304 - RNA, 22 nt, Human
ugucauuuacuccauacccuca

SEQ ID NO: 284305 - RNA, 22 nt, Human
ccagggcaauuauuuggagggu

SEQ ID NO: 284306 - RNA, 22 nt, Human
cagaaaauaaaguuucuacgca

SEQ ID NO: 284307 - RNA, 21 nt, Human
ccugugccagucuauguguuc

SEQ ID NO: 284308 - RNA, 22 nt, Human
ucuguggcuuucuuauguugua

SEQ ID NO: 284309 - RNA, 22 nt, Human
uccuuccugcaggccaaguccu

SEQ ID NO: 284310 - RNA, 22 nt, Human
ucagagaaguaggcuaauggug

SEQ ID NO: 284311 - RNA, 22 nt, Human
uuugcagagugcagaagcaucu

SEQ ID NO: 284312 - RNA, 22 nt, Human
cugaaauucugccucugcacaa

SEQ ID NO: 284313 - RNA, 22 nt, Human
gcaucuaauccaguccagcauc

SEQ ID NO: 284314 - RNA, 22 nt, Human
ugccugccucuggcagcccugc

SEQ ID NO: 284315 - RNA, 22 nt, Human
auuucaaggcuauuaauauaaa

SEQ ID NO: 284316 - RNA, 22 nt, Human
acagcaggcaugaagaaauguu

SEQ ID NO: 284317 - RNA, 21 nt, Human
uaauaauuccacuacagagua

SEQ ID NO: 284318 - RNA, 22 nt, Human
auagccuugacucacagcucuu

SEQ ID NO: 284319 - RNA, 22 nt, Human
agcaggugggaucaagcuggca

SEQ ID NO: 284320 - RNA, 23 nt, Human
augggcuuagaaagcaaguggga

SEQ ID NO: 284321 - RNA, 22 nt, Human
cauuauugccagccauacugaa

SEQ ID NO: 284322 - RNA, 22 nt, Human
ucucuaggggagccccguuugu

SEQ ID NO: 284323 - RNA, 22 nt, Human
guaggcagggcuguggggagaa

SEQ ID NO: 284324 - RNA, 22 nt, Human
ggcucaggacugcagcguagag

SEQ ID NO: 284325 - RNA, 19 nt, Human
aggcuugguguugaauggg

SEQ ID NO: 284326 - RNA, 22 nt, Human
guacauuuacugaugaaaagua

SEQ ID NO: 284327 - RNA, 22 nt, Human
gcuccuggugcuguagagauuu

SEQ ID NO: 284328 - RNA, 22 nt, Human
uucuggcuuaguuguuguauau

SEQ ID NO: 284329 - RNA, 22 nt, Human
cugccuggcauagucuggucga

SEQ ID NO: 284330 - RNA, 22 nt, Human
uuauugagaccguaagucaggu

SEQ ID NO: 284331 - RNA, 22 nt, Human
auaaauuaugaauggcccuuuu

SEQ ID NO: 284332 - RNA, 22 nt, Human
auuuccauagagcgucucacag

SEQ ID NO: 284333 - RNA, 22 nt, Human
cauuugaaauaguucauucuug

SEQ ID NO: 284334 - RNA, 22 nt, Human
ucuggcuggcagugauggugug

SEQ ID NO: 284335 - RNA, 22 nt, Human
gcucccucccaccagccugcag

SEQ ID NO: 284336 - RNA, 22 nt, Human
ugaggugggcuuguggauuugc

SEQ ID NO: 284337 - RNA, 22 nt, Human
cuguuuucccuggaguucagca

SEQ ID NO: 284338 - RNA, 22 nt, Human
aucauuuuuaagagacucuucu

SEQ ID NO: 284339 - RNA, 22 nt, Human
cacagguguucuugcagugaaa

SEQ ID NO: 284340 - RNA, 22 nt, Human
aacuguggacuugagacugaug

SEQ ID NO: 284341 - RNA, 22 nt, Human
ccuguguuaguuaugggucucu

SEQ ID NO: 284342 - RNA, 22 nt, Human
acaugcauacacguacauaccu

SEQ ID NO: 284343 - RNA, 22 nt, Human
ugucucagcugugcuucauugg

SEQ ID NO: 284344 - RNA, 22 nt, Human
aagaaaggauauaugggaggua

SEQ ID NO: 284345 - RNA, 22 nt, Human
ugucugaagcagccagugcugu

SEQ ID NO: 284346 - RNA, 22 nt, Human
aacuggaaagaucaguaggaag

SEQ ID NO: 284347 - RNA, 22 nt, Human
uucaggcccaacgcacagcuuc

SEQ ID NO: 284348 - RNA, 22 nt, Human
uacagugcacauuucuuaggaa

SEQ ID NO: 284349 - RNA, 22 nt, Human
uggcccugguggcacagccugc

SEQ ID NO: 284350 - RNA, 22 nt, Human
ugaaaucaauugcaauguuuau

SEQ ID NO: 284351 - RNA, 22 nt, Human
cagaugaggacagaugacuggg

SEQ ID NO: 284352 - RNA, 18 nt, Human
uucuggcucacucaugcu

SEQ ID NO: 284353 - RNA, 22 nt, Human
auucagcaaugagcuuggauuu

SEQ ID NO: 284354 - RNA, 22 nt, Human
uacaguaccagaaaugcuaaga

SEQ ID NO: 284355 - RNA, 22 nt, Human
ucuucuccagugcuucugcaca

SEQ ID NO: 284356 - RNA, 22 nt, Human
gcuuucugauugcgaaaacaaa

SEQ ID NO: 284357 - RNA, 22 nt, Human
auucaacuuacaaaggagaaga

SEQ ID NO: 284358 - RNA, 22 nt, Human
guccuggugcuggucauugucg

SEQ ID NO: 284359 - RNA, 22 nt, Human
uguaaacauauguauguaugua

SEQ ID NO: 284360 - RNA, 22 nt, Human
cuggauggucccaugagcagcu

SEQ ID NO: 284361 - RNA, 22 nt, Human
uaaagguuuauucaacaaaaua

SEQ ID NO: 284362 - RNA, 22 nt, Human
uugguaaauaacaaucacagug

SEQ ID NO: 284363 - RNA, 22 nt, Human
agucucuccacauuguuauaaa

SEQ ID NO: 284364 - RNA, 22 nt, Human
caaaugaauagggagugugaug

SEQ ID NO: 284365 - RNA, 22 nt, Human
uguagcucuccagccagcaagg

SEQ ID NO: 284366 - RNA, 22 nt, Human
gccauguccugggcaucugcca

SEQ ID NO: 284367 - RNA, 22 nt, Human
gacauuaauggcaaauuaauua

SEQ ID NO: 284368 - RNA, 22 nt, Human
auucuggggcugguuauuuuga

SEQ ID NO: 284369 - RNA, 22 nt, Human
uuggguuuugauacaugucuaa

SEQ ID NO: 284370 - RNA, 22 nt, Human
aucuaaaaggagcucuuuaucu

SEQ ID NO: 284371 - RNA, 22 nt, Human
ucagggacugcagagggaagcu

SEQ ID NO: 284372 - RNA, 22 nt, Human
caauuucaucuugugcuucaau

SEQ ID NO: 284373 - RNA, 22 nt, Human
gagagcccugcauggcugauga

SEQ ID NO: 284374 - RNA, 17 nt, Human
uuaguguaucuguuuug

SEQ ID NO: 284375 - RNA, 22 nt, Human
caggcauagaagggcaagaaua

SEQ ID NO: 284376 - RNA, 22 nt, Human
uguguacacaaguauauauaca

SEQ ID NO: 284377 - RNA, 22 nt, Human
ccacccuaacaauccuuacugu

SEQ ID NO: 284378 - RNA, 22 nt, Human
acacaguugguggcucagucug

SEQ ID NO: 284379 - RNA, 22 nt, Human
agguacagaugaaagucuaguu

SEQ ID NO: 284380 - RNA, 22 nt, Human
auaagcauguuagaauauuuga

SEQ ID NO: 284381 - RNA, 22 nt, Human
gcagggaccucacuacccccag

SEQ ID NO: 284382 - RNA, 22 nt, Human
ccuggcaggcaagaggaaggga

SEQ ID NO: 284383 - RNA, 22 nt, Human
uauaaagaaggcacagcaagac

SEQ ID NO: 284384 - RNA, 22 nt, Human
uuuuuggcagcucagaaacuuc

SEQ ID NO: 284385 - RNA, 21 nt, Human
uccaaaucccauucuguaguc

SEQ ID NO: 284386 - RNA, 22 nt, Human
uccuucugaaaaaugcacacga

SEQ ID NO: 284387 - RNA, 22 nt, Human
uucuucaaccaucuacauaaac

SEQ ID NO: 284388 - RNA, 22 nt, Human
aaguguuuacuuaaagucaugg

SEQ ID NO: 284389 - RNA, 22 nt, Human
agcacuguaguuauagcuaaca

SEQ ID NO: 284390 - RNA, 22 nt, Human
ugcuguggcaguuuauguauag

SEQ ID NO: 284391 - RNA, 22 nt, Human
ccucaggauccgcaggugcagu

SEQ ID NO: 284392 - RNA, 21 nt, Human
cuggcauuaugauagcguccu

SEQ ID NO: 284393 - RNA, 20 nt, Human
agugauuuguuaguacauug

SEQ ID NO: 284394 - RNA, 22 nt, Human
uauuguacauuucaaaguagcu

SEQ ID NO: 284395 - RNA, 22 nt, Human
uccaggcagggcagccaucaag

SEQ ID NO: 284396 - RNA, 22 nt, Human
cugcacaggggaugagggcagu

SEQ ID NO: 284397 - RNA, 20 nt, Human
uauugaguaccuacuguaua

SEQ ID NO: 284398 - RNA, 22 nt, Human
aguagauuuuugaauguaaguu

SEQ ID NO: 284399 - RNA, 22 nt, Human
uccuggcccacuccuagcuucu

SEQ ID NO: 284400 - RNA, 22 nt, Human
gggagggucugagagcugcacc

SEQ ID NO: 284401 - RNA, 22 nt, Human
guccuggcugucuuauguugaa

SEQ ID NO: 284402 - RNA, 22 nt, Human
augaaaauguacauguguauaa

SEQ ID NO: 284403 - RNA, 22 nt, Human
uuggaggaggcauuggaggauu

SEQ ID NO: 284404 - RNA, 22 nt, Human
auguuacaacccugaggagccg

SEQ ID NO: 284405 - RNA, 19 nt, Human
uccuucuccggccaccccg

SEQ ID NO: 284406 - RNA, 22 nt, Human
ucaugcaguuacuguuaugcaa

SEQ ID NO: 284407 - RNA, 22 nt, Human
uugguaaauacuauaaucaaau

SEQ ID NO: 284408 - RNA, 22 nt, Human
accuacauggcuuuaaguaagu

SEQ ID NO: 284409 - RNA, 22 nt, Human
uagucagugaucaguggaguug

SEQ ID NO: 284410 - RNA, 21 nt, Human
ucccagggccaggugccauca

SEQ ID NO: 284411 - RNA, 22 nt, Human
gcuggcaguaaaggguuuggca

SEQ ID NO: 284412 - RNA, 22 nt, Human
gaauguuauugaacuacgagcu

SEQ ID NO: 284413 - RNA, 22 nt, Human
acuagaaaauuccuagaaacua

SEQ ID NO: 284414 - RNA, 22 nt, Human
ccugugggcuugaguguagggu

SEQ ID NO: 284415 - RNA, 22 nt, Human
uucuuuucaagaggggcaagga

SEQ ID NO: 284416 - RNA, 22 nt, Human
gugguaucugucucccccacug

SEQ ID NO: 284417 - RNA, 22 nt, Human
ccuuuucuacaagcaaaugugc

SEQ ID NO: 284418 - RNA, 23 nt, Human
uuccagaguccacaucugccacc

SEQ ID NO: 284419 - RNA, 22 nt, Human
agucacaguuucccugagagag

SEQ ID NO: 284420 - RNA, 22 nt, Human
cugugaaacuggacagcacuug

SEQ ID NO: 284421 - RNA, 22 nt, Human
ggcaggcagaggcugagacagg

SEQ ID NO: 284422 - RNA, 22 nt, Human
cuuaagcaaaauauucuuucac

SEQ ID NO: 284423 - RNA, 18 nt, Human
cuuuaugugcagagcuuu

SEQ ID NO: 284424 - RNA, 22 nt, Human
ggggugugucugacaaugguau

SEQ ID NO: 284425 - RNA, 22 nt, Human
uccuucuuugacaaguggcaga

SEQ ID NO: 284426 - RNA, 22 nt, Human
cuucuguggauauguucucucu

SEQ ID NO: 284427 - RNA, 22 nt, Human
accuguuuacccugggcucccc

SEQ ID NO: 284428 - RNA, 22 nt, Human
aggaggcugcaacccugaggcc

SEQ ID NO: 284429 - RNA, 22 nt, Human
gcaguguuaggaauaaaaauga

SEQ ID NO: 284430 - RNA, 22 nt, Human
cuaauacacccuauugcuuguu

SEQ ID NO: 284431 - RNA, 22 nt, Human
ucaugccaaacugaacacaguu

SEQ ID NO: 284432 - RNA, 22 nt, Human
ucuguuuagacucaguugaaac

SEQ ID NO: 284433 - RNA, 22 nt, Human
uuuaucuggacugugauauaaa

SEQ ID NO: 284434 - RNA, 22 nt, Human
acuguacauauggauucuaaga

SEQ ID NO: 284435 - RNA, 22 nt, Human
gcuauuuuugagccauuuauaa

SEQ ID NO: 284436 - RNA, 22 nt, Human
gcagguguggguggcugccagg

SEQ ID NO: 284437 - RNA, 22 nt, Human
gcaugguggccuuaggguagcc

SEQ ID NO: 284438 - RNA, 22 nt, Human
augugucucuaccaaugcaauu

SEQ ID NO: 284439 - RNA, 20 nt, Human
uuaagaaaagcacauccugc

SEQ ID NO: 284440 - RNA, 22 nt, Human
aagcugcaaaaaauuucugucu

SEQ ID NO: 284441 - RNA, 22 nt, Human
accugggaaagccguggaaagg

SEQ ID NO: 284442 - RNA, 21 nt, Human
uccuccuucaaguccuggccu

SEQ ID NO: 284443 - RNA, 22 nt, Human
uuuguucaccuagcaaacuuuu

SEQ ID NO: 284444 - RNA, 22 nt, Human
ccugagagugagggccuccuua

SEQ ID NO: 284445 - RNA, 22 nt, Human
ccaaaguauuaaaucuuagcaa

SEQ ID NO: 284446 - RNA, 22 nt, Human
uuacaguggucauuugggaaaa

SEQ ID NO: 284447 - RNA, 22 nt, Human
caugauguuaucuaaaucuggu

SEQ ID NO: 284448 - RNA, 22 nt, Human
uuaaggaaagccaaaaugaauu

SEQ ID NO: 284449 - RNA, 22 nt, Human
cagggcacggagaagucacccc

SEQ ID NO: 284450 - RNA, 22 nt, Human
ucuguggcuguuaucuuuauau

SEQ ID NO: 284451 - RNA, 22 nt, Human
uaacuugguuggugggcaggag

SEQ ID NO: 284452 - RNA, 22 nt, Human
uguccuuuuccccaaauucacu

SEQ ID NO: 284453 - RNA, 22 nt, Human
augaagcaacagcccuccuauu

SEQ ID NO: 284454 - RNA, 22 nt, Human
agcugcaacaucugcuuguccc

SEQ ID NO: 284455 - RNA, 22 nt, Human
uaugucuuuugcuugcaaauag

SEQ ID NO: 284456 - RNA, 22 nt, Human
acugugauguuugugaucaucu

SEQ ID NO: 284457 - RNA, 22 nt, Human
ugcagggcaucuuugaagugug

SEQ ID NO: 284458 - RNA, 22 nt, Human
auuaauauacacuguuagcaug

SEQ ID NO: 284459 - RNA, 22 nt, Human
uauucauaguaaacaaaagugg

SEQ ID NO: 284460 - RNA, 23 nt, Human
ucccagggaaggugagcgaggcu

SEQ ID NO: 284461 - RNA, 22 nt, Human
cugcucuugagggacugcgguc

SEQ ID NO: 284462 - RNA, 22 nt, Human
acagucuuugcaaaguccuggu

SEQ ID NO: 284463 - RNA, 22 nt, Human
gugaccauaauagauuaugagu

SEQ ID NO: 284464 - RNA, 19 nt, Human
agccagaacuaguguuucu

SEQ ID NO: 284465 - RNA, 22 nt, Human
cagugcaguuucccagaugcug

SEQ ID NO: 284466 - RNA, 22 nt, Human
ucucuguggagcaguguguuca

SEQ ID NO: 284467 - RNA, 22 nt, Human
cauaauuucuguaucagcacca

SEQ ID NO: 284468 - RNA, 22 nt, Human
ugacacauaccgaaaauauuug

SEQ ID NO: 284469 - RNA, 22 nt, Human
cuucuggcaaaacaggcagaaa

SEQ ID NO: 284470 - RNA, 22 nt, Human
uccaggccauugacugcauccu

SEQ ID NO: 284471 - RNA, 22 nt, Human
cacugucuuuugugaagacaau

SEQ ID NO: 284472 - RNA, 22 nt, Human
aauaguacaaucuacagacaua

SEQ ID NO: 284473 - RNA, 22 nt, Human
aucuuuuuugucuuggucacug

SEQ ID NO: 284474 - RNA, 23 nt, Human
uuucugaaguugagauggacuuu

SEQ ID NO: 284475 - RNA, 20 nt, Human
gaugaaaucacugggcagcc

SEQ ID NO: 284476 - RNA, 22 nt, Human
agaaggaaaaccugucuuaugu

SEQ ID NO: 284477 - RNA, 22 nt, Human
cccugcagagaccacugaccuu

SEQ ID NO: 284478 - RNA, 22 nt, Human
aaauguaguauguugcauguau

SEQ ID NO: 284479 - RNA, 22 nt, Human
uucuuggccaccagaucucacu

SEQ ID NO: 284480 - RNA, 22 nt, Human
ccuggaucccgauggcugugag

SEQ ID NO: 284481 - RNA, 22 nt, Human
aaagauguuaugaaauaacuau

SEQ ID NO: 284482 - RNA, 22 nt, Human
uauuucugggaguucagaaauu

SEQ ID NO: 284483 - RNA, 17 nt, Human
gggcagggacuccuggg

SEQ ID NO: 284484 - RNA, 22 nt, Human
ucucagaaaugacaggagguac

SEQ ID NO: 284485 - RNA, 22 nt, Human
aggucagcaggccaggggcgaa

SEQ ID NO: 284486 - RNA, 22 nt, Human
auguuucugaaguuuacagaua

SEQ ID NO: 284487 - RNA, 22 nt, Human
gcaggggaguggaugauggauu

SEQ ID NO: 284488 - RNA, 22 nt, Human
acuggcagcuguaggaugcaug

SEQ ID NO: 284489 - RNA, 22 nt, Human
cugaaauaaaguugcuaaaauu

SEQ ID NO: 284490 - RNA, 23 nt, Human
cggcugcucggccgaguccucgg

SEQ ID NO: 284491 - RNA, 22 nt, Human
uaauugcuuuauccuguuagaa

SEQ ID NO: 284492 - RNA, 22 nt, Human
gucaguuauucaauugguuuaa

SEQ ID NO: 284493 - RNA, 22 nt, Human
cccagcuggccagguggcuuug

SEQ ID NO: 284494 - RNA, 22 nt, Human
gccaaggaaggcuuccuggaag

SEQ ID NO: 284495 - RNA, 22 nt, Human
uaaaugagggcugacaugauug

SEQ ID NO: 284496 - RNA, 22 nt, Human
aauucuauguucuugaguaaga

SEQ ID NO: 284497 - RNA, 22 nt, Human
ugagguggugcuaaucucugcu

SEQ ID NO: 284498 - RNA, 22 nt, Human
uuucuacaauuuuuggcaugag

SEQ ID NO: 284499 - RNA, 22 nt, Human
uuuagcagugaagugaagugaa

SEQ ID NO: 284500 - RNA, 22 nt, Human
uugcuuuaggauuuaaguggca

SEQ ID NO: 284501 - RNA, 18 nt, Human
uaggaggauacugagaug

SEQ ID NO: 284502 - RNA, 22 nt, Human
uggccugccacugccacgccac

SEQ ID NO: 284503 - RNA, 22 nt, Human
uuuuauguaauccuuacugucg

SEQ ID NO: 284504 - RNA, 20 nt, Human
gagggcaggcacccauuuca

SEQ ID NO: 284505 - RNA, 22 nt, Human
ggguggggcccaggaaaucuau

SEQ ID NO: 284506 - RNA, 22 nt, Human
uucaggcccagcacagcgcgug

SEQ ID NO: 284507 - RNA, 22 nt, Human
caggccuccacuccacgcagac

SEQ ID NO: 284508 - RNA, 22 nt, Human
ggaugagguagaugaacaaggg

SEQ ID NO: 284509 - RNA, 22 nt, Human
ccuuuauucaauuaguccuaau

SEQ ID NO: 284510 - RNA, 22 nt, Human
uuagagaagcuguaauuauuca

SEQ ID NO: 284511 - RNA, 22 nt, Human
cagggcaggaugcugugauuau

SEQ ID NO: 284512 - RNA, 20 nt, Human
caugccugcugguaucuggc

SEQ ID NO: 284513 - RNA, 22 nt, Human
ccauccugucuguggccucagg

SEQ ID NO: 284514 - RNA, 22 nt, Human
agcagggcuuugucucugugaa

SEQ ID NO: 284515 - RNA, 22 nt, Human
uaggugucugcucuuauuuaac

SEQ ID NO: 284516 - RNA, 22 nt, Human
uuccggaagguucucuagaauu

SEQ ID NO: 284517 - RNA, 22 nt, Human
aauaauauuccucugugugcgu

SEQ ID NO: 284518 - RNA, 22 nt, Human
uucacuuauagggauguuauug

SEQ ID NO: 284519 - RNA, 22 nt, Human
gaccucagugaauggucaugua

SEQ ID NO: 284520 - RNA, 22 nt, Human
uuuacauuucccucugucaguu

SEQ ID NO: 284521 - RNA, 22 nt, Human
ggcaggcagccuccauccacag

SEQ ID NO: 284522 - RNA, 20 nt, Human
gcuucccaauucuugaucug

SEQ ID NO: 284523 - RNA, 22 nt, Human
uguuucugucuguuuucuacau

SEQ ID NO: 284524 - RNA, 22 nt, Human
ggagucacacaggaagaaggac

SEQ ID NO: 284525 - RNA, 18 nt, Human
cuaaacugcaccuaauga

SEQ ID NO: 284526 - RNA, 22 nt, Human
gaaugaauuuuggauggugaag

SEQ ID NO: 284527 - RNA, 22 nt, Human
ugcagaaacagucauuaaugua

SEQ ID NO: 284528 - RNA, 22 nt, Human
ggguauuaaaaugaaggagaaa

SEQ ID NO: 284529 - RNA, 22 nt, Human
cuggcaugaaauggcaucucau

SEQ ID NO: 284530 - RNA, 22 nt, Human
cucugccacucgaagucaagga

SEQ ID NO: 284531 - RNA, 22 nt, Human
ccacgacgagucaucagggcga

SEQ ID NO: 284532 - RNA, 22 nt, Human
acauguguggacaugaaucuac

SEQ ID NO: 284533 - RNA, 22 nt, Human
ugcaggugcugugucaagagag

SEQ ID NO: 284534 - RNA, 16 nt, Human
gcagguggaucaccug

SEQ ID NO: 284535 - RNA, 22 nt, Human
aagcauguacaaugagugucuc

SEQ ID NO: 284536 - RNA, 22 nt, Human
agucacagaaacccaggugugg

SEQ ID NO: 284537 - RNA, 22 nt, Human
aggaaaaaccuguuaaugguag

SEQ ID NO: 284538 - RNA, 22 nt, Human
uugugucccugcggcugaggag

SEQ ID NO: 284539 - RNA, 22 nt, Human
agaggacaaaaugagaagugcu

SEQ ID NO: 284540 - RNA, 22 nt, Human
cacaguuuuaucuuauacugau

SEQ ID NO: 284541 - RNA, 22 nt, Human
uagaagauucauuuccucugaa

SEQ ID NO: 284542 - RNA, 22 nt, Human
gagaaagcuucagaaauggccu

SEQ ID NO: 284543 - RNA, 22 nt, Human
aucuuuuugacauggugauggu

SEQ ID NO: 284544 - RNA, 22 nt, Human
acuggcagguccaucgcccuuu

SEQ ID NO: 284545 - RNA, 22 nt, Human
aagggcagaauagagaagaugg

SEQ ID NO: 284546 - RNA, 22 nt, Human
cacaugcccagaacuucucauu

SEQ ID NO: 284547 - RNA, 22 nt, Human
uuucucagcucagcaucugggu

SEQ ID NO: 284548 - RNA, 22 nt, Human
gaaggcugcgaggggagugccg

SEQ ID NO: 284549 - RNA, 22 nt, Human
uggcauuucuggccauuugugu

SEQ ID NO: 284550 - RNA, 22 nt, Human
acagguguccaacauuuaccuu

SEQ ID NO: 284551 - RNA, 22 nt, Human
uuucacaugguacugccuguuu

SEQ ID NO: 284552 - RNA, 22 nt, Human
aucgccaauggggaggaaagaa

SEQ ID NO: 284553 - RNA, 22 nt, Human
auuguauaauuguauugccaaa

SEQ ID NO: 284554 - RNA, 22 nt, Human
acacauucaugagugcaugcac

SEQ ID NO: 284555 - RNA, 22 nt, Human
uuguccagagccaggcugucgg

SEQ ID NO: 284556 - RNA, 22 nt, Human
uauuuaagaugugucauaaaga

SEQ ID NO: 284557 - RNA, 22 nt, Human
gaggcauaaguagaagagauug

SEQ ID NO: 284558 - RNA, 23 nt, Human
ugcugggguaguuuguggcacag

SEQ ID NO: 284559 - RNA, 22 nt, Human
gacuuuaucuuguccuuccugc

SEQ ID NO: 284560 - RNA, 20 nt, Human
ugagccagucaagcuacauu

SEQ ID NO: 284561 - RNA, 23 nt, Human
guacacauaguguaguuauauuu

SEQ ID NO: 284562 - RNA, 22 nt, Human
agccagggucucucgcucuguu

SEQ ID NO: 284563 - RNA, 22 nt, Human
uuacaucacuuuacuuaauaau

SEQ ID NO: 284564 - RNA, 22 nt, Human
gucaggucuuggaagauaggcu

SEQ ID NO: 284565 - RNA, 22 nt, Human
acagguggacacagcagcaguc

SEQ ID NO: 284566 - RNA, 22 nt, Human
cacccacauggaaauucacagu

SEQ ID NO: 284567 - RNA, 22 nt, Human
gaaggggaaaguugagcaaaua

SEQ ID NO: 284568 - RNA, 22 nt, Human
uauaucagcaaagcauuuaaaa

SEQ ID NO: 284569 - RNA, 22 nt, Human
auugcuuuagaaagaaaaauau

SEQ ID NO: 284570 - RNA, 22 nt, Human
uucauaaugagguccuagaggc

SEQ ID NO: 284571 - RNA, 22 nt, Human
ccagguggcuucugcccgaugu

SEQ ID NO: 284572 - RNA, 22 nt, Human
ggcugaucaggugcaaaugcau

SEQ ID NO: 284573 - RNA, 22 nt, Human
gcauucuucacuaggugagagc

SEQ ID NO: 284574 - RNA, 22 nt, Human
cugagcccaggcgggagcugag

SEQ ID NO: 284575 - RNA, 22 nt, Human
ucaguuuauaaauuguauuuag

SEQ ID NO: 284576 - RNA, 22 nt, Human
aaacaaauagugcaugggaauu

SEQ ID NO: 284577 - RNA, 22 nt, Human
aagcugaaucugaaauagaauu

SEQ ID NO: 284578 - RNA, 22 nt, Human
gacccugccaugagugacaggg

SEQ ID NO: 284579 - RNA, 22 nt, Human
uuggucagcuaauaaggacagg

SEQ ID NO: 284580 - RNA, 22 nt, Human
auauuuucacugaaccaaagua

SEQ ID NO: 284581 - RNA, 22 nt, Human
agagcaucuaacacauaagccu

SEQ ID NO: 284582 - RNA, 22 nt, Human
acagggcagagggcaguuggua

SEQ ID NO: 284583 - RNA, 22 nt, Human
acuugguugcaaaugaauuauu

SEQ ID NO: 284584 - RNA, 22 nt, Human
gccugaugagcuuccagcugag

SEQ ID NO: 284585 - RNA, 23 nt, Human
cuguccuguaguucacguuggcc

SEQ ID NO: 284586 - RNA, 22 nt, Human
ggccuugagcagggagaaacca

SEQ ID NO: 284587 - RNA, 19 nt, Human
uggcagguagugagcaguc

SEQ ID NO: 284588 - RNA, 22 nt, Human
cuguccucaccuuggcaggggg

SEQ ID NO: 284589 - RNA, 22 nt, Human
agaaagaacguugguuaucuua

SEQ ID NO: 284590 - RNA, 22 nt, Human
acuguggccaaagccucuggga

SEQ ID NO: 284591 - RNA, 22 nt, Human
gcuggcagccaagugaagaggg

SEQ ID NO: 284592 - RNA, 22 nt, Human
uucucuagguuuuagaugaaga

SEQ ID NO: 284593 - RNA, 22 nt, Human
aagcaauagcaacaacuuuaca

SEQ ID NO: 284594 - RNA, 20 nt, Human
agggucaguagcacagagcu

SEQ ID NO: 284595 - RNA, 22 nt, Human
cugcguguuugcacccugucug

SEQ ID NO: 284596 - RNA, 22 nt, Human
ccuggguccaauucuggcuugu

SEQ ID NO: 284597 - RNA, 22 nt, Human
uaucuauuccaaauaucagcgu

SEQ ID NO: 284598 - RNA, 22 nt, Human
caaaugauaccuauuacuaggc

SEQ ID NO: 284599 - RNA, 22 nt, Human
uccuccuucgggacugcuugac

SEQ ID NO: 284600 - RNA, 22 nt, Human
gauguuuggcucaaacgagugu

SEQ ID NO: 284601 - RNA, 22 nt, Human
uugaggagcacuagucagguau

SEQ ID NO: 284602 - RNA, 22 nt, Human
uaugaaacauucauacaaauaa

SEQ ID NO: 284603 - RNA, 22 nt, Human
ugagccagauaagggcucacgc

SEQ ID NO: 284604 - RNA, 22 nt, Human
uuugagaagauguaauguuaag

SEQ ID NO: 284605 - RNA, 22 nt, Human
ugcacccucaucagucaaaugg

SEQ ID NO: 284606 - RNA, 22 nt, Human
cagcugaacauguagagcaucu

SEQ ID NO: 284607 - RNA, 22 nt, Human
aaaugcagauugucauucagga

SEQ ID NO: 284608 - RNA, 22 nt, Human
uccuguuucuccugcaaaaucc

SEQ ID NO: 284609 - RNA, 22 nt, Human
uaguaaauuaaaauauugacuu

SEQ ID NO: 284610 - RNA, 18 nt, Human
ucuagaaacuucucuccu

SEQ ID NO: 284611 - RNA, 22 nt, Human
uuuccagggcucuguagaagaa

SEQ ID NO: 284612 - RNA, 22 nt, Human
uuggaggauugcucucagccca

SEQ ID NO: 284613 - RNA, 22 nt, Human
guacuucuuuagucaauaugua

SEQ ID NO: 284614 - RNA, 22 nt, Human
ggccaggccaagaggguuggaa

SEQ ID NO: 284615 - RNA, 22 nt, Human
cugacagaugcugcuggcagua

SEQ ID NO: 284616 - RNA, 22 nt, Human
aaaauucucuugaucuugacag

SEQ ID NO: 284617 - RNA, 22 nt, Human
gcaguggcccagcuugcaggcu

SEQ ID NO: 284618 - RNA, 18 nt, Human
ccuggaccugucuccuuu

SEQ ID NO: 284619 - RNA, 22 nt, Human
uggaaagagguagaggaucugg

SEQ ID NO: 284620 - RNA, 22 nt, Human
acugaaaaugaauuagaaacag

SEQ ID NO: 284621 - RNA, 22 nt, Human
cagggcucgcugccagcuucag

SEQ ID NO: 284622 - RNA, 22 nt, Human
cuaugaaaggauuuggaguugu

SEQ ID NO: 284623 - RNA, 22 nt, Human
uuacagugugcaaucccagaau

SEQ ID NO: 284624 - RNA, 22 nt, Human
uuuccuuccagguuccuaaggc

SEQ ID NO: 284625 - RNA, 22 nt, Human
uugugucccuguaagacaaagc

SEQ ID NO: 284626 - RNA, 22 nt, Human
cugguacauaguaagaacacaa

SEQ ID NO: 284627 - RNA, 22 nt, Human
gcauguguggaggagaugugcu

SEQ ID NO: 284628 - RNA, 22 nt, Human
cuagagaauggcaaagauuaga

SEQ ID NO: 284629 - RNA, 22 nt, Human
ugcucuucacaguuucagcauc

SEQ ID NO: 284630 - RNA, 22 nt, Human
uagaagaaagugaagcugggga

SEQ ID NO: 284631 - RNA, 22 nt, Human
ggagcugaaggggugggcucag

SEQ ID NO: 284632 - RNA, 21 nt, Human
auuuucauuuccaggggagga

SEQ ID NO: 284633 - RNA, 22 nt, Human
uguggggcucccuggcagccug

SEQ ID NO: 284634 - RNA, 22 nt, Human
aaguuuaacuugaauucuuucu

SEQ ID NO: 284635 - RNA, 22 nt, Human
ccaaggcaggggaucaaaguuu

SEQ ID NO: 284636 - RNA, 22 nt, Human
ucaaggagcccacagucuaaug

SEQ ID NO: 284637 - RNA, 22 nt, Human
aucgagggugaguacagcggac

SEQ ID NO: 284638 - RNA, 22 nt, Human
aaggaggccuggcagaugaaga

SEQ ID NO: 284639 - RNA, 19 nt, Human
uugaaauuguuugauaugg

SEQ ID NO: 284640 - RNA, 22 nt, Human
ucugggaaugaauaagaccugu

SEQ ID NO: 284641 - RNA, 22 nt, Human
ucagcauaucuugagcuucaug

SEQ ID NO: 284642 - RNA, 22 nt, Human
cuucaguucuaaaguagaaugu

SEQ ID NO: 284643 - RNA, 20 nt, Human
acaguuuauccaguuagcag

SEQ ID NO: 284644 - RNA, 22 nt, Human
agcccccucccuagugacugga

SEQ ID NO: 284645 - RNA, 22 nt, Human
ugguauuuccaggcuuauggua

SEQ ID NO: 284646 - RNA, 22 nt, Human
gccuguuuggcaucauugguug

SEQ ID NO: 284647 - RNA, 22 nt, Human
uagcaggguuuugaagaggguu

SEQ ID NO: 284648 - RNA, 22 nt, Human
auuaagugacuaaaguaaugcu

SEQ ID NO: 284649 - RNA, 22 nt, Human
cucggcagguggagguuguagu

SEQ ID NO: 284650 - RNA, 22 nt, Human
gcuccuggguguggcugccccu

SEQ ID NO: 284651 - RNA, 22 nt, Human
uuuuauuaguggcuagaugggg

SEQ ID NO: 284652 - RNA, 22 nt, Human
cauucauuuaugaaauaucuau

SEQ ID NO: 284653 - RNA, 22 nt, Human
ucucacugauuugagaccaagg

SEQ ID NO: 284654 - RNA, 22 nt, Human
cucagcaacccacacacggucu

SEQ ID NO: 284655 - RNA, 22 nt, Human
ucuaacuuagggaauacuuuag

SEQ ID NO: 284656 - RNA, 22 nt, Human
aaggugcucacgggcucaggga

SEQ ID NO: 284657 - RNA, 22 nt, Human
acucuucaccgcuacugaaaua

SEQ ID NO: 284658 - RNA, 21 nt, Human
cagacccucuagaggccaccu

SEQ ID NO: 284659 - RNA, 22 nt, Human
uguguuucagaaccuucuuuca

SEQ ID NO: 284660 - RNA, 22 nt, Human
uucugugaaucuuuuuucccac

SEQ ID NO: 284661 - RNA, 22 nt, Human
caugugucacagccuuuuauug

SEQ ID NO: 284662 - RNA, 20 nt, Human
uccuaauaaccugaagaaau

SEQ ID NO: 284663 - RNA, 22 nt, Human
aaauuagaaauacuuucaaagc

SEQ ID NO: 284664 - RNA, 18 nt, Human
gccugcucugcucucccc

SEQ ID NO: 284665 - RNA, 22 nt, Human
ugacccuuucauuauucucauu

SEQ ID NO: 284666 - RNA, 22 nt, Human
auucuuucaaggaauaguuauu

SEQ ID NO: 284667 - RNA, 22 nt, Human
aucuuguuaaaaagcagauucu

SEQ ID NO: 284668 - RNA, 22 nt, Human
aggcagguguugggagacacca

SEQ ID NO: 284669 - RNA, 22 nt, Human
aaauacacguacauguguaaaa

SEQ ID NO: 284670 - RNA, 22 nt, Human
ucucauucauacccuacaugcu

SEQ ID NO: 284671 - RNA, 22 nt, Human
ucuucagauaaagggagaguau

SEQ ID NO: 284672 - RNA, 22 nt, Human
aguaugcauauuucaaaguaag

SEQ ID NO: 284673 - RNA, 22 nt, Human
ccuguucaugaaacugcuuucc

SEQ ID NO: 284674 - RNA, 22 nt, Human
cagggcagggagcuuagaauga

SEQ ID NO: 284675 - RNA, 22 nt, Human
ccuguucaccauggucacgugc

SEQ ID NO: 284676 - RNA, 20 nt, Human
aggucucagagcaagagccc

SEQ ID NO: 284677 - RNA, 22 nt, Human
guguccauguuguucaggguga

SEQ ID NO: 284678 - RNA, 22 nt, Human
cucagcaagauuaagcagcuug

SEQ ID NO: 284679 - RNA, 22 nt, Human
ggcuguggcauuaggugaggcc

SEQ ID NO: 284680 - RNA, 21 nt, Human
uugggaucugagaagugaaaa

SEQ ID NO: 284681 - RNA, 19 nt, Human
guguccauggagcauggag

SEQ ID NO: 284682 - RNA, 23 nt, Human
ucauaaauauuagcacaguagga

SEQ ID NO: 284683 - RNA, 23 nt, Human
gacagagugagaccuugucuuac

SEQ ID NO: 284684 - RNA, 20 nt, Human
ucacaucuggcagcugauga

SEQ ID NO: 284685 - RNA, 23 nt, Human
ucauucaaggcugguaucuuuca

SEQ ID NO: 284686 - RNA, 20 nt, Human
gggaucuuccaggcucuccu

SEQ ID NO: 284687 - RNA, 22 nt, Human
ugcccuccuccugagcccaugu

SEQ ID NO: 284688 - RNA, 22 nt, Human
cagacaggcuagccagacucac

SEQ ID NO: 284689 - RNA, 19 nt, Human
uuucccagucccaggagug

SEQ ID NO: 284690 - RNA, 22 nt, Human
gaaaauacuucaguguucuggc

SEQ ID NO: 284691 - RNA, 18 nt, Human
aaauuagauggaccugug

SEQ ID NO: 284692 - RNA, 22 nt, Human
uauaaagagucucaaagaaguu

SEQ ID NO: 284693 - RNA, 22 nt, Human
auugucauuccagucauuguua

SEQ ID NO: 284694 - RNA, 22 nt, Human
cugcacagcugggcaagauaua

SEQ ID NO: 284695 - RNA, 22 nt, Human
cagucuggaggucagcuggcuu

SEQ ID NO: 284696 - RNA, 22 nt, Human
uauuagguaaaggacuugcagg

SEQ ID NO: 284697 - RNA, 22 nt, Human
accacagcuuugcaccaggugu

SEQ ID NO: 284698 - RNA, 22 nt, Human
guuguacauaugaggauaaguu

SEQ ID NO: 284699 - RNA, 22 nt, Human
cccaggcuccugacucauucua

SEQ ID NO: 284700 - RNA, 20 nt, Human
ucucaggguucagcaaagua

SEQ ID NO: 284701 - RNA, 22 nt, Human
agacacuguguacagaaaaaga

SEQ ID NO: 284702 - RNA, 22 nt, Human
acuguuuucuguaaagggccag

SEQ ID NO: 284703 - RNA, 23 nt, Human
caugccaguuugugcaggcagau

SEQ ID NO: 284704 - RNA, 22 nt, Human
gugaccaucagagaauaacaaa

SEQ ID NO: 284705 - RNA, 22 nt, Human
uccuggacuggcucagcacccu

SEQ ID NO: 284706 - RNA, 22 nt, Human
auucuucaguauguguggauug

SEQ ID NO: 284707 - RNA, 22 nt, Human
cucaguuucugacauuaaaauc

SEQ ID NO: 284708 - RNA, 22 nt, Human
uacauucucuucccauugucuc

SEQ ID NO: 284709 - RNA, 22 nt, Human
gucucuuagaaucgcauauugu

SEQ ID NO: 284710 - RNA, 22 nt, Human
cugaaggcuaaaauggacugaa

SEQ ID NO: 284711 - RNA, 20 nt, Human
aaaagagugcuucaacugcu

SEQ ID NO: 284712 - RNA, 22 nt, Human
gacuguggcaggcucagcacug

SEQ ID NO: 284713 - RNA, 22 nt, Human
guguuuuaucagacaaaguaua

SEQ ID NO: 284714 - RNA, 22 nt, Human
ugacaagaggcagaaucagcug

SEQ ID NO: 284715 - RNA, 22 nt, Human
aacuuuauuguuaggggcuaaa

SEQ ID NO: 284716 - RNA, 22 nt, Human
uucagaaguagcuaagcaguca

SEQ ID NO: 284717 - RNA, 20 nt, Human
gcuuccaggagggcugauau

SEQ ID NO: 284718 - RNA, 22 nt, Human
gaauaauuuugaucagaaggga

SEQ ID NO: 284719 - RNA, 22 nt, Human
aggagauagucaaagcuucuug

SEQ ID NO: 284720 - RNA, 22 nt, Human
acauacuuaugcuaaaaauaua

SEQ ID NO: 284721 - RNA, 22 nt, Human
augaggagcuccuugaaaugag

SEQ ID NO: 284722 - RNA, 22 nt, Human
uuuuugcugauaagcagaauuc

SEQ ID NO: 284723 - RNA, 22 nt, Human
guauuacaaauaaauguuacug

SEQ ID NO: 284724 - RNA, 22 nt, Human
uucuaccuacccucugcauaca

SEQ ID NO: 284725 - RNA, 22 nt, Human
cucuccagaauaugccgccgug

SEQ ID NO: 284726 - RNA, 23 nt, Human
uguguccuuaacuguauauacua

SEQ ID NO: 284727 - RNA, 20 nt, Human
uggcagguggccucaguucc

SEQ ID NO: 284728 - RNA, 22 nt, Human
cagguugaaaguggaggagcua

SEQ ID NO: 284729 - RNA, 17 nt, Human
gcaaaggugaggagaga

SEQ ID NO: 284730 - RNA, 22 nt, Human
gccaaggagacacgguguugua

SEQ ID NO: 284731 - RNA, 22 nt, Human
ccaaggcuguggggcugugcag

SEQ ID NO: 284732 - RNA, 22 nt, Human
aacuauguuaauaaguuucauu

SEQ ID NO: 284733 - RNA, 22 nt, Human
uaugacaagguggaguaugagu

SEQ ID NO: 284734 - RNA, 22 nt, Human
gggagaaggagcuaguucuuga

SEQ ID NO: 284735 - RNA, 22 nt, Human
uauugcuguucuuuaaaugaag

SEQ ID NO: 284736 - RNA, 22 nt, Human
acuacauuaugaggaaagagug

SEQ ID NO: 284737 - RNA, 23 nt, Human
ccucuccagacacugggccuugu

SEQ ID NO: 284738 - RNA, 22 nt, Human
gaggugucuagaucuaccagua

SEQ ID NO: 284739 - RNA, 22 nt, Human
gucaguuauuuugagcaauugg

SEQ ID NO: 284740 - RNA, 22 nt, Human
uuacuaguggagaaacugaggc

SEQ ID NO: 284741 - RNA, 22 nt, Human
uuugaagacauuugaauacuuu

SEQ ID NO: 284742 - RNA, 23 nt, Human
cccugcagucagggugagauggu

SEQ ID NO: 284743 - RNA, 22 nt, Human
aggcuguguuuaagugguaaug

SEQ ID NO: 284744 - RNA, 22 nt, Human
ugcuggaggccagaagucugag

SEQ ID NO: 284745 - RNA, 22 nt, Human
ggccuuugcguccacgccgcuu

SEQ ID NO: 284746 - RNA, 22 nt, Human
uuguuucuggaaaaggcgagaa

SEQ ID NO: 284747 - RNA, 22 nt, Human
ccaaggagcaaguuuacaccug

SEQ ID NO: 284748 - RNA, 22 nt, Human
ccugcugucccucugggcucca

SEQ ID NO: 284749 - RNA, 22 nt, Human
uuagaaucuaacauucuuaucu

SEQ ID NO: 284750 - RNA, 22 nt, Human
ggcucugguugaccaugauggc

SEQ ID NO: 284751 - RNA, 22 nt, Human
acauucuuucaccuugugucca

SEQ ID NO: 284752 - RNA, 22 nt, Human
cugccccagugccaggcaggug

SEQ ID NO: 284753 - RNA, 22 nt, Human
gcagguguccugggcuggcagu

SEQ ID NO: 284754 - RNA, 21 nt, Human
uccaggcuggaaggggcguug

SEQ ID NO: 284755 - RNA, 22 nt, Human
uguuuucucuugaaaagcaguc

SEQ ID NO: 284756 - RNA, 22 nt, Human
ugauuucucuccguuauuucag

SEQ ID NO: 284757 - RNA, 22 nt, Human
cucagucucuugggcugugaag

SEQ ID NO: 284758 - RNA, 22 nt, Human
uucagagaguccaguaugcagu

SEQ ID NO: 284759 - RNA, 22 nt, Human
uccuggccauaggcuauuucag

SEQ ID NO: 284760 - RNA, 20 nt, Human
cugugaccagagacccagga

SEQ ID NO: 284761 - RNA, 22 nt, Human
caucugaagugaauugcuuuuu

SEQ ID NO: 284762 - RNA, 21 nt, Human
ucauuugugaucugauuucca

SEQ ID NO: 284763 - RNA, 22 nt, Human
agucagaguuuugaggugugac

SEQ ID NO: 284764 - RNA, 22 nt, Human
ugucacaaaaaucaguaauugc

SEQ ID NO: 284765 - RNA, 22 nt, Human
guaagccucugcucuaucuggu

SEQ ID NO: 284766 - RNA, 22 nt, Human
agcuuuaugaggagaccuuagu

SEQ ID NO: 284767 - RNA, 22 nt, Human
uugcauuccaugguuuuccuuc

SEQ ID NO: 284768 - RNA, 22 nt, Human
uguguaaaaucugauuaauacu

SEQ ID NO: 284769 - RNA, 22 nt, Human
cuauuagguaugcagccuauuu

SEQ ID NO: 284770 - RNA, 22 nt, Human
gcagggaccagggccagaucca

SEQ ID NO: 284771 - RNA, 22 nt, Human
ucaggugucugccucuuugagu

SEQ ID NO: 284772 - RNA, 21 nt, Human
aggcuuggauagauauucaua

SEQ ID NO: 284773 - RNA, 22 nt, Human
agucucucuccucgugguaacc

SEQ ID NO: 284774 - RNA, 22 nt, Human
gggcagguggagggcccagcca

SEQ ID NO: 284775 - RNA, 22 nt, Human
uaguuaacucuugguaauaggu

SEQ ID NO: 284776 - RNA, 22 nt, Human
auaaggcacacauagauagggu

SEQ ID NO: 284777 - RNA, 22 nt, Human
uuguauuuuguuaugcuacugc

SEQ ID NO: 284778 - RNA, 22 nt, Human
acagacagaggcuccaugagga

SEQ ID NO: 284779 - RNA, 22 nt, Human
uggcaagagggaugcaagguuu

SEQ ID NO: 284780 - RNA, 22 nt, Human
cuggugcacguggcugcagucg

SEQ ID NO: 284781 - RNA, 22 nt, Human
acuccagggcuccaccccagau

SEQ ID NO: 284782 - RNA, 22 nt, Human
ugucugggucaccccuccuggc

SEQ ID NO: 284783 - RNA, 22 nt, Human
uucacauuacaaggccauauuu

SEQ ID NO: 284784 - RNA, 17 nt, Human
ucauuuguugugacuag

SEQ ID NO: 284785 - RNA, 22 nt, Human
auucaguuucaaucauuguagu

SEQ ID NO: 284786 - RNA, 19 nt, Human
auacacauacguaaacuga

SEQ ID NO: 284787 - RNA, 22 nt, Human
uuugggauuuuacauuguaugg

SEQ ID NO: 284788 - RNA, 21 nt, Human
ucagggcagugggagguuccu

SEQ ID NO: 284789 - RNA, 22 nt, Human
uguguccugugaucucuagggu

SEQ ID NO: 284790 - RNA, 22 nt, Human
gccuggacaccgcccuugcaga

SEQ ID NO: 284791 - RNA, 22 nt, Human
aauguuaaguuuagauuauaac

SEQ ID NO: 284792 - RNA, 22 nt, Human
cacaguuugggucuccggggca

SEQ ID NO: 284793 - RNA, 22 nt, Human
uacagagaugugaaaagcucua

SEQ ID NO: 284794 - RNA, 22 nt, Human
caucuucagguucauggucaua

SEQ ID NO: 284795 - RNA, 23 nt, Human
uuguuucuuuguauugucucuau

SEQ ID NO: 284796 - RNA, 22 nt, Human
auuccuucuauucucugugggu

SEQ ID NO: 284797 - RNA, 22 nt, Human
aucuuuagcauuacuuuauuca

SEQ ID NO: 284798 - RNA, 22 nt, Human
cuucuuugaaaaaggcagucag

SEQ ID NO: 284799 - RNA, 22 nt, Human
caguguaagcucuagacuagaa

SEQ ID NO: 284800 - RNA, 22 nt, Human
aaugagauggcaaugacuuaaa

SEQ ID NO: 284801 - RNA, 22 nt, Human
cacagguuagguauuauacuau

SEQ ID NO: 284802 - RNA, 22 nt, Human
auuacaguggguaaacagaauu

SEQ ID NO: 284803 - RNA, 22 nt, Human
ucagggcaccaaaaaagaugcc

SEQ ID NO: 284804 - RNA, 22 nt, Human
uagggcagagcuuguacacgau

SEQ ID NO: 284805 - RNA, 22 nt, Human
acaggcagguccugucccagcu

SEQ ID NO: 284806 - RNA, 22 nt, Human
agaaggcagguuuuaaaauguc

SEQ ID NO: 284807 - RNA, 22 nt, Human
acagguguugaaugaugucaca

SEQ ID NO: 284808 - RNA, 22 nt, Human
ccaugagcuuccuauauagggu

SEQ ID NO: 284809 - RNA, 22 nt, Human
ugcuuuauguggcugauacuca

SEQ ID NO: 284810 - RNA, 22 nt, Human
ggcuugggagcaggcaugugac

SEQ ID NO: 284811 - RNA, 22 nt, Human
uguuucuucucacacaaacuca

SEQ ID NO: 284812 - RNA, 22 nt, Human
cacaauuuccuugcuucacuuu

SEQ ID NO: 284813 - RNA, 22 nt, Human
aaaguguuaugcaaaacucugu

SEQ ID NO: 284814 - RNA, 22 nt, Human
uuccuacauuugccucacuccc

SEQ ID NO: 284815 - RNA, 22 nt, Human
auuuuucagcuucauugaggca

SEQ ID NO: 284816 - RNA, 22 nt, Human
cuugggugcuggaggcugccgc

SEQ ID NO: 284817 - RNA, 22 nt, Human
uugcaagguuucucucugccua

SEQ ID NO: 284818 - RNA, 22 nt, Human
uaggcuugcuucuccuccacag

SEQ ID NO: 284819 - RNA, 22 nt, Human
augcauugucugguuucauuuu

SEQ ID NO: 284820 - RNA, 22 nt, Human
uuauugagcaacucuggggcuc

SEQ ID NO: 284821 - RNA, 16 nt, Human
uggcagguuuuuaucu

SEQ ID NO: 284822 - RNA, 22 nt, Human
agggagaagagaacaaagcccu

SEQ ID NO: 284823 - RNA, 22 nt, Human
aacuagaaaacaagaugcugau

SEQ ID NO: 284824 - RNA, 22 nt, Human
aaauuauuuucagaauggagaa

SEQ ID NO: 284825 - RNA, 20 nt, Human
uugaggagauauugaauacu

SEQ ID NO: 284826 - RNA, 22 nt, Human
auccucagaccucagcaaagcc

SEQ ID NO: 284827 - RNA, 22 nt, Human
uugauaaaaugauaucuucuuu

SEQ ID NO: 284828 - RNA, 22 nt, Human
gcccggcagucacacacccagg

SEQ ID NO: 284829 - RNA, 22 nt, Human
uacuguauuugauaagugaagu

SEQ ID NO: 284830 - RNA, 23 nt, Human
uggaagaaaaugguuuggcugug

SEQ ID NO: 284831 - RNA, 22 nt, Human
agccuugacacuggggaaacug

SEQ ID NO: 284832 - RNA, 19 nt, Human
uacaugcagcaggcacgca

SEQ ID NO: 284833 - RNA, 22 nt, Human
cagaaauucccauuucagauuc

SEQ ID NO: 284834 - RNA, 18 nt, Human
cuucucccaucuuggcca

SEQ ID NO: 284835 - RNA, 22 nt, Human
ugcuacuacuugucaacgguca

SEQ ID NO: 284836 - RNA, 22 nt, Human
uuccuucuccagaacuucuagg

SEQ ID NO: 284837 - RNA, 22 nt, Human
gcacagagacaguccugagauc

SEQ ID NO: 284838 - RNA, 22 nt, Human
ggaggugggagccuccaguggu

SEQ ID NO: 284839 - RNA, 22 nt, Human
uuguacaacacauauucuacag

SEQ ID NO: 284840 - RNA, 22 nt, Human
uacauuaucuuguuaucuuuca

SEQ ID NO: 284841 - RNA, 22 nt, Human
gggcaacagagcgagggccugu

SEQ ID NO: 284842 - RNA, 22 nt, Human
aguguccuugagguuccuagga

SEQ ID NO: 284843 - RNA, 22 nt, Human
ugucucuccacacagccagugc

SEQ ID NO: 284844 - RNA, 20 nt, Human
ugccuggccuuucucugccc

SEQ ID NO: 284845 - RNA, 22 nt, Human
gaugugucuccguuucaaggca

SEQ ID NO: 284846 - RNA, 22 nt, Human
aaggccugggaggccucucuuc

SEQ ID NO: 284847 - RNA, 22 nt, Human
aagagaaagcagacuuugucau

SEQ ID NO: 284848 - RNA, 22 nt, Human
aagcgccaugguuccugcgcag

SEQ ID NO: 284849 - RNA, 22 nt, Human
gugggagaaauuagcucuaguu

SEQ ID NO: 284850 - RNA, 22 nt, Human
ucuaacuuguauguauaguuuu

SEQ ID NO: 284851 - RNA, 22 nt, Human
ugcagggagggcccagcaaucu

SEQ ID NO: 284852 - RNA, 22 nt, Human
caguuuuaucaucugugaaaug

SEQ ID NO: 284853 - RNA, 22 nt, Human
guuauuuuaacuucucaguaau

SEQ ID NO: 284854 - RNA, 22 nt, Human
acagugcagggcgggaagaagg

SEQ ID NO: 284855 - RNA, 22 nt, Human
ugucuccugggucccuuccacc

SEQ ID NO: 284856 - RNA, 22 nt, Human
uuuacaugaguagcagauguuc

SEQ ID NO: 284857 - RNA, 22 nt, Human
cuggcugugcugacugagaggg

SEQ ID NO: 284858 - RNA, 22 nt, Human
auugcugggaggauguguguuc

SEQ ID NO: 284859 - RNA, 22 nt, Human
gcagggcacacaagaaugauaa

SEQ ID NO: 284860 - RNA, 22 nt, Human
uaaagugcaggcuacucagaag

SEQ ID NO: 284861 - RNA, 22 nt, Human
acccacccuacuagcagugucc

SEQ ID NO: 284862 - RNA, 22 nt, Human
auucaacuuauaagauauuaau

SEQ ID NO: 284863 - RNA, 22 nt, Human
cuuugucauuuugucucucagu

SEQ ID NO: 284864 - RNA, 22 nt, Human
aauuagaguggcgagugauuua

SEQ ID NO: 284865 - RNA, 22 nt, Human
cuccaugaauuugagcuuugug

SEQ ID NO: 284866 - RNA, 22 nt, Human
ugccagugcuugugucugagca

SEQ ID NO: 284867 - RNA, 22 nt, Human
ucugcugcugcagcuacacuau

SEQ ID NO: 284868 - RNA, 22 nt, Human
cggggucccugcccacccauac

SEQ ID NO: 284869 - RNA, 17 nt, Human
aaugaaugaauucuuug

SEQ ID NO: 284870 - RNA, 22 nt, Human
acuacauuugcagagaagcaau

SEQ ID NO: 284871 - RNA, 22 nt, Human
gugagaagauaaguauugcaaa

SEQ ID NO: 284872 - RNA, 19 nt, Human
aguucuuguccugucuguu

SEQ ID NO: 284873 - RNA, 22 nt, Human
ucauucaugaggugcuagugcu

SEQ ID NO: 284874 - RNA, 22 nt, Human
cagcuuuauuucacguguuugu

SEQ ID NO: 284875 - RNA, 22 nt, Human
ucugucuuggccagccaucugg

SEQ ID NO: 284876 - RNA, 22 nt, Human
uacauagugaacauuuacagag

SEQ ID NO: 284877 - RNA, 22 nt, Human
ucagugucucauaugagguuuc

SEQ ID NO: 284878 - RNA, 17 nt, Human
agcugaaauugcugaag

SEQ ID NO: 284879 - RNA, 19 nt, Human
gaguccugugcuccuuguu

SEQ ID NO: 284880 - RNA, 22 nt, Human
ggcugaggcucaugccaucuug

SEQ ID NO: 284881 - RNA, 22 nt, Human
ucugugcucaaguucugccucu

SEQ ID NO: 284882 - RNA, 22 nt, Human
ggaagcuggacaggcuuugagu

SEQ ID NO: 284883 - RNA, 20 nt, Human
augugagggguugaaguggg

SEQ ID NO: 284884 - RNA, 22 nt, Human
augcuuuauuguuaggucaugu

SEQ ID NO: 284885 - RNA, 22 nt, Human
ugcagggauccuagcugaagag

SEQ ID NO: 284886 - RNA, 22 nt, Human
gcugggaagugcaagaucaagg

SEQ ID NO: 284887 - RNA, 22 nt, Human
uggcagggucuugcuguguugc

SEQ ID NO: 284888 - RNA, 22 nt, Human
gcagggcaugggcccugucugc

SEQ ID NO: 284889 - RNA, 20 nt, Human
aaagagcccuuggagcaggc

SEQ ID NO: 284890 - RNA, 22 nt, Human
gacccauauauacguaauuugu

SEQ ID NO: 284891 - RNA, 20 nt, Human
uagauuucauacuucucuuu

SEQ ID NO: 284892 - RNA, 22 nt, Human
ugaucuuuacugcuguuuauaa

SEQ ID NO: 284893 - RNA, 22 nt, Human
uuuaaacaaauaggauugccua

SEQ ID NO: 284894 - RNA, 22 nt, Human
gcuccuggauguucaagucggc

SEQ ID NO: 284895 - RNA, 22 nt, Human
aaguaucucaaaaacaguaauc

SEQ ID NO: 284896 - RNA, 22 nt, Human
caguuucugagcccugucauuu

SEQ ID NO: 284897 - RNA, 22 nt, Human
uagcaggguccaaugugaggca

SEQ ID NO: 284898 - RNA, 22 nt, Human
caaaaguucucacccagacaug

SEQ ID NO: 284899 - RNA, 22 nt, Human
ggugagaaagggauuccuguuc

SEQ ID NO: 284900 - RNA, 22 nt, Human
cugucuucccgaggcccuggag

SEQ ID NO: 284901 - RNA, 22 nt, Human
aguuuauguaaaauuaguaaug

SEQ ID NO: 284902 - RNA, 22 nt, Human
aggagggaccuaggaauauugc

SEQ ID NO: 284903 - RNA, 22 nt, Human
ugcuuaaaggauaguuuaaacu

SEQ ID NO: 284904 - RNA, 22 nt, Human
uaugaacugcucuuguguuuug

SEQ ID NO: 284905 - RNA, 22 nt, Human
uuuauuuggcaucucugccaag

SEQ ID NO: 284906 - RNA, 22 nt, Human
aggacacaggcaggaggagauc

SEQ ID NO: 284907 - RNA, 22 nt, Human
gcugccacgaucucugcuguag

SEQ ID NO: 284908 - RNA, 22 nt, Human
auuuugcugugguacauuagga

SEQ ID NO: 284909 - RNA, 22 nt, Human
ucugcccaggaggucccauggg

SEQ ID NO: 284910 - RNA, 22 nt, Human
auuugaagaaaguuuucuagau

SEQ ID NO: 284911 - RNA, 22 nt, Human
ggcucugggccuccaaggucug

SEQ ID NO: 284912 - RNA, 22 nt, Human
aggccaggauagcauggaucag

SEQ ID NO: 284913 - RNA, 22 nt, Human
caggacaaagcccuuugagaaa

SEQ ID NO: 284914 - RNA, 22 nt, Human
aggcugcugccuuggagagugu

SEQ ID NO: 284915 - RNA, 22 nt, Human
caugcagggacuagagaacagg

SEQ ID NO: 284916 - RNA, 22 nt, Human
uaaacuguguaauaugaugucu

SEQ ID NO: 284917 - RNA, 23 nt, Human
ugguaauagggagcagaagguag

SEQ ID NO: 284918 - RNA, 22 nt, Human
ucugaagagaaugcugcugaac

SEQ ID NO: 284919 - RNA, 22 nt, Human
uacuaaauaguuuaauuccuca

SEQ ID NO: 284920 - RNA, 22 nt, Human
auuuccaugaaguuuaguuaua

SEQ ID NO: 284921 - RNA, 22 nt, Human
uuuauacauggagaauuuuugc

SEQ ID NO: 284922 - RNA, 22 nt, Human
uucaguuccauuucaggugggu

SEQ ID NO: 284923 - RNA, 22 nt, Human
augucacuguuguuauuguuau

SEQ ID NO: 284924 - RNA, 22 nt, Human
cuggauuaaguaaaauagagga

SEQ ID NO: 284925 - RNA, 22 nt, Human
auguuuacaauucaguauuaca

SEQ ID NO: 284926 - RNA, 22 nt, Human
ucacauuugcaauugcauuguu

SEQ ID NO: 284927 - RNA, 22 nt, Human
guuggcuaugagagcuuuagug

SEQ ID NO: 284928 - RNA, 22 nt, Human
uguuucuagagaaaauauuuac

SEQ ID NO: 284929 - RNA, 22 nt, Human
ucagugucuugaccugggugug

SEQ ID NO: 284930 - RNA, 22 nt, Human
cccugcaggcucagacuggagu

SEQ ID NO: 284931 - RNA, 22 nt, Human
uccacuccuuaugccagacggu

SEQ ID NO: 284932 - RNA, 22 nt, Human
gaacucagagccugagcuagga

SEQ ID NO: 284933 - RNA, 22 nt, Human
agggugugcuguugggucuuuc

SEQ ID NO: 284934 - RNA, 22 nt, Human
gaugaaggggcuggugcccucu

SEQ ID NO: 284935 - RNA, 22 nt, Human
uucuuggaaacugauuccuugu

SEQ ID NO: 284936 - RNA, 22 nt, Human
cacaaauaccaguuuccuaaca

SEQ ID NO: 284937 - RNA, 22 nt, Human
uaaaucuccuguuuuucaucua

SEQ ID NO: 284938 - RNA, 22 nt, Human
cuagagaaaccccaugagcuuu

SEQ ID NO: 284939 - RNA, 22 nt, Human
acaguggcaguauuagggcaga

SEQ ID NO: 284940 - RNA, 22 nt, Human
gugcuggcaccccucuccaguu

SEQ ID NO: 284941 - RNA, 22 nt, Human
aagcugucagugucaggcuaaa

SEQ ID NO: 284942 - RNA, 22 nt, Human
uaucacaucaauguuuuaaaau

SEQ ID NO: 284943 - RNA, 22 nt, Human
uuacagugaagauucagguucc

SEQ ID NO: 284944 - RNA, 22 nt, Human
gggguguggacggcugugccag

SEQ ID NO: 284945 - RNA, 22 nt, Human
ugccuucaaucaggauggucuc

SEQ ID NO: 284946 - RNA, 22 nt, Human
cauuuauugaguggccacagug

SEQ ID NO: 284947 - RNA, 22 nt, Human
guguccaucucuguaugcugcu

SEQ ID NO: 284948 - RNA, 22 nt, Human
uucauucuuauuugugaucugg

SEQ ID NO: 284949 - RNA, 22 nt, Human
guuuuuguccauggaggcaaac

SEQ ID NO: 284950 - RNA, 22 nt, Human
ucuccuggaagugauuccccug

SEQ ID NO: 284951 - RNA, 22 nt, Human
acagguggaaacaugguguugg

SEQ ID NO: 284952 - RNA, 22 nt, Human
cccagugucucuugugccuuuc

SEQ ID NO: 284953 - RNA, 22 nt, Human
cugcaggagcaaagccucugcu

SEQ ID NO: 284954 - RNA, 22 nt, Human
accccccagauaaucccuugag

SEQ ID NO: 284955 - RNA, 22 nt, Human
agaugggugccuucuuucuuua

SEQ ID NO: 284956 - RNA, 22 nt, Human
cccagugugguucuuuggagaa

SEQ ID NO: 284957 - RNA, 22 nt, Human
cucccugggccucaguuucucu

SEQ ID NO: 284958 - RNA, 22 nt, Human
ucugccaggccacacagggcac

SEQ ID NO: 284959 - RNA, 22 nt, Human
ucugggaagcugcgugccuguu

SEQ ID NO: 284960 - RNA, 22 nt, Human
ccagcuuuaucaagucugagcu

SEQ ID NO: 284961 - RNA, 22 nt, Human
acagguggcagaagcauuuacu

SEQ ID NO: 284962 - RNA, 22 nt, Human
uagggauggaaacuaggaaucu

SEQ ID NO: 284963 - RNA, 22 nt, Human
aggccagguggucaugcuugcu

SEQ ID NO: 284964 - RNA, 22 nt, Human
aaacuguaagagaauaaacuac

SEQ ID NO: 284965 - RNA, 20 nt, Human
ccucuguguccugugucaua

SEQ ID NO: 284966 - RNA, 22 nt, Human
uccugcagugugucuccugcac

SEQ ID NO: 284967 - RNA, 14 nt, Human
agcugcaagcaucc

SEQ ID NO: 284968 - RNA, 22 nt, Human
gcucagaguuaaauauagugcu

SEQ ID NO: 284969 - RNA, 22 nt, Human
uuagaagucaucuagucuaaaa

SEQ ID NO: 284970 - RNA, 22 nt, Human
aaucauucuuauuucacagcaa

SEQ ID NO: 284971 - RNA, 22 nt, Human
cuagcuguguaaaccgagcugc

SEQ ID NO: 284972 - RNA, 22 nt, Human
cccugguucagguuucucugaa

SEQ ID NO: 284973 - RNA, 22 nt, Human
agugucuuacucccucaggcac

SEQ ID NO: 284974 - RNA, 22 nt, Human
gcccaggggcagcgcauagugg

SEQ ID NO: 284975 - RNA, 22 nt, Human
ugacaggucauauaagcuugca

SEQ ID NO: 284976 - RNA, 22 nt, Human
ggauccugauauguguuucuca

SEQ ID NO: 284977 - RNA, 22 nt, Human
ggcccagucuggggcccuguga

SEQ ID NO: 284978 - RNA, 22 nt, Human
uguccuuuaugaaaugguguuu

SEQ ID NO: 284979 - RNA, 22 nt, Human
guuauuuucauuggcucagacu

SEQ ID NO: 284980 - RNA, 22 nt, Human
auuagggaaacugacuugucuc

SEQ ID NO: 284981 - RNA, 22 nt, Human
agugucaaauuaaauaaucugg

SEQ ID NO: 284982 - RNA, 22 nt, Human
acagucuacuaaacaucaucag

SEQ ID NO: 284983 - RNA, 20 nt, Human
gcucaguggagaaaugcacc

SEQ ID NO: 284984 - RNA, 22 nt, Human
ucuggguggugucuuccaagac

SEQ ID NO: 284985 - RNA, 22 nt, Human
gcaaacaugcugagaaauaaga

SEQ ID NO: 284986 - RNA, 22 nt, Human
agcagguuuaaacucuaaugca

SEQ ID NO: 284987 - RNA, 21 nt, Human
agggucaggaaccaggguacc

SEQ ID NO: 284988 - RNA, 22 nt, Human
agucauuuaucuuagccauuau

SEQ ID NO: 284989 - RNA, 22 nt, Human
ucagaacaauuccuuuauaaca

SEQ ID NO: 284990 - RNA, 22 nt, Human
ucuccacaaguguugagaguac

SEQ ID NO: 284991 - RNA, 22 nt, Human
uccugggucugggugucugagg

SEQ ID NO: 284992 - RNA, 22 nt, Human
acagcuuugggcaaugcuauga

SEQ ID NO: 284993 - RNA, 22 nt, Human
ccaggcuuccuaaugugugcag

SEQ ID NO: 284994 - RNA, 19 nt, Human
guccaguguuuuccaguca

SEQ ID NO: 284995 - RNA, 22 nt, Human
uccaggcaaagggacuagcagg

SEQ ID NO: 284996 - RNA, 22 nt, Human
cagaggaaguuccuugaugaga

SEQ ID NO: 284997 - RNA, 22 nt, Human
uuagcuucuuacauuucauccu

SEQ ID NO: 284998 - RNA, 22 nt, Human
gagcugugaaaagugccugggg

SEQ ID NO: 284999 - RNA, 22 nt, Human
uaggugucaggccuccuccagc

SEQ ID NO: 285000 - RNA, 22 nt, Human
auaguuuuaaaaccucaggaag

SEQ ID NO: 285001 - RNA, 22 nt, Human
agcugccagcaaguuucaaaca

SEQ ID NO: 285002 - RNA, 22 nt, Human
agagggcaugcuugguggccug

SEQ ID NO: 285003 - RNA, 22 nt, Human
auuauuuuaugugcggccugau

SEQ ID NO: 285004 - RNA, 22 nt, Human
uuucugcaaguguagauaccca

SEQ ID NO: 285005 - RNA, 22 nt, Human
acugaggauggauaggucauau

SEQ ID NO: 285006 - RNA, 22 nt, Human
auaguacaaucaguuaauuagu

SEQ ID NO: 285007 - RNA, 22 nt, Human
ucagcacugaaauucuucacau

SEQ ID NO: 285008 - RNA, 22 nt, Human
ugcuggagcaacauuauugugc

SEQ ID NO: 285009 - RNA, 22 nt, Human
caugauaauuguuaacaaagua

SEQ ID NO: 285010 - RNA, 22 nt, Human
aagucacuggcaaaagcugcag

SEQ ID NO: 285011 - RNA, 22 nt, Human
aucacacuguuauuuuaguuaa

SEQ ID NO: 285012 - RNA, 22 nt, Human
cccucucccugcagaauguggc

SEQ ID NO: 285013 - RNA, 22 nt, Human
ccugccuguacuagagacccag

SEQ ID NO: 285014 - RNA, 19 nt, Human
ccaggccucuggggccugu

SEQ ID NO: 285015 - RNA, 22 nt, Human
aaggugucauuguuuauggaga

SEQ ID NO: 285016 - RNA, 23 nt, Human
uauuagggccaggacuggcaaau

SEQ ID NO: 285017 - RNA, 22 nt, Human
caguuuugguccuuucuaggua

SEQ ID NO: 285018 - RNA, 22 nt, Human
ucuggcagcagcaucaguggcu

SEQ ID NO: 285019 - RNA, 22 nt, Human
uccuggcccgaucccugugaag

SEQ ID NO: 285020 - RNA, 22 nt, Human
augguacagugcacugaaugga

SEQ ID NO: 285021 - RNA, 22 nt, Human
aagucuaaguuuguaacuugga

SEQ ID NO: 285022 - RNA, 22 nt, Human
ugcccugggaggcuuuccuguu

SEQ ID NO: 285023 - RNA, 22 nt, Human
ggggcaggagguguucucuuuu

SEQ ID NO: 285024 - RNA, 21 nt, Human
agccugcaauguagguaccgg

SEQ ID NO: 285025 - RNA, 22 nt, Human
ggcaguagccagggacuggcag

SEQ ID NO: 285026 - RNA, 22 nt, Human
auuucuguugcuuauaaauuac

SEQ ID NO: 285027 - RNA, 22 nt, Human
gagagucuagugcaccuaguuu

SEQ ID NO: 285028 - RNA, 22 nt, Human
ggagggggaauucagccccagc

SEQ ID NO: 285029 - RNA, 22 nt, Human
gucugcccuuggcucagccaua

SEQ ID NO: 285030 - RNA, 20 nt, Human
cugcagggugagugggcgau

SEQ ID NO: 285031 - RNA, 21 nt, Human
aaaaaugaaguuguucaggaa

SEQ ID NO: 285032 - RNA, 22 nt, Human
ucccagugagaugaaacaggua

SEQ ID NO: 285033 - RNA, 22 nt, Human
ggcagcuucucccaggcuguuu

SEQ ID NO: 285034 - RNA, 23 nt, Human
ucaggugugcggacugcugaguc

SEQ ID NO: 285035 - RNA, 22 nt, Human
agggcagcaaugcagcugcugc

SEQ ID NO: 285036 - RNA, 22 nt, Human
ucccagaagugaaauuucuaga

SEQ ID NO: 285037 - RNA, 22 nt, Human
uuacagugagggugacauuuac

SEQ ID NO: 285038 - RNA, 22 nt, Human
ucaggaaacuacaguugaacua

SEQ ID NO: 285039 - RNA, 22 nt, Human
ccucagcugcuucccuggagcc

SEQ ID NO: 285040 - RNA, 22 nt, Human
ucuuuauuuuaugcuugugcaa

SEQ ID NO: 285041 - RNA, 23 nt, Human
ucugcaagauaaugaagaugaua

SEQ ID NO: 285042 - RNA, 22 nt, Human
ugcauaaagugccauaguauua

SEQ ID NO: 285043 - RNA, 22 nt, Human
cagcucagacgcaggucgagca

SEQ ID NO: 285044 - RNA, 22 nt, Human
caggauggccccggggcugugc

SEQ ID NO: 285045 - RNA, 22 nt, Human
ggcugucucugugacugccacc

SEQ ID NO: 285046 - RNA, 22 nt, Human
aauaugaauuauuguuacaagu

SEQ ID NO: 285047 - RNA, 22 nt, Human
uccugagguauaugcuuugcag

SEQ ID NO: 285048 - RNA, 22 nt, Human
agaggggaaggaugugauguga

SEQ ID NO: 285049 - RNA, 22 nt, Human
ugcagguggcagcggggcacca

SEQ ID NO: 285050 - RNA, 22 nt, Human
cagugcaguugguggcaggggu

SEQ ID NO: 285051 - RNA, 22 nt, Human
aagucuuuuugaaucuauaacu

SEQ ID NO: 285052 - RNA, 22 nt, Human
gccccaccugcuaccuuccagc

SEQ ID NO: 285053 - RNA, 22 nt, Human
ccugugacauuagaauuucauu

SEQ ID NO: 285054 - RNA, 22 nt, Human
aagcugcagacccccugucuca

SEQ ID NO: 285055 - RNA, 22 nt, Human
aacucuuuggucucaggaaagg

SEQ ID NO: 285056 - RNA, 22 nt, Human
guacaaaugcagguuuguuaca

SEQ ID NO: 285057 - RNA, 22 nt, Human
ugaccugucacauuuugaugaa

SEQ ID NO: 285058 - RNA, 22 nt, Human
uccuucuuucccccuagucauu

SEQ ID NO: 285059 - RNA, 22 nt, Human
gagcuuuagcugagaccugcuu

SEQ ID NO: 285060 - RNA, 22 nt, Human
aaaggaggccacauggcuagga

SEQ ID NO: 285061 - RNA, 22 nt, Human
aagauuuuuuuccacagacuca

SEQ ID NO: 285062 - RNA, 22 nt, Human
cccaggcaguagaaagaagagg

SEQ ID NO: 285063 - RNA, 22 nt, Human
agcauguucaucuucuguuggu

SEQ ID NO: 285064 - RNA, 22 nt, Human
gaggcuggcagaaaagcacagg

SEQ ID NO: 285065 - RNA, 22 nt, Human
ugagccaguucuucagauccau

SEQ ID NO: 285066 - RNA, 22 nt, Human
aucugacaaggccacauauucu

SEQ ID NO: 285067 - RNA, 22 nt, Human
guuacaaaggacugggggccac

SEQ ID NO: 285068 - RNA, 22 nt, Human
caggcagcugcgacaagagagc

SEQ ID NO: 285069 - RNA, 22 nt, Human
ucugggugcuacaaacaguauu

SEQ ID NO: 285070 - RNA, 22 nt, Human
ugggccagcacugggugcucau

SEQ ID NO: 285071 - RNA, 22 nt, Human
cacaagcugggcaaguguauau

SEQ ID NO: 285072 - RNA, 22 nt, Human
guugcugggagcagggauccug

SEQ ID NO: 285073 - RNA, 22 nt, Human
augaaaauugacagcggaagua

SEQ ID NO: 285074 - RNA, 22 nt, Human
agagccaggaaguggcgugggg

SEQ ID NO: 285075 - RNA, 20 nt, Human
uugaagagucagguagggcc

SEQ ID NO: 285076 - RNA, 22 nt, Human
uggguagaguggagggauaaga

SEQ ID NO: 285077 - RNA, 19 nt, Human
uccuggcacaguggaacca

SEQ ID NO: 285078 - RNA, 18 nt, Human
aggcaggugcuggaaguc

SEQ ID NO: 285079 - RNA, 22 nt, Human
caguuucuucuauuuugaacua

SEQ ID NO: 285080 - RNA, 22 nt, Human
caugcagucaauaaacaugugu

SEQ ID NO: 285081 - RNA, 19 nt, Human
ugcuguccucagaguaagu

SEQ ID NO: 285082 - RNA, 20 nt, Human
agggcugagaagggacuagc

SEQ ID NO: 285083 - RNA, 22 nt, Human
cuuauauuuuaggaacagacaa

SEQ ID NO: 285084 - RNA, 22 nt, Human
cuggaggaauaaucuccuaccc

SEQ ID NO: 285085 - RNA, 22 nt, Human
cauaugaaauaugaguugaaca

SEQ ID NO: 285086 - RNA, 22 nt, Human
aaugugucccuuauuucacagg

SEQ ID NO: 285087 - RNA, 22 nt, Human
gaaggcaucacagaggcuguga

SEQ ID NO: 285088 - RNA, 19 nt, Human
ucacauucagccuugcuga

SEQ ID NO: 285089 - RNA, 22 nt, Human
cucuuaaaaacuugauauauuu

SEQ ID NO: 285090 - RNA, 22 nt, Human
uagggagaggaagcaggccgcu

SEQ ID NO: 285091 - RNA, 22 nt, Human
gggguggauuccuacaggucca

SEQ ID NO: 285092 - RNA, 22 nt, Human
cccagugucauucuaagggagg

SEQ ID NO: 285093 - RNA, 22 nt, Human
ccugggugaaugauauucuaaa

SEQ ID NO: 285094 - RNA, 22 nt, Human
gccugcagugagugcagaaggu

SEQ ID NO: 285095 - RNA, 19 nt, Human
gcugggugaggucguugga

SEQ ID NO: 285096 - RNA, 23 nt, Human
agaggggagcaucugcuggcuga

SEQ ID NO: 285097 - RNA, 22 nt, Human
cagaggcugccagccaugugca

SEQ ID NO: 285098 - RNA, 18 nt, Human
ugcuuggagcauuuacca

SEQ ID NO: 285099 - RNA, 22 nt, Human
uacaguuuacaugagaggaagc

SEQ ID NO: 285100 - RNA, 22 nt, Human
aaauaauugaguuggucaauau

SEQ ID NO: 285101 - RNA, 19 nt, Human
agcaguuauaugcauggga

SEQ ID NO: 285102 - RNA, 22 nt, Human
gcagcuuuaaucugaauaagua

SEQ ID NO: 285103 - RNA, 22 nt, Human
uucaugugauaaaugugugacu

SEQ ID NO: 285104 - RNA, 22 nt, Human
ucccaccccuugacucuuuaag

SEQ ID NO: 285105 - RNA, 22 nt, Human
cugaggagaccaucaacuaauu

SEQ ID NO: 285106 - RNA, 20 nt, Human
uucaggaauaagauagcagc

SEQ ID NO: 285107 - RNA, 22 nt, Human
ucaggauggagggaagcacaga

SEQ ID NO: 285108 - RNA, 22 nt, Human
uguuuggaaacacuggcagaaa

SEQ ID NO: 285109 - RNA, 22 nt, Human
uacugcaugguggaguggagcu

SEQ ID NO: 285110 - RNA, 22 nt, Human
ucuggcaggauaucgaagugaa

SEQ ID NO: 285111 - RNA, 22 nt, Human
uuccuacauuuguacaauaaga

SEQ ID NO: 285112 - RNA, 22 nt, Human
aacuaaaucuggcauuuagagc

SEQ ID NO: 285113 - RNA, 19 nt, Human
cucagucuggcucugccug

SEQ ID NO: 285114 - RNA, 22 nt, Human
ugagcuggucuugaguguagcu

SEQ ID NO: 285115 - RNA, 22 nt, Human
ucuacauuuucuuuauguacau

SEQ ID NO: 285116 - RNA, 22 nt, Human
gaggugucuggccuuuguagga

SEQ ID NO: 285117 - RNA, 22 nt, Human
uuagcuuucuuggagaauuaca

SEQ ID NO: 285118 - RNA, 22 nt, Human
uuucuacuuuggaaugcacuga

SEQ ID NO: 285119 - RNA, 22 nt, Human
ccauaaucuggcuuugagagag

SEQ ID NO: 285120 - RNA, 22 nt, Human
aagcccuggcccaaccuugauu

SEQ ID NO: 285121 - RNA, 22 nt, Human
uuauauaaagauaacuuuucuu

SEQ ID NO: 285122 - RNA, 22 nt, Human
ucugaagaauaggauguugugu

SEQ ID NO: 285123 - RNA, 22 nt, Human
uguccugggccggcgacugguc

SEQ ID NO: 285124 - RNA, 22 nt, Human
ugguuccaagauggcugccaca

SEQ ID NO: 285125 - RNA, 22 nt, Human
aauugcuugucuucuucccuac

SEQ ID NO: 285126 - RNA, 22 nt, Human
gccuguuuccaucaacacaugc

SEQ ID NO: 285127 - RNA, 22 nt, Human
caugugucuuuauggagccaca

SEQ ID NO: 285128 - RNA, 23 nt, Human
aaugacagugugugauugaagaa

SEQ ID NO: 285129 - RNA, 22 nt, Human
uauaauuuuagaagagauggaa

SEQ ID NO: 285130 - RNA, 22 nt, Human
ugggcagacuaaggucaaagcu

SEQ ID NO: 285131 - RNA, 22 nt, Human
ucuccccaaccauggcacucac

SEQ ID NO: 285132 - RNA, 22 nt, Human
uaugaaaauuuagcugaagcau

SEQ ID NO: 285133 - RNA, 22 nt, Human
gcauguguuauuuuauguauga

SEQ ID NO: 285134 - RNA, 22 nt, Human
acagguggggaggcugagguuc

SEQ ID NO: 285135 - RNA, 22 nt, Human
uugaaucuauaauuucaguauu

SEQ ID NO: 285136 - RNA, 22 nt, Human
cacccagcagcacuuaagacua

SEQ ID NO: 285137 - RNA, 22 nt, Human
caagcguggcugcucugaugga

SEQ ID NO: 285138 - RNA, 18 nt, Human
agcaggugugcagaaugu

SEQ ID NO: 285139 - RNA, 22 nt, Human
ggggcuccagucuucacauuuu

SEQ ID NO: 285140 - RNA, 22 nt, Human
ugacauguuagggaaaugugau

SEQ ID NO: 285141 - RNA, 22 nt, Human
ggggaccuuuccauuucugaga

SEQ ID NO: 285142 - RNA, 22 nt, Human
uagggcaguuucauguuaucuu

SEQ ID NO: 285143 - RNA, 22 nt, Human
acuuucuuggucccauguuuga

SEQ ID NO: 285144 - RNA, 22 nt, Human
cgggcuccgggucuuugcaguc

SEQ ID NO: 285145 - RNA, 22 nt, Human
ggcaggcaaugaggaugggaag

SEQ ID NO: 285146 - RNA, 22 nt, Human
uaaaugagauguacauaacuca

SEQ ID NO: 285147 - RNA, 22 nt, Human
ccuccagcgcgauccacuccgg

SEQ ID NO: 285148 - RNA, 22 nt, Human
agcaaacauucagcagauuggc

SEQ ID NO: 285149 - RNA, 21 nt, Human
uggccaaacuggagcauuuga

SEQ ID NO: 285150 - RNA, 22 nt, Human
uuauauuguguaauaagugaag

SEQ ID NO: 285151 - RNA, 22 nt, Human
augcagcuucaggauuaugaug

SEQ ID NO: 285152 - RNA, 22 nt, Human
uacauuccugggcuccacccua

SEQ ID NO: 285153 - RNA, 22 nt, Human
aggccaaguagccgcuguccua

SEQ ID NO: 285154 - RNA, 22 nt, Human
ggugagggaguggaacgaggug

SEQ ID NO: 285155 - RNA, 21 nt, Human
aguuugaugcaauuucugaga

SEQ ID NO: 285156 - RNA, 22 nt, Human
caguuaaagcugcaugugucag

SEQ ID NO: 285157 - RNA, 22 nt, Human
gucuucuuuucagucugcuugu

SEQ ID NO: 285158 - RNA, 22 nt, Human
cuaacugucaugcacauguguu

SEQ ID NO: 285159 - RNA, 22 nt, Human
acuguggccggaacagugggac

SEQ ID NO: 285160 - RNA, 22 nt, Human
ucgccauggaaguccuugcgga

SEQ ID NO: 285161 - RNA, 22 nt, Human
gaggggucuuuuguugucaggg

SEQ ID NO: 285162 - RNA, 23 nt, Human
acagacuguauucaaaguaggac

SEQ ID NO: 285163 - RNA, 22 nt, Human
ucugggaacucugucauuuccc

SEQ ID NO: 285164 - RNA, 22 nt, Human
cuucagaggggacucaaaguca

SEQ ID NO: 285165 - RNA, 22 nt, Human
ugccauccuugaggaagggcaa

SEQ ID NO: 285166 - RNA, 22 nt, Human
uguccuuuguucccugucucug

SEQ ID NO: 285167 - RNA, 22 nt, Human
uguccuagaguacauuccacug

SEQ ID NO: 285168 - RNA, 22 nt, Human
aguaaaauuaauggaucagaag

SEQ ID NO: 285169 - RNA, 22 nt, Human
ucugucaucuguucagugcuca

SEQ ID NO: 285170 - RNA, 19 nt, Human
cagggauggguagggacuc

SEQ ID NO: 285171 - RNA, 18 nt, Human
aggagaaagggaccaggg

SEQ ID NO: 285172 - RNA, 22 nt, Human
cccccagaugcgagccauagcc

SEQ ID NO: 285173 - RNA, 22 nt, Human
agauuccagaucccaaaaauga

SEQ ID NO: 285174 - RNA, 22 nt, Human
guucuucaucuuaaccaucugu

SEQ ID NO: 285175 - RNA, 22 nt, Human
uauuccagguauucuucaagag

SEQ ID NO: 285176 - RNA, 22 nt, Human
agagaggcgaguuaccugugcu

SEQ ID NO: 285177 - RNA, 22 nt, Human
gguaauaagaucuguuacaugg

SEQ ID NO: 285178 - RNA, 22 nt, Human
caguuucuuuccauuguuaccu

SEQ ID NO: 285179 - RNA, 22 nt, Human
auaaaugugaauuagagcuuug

SEQ ID NO: 285180 - RNA, 22 nt, Human
aucugcuugaaugagcaacagg

SEQ ID NO: 285181 - RNA, 22 nt, Human
ugccaguguggaacuaggaaga

SEQ ID NO: 285182 - RNA, 21 nt, Human
gcuuuuuguauggcccaggaa

SEQ ID NO: 285183 - RNA, 22 nt, Human
caggaacacaaugagucucaaa

SEQ ID NO: 285184 - RNA, 22 nt, Human
uuccuagaaugguuagaaaaua

SEQ ID NO: 285185 - RNA, 22 nt, Human
uccugagcugccgcaucagcag

SEQ ID NO: 285186 - RNA, 22 nt, Human
aucugguaugagguuuugcuuu

SEQ ID NO: 285187 - RNA, 22 nt, Human
ugucauuuaugcuucuucagug

SEQ ID NO: 285188 - RNA, 22 nt, Human
aaagccuuugucucaggcucug

SEQ ID NO: 285189 - RNA, 21 nt, Human
aggcucccagaaaugggcauc

SEQ ID NO: 285190 - RNA, 22 nt, Human
gcugccacucugagcuugcuuc

SEQ ID NO: 285191 - RNA, 22 nt, Human
gggaucuugaaacagcuggauu

SEQ ID NO: 285192 - RNA, 22 nt, Human
aacauacauauuucagugucca

SEQ ID NO: 285193 - RNA, 22 nt, Human
uuguagaaucauuauuucuagu

SEQ ID NO: 285194 - RNA, 22 nt, Human
aacauucaccucuaccuccuuc

SEQ ID NO: 285195 - RNA, 22 nt, Human
uuacagcauuuaaugagaucug

SEQ ID NO: 285196 - RNA, 22 nt, Human
aacauucaauugaggaaguuaa

SEQ ID NO: 285197 - RNA, 22 nt, Human
ccacccagcagaggaggcaaga

SEQ ID NO: 285198 - RNA, 22 nt, Human
cauauucuuuaagcaaugcucu

SEQ ID NO: 285199 - RNA, 22 nt, Human
cauucauuagaauagauaugua

SEQ ID NO: 285200 - RNA, 22 nt, Human
gcugggcucauuugugugucug

SEQ ID NO: 285201 - RNA, 22 nt, Human
agccuucagcaguucaggugcc

SEQ ID NO: 285202 - RNA, 22 nt, Human
agaguuggcccacguguaggcg

SEQ ID NO: 285203 - RNA, 22 nt, Human
aggauccuuuuucugcuguuug

SEQ ID NO: 285204 - RNA, 22 nt, Human
uuccagauguuuaaguucugcu

SEQ ID NO: 285205 - RNA, 22 nt, Human
acauguguuuuccuacuuauga

SEQ ID NO: 285206 - RNA, 22 nt, Human
uggcuugggagauucucgaacu

SEQ ID NO: 285207 - RNA, 22 nt, Human
gaaguuuucugaggcuguagcu

SEQ ID NO: 285208 - RNA, 22 nt, Human
aagaaucauccugcaagagucu

SEQ ID NO: 285209 - RNA, 22 nt, Human
uucuaaauuuuggaagaugcag

SEQ ID NO: 285210 - RNA, 22 nt, Human
ucaccaaguccauaugcaucau

SEQ ID NO: 285211 - RNA, 22 nt, Human
gugaaaaaugauuuguuaacug

SEQ ID NO: 285212 - RNA, 22 nt, Human
uuccagaaaguucuggaacugg

SEQ ID NO: 285213 - RNA, 22 nt, Human
cuuguucugugcuucuuacauu

SEQ ID NO: 285214 - RNA, 22 nt, Human
auauuccauugguuucccuucu

SEQ ID NO: 285215 - RNA, 22 nt, Human
aggugggguucagucucagccg

SEQ ID NO: 285216 - RNA, 22 nt, Human
uuucuagaugcggggcuugugc

SEQ ID NO: 285217 - RNA, 22 nt, Human
aacagacauauuuuuaauaugc

SEQ ID NO: 285218 - RNA, 22 nt, Human
caagagcugaggcuggagaggu

SEQ ID NO: 285219 - RNA, 22 nt, Human
caggcugcggccgugugagcau

SEQ ID NO: 285220 - RNA, 22 nt, Human
uaauaauuggcuaacccuggga

SEQ ID NO: 285221 - RNA, 19 nt, Human
gccucugagggcaggacac

SEQ ID NO: 285222 - RNA, 22 nt, Human
gagcccagcugcggcccucagc

SEQ ID NO: 285223 - RNA, 22 nt, Human
gaaacaugucugacaauuuacc

SEQ ID NO: 285224 - RNA, 22 nt, Human
acuguacugaaaaguaagcaag

SEQ ID NO: 285225 - RNA, 22 nt, Human
cuuuauggaaucaaagacugga

SEQ ID NO: 285226 - RNA, 22 nt, Human
ucaaggcacuucaugucucagu

SEQ ID NO: 285227 - RNA, 20 nt, Human
cguguccuuggcgggagagc

SEQ ID NO: 285228 - RNA, 22 nt, Human
aacaguaaaaaucauuuaguug

SEQ ID NO: 285229 - RNA, 22 nt, Human
uuuagguucuuggaaucagucu

SEQ ID NO: 285230 - RNA, 22 nt, Human
caguggcugguuagggacagga

SEQ ID NO: 285231 - RNA, 22 nt, Human
caucacuguccucagcauucca

SEQ ID NO: 285232 - RNA, 22 nt, Human
ccauguguaaauuagauaacuc

SEQ ID NO: 285233 - RNA, 22 nt, Human
auuugcuuuaagguauaaaagg

SEQ ID NO: 285234 - RNA, 22 nt, Human
ucucuucugaaaccugucuuua

SEQ ID NO: 285235 - RNA, 22 nt, Human
cacuuuauaaaauuggugugag

SEQ ID NO: 285236 - RNA, 22 nt, Human
agcuccugugugcccaccugcu

SEQ ID NO: 285237 - RNA, 22 nt, Human
uccagagguauguagagaguau

SEQ ID NO: 285238 - RNA, 22 nt, Human
uguaaaaccaaaucaaucuagu

SEQ ID NO: 285239 - RNA, 22 nt, Human
gacaggugagaugaggaacacc

SEQ ID NO: 285240 - RNA, 22 nt, Human
uacauguggguuaaaaacacuc

SEQ ID NO: 285241 - RNA, 22 nt, Human
ucugaaaugcaaauuugacuga

SEQ ID NO: 285242 - RNA, 22 nt, Human
cuggcccuugacuuacagcagg

SEQ ID NO: 285243 - RNA, 22 nt, Human
agggccucuaccauccaagguu

SEQ ID NO: 285244 - RNA, 22 nt, Human
gccuccugaaaggaagagcucc

SEQ ID NO: 285245 - RNA, 23 nt, Human
cugguaaaucacuaaaauuacaa

SEQ ID NO: 285246 - RNA, 22 nt, Human
aggaucugugccucaacccaga

SEQ ID NO: 285247 - RNA, 22 nt, Human
cauuccugagggcccccuacuu

SEQ ID NO: 285248 - RNA, 22 nt, Human
aaguccuuuaauaucacauagu

SEQ ID NO: 285249 - RNA, 22 nt, Human
auucauaacggcaaaugucacc

SEQ ID NO: 285250 - RNA, 22 nt, Human
uauagauagacugacgauacag

SEQ ID NO: 285251 - RNA, 22 nt, Human
cuguggaaggccuguccugaaa

SEQ ID NO: 285252 - RNA, 22 nt, Human
ucagagagguuggugauaagaa

SEQ ID NO: 285253 - RNA, 22 nt, Human
gggccaggucggugaaugguca

SEQ ID NO: 285254 - RNA, 22 nt, Human
ugagccaggaguuugaggcugu

SEQ ID NO: 285255 - RNA, 21 nt, Human
uucucagaucgaguagugaga

SEQ ID NO: 285256 - RNA, 22 nt, Human
acaccuuugccccaagucauag

SEQ ID NO: 285257 - RNA, 22 nt, Human
auugaaaauauaauucuaggag

SEQ ID NO: 285258 - RNA, 22 nt, Human
cugggugaguauaggaaaggga

SEQ ID NO: 285259 - RNA, 22 nt, Human
agaaugcaguuugaaauaaggu

SEQ ID NO: 285260 - RNA, 22 nt, Human
aaagcaaacagaaccccaagcu

SEQ ID NO: 285261 - RNA, 21 nt, Human
auucaacuagaugauuauuuc

SEQ ID NO: 285262 - RNA, 22 nt, Human
ucuucuuccucauuuauacaua

SEQ ID NO: 285263 - RNA, 22 nt, Human
auauuuuggcaaaugucuagau

SEQ ID NO: 285264 - RNA, 22 nt, Human
guauuagguuggugcaaaagua

SEQ ID NO: 285265 - RNA, 22 nt, Human
cuuagugaggaaugaauuuguu

SEQ ID NO: 285266 - RNA, 22 nt, Human
aucugaagggaaguggaaggca

SEQ ID NO: 285267 - RNA, 22 nt, Human
uucuggguaacaaggcaagaau

SEQ ID NO: 285268 - RNA, 22 nt, Human
aggcuuagaaaggguaagugac

SEQ ID NO: 285269 - RNA, 21 nt, Human
ugcuauuuaauuuuucuguuc

SEQ ID NO: 285270 - RNA, 22 nt, Human
uucauucaagggguuccugauu

SEQ ID NO: 285271 - RNA, 22 nt, Human
ggaggugaucagaguuuugagg

SEQ ID NO: 285272 - RNA, 22 nt, Human
uccugaggcacaauccuagaau

SEQ ID NO: 285273 - RNA, 22 nt, Human
cagcugucuaaguugagcagga

SEQ ID NO: 285274 - RNA, 22 nt, Human
augaggaggucaggccuuacaa

SEQ ID NO: 285275 - RNA, 21 nt, Human
cauuagggcagaagcaggaag

SEQ ID NO: 285276 - RNA, 22 nt, Human
ucuuggaaguagaacacagucu

SEQ ID NO: 285277 - RNA, 20 nt, Human
uuccuggcucuaggaccuug

SEQ ID NO: 285278 - RNA, 22 nt, Human
acgugcaggaucugguuggcga

SEQ ID NO: 285279 - RNA, 22 nt, Human
uggugcagucauuggcccaggg

SEQ ID NO: 285280 - RNA, 22 nt, Human
gucaggaaaaauugauaauuuu

SEQ ID NO: 285281 - RNA, 22 nt, Human
agagagcaguggaucaccuagc

SEQ ID NO: 285282 - RNA, 22 nt, Human
uguauguauguauguauuuggg

SEQ ID NO: 285283 - RNA, 20 nt, Human
aggaggcaauguagauaagc

SEQ ID NO: 285284 - RNA, 22 nt, Human
caagauuugccaguggccaacu

SEQ ID NO: 285285 - RNA, 22 nt, Human
agcagguguagggcucuuugua

SEQ ID NO: 285286 - RNA, 22 nt, Human
aacucaguuacauauuagaaua

SEQ ID NO: 285287 - RNA, 22 nt, Human
uucuucuuuaucucaguauccu

SEQ ID NO: 285288 - RNA, 21 nt, Human
ccugggugggaccccucuucc

SEQ ID NO: 285289 - RNA, 22 nt, Human
ugcaggaaguuuccugaacuuu

SEQ ID NO: 285290 - RNA, 22 nt, Human
aaauauuguuuugguaagcuuc

SEQ ID NO: 285291 - RNA, 22 nt, Human
cagaugcagcaaaaugacaggc

SEQ ID NO: 285292 - RNA, 22 nt, Human
aaggaucugacagacuauagaa

SEQ ID NO: 285293 - RNA, 22 nt, Human
agggcuccgggccaccggccug

SEQ ID NO: 285294 - RNA, 22 nt, Human
ugagggagcacacacugaagug

SEQ ID NO: 285295 - RNA, 22 nt, Human
caccugccugcaggggcuccac

SEQ ID NO: 285296 - RNA, 22 nt, Human
ugcaaccugcacucugucuuua

SEQ ID NO: 285297 - RNA, 22 nt, Human
aguagcacaauuuugucccuaa

SEQ ID NO: 285298 - RNA, 23 nt, Human
gccaggcacaugguggacacgca

SEQ ID NO: 285299 - RNA, 22 nt, Human
uaggugucuugucacuaccguu

SEQ ID NO: 285300 - RNA, 22 nt, Human
cagacaugauguaagcagaggc

SEQ ID NO: 285301 - RNA, 22 nt, Human
cauuuauuggcauguaguaggu

SEQ ID NO: 285302 - RNA, 22 nt, Human
ccugugaccacucugguucugc

SEQ ID NO: 285303 - RNA, 22 nt, Human
gagaaaugcuagcuuaggaauc

SEQ ID NO: 285304 - RNA, 22 nt, Human
gcuguacauucugcacaggccc

SEQ ID NO: 285305 - RNA, 22 nt, Human
uaagaaacaugauacuuuuccu

SEQ ID NO: 285306 - RNA, 22 nt, Human
uccaggaacucuugauggugau

SEQ ID NO: 285307 - RNA, 20 nt, Human
acuccugguaacuuuuguga

SEQ ID NO: 285308 - RNA, 22 nt, Human
ucagggcugcagaagaggcagg

SEQ ID NO: 285309 - RNA, 17 nt, Human
cccaggccgccgggagc

SEQ ID NO: 285310 - RNA, 22 nt, Human
gagaaugggaaugaaaguagca

SEQ ID NO: 285311 - RNA, 22 nt, Human
gcagagugaagggagaggugug

SEQ ID NO: 285312 - RNA, 22 nt, Human
auuuuaguaccucaaguaucca

SEQ ID NO: 285313 - RNA, 22 nt, Human
caaaugauagagccgauuauca

SEQ ID NO: 285314 - RNA, 22 nt, Human
gccaggcacugcucuaagcccu

SEQ ID NO: 285315 - RNA, 22 nt, Human
aaaagucucucugaguaaaagu

SEQ ID NO: 285316 - RNA, 22 nt, Human
cugucucugauaagcucgaggg

SEQ ID NO: 285317 - RNA, 22 nt, Human
gccuuccuuuuaccaccagcca

SEQ ID NO: 285318 - RNA, 22 nt, Human
uuuguguuuguacaaugcacua

SEQ ID NO: 285319 - RNA, 23 nt, Human
aaugggugcaacuauccaugaca

SEQ ID NO: 285320 - RNA, 19 nt, Human
gggaccugacuaauuggca

SEQ ID NO: 285321 - RNA, 22 nt, Human
aucagagaaguuucacuggcau

SEQ ID NO: 285322 - RNA, 20 nt, Human
aggucugauuccagaaucag

SEQ ID NO: 285323 - RNA, 22 nt, Human
auggaagacagauaaggcagaa

SEQ ID NO: 285324 - RNA, 22 nt, Human
agaauaauacugaaaugcugaa

SEQ ID NO: 285325 - RNA, 22 nt, Human
agguaaaaugagucuccauuau

SEQ ID NO: 285326 - RNA, 22 nt, Human
uccuggcauuuacaaacccacc

SEQ ID NO: 285327 - RNA, 20 nt, Human
agcaccuguguagaagcauc

SEQ ID NO: 285328 - RNA, 22 nt, Human
agggaccugucaaugacaguua

SEQ ID NO: 285329 - RNA, 22 nt, Human
ccucccugcuccucaacuggca

SEQ ID NO: 285330 - RNA, 22 nt, Human
augugcccucuuagagucucug

SEQ ID NO: 285331 - RNA, 22 nt, Human
acagucuacuugagcuuguaua

SEQ ID NO: 285332 - RNA, 18 nt, Human
aguaaagcuuauuacaug

SEQ ID NO: 285333 - RNA, 22 nt, Human
gaggaaugucagcacaggccuc

SEQ ID NO: 285334 - RNA, 22 nt, Human
aaaguuguucaguaagaaacuc

SEQ ID NO: 285335 - RNA, 19 nt, Human
ggccccucucacaggaguu

SEQ ID NO: 285336 - RNA, 19 nt, Human
ccaggccuggcgucuccgc

SEQ ID NO: 285337 - RNA, 22 nt, Human
ucugguaacucagaagaaagga

SEQ ID NO: 285338 - RNA, 22 nt, Human
cagccaggcccccgagucguug

SEQ ID NO: 285339 - RNA, 22 nt, Human
agacaaauggaguaugagcaac

SEQ ID NO: 285340 - RNA, 22 nt, Human
ucaaauuauuuaggauagugcu

SEQ ID NO: 285341 - RNA, 22 nt, Human
uucacauuaucaggauuguuuc

SEQ ID NO: 285342 - RNA, 22 nt, Human
gcagggcucaacaggacacccc

SEQ ID NO: 285343 - RNA, 22 nt, Human
ucuucagagugaaagucuguga

SEQ ID NO: 285344 - RNA, 22 nt, Human
gcucagagaaauuauaggaauu

SEQ ID NO: 285345 - RNA, 22 nt, Human
cuuauuagaaagaaaagacaug

SEQ ID NO: 285346 - RNA, 22 nt, Human
gaucugaaucaauagaauaacu

SEQ ID NO: 285347 - RNA, 22 nt, Human
caggaacaauguaagucucauu

SEQ ID NO: 285348 - RNA, 23 nt, Human
aggaaagcauucauuuuuaccau

SEQ ID NO: 285349 - RNA, 22 nt, Human
aaggaggaauaaagagguggug

SEQ ID NO: 285350 - RNA, 22 nt, Human
ucccucucccuauugccuggag

SEQ ID NO: 285351 - RNA, 22 nt, Human
caggccuugucaagaaaaugcc

SEQ ID NO: 285352 - RNA, 21 nt, Human
uguuuuccaccuugaggcaag

SEQ ID NO: 285353 - RNA, 22 nt, Human
uccaugguuucagucuggcugg

SEQ ID NO: 285354 - RNA, 22 nt, Human
auuguacaugcagugagucauc

SEQ ID NO: 285355 - RNA, 22 nt, Human
cagggcucagggacugcagaaa

SEQ ID NO: 285356 - RNA, 22 nt, Human
auuauuaggugcucucugacaa

SEQ ID NO: 285357 - RNA, 22 nt, Human
uuccugugucccgggcacccug

SEQ ID NO: 285358 - RNA, 22 nt, Human
aacagagcauucugcacuacaa

SEQ ID NO: 285359 - RNA, 22 nt, Human
uuucuguuguauggcuucugca

SEQ ID NO: 285360 - RNA, 22 nt, Human
aaagcugcuuuaaacaucuaug

SEQ ID NO: 285361 - RNA, 22 nt, Human
cuuuucauuguuuguacaugca

SEQ ID NO: 285362 - RNA, 22 nt, Human
uugcagggucccagaggccugg

SEQ ID NO: 285363 - RNA, 22 nt, Human
ugguacaauggcaucuaucuau

SEQ ID NO: 285364 - RNA, 22 nt, Human
uuaggaagaaggaggcaguauu

SEQ ID NO: 285365 - RNA, 22 nt, Human
gccucuagggcuguugggaauu

SEQ ID NO: 285366 - RNA, 22 nt, Human
agagucaguaacauauauggua

SEQ ID NO: 285367 - RNA, 22 nt, Human
cacugucuucaguuucacugca

SEQ ID NO: 285368 - RNA, 22 nt, Human
aauugcuuguuucuuuaacuga

SEQ ID NO: 285369 - RNA, 22 nt, Human
auuugaauggcuuaacacaacg

SEQ ID NO: 285370 - RNA, 22 nt, Human
uguccugggucccugcuagaag

SEQ ID NO: 285371 - RNA, 22 nt, Human
cugaccaacauggugaaaccuu

SEQ ID NO: 285372 - RNA, 18 nt, Human
agcaggugcuguuucuuu

SEQ ID NO: 285373 - RNA, 22 nt, Human
cuaaucaucuuucucuuaaagc

SEQ ID NO: 285374 - RNA, 22 nt, Human
cauuuguuuauaaguuccccag

SEQ ID NO: 285375 - RNA, 22 nt, Human
uuucucucuuaaggaguuuaaa

SEQ ID NO: 285376 - RNA, 20 nt, Human
ugcagcacgggcccuuucca

SEQ ID NO: 285377 - RNA, 22 nt, Human
cuuccucccggcccaugcucug

SEQ ID NO: 285378 - RNA, 22 nt, Human
augccugcuuacuccaggugcu

SEQ ID NO: 285379 - RNA, 22 nt, Human
uaguuaaagcccuaaauugaua

SEQ ID NO: 285380 - RNA, 22 nt, Human
uuccuagggcagagccgcuggg

SEQ ID NO: 285381 - RNA, 22 nt, Human
aggaauguaguuugaguagaaa

SEQ ID NO: 285382 - RNA, 22 nt, Human
uaggaaaagucuagauugauga

SEQ ID NO: 285383 - RNA, 22 nt, Human
agucucaagggaugucucuaua

SEQ ID NO: 285384 - RNA, 22 nt, Human
uuauccaagcagaagcugcaca

SEQ ID NO: 285385 - RNA, 22 nt, Human
gauucccaugucugaggaggug

SEQ ID NO: 285386 - RNA, 22 nt, Human
uuucugcagcagacucagugug

SEQ ID NO: 285387 - RNA, 22 nt, Human
ucuaugaaaagucuauucauuc

SEQ ID NO: 285388 - RNA, 22 nt, Human
uauacacaaacaagggguuaag

SEQ ID NO: 285389 - RNA, 21 nt, Human
uuaaugcuaugcagaaaaucu

SEQ ID NO: 285390 - RNA, 22 nt, Human
uccuucaagugcaguaccugag

SEQ ID NO: 285391 - RNA, 22 nt, Human
ucagguggccaaaugggagcgc

SEQ ID NO: 285392 - RNA, 22 nt, Human
ggcuccacccugcuuccagaag

SEQ ID NO: 285393 - RNA, 22 nt, Human
aaggcauaugcuguguacaguu

SEQ ID NO: 285394 - RNA, 22 nt, Human
gccaggcagcuagcaaccccug

SEQ ID NO: 285395 - RNA, 22 nt, Human
ugacaagaauuugggacuguua

SEQ ID NO: 285396 - RNA, 22 nt, Human
ucuagaaagccaaauuaggaau

SEQ ID NO: 285397 - RNA, 22 nt, Human
uaaaauugcggugaauauuucc

SEQ ID NO: 285398 - RNA, 22 nt, Human
acuuggauauguucacuagacc

SEQ ID NO: 285399 - RNA, 22 nt, Human
agaaaugaagcaggaguuauua

SEQ ID NO: 285400 - RNA, 22 nt, Human
cucugaauggacacuccagugu

SEQ ID NO: 285401 - RNA, 22 nt, Human
agcaaucaccaccucuauauuu

SEQ ID NO: 285402 - RNA, 22 nt, Human
uuucauaauacuguacaugaaa

SEQ ID NO: 285403 - RNA, 22 nt, Human
cagugaggcucugcugagcggu

SEQ ID NO: 285404 - RNA, 22 nt, Human
ugaggcaaggcugaaugaaggc

SEQ ID NO: 285405 - RNA, 22 nt, Human
caauauauaggaacaacuuagg

SEQ ID NO: 285406 - RNA, 22 nt, Human
uacaaaugaguuguaugaacca

SEQ ID NO: 285407 - RNA, 22 nt, Human
agaggcaugcacagaugugcug

SEQ ID NO: 285408 - RNA, 22 nt, Human
cuuuuuguuguccacacuagga

SEQ ID NO: 285409 - RNA, 22 nt, Human
cacaggccugucucuuucuaac

SEQ ID NO: 285410 - RNA, 18 nt, Human
ucagcuuuugaaaaccaa

SEQ ID NO: 285411 - RNA, 22 nt, Human
uggcuuuacuuaaacugaauca

SEQ ID NO: 285412 - RNA, 22 nt, Human
agguggggcccaccaauuugca

SEQ ID NO: 285413 - RNA, 22 nt, Human
ccagagaggggaagggcuugcc

SEQ ID NO: 285414 - RNA, 22 nt, Human
ucuuuuuuuccugugcagagcu

SEQ ID NO: 285415 - RNA, 22 nt, Human
uguuuuccuccugguuucugcc

SEQ ID NO: 285416 - RNA, 22 nt, Human
gccaucuggcauugcagcaccu

SEQ ID NO: 285417 - RNA, 22 nt, Human
uccuggccuagaguuuguguuc

SEQ ID NO: 285418 - RNA, 22 nt, Human
gaggcacagucccgaggcaagg

SEQ ID NO: 285419 - RNA, 22 nt, Human
aggcacaggaaugucauccagu

SEQ ID NO: 285420 - RNA, 22 nt, Human
cacagcuggggaagcugaggcc

SEQ ID NO: 285421 - RNA, 22 nt, Human
gucucaagggggaacucacugu

SEQ ID NO: 285422 - RNA, 22 nt, Human
uguguucaucaugauaucaggu

SEQ ID NO: 285423 - RNA, 22 nt, Human
ggcaggcacaguaauacauguu

SEQ ID NO: 285424 - RNA, 22 nt, Human
auuuccuugcaaguuucuguaa

SEQ ID NO: 285425 - RNA, 20 nt, Human
guguuucaugugauacaaug

SEQ ID NO: 285426 - RNA, 22 nt, Human
aaggggccucacagaugggcuu

SEQ ID NO: 285427 - RNA, 22 nt, Human
aggacaguggacacuagucccu

SEQ ID NO: 285428 - RNA, 18 nt, Human
agacagacagguuugugc

SEQ ID NO: 285429 - RNA, 22 nt, Human
uauuuaaaauagugcuccagca

SEQ ID NO: 285430 - RNA, 22 nt, Human
ucuauugcagauggaugcccuc

SEQ ID NO: 285431 - RNA, 22 nt, Human
cuccuugguguaguacugagca

SEQ ID NO: 285432 - RNA, 22 nt, Human
cccugaggaaaggguggagggc

SEQ ID NO: 285433 - RNA, 22 nt, Human
caaauuaaugugucucaaaaua

SEQ ID NO: 285434 - RNA, 22 nt, Human
uauaaauuauuaggcugcuaaa

SEQ ID NO: 285435 - RNA, 22 nt, Human
ucuccuggagcaggaagguggg

SEQ ID NO: 285436 - RNA, 22 nt, Human
guguggcugauugacaugguca

SEQ ID NO: 285437 - RNA, 22 nt, Human
cagucuaacuucacagccugga

SEQ ID NO: 285438 - RNA, 22 nt, Human
uugcuguaguguucugauguca

SEQ ID NO: 285439 - RNA, 22 nt, Human
uuuccuguugccaucaagaaug

SEQ ID NO: 285440 - RNA, 22 nt, Human
aggguggcaccuggaagggaug

SEQ ID NO: 285441 - RNA, 22 nt, Human
agguggcuguauucagcuguaa

SEQ ID NO: 285442 - RNA, 22 nt, Human
gccuguuuguuaugucauggua

SEQ ID NO: 285443 - RNA, 22 nt, Human
ugcugucugcaacaguacuaca

SEQ ID NO: 285444 - RNA, 22 nt, Human
gagaaaaugucagacuuggucg

SEQ ID NO: 285445 - RNA, 22 nt, Human
acuguucacuagugaggguuga

SEQ ID NO: 285446 - RNA, 22 nt, Human
agagccagaccauugccgugca

SEQ ID NO: 285447 - RNA, 22 nt, Human
agcuccuggggguuccaagcag

SEQ ID NO: 285448 - RNA, 21 nt, Human
aaucugcuucccugugacuug

SEQ ID NO: 285449 - RNA, 22 nt, Human
uccaggagguagugcuuaauuu

SEQ ID NO: 285450 - RNA, 22 nt, Human
aauauucaaguuauucuuucuu

SEQ ID NO: 285451 - RNA, 22 nt, Human
cucuuagauauggagaauuacc

SEQ ID NO: 285452 - RNA, 22 nt, Human
uguguucauguauguauacaua

SEQ ID NO: 285453 - RNA, 22 nt, Human
cccuuccuugauuuuaacugga

SEQ ID NO: 285454 - RNA, 22 nt, Human
uuauauguuucuguuuggaggc

SEQ ID NO: 285455 - RNA, 22 nt, Human
gagugcauggacuacuggcuug

SEQ ID NO: 285456 - RNA, 22 nt, Human
uguggcugcucaggugcagacc

SEQ ID NO: 285457 - RNA, 22 nt, Human
uggcaggguuggccaccuuacc

SEQ ID NO: 285458 - RNA, 20 nt, Human
uucagagucagcaaaugcag

SEQ ID NO: 285459 - RNA, 21 nt, Human
gcugcaaauucuaacaauuau

SEQ ID NO: 285460 - RNA, 22 nt, Human
acuaucaacaucauugcucuag

SEQ ID NO: 285461 - RNA, 22 nt, Human
uuaguacaagagauuaauuacu

SEQ ID NO: 285462 - RNA, 22 nt, Human
ugggggagccuucacaguagcu

SEQ ID NO: 285463 - RNA, 23 nt, Human
auagucauguaaaauauuugaag

SEQ ID NO: 285464 - RNA, 22 nt, Human
aaaagcacuacaauuucgcuuc

SEQ ID NO: 285465 - RNA, 22 nt, Human
ugcaggguauccuugucucugc

SEQ ID NO: 285466 - RNA, 22 nt, Human
aaguccugugugcuuacacuug

SEQ ID NO: 285467 - RNA, 22 nt, Human
cuuuauguucaguacaaugcuu

SEQ ID NO: 285468 - RNA, 22 nt, Human
uaugcagugguaucauuuuaaa

SEQ ID NO: 285469 - RNA, 22 nt, Human
aaagcagacugauuugcaucac

SEQ ID NO: 285470 - RNA, 22 nt, Human
augugucuaauuccaggagcac

SEQ ID NO: 285471 - RNA, 22 nt, Human
uaauuuaugaugcaaagaaaag

SEQ ID NO: 285472 - RNA, 22 nt, Human
ggagcccuucuauuccauggag

SEQ ID NO: 285473 - RNA, 23 nt, Human
ucuguggccccuucgccccacuc

SEQ ID NO: 285474 - RNA, 22 nt, Human
ccacaggaccagaggagaucac

SEQ ID NO: 285475 - RNA, 23 nt, Human
acauucuugauucaggccuuagc

SEQ ID NO: 285476 - RNA, 22 nt, Human
aguguccuugauuccuguuguu

SEQ ID NO: 285477 - RNA, 22 nt, Human
auggaggaugugcagcaugggc

SEQ ID NO: 285478 - RNA, 22 nt, Human
uccaggcuccccugcgugcucc

SEQ ID NO: 285479 - RNA, 22 nt, Human
ugagaggagugauuguaaaauu

SEQ ID NO: 285480 - RNA, 23 nt, Human
ucuaaaauucaucauuuacguuc

SEQ ID NO: 285481 - RNA, 22 nt, Human
cuaaaugucauggaguuguaga

SEQ ID NO: 285482 - RNA, 22 nt, Human
uccugugagcagcacagagaca

SEQ ID NO: 285483 - RNA, 22 nt, Human
gacucagugauuugacaugccu

SEQ ID NO: 285484 - RNA, 22 nt, Human
acagagagguaaaauauauagu

SEQ ID NO: 285485 - RNA, 20 nt, Human
agaaggcaggagacaaaagg

SEQ ID NO: 285486 - RNA, 22 nt, Human
aacaaucaaguuucuaaaugac

SEQ ID NO: 285487 - RNA, 22 nt, Human
acaggccuggugcugcugacag

SEQ ID NO: 285488 - RNA, 22 nt, Human
auauuuugguagcucucaauga

SEQ ID NO: 285489 - RNA, 22 nt, Human
caggugguuaugaggaagguga

SEQ ID NO: 285490 - RNA, 22 nt, Human
augaaauguaugagucuggguu

SEQ ID NO: 285491 - RNA, 22 nt, Human
agucacacacugucaguucugc

SEQ ID NO: 285492 - RNA, 23 nt, Human
ucuccuggcugcacuguggccac

SEQ ID NO: 285493 - RNA, 22 nt, Human
ucaaucacguguuccauguucu

SEQ ID NO: 285494 - RNA, 22 nt, Human
aaugaucuggcucaggauauca

SEQ ID NO: 285495 - RNA, 22 nt, Human
auguccagccaaccacuggauu

SEQ ID NO: 285496 - RNA, 22 nt, Human
aaaagagaauccuguacagaga

SEQ ID NO: 285497 - RNA, 22 nt, Human
augugcccuuucugcuuugcag

SEQ ID NO: 285498 - RNA, 22 nt, Human
uacuaucucuucuaacuucaga

SEQ ID NO: 285499 - RNA, 22 nt, Human
agucucagaguaccugagggac

SEQ ID NO: 285500 - RNA, 22 nt, Human
uauuucagcaagaagaaugugg

SEQ ID NO: 285501 - RNA, 22 nt, Human
ggcaggcacugugcuaggcgcu

SEQ ID NO: 285502 - RNA, 22 nt, Human
gccaaaucuggauuuagcaaga

SEQ ID NO: 285503 - RNA, 22 nt, Human
uauuuccaagcugaauccaaug

SEQ ID NO: 285504 - RNA, 22 nt, Human
agaggaggcagcuuaacucagu

SEQ ID NO: 285505 - RNA, 22 nt, Human
cagagagagcaggaaaccuccg

SEQ ID NO: 285506 - RNA, 22 nt, Human
uuugaagacauauuguuacaua

SEQ ID NO: 285507 - RNA, 22 nt, Human
caaauacuggguaaguuaauuu

SEQ ID NO: 285508 - RNA, 22 nt, Human
caggcacaagaucggcuagaua

SEQ ID NO: 285509 - RNA, 22 nt, Human
gggucuggcaugcugagaugga

SEQ ID NO: 285510 - RNA, 23 nt, Human
cuccuggaggguccggcccugcc

SEQ ID NO: 285511 - RNA, 22 nt, Human
caggauggagggagggcuguua

SEQ ID NO: 285512 - RNA, 22 nt, Human
acuggacagaggaaauauggag

SEQ ID NO: 285513 - RNA, 22 nt, Human
agacagacuuugaucuggaugu

SEQ ID NO: 285514 - RNA, 22 nt, Human
auccaggaaggauggcauugag

SEQ ID NO: 285515 - RNA, 22 nt, Human
acuagaaacuaauggauuauua

SEQ ID NO: 285516 - RNA, 22 nt, Human
uccuggccacccgacagaaguc

SEQ ID NO: 285517 - RNA, 22 nt, Human
uauuuucauucugugugacugu

SEQ ID NO: 285518 - RNA, 22 nt, Human
ucucagacucuuuagugaaggu

SEQ ID NO: 285519 - RNA, 22 nt, Human
uuaaucugaaucaguaaacacu

SEQ ID NO: 285520 - RNA, 22 nt, Human
cacaaaguguuagaugccacuc

SEQ ID NO: 285521 - RNA, 22 nt, Human
ucugccagguggggagaggcca

SEQ ID NO: 285522 - RNA, 22 nt, Human
gagcaguggugguguguuagag

SEQ ID NO: 285523 - RNA, 22 nt, Human
uucucuuuucaccaguugcuaa

SEQ ID NO: 285524 - RNA, 19 nt, Human
augucacucauguucccug

SEQ ID NO: 285525 - RNA, 22 nt, Human
auauaauacaaccugcuaagug

SEQ ID NO: 285526 - RNA, 23 nt, Human
uucaggaaaugaauacagacaca

SEQ ID NO: 285527 - RNA, 22 nt, Human
auuagauuguaaauguuuucac

SEQ ID NO: 285528 - RNA, 22 nt, Human
ugaccauuugaucuacauucca

SEQ ID NO: 285529 - RNA, 22 nt, Human
uccaggcaugucugaguccuuc

SEQ ID NO: 285530 - RNA, 22 nt, Human
ucauucccccauaaugguauuu

SEQ ID NO: 285531 - RNA, 22 nt, Human
ucucuucauagugacacccauc

SEQ ID NO: 285532 - RNA, 22 nt, Human
aaugcacacauuugguacugaa

SEQ ID NO: 285533 - RNA, 22 nt, Human
aaaacaguuuaggcaucacagu

SEQ ID NO: 285534 - RNA, 22 nt, Human
ucagguguaucauggaguugaa

SEQ ID NO: 285535 - RNA, 22 nt, Human
ugcuagggauauaguggcgagu

SEQ ID NO: 285536 - RNA, 22 nt, Human
cauggcggucaggauguaggug

SEQ ID NO: 285537 - RNA, 22 nt, Human
aaauuauuaugccccucuauaa

SEQ ID NO: 285538 - RNA, 18 nt, Human
auauucaagaagacagag

SEQ ID NO: 285539 - RNA, 22 nt, Human
cuggagggcugcagcgaggcug

SEQ ID NO: 285540 - RNA, 22 nt, Human
ggcuggcuugccaagcucaggg

SEQ ID NO: 285541 - RNA, 22 nt, Human
gccucugucauagcucauguga

SEQ ID NO: 285542 - RNA, 22 nt, Human
acugaaaaagacaucuugguaa

SEQ ID NO: 285543 - RNA, 22 nt, Human
uuacaaagcguugagacaagua

SEQ ID NO: 285544 - RNA, 22 nt, Human
agccuucauaaucuugggcuuu

SEQ ID NO: 285545 - RNA, 22 nt, Human
guucuucagaggggaaagaacc

SEQ ID NO: 285546 - RNA, 22 nt, Human
caacuuuagcaauguuaguaua

SEQ ID NO: 285547 - RNA, 22 nt, Human
ccagguggacggcgaguacagg

SEQ ID NO: 285548 - RNA, 22 nt, Human
aguccaguguguucuggcagca

SEQ ID NO: 285549 - RNA, 22 nt, Human
acugagguuuacuugaaggaga

SEQ ID NO: 285550 - RNA, 22 nt, Human
augcaggauuagaaaguugccu

SEQ ID NO: 285551 - RNA, 23 nt, Human
aaacaagucucucaauggcuugc

SEQ ID NO: 285552 - RNA, 22 nt, Human
auacuucuuuagcauauugaac

SEQ ID NO: 285553 - RNA, 20 nt, Human
cugcaaaaugacauuaggaa

SEQ ID NO: 285554 - RNA, 22 nt, Human
ccuguucaaugcccuggcuuca

SEQ ID NO: 285555 - RNA, 22 nt, Human
gcagguggauuaucagaagugc

SEQ ID NO: 285556 - RNA, 22 nt, Human
uuaaaagaauccuguuauccuc

SEQ ID NO: 285557 - RNA, 22 nt, Human
ccagugugguagguccacaggu

SEQ ID NO: 285558 - RNA, 22 nt, Human
cugaggaggcuaauuugaggau

SEQ ID NO: 285559 - RNA, 22 nt, Human
agucucagccacacagaccuau

SEQ ID NO: 285560 - RNA, 22 nt, Human
uugguaaauuauuucuuccaau

SEQ ID NO: 285561 - RNA, 23 nt, Human
uucuggguugcugugcuuggaau

SEQ ID NO: 285562 - RNA, 22 nt, Human
ucauuuguucucauucucuacu

SEQ ID NO: 285563 - RNA, 22 nt, Human
ucucuuaauaaguaaauacuga

SEQ ID NO: 285564 - RNA, 22 nt, Human
aagugaaucuccuuucuuuauu

SEQ ID NO: 285565 - RNA, 22 nt, Human
uauacacaccuccaaagcagga

SEQ ID NO: 285566 - RNA, 19 nt, Human
ccagugucuagcgcacagc

SEQ ID NO: 285567 - RNA, 23 nt, Human
ugcuggcuuuuaucuggucccua

SEQ ID NO: 285568 - RNA, 22 nt, Human
acuccugggugcugaccagcgu

SEQ ID NO: 285569 - RNA, 22 nt, Human
uuucuggguuuaugucacagcu

SEQ ID NO: 285570 - RNA, 22 nt, Human
gcagcuuuaaaggaggcucuga

SEQ ID NO: 285571 - RNA, 22 nt, Human
gccaccaggagcccaguccaaa

SEQ ID NO: 285572 - RNA, 22 nt, Human
aauugcuuagagaauccaggua

SEQ ID NO: 285573 - RNA, 22 nt, Human
acagugcaaauaggacugucuu

SEQ ID NO: 285574 - RNA, 18 nt, Human
aucaaggaggggaagguc

SEQ ID NO: 285575 - RNA, 22 nt, Human
cuuggcuguaaaaucagaggcu

SEQ ID NO: 285576 - RNA, 22 nt, Human
agugucuguugaguuucaaaag

SEQ ID NO: 285577 - RNA, 22 nt, Human
ugucugggauguaauuccugcc

SEQ ID NO: 285578 - RNA, 22 nt, Human
uacccagggcuuuucugaugca

SEQ ID NO: 285579 - RNA, 22 nt, Human
auguuuugcuggauguuggcua

SEQ ID NO: 285580 - RNA, 18 nt, Human
ccugugacagaggcauca

SEQ ID NO: 285581 - RNA, 22 nt, Human
uuccugggugguccugguagag

SEQ ID NO: 285582 - RNA, 22 nt, Human
cuccaggcucguccaagaucga

SEQ ID NO: 285583 - RNA, 20 nt, Human
auacacaugcagacagaugc

SEQ ID NO: 285584 - RNA, 22 nt, Human
uaugauguguaccuaagucacc

SEQ ID NO: 285585 - RNA, 22 nt, Human
ccugcagguccccggaugcgca

SEQ ID NO: 285586 - RNA, 22 nt, Human
aaauggaucuguggaauacauu

SEQ ID NO: 285587 - RNA, 22 nt, Human
ugucucugaggugagggucagc

SEQ ID NO: 285588 - RNA, 22 nt, Human
uuguugcucuuguugccacaug

SEQ ID NO: 285589 - RNA, 22 nt, Human
aacucaguguguuucuuaguau

SEQ ID NO: 285590 - RNA, 22 nt, Human
cauuuguagcuauuuacuguau

SEQ ID NO: 285591 - RNA, 22 nt, Human
aagacacagcgaaauguuccug

SEQ ID NO: 285592 - RNA, 22 nt, Human
uuucucucugacugggagcuga

SEQ ID NO: 285593 - RNA, 22 nt, Human
cagaacagacuuaacagggcug

SEQ ID NO: 285594 - RNA, 22 nt, Human
agggcagcucucaccucuggcc

SEQ ID NO: 285595 - RNA, 22 nt, Human
cauuggaaugcauuugaagaga

SEQ ID NO: 285596 - RNA, 22 nt, Human
gcuggaggaggaagugugaggg

SEQ ID NO: 285597 - RNA, 22 nt, Human
aggccagggcacugcucuuuag

SEQ ID NO: 285598 - RNA, 22 nt, Human
cauuuguacagaacagcuuuau

SEQ ID NO: 285599 - RNA, 22 nt, Human
acauuuuacaguugucuggcua

SEQ ID NO: 285600 - RNA, 22 nt, Human
uucccucucuccagggcugccu

SEQ ID NO: 285601 - RNA, 22 nt, Human
cccagccuuccacccuggacua

SEQ ID NO: 285602 - RNA, 22 nt, Human
aauguuuugcauuaguuuucua

SEQ ID NO: 285603 - RNA, 22 nt, Human
uuccaggauggcaauaaugaau

SEQ ID NO: 285604 - RNA, 22 nt, Human
ugccuggaaggcccaugggaag

SEQ ID NO: 285605 - RNA, 22 nt, Human
uauugguauaggcauugaaacu

SEQ ID NO: 285606 - RNA, 22 nt, Human
acuggcagaacgugaugcgggu

SEQ ID NO: 285607 - RNA, 22 nt, Human
uuuuauagcugaauaguauucc

SEQ ID NO: 285608 - RNA, 22 nt, Human
acacaguugauugucacucagg

SEQ ID NO: 285609 - RNA, 22 nt, Human
gacugggguaaggugaggaggu

SEQ ID NO: 285610 - RNA, 22 nt, Human
gucuuuauauuuacuaaagaau

SEQ ID NO: 285611 - RNA, 22 nt, Human
ucugggaaccagugcggcuggg

SEQ ID NO: 285612 - RNA, 22 nt, Human
gguggggccugcuccagcggcc

SEQ ID NO: 285613 - RNA, 22 nt, Human
aggcucagccugggccuagagc

SEQ ID NO: 285614 - RNA, 22 nt, Human
ucccagggggaugaacacugcc

SEQ ID NO: 285615 - RNA, 22 nt, Human
ccuccugguugcaaugaaaugg

SEQ ID NO: 285616 - RNA, 22 nt, Human
cuccagggaugagacagaguag

SEQ ID NO: 285617 - RNA, 22 nt, Human
gccuggcaauggccucaggaag

SEQ ID NO: 285618 - RNA, 22 nt, Human
uuauguacucugcaauguuuga

SEQ ID NO: 285619 - RNA, 22 nt, Human
agccuugagcaguucacuuggu

SEQ ID NO: 285620 - RNA, 22 nt, Human
auuugaagucuucaugauuucu

SEQ ID NO: 285621 - RNA, 20 nt, Human
ucauguguguccuacagaga

SEQ ID NO: 285622 - RNA, 22 nt, Human
ucugaaaugaacucuugaacuu

SEQ ID NO: 285623 - RNA, 22 nt, Human
gucaaaaaguagucauuucugu

SEQ ID NO: 285624 - RNA, 22 nt, Human
auacaacuuuacaugcaauucc

SEQ ID NO: 285625 - RNA, 22 nt, Human
uggcaaaggcgcucacaugccu

SEQ ID NO: 285626 - RNA, 22 nt, Human
cucccaguguuguuuucugaug

SEQ ID NO: 285627 - RNA, 22 nt, Human
ccugcaggggagagacuucuag

SEQ ID NO: 285628 - RNA, 19 nt, Human
ugagacagaagaugagccu

SEQ ID NO: 285629 - RNA, 15 nt, Human
gcaggcaggucaccu

SEQ ID NO: 285630 - RNA, 22 nt, Human
uaggaaaugcuccauugcauaa

SEQ ID NO: 285631 - RNA, 22 nt, Human
ucauuguauuaaaauauugguu

SEQ ID NO: 285632 - RNA, 23 nt, Human
uccaggagcaugcuggcuggcga

SEQ ID NO: 285633 - RNA, 22 nt, Human
aaaaguaauugcaauuuuguag

SEQ ID NO: 285634 - RNA, 22 nt, Human
cagagacaccccagaaaauaag

SEQ ID NO: 285635 - RNA, 22 nt, Human
uauguucaugucaaacaaaugc

SEQ ID NO: 285636 - RNA, 22 nt, Human
ucgggcucgcucuccuagcgga

SEQ ID NO: 285637 - RNA, 20 nt, Human
caccacagaauuggggacag

SEQ ID NO: 285638 - RNA, 22 nt, Human
uugcuuuaucucuuaugccuca

SEQ ID NO: 285639 - RNA, 20 nt, Human
uuaaaaagagucacaggaga

SEQ ID NO: 285640 - RNA, 22 nt, Human
uguucucuuuuccugcugagcc

SEQ ID NO: 285641 - RNA, 22 nt, Human
cccugcagacgucuugaugccu

SEQ ID NO: 285642 - RNA, 22 nt, Human
cauuuguaauacugacuugcag

SEQ ID NO: 285643 - RNA, 22 nt, Human
uggcacagaaaaaugcuccauu

SEQ ID NO: 285644 - RNA, 22 nt, Human
uuacuuuugcaccaaacuaaua

SEQ ID NO: 285645 - RNA, 22 nt, Human
ggguaccaagcugcuugggggc

SEQ ID NO: 285646 - RNA, 22 nt, Human
cugggcacagacccccugggcc

SEQ ID NO: 285647 - RNA, 22 nt, Human
uggguccuuuuuggacuucuuc

SEQ ID NO: 285648 - RNA, 22 nt, Human
cuggguguucaggagcugggcu

SEQ ID NO: 285649 - RNA, 22 nt, Human
ucaucucagagagguauguuag

SEQ ID NO: 285650 - RNA, 22 nt, Human
caggcacaggggaaugucuuuu

SEQ ID NO: 285651 - RNA, 22 nt, Human
ucagcuuugccaccagcuguaa

SEQ ID NO: 285652 - RNA, 22 nt, Human
gaaucauuggaaccacauccaa

SEQ ID NO: 285653 - RNA, 22 nt, Human
acucuuauuuugaaguaauaau

SEQ ID NO: 285654 - RNA, 20 nt, Human
uccaugaguuagagacuaua

SEQ ID NO: 285655 - RNA, 22 nt, Human
aaacacaccuuuggaacuguga

SEQ ID NO: 285656 - RNA, 22 nt, Human
uguucaaaugaucuucuuaaau

SEQ ID NO: 285657 - RNA, 22 nt, Human
caggcuuuuucugcuguccucu

SEQ ID NO: 285658 - RNA, 22 nt, Human
ucagagaaucucuccuuaguuu

SEQ ID NO: 285659 - RNA, 17 nt, Human
agucagaggaguaucug

SEQ ID NO: 285660 - RNA, 19 nt, Human
gcagugucaugguaggagc

SEQ ID NO: 285661 - RNA, 22 nt, Human
uaauuccuagaaauuauucuca

SEQ ID NO: 285662 - RNA, 22 nt, Human
uaguuuugaggauuauauguga

SEQ ID NO: 285663 - RNA, 22 nt, Human
aauuuguuagcauacucuaguu

SEQ ID NO: 285664 - RNA, 22 nt, Human
caaauucucacccuguuugauu

SEQ ID NO: 285665 - RNA, 19 nt, Human
ggcugugguggugccuugc

SEQ ID NO: 285666 - RNA, 22 nt, Human
ucuggagaacuugcaagaggau

SEQ ID NO: 285667 - RNA, 22 nt, Human
ucuggcaguaauaggggagaga

SEQ ID NO: 285668 - RNA, 22 nt, Human
auugucuuuaaaaauauacaac

SEQ ID NO: 285669 - RNA, 21 nt, Human
aguguccuugaucuugccuug

SEQ ID NO: 285670 - RNA, 22 nt, Human
cuguucagaaaaaaucuucaug

SEQ ID NO: 285671 - RNA, 22 nt, Human
uuccugcuuccuggccucacaa

SEQ ID NO: 285672 - RNA, 22 nt, Human
uacauguacaugcauagguaga

SEQ ID NO: 285673 - RNA, 22 nt, Human
cauuucuagggaucauaaagua

SEQ ID NO: 285674 - RNA, 22 nt, Human
uuggaauuugcuucagcuaaua

SEQ ID NO: 285675 - RNA, 22 nt, Human
caggaucugcccaggccuuugg

SEQ ID NO: 285676 - RNA, 22 nt, Human
gaugugucuauucaacaugaaa

SEQ ID NO: 285677 - RNA, 22 nt, Human
ccaugugucgggccugcagugg

SEQ ID NO: 285678 - RNA, 22 nt, Human
acaauagucaaugcacgucauu

SEQ ID NO: 285679 - RNA, 22 nt, Human
ugcucagagcuccagcucuccu

SEQ ID NO: 285680 - RNA, 22 nt, Human
ucacaaaugaggaaaucgagca

SEQ ID NO: 285681 - RNA, 22 nt, Human
ccaggcucuguuccccgaggag

SEQ ID NO: 285682 - RNA, 22 nt, Human
ccuggcagcuguuuggcuuggc

SEQ ID NO: 285683 - RNA, 22 nt, Human
cccaaggaagacgcuugugaua

SEQ ID NO: 285684 - RNA, 22 nt, Human
agcucugacauugauucucagc

SEQ ID NO: 285685 - RNA, 22 nt, Human
uaauuauuugaagacauuagag

SEQ ID NO: 285686 - RNA, 22 nt, Human
cuauuagacacaauuagugauu

SEQ ID NO: 285687 - RNA, 22 nt, Human
caagauuugacuucgugguuug

SEQ ID NO: 285688 - RNA, 22 nt, Human
uuaccugugucaguauaugaga

SEQ ID NO: 285689 - RNA, 15 nt, Human
uuggaggauguagua

SEQ ID NO: 285690 - RNA, 22 nt, Human
gcacagagcuggcccuccaggc

SEQ ID NO: 285691 - RNA, 22 nt, Human
gugcaguggcagauccuagcuc

SEQ ID NO: 285692 - RNA, 22 nt, Human
aguagaaauguaagaaggauua

SEQ ID NO: 285693 - RNA, 22 nt, Human
guacauuucucccaacacuaaa

SEQ ID NO: 285694 - RNA, 22 nt, Human
uuccugaggcucaucggagucg

SEQ ID NO: 285695 - RNA, 22 nt, Human
cugcaaaaguaauuggggcuuu

SEQ ID NO: 285696 - RNA, 22 nt, Human
gccuuaggggucagacagagcu

SEQ ID NO: 285697 - RNA, 18 nt, Human
cccucuccugcuaguggg

SEQ ID NO: 285698 - RNA, 23 nt, Human
gaauucuuaaggucacuaaaguc

SEQ ID NO: 285699 - RNA, 22 nt, Human
uuuagccaacuauaugacuagu

SEQ ID NO: 285700 - RNA, 22 nt, Human
acuaaauagccucugguaguug

SEQ ID NO: 285701 - RNA, 22 nt, Human
uacuagaagcuguaauuuuuca

SEQ ID NO: 285702 - RNA, 22 nt, Human
accuguuuggaggagguguuag

SEQ ID NO: 285703 - RNA, 22 nt, Human
ucuucuuugaaucauagugacc

SEQ ID NO: 285704 - RNA, 22 nt, Human
gggugggaucuguggagccuca

SEQ ID NO: 285705 - RNA, 22 nt, Human
cuugaaucuggcuuugccacuu

SEQ ID NO: 285706 - RNA, 22 nt, Human
acauugugauccgacugauuaa

SEQ ID NO: 285707 - RNA, 22 nt, Human
ggaauguugucauuuacauuau

SEQ ID NO: 285708 - RNA, 22 nt, Human
aguuuacaugacguguauuuca

SEQ ID NO: 285709 - RNA, 22 nt, Human
uucuguguugugacauucuaga

SEQ ID NO: 285710 - RNA, 22 nt, Human
cugggucuggcuacugcuuccu

SEQ ID NO: 285711 - RNA, 22 nt, Human
aaauuucuggaagugucagagu

SEQ ID NO: 285712 - RNA, 22 nt, Human
aacaagucuuugguuuuggcua

SEQ ID NO: 285713 - RNA, 22 nt, Human
ggcaguggcuguagucucuugg

SEQ ID NO: 285714 - RNA, 22 nt, Human
uggucaaagaccaggaaaugcu

SEQ ID NO: 285715 - RNA, 18 nt, Human
uggcaggggcaguacgcc

SEQ ID NO: 285716 - RNA, 22 nt, Human
cacaaaaguaggaggcaggcgg

SEQ ID NO: 285717 - RNA, 22 nt, Human
aggaggcuguggagcacuccau

SEQ ID NO: 285718 - RNA, 22 nt, Human
ccuccagggccccucucacugg

SEQ ID NO: 285719 - RNA, 22 nt, Human
caguuuuauugguugaaaucug

SEQ ID NO: 285720 - RNA, 22 nt, Human
ucuguggcuuucguguaagaug

SEQ ID NO: 285721 - RNA, 22 nt, Human
auuaagcuccaaguugcucuga

SEQ ID NO: 285722 - RNA, 22 nt, Human
uuauuugcccauguuuagcaga

SEQ ID NO: 285723 - RNA, 22 nt, Human
uucucuuuugugaugugagaug

SEQ ID NO: 285724 - RNA, 22 nt, Human
ugucccagucaaggcugucauc

SEQ ID NO: 285725 - RNA, 22 nt, Human
ccaggaggcucuugucccuggu

SEQ ID NO: 285726 - RNA, 22 nt, Human
uguucuuugccagugauuuaau

SEQ ID NO: 285727 - RNA, 22 nt, Human
aauuuuacuaaucugaguguga

SEQ ID NO: 285728 - RNA, 22 nt, Human
cuucccuuucuggugacuucuc

SEQ ID NO: 285729 - RNA, 22 nt, Human
gcuggcuugacagaggccuggg

SEQ ID NO: 285730 - RNA, 22 nt, Human
agacagacguagugugagagua

SEQ ID NO: 285731 - RNA, 22 nt, Human
uuuuuuggauaauaaacgaucu

SEQ ID NO: 285732 - RNA, 22 nt, Human
gagggcuccucacauucucuau

SEQ ID NO: 285733 - RNA, 18 nt, Human
agugcaugcuaggggaag

SEQ ID NO: 285734 - RNA, 22 nt, Human
cuuugcugagcugguuguucaa

SEQ ID NO: 285735 - RNA, 22 nt, Human
gaaggaggucugcauucuacag

SEQ ID NO: 285736 - RNA, 22 nt, Human
cccugagaugccucacccuagu

SEQ ID NO: 285737 - RNA, 22 nt, Human
uguguccuccagggagauguaa

SEQ ID NO: 285738 - RNA, 22 nt, Human
gggcagguggcaaagccagagg

SEQ ID NO: 285739 - RNA, 17 nt, Human
ugcucaaauacuuuuga

SEQ ID NO: 285740 - RNA, 19 nt, Human
ugugaccccagacaagcug

SEQ ID NO: 285741 - RNA, 22 nt, Human
uuuuuuaucuaugguaguacca

SEQ ID NO: 285742 - RNA, 22 nt, Human
uacauuccuucguuuagagauu

SEQ ID NO: 285743 - RNA, 22 nt, Human
agacagugauggacaggcagac

SEQ ID NO: 285744 - RNA, 22 nt, Human
ugggcuccaauuuguccuuuca

SEQ ID NO: 285745 - RNA, 22 nt, Human
auuuuacuacuccaauuaauga

SEQ ID NO: 285746 - RNA, 22 nt, Human
uugcugggcucuucaacacaca

SEQ ID NO: 285747 - RNA, 22 nt, Human
ugagguggguggcuucuguuau

SEQ ID NO: 285748 - RNA, 21 nt, Human
guagauaaagcauuuucauua

SEQ ID NO: 285749 - RNA, 22 nt, Human
auuuuaguuuuagcauccaugc

SEQ ID NO: 285750 - RNA, 22 nt, Human
uuggaggacuaguuaagagacc

SEQ ID NO: 285751 - RNA, 22 nt, Human
ccuccuggaggcucuaagggag

SEQ ID NO: 285752 - RNA, 22 nt, Human
guacaaauacauucugaaggua

SEQ ID NO: 285753 - RNA, 19 nt, Human
aauguuuaagagaaaaagg

SEQ ID NO: 285754 - RNA, 20 nt, Human
uuucacaucugucccuuuaa

SEQ ID NO: 285755 - RNA, 18 nt, Human
ccuggcagccaugcgcgc

SEQ ID NO: 285756 - RNA, 22 nt, Human
gagcaaaauaaauucugacaaa

SEQ ID NO: 285757 - RNA, 22 nt, Human
aaaaaccuuucauugcaaaugu

SEQ ID NO: 285758 - RNA, 21 nt, Human
aggcuuggauagguuauguga

SEQ ID NO: 285759 - RNA, 22 nt, Human
gguccuuugaaagggguguguc

SEQ ID NO: 285760 - RNA, 22 nt, Human
gcuggagguagggagguccugu

SEQ ID NO: 285761 - RNA, 22 nt, Human
gggacauggaggcgcgcaggca

SEQ ID NO: 285762 - RNA, 22 nt, Human
cuccugugaggcuuaagcccag

SEQ ID NO: 285763 - RNA, 22 nt, Human
caggagaugacagggaagaacc

SEQ ID NO: 285764 - RNA, 22 nt, Human
ggucccaugacugacacagcag

SEQ ID NO: 285765 - RNA, 22 nt, Human
uccugcugccauuucaagugcu

SEQ ID NO: 285766 - RNA, 22 nt, Human
gcuuccaguaaguugcugccau

SEQ ID NO: 285767 - RNA, 19 nt, Human
ccuggcucugagcccagcc

SEQ ID NO: 285768 - RNA, 22 nt, Human
cugaggagcaaccccgugcccu

SEQ ID NO: 285769 - RNA, 22 nt, Human
gccuguuuggaaucuguuuaau

SEQ ID NO: 285770 - RNA, 22 nt, Human
gcaggugguggggcuaugaucu

SEQ ID NO: 285771 - RNA, 22 nt, Human
aaauguuucuacuugugagcau

SEQ ID NO: 285772 - RNA, 22 nt, Human
cuuucauaaaggaaaugaugag

SEQ ID NO: 285773 - RNA, 22 nt, Human
ugcacuucaaaaaugucacuga

SEQ ID NO: 285774 - RNA, 22 nt, Human
ggaauguuuuagcuugacuuuu

SEQ ID NO: 285775 - RNA, 22 nt, Human
gaauguuauuggacagcagugg

SEQ ID NO: 285776 - RNA, 22 nt, Human
uuuuggcuccagugguuugugc

SEQ ID NO: 285777 - RNA, 22 nt, Human
ucuguggcuucuauuuaacuuu

SEQ ID NO: 285778 - RNA, 22 nt, Human
auugcugaaaugaaaggauaug

SEQ ID NO: 285779 - RNA, 22 nt, Human
acuuagauuuccuuacugggug

SEQ ID NO: 285780 - RNA, 22 nt, Human
aucuuguuaaagugcagauuuu

SEQ ID NO: 285781 - RNA, 22 nt, Human
cagggcagaaggcacucuacuc

SEQ ID NO: 285782 - RNA, 21 nt, Human
ugucagagcuuguaggacauu

SEQ ID NO: 285783 - RNA, 19 nt, Human
gacauuccugacacuggcu

SEQ ID NO: 285784 - RNA, 22 nt, Human
auggguuuauagguggacuuuu

SEQ ID NO: 285785 - RNA, 22 nt, Human
caugaaggaauuaagguaagga

SEQ ID NO: 285786 - RNA, 22 nt, Human
ugaaagcagugauuucuccuuc

SEQ ID NO: 285787 - RNA, 22 nt, Human
cuuucauucuuagauauuagug

SEQ ID NO: 285788 - RNA, 22 nt, Human
aaauuguugaucuacaguaagg

SEQ ID NO: 285789 - RNA, 20 nt, Human
auagacaaagacaugccaga

SEQ ID NO: 285790 - RNA, 22 nt, Human
uggcaggugaaguuguuaggga

SEQ ID NO: 285791 - RNA, 22 nt, Human
uugcagcuuagugauguuaucu

SEQ ID NO: 285792 - RNA, 22 nt, Human
aaggugucggcagagccgcuuc

SEQ ID NO: 285793 - RNA, 22 nt, Human
ucagguguguggcucuggacca

SEQ ID NO: 285794 - RNA, 22 nt, Human
gguguccugggcaggcagcuga

SEQ ID NO: 285795 - RNA, 22 nt, Human
uucauguauuuaucauguaaau

SEQ ID NO: 285796 - RNA, 22 nt, Human
uguaaaauaauucuccauguuu

SEQ ID NO: 285797 - RNA, 22 nt, Human
aggcuuucgaugaacgcuugcu

SEQ ID NO: 285798 - RNA, 22 nt, Human
aucuuguuaaagugcagauucu

SEQ ID NO: 285799 - RNA, 22 nt, Human
uuccagaaaaaaauguauaucu

SEQ ID NO: 285800 - RNA, 23 nt, Human
aaugaacugagaaucuguacagu

SEQ ID NO: 285801 - RNA, 22 nt, Human
cuguugcugagguucaaggguc

SEQ ID NO: 285802 - RNA, 22 nt, Human
aaaauagaugaaaggaagucug

SEQ ID NO: 285803 - RNA, 22 nt, Human
gacaggugugaugauuuaggcu

SEQ ID NO: 285804 - RNA, 23 nt, Human
auucuucauuaucuucuagaaaa

SEQ ID NO: 285805 - RNA, 22 nt, Human
cugccuggguucaaguccuguu

SEQ ID NO: 285806 - RNA, 22 nt, Human
aucaaguuuucuuaguugacug

SEQ ID NO: 285807 - RNA, 22 nt, Human
gaggccuggguuaccuacucgu

SEQ ID NO: 285808 - RNA, 22 nt, Human
aguuuaugucuuuacuucagcu

SEQ ID NO: 285809 - RNA, 22 nt, Human
gcuggcagguaaagccccgggg

SEQ ID NO: 285810 - RNA, 22 nt, Human
aaaaaauuaucauaguuccuga

SEQ ID NO: 285811 - RNA, 22 nt, Human
uggacaugaccucgagcgagau

SEQ ID NO: 285812 - RNA, 17 nt, Human
aggcagguaagaguuau

SEQ ID NO: 285813 - RNA, 22 nt, Human
aagaaagugcuuuguaaauuau

SEQ ID NO: 285814 - RNA, 22 nt, Human
gaggggcacaguaaaggguccc

SEQ ID NO: 285815 - RNA, 20 nt, Human
agguauaagaaaugugauuu

SEQ ID NO: 285816 - RNA, 22 nt, Human
gcuuuuacaagagccagagagg

SEQ ID NO: 285817 - RNA, 22 nt, Human
aaaaaaucagaucuuugguuaa

SEQ ID NO: 285818 - RNA, 22 nt, Human
guuagggaagcgcuguguucuu

SEQ ID NO: 285819 - RNA, 22 nt, Human
uuucaggauuuuaugagauagu

SEQ ID NO: 285820 - RNA, 22 nt, Human
agccagagcagggaauuggaca

SEQ ID NO: 285821 - RNA, 22 nt, Human
agaggccuaauugcuacccuuu

SEQ ID NO: 285822 - RNA, 22 nt, Human
acuccaggcaucugcuucugcu

SEQ ID NO: 285823 - RNA, 22 nt, Human
uuaagacauucagauauuucua

SEQ ID NO: 285824 - RNA, 22 nt, Human
agguggucuuaaacugcucugg

SEQ ID NO: 285825 - RNA, 22 nt, Human
ccaggcuugguguguggucagg

SEQ ID NO: 285826 - RNA, 22 nt, Human
cguguccuuuuagcuucagguc

SEQ ID NO: 285827 - RNA, 22 nt, Human
aggggagguguccccaaaucuc

SEQ ID NO: 285828 - RNA, 22 nt, Human
uuucuuucucguaaacuuaguu

SEQ ID NO: 285829 - RNA, 22 nt, Human
uccaggaaagcacugggcuggg

SEQ ID NO: 285830 - RNA, 21 nt, Human
acagugugcuucucucccucc

SEQ ID NO: 285831 - RNA, 22 nt, Human
ucucacugggucacagcagagg

SEQ ID NO: 285832 - RNA, 22 nt, Human
ugcuggagaugaaagggcccug

SEQ ID NO: 285833 - RNA, 21 nt, Human
aguaguuuagcacaggguuug

SEQ ID NO: 285834 - RNA, 17 nt, Human
caucaaagaaauuucca

SEQ ID NO: 285835 - RNA, 22 nt, Human
agcaggugucggcgagggucuu

SEQ ID NO: 285836 - RNA, 22 nt, Human
ucauuuugccugccauuugagu

SEQ ID NO: 285837 - RNA, 22 nt, Human
aucuuuagugugaauuuauuga

SEQ ID NO: 285838 - RNA, 22 nt, Human
aguuuccucaucuguaaaauga

SEQ ID NO: 285839 - RNA, 22 nt, Human
ugccuggcuaauuuuuguaucc

SEQ ID NO: 285840 - RNA, 22 nt, Human
uccaggcaugguguaauuuugc

SEQ ID NO: 285841 - RNA, 22 nt, Human
aaggcauagucuuuaaguucug

SEQ ID NO: 285842 - RNA, 22 nt, Human
gggaaagaccuuccuggggugu

SEQ ID NO: 285843 - RNA, 22 nt, Human
ucaauucuagagccuuacauug

SEQ ID NO: 285844 - RNA, 22 nt, Human
agugugaguuugguugagacuu

SEQ ID NO: 285845 - RNA, 21 nt, Human
agacaggucagggagagguga

SEQ ID NO: 285846 - RNA, 22 nt, Human
cucugaaaguuagagaaaauag

SEQ ID NO: 285847 - RNA, 22 nt, Human
ugccagaacagcucaucuggcc

SEQ ID NO: 285848 - RNA, 22 nt, Human
acauguguacuuuuaaggaugu

SEQ ID NO: 285849 - RNA, 23 nt, Human
acuccccagucucuucuugccaa

SEQ ID NO: 285850 - RNA, 22 nt, Human
ucugaaauggcgauggccguug

SEQ ID NO: 285851 - RNA, 22 nt, Human
acacaaauuguaggauaauugc

SEQ ID NO: 285852 - RNA, 22 nt, Human
gagcuccuggauugcuccuagg

SEQ ID NO: 285853 - RNA, 22 nt, Human
gcugcgguggcuggcgauggga

SEQ ID NO: 285854 - RNA, 22 nt, Human
aauagcuuuggucaccaucugg

SEQ ID NO: 285855 - RNA, 22 nt, Human
ggaggaaaugaaaggaggguuu

SEQ ID NO: 285856 - RNA, 22 nt, Human
auacuucuggugacaaagucuu

SEQ ID NO: 285857 - RNA, 22 nt, Human
uuuguagcagcaugauuuauaa

SEQ ID NO: 285858 - RNA, 22 nt, Human
agcagggcuguguagguaauga

SEQ ID NO: 285859 - RNA, 22 nt, Human
cagggcuccccgcaccgcagcc

SEQ ID NO: 285860 - RNA, 22 nt, Human
agcccagaggcugggcgugcau

SEQ ID NO: 285861 - RNA, 22 nt, Human
gagggaaaauaaaauugcagua

SEQ ID NO: 285862 - RNA, 22 nt, Human
ucugucuucaucagcaugugau

SEQ ID NO: 285863 - RNA, 22 nt, Human
agguaaaauagauaguauuucu

SEQ ID NO: 285864 - RNA, 22 nt, Human
aacaugauuuaguauaaugcag

SEQ ID NO: 285865 - RNA, 22 nt, Human
ccccaggcagggccuaacagag

SEQ ID NO: 285866 - RNA, 22 nt, Human
aaauuagauaugugugagacuc

SEQ ID NO: 285867 - RNA, 22 nt, Human
aggacacacugcaagagccugg

SEQ ID NO: 285868 - RNA, 22 nt, Human
aucaagaaaagugcuuucggcu

SEQ ID NO: 285869 - RNA, 22 nt, Human
ccugggucuugguucaugcucu

SEQ ID NO: 285870 - RNA, 17 nt, Human
uacauguguaucugauu

SEQ ID NO: 285871 - RNA, 22 nt, Human
gcaguccaaaguggcucucacc

SEQ ID NO: 285872 - RNA, 17 nt, Human
acauuuccuaacugaag

SEQ ID NO: 285873 - RNA, 22 nt, Human
ugcacccauagcacacacuccu

SEQ ID NO: 285874 - RNA, 22 nt, Human
cuucuauucacuggucacaguu

SEQ ID NO: 285875 - RNA, 21 nt, Human
uucccagcaccuagcacaggu

SEQ ID NO: 285876 - RNA, 22 nt, Human
ggaauguuugcucccuucaggg

SEQ ID NO: 285877 - RNA, 22 nt, Human
uccugaagucacaggcucugag

SEQ ID NO: 285878 - RNA, 22 nt, Human
ccuuuggucaccuccacucuua

SEQ ID NO: 285879 - RNA, 22 nt, Human
aucuguucuugugucaguaauu

SEQ ID NO: 285880 - RNA, 21 nt, Human
auaagcaugcugauuacauuu

SEQ ID NO: 285881 - RNA, 22 nt, Human
aggcagcuggaaaacuccaggc

SEQ ID NO: 285882 - RNA, 23 nt, Human
cagaccuuucuguaucaguuauc

SEQ ID NO: 285883 - RNA, 22 nt, Human
gaggccagaaugagcugaaugc

SEQ ID NO: 285884 - RNA, 22 nt, Human
aagccuuccugagugcaaggcc

SEQ ID NO: 285885 - RNA, 21 nt, Human
ccugugccaaaguguguuagg

SEQ ID NO: 285886 - RNA, 22 nt, Human
caaggaggaagaugcaggggac

SEQ ID NO: 285887 - RNA, 22 nt, Human
gacuccuggcuuucccucuuag

SEQ ID NO: 285888 - RNA, 22 nt, Human
uguuccugguuccugcaugaug

SEQ ID NO: 285889 - RNA, 22 nt, Human
cuuccccaggaccucugcuaaa

SEQ ID NO: 285890 - RNA, 22 nt, Human
agggcucccgcgguguccggga

SEQ ID NO: 285891 - RNA, 22 nt, Human
uuuuaccugaaccacacaguau

SEQ ID NO: 285892 - RNA, 22 nt, Human
ggagacucggguucuagccuug

SEQ ID NO: 285893 - RNA, 22 nt, Human
ucagggcaagauugguuaauaa

SEQ ID NO: 285894 - RNA, 22 nt, Human
cgacugucauacacaagacaug

SEQ ID NO: 285895 - RNA, 22 nt, Human
aauucauugccagaaucuauga

SEQ ID NO: 285896 - RNA, 22 nt, Human
ccagugugauuguugcaagaau

SEQ ID NO: 285897 - RNA, 22 nt, Human
gucuuuauuugagauugucauu

SEQ ID NO: 285898 - RNA, 22 nt, Human
uccacccccagacagcugguga

SEQ ID NO: 285899 - RNA, 22 nt, Human
cucagggugcagcacaguuccu

SEQ ID NO: 285900 - RNA, 22 nt, Human
ugguuccucaagcgcuggcggc

SEQ ID NO: 285901 - RNA, 22 nt, Human
ucagacagaaagaugaguaugg

SEQ ID NO: 285902 - RNA, 22 nt, Human
acaacaaucuacccuagcuucu

SEQ ID NO: 285903 - RNA, 22 nt, Human
auaguuuuauagauauugugua

SEQ ID NO: 285904 - RNA, 22 nt, Human
cauauuugguauaacuuaagca

SEQ ID NO: 285905 - RNA, 22 nt, Human
ugcauaaacagauacuucaugu

SEQ ID NO: 285906 - RNA, 22 nt, Human
aaucuucuacuugacaguucuc

SEQ ID NO: 285907 - RNA, 22 nt, Human
ccuccccacagcccaggagacu

SEQ ID NO: 285908 - RNA, 22 nt, Human
uuucuuucaauucuccuaaugc

SEQ ID NO: 285909 - RNA, 22 nt, Human
uccaggcuggaaaugucaaacu

SEQ ID NO: 285910 - RNA, 22 nt, Human
uuagauaaauugcaacuugauu

SEQ ID NO: 285911 - RNA, 19 nt, Human
gcuggcagauguggccgug

SEQ ID NO: 285912 - RNA, 21 nt, Human
cuggcucuguugucacccggc

SEQ ID NO: 285913 - RNA, 22 nt, Human
gggaucuuucugaugcuguggc

SEQ ID NO: 285914 - RNA, 22 nt, Human
ucagguguguuguauuuuacca

SEQ ID NO: 285915 - RNA, 22 nt, Human
gcugucuuuuccuggcaguaaa

SEQ ID NO: 285916 - RNA, 22 nt, Human
cccugagcucaggcccuugggg

SEQ ID NO: 285917 - RNA, 20 nt, Human
ucagacagucgcaguucugg

SEQ ID NO: 285918 - RNA, 22 nt, Human
uguaagaaaaguaaauagugac

SEQ ID NO: 285919 - RNA, 22 nt, Human
uccuuggcaugccgucuucucc

SEQ ID NO: 285920 - RNA, 22 nt, Human
cauucuuauauuuacucauuca

SEQ ID NO: 285921 - RNA, 22 nt, Human
agugugucugaucacuugugag

SEQ ID NO: 285922 - RNA, 22 nt, Human
uugaggaggaacugugaggcaa

SEQ ID NO: 285923 - RNA, 22 nt, Human
guuucuuagguaaauucuuuga

SEQ ID NO: 285924 - RNA, 22 nt, Human
aaugcuaacauugguuuauauc

SEQ ID NO: 285925 - RNA, 22 nt, Human
caggagcaaggagcagugggau

SEQ ID NO: 285926 - RNA, 22 nt, Human
caggcagcugacugucagauau

SEQ ID NO: 285927 - RNA, 19 nt, Human
ggaacuuggccuuuaccca

SEQ ID NO: 285928 - RNA, 16 nt, Human
caggugucagucaccu

SEQ ID NO: 285929 - RNA, 22 nt, Human
cuguggcucagcacggggucag

SEQ ID NO: 285930 - RNA, 22 nt, Human
ugucccagcugucucuguuuuu

SEQ ID NO: 285931 - RNA, 20 nt, Human
ugucauuuauuuaucaaaug

SEQ ID NO: 285932 - RNA, 22 nt, Human
ugucuguauuagucagcauucu

SEQ ID NO: 285933 - RNA, 20 nt, Human
uccaggcagacagcuauggg

SEQ ID NO: 285934 - RNA, 22 nt, Human
cagcuucugucugauuagcaag

SEQ ID NO: 285935 - RNA, 21 nt, Human
gacaggugauucagagcaggg

SEQ ID NO: 285936 - RNA, 23 nt, Human
uccaauucaauugggucaggaag

SEQ ID NO: 285937 - RNA, 22 nt, Human
acagggcagguggcuacugguc

SEQ ID NO: 285938 - RNA, 19 nt, Human
uucacauuggaagaaguag

SEQ ID NO: 285939 - RNA, 22 nt, Human
aggaaaacacaguauugaugga

SEQ ID NO: 285940 - RNA, 22 nt, Human
uagugcaggguuuuaagcacug

SEQ ID NO: 285941 - RNA, 22 nt, Human
gggcagguuauuggaguaggga

SEQ ID NO: 285942 - RNA, 22 nt, Human
ugccugccaugcagaaagcuga

SEQ ID NO: 285943 - RNA, 22 nt, Human
gacagacacuauugguaugccu

SEQ ID NO: 285944 - RNA, 22 nt, Human
cuucucucccuggcacucagac

SEQ ID NO: 285945 - RNA, 22 nt, Human
ccugggagaacugcuggguugg

SEQ ID NO: 285946 - RNA, 19 nt, Human
gcccaggggcccgaugcug

SEQ ID NO: 285947 - RNA, 22 nt, Human
gugugucccuccucuccugagu

SEQ ID NO: 285948 - RNA, 22 nt, Human
ugagcaggcgcagcaggagguc

SEQ ID NO: 285949 - RNA, 22 nt, Human
caggcugcagugcaguggcuau

SEQ ID NO: 285950 - RNA, 22 nt, Human
uggccaggaggcugcuucugac

SEQ ID NO: 285951 - RNA, 22 nt, Human
ccagucuguacuuugcucuguu

SEQ ID NO: 285952 - RNA, 22 nt, Human
agauguguuucuaguuccugca

SEQ ID NO: 285953 - RNA, 22 nt, Human
uccaggcaaaaaccaacuacag

SEQ ID NO: 285954 - RNA, 22 nt, Human
cuuauuagugucugucugaguu

SEQ ID NO: 285955 - RNA, 22 nt, Human
uuucuucagccuucacaaccug

SEQ ID NO: 285956 - RNA, 22 nt, Human
gaauuguaaguaccagcaugcu

SEQ ID NO: 285957 - RNA, 22 nt, Human
uaauuauuaugacaacaauugc

SEQ ID NO: 285958 - RNA, 22 nt, Human
cgaggcagggaagcugcaaaag

SEQ ID NO: 285959 - RNA, 22 nt, Human
uccugucuuaaugaucucgugc

SEQ ID NO: 285960 - RNA, 22 nt, Human
aaaucacuguuauugaucuuaa

SEQ ID NO: 285961 - RNA, 22 nt, Human
aucuuguuaaaaugcagaaacu

SEQ ID NO: 285962 - RNA, 22 nt, Human
cuucucagucuugguuagagag

SEQ ID NO: 285963 - RNA, 22 nt, Human
aggaauguauugaccuguugca

SEQ ID NO: 285964 - RNA, 22 nt, Human
aaaggccucuguccuagugccu

SEQ ID NO: 285965 - RNA, 22 nt, Human
ucaguuuauggucuaguucaug

SEQ ID NO: 285966 - RNA, 21 nt, Human
uccuggcccacucuaucccca

SEQ ID NO: 285967 - RNA, 22 nt, Human
ccuuggcccuagccucaggcaa

SEQ ID NO: 285968 - RNA, 22 nt, Human
acuguugaagugccagcuugau

SEQ ID NO: 285969 - RNA, 22 nt, Human
cagccaggauggagaacuguug

SEQ ID NO: 285970 - RNA, 22 nt, Human
guuuucugauuagcaaaucuga

SEQ ID NO: 285971 - RNA, 22 nt, Human
aaacauuugcaacucgguuugg

SEQ ID NO: 285972 - RNA, 22 nt, Human
ucuccugcucagaacagccuca

SEQ ID NO: 285973 - RNA, 22 nt, Human
gcauaguaggcugucaaaaaug

SEQ ID NO: 285974 - RNA, 22 nt, Human
auacauguugagaaaauaucug

SEQ ID NO: 285975 - RNA, 22 nt, Human
uggcagugggaauggacaaaca

SEQ ID NO: 285976 - RNA, 22 nt, Human
uaaugaaugagaauauaacaga

SEQ ID NO: 285977 - RNA, 22 nt, Human
uugaaaugagcaaacugucagc

SEQ ID NO: 285978 - RNA, 22 nt, Human
ccugggucuggucacuaaguca

SEQ ID NO: 285979 - RNA, 22 nt, Human
uauauucacuuguguccaacca

SEQ ID NO: 285980 - RNA, 22 nt, Human
ucugaagagucuugcaagaaag

SEQ ID NO: 285981 - RNA, 22 nt, Human
gguguccucggauucagggcag

SEQ ID NO: 285982 - RNA, 22 nt, Human
ugagugaggcugggcagucccu

SEQ ID NO: 285983 - RNA, 22 nt, Human
cuuuuacaguggaccugccauu

SEQ ID NO: 285984 - RNA, 22 nt, Human
aaggccucuucucucuggagau

SEQ ID NO: 285985 - RNA, 22 nt, Human
ugucuuuagccagcagucuucu

SEQ ID NO: 285986 - RNA, 19 nt, Human
cuguccuuggcugcacugu

SEQ ID NO: 285987 - RNA, 22 nt, Human
guucuucagucacaucacagaa

SEQ ID NO: 285988 - RNA, 22 nt, Human
uagugcagguuaauaggacuuc

SEQ ID NO: 285989 - RNA, 22 nt, Human
cagaguggcgacccccucagcu

SEQ ID NO: 285990 - RNA, 22 nt, Human
aguggacuuuuaguauccuuau

SEQ ID NO: 285991 - RNA, 23 nt, Human
cacaugaccugaccuaggcuagg

SEQ ID NO: 285992 - RNA, 21 nt, Human
ugccuggccuuugcuuuuccu

SEQ ID NO: 285993 - RNA, 22 nt, Human
uccuggcagguguauuggcugu

SEQ ID NO: 285994 - RNA, 17 nt, Human
uguccauuugccuggag

SEQ ID NO: 285995 - RNA, 21 nt, Human
ucauguguaacuuuugaccac

SEQ ID NO: 285996 - RNA, 22 nt, Human
aaagccuucugucuagcagaua

SEQ ID NO: 285997 - RNA, 22 nt, Human
uucuuuucuuuaggcauugugu

SEQ ID NO: 285998 - RNA, 22 nt, Human
ccacccaugugacuaccucaug

SEQ ID NO: 285999 - RNA, 22 nt, Human
cauguuaaaauauacauucuga

SEQ ID NO: 286000 - RNA, 22 nt, Human
aaauuucuguuguuuugagcca

SEQ ID NO: 286001 - RNA, 22 nt, Human
uugguacaaaaccaugaaagaa

SEQ ID NO: 286002 - RNA, 22 nt, Human
cuuugcaaacgauuaccacaug

SEQ ID NO: 286003 - RNA, 22 nt, Human
ggcuuugacaugcugaauuaaa

SEQ ID NO: 286004 - RNA, 22 nt, Human
uccugcagccauuagaggucaa

SEQ ID NO: 286005 - RNA, 22 nt, Human
uagcuuuaaaaaucaucaaagc

SEQ ID NO: 286006 - RNA, 22 nt, Human
uuugacucaguggacguacuag

SEQ ID NO: 286007 - RNA, 22 nt, Human
ucagaacaguucuuaauauugc

SEQ ID NO: 286008 - RNA, 22 nt, Human
ugguaaaaacugcaauuacuuu

SEQ ID NO: 286009 - RNA, 22 nt, Human
ccuggcaguucaucaaauggca

SEQ ID NO: 286010 - RNA, 22 nt, Human
agucaggauuuuggauuauucg

SEQ ID NO: 286011 - RNA, 22 nt, Human
cacagcugaccacccugcuccc

SEQ ID NO: 286012 - RNA, 22 nt, Human
ccaccauucaaggucuucacag

SEQ ID NO: 286013 - RNA, 22 nt, Human
uggcauuuggcuuacuuauguu

SEQ ID NO: 286014 - RNA, 20 nt, Human
cagggcucugggccuggccu

SEQ ID NO: 286015 - RNA, 22 nt, Human
auauguauugagugccaacugu

SEQ ID NO: 286016 - RNA, 22 nt, Human
uccuggcccacuaugccagcau

SEQ ID NO: 286017 - RNA, 22 nt, Human
uaacuuuaggaauagguaaucu

SEQ ID NO: 286018 - RNA, 22 nt, Human
uauaaaugcacuuuugaaauau

SEQ ID NO: 286019 - RNA, 22 nt, Human
auucuacacaacaugaugaugg

SEQ ID NO: 286020 - RNA, 19 nt, Human
acacaugaggagggacccc

SEQ ID NO: 286021 - RNA, 22 nt, Human
ucuuuauuuaagucuguuguaa

SEQ ID NO: 286022 - RNA, 22 nt, Human
uuugacucuuaaguggcucaau

SEQ ID NO: 286023 - RNA, 22 nt, Human
agcuuuauggugccucacuuga

SEQ ID NO: 286024 - RNA, 19 nt, Human
agcugcagaccagaagugc

SEQ ID NO: 286025 - RNA, 22 nt, Human
aguguccucaggcuuuguuccu

SEQ ID NO: 286026 - RNA, 22 nt, Human
ggagaaggcgaagucauucuuu

SEQ ID NO: 286027 - RNA, 22 nt, Human
uauugcugacugucuucugagu

SEQ ID NO: 286028 - RNA, 22 nt, Human
uggaaaacauugagauaccaag

SEQ ID NO: 286029 - RNA, 22 nt, Human
agccacccauucccgagcccua

SEQ ID NO: 286030 - RNA, 22 nt, Human
gaggagcacaugaggcugaggg

SEQ ID NO: 286031 - RNA, 22 nt, Human
uguguccuuucuuaagagugag

SEQ ID NO: 286032 - RNA, 22 nt, Human
ugagaaaauuacuauaauuguc

SEQ ID NO: 286033 - RNA, 22 nt, Human
aucugagucucugacagcaugu

SEQ ID NO: 286034 - RNA, 22 nt, Human
ugcccugguuacacuggagucc

SEQ ID NO: 286035 - RNA, 22 nt, Human
caaauaguuuuucauguauuau

SEQ ID NO: 286036 - RNA, 22 nt, Human
auuacacuaaugugacaacaau

SEQ ID NO: 286037 - RNA, 22 nt, Human
gucugucuguuguugagaagca

SEQ ID NO: 286038 - RNA, 22 nt, Human
ucccagaguuuccuguguccca

SEQ ID NO: 286039 - RNA, 22 nt, Human
ugaaacauuugaugaucuuugg

SEQ ID NO: 286040 - RNA, 22 nt, Human
uucaagcaccaaauuaguaggc

SEQ ID NO: 286041 - RNA, 22 nt, Human
ugucaaagacagaaggaaaugg

SEQ ID NO: 286042 - RNA, 22 nt, Human
uuugcacuagcauuuguccaug

SEQ ID NO: 286043 - RNA, 22 nt, Human
uauguuauuuucauacaacaga

SEQ ID NO: 286044 - RNA, 22 nt, Human
ggcccucuguggcugccaugga

SEQ ID NO: 286045 - RNA, 22 nt, Human
aaaaaguauuggccaugguuga

SEQ ID NO: 286046 - RNA, 22 nt, Human
aagcagacagagaauggguuug

SEQ ID NO: 286047 - RNA, 22 nt, Human
uguccugggaaaucccuuaggc

SEQ ID NO: 286048 - RNA, 22 nt, Human
uacauguuauuucacuauuggu

SEQ ID NO: 286049 - RNA, 22 nt, Human
uuguuuuaucuuucuacagacu

SEQ ID NO: 286050 - RNA, 22 nt, Human
caacuuuaugauugguuuguca

SEQ ID NO: 286051 - RNA, 22 nt, Human
aauaauguacauacauauuucg

SEQ ID NO: 286052 - RNA, 22 nt, Human
uaguaguaauuguuaucuuauu

SEQ ID NO: 286053 - RNA, 22 nt, Human
ucacaaauagcuauauuaagga

SEQ ID NO: 286054 - RNA, 18 nt, Human
cucagagaugcccuuauu

SEQ ID NO: 286055 - RNA, 22 nt, Human
ggagaagggcaugguaguuuua

SEQ ID NO: 286056 - RNA, 22 nt, Human
aauauuaguuucucaagagaga

SEQ ID NO: 286057 - RNA, 23 nt, Human
cagugcagggcaacucagacucc

SEQ ID NO: 286058 - RNA, 22 nt, Human
cagggcuccccagagagccucu

SEQ ID NO: 286059 - RNA, 22 nt, Human
ucauuugucuggcacagggaau

SEQ ID NO: 286060 - RNA, 22 nt, Human
augggagaaacaucaugaggca

SEQ ID NO: 286061 - RNA, 22 nt, Human
auauaauaguuucauaaaggcu

SEQ ID NO: 286062 - RNA, 22 nt, Human
acaagauuuugucugguagggu

SEQ ID NO: 286063 - RNA, 22 nt, Human
ucuccacaagcugaugcuagga

SEQ ID NO: 286064 - RNA, 19 nt, Human
uggcagggagaguuugaag

SEQ ID NO: 286065 - RNA, 22 nt, Human
caguuuuagggcaaugugaaga

SEQ ID NO: 286066 - RNA, 22 nt, Human
caggagucucucuugagcccag

SEQ ID NO: 286067 - RNA, 22 nt, Human
accuacauaguuaaguaacaaa

SEQ ID NO: 286068 - RNA, 22 nt, Human
agauauuaaucguacauaaggu

SEQ ID NO: 286069 - RNA, 22 nt, Human
gacagacaccugggggguugcu

SEQ ID NO: 286070 - RNA, 22 nt, Human
uuucaaaauuuugcagugguaa

SEQ ID NO: 286071 - RNA, 22 nt, Human
gcacccaggccggcgacugcag

SEQ ID NO: 286072 - RNA, 22 nt, Human
uaauuagagucacaaguaacca

SEQ ID NO: 286073 - RNA, 22 nt, Human
ucuucaaguuccaaagugcagg

SEQ ID NO: 286074 - RNA, 22 nt, Human
cugaggagaacaaugagaucaa

SEQ ID NO: 286075 - RNA, 22 nt, Human
ggcuguggccagcggggcugag

SEQ ID NO: 286076 - RNA, 22 nt, Human
cuuggcagagggcugggcucag

SEQ ID NO: 286077 - RNA, 22 nt, Human
caugaggugauaaagcugggau

SEQ ID NO: 286078 - RNA, 22 nt, Human
cccaaggaauaggaucccagga

SEQ ID NO: 286079 - RNA, 22 nt, Human
uucaaaguugcaugacagcuua

SEQ ID NO: 286080 - RNA, 22 nt, Human
caugcaggaggaaaaagcagcu

SEQ ID NO: 286081 - RNA, 20 nt, Human
gcaaaauaggcucuguuggu

SEQ ID NO: 286082 - RNA, 22 nt, Human
caguuaaacgggccaugugagu

SEQ ID NO: 286083 - RNA, 22 nt, Human
aggaccugaaauucuugcuuuu

SEQ ID NO: 286084 - RNA, 22 nt, Human
cugccuggcuaaacucaagucg

SEQ ID NO: 286085 - RNA, 22 nt, Human
cagguggucaggcagaugggcu

SEQ ID NO: 286086 - RNA, 22 nt, Human
aaauucaaugaucacuggcuca

SEQ ID NO: 286087 - RNA, 22 nt, Human
aggacaugaagaaagggcaagg

SEQ ID NO: 286088 - RNA, 22 nt, Human
uuacaaguauuuaagaugcugu

SEQ ID NO: 286089 - RNA, 22 nt, Human
gacaugcaugaaugcaggucuc

SEQ ID NO: 286090 - RNA, 18 nt, Human
uauauuucacacauauuc

SEQ ID NO: 286091 - RNA, 22 nt, Human
caaaauucugcauuucuaauaa

SEQ ID NO: 286092 - RNA, 22 nt, Human
uguccuuugggagggcacagcu

SEQ ID NO: 286093 - RNA, 22 nt, Human
uuccuggccucuuccaccacca

SEQ ID NO: 286094 - RNA, 21 nt, Human
uuuaauuugcauguaugacgc

SEQ ID NO: 286095 - RNA, 22 nt, Human
gcuguggcuuucuguuucuguu

SEQ ID NO: 286096 - RNA, 22 nt, Human
uuuguuuucuguaggccuuucc

SEQ ID NO: 286097 - RNA, 22 nt, Human
cuuggaauggggcagaaaaugg

SEQ ID NO: 286098 - RNA, 22 nt, Human
cagcaucauacuaccuaaauga

SEQ ID NO: 286099 - RNA, 22 nt, Human
agugcagggccugcccagcagg

SEQ ID NO: 286100 - RNA, 22 nt, Human
gggcuuggguauugugagaggu

SEQ ID NO: 286101 - RNA, 22 nt, Human
uggcaaagacgcuagcuaagau

SEQ ID NO: 286102 - RNA, 21 nt, Human
ucugugguauggccaucuucc

SEQ ID NO: 286103 - RNA, 22 nt, Human
auuuccuguugcuuuugccacu

SEQ ID NO: 286104 - RNA, 22 nt, Human
acccagccacagcauugaggga

SEQ ID NO: 286105 - RNA, 22 nt, Human
agugcuuuccuucuugugacau

SEQ ID NO: 286106 - RNA, 22 nt, Human
aaucauaauuguauacauucau

SEQ ID NO: 286107 - RNA, 22 nt, Human
uuuuucugagaauaugagagga

SEQ ID NO: 286108 - RNA, 18 nt, Human
gccaguggguccaggugc

SEQ ID NO: 286109 - RNA, 22 nt, Human
uccaggcauguggccaguacuc

SEQ ID NO: 286110 - RNA, 22 nt, Human
ccuggcucgcugaccucagggg

SEQ ID NO: 286111 - RNA, 22 nt, Human
aauguuuucucugugaacacau

SEQ ID NO: 286112 - RNA, 22 nt, Human
ggagaggggcaaguuuaucuag

SEQ ID NO: 286113 - RNA, 22 nt, Human
cugcccaggggagugcugucgg

SEQ ID NO: 286114 - RNA, 22 nt, Human
caaaguuuaaaguagauuucag

SEQ ID NO: 286115 - RNA, 22 nt, Human
gcuguggccuccagcacucccc

SEQ ID NO: 286116 - RNA, 22 nt, Human
agcuccugcagacuccugcuca

SEQ ID NO: 286117 - RNA, 22 nt, Human
uauacaagugagaagaagaguu

SEQ ID NO: 286118 - RNA, 22 nt, Human
cugcagagcaaguucucuguug

SEQ ID NO: 286119 - RNA, 22 nt, Human
ccaggaagccucagaugcugag

SEQ ID NO: 286120 - RNA, 22 nt, Human
uugcuuuacauguucugguaaa

SEQ ID NO: 286121 - RNA, 22 nt, Human
agcaaaauaagguaauuuauug

SEQ ID NO: 286122 - RNA, 22 nt, Human
aggaggaacucagaaagaaggu

SEQ ID NO: 286123 - RNA, 22 nt, Human
ucauuuauaaggaugcaauuaa

SEQ ID NO: 286124 - RNA, 22 nt, Human
ccuguucacgguguguuguuag

SEQ ID NO: 286125 - RNA, 22 nt, Human
ggggcaggagcccuucuucagc

SEQ ID NO: 286126 - RNA, 22 nt, Human
cuuucacacacauacauuugga

SEQ ID NO: 286127 - RNA, 22 nt, Human
auguaauaggguaacauaacau

SEQ ID NO: 286128 - RNA, 21 nt, Human
ucagugcaauucuauggggaa

SEQ ID NO: 286129 - RNA, 22 nt, Human
aaaaaccauugucuucagucuc

SEQ ID NO: 286130 - RNA, 22 nt, Human
ucauuucaaugauacuacuaag

SEQ ID NO: 286131 - RNA, 22 nt, Human
ccagugcauaaucaauacagcc

SEQ ID NO: 286132 - RNA, 22 nt, Human
ucaggagugauaccauuuguca

SEQ ID NO: 286133 - RNA, 22 nt, Human
uuucaacaccagagaccaugcg

SEQ ID NO: 286134 - RNA, 22 nt, Human
uucucauggugucuuuauacau

SEQ ID NO: 286135 - RNA, 22 nt, Human
uggccugggcaugaagcaucgu

SEQ ID NO: 286136 - RNA, 22 nt, Human
uuccuucucagcccucgaggau

SEQ ID NO: 286137 - RNA, 22 nt, Human
ugaggcucaagaauagacagua

SEQ ID NO: 286138 - RNA, 22 nt, Human
gggcuuggaguaggcugaugaa

SEQ ID NO: 286139 - RNA, 22 nt, Human
gacagcagccacagggagaggg

SEQ ID NO: 286140 - RNA, 22 nt, Human
ucuggcaguuccuuguugauau

SEQ ID NO: 286141 - RNA, 22 nt, Human
uugggucuuauggcuggaguag

SEQ ID NO: 286142 - RNA, 21 nt, Human
uuuuacagaugaggggaaggg

SEQ ID NO: 286143 - RNA, 22 nt, Human
ucuucccagcugcugcgaugcc

SEQ ID NO: 286144 - RNA, 19 nt, Human
uggaggaaguauauuucau

SEQ ID NO: 286145 - RNA, 22 nt, Human
guauuagacugagaaauggagu

SEQ ID NO: 286146 - RNA, 21 nt, Human
cuguggaagggaacuagaggg

SEQ ID NO: 286147 - RNA, 22 nt, Human
uggaaaacuuugguggugaggg

SEQ ID NO: 286148 - RNA, 22 nt, Human
gaugguccuccugcugccucuc

SEQ ID NO: 286149 - RNA, 22 nt, Human
cauagcuuagggguuaaacuca

SEQ ID NO: 286150 - RNA, 22 nt, Human
ucaaauuaguggaauaauaaug

SEQ ID NO: 286151 - RNA, 22 nt, Human
ugcccuggaggggcuuacaguc

SEQ ID NO: 286152 - RNA, 22 nt, Human
ugaaagcauaugcuaaagacca

SEQ ID NO: 286153 - RNA, 22 nt, Human
gcugaaaugaaaacacaggucg

SEQ ID NO: 286154 - RNA, 22 nt, Human
ggcucugggaaauggucuuccu

SEQ ID NO: 286155 - RNA, 22 nt, Human
aagauagaugucaucagcauau

SEQ ID NO: 286156 - RNA, 20 nt, Human
aaagagaagccucaccuugu

SEQ ID NO: 286157 - RNA, 22 nt, Human
gugcagggcccuccuaacaucu

SEQ ID NO: 286158 - RNA, 22 nt, Human
ggagaagggaacugaguuuuug

SEQ ID NO: 286159 - RNA, 22 nt, Human
ugcauuuuuaacaaggcuaauu

SEQ ID NO: 286160 - RNA, 22 nt, Human
agaaaugacacacaugagacau

SEQ ID NO: 286161 - RNA, 22 nt, Human
cugagccaugggucuaagcacu

SEQ ID NO: 286162 - RNA, 22 nt, Human
caaauguauucucacuucaggg

SEQ ID NO: 286163 - RNA, 22 nt, Human
caaaugcuacuaauaggcaagu

SEQ ID NO: 286164 - RNA, 22 nt, Human
agacagacuguguuugaauccu

SEQ ID NO: 286165 - RNA, 22 nt, Human
uuuauugucuaugaacugcuug

SEQ ID NO: 286166 - RNA, 20 nt, Human
ccagcuuucccugcagcauc

SEQ ID NO: 286167 - RNA, 22 nt, Human
cuuuauguacuguguauuugaa

SEQ ID NO: 286168 - RNA, 22 nt, Human
gcccagggcuucaaagagagaa

SEQ ID NO: 286169 - RNA, 22 nt, Human
guugggaaggugaacaugaugc

SEQ ID NO: 286170 - RNA, 22 nt, Human
gaaagccaucuggcugcuggga

SEQ ID NO: 286171 - RNA, 22 nt, Human
ugcugggucaggcaucugcaga

SEQ ID NO: 286172 - RNA, 21 nt, Human
aucuuuauuacgcagagaaga

SEQ ID NO: 286173 - RNA, 22 nt, Human
acagggcagagugaaaugcuau

SEQ ID NO: 286174 - RNA, 22 nt, Human
agcuuguuaaggaugcauauua

SEQ ID NO: 286175 - RNA, 22 nt, Human
ggugcauguagccaucaagaua

SEQ ID NO: 286176 - RNA, 22 nt, Human
ucagguguuucuggagaaguaa

SEQ ID NO: 286177 - RNA, 22 nt, Human
acugugccuucuuauugggucc

SEQ ID NO: 286178 - RNA, 22 nt, Human
guauucauauuaaacauaucaa

SEQ ID NO: 286179 - RNA, 22 nt, Human
ucucuggggguagaacucaggc

SEQ ID NO: 286180 - RNA, 22 nt, Human
cuguccuuacugcuucuggcuu

SEQ ID NO: 286181 - RNA, 17 nt, Human
agugagaaugucaugua

SEQ ID NO: 286182 - RNA, 22 nt, Human
uuucacauaaauauuaugccua

SEQ ID NO: 286183 - RNA, 22 nt, Human
cuggaguuagaguagacacuga

SEQ ID NO: 286184 - RNA, 22 nt, Human
augcaugcagggaagacaguag

SEQ ID NO: 286185 - RNA, 22 nt, Human
gcagcuuuuuggaugucaguua

SEQ ID NO: 286186 - RNA, 21 nt, Human
ucugucuuccucagccuaagg

SEQ ID NO: 286187 - RNA, 22 nt, Human
uccuguuuaucugugugacucg

SEQ ID NO: 286188 - RNA, 22 nt, Human
guacauuuauuuuugcagcaua

SEQ ID NO: 286189 - RNA, 22 nt, Human
auuauuaggacuacugggguug

SEQ ID NO: 286190 - RNA, 22 nt, Human
aggaauguuaggagaugagucu

SEQ ID NO: 286191 - RNA, 22 nt, Human
auuucucaguaggugcacagug

SEQ ID NO: 286192 - RNA, 22 nt, Human
acugagcagaagagaucuguga

SEQ ID NO: 286193 - RNA, 19 nt, Human
aaggugucccaacugcguu

SEQ ID NO: 286194 - RNA, 22 nt, Human
ucuaaacacuaagucuugaugc

SEQ ID NO: 286195 - RNA, 22 nt, Human
uuuuuuggugcuccuaggaagg

SEQ ID NO: 286196 - RNA, 22 nt, Human
uucuaacuuucaagguccuuuc

SEQ ID NO: 286197 - RNA, 22 nt, Human
gccagcagccacagaagucacu

SEQ ID NO: 286198 - RNA, 22 nt, Human
aguguacaaaaugauagauaaa

SEQ ID NO: 286199 - RNA, 22 nt, Human
cuguucuaucauuaaaagcuau

SEQ ID NO: 286200 - RNA, 20 nt, Human
uuuaucugugggaguggaga

SEQ ID NO: 286201 - RNA, 22 nt, Human
uaagaacuucggacauguuauc

SEQ ID NO: 286202 - RNA, 21 nt, Human
aggaugccgcaggcggagaag

SEQ ID NO: 286203 - RNA, 22 nt, Human
auucagcauucauuaugcgcca

SEQ ID NO: 286204 - RNA, 22 nt, Human
cugguuugucuugggaggaugu

SEQ ID NO: 286205 - RNA, 23 nt, Human
gggggccguccuggggauuauag

SEQ ID NO: 286206 - RNA, 22 nt, Human
uauacacaaggugugcauuugu

SEQ ID NO: 286207 - RNA, 22 nt, Human
cucugagggucuaaggagucac

SEQ ID NO: 286208 - RNA, 22 nt, Human
acaugagaucacaaagauaaau

SEQ ID NO: 286209 - RNA, 20 nt, Human
gcuguucacauuauuaguag

SEQ ID NO: 286210 - RNA, 22 nt, Human
gggaccugaggcccugcuccac

SEQ ID NO: 286211 - RNA, 23 nt, Human
uggaggaaacacaucagaagacc

SEQ ID NO: 286212 - RNA, 22 nt, Human
aagcuuuaaggaauuuuaugga

SEQ ID NO: 286213 - RNA, 22 nt, Human
acaugcuuuucccacaauuaua

SEQ ID NO: 286214 - RNA, 22 nt, Human
acuagaaaguuuccagaguuau

SEQ ID NO: 286215 - RNA, 22 nt, Human
gaugaugaggccaugaggcagg

SEQ ID NO: 286216 - RNA, 22 nt, Human
cagguucuggguccuggguccu

SEQ ID NO: 286217 - RNA, 22 nt, Human
uuaaauaguaggucuauuuugg

SEQ ID NO: 286218 - RNA, 22 nt, Human
uggcaauguuagcaaagcauuu

SEQ ID NO: 286219 - RNA, 22 nt, Human
gcagguggauauugcuacuuga

SEQ ID NO: 286220 - RNA, 22 nt, Human
auggagggugguaagacagaga

SEQ ID NO: 286221 - RNA, 22 nt, Human
auuuuagagcuccaaguacagc

SEQ ID NO: 286222 - RNA, 22 nt, Human
ugucuuuagagucacaaaacca

SEQ ID NO: 286223 - RNA, 22 nt, Human
ugggacucacucuuuuggccag

SEQ ID NO: 286224 - RNA, 22 nt, Human
uccaggcaaggauaauaaacau

SEQ ID NO: 286225 - RNA, 22 nt, Human
aguuuacaaaguuucacuguuc

SEQ ID NO: 286226 - RNA, 22 nt, Human
aggaccuguguuuuccuugaau

SEQ ID NO: 286227 - RNA, 22 nt, Human
ugggugugccauauuccauuuc

SEQ ID NO: 286228 - RNA, 22 nt, Human
uacaaguccguaaagggcagau

SEQ ID NO: 286229 - RNA, 22 nt, Human
acagaugaggaagagucagcca

SEQ ID NO: 286230 - RNA, 22 nt, Human
cuuugguggaggggugcaggca

SEQ ID NO: 286231 - RNA, 22 nt, Human
ucugugugaccauaagccagcu

SEQ ID NO: 286232 - RNA, 22 nt, Human
acuaaaaacuacugccaauagc

SEQ ID NO: 286233 - RNA, 22 nt, Human
aucauucugauggucaaugcua

SEQ ID NO: 286234 - RNA, 22 nt, Human
uuuccagguauuaauacuguau

SEQ ID NO: 286235 - RNA, 22 nt, Human
uucauucauucaugaauguuaa

SEQ ID NO: 286236 - RNA, 23 nt, Human
ucuggaggggacacugcagaugc

SEQ ID NO: 286237 - RNA, 20 nt, Human
ugggguccuggaggggaucc

SEQ ID NO: 286238 - RNA, 22 nt, Human
uuucucuucacugugugccuca

SEQ ID NO: 286239 - RNA, 22 nt, Human
uucaacuagauuuauacaauuc

SEQ ID NO: 286240 - RNA, 22 nt, Human
cauuugaaauucuuagaacaaa

SEQ ID NO: 286241 - RNA, 22 nt, Human
uacaaaaggaagagggaucuua

SEQ ID NO: 286242 - RNA, 22 nt, Human
cuaguguuuggaagucauagcc

SEQ ID NO: 286243 - RNA, 22 nt, Human
agcuuuauuugucauucacggc

SEQ ID NO: 286244 - RNA, 19 nt, Human
ggacacagaaagcugcauu

SEQ ID NO: 286245 - RNA, 22 nt, Human
auguguccaaggccacaauagc

SEQ ID NO: 286246 - RNA, 22 nt, Human
uucugguuacauuguuacagcu

SEQ ID NO: 286247 - RNA, 22 nt, Human
agagaacaaauuaaaggugguu

SEQ ID NO: 286248 - RNA, 22 nt, Human
cuuagcaguggguaccagggcu

SEQ ID NO: 286249 - RNA, 22 nt, Human
ggugggcagcucuuggcaggca

SEQ ID NO: 286250 - RNA, 22 nt, Human
caauuucagguggauagguuuu

SEQ ID NO: 286251 - RNA, 22 nt, Human
uucagcaguuucugagaagcaa

SEQ ID NO: 286252 - RNA, 22 nt, Human
gguccugggaagaugcucauga

SEQ ID NO: 286253 - RNA, 21 nt, Human
uuucacaaaaguaugugacaa

SEQ ID NO: 286254 - RNA, 22 nt, Human
aaaugcagguaguauuuauuuu

SEQ ID NO: 286255 - RNA, 22 nt, Human
ucauuauccuaguaucuugaau

SEQ ID NO: 286256 - RNA, 22 nt, Human
uugaaaaaauugguagaggaug

SEQ ID NO: 286257 - RNA, 22 nt, Human
gcugauagacugaauguuggga

SEQ ID NO: 286258 - RNA, 22 nt, Human
uucuuuucccaauauuuugcug

SEQ ID NO: 286259 - RNA, 22 nt, Human
cagaagaggacuggguagcuca

SEQ ID NO: 286260 - RNA, 22 nt, Human
gugcaaaaggcauugugguuuu

SEQ ID NO: 286261 - RNA, 22 nt, Human
ucaguccauaggugggccugag

SEQ ID NO: 286262 - RNA, 20 nt, Human
auguaaaauuauaaggcuga

SEQ ID NO: 286263 - RNA, 19 nt, Human
uuccugggguuccauugug

SEQ ID NO: 286264 - RNA, 22 nt, Human
gccagccuucuguggccugcaa

SEQ ID NO: 286265 - RNA, 22 nt, Human
caaggaaaagaaguauuucaga

SEQ ID NO: 286266 - RNA, 22 nt, Human
ccaggccucuggcugcuuaguc

SEQ ID NO: 286267 - RNA, 22 nt, Human
aacaguuugcuuuaagaggcac

SEQ ID NO: 286268 - RNA, 22 nt, Human
auuguauaagucuauuuacaau

SEQ ID NO: 286269 - RNA, 17 nt, Human
guaaggcuugcagaugc

SEQ ID NO: 286270 - RNA, 22 nt, Human
auacacauuugcuagagauggg

SEQ ID NO: 286271 - RNA, 22 nt, Human
aaugugucagcuugucgaucuu

SEQ ID NO: 286272 - RNA, 21 nt, Human
cauuucuaagccuggcuauag

SEQ ID NO: 286273 - RNA, 22 nt, Human
acuguacaugcaucuugucuau

SEQ ID NO: 286274 - RNA, 22 nt, Human
aaugugucuaugugguucacag

SEQ ID NO: 286275 - RNA, 22 nt, Human
ucauucuugaucacuaguuagu

SEQ ID NO: 286276 - RNA, 22 nt, Human
acagugucuccugguacccagu

SEQ ID NO: 286277 - RNA, 22 nt, Human
uuucauugucuacauaugacau

SEQ ID NO: 286278 - RNA, 21 nt, Human
ucucuguauccauggguucca

SEQ ID NO: 286279 - RNA, 22 nt, Human
gggcagguacuggguggugagc

SEQ ID NO: 286280 - RNA, 22 nt, Human
cagggagcuggugccagccgac

SEQ ID NO: 286281 - RNA, 22 nt, Human
uagaaacauauguuugagacau

SEQ ID NO: 286282 - RNA, 22 nt, Human
ucugaaaugaccuuuccccacu

SEQ ID NO: 286283 - RNA, 22 nt, Human
ucuucagaggaagucagucuuu

SEQ ID NO: 286284 - RNA, 19 nt, Human
ggccuugaugaguggggag

SEQ ID NO: 286285 - RNA, 22 nt, Human
agcuccaagguugaggagugag

SEQ ID NO: 286286 - RNA, 22 nt, Human
aauauguugagucuaucuuuau

SEQ ID NO: 286287 - RNA, 22 nt, Human
caguuaccaucuucagugauga

SEQ ID NO: 286288 - RNA, 22 nt, Human
cauuuuguaagucucucuuguu

SEQ ID NO: 286289 - RNA, 22 nt, Human
ggaacugaggaacgaacuggga

SEQ ID NO: 286290 - RNA, 22 nt, Human
aaggugguuugcuaaucccaac

SEQ ID NO: 286291 - RNA, 22 nt, Human
cuguuggccuuucaucaguaau

SEQ ID NO: 286292 - RNA, 22 nt, Human
ggcagguggauuuucuacucua

SEQ ID NO: 286293 - RNA, 22 nt, Human
acccggagucggagguugcagu

SEQ ID NO: 286294 - RNA, 22 nt, Human
ucuagaaacagguuucuagaaa

SEQ ID NO: 286295 - RNA, 22 nt, Human
aggcuugguuuauagaaguaau

SEQ ID NO: 286296 - RNA, 22 nt, Human
uguacauagaucuugaaaauua

SEQ ID NO: 286297 - RNA, 22 nt, Human
acauuucagcgugcaugacaug

SEQ ID NO: 286298 - RNA, 22 nt, Human
aagauuauuuaagacaggaacc

SEQ ID NO: 286299 - RNA, 22 nt, Human
caaggaaggagagaugaugggu

SEQ ID NO: 286300 - RNA, 22 nt, Human
uagggauguaaacauaguaauu

SEQ ID NO: 286301 - RNA, 22 nt, Human
ccccaaggugcucacugucugg

SEQ ID NO: 286302 - RNA, 18 nt, Human
uguuuauuuuucucuuac

SEQ ID NO: 286303 - RNA, 22 nt, Human
aacuagaacgucuaguugcugg

SEQ ID NO: 286304 - RNA, 22 nt, Human
augcaucuuuucaagguauuuc

SEQ ID NO: 286305 - RNA, 22 nt, Human
cuuucuuuguccaccaacaaug

SEQ ID NO: 286306 - RNA, 22 nt, Human
gcuggcuggcgggugcguccuc

SEQ ID NO: 286307 - RNA, 22 nt, Human
gcacaguuaaagggucauguga

SEQ ID NO: 286308 - RNA, 22 nt, Human
gcaugcagggagggucuggcug

SEQ ID NO: 286309 - RNA, 22 nt, Human
agucaguuaaccucacagcauc

SEQ ID NO: 286310 - RNA, 17 nt, Human
gagugcagacacaagca

SEQ ID NO: 286311 - RNA, 22 nt, Human
uuuaauugcauuuaaagaugga

SEQ ID NO: 286312 - RNA, 22 nt, Human
ggcuagggaucuagaccaggac

SEQ ID NO: 286313 - RNA, 21 nt, Human
uaucuacuggugucuuucaga

SEQ ID NO: 286314 - RNA, 23 nt, Human
uaauuagauguugauuccugaga

SEQ ID NO: 286315 - RNA, 23 nt, Human
ucuguacaauugagaagagaaca

SEQ ID NO: 286316 - RNA, 22 nt, Human
caauauauaaugaguacuuucc

SEQ ID NO: 286317 - RNA, 22 nt, Human
uucaaacaaaacuguucccaua

SEQ ID NO: 286318 - RNA, 22 nt, Human
ggagagaauuccauggacaugu

SEQ ID NO: 286319 - RNA, 22 nt, Human
gccugcagggcccuuguggguc

SEQ ID NO: 286320 - RNA, 22 nt, Human
uggcugugauuugcacgagaug

SEQ ID NO: 286321 - RNA, 22 nt, Human
cccaucaggaacccaggagccc

SEQ ID NO: 286322 - RNA, 22 nt, Human
ucuuuccauggccacacagucu

SEQ ID NO: 286323 - RNA, 20 nt, Human
uuucuuguacuuggagaagg

SEQ ID NO: 286324 - RNA, 22 nt, Human
uuccuggccagcuguggugagu

SEQ ID NO: 286325 - RNA, 22 nt, Human
aauguauucugggaaaauguua

SEQ ID NO: 286326 - RNA, 17 nt, Human
uuccugugguuugaucu

SEQ ID NO: 286327 - RNA, 19 nt, Human
ugcauaaauuauauacuuu

SEQ ID NO: 286328 - RNA, 22 nt, Human
ugagccagucucucagaacccu

SEQ ID NO: 286329 - RNA, 22 nt, Human
acucuuauaguauugguuauua

SEQ ID NO: 286330 - RNA, 22 nt, Human
cugucucagcaggaagucauca

SEQ ID NO: 286331 - RNA, 23 nt, Human
agguggucuuguggaugcugcaa

SEQ ID NO: 286332 - RNA, 22 nt, Human
uucuuucucaacaugaauguuu

SEQ ID NO: 286333 - RNA, 22 nt, Human
gaguuauaaccuaguuuaacug

SEQ ID NO: 286334 - RNA, 22 nt, Human
cagugucugggacagaaaguca

SEQ ID NO: 286335 - RNA, 22 nt, Human
agagcagauuucaaauauuggc

SEQ ID NO: 286336 - RNA, 22 nt, Human
uauuccuauuucuaaacauaug

SEQ ID NO: 286337 - RNA, 21 nt, Human
ucuccaguauccuucucugag

SEQ ID NO: 286338 - RNA, 21 nt, Human
gcaaguacuaucaucauuauc

SEQ ID NO: 286339 - RNA, 22 nt, Human
cacaagucuguggucuccaaca

SEQ ID NO: 286340 - RNA, 22 nt, Human
uggcugcugagaaggcagcugu

SEQ ID NO: 286341 - RNA, 22 nt, Human
uauuacagcuuugauuaucugg

SEQ ID NO: 286342 - RNA, 22 nt, Human
ccagccuggggaggcagcuucu

SEQ ID NO: 286343 - RNA, 21 nt, Human
uccuggcaggcccaggacccu

SEQ ID NO: 286344 - RNA, 22 nt, Human
cugaggcuuguccucucagcuu

SEQ ID NO: 286345 - RNA, 22 nt, Human
gcuuggccagcagccgggaugc

SEQ ID NO: 286346 - RNA, 22 nt, Human
auccuggcaagcagaggagaac

SEQ ID NO: 286347 - RNA, 22 nt, Human
auugcuuuugagcuagaauuuu

SEQ ID NO: 286348 - RNA, 22 nt, Human
aguauuuagagacacaagaugg

SEQ ID NO: 286349 - RNA, 22 nt, Human
ugcagggccuucuagaccaugg

SEQ ID NO: 286350 - RNA, 22 nt, Human
acaugauuuuaguaucauaaua

SEQ ID NO: 286351 - RNA, 22 nt, Human
uaggauuuggcuuuagucaggu

SEQ ID NO: 286352 - RNA, 22 nt, Human
ucugauguggagacacuguuuu

SEQ ID NO: 286353 - RNA, 22 nt, Human
aaaacauucugugaacucucaa

SEQ ID NO: 286354 - RNA, 22 nt, Human
guuuacuguuaaccaacgaaug

SEQ ID NO: 286355 - RNA, 22 nt, Human
ggagaaggaagaaagcuacuau

SEQ ID NO: 286356 - RNA, 22 nt, Human
aauugcuuuuauuuagggccag

SEQ ID NO: 286357 - RNA, 22 nt, Human
uuauuccauuauuucacuuagg

SEQ ID NO: 286358 - RNA, 22 nt, Human
aaaaagucugcaaaggagguug

SEQ ID NO: 286359 - RNA, 22 nt, Human
acagagucugacagguaggcgc

SEQ ID NO: 286360 - RNA, 22 nt, Human
auuagggaaggauuuggccuga

SEQ ID NO: 286361 - RNA, 22 nt, Human
acagacagacagagaacuauuc

SEQ ID NO: 286362 - RNA, 22 nt, Human
aguguccuggcaaggguuucag

SEQ ID NO: 286363 - RNA, 22 nt, Human
auuggcuuucuuuugugaaaau

SEQ ID NO: 286364 - RNA, 18 nt, Human
uccaaagccagagaaguu

SEQ ID NO: 286365 - RNA, 22 nt, Human
gucucugagcucugagcuggcu

SEQ ID NO: 286366 - RNA, 22 nt, Human
uuuaucuuuaggacuuugcaga

SEQ ID NO: 286367 - RNA, 22 nt, Human
agaaaauuuaaagagacacaca

SEQ ID NO: 286368 - RNA, 22 nt, Human
agagccaggaucuguuuugggg

SEQ ID NO: 286369 - RNA, 19 nt, Human
auggaaaaugccagacuga

SEQ ID NO: 286370 - RNA, 22 nt, Human
uaucaaaaggaguugaaagggg

SEQ ID NO: 286371 - RNA, 22 nt, Human
gaagacaauucuggguggagga

SEQ ID NO: 286372 - RNA, 22 nt, Human
aacuuguauauguuauucagag

SEQ ID NO: 286373 - RNA, 22 nt, Human
aaggugguaggcuauaucagua

SEQ ID NO: 286374 - RNA, 22 nt, Human
uguaaacuguagaaaauacuuu

SEQ ID NO: 286375 - RNA, 22 nt, Human
aggaaugucauagaauaaucau

SEQ ID NO: 286376 - RNA, 22 nt, Human
cugccuguauugucugcuuggg

SEQ ID NO: 286377 - RNA, 22 nt, Human
cagggaugucucuggaagggag

SEQ ID NO: 286378 - RNA, 22 nt, Human
uuccugaagucaaagaucuaaa

SEQ ID NO: 286379 - RNA, 22 nt, Human
uucuuguauauaaaaaucauuu

SEQ ID NO: 286380 - RNA, 22 nt, Human
ccauccugcaggaccuccauau

SEQ ID NO: 286381 - RNA, 22 nt, Human
acagcagcugccuucaggcucu

SEQ ID NO: 286382 - RNA, 18 nt, Human
cauuuguuauugugugug

SEQ ID NO: 286383 - RNA, 22 nt, Human
uccaggcucccucaggaugcac

SEQ ID NO: 286384 - RNA, 22 nt, Human
uuucacaugcagcagggaagug

SEQ ID NO: 286385 - RNA, 22 nt, Human
acuauuagcauaucaugaaugg

SEQ ID NO: 286386 - RNA, 22 nt, Human
cugaaugaaaucaaggacugag

SEQ ID NO: 286387 - RNA, 22 nt, Human
ugcuucaaguugaaauauucuu

SEQ ID NO: 286388 - RNA, 22 nt, Human
uccaggcuaauuuugcauuguu

SEQ ID NO: 286389 - RNA, 22 nt, Human
aaagacagacggaaaccugagg

SEQ ID NO: 286390 - RNA, 22 nt, Human
cacagaaaaaggcuugaaaauc

SEQ ID NO: 286391 - RNA, 22 nt, Human
acuaacuugcugagugaccaug

SEQ ID NO: 286392 - RNA, 22 nt, Human
gauuguaaaacagaucauuauc

SEQ ID NO: 286393 - RNA, 22 nt, Human
agggcuacugccugccuucagg

SEQ ID NO: 286394 - RNA, 22 nt, Human
agggcuccuccccggccuccac

SEQ ID NO: 286395 - RNA, 22 nt, Human
guccuggcuagucguccgcgac

SEQ ID NO: 286396 - RNA, 22 nt, Human
agcagguggugggccagauuug

SEQ ID NO: 286397 - RNA, 22 nt, Human
ucuggagagcagaugccucugg

SEQ ID NO: 286398 - RNA, 22 nt, Human
augaaauggugguuuuccauuu

SEQ ID NO: 286399 - RNA, 22 nt, Human
uguaaaugaaguaugcuuuacu

SEQ ID NO: 286400 - RNA, 22 nt, Human
guacacauacuauucaaagaga

SEQ ID NO: 286401 - RNA, 22 nt, Human
uacagagacuuuauggcacaaa

SEQ ID NO: 286402 - RNA, 22 nt, Human
ggaaggaaguaaaugaugcuau

SEQ ID NO: 286403 - RNA, 22 nt, Human
uccaggcacuauauauacuuuu

SEQ ID NO: 286404 - RNA, 22 nt, Human
acagauggaauguguuauggga

SEQ ID NO: 286405 - RNA, 22 nt, Human
ugacaagagcauucccacaccu

SEQ ID NO: 286406 - RNA, 21 nt, Human
caggcuugaggaaugugccug

SEQ ID NO: 286407 - RNA, 22 nt, Human
uaaguucaagucuuggauauaa

SEQ ID NO: 286408 - RNA, 22 nt, Human
aggagaggcaucaagaaaaucg

SEQ ID NO: 286409 - RNA, 22 nt, Human
aggcuuuaauuaucuacaggag

SEQ ID NO: 286410 - RNA, 22 nt, Human
cagcccugugcuaagcacccuc

SEQ ID NO: 286411 - RNA, 22 nt, Human
uugacacagaucaauauucaac

SEQ ID NO: 286412 - RNA, 17 nt, Human
gggcugacaguggccuc

SEQ ID NO: 286413 - RNA, 20 nt, Human
cugccuggaggccucuaccu

SEQ ID NO: 286414 - RNA, 22 nt, Human
ggaagaaagcacacaaacuuga

SEQ ID NO: 286415 - RNA, 22 nt, Human
ugaaauuagugaaguuacaguu

SEQ ID NO: 286416 - RNA, 19 nt, Human
agggagaauuccaagagga

SEQ ID NO: 286417 - RNA, 22 nt, Human
caguuaaacagauugaguguua

SEQ ID NO: 286418 - RNA, 22 nt, Human
gggagccaugcuggucuucuuu

SEQ ID NO: 286419 - RNA, 22 nt, Human
ucaggugggucuacaauuaguu

SEQ ID NO: 286420 - RNA, 22 nt, Human
ugggccaggggccucuucugau

SEQ ID NO: 286421 - RNA, 22 nt, Human
agagucagacuaagccauggug

SEQ ID NO: 286422 - RNA, 22 nt, Human
ucuggcccaucuucugccacca

SEQ ID NO: 286423 - RNA, 22 nt, Human
uccugcagcauccgucgucugu

SEQ ID NO: 286424 - RNA, 22 nt, Human
gccggggcuggggagagacaug

SEQ ID NO: 286425 - RNA, 22 nt, Human
cauuuaauagaugcuguuucag

SEQ ID NO: 286426 - RNA, 22 nt, Human
ccccagccagcaggaccucuga

SEQ ID NO: 286427 - RNA, 22 nt, Human
aaaguuuuagaacuaggaagca

SEQ ID NO: 286428 - RNA, 22 nt, Human
aaauccuaaggagaauaugauu

SEQ ID NO: 286429 - RNA, 22 nt, Human
uaagaaacuaaugcaauaagag

SEQ ID NO: 286430 - RNA, 22 nt, Human
acugucuuuauuagaaucuuau

SEQ ID NO: 286431 - RNA, 22 nt, Human
uuguacaaguauuaugugaaca

SEQ ID NO: 286432 - RNA, 22 nt, Human
gauucuuuggccuuuauugaca

SEQ ID NO: 286433 - RNA, 22 nt, Human
gagaggagguggcuaugacagc

SEQ ID NO: 286434 - RNA, 21 nt, Human
aaugucuuuguccaugcucug

SEQ ID NO: 286435 - RNA, 22 nt, Human
aucuuucuauuucuaaaaacua

SEQ ID NO: 286436 - RNA, 23 nt, Human
acacauauauucagauacagaug

SEQ ID NO: 286437 - RNA, 22 nt, Human
ccagggcaucacauccaguguu

SEQ ID NO: 286438 - RNA, 22 nt, Human
gccagcucaguuucaaaguagg

SEQ ID NO: 286439 - RNA, 22 nt, Human
cauuuguaggaugcuucuuguu

SEQ ID NO: 286440 - RNA, 21 nt, Human
ugaccagugccccauccuguc

SEQ ID NO: 286441 - RNA, 22 nt, Human
agguuuaugccuuggagcuggg

SEQ ID NO: 286442 - RNA, 22 nt, Human
uuuacacaaaagauagcacacc

SEQ ID NO: 286443 - RNA, 22 nt, Human
guaacauaguuugugcuucauc

SEQ ID NO: 286444 - RNA, 22 nt, Human
uucacacuuguuaggauggcuu

SEQ ID NO: 286445 - RNA, 22 nt, Human
aaauguacgggaguagaauuag

SEQ ID NO: 286446 - RNA, 22 nt, Human
cugaggcugggcauggggucca

SEQ ID NO: 286447 - RNA, 22 nt, Human
caguggugaagagcaggggcuc

SEQ ID NO: 286448 - RNA, 20 nt, Human
uugcuuuaucagacaugaua

SEQ ID NO: 286449 - RNA, 22 nt, Human
ucagacagaaggacuauuugaa

SEQ ID NO: 286450 - RNA, 22 nt, Human
acagucuacaaagugaugugug

SEQ ID NO: 286451 - RNA, 23 nt, Human
uccuggguuugaauucuagucuu

SEQ ID NO: 286452 - RNA, 22 nt, Human
agagccagcaagugaauaguga

SEQ ID NO: 286453 - RNA, 22 nt, Human
aggcugugcgaggucucagagu

SEQ ID NO: 286454 - RNA, 22 nt, Human
agaggcaagauuaucagggcau

SEQ ID NO: 286455 - RNA, 22 nt, Human
ggaccugccagaacucaggcua

SEQ ID NO: 286456 - RNA, 18 nt, Human
ucuggagggaagcuuuga

SEQ ID NO: 286457 - RNA, 22 nt, Human
aagcugcaaggaagugugccag

SEQ ID NO: 286458 - RNA, 22 nt, Human
ccugagaauguuuaacagagaa

SEQ ID NO: 286459 - RNA, 22 nt, Human
aagcaaagagauaaccuuuugg

SEQ ID NO: 286460 - RNA, 22 nt, Human
ggcuuuauuucacuguaccaua

SEQ ID NO: 286461 - RNA, 22 nt, Human
ucugaaaucuguaagcacuagc

SEQ ID NO: 286462 - RNA, 17 nt, Human
aguguuuccuuaucauu

SEQ ID NO: 286463 - RNA, 20 nt, Human
acaaagacuggaaaagcaag

SEQ ID NO: 286464 - RNA, 22 nt, Human
ucauugcaguugaguuguguua

SEQ ID NO: 286465 - RNA, 22 nt, Human
uugcugggucagaagccaggag

SEQ ID NO: 286466 - RNA, 22 nt, Human
cccagagcaugugcugccuuug

SEQ ID NO: 286467 - RNA, 22 nt, Human
auguaaaagauuauuuuccugu

SEQ ID NO: 286468 - RNA, 22 nt, Human
agggagaguagauaucaggugu

SEQ ID NO: 286469 - RNA, 22 nt, Human
ggaggggagucucccaaagccg

SEQ ID NO: 286470 - RNA, 19 nt, Human
uucuaccuuacuguaggcu

SEQ ID NO: 286471 - RNA, 23 nt, Human
uggacagcagcagcagugucacc

SEQ ID NO: 286472 - RNA, 22 nt, Human
gacccagccugguuuuuauagg

SEQ ID NO: 286473 - RNA, 22 nt, Human
aacaguuucaguuacugaugag

SEQ ID NO: 286474 - RNA, 22 nt, Human
acucaguuaucauguguccaca

SEQ ID NO: 286475 - RNA, 22 nt, Human
uccagggagagccgcugcucca

SEQ ID NO: 286476 - RNA, 22 nt, Human
ccuccugggccuugcucuguga

SEQ ID NO: 286477 - RNA, 22 nt, Human
ucccagaggcuccagucucuau

SEQ ID NO: 286478 - RNA, 22 nt, Human
aauuccucuaucuuucuucaag

SEQ ID NO: 286479 - RNA, 22 nt, Human
aaauguguuccuuugcuacaga

SEQ ID NO: 286480 - RNA, 22 nt, Human
uaaggaggcagucauuaucagg

SEQ ID NO: 286481 - RNA, 22 nt, Human
aacaagaagggaaggcaugauu

SEQ ID NO: 286482 - RNA, 22 nt, Human
cugggaaauggcuucgagcuca

SEQ ID NO: 286483 - RNA, 22 nt, Human
gaccuggaggauccucuucuug

SEQ ID NO: 286484 - RNA, 22 nt, Human
uucacaaaacacuauuuucugg

SEQ ID NO: 286485 - RNA, 22 nt, Human
auccuggcccagguguggaggg

SEQ ID NO: 286486 - RNA, 22 nt, Human
uuuuuagaauuggcugagaauu

SEQ ID NO: 286487 - RNA, 22 nt, Human
auucuucauacagacaaguccu

SEQ ID NO: 286488 - RNA, 22 nt, Human
cagagcugucauuugccaguga

SEQ ID NO: 286489 - RNA, 22 nt, Human
acuguggcucagggaaugcaug

SEQ ID NO: 286490 - RNA, 22 nt, Human
ugcacaagucagaguaacauuu

SEQ ID NO: 286491 - RNA, 20 nt, Human
guauuaggagguaaauguaa

SEQ ID NO: 286492 - RNA, 22 nt, Human
uuuuucuugugcuggaucuaau

SEQ ID NO: 286493 - RNA, 22 nt, Human
aucauaaaccacuuuguaaucu

SEQ ID NO: 286494 - RNA, 22 nt, Human
cuggcugguucccugcuccagg

SEQ ID NO: 286495 - RNA, 22 nt, Human
gacuuuauuacuaacccuguga

SEQ ID NO: 286496 - RNA, 22 nt, Human
ggcagggcagcgcugauuaggg

SEQ ID NO: 286497 - RNA, 22 nt, Human
ccuccuucuggggccuucugcu

SEQ ID NO: 286498 - RNA, 22 nt, Human
ugcccaggcuggagugcagagg

SEQ ID NO: 286499 - RNA, 22 nt, Human
aagugagguuucugcuuucaga

SEQ ID NO: 286500 - RNA, 22 nt, Human
ucagggcugcauacaggagaua

SEQ ID NO: 286501 - RNA, 22 nt, Human
cuucagugaauguugaguaagg

SEQ ID NO: 286502 - RNA, 22 nt, Human
gcgggccaccuuggagagcgcu

SEQ ID NO: 286503 - RNA, 22 nt, Human
gaagucuucauucucucugaga

SEQ ID NO: 286504 - RNA, 21 nt, Human
agaugaggauacugaggccua

SEQ ID NO: 286505 - RNA, 22 nt, Human
aaauauacggucccuaacaguc

SEQ ID NO: 286506 - RNA, 22 nt, Human
ugagacagcagucagggaaaua

SEQ ID NO: 286507 - RNA, 20 nt, Human
ugcugggugggcagcuguaa

SEQ ID NO: 286508 - RNA, 22 nt, Human
uuucuauaugaggagcuaaagu

SEQ ID NO: 286509 - RNA, 22 nt, Human
uaacaguugguguaauuucuug

SEQ ID NO: 286510 - RNA, 20 nt, Human
ccagagaguagguuagugau

SEQ ID NO: 286511 - RNA, 22 nt, Human
guggcaggagacuggaagaugg

SEQ ID NO: 286512 - RNA, 22 nt, Human
gaggaaaauauucagggagguu

SEQ ID NO: 286513 - RNA, 22 nt, Human
uuuacagaauguugaauuuggg

SEQ ID NO: 286514 - RNA, 19 nt, Human
uccaguguagcuggucauu

SEQ ID NO: 286515 - RNA, 21 nt, Human
agugccaguagguauggagga

SEQ ID NO: 286516 - RNA, 22 nt, Human
uucuucuucuggcugcaccugg

SEQ ID NO: 286517 - RNA, 22 nt, Human
cuggaggccacuguacagauug

SEQ ID NO: 286518 - RNA, 22 nt, Human
ucagaugagugcuuucagcugc

SEQ ID NO: 286519 - RNA, 22 nt, Human
cacugagcugauagaauuccag

SEQ ID NO: 286520 - RNA, 22 nt, Human
uccagcauuuuucaauagaauu

SEQ ID NO: 286521 - RNA, 22 nt, Human
ccauggcucuuaccuuguuaua

SEQ ID NO: 286522 - RNA, 22 nt, Human
gggagggaagguaccuguguga

SEQ ID NO: 286523 - RNA, 22 nt, Human
aauguuuucauuauccuaacug

SEQ ID NO: 286524 - RNA, 22 nt, Human
gcuggcagagagcuggugagga

SEQ ID NO: 286525 - RNA, 23 nt, Human
uugcuugagcccaggaaguggag

SEQ ID NO: 286526 - RNA, 22 nt, Human
aguccuuugcugaacugucaca

SEQ ID NO: 286527 - RNA, 22 nt, Human
gaggcugcccacaccugcgccg

SEQ ID NO: 286528 - RNA, 22 nt, Human
ggcuacugugauggucugcaag

SEQ ID NO: 286529 - RNA, 22 nt, Human
ucagaggugcaagaaguucuga

SEQ ID NO: 286530 - RNA, 22 nt, Human
gggucuccauguuaacaucacu

SEQ ID NO: 286531 - RNA, 19 nt, Human
ccuggguccacucagacua

SEQ ID NO: 286532 - RNA, 22 nt, Human
auuuccaucaucauuaggccua

SEQ ID NO: 286533 - RNA, 15 nt, Human
uccaggcauucauuc

SEQ ID NO: 286534 - RNA, 22 nt, Human
ggaacugauuaagucaugagaa

SEQ ID NO: 286535 - RNA, 22 nt, Human
ucagaggccuaugucuacaacu

SEQ ID NO: 286536 - RNA, 18 nt, Human
gcuuucugugcagcggag

SEQ ID NO: 286537 - RNA, 20 nt, Human
aguaggcaaaggaaagaucu

SEQ ID NO: 286538 - RNA, 22 nt, Human
uaggaggguuagagggaaauau

SEQ ID NO: 286539 - RNA, 22 nt, Human
ccacaugcucuuguuacagugu

SEQ ID NO: 286540 - RNA, 17 nt, Human
ggaaggucaaggggagg

SEQ ID NO: 286541 - RNA, 22 nt, Human
ucucaaggaaaagugauggcau

SEQ ID NO: 286542 - RNA, 22 nt, Human
cucuggaaaauugugugggggu

SEQ ID NO: 286543 - RNA, 22 nt, Human
aagugugauuuguagaaugccu

SEQ ID NO: 286544 - RNA, 22 nt, Human
ucagcuuuccuugcuuuagauu

SEQ ID NO: 286545 - RNA, 22 nt, Human
aaguuugcauagauuaagcauu

SEQ ID NO: 286546 - RNA, 22 nt, Human
caauucuuggagaagaagcaua

SEQ ID NO: 286547 - RNA, 22 nt, Human
ccuccugggcuccugucugcac

SEQ ID NO: 286548 - RNA, 22 nt, Human
cuccaggacugaggacagagcu

SEQ ID NO: 286549 - RNA, 22 nt, Human
agugugagcuaauagcagagcc

SEQ ID NO: 286550 - RNA, 22 nt, Human
ucucugggccuguuuucucauc

SEQ ID NO: 286551 - RNA, 22 nt, Human
uuuucuaacaucuaguaauuug

SEQ ID NO: 286552 - RNA, 22 nt, Human
cacaguuuugcccagggcuucu

SEQ ID NO: 286553 - RNA, 20 nt, Human
cuuuaguuauuaacagcacu

SEQ ID NO: 286554 - RNA, 22 nt, Human
uauuuuugccucucagauaaaa

SEQ ID NO: 286555 - RNA, 22 nt, Human
ugcaggugacaccacucuuccu

SEQ ID NO: 286556 - RNA, 22 nt, Human
ucagagaauuguuuaauggaau

SEQ ID NO: 286557 - RNA, 22 nt, Human
uuuagauaaugcucaagcaauu

SEQ ID NO: 286558 - RNA, 22 nt, Human
cagaagcuuugucuagucuuga

SEQ ID NO: 286559 - RNA, 22 nt, Human
aaaugccaaggagagacuguua

SEQ ID NO: 286560 - RNA, 22 nt, Human
aaacuacacuuugggaccagca

SEQ ID NO: 286561 - RNA, 22 nt, Human
ccugagcucaagaaggugacca

SEQ ID NO: 286562 - RNA, 22 nt, Human
agagucagaaagcagacagggg

SEQ ID NO: 286563 - RNA, 22 nt, Human
auuuacagccuugaaaacagca

SEQ ID NO: 286564 - RNA, 22 nt, Human
uucacauuugaaaggaaagaua

SEQ ID NO: 286565 - RNA, 22 nt, Human
uuaccaaaugaaauagagauuu

SEQ ID NO: 286566 - RNA, 22 nt, Human
uuuuugcuaauccccagccacu

SEQ ID NO: 286567 - RNA, 22 nt, Human
gucccagggcaaggcuguuucu

SEQ ID NO: 286568 - RNA, 22 nt, Human
uaaauuagggacuuuaguuaau

SEQ ID NO: 286569 - RNA, 22 nt, Human
acagaugguuauugucauuucu

SEQ ID NO: 286570 - RNA, 22 nt, Human
uacagugcgauuuuuaggccuc

SEQ ID NO: 286571 - RNA, 22 nt, Human
aguguucuagcgcugugcuugu

SEQ ID NO: 286572 - RNA, 22 nt, Human
cagauucucacuguauucaggu

SEQ ID NO: 286573 - RNA, 22 nt, Human
gcuccuggcucuggccaaggga

SEQ ID NO: 286574 - RNA, 18 nt, Human
ucuugccugcacccucuc

SEQ ID NO: 286575 - RNA, 22 nt, Human
auuuauaacgugcagccagggu

SEQ ID NO: 286576 - RNA, 20 nt, Human
uuccagagaucugcauuuua

SEQ ID NO: 286577 - RNA, 22 nt, Human
gucugcccucacaugcacucuu

SEQ ID NO: 286578 - RNA, 22 nt, Human
acacuuuacagaauguuuugau

SEQ ID NO: 286579 - RNA, 22 nt, Human
ccuguggccugaauuugguaaa

SEQ ID NO: 286580 - RNA, 22 nt, Human
gcagggcagagggagaaucucu

SEQ ID NO: 286581 - RNA, 22 nt, Human
uucacugccaacuaacauggaa

SEQ ID NO: 286582 - RNA, 17 nt, Human
ucagcaaagacaaagga

SEQ ID NO: 286583 - RNA, 22 nt, Human
gcauucuucgaaguaaguagug

SEQ ID NO: 286584 - RNA, 22 nt, Human
agaaagcuggagucaagcagag

SEQ ID NO: 286585 - RNA, 22 nt, Human
uggcuuggacuaaauggaccgu

SEQ ID NO: 286586 - RNA, 22 nt, Human
cccaggcagccugcagggaagg

SEQ ID NO: 286587 - RNA, 22 nt, Human
aggcuuggaaaauuuacagugu

SEQ ID NO: 286588 - RNA, 22 nt, Human
uuggaacauccaggacagauau

SEQ ID NO: 286589 - RNA, 22 nt, Human
aagcaauauacugauaugauua

SEQ ID NO: 286590 - RNA, 22 nt, Human
guuauaaauaccuaauaggauu

SEQ ID NO: 286591 - RNA, 22 nt, Human
gcucuucuaaagaauguacagg

SEQ ID NO: 286592 - RNA, 22 nt, Human
gcugucuuccuugcuccaaggg

SEQ ID NO: 286593 - RNA, 22 nt, Human
uguuuacuuaaauguuuucaua

SEQ ID NO: 286594 - RNA, 22 nt, Human
gggagcauuucccuguguugaa

SEQ ID NO: 286595 - RNA, 22 nt, Human
uccugaaauucugguugucacu

SEQ ID NO: 286596 - RNA, 22 nt, Human
accuugaacccagcuugcugca

SEQ ID NO: 286597 - RNA, 22 nt, Human
cagagucagagcuccauggagu

SEQ ID NO: 286598 - RNA, 17 nt, Human
ccaggugggaggugggg

SEQ ID NO: 286599 - RNA, 22 nt, Human
agauuugaaacuugcuucauaa

SEQ ID NO: 286600 - RNA, 22 nt, Human
agacugaaauagugcacaccaa

SEQ ID NO: 286601 - RNA, 18 nt, Human
agucuuuauuucuuucau

SEQ ID NO: 286602 - RNA, 22 nt, Human
aauguuaauguguuugcuuaug

SEQ ID NO: 286603 - RNA, 22 nt, Human
agggcuccaggggaccaucagu

SEQ ID NO: 286604 - RNA, 22 nt, Human
aacuccugaggaaauggucuca

SEQ ID NO: 286605 - RNA, 22 nt, Human
ggccucuguuuggagccaggau

SEQ ID NO: 286606 - RNA, 22 nt, Human
cuucugugcuaaaugcaaaacc

SEQ ID NO: 286607 - RNA, 22 nt, Human
uaugaacugugagugugauggg

SEQ ID NO: 286608 - RNA, 22 nt, Human
uuaaacugcagacucaguguuc

SEQ ID NO: 286609 - RNA, 18 nt, Human
cccacacagcaguagcuc

SEQ ID NO: 286610 - RNA, 22 nt, Human
gaggugucccugacccuuugca

SEQ ID NO: 286611 - RNA, 22 nt, Human
caguucucugugccucgcuggg

SEQ ID NO: 286612 - RNA, 17 nt, Human
cugccuggagucccauc

SEQ ID NO: 286613 - RNA, 22 nt, Human
uugguacaaaaguaacuguggu

SEQ ID NO: 286614 - RNA, 22 nt, Human
acauucuuggacuccacucuag

SEQ ID NO: 286615 - RNA, 23 nt, Human
ucccuggccgcaauggccgccuu

SEQ ID NO: 286616 - RNA, 22 nt, Human
cauuuuacgacauagggcaggc

SEQ ID NO: 286617 - RNA, 22 nt, Human
acuuggaaagaugcaacacagu

SEQ ID NO: 286618 - RNA, 20 nt, Human
uuguuucugcuauuuucuaa

SEQ ID NO: 286619 - RNA, 22 nt, Human
uccagaaaaaguaauuuauuug

SEQ ID NO: 286620 - RNA, 21 nt, Human
ucugggcugcugcugcccauc

SEQ ID NO: 286621 - RNA, 22 nt, Human
aucuuuuuacuaacacugcuua

SEQ ID NO: 286622 - RNA, 19 nt, Human
ggcaggugugcuuaugcuu

SEQ ID NO: 286623 - RNA, 22 nt, Human
agagugagggggcacugagacg

SEQ ID NO: 286624 - RNA, 22 nt, Human
ccaggccucccuuuuccagcca

SEQ ID NO: 286625 - RNA, 22 nt, Human
uuauacauguuuauaagguuga

SEQ ID NO: 286626 - RNA, 22 nt, Human
gcuugggaaacguaguuccuag

SEQ ID NO: 286627 - RNA, 23 nt, Human
ccuggcagcaaacgaggagguua

SEQ ID NO: 286628 - RNA, 22 nt, Human
uuuguuagagugugggaggcug

SEQ ID NO: 286629 - RNA, 22 nt, Human
uuggaaaaugaggcacagagag

SEQ ID NO: 286630 - RNA, 22 nt, Human
cucugggcaaagaugccucauc

SEQ ID NO: 286631 - RNA, 22 nt, Human
ugagucacacauuucuucauac

SEQ ID NO: 286632 - RNA, 22 nt, Human
gggagggaaggaggcgccgugu

SEQ ID NO: 286633 - RNA, 22 nt, Human
uuucaaauggagucgugaaaug

SEQ ID NO: 286634 - RNA, 22 nt, Human
cuguccagucuuuagcaagcug

SEQ ID NO: 286635 - RNA, 22 nt, Human
gguagggcaaaguagggcaccu

SEQ ID NO: 286636 - RNA, 22 nt, Human
agauaaaaugguucaaaggcua

SEQ ID NO: 286637 - RNA, 22 nt, Human
uaauacagaaguguauuaaaau

SEQ ID NO: 286638 - RNA, 22 nt, Human
gucuggcuuuauauuugcuauu

SEQ ID NO: 286639 - RNA, 22 nt, Human
auguguuuaccaggggaacaug

SEQ ID NO: 286640 - RNA, 22 nt, Human
uggccaggcagguagaacggcc

SEQ ID NO: 286641 - RNA, 22 nt, Human
uggcagguggcucuggcauucu

SEQ ID NO: 286642 - RNA, 22 nt, Human
gagaggcugaaaucacaggagc

SEQ ID NO: 286643 - RNA, 20 nt, Human
uucuucucuaguuaucuuca

SEQ ID NO: 286644 - RNA, 23 nt, Human
uuauugaggguguagauuggugu

SEQ ID NO: 286645 - RNA, 22 nt, Human
gccaggcagcagcgaggauggu

SEQ ID NO: 286646 - RNA, 22 nt, Human
gagcuguguaugcaucauucug

SEQ ID NO: 286647 - RNA, 19 nt, Human
uacaagcuuuuuuggcagg

SEQ ID NO: 286648 - RNA, 22 nt, Human
accuuuauaugaaagaugacau

SEQ ID NO: 286649 - RNA, 22 nt, Human
uguaauuuccugauguuagaac

SEQ ID NO: 286650 - RNA, 22 nt, Human
cuguucaguaaccuauaaaaca

SEQ ID NO: 286651 - RNA, 22 nt, Human
auuccagauggcuucaaguaag

SEQ ID NO: 286652 - RNA, 22 nt, Human
cccagugucaccaacaggacac

SEQ ID NO: 286653 - RNA, 22 nt, Human
aauaucaacaguguccuucuaa

SEQ ID NO: 286654 - RNA, 22 nt, Human
cccaggcagugugugcaugcgu

SEQ ID NO: 286655 - RNA, 22 nt, Human
ucuuggcaguggaauaccagga

SEQ ID NO: 286656 - RNA, 22 nt, Human
caagcuuguuucuccugggggu

SEQ ID NO: 286657 - RNA, 22 nt, Human
ccagagagaaauggauuugagu

SEQ ID NO: 286658 - RNA, 22 nt, Human
uuuguaaaggccugaauuucag

SEQ ID NO: 286659 - RNA, 22 nt, Human
aacagacagaaaaaugugaucu

SEQ ID NO: 286660 - RNA, 22 nt, Human
uucccucucacuuaaagcuugg

SEQ ID NO: 286661 - RNA, 22 nt, Human
auccuggcuuuaggucagaggc

SEQ ID NO: 286662 - RNA, 22 nt, Human
ggugggaggacuguuugaggca

SEQ ID NO: 286663 - RNA, 22 nt, Human
gaggagggagaauuaggcuuaa

SEQ ID NO: 286664 - RNA, 22 nt, Human
ucagacaggcuggacagcuugc

SEQ ID NO: 286665 - RNA, 22 nt, Human
gagggcucaacuacuacuaggc

SEQ ID NO: 286666 - RNA, 22 nt, Human
auuucuguaacuuaugaaaguu

SEQ ID NO: 286667 - RNA, 22 nt, Human
caauuuuauugguccaaauaca

SEQ ID NO: 286668 - RNA, 22 nt, Human
ugcauacacaugugcacauacg

SEQ ID NO: 286669 - RNA, 22 nt, Human
gauaauauuagaagauacaaau

SEQ ID NO: 286670 - RNA, 22 nt, Human
gcagguguucucagaggaggcu

SEQ ID NO: 286671 - RNA, 22 nt, Human
ugcaggcuggggaggcagacuu

SEQ ID NO: 286672 - RNA, 22 nt, Human
uuucaaggauguuauauaaaug

SEQ ID NO: 286673 - RNA, 22 nt, Human
ucuccacaccagaaggagcuga

SEQ ID NO: 286674 - RNA, 22 nt, Human
gcuggagguuucaccugaguuu

SEQ ID NO: 286675 - RNA, 22 nt, Human
aagccuucccuuuuugagcuca

SEQ ID NO: 286676 - RNA, 23 nt, Human
cuuuucauugccuuagcgcagag

SEQ ID NO: 286677 - RNA, 20 nt, Human
acaguuuauuuuacuugguu

SEQ ID NO: 286678 - RNA, 22 nt, Human
auuccucauuuguugagaacca

SEQ ID NO: 286679 - RNA, 22 nt, Human
ucccuccccacuucugagcuuu

SEQ ID NO: 286680 - RNA, 22 nt, Human
aggaaagcuuggcaaacuaaau

SEQ ID NO: 286681 - RNA, 22 nt, Human
aguccaagauuagggugacagc

SEQ ID NO: 286682 - RNA, 22 nt, Human
uugcuuuacaaaaauugauggu

SEQ ID NO: 286683 - RNA, 22 nt, Human
aagucuaaacacauauuuaaaa

SEQ ID NO: 286684 - RNA, 22 nt, Human
auucuucauguugaagcuguca

SEQ ID NO: 286685 - RNA, 22 nt, Human
agaguccaaaugugcaguuaug

SEQ ID NO: 286686 - RNA, 20 nt, Human
acugcuguagaccaucugca

SEQ ID NO: 286687 - RNA, 22 nt, Human
cagcuuuaccuuuaggaguaac

SEQ ID NO: 286688 - RNA, 22 nt, Human
gcuggcaggauaacuucuaagc

SEQ ID NO: 286689 - RNA, 22 nt, Human
aaaauucugucauuaaauugug

SEQ ID NO: 286690 - RNA, 22 nt, Human
gcuuccaccuacuaaaugccac

SEQ ID NO: 286691 - RNA, 22 nt, Human
ugggcagggagcuggaaccaca

SEQ ID NO: 286692 - RNA, 20 nt, Human
guauuacaggcuuagaacca

SEQ ID NO: 286693 - RNA, 22 nt, Human
ugacaagaagaccugguaauga

SEQ ID NO: 286694 - RNA, 22 nt, Human
cagugucaggaucaguauauuu

SEQ ID NO: 286695 - RNA, 22 nt, Human
acagucuugagcaucagccaga

SEQ ID NO: 286696 - RNA, 22 nt, Human
cagagaaagggugaauuccuuc

SEQ ID NO: 286697 - RNA, 22 nt, Human
ugguuaaguccagaaaggaagc

SEQ ID NO: 286698 - RNA, 22 nt, Human
uuccugguuugccuggaaucca

SEQ ID NO: 286699 - RNA, 22 nt, Human
auaguuugugaaacacagcagu

SEQ ID NO: 286700 - RNA, 22 nt, Human
cuuaaauuggaugaguuaaguu

SEQ ID NO: 286701 - RNA, 22 nt, Human
guaaaauagaauaacguggcua

SEQ ID NO: 286702 - RNA, 22 nt, Human
cugcugcccuagacccaguccu

SEQ ID NO: 286703 - RNA, 22 nt, Human
ugugugugacaaccuaguucag

SEQ ID NO: 286704 - RNA, 23 nt, Human
ucuaaugcaauuagaaauuaggg

SEQ ID NO: 286705 - RNA, 22 nt, Human
uucccacauucuuuacauucau

SEQ ID NO: 286706 - RNA, 22 nt, Human
acuagaaagcaaaagccauuuc

SEQ ID NO: 286707 - RNA, 22 nt, Human
aaggcauuuguuggauuucuca

SEQ ID NO: 286708 - RNA, 22 nt, Human
cauuucuaccaaaugugacugg

SEQ ID NO: 286709 - RNA, 22 nt, Human
agauacacagcccugccaucac

SEQ ID NO: 286710 - RNA, 22 nt, Human
uacaugcaugauacaaaguugc

SEQ ID NO: 286711 - RNA, 21 nt, Human
ucuggcaggaagacggauggg

SEQ ID NO: 286712 - RNA, 22 nt, Human
auugcugaaaguauuuuaugac

SEQ ID NO: 286713 - RNA, 22 nt, Human
aagauuuucucaacuguauuug

SEQ ID NO: 286714 - RNA, 22 nt, Human
caauuucugggccucacacaag

SEQ ID NO: 286715 - RNA, 22 nt, Human
cagaggcucagauggcccuggc

SEQ ID NO: 286716 - RNA, 20 nt, Human
cccaguguccagccuugcca

SEQ ID NO: 286717 - RNA, 22 nt, Human
cuccuccuaaaugauucuuccu

SEQ ID NO: 286718 - RNA, 22 nt, Human
ucauagcuaagcuccagagugc

SEQ ID NO: 286719 - RNA, 22 nt, Human
ggcuuuuguuucagcucugcua

SEQ ID NO: 286720 - RNA, 22 nt, Human
gcucagcacuuucuccaaccac

SEQ ID NO: 286721 - RNA, 19 nt, Human
uuagguauuauugcuuucc

SEQ ID NO: 286722 - RNA, 22 nt, Human
uuuuucaugagacuagaaguca

SEQ ID NO: 286723 - RNA, 22 nt, Human
agaagcuauaacaacaauuaua

SEQ ID NO: 286724 - RNA, 22 nt, Human
ccucuuggagucuaucauucug

SEQ ID NO: 286725 - RNA, 20 nt, Human
aggaggaaaaaaugacgagc

SEQ ID NO: 286726 - RNA, 22 nt, Human
accuguuuguuaagaaagcuuc

SEQ ID NO: 286727 - RNA, 22 nt, Human
gaggacaagcugugaguggggu

SEQ ID NO: 286728 - RNA, 19 nt, Human
aauuagggagucgguuaag

SEQ ID NO: 286729 - RNA, 22 nt, Human
uaauucagggccagaaucccca

SEQ ID NO: 286730 - RNA, 22 nt, Human
aguccggggucuggacaccugg

SEQ ID NO: 286731 - RNA, 22 nt, Human
uuccugugugacucaagugguu

SEQ ID NO: 286732 - RNA, 21 nt, Human
agggaaaaggcugagugaggg

SEQ ID NO: 286733 - RNA, 21 nt, Human
uccagaccucccucuccuagc

SEQ ID NO: 286734 - RNA, 22 nt, Human
aacaugaaguuuucuauaguga

SEQ ID NO: 286735 - RNA, 22 nt, Human
agagccagcauuugggcccugc

SEQ ID NO: 286736 - RNA, 20 nt, Human
uuacagugggaccuuccuga

SEQ ID NO: 286737 - RNA, 22 nt, Human
aaguauuucguucugaaaaagu

SEQ ID NO: 286738 - RNA, 22 nt, Human
ccauucuuucagugucucaugu

SEQ ID NO: 286739 - RNA, 22 nt, Human
uggcaaagugacuccuuggggc

SEQ ID NO: 286740 - RNA, 21 nt, Human
caugugucauuggagagcaau

SEQ ID NO: 286741 - RNA, 22 nt, Human
ugaagcuuuccuguggucagga

SEQ ID NO: 286742 - RNA, 22 nt, Human
uuuauuggauauuuacaagaua

SEQ ID NO: 286743 - RNA, 22 nt, Human
ugcaaacagaaaagcuacuuug

SEQ ID NO: 286744 - RNA, 22 nt, Human
ggucucugaacuuccacugcgc

SEQ ID NO: 286745 - RNA, 22 nt, Human
uccagacccaugacccugggga

SEQ ID NO: 286746 - RNA, 20 nt, Human
ggaaucaggguaauguacug

SEQ ID NO: 286747 - RNA, 22 nt, Human
gacaggcuucaugauggcagga

SEQ ID NO: 286748 - RNA, 22 nt, Human
gcugucuuggguagaaagaggu

SEQ ID NO: 286749 - RNA, 22 nt, Human
gacacugugcuagcugggcuua

SEQ ID NO: 286750 - RNA, 22 nt, Human
uuuauuguguugaaacugaauu

SEQ ID NO: 286751 - RNA, 21 nt, Human
auucaguuugacaucuagcag

SEQ ID NO: 286752 - RNA, 22 nt, Human
cucccagguuacaucugagccu

SEQ ID NO: 286753 - RNA, 22 nt, Human
uuccuggcaaagugagcaucac

SEQ ID NO: 286754 - RNA, 22 nt, Human
guguguccaaggccacaauagc

SEQ ID NO: 286755 - RNA, 22 nt, Human
uggcagguuggccuuugguuca

SEQ ID NO: 286756 - RNA, 22 nt, Human
ucugaaauaacugaugccagau

SEQ ID NO: 286757 - RNA, 22 nt, Human
uuccuggcugucaugcccuagu

SEQ ID NO: 286758 - RNA, 19 nt, Human
ggaagagaggaaaggugga

SEQ ID NO: 286759 - RNA, 22 nt, Human
aagagucauagagacauugauu

SEQ ID NO: 286760 - RNA, 22 nt, Human
guuauuagaagugaaggauugu

SEQ ID NO: 286761 - RNA, 22 nt, Human
cagcugaaagaaggaaguguca

SEQ ID NO: 286762 - RNA, 21 nt, Human
aagaaagauaauuaaggaccc

SEQ ID NO: 286763 - RNA, 22 nt, Human
ugggcaggugcuauuuuccaug

SEQ ID NO: 286764 - RNA, 22 nt, Human
ucaggcaguagaauugcuugaa

SEQ ID NO: 286765 - RNA, 22 nt, Human
agggaccaaucaccgacaggcu

SEQ ID NO: 286766 - RNA, 22 nt, Human
gggccaagggugcguggcagga

SEQ ID NO: 286767 - RNA, 22 nt, Human
gacuuuauccugccugaccacg

SEQ ID NO: 286768 - RNA, 22 nt, Human
ggcuuuauauuguuugagcaga

SEQ ID NO: 286769 - RNA, 22 nt, Human
agacagguagcaggacagauau

SEQ ID NO: 286770 - RNA, 22 nt, Human
cagacaggguccuguccgucac

SEQ ID NO: 286771 - RNA, 22 nt, Human
cauuaaaauaucucaugguguu

SEQ ID NO: 286772 - RNA, 22 nt, Human
aggggcagccucacaauccucu

SEQ ID NO: 286773 - RNA, 22 nt, Human
aaagcugcccuacacggaagca

SEQ ID NO: 286774 - RNA, 22 nt, Human
gguucucuuccuccugacugag

SEQ ID NO: 286775 - RNA, 22 nt, Human
caagauaagaucauuuacacua

SEQ ID NO: 286776 - RNA, 18 nt, Human
cugugggcuggugcauga

SEQ ID NO: 286777 - RNA, 22 nt, Human
uaugccagacugugagcuucuu

SEQ ID NO: 286778 - RNA, 22 nt, Human
gcaugcagucaaccaguaaggg

SEQ ID NO: 286779 - RNA, 22 nt, Human
uucuuagugguagucaucuuug

SEQ ID NO: 286780 - RNA, 22 nt, Human
ccagggcagcagaauuggggca

SEQ ID NO: 286781 - RNA, 22 nt, Human
cuaaaauuaccuaccaguuuag

SEQ ID NO: 286782 - RNA, 22 nt, Human
gaggagggagcuggaagcucuu

SEQ ID NO: 286783 - RNA, 22 nt, Human
aaauuuucucucuaagacuuaa

SEQ ID NO: 286784 - RNA, 22 nt, Human
cuauuuucugucucuauagagu

SEQ ID NO: 286785 - RNA, 22 nt, Human
gaacuguguacauuguagauaa

SEQ ID NO: 286786 - RNA, 22 nt, Human
uccuggcauccgugggucugug

SEQ ID NO: 286787 - RNA, 22 nt, Human
uuccuucuucauuguguuacag

SEQ ID NO: 286788 - RNA, 22 nt, Human
ggacuccucuagaaguugaggc

SEQ ID NO: 286789 - RNA, 22 nt, Human
uuucacaacugcuuauuugaga

SEQ ID NO: 286790 - RNA, 21 nt, Human
ucuuccuccacagcgugccac

SEQ ID NO: 286791 - RNA, 22 nt, Human
cuuaaucucaccugcaaagucc

SEQ ID NO: 286792 - RNA, 22 nt, Human
augcaaacaugaagagaaagag

SEQ ID NO: 286793 - RNA, 21 nt, Human
agcagguguaaaggaggaaau

SEQ ID NO: 286794 - RNA, 22 nt, Human
uauguacacacacaugcaugua

SEQ ID NO: 286795 - RNA, 22 nt, Human
cuauguuuaucuguauuucugu

SEQ ID NO: 286796 - RNA, 22 nt, Human
uaagccugcaugaaccaugaga

SEQ ID NO: 286797 - RNA, 22 nt, Human
aaguucuuagacaagcuugugg

SEQ ID NO: 286798 - RNA, 22 nt, Human
acuucaaacaauuaacagagaa

SEQ ID NO: 286799 - RNA, 22 nt, Human
gcugcuuuauaaucucggcaga

SEQ ID NO: 286800 - RNA, 21 nt, Human
augcacaaaaagacucuuucu

SEQ ID NO: 286801 - RNA, 22 nt, Human
ggauuucuuccuuccucagaag

SEQ ID NO: 286802 - RNA, 22 nt, Human
aagcccugccacccauucacug

SEQ ID NO: 286803 - RNA, 22 nt, Human
cuguccagaaagggggcaacaa

SEQ ID NO: 286804 - RNA, 22 nt, Human
ucagggaccccucugaguggag

SEQ ID NO: 286805 - RNA, 22 nt, Human
uggacaugucuucuccaagaaa

SEQ ID NO: 286806 - RNA, 22 nt, Human
agggcagcccuucugggagggc

SEQ ID NO: 286807 - RNA, 22 nt, Human
ugaggaaagaaaggcaugcaug

SEQ ID NO: 286808 - RNA, 23 nt, Human
uuuuauugauauguagcuguugu

SEQ ID NO: 286809 - RNA, 22 nt, Human
aagagaaggugaggaagccggu

SEQ ID NO: 286810 - RNA, 22 nt, Human
aggaggcugaacuagggucugg

SEQ ID NO: 286811 - RNA, 18 nt, Human
ucugaaagcaccggugaa

SEQ ID NO: 286812 - RNA, 22 nt, Human
acuucuucuucagcugggggau

SEQ ID NO: 286813 - RNA, 22 nt, Human
ccugccuucuaaagcgcccgcc

SEQ ID NO: 286814 - RNA, 22 nt, Human
cagcuauuggcaagaaguggug

SEQ ID NO: 286815 - RNA, 22 nt, Human
ugcagggcuuccucuuggaguu

SEQ ID NO: 286816 - RNA, 18 nt, Human
ugaggcagucagugaugg

SEQ ID NO: 286817 - RNA, 23 nt, Human
agcacagacuagaaaggucuuuc

SEQ ID NO: 286818 - RNA, 22 nt, Human
uucuuuugcaagacuauugauu

SEQ ID NO: 286819 - RNA, 22 nt, Human
aaaaucuugugacuuaggaagg

SEQ ID NO: 286820 - RNA, 22 nt, Human
uagacagauguuuucuggcugu

SEQ ID NO: 286821 - RNA, 22 nt, Human
acuggcaauagcaaaugcuugg

SEQ ID NO: 286822 - RNA, 22 nt, Human
ccaggucaagcuccccuguggu

SEQ ID NO: 286823 - RNA, 22 nt, Human
uccuggccacacauuaauagug

SEQ ID NO: 286824 - RNA, 22 nt, Human
aauuaguaaccuaauuccaucu

SEQ ID NO: 286825 - RNA, 22 nt, Human
ugguggcaauucaaagacagca

SEQ ID NO: 286826 - RNA, 17 nt, Human
uuucugcaugauuggac

SEQ ID NO: 286827 - RNA, 22 nt, Human
aggaagaaccuaagaaagucuc

SEQ ID NO: 286828 - RNA, 18 nt, Human
agcuccugaacucugugg

SEQ ID NO: 286829 - RNA, 22 nt, Human
aaguuuuccuguguccaagaug

SEQ ID NO: 286830 - RNA, 22 nt, Human
cuuuauauauucccaggcugcc

SEQ ID NO: 286831 - RNA, 22 nt, Human
caaaauaccacgacuuguuuua

SEQ ID NO: 286832 - RNA, 22 nt, Human
ccuggcagcuccguggccuucc

SEQ ID NO: 286833 - RNA, 22 nt, Human
cuguggcucauucuugguggca

SEQ ID NO: 286834 - RNA, 18 nt, Human
uucggcagauacgcuugg

SEQ ID NO: 286835 - RNA, 22 nt, Human
ugcaggugccucuugagcuugu

SEQ ID NO: 286836 - RNA, 22 nt, Human
uggagcugccuggcaccuacag

SEQ ID NO: 286837 - RNA, 22 nt, Human
uuucuuauacuauauugucauc

SEQ ID NO: 286838 - RNA, 22 nt, Human
agggccucugacgcccccagcc

SEQ ID NO: 286839 - RNA, 22 nt, Human
ggaguugauuuuggauauauua

SEQ ID NO: 286840 - RNA, 22 nt, Human
gacaggugcuaagggaccuggc

SEQ ID NO: 286841 - RNA, 19 nt, Human
caggaaugagguaauggcu

SEQ ID NO: 286842 - RNA, 22 nt, Human
uccaugagggacacuggaugcu

SEQ ID NO: 286843 - RNA, 22 nt, Human
auccugggcaagucaauguccc

SEQ ID NO: 286844 - RNA, 22 nt, Human
gaggaggggcacuugucuccua

SEQ ID NO: 286845 - RNA, 22 nt, Human
cauuuauucucagauccuuguc

SEQ ID NO: 286846 - RNA, 22 nt, Human
aauuagggagagguagcuaggu

SEQ ID NO: 286847 - RNA, 20 nt, Human
agggcagcuugaggagccgg

SEQ ID NO: 286848 - RNA, 22 nt, Human
aggcuuagacuaccuggucugu

SEQ ID NO: 286849 - RNA, 22 nt, Human
ucucuggguaaaguucucucau

SEQ ID NO: 286850 - RNA, 22 nt, Human
cuaguucuagaucccugaggaa

SEQ ID NO: 286851 - RNA, 22 nt, Human
uguccucuuccagugcuccuuc

SEQ ID NO: 286852 - RNA, 22 nt, Human
augaggagucaaggagucggag

SEQ ID NO: 286853 - RNA, 22 nt, Human
auccaggcugcuaugaggauga

SEQ ID NO: 286854 - RNA, 22 nt, Human
acuggcagaauugaauaguugu

SEQ ID NO: 286855 - RNA, 22 nt, Human
cccagaaggucgaggcugcagu

SEQ ID NO: 286856 - RNA, 22 nt, Human
agguggggccaaaugcuacagu

SEQ ID NO: 286857 - RNA, 22 nt, Human
cacugucuauuaauauaacuua

SEQ ID NO: 286858 - RNA, 22 nt, Human
ggacagacagugugagugaggc

SEQ ID NO: 286859 - RNA, 22 nt, Human
guacaaaugaaaauagaccacu

SEQ ID NO: 286860 - RNA, 22 nt, Human
acaaaugaacauauaagcuuga

SEQ ID NO: 286861 - RNA, 22 nt, Human
ugucugaugauagugucucucc

SEQ ID NO: 286862 - RNA, 23 nt, Human
ugcuggguaaauagcugaguaac

SEQ ID NO: 286863 - RNA, 22 nt, Human
aggcagcugaccacaguaugau

SEQ ID NO: 286864 - RNA, 22 nt, Human
aggaagccaagccugacacuca

SEQ ID NO: 286865 - RNA, 22 nt, Human
uucauugaaccacuuuauucuu

SEQ ID NO: 286866 - RNA, 22 nt, Human
agccagagacugugucuguaau

SEQ ID NO: 286867 - RNA, 22 nt, Human
ucaggaaagccuagaagagaac

SEQ ID NO: 286868 - RNA, 22 nt, Human
agacacagucugucuggaggag

SEQ ID NO: 286869 - RNA, 20 nt, Human
ucuucuguugccuuguucug

SEQ ID NO: 286870 - RNA, 22 nt, Human
augaaggauagggcaaaauuuu

SEQ ID NO: 286871 - RNA, 18 nt, Human
uggcagguagacucaggu

SEQ ID NO: 286872 - RNA, 22 nt, Human
gcagggauugucaaugcugcuc

SEQ ID NO: 286873 - RNA, 22 nt, Human
uucccucuuuuccaacaguugu

SEQ ID NO: 286874 - RNA, 22 nt, Human
ucucucuugucaccccaucugc

SEQ ID NO: 286875 - RNA, 22 nt, Human
ccaaggacuggacacacagguu

SEQ ID NO: 286876 - RNA, 22 nt, Human
ggaggccaggguggguggaucg

SEQ ID NO: 286877 - RNA, 21 nt, Human
ccugaaauucucacuagcuua

SEQ ID NO: 286878 - RNA, 22 nt, Human
aguguccuccucugggagccag

SEQ ID NO: 286879 - RNA, 22 nt, Human
cuuagcuuguuuucaccuaaga

SEQ ID NO: 286880 - RNA, 22 nt, Human
uccuggcacauugcaggggcuc

SEQ ID NO: 286881 - RNA, 22 nt, Human
uggaugcugcugucagggaugg

SEQ ID NO: 286882 - RNA, 22 nt, Human
gccuguuucccugacgcuuaca

SEQ ID NO: 286883 - RNA, 22 nt, Human
uccugcagucugcacucugccu

SEQ ID NO: 286884 - RNA, 22 nt, Human
ggcaauaguuguggguucuuua

SEQ ID NO: 286885 - RNA, 22 nt, Human
ccugugccauccugagcauccc

SEQ ID NO: 286886 - RNA, 23 nt, Human
ugcuggguaucagaaucacugag

SEQ ID NO: 286887 - RNA, 22 nt, Human
ucuguggcaaacacagugacca

SEQ ID NO: 286888 - RNA, 22 nt, Human
aaaccuuucugcucucagcgua

SEQ ID NO: 286889 - RNA, 22 nt, Human
uauuucagucacuucuucucug

SEQ ID NO: 286890 - RNA, 22 nt, Human
uccuggguuaauuaugauucac

SEQ ID NO: 286891 - RNA, 22 nt, Human
ugucauuuucuaaucuguuguc

SEQ ID NO: 286892 - RNA, 22 nt, Human
aucuuuauauaucuccucugaa

SEQ ID NO: 286893 - RNA, 22 nt, Human
uuccuccuacgcuuaucacuuu

SEQ ID NO: 286894 - RNA, 22 nt, Human
ugguacaagauguucuaacuga

SEQ ID NO: 286895 - RNA, 22 nt, Human
ucagcuuuuaaaaacaagaagu

SEQ ID NO: 286896 - RNA, 22 nt, Human
gcagggcaaugaucccgagagg

SEQ ID NO: 286897 - RNA, 22 nt, Human
aaagcagagaucauggcuugua

SEQ ID NO: 286898 - RNA, 22 nt, Human
uccuuagacaaagagugggcuu

SEQ ID NO: 286899 - RNA, 22 nt, Human
uccuggauggagcugcccucgc

SEQ ID NO: 286900 - RNA, 22 nt, Human
ucugccagaaguucugagagua

SEQ ID NO: 286901 - RNA, 22 nt, Human
agaggccugugugcuccagugg

SEQ ID NO: 286902 - RNA, 20 nt, Human
cucuggaagaguuuaaaugg

SEQ ID NO: 286903 - RNA, 22 nt, Human
ugcuuuaucaaagcuauaguga

SEQ ID NO: 286904 - RNA, 22 nt, Human
uuacauucagaaagauuugagu

SEQ ID NO: 286905 - RNA, 22 nt, Human
aaacauucacauuugcuaguaa

SEQ ID NO: 286906 - RNA, 22 nt, Human
uauuucugagaaccaacuuacc

SEQ ID NO: 286907 - RNA, 19 nt, Human
gagguucacgcgcuggaug

SEQ ID NO: 286908 - RNA, 22 nt, Human
uuuacuuugugucaagucaaga

SEQ ID NO: 286909 - RNA, 22 nt, Human
ggcagguggcacugcugcuccc

SEQ ID NO: 286910 - RNA, 22 nt, Human
uccugacccaccaagucuguaa

SEQ ID NO: 286911 - RNA, 22 nt, Human
uuucuuuaaaggaacucuguuu

SEQ ID NO: 286912 - RNA, 22 nt, Human
gcuggcaggagaaacggggugc

SEQ ID NO: 286913 - RNA, 22 nt, Human
ucugggugggcccgagaaaucu

SEQ ID NO: 286914 - RNA, 20 nt, Human
uuucaagucagcaauucuca

SEQ ID NO: 286915 - RNA, 21 nt, Human
agaaaaacacgauauaagccc

SEQ ID NO: 286916 - RNA, 22 nt, Human
ugacaagaaagcgucuucuuuu

SEQ ID NO: 286917 - RNA, 22 nt, Human
aggcugagcuggcccuugaaau

SEQ ID NO: 286918 - RNA, 22 nt, Human
aagcucuuuucaccauuaaagu

SEQ ID NO: 286919 - RNA, 22 nt, Human
uccaggcuagaagucacaggcc

SEQ ID NO: 286920 - RNA, 22 nt, Human
acauuaaaauggagaauuuuga

SEQ ID NO: 286921 - RNA, 22 nt, Human
cuuacauugugugcaugagggg

SEQ ID NO: 286922 - RNA, 22 nt, Human
aguuauaugugaaaacacguau

SEQ ID NO: 286923 - RNA, 22 nt, Human
aaguguguuuucaguguacuua

SEQ ID NO: 286924 - RNA, 22 nt, Human
agcucuuacauuuaggucuaug

SEQ ID NO: 286925 - RNA, 22 nt, Human
uggcucugugucucccagcagc

SEQ ID NO: 286926 - RNA, 22 nt, Human
aacauuuacaaauccuucugca

SEQ ID NO: 286927 - RNA, 22 nt, Human
agccucccuaugcaccuucagg

SEQ ID NO: 286928 - RNA, 22 nt, Human
uacacagugaguccucucugcc

SEQ ID NO: 286929 - RNA, 22 nt, Human
ucccuccuggccgucaccgcug

SEQ ID NO: 286930 - RNA, 22 nt, Human
agcugucuuucugccuccugau

SEQ ID NO: 286931 - RNA, 21 nt, Human
ucugggugcuaguguuugcuu

SEQ ID NO: 286932 - RNA, 22 nt, Human
uucuccaacacaagcaugaugu

SEQ ID NO: 286933 - RNA, 20 nt, Human
uuucaguugguuaauggcau

SEQ ID NO: 286934 - RNA, 22 nt, Human
ccaugaccccuggcauccaggg

SEQ ID NO: 286935 - RNA, 22 nt, Human
uuggaaaagugaaacuagaugc

SEQ ID NO: 286936 - RNA, 22 nt, Human
aaaguccugacugcaggggaug

SEQ ID NO: 286937 - RNA, 22 nt, Human
gaggugucccgcaguccccaag

SEQ ID NO: 286938 - RNA, 22 nt, Human
uucuggcuacccuccuaauguu

SEQ ID NO: 286939 - RNA, 22 nt, Human
acuccuggguucuaaauuugaa

SEQ ID NO: 286940 - RNA, 22 nt, Human
gccaccccaaccucccuaaguu

SEQ ID NO: 286941 - RNA, 22 nt, Human
ccaaggcuggagugcaguggcg

SEQ ID NO: 286942 - RNA, 22 nt, Human
uccacccugcuuucuuaucucc

SEQ ID NO: 286943 - RNA, 22 nt, Human
aguaaacauaauuuaccuguag

SEQ ID NO: 286944 - RNA, 22 nt, Human
gugaugucagcaagaauaggaa

SEQ ID NO: 286945 - RNA, 19 nt, Human
agagccagacagcauagga

SEQ ID NO: 286946 - RNA, 22 nt, Human
uuaaagcugagcccucagaagc

SEQ ID NO: 286947 - RNA, 22 nt, Human
agacccucuccaugcccacugc

SEQ ID NO: 286948 - RNA, 22 nt, Human
uguuccugaaugccuggcuggc

SEQ ID NO: 286949 - RNA, 22 nt, Human
uacucaguuuaugauuucaagu

SEQ ID NO: 286950 - RNA, 22 nt, Human
uucauucuuugaaucugaggua

SEQ ID NO: 286951 - RNA, 22 nt, Human
uacagauauuguacaguuauag

SEQ ID NO: 286952 - RNA, 22 nt, Human
ugacauguauaucuuacgcuau

SEQ ID NO: 286953 - RNA, 22 nt, Human
auucuacaugauagaagggaga

SEQ ID NO: 286954 - RNA, 22 nt, Human
cugaggaguuuggguuguucaa

SEQ ID NO: 286955 - RNA, 22 nt, Human
aaauaguuagcccugcauauau

SEQ ID NO: 286956 - RNA, 22 nt, Human
uuccagagguagcaaugacuug

SEQ ID NO: 286957 - RNA, 22 nt, Human
cacaguuuugucuugguuucca

SEQ ID NO: 286958 - RNA, 22 nt, Human
auacuacacuaugcauggaugu

SEQ ID NO: 286959 - RNA, 22 nt, Human
uugagggucuggaucugcugcu

SEQ ID NO: 286960 - RNA, 22 nt, Human
gcagggacaacugugcaccuga

SEQ ID NO: 286961 - RNA, 20 nt, Human
uguuucuuuuaaugagcggc

SEQ ID NO: 286962 - RNA, 22 nt, Human
uguauacaggauuacucauagc

SEQ ID NO: 286963 - RNA, 22 nt, Human
ucaguuaaucaauguggucuaa

SEQ ID NO: 286964 - RNA, 22 nt, Human
cccugaccaccagcuccauuug

SEQ ID NO: 286965 - RNA, 22 nt, Human
uguacuauuaagaggccuaaau

SEQ ID NO: 286966 - RNA, 22 nt, Human
caguccagagcccaccagagga

SEQ ID NO: 286967 - RNA, 22 nt, Human
uuccuacaauuagagccucuuu

SEQ ID NO: 286968 - RNA, 22 nt, Human
agaugguugucgcaaaugaaug

SEQ ID NO: 286969 - RNA, 22 nt, Human
auuaaauuaaguggcuaauuua

SEQ ID NO: 286970 - RNA, 22 nt, Human
gaguccagugauguuccugguc

SEQ ID NO: 286971 - RNA, 21 nt, Human
gaaaagcaagggaguagaaca

SEQ ID NO: 286972 - RNA, 18 nt, Human
ucucugaauauuuuaugu

SEQ ID NO: 286973 - RNA, 23 nt, Human
uaauucacauauacauugcuuca

SEQ ID NO: 286974 - RNA, 22 nt, Human
uguccuggagugcuugggggaa

SEQ ID NO: 286975 - RNA, 22 nt, Human
aaaugaucauguaauuucagaa

SEQ ID NO: 286976 - RNA, 22 nt, Human
ucacaugaguauuauuuuccaa

SEQ ID NO: 286977 - RNA, 22 nt, Human
caguggcuucucaugucauuca

SEQ ID NO: 286978 - RNA, 22 nt, Human
cuguacuaauugcuuuacaugu

SEQ ID NO: 286979 - RNA, 22 nt, Human
guuuacaguacucacuugcauu

SEQ ID NO: 286980 - RNA, 22 nt, Human
gucuggcucccacucuuacaaa

SEQ ID NO: 286981 - RNA, 22 nt, Human
ggucuggauuuuaucuacugua

SEQ ID NO: 286982 - RNA, 22 nt, Human
auuuacugagcagcuaccaugu

SEQ ID NO: 286983 - RNA, 22 nt, Human
guuaauuuaguagaguccagau

SEQ ID NO: 286984 - RNA, 22 nt, Human
gguguccuuagaaagcagaccu

SEQ ID NO: 286985 - RNA, 22 nt, Human
gcuguucagaugcgauucagga

SEQ ID NO: 286986 - RNA, 22 nt, Human
cagucucucagcuuucagcugu

SEQ ID NO: 286987 - RNA, 22 nt, Human
ggcaggcaguguggugugaaac

SEQ ID NO: 286988 - RNA, 22 nt, Human
uaaguuuuaagcaaucugauaa

SEQ ID NO: 286989 - RNA, 22 nt, Human
gguguccuuguugaacgaaaau

SEQ ID NO: 286990 - RNA, 22 nt, Human
aucuuucuccauauacaucuuu

SEQ ID NO: 286991 - RNA, 22 nt, Human
uaaauucacuccugguagaccu

SEQ ID NO: 286992 - RNA, 22 nt, Human
gcaggugucuucagcaggauga

SEQ ID NO: 286993 - RNA, 18 nt, Human
agggccagcugugaguag

SEQ ID NO: 286994 - RNA, 22 nt, Human
ccugggcuguugcaucauccuu

SEQ ID NO: 286995 - RNA, 22 nt, Human
aaacugugaagcaaguacaagg

SEQ ID NO: 286996 - RNA, 22 nt, Human
ucagcucuacacacaccugugu

SEQ ID NO: 286997 - RNA, 22 nt, Human
uuugauuuacuggauauucuca

SEQ ID NO: 286998 - RNA, 22 nt, Human
cgccccagccaguugagcggcg

SEQ ID NO: 286999 - RNA, 22 nt, Human
auuguauaacagcauguauuuu

SEQ ID NO: 287000 - RNA, 22 nt, Human
aacuagaaagaacauauuucca

SEQ ID NO: 287001 - RNA, 22 nt, Human
uacuaguucucauaugaaauaa

SEQ ID NO: 287002 - RNA, 22 nt, Human
uggucuggggaccgaggguuac

SEQ ID NO: 287003 - RNA, 20 nt, Human
ggaaggggcaaaguguguga

SEQ ID NO: 287004 - RNA, 22 nt, Human
ucuggcccuauggcauguaccu

SEQ ID NO: 287005 - RNA, 22 nt, Human
aauauuuguuaguguuuuaaug

SEQ ID NO: 287006 - RNA, 22 nt, Human
ggcagacuuuuucucugaaggg

SEQ ID NO: 287007 - RNA, 20 nt, Human
acuuuacugagcuguaauuc

SEQ ID NO: 287008 - RNA, 22 nt, Human
agccuucaaccuagcuagagca

SEQ ID NO: 287009 - RNA, 22 nt, Human
uccaagcucucuaugccaugau

SEQ ID NO: 287010 - RNA, 22 nt, Human
aagggggcggcagccaguggaa

SEQ ID NO: 287011 - RNA, 22 nt, Human
uuuacagucucuauagucaaaa

SEQ ID NO: 287012 - RNA, 22 nt, Human
uuagcaaauaucuugaaacagg

SEQ ID NO: 287013 - RNA, 22 nt, Human
uucuucuuuccuauaauuaauu

SEQ ID NO: 287014 - RNA, 22 nt, Human
uuucuugagcccaggaggugga

SEQ ID NO: 287015 - RNA, 22 nt, Human
acauggcucagucucaugacag

SEQ ID NO: 287016 - RNA, 22 nt, Human
cuggcaguuggcauuggcaucu

SEQ ID NO: 287017 - RNA, 22 nt, Human
ccagacccugcucuggggcucu

SEQ ID NO: 287018 - RNA, 22 nt, Human
gcuuuuggaccucugauguuuc

SEQ ID NO: 287019 - RNA, 22 nt, Human
ugaugagggagauuugagccca

SEQ ID NO: 287020 - RNA, 22 nt, Human
uuuaucuguuguaccugcauug

SEQ ID NO: 287021 - RNA, 22 nt, Human
auugcuggcagcuggaucugca

SEQ ID NO: 287022 - RNA, 22 nt, Human
ugcuauuuuuaucuugaucaaa

SEQ ID NO: 287023 - RNA, 22 nt, Human
aauuucagaacccaaauuagcg

SEQ ID NO: 287024 - RNA, 22 nt, Human
uuccuggcucucuguugcacag

SEQ ID NO: 287025 - RNA, 17 nt, Human
aaguccagaguugagca

SEQ ID NO: 287026 - RNA, 22 nt, Human
uaaggaggugcccacucucagg

SEQ ID NO: 287027 - RNA, 22 nt, Human
gugcagggcuggcaccggaggc

SEQ ID NO: 287028 - RNA, 22 nt, Human
aguccucugcugugcgucuuug

SEQ ID NO: 287029 - RNA, 22 nt, Human
uuauuugugaaucauuuaucua

SEQ ID NO: 287030 - RNA, 22 nt, Human
gaggccuggagccgccuaggcg

SEQ ID NO: 287031 - RNA, 22 nt, Human
ccugugugucugucacugcaca

SEQ ID NO: 287032 - RNA, 22 nt, Human
ucccugaaacauaauagaugcc

SEQ ID NO: 287033 - RNA, 22 nt, Human
ccacccugagccgcaagagcag

SEQ ID NO: 287034 - RNA, 22 nt, Human
caaggccuucgucuccuagcuu

SEQ ID NO: 287035 - RNA, 22 nt, Human
uuguacaaauaggaaccucuga

SEQ ID NO: 287036 - RNA, 22 nt, Human
uaguauaauuguucuggaauca

SEQ ID NO: 287037 - RNA, 22 nt, Human
ucugucaauauaugugcugcag

SEQ ID NO: 287038 - RNA, 20 nt, Human
ccagagcagccacugaaguu

SEQ ID NO: 287039 - RNA, 22 nt, Human
gcagguggcagaggugggaucu

SEQ ID NO: 287040 - RNA, 19 nt, Human
acuggcaguuucugcaugg

SEQ ID NO: 287041 - RNA, 22 nt, Human
gauggucuuugucucugauaag

SEQ ID NO: 287042 - RNA, 19 nt, Human
gaagcccugcauucuccgc

SEQ ID NO: 287043 - RNA, 22 nt, Human
agagucugaaugcucagaguug

SEQ ID NO: 287044 - RNA, 22 nt, Human
auucuuauuuaaauagagucug

SEQ ID NO: 287045 - RNA, 22 nt, Human
auaaaaguucaagagaguacag

SEQ ID NO: 287046 - RNA, 22 nt, Human
acaggugguagaguggaaagag

SEQ ID NO: 287047 - RNA, 22 nt, Human
ggcuuuauuugcagccauuguu

SEQ ID NO: 287048 - RNA, 20 nt, Human
cuguggugagcaggagagua

SEQ ID NO: 287049 - RNA, 20 nt, Human
caggcacacucauuccugcu

SEQ ID NO: 287050 - RNA, 20 nt, Human
uuugcgaggccaaggcgggc

SEQ ID NO: 287051 - RNA, 22 nt, Human
auccacagucuuagccaucaaa

SEQ ID NO: 287052 - RNA, 22 nt, Human
ugugauucucagaagagggaag

SEQ ID NO: 287053 - RNA, 22 nt, Human
acaauucucucauaucuuauua

SEQ ID NO: 287054 - RNA, 22 nt, Human
auguucuuccaaaucuguaaca

SEQ ID NO: 287055 - RNA, 22 nt, Human
uguuugaguucuagcgcauuua

SEQ ID NO: 287056 - RNA, 22 nt, Human
aauaucaguauauuguaucagu

SEQ ID NO: 287057 - RNA, 22 nt, Human
uugcugauuuccccuugagugu

SEQ ID NO: 287058 - RNA, 22 nt, Human
uaaugucagcauaguuuauuuu

SEQ ID NO: 287059 - RNA, 22 nt, Human
uaaauguuuagucuuauuuggg

SEQ ID NO: 287060 - RNA, 17 nt, Human
cagagucugucugcauc

SEQ ID NO: 287061 - RNA, 22 nt, Human
ucagggcauacucuucaagguc

SEQ ID NO: 287062 - RNA, 22 nt, Human
auaaucuggucuuuguaugagu

SEQ ID NO: 287063 - RNA, 22 nt, Human
uuggaggaugucggcauauuua

SEQ ID NO: 287064 - RNA, 22 nt, Human
gaggcugcuuuccuccuauccu

SEQ ID NO: 287065 - RNA, 22 nt, Human
gccagccauaggccagcacugg

SEQ ID NO: 287066 - RNA, 22 nt, Human
uucacacuguuuuucauagugg

SEQ ID NO: 287067 - RNA, 22 nt, Human
cuguguccuccccaucacuucu

SEQ ID NO: 287068 - RNA, 22 nt, Human
gcuggagggguaauaggauggg

SEQ ID NO: 287069 - RNA, 22 nt, Human
uauuuccaggccccacucuaga

SEQ ID NO: 287070 - RNA, 22 nt, Human
uagggcagauucgguggaguuu

SEQ ID NO: 287071 - RNA, 22 nt, Human
aagaacaacugcuuuaaaagca

SEQ ID NO: 287072 - RNA, 22 nt, Human
aacuagaaccacuuguauuucc

SEQ ID NO: 287073 - RNA, 21 nt, Human
cugcagagcaugcaaaauguu

SEQ ID NO: 287074 - RNA, 22 nt, Human
guggaauguccuugaucauaag

SEQ ID NO: 287075 - RNA, 22 nt, Human
gugagacacgugugugaccugg

SEQ ID NO: 287076 - RNA, 22 nt, Human
cuuuccaagaaugcagauaccu

SEQ ID NO: 287077 - RNA, 22 nt, Human
cuggcagcuuagcacucugguu

SEQ ID NO: 287078 - RNA, 22 nt, Human
uucagggcagagaguucaggga

SEQ ID NO: 287079 - RNA, 17 nt, Human
ucugugauaguguagau

SEQ ID NO: 287080 - RNA, 22 nt, Human
uggaaagaggaagugcccagca

SEQ ID NO: 287081 - RNA, 22 nt, Human
agagggcuuugauucucaguuc

SEQ ID NO: 287082 - RNA, 22 nt, Human
uuuucaguuccaucucugcucu

SEQ ID NO: 287083 - RNA, 22 nt, Human
ccaggugugagcauucugucuu

SEQ ID NO: 287084 - RNA, 22 nt, Human
gcaaggagccuggaggugagug

SEQ ID NO: 287085 - RNA, 22 nt, Human
agccuggaauuaaggaaaugca

SEQ ID NO: 287086 - RNA, 22 nt, Human
ucucagaguaauucuuuaaggu

SEQ ID NO: 287087 - RNA, 22 nt, Human
auagauuauuugcucauuacuu

SEQ ID NO: 287088 - RNA, 22 nt, Human
caggcacacauccgugagagau

SEQ ID NO: 287089 - RNA, 22 nt, Human
gaauguuauguauccagucaca

SEQ ID NO: 287090 - RNA, 22 nt, Human
auguuacagaaagcaaagauga

SEQ ID NO: 287091 - RNA, 22 nt, Human
ucuggcaggcaaucggcucugg

SEQ ID NO: 287092 - RNA, 17 nt, Human
cagugcagauaagugag

SEQ ID NO: 287093 - RNA, 22 nt, Human
aagaaauguagagccuaguaaa

SEQ ID NO: 287094 - RNA, 18 nt, Human
caaauucagugcuggaag

SEQ ID NO: 287095 - RNA, 22 nt, Human
uuccuucuuccaaacccaucau

SEQ ID NO: 287096 - RNA, 22 nt, Human
caguuaaaagguaugcuaccaa

SEQ ID NO: 287097 - RNA, 22 nt, Human
auuguaacauguucagaucacu

SEQ ID NO: 287098 - RNA, 22 nt, Human
cagcuucugcuaucgaacaucu

SEQ ID NO: 287099 - RNA, 22 nt, Human
gagcugguucuguccagggaau

SEQ ID NO: 287100 - RNA, 18 nt, Human
uggcagguccagcugugg

SEQ ID NO: 287101 - RNA, 22 nt, Human
cagaugaacuaggcugcacuug

SEQ ID NO: 287102 - RNA, 22 nt, Human
gagaggaguagacacuuugguu

SEQ ID NO: 287103 - RNA, 22 nt, Human
auuucacagcugcuguucaggu

SEQ ID NO: 287104 - RNA, 22 nt, Human
uagaaacaaagaccugggugcu

SEQ ID NO: 287105 - RNA, 22 nt, Human
ugagaaaauccagaggcuaguu

SEQ ID NO: 287106 - RNA, 22 nt, Human
agcucagagauaaucaagagac

SEQ ID NO: 287107 - RNA, 22 nt, Human
gauuguaauucuacuuuccgcu

SEQ ID NO: 287108 - RNA, 22 nt, Human
uagaaacagaauaugagugaga

SEQ ID NO: 287109 - RNA, 22 nt, Human
augaaacacacacgcgcauacu

SEQ ID NO: 287110 - RNA, 22 nt, Human
ggaggaaauccuuaguaaggca

SEQ ID NO: 287111 - RNA, 22 nt, Human
caugccauuuuucuagauugag

SEQ ID NO: 287112 - RNA, 22 nt, Human
ugggaagauggagugacaggca

SEQ ID NO: 287113 - RNA, 22 nt, Human
cuguggcucuccaauggaggga

SEQ ID NO: 287114 - RNA, 22 nt, Human
gugcaaaaguaauugugguuuu

SEQ ID NO: 287115 - RNA, 22 nt, Human
ccccaugaaguagggucucuga

SEQ ID NO: 287116 - RNA, 22 nt, Human
uccaggaacgagaggcugggca

SEQ ID NO: 287117 - RNA, 22 nt, Human
caggcaccccaggugagcacug

SEQ ID NO: 287118 - RNA, 22 nt, Human
gcaaagcagaacccucucuauc

SEQ ID NO: 287119 - RNA, 20 nt, Human
guuaaaagaguaauuugagg

SEQ ID NO: 287120 - RNA, 22 nt, Human
gcaggagcugcucuccugacga

SEQ ID NO: 287121 - RNA, 22 nt, Human
cuggcacgcccacguaggcacu

SEQ ID NO: 287122 - RNA, 22 nt, Human
uaaaaugaucucucauguucuu

SEQ ID NO: 287123 - RNA, 22 nt, Human
aacuagaaaaagacuuucugag

SEQ ID NO: 287124 - RNA, 22 nt, Human
uuucuagucuucccuaccuccc

SEQ ID NO: 287125 - RNA, 22 nt, Human
uuauuucauguaaaauuuaugu

SEQ ID NO: 287126 - RNA, 22 nt, Human
ugaaucauggauaaauagcuua

SEQ ID NO: 287127 - RNA, 22 nt, Human
uuuccuaggagauugaucacau

SEQ ID NO: 287128 - RNA, 22 nt, Human
cucuggaaauggccauagucau

SEQ ID NO: 287129 - RNA, 22 nt, Human
acauggcuggcaccuuaaauuu

SEQ ID NO: 287130 - RNA, 22 nt, Human
cccugccucugaagcugcucag

SEQ ID NO: 287131 - RNA, 22 nt, Human
cuguguccaauggccuuagcag

SEQ ID NO: 287132 - RNA, 22 nt, Human
cuggcccauggugagcucuggg

SEQ ID NO: 287133 - RNA, 22 nt, Human
gagcuucagcugccaugacugu

SEQ ID NO: 287134 - RNA, 22 nt, Human
ggugcaaacguaauugugguuu

SEQ ID NO: 287135 - RNA, 21 nt, Human
ugucacagauucucagcuugc

SEQ ID NO: 287136 - RNA, 22 nt, Human
gcuguggcugacauugcagaca

SEQ ID NO: 287137 - RNA, 22 nt, Human
cccaggcaggagugugguggcu

SEQ ID NO: 287138 - RNA, 22 nt, Human
acugccugccuuccagguacug

SEQ ID NO: 287139 - RNA, 22 nt, Human
uugaaucuggguacuuguaaua

SEQ ID NO: 287140 - RNA, 22 nt, Human
ccaaguacucucaccaaagcuu

SEQ ID NO: 287141 - RNA, 22 nt, Human
agacaucaaugaucagagguag

SEQ ID NO: 287142 - RNA, 23 nt, Human
ccuguggcaaguagaugagauga

SEQ ID NO: 287143 - RNA, 22 nt, Human
guguuugugagcuaggugacau

SEQ ID NO: 287144 - RNA, 22 nt, Human
uuugcagcaaggagagagcauu

SEQ ID NO: 287145 - RNA, 22 nt, Human
cagguggguguaugaaugcaaa

SEQ ID NO: 287146 - RNA, 20 nt, Human
ggcaggcaggagguuuccag

SEQ ID NO: 287147 - RNA, 20 nt, Human
ggcaggugcuguccccuccu

SEQ ID NO: 287148 - RNA, 22 nt, Human
agugucugcgggcagaggagcg

SEQ ID NO: 287149 - RNA, 22 nt, Human
gggcagggguagcauuccaagu

SEQ ID NO: 287150 - RNA, 22 nt, Human
agccuucaguaagggcuuagca

SEQ ID NO: 287151 - RNA, 22 nt, Human
acuaaagaagccaaaguuuucu

SEQ ID NO: 287152 - RNA, 22 nt, Human
acauucuuucucuucaggaaac

SEQ ID NO: 287153 - RNA, 17 nt, Human
uguuuucauucauugcu

SEQ ID NO: 287154 - RNA, 22 nt, Human
uguguaaagcuuguuccagaaa

SEQ ID NO: 287155 - RNA, 22 nt, Human
ucuggcaggacaugcugaccau

SEQ ID NO: 287156 - RNA, 22 nt, Human
uauuuauucuuuguacugccuu

SEQ ID NO: 287157 - RNA, 23 nt, Human
aggaaguuaaggcagacagacag

SEQ ID NO: 287158 - RNA, 22 nt, Human
uucuaagaggcuaaugaagaau

SEQ ID NO: 287159 - RNA, 22 nt, Human
uuugacuccacuccuaacuccu

SEQ ID NO: 287160 - RNA, 22 nt, Human
ugcuuaaacauacuauuuauau

SEQ ID NO: 287161 - RNA, 22 nt, Human
aaaaaugcuuggacuuaauaaa

SEQ ID NO: 287162 - RNA, 22 nt, Human
guuuuggagucaggcuuagaug

SEQ ID NO: 287163 - RNA, 22 nt, Human
ccauggcuucuuucucugccag

SEQ ID NO: 287164 - RNA, 17 nt, Human
cugagccccgggcagcu

SEQ ID NO: 287165 - RNA, 22 nt, Human
cagcuuguuaccgagggagggu

SEQ ID NO: 287166 - RNA, 19 nt, Human
ccuugccugucccugcagc

SEQ ID NO: 287167 - RNA, 22 nt, Human
ccugccagcgcuuaucucucgg

SEQ ID NO: 287168 - RNA, 22 nt, Human
uuccuucuuuuacaccauaaau

SEQ ID NO: 287169 - RNA, 20 nt, Human
aucaaaauccuauugagguu

SEQ ID NO: 287170 - RNA, 22 nt, Human
caaggcauacuccuuucucagc

SEQ ID NO: 287171 - RNA, 22 nt, Human
guuacagucaggagauauuuug

SEQ ID NO: 287172 - RNA, 22 nt, Human
guauacacugguaagauuuguc

SEQ ID NO: 287173 - RNA, 22 nt, Human
ccagagagaaaauggagggcca

SEQ ID NO: 287174 - RNA, 22 nt, Human
auacacauaucagguguauaca

SEQ ID NO: 287175 - RNA, 22 nt, Human
gauuuuauauggcauacugugg

SEQ ID NO: 287176 - RNA, 22 nt, Human
acagguguagaaaacagauuau

SEQ ID NO: 287177 - RNA, 22 nt, Human
auguguccuuauaagaagaaga

SEQ ID NO: 287178 - RNA, 22 nt, Human
cuggaggagaacuugaggaagg

SEQ ID NO: 287179 - RNA, 22 nt, Human
uacuuuauuguaaaugcugaug

SEQ ID NO: 287180 - RNA, 21 nt, Human
ucuuccugcuccacacucccc

SEQ ID NO: 287181 - RNA, 22 nt, Human
ucagggcaaagggcagaguuug

SEQ ID NO: 287182 - RNA, 22 nt, Human
uguccuuuguguaucuauagua

SEQ ID NO: 287183 - RNA, 22 nt, Human
ucagggcugccgggcagaccgu

SEQ ID NO: 287184 - RNA, 22 nt, Human
uccuggcaguucagcccccuaa

SEQ ID NO: 287185 - RNA, 22 nt, Human
cugucaaagacuaagguucuua

SEQ ID NO: 287186 - RNA, 22 nt, Human
uggcauguauacuugaguagga

SEQ ID NO: 287187 - RNA, 22 nt, Human
acagugucucacugcugaaauc

SEQ ID NO: 287188 - RNA, 22 nt, Human
uuuagggaugucagaacaggga

SEQ ID NO: 287189 - RNA, 22 nt, Human
gacuuuauucguuaacuguuaa

SEQ ID NO: 287190 - RNA, 22 nt, Human
acacaggaacucugagaggugg

SEQ ID NO: 287191 - RNA, 22 nt, Human
cagcacuugagcuuucauguaa

SEQ ID NO: 287192 - RNA, 22 nt, Human
cuucaagauauuucuagaauca

SEQ ID NO: 287193 - RNA, 22 nt, Human
ucugaaauaagggagaagggaa

SEQ ID NO: 287194 - RNA, 22 nt, Human
ucugaaauaggagccauguaga

SEQ ID NO: 287195 - RNA, 22 nt, Human
aacauuguuuugcacaacucuu

SEQ ID NO: 287196 - RNA, 22 nt, Human
acagcaggcacacaaggauaga

SEQ ID NO: 287197 - RNA, 22 nt, Human
cuggugcaggaaggagcuggca

SEQ ID NO: 287198 - RNA, 22 nt, Human
agguggaaauggcuuuccuagg

SEQ ID NO: 287199 - RNA, 22 nt, Human
caggcauggugagaacucagcc

SEQ ID NO: 287200 - RNA, 22 nt, Human
uccagagggcgauggcuggggg

SEQ ID NO: 287201 - RNA, 22 nt, Human
aagccuucaguccguugcagag

SEQ ID NO: 287202 - RNA, 21 nt, Human
uacuacagucucuuuaucagu

SEQ ID NO: 287203 - RNA, 22 nt, Human
cagcuuuuaggacugugagaaa

SEQ ID NO: 287204 - RNA, 19 nt, Human
cacagggagaccacauguc

SEQ ID NO: 287205 - RNA, 22 nt, Human
cacauucagguggcauguuaga

SEQ ID NO: 287206 - RNA, 22 nt, Human
uuccaggacuggguguuugaag

SEQ ID NO: 287207 - RNA, 22 nt, Human
auccacagagaggaagaauagu

SEQ ID NO: 287208 - RNA, 21 nt, Human
uacagaaugcgcuucagucug

SEQ ID NO: 287209 - RNA, 22 nt, Human
aucuuuauuuauugagcacuua

SEQ ID NO: 287210 - RNA, 18 nt, Human
uuucuuucugccuggggc

SEQ ID NO: 287211 - RNA, 22 nt, Human
uuugcauugcauuaaguauucu

SEQ ID NO: 287212 - RNA, 22 nt, Human
ucuuggaauaccccgaagguca

SEQ ID NO: 287213 - RNA, 22 nt, Human
auguuauaguuauaaaaugagg

SEQ ID NO: 287214 - RNA, 22 nt, Human
cagcugaagguaggaaccagga

SEQ ID NO: 287215 - RNA, 22 nt, Human
aauuucagaugucauaaauaua

SEQ ID NO: 287216 - RNA, 23 nt, Human
ccaucaggccuccguguccagcc

SEQ ID NO: 287217 - RNA, 22 nt, Human
ugcaggugccaucgcugcucau

SEQ ID NO: 287218 - RNA, 22 nt, Human
aaugauuuccccuacacagaag

SEQ ID NO: 287219 - RNA, 22 nt, Human
uugagaagguggucauuugcaa

SEQ ID NO: 287220 - RNA, 22 nt, Human
cuguaacuuaaugagaggcaga

SEQ ID NO: 287221 - RNA, 22 nt, Human
agggcgacaauggagagcguuu

SEQ ID NO: 287222 - RNA, 22 nt, Human
aagccagauagaagaacucauu

SEQ ID NO: 287223 - RNA, 19 nt, Human
ucuggcagguaauuaggga

SEQ ID NO: 287224 - RNA, 22 nt, Human
cccaggcagggacgugcucugg

SEQ ID NO: 287225 - RNA, 22 nt, Human
ccuccccaugacccggugcugg

SEQ ID NO: 287226 - RNA, 22 nt, Human
caggcuugggagcagagccacu

SEQ ID NO: 287227 - RNA, 22 nt, Human
aguuaacucauuuuauaaugcc

SEQ ID NO: 287228 - RNA, 22 nt, Human
aucucagucagguugaauuugg

SEQ ID NO: 287229 - RNA, 22 nt, Human
uuuccuuccuaaggugaagcaa

SEQ ID NO: 287230 - RNA, 22 nt, Human
ucccuggcacaagaaggcuguc

SEQ ID NO: 287231 - RNA, 22 nt, Human
uccugaccacacugccuucugc

SEQ ID NO: 287232 - RNA, 22 nt, Human
uucuccuuuguaauucucaucc

SEQ ID NO: 287233 - RNA, 22 nt, Human
gaggaaaauaacaacuaagggc

SEQ ID NO: 287234 - RNA, 22 nt, Human
ucaaaaauaagauauucuggac

SEQ ID NO: 287235 - RNA, 22 nt, Human
uagguucagugucuuguucugc

SEQ ID NO: 287236 - RNA, 22 nt, Human
uguuugcuaggguugguauuua

SEQ ID NO: 287237 - RNA, 22 nt, Human
ccuuuucuauguaccagcagug

SEQ ID NO: 287238 - RNA, 22 nt, Human
guucuucacauuucauugagga

SEQ ID NO: 287239 - RNA, 22 nt, Human
gcucucuugguggcuguccugg

SEQ ID NO: 287240 - RNA, 22 nt, Human
agaagaggggugucccuguggc

SEQ ID NO: 287241 - RNA, 22 nt, Human
uugguggaccucaucagaaccg

SEQ ID NO: 287242 - RNA, 22 nt, Human
uuucauaauagugcaguuuguu

SEQ ID NO: 287243 - RNA, 22 nt, Human
uucacauuagccaagagaugga

SEQ ID NO: 287244 - RNA, 22 nt, Human
gccugcagauauauaggauggu

SEQ ID NO: 287245 - RNA, 22 nt, Human
uuucaguguaucuuccaaaagc

SEQ ID NO: 287246 - RNA, 22 nt, Human
gcacagagucacuagcuaagca

SEQ ID NO: 287247 - RNA, 22 nt, Human
cauagcaacagcaucaagucaa

SEQ ID NO: 287248 - RNA, 22 nt, Human
ugggaccugcccuggccccauc

SEQ ID NO: 287249 - RNA, 22 nt, Human
auagcuguagaauguauacaca

SEQ ID NO: 287250 - RNA, 22 nt, Human
uccagauggauuuaagaccuaa

SEQ ID NO: 287251 - RNA, 20 nt, Human
uccuggccucccuggggcuc

SEQ ID NO: 287252 - RNA, 19 nt, Human
gguccucagcagagcaugc

SEQ ID NO: 287253 - RNA, 21 nt, Human
agguggggcugcaccucugcu

SEQ ID NO: 287254 - RNA, 22 nt, Human
ggagcugaggacacuacauuuu

SEQ ID NO: 287255 - RNA, 22 nt, Human
uuugaaguguaugaaaauacag

SEQ ID NO: 287256 - RNA, 22 nt, Human
auuauuguacuuucaauaaggu

SEQ ID NO: 287257 - RNA, 22 nt, Human
gaaugaauucagcacauggaau

SEQ ID NO: 287258 - RNA, 22 nt, Human
acacaguucuuagcaggugucu

SEQ ID NO: 287259 - RNA, 22 nt, Human
gccuuguuucauuacacguggu

SEQ ID NO: 287260 - RNA, 22 nt, Human
cuuccugcccacuuccugcugg

SEQ ID NO: 287261 - RNA, 22 nt, Human
aacauuguuuucccuauaucca

SEQ ID NO: 287262 - RNA, 19 nt, Human
guccucucaacaacccggg

SEQ ID NO: 287263 - RNA, 22 nt, Human
aaagcaguccuucccuuaaggu

SEQ ID NO: 287264 - RNA, 22 nt, Human
caggggagugagucccucucug

SEQ ID NO: 287265 - RNA, 22 nt, Human
ucauucauaaaaauuaguuggc

SEQ ID NO: 287266 - RNA, 23 nt, Human
aaugaguugggcagcauacaggc

SEQ ID NO: 287267 - RNA, 22 nt, Human
acuguguugccuucccccagcc

SEQ ID NO: 287268 - RNA, 22 nt, Human
uucuucugccucccaccugaua

SEQ ID NO: 287269 - RNA, 22 nt, Human
ugagcccuaagggucaagcagg

SEQ ID NO: 287270 - RNA, 22 nt, Human
uuaggaaaaucaugagagauga

SEQ ID NO: 287271 - RNA, 22 nt, Human
ugacauguauguuguuggcaug

SEQ ID NO: 287272 - RNA, 22 nt, Human
acacaggaagagagauaauaau

SEQ ID NO: 287273 - RNA, 22 nt, Human
ucugcgccaccuugugcuugug

SEQ ID NO: 287274 - RNA, 22 nt, Human
acuccugggugcauuucugauu

SEQ ID NO: 287275 - RNA, 22 nt, Human
aagacauugucauuuuauaauu

SEQ ID NO: 287276 - RNA, 22 nt, Human
acuggaggauuccuggaaggcg

SEQ ID NO: 287277 - RNA, 22 nt, Human
cagacugaguggauuaaacaau

SEQ ID NO: 287278 - RNA, 22 nt, Human
uccuggccuccguucucugcau

SEQ ID NO: 287279 - RNA, 22 nt, Human
gcaaaguaaaaauagauucuga

SEQ ID NO: 287280 - RNA, 22 nt, Human
gucaggccaauacucuccagca

SEQ ID NO: 287281 - RNA, 22 nt, Human
ugaaaugaaugugauucgauag

SEQ ID NO: 287282 - RNA, 22 nt, Human
ucaugcagauaagaauaaguaa

SEQ ID NO: 287283 - RNA, 22 nt, Human
caguuaaaggcccaauaucugg

SEQ ID NO: 287284 - RNA, 22 nt, Human
cguccuuugaauugaggucuuu

SEQ ID NO: 287285 - RNA, 22 nt, Human
ucuuucccgccagagcaugagu

SEQ ID NO: 287286 - RNA, 22 nt, Human
auguguccacaggugugagaga

SEQ ID NO: 287287 - RNA, 22 nt, Human
uguggggccucgugcuagcugg

SEQ ID NO: 287288 - RNA, 22 nt, Human
cauguuuuguguacagaauauu

SEQ ID NO: 287289 - RNA, 22 nt, Human
aaaucaugugcagagaucagga

SEQ ID NO: 287290 - RNA, 20 nt, Human
auguuaaauagcauuuagag

SEQ ID NO: 287291 - RNA, 22 nt, Human
gcugaaauuagacugcagaagu

SEQ ID NO: 287292 - RNA, 21 nt, Human
ggugacacguggccccgcucu

SEQ ID NO: 287293 - RNA, 19 nt, Human
acacauuugcacaauccac

SEQ ID NO: 287294 - RNA, 22 nt, Human
gaauaauugugaugcuugaagu

SEQ ID NO: 287295 - RNA, 19 nt, Human
ccagguggaacugagguag

SEQ ID NO: 287296 - RNA, 22 nt, Human
cuguccagcuuggcuccugggg

SEQ ID NO: 287297 - RNA, 22 nt, Human
cagcuuuauuaaugauugucuu

SEQ ID NO: 287298 - RNA, 22 nt, Human
aacaggccuuguuuuuguucau

SEQ ID NO: 287299 - RNA, 22 nt, Human
guccugguuuucacagaccuuu

SEQ ID NO: 287300 - RNA, 22 nt, Human
auuaauuuccaggcacugugcu

SEQ ID NO: 287301 - RNA, 22 nt, Human
gccugagaucagccaagccccu

SEQ ID NO: 287302 - RNA, 22 nt, Human
ugcugcauuugcaguccuuuaa

SEQ ID NO: 287303 - RNA, 22 nt, Human
gaauguaauagucaguagaaca

SEQ ID NO: 287304 - RNA, 22 nt, Human
gcaguggcuaagcucgcaugca

SEQ ID NO: 287305 - RNA, 22 nt, Human
cuccuggaccaccuuguggcca

SEQ ID NO: 287306 - RNA, 22 nt, Human
cugagagguaagcagcgcagug

SEQ ID NO: 287307 - RNA, 18 nt, Human
uaugugucuguuacaacu

SEQ ID NO: 287308 - RNA, 22 nt, Human
caugcagcggcguuugguuuaa

SEQ ID NO: 287309 - RNA, 19 nt, Human
ccagucccauacaggagau

SEQ ID NO: 287310 - RNA, 22 nt, Human
uuagaagugaaauagcuguaca

SEQ ID NO: 287311 - RNA, 22 nt, Human
auuagcaacauggugaauaugu

SEQ ID NO: 287312 - RNA, 22 nt, Human
agcgagggaggucugaggacag

SEQ ID NO: 287313 - RNA, 20 nt, Human
cugcccacuagaacuaccug

SEQ ID NO: 287314 - RNA, 22 nt, Human
gcccagggucuacaaaaauauu

SEQ ID NO: 287315 - RNA, 22 nt, Human
uccuggcuuccacuccucuguu

SEQ ID NO: 287316 - RNA, 22 nt, Human
gcauucuuuuugacuccugguu

SEQ ID NO: 287317 - RNA, 22 nt, Human
ucaauguuuguucaugaaaaua

SEQ ID NO: 287318 - RNA, 22 nt, Human
gugaaaauaaggcugguucuug

SEQ ID NO: 287319 - RNA, 21 nt, Human
uugaggagugagaguggguuu

SEQ ID NO: 287320 - RNA, 22 nt, Human
gcaguggccacauggaggagga

SEQ ID NO: 287321 - RNA, 22 nt, Human
agcauuuaggagaauuugagaa

SEQ ID NO: 287322 - RNA, 22 nt, Human
ggcuacuagguaccauuuagaa

SEQ ID NO: 287323 - RNA, 21 nt, Human
agaugcugaugcugcaggucc

SEQ ID NO: 287324 - RNA, 22 nt, Human
gagguaauuacuauguucagau

SEQ ID NO: 287325 - RNA, 22 nt, Human
uaucauuuaacagaaucauugc

SEQ ID NO: 287326 - RNA, 22 nt, Human
gcaguucuacuuauccauagac

SEQ ID NO: 287327 - RNA, 20 nt, Human
uguuucugacgguaggagag

SEQ ID NO: 287328 - RNA, 22 nt, Human
ccagcuuuuagugggcuuauua

SEQ ID NO: 287329 - RNA, 22 nt, Human
agcuuuguggcuuugcaagacu

SEQ ID NO: 287330 - RNA, 22 nt, Human
cuucuucacacuggucugaagc

SEQ ID NO: 287331 - RNA, 22 nt, Human
gagaaagacguaggcugggagg

SEQ ID NO: 287332 - RNA, 22 nt, Human
ucugggaacugagcuccccuag

SEQ ID NO: 287333 - RNA, 22 nt, Human
uguccuauuucucugugcauga

SEQ ID NO: 287334 - RNA, 22 nt, Human
augaggcagcuggcuuucuccc

SEQ ID NO: 287335 - RNA, 22 nt, Human
uuuacauguaauguuauacaaa

SEQ ID NO: 287336 - RNA, 22 nt, Human
auguguccucuggcagguuuag

SEQ ID NO: 287337 - RNA, 22 nt, Human
cggcaggguugguuuucucuga

SEQ ID NO: 287338 - RNA, 22 nt, Human
ccagagaguaggaggcauuauu

SEQ ID NO: 287339 - RNA, 22 nt, Human
guuuacaugcagaaaaucaaug

SEQ ID NO: 287340 - RNA, 22 nt, Human
aaagccacguggccuggggagc

SEQ ID NO: 287341 - RNA, 22 nt, Human
auaagccugauucacuugucau

SEQ ID NO: 287342 - RNA, 22 nt, Human
ugcauugauagaaaaacaugga

SEQ ID NO: 287343 - RNA, 22 nt, Human
cccugcagagccagcccugacc

SEQ ID NO: 287344 - RNA, 22 nt, Human
gcucuaggaggugugcuuagaa

SEQ ID NO: 287345 - RNA, 22 nt, Human
ucugugcccucggugcugggcc

SEQ ID NO: 287346 - RNA, 22 nt, Human
uugcuuuaccugugguauauuu

SEQ ID NO: 287347 - RNA, 22 nt, Human
cagcauuuagaauuugaagugu

SEQ ID NO: 287348 - RNA, 22 nt, Human
uguuaauauacuaaaauccacu

SEQ ID NO: 287349 - RNA, 22 nt, Human
gccaggcaguucaaguacacca

SEQ ID NO: 287350 - RNA, 23 nt, Human
uaucucagaggaauguaguuacu

SEQ ID NO: 287351 - RNA, 22 nt, Human
aauaaauguuuguuggauguuu

SEQ ID NO: 287352 - RNA, 22 nt, Human
ggaagagaauuucucucuuuuu

SEQ ID NO: 287353 - RNA, 22 nt, Human
uucugucacagugcugguauca

SEQ ID NO: 287354 - RNA, 22 nt, Human
uggaggaaaauuacuggggucu

SEQ ID NO: 287355 - RNA, 22 nt, Human
caaauggucauuucucuuuugu

SEQ ID NO: 287356 - RNA, 22 nt, Human
cagggagcuuucccaggacccu

SEQ ID NO: 287357 - RNA, 22 nt, Human
agcagguguuuguaucauaagg

SEQ ID NO: 287358 - RNA, 22 nt, Human
cgcagggccgcgagcgggacca

SEQ ID NO: 287359 - RNA, 23 nt, Human
uuguccucuggaucgguuugguu

SEQ ID NO: 287360 - RNA, 20 nt, Human
uuucauugucagaaucuuau

SEQ ID NO: 287361 - RNA, 22 nt, Human
aauaaugagcuugucuaauugu

SEQ ID NO: 287362 - RNA, 22 nt, Human
uagggacaaagagcugaggccu

SEQ ID NO: 287363 - RNA, 22 nt, Human
ugagaggaacaggcaguagguu

SEQ ID NO: 287364 - RNA, 22 nt, Human
ugauggcuuaguggcagggcga

SEQ ID NO: 287365 - RNA, 22 nt, Human
cuuagggaaucuuagagcugga

SEQ ID NO: 287366 - RNA, 21 nt, Human
ugggaccuagcuuugcacagg

SEQ ID NO: 287367 - RNA, 22 nt, Human
ugcuggagaucauuaauguuca

SEQ ID NO: 287368 - RNA, 22 nt, Human
ugcuuucuuuagcuccugaguc

SEQ ID NO: 287369 - RNA, 22 nt, Human
cuauaaaucuacccagcauugg

SEQ ID NO: 287370 - RNA, 18 nt, Human
cauaauuuucuuucuuua

SEQ ID NO: 287371 - RNA, 22 nt, Human
uucccaguuagucauuuuuaca

SEQ ID NO: 287372 - RNA, 22 nt, Human
uuacagauacuuuguaggcaag

SEQ ID NO: 287373 - RNA, 22 nt, Human
ucaggugggcaguggguugagc

SEQ ID NO: 287374 - RNA, 22 nt, Human
aguguuuuauuagaacacagcc

SEQ ID NO: 287375 - RNA, 22 nt, Human
uggcaggugccuguaaucucag

SEQ ID NO: 287376 - RNA, 22 nt, Human
ccagguggaggugugagguccu

SEQ ID NO: 287377 - RNA, 22 nt, Human
aacuuguaaugaaaggcaauag

SEQ ID NO: 287378 - RNA, 22 nt, Human
acagguguccucacagggggug

SEQ ID NO: 287379 - RNA, 22 nt, Human
ucuugaaagcaugagauggaca

SEQ ID NO: 287380 - RNA, 22 nt, Human
ugaucauuaucaaacuggucau

SEQ ID NO: 287381 - RNA, 22 nt, Human
auugcuuuucagacaaugaggc

SEQ ID NO: 287382 - RNA, 22 nt, Human
ccuguucaaguugcagggcugg

SEQ ID NO: 287383 - RNA, 23 nt, Human
ggcugcucuuuucaugcuguuuc

SEQ ID NO: 287384 - RNA, 22 nt, Human
cuucuucuuuuaauaaaugucu

SEQ ID NO: 287385 - RNA, 22 nt, Human
ugacauguccugagaagauggc

SEQ ID NO: 287386 - RNA, 16 nt, Human
uuauugaggccaagga

SEQ ID NO: 287387 - RNA, 22 nt, Human
agcugaaauucacaaggaucca

SEQ ID NO: 287388 - RNA, 21 nt, Human
ugagcaggugcagggaagugg

SEQ ID NO: 287389 - RNA, 22 nt, Human
gcagcuuuaaacauuggaaaua

SEQ ID NO: 287390 - RNA, 19 nt, Human
gcagacagguccagagagg

SEQ ID NO: 287391 - RNA, 22 nt, Human
auguguuuguaccuuuaaauau

SEQ ID NO: 287392 - RNA, 22 nt, Human
aguauuugauacagucuucuag

SEQ ID NO: 287393 - RNA, 22 nt, Human
uuuguccucuccauguacaaua

SEQ ID NO: 287394 - RNA, 22 nt, Human
cuucuuaacuguauauacuaug

SEQ ID NO: 287395 - RNA, 22 nt, Human
agcaggugucacuuucacucca

SEQ ID NO: 287396 - RNA, 22 nt, Human
augaguugaagcuacaagaggc

SEQ ID NO: 287397 - RNA, 22 nt, Human
cagugauauuuauccuacucac

SEQ ID NO: 287398 - RNA, 22 nt, Human
aggaugccuucauugcauggcc

SEQ ID NO: 287399 - RNA, 22 nt, Human
uuuaguguaagcauaaagaaca

SEQ ID NO: 287400 - RNA, 22 nt, Human
aacugugggaugcauuaauuca

SEQ ID NO: 287401 - RNA, 22 nt, Human
cucagcucaaaauucaccuuug

SEQ ID NO: 287402 - RNA, 22 nt, Human
ccugcuguaaugugucuuuauu

SEQ ID NO: 287403 - RNA, 21 nt, Human
aaagagcccgcugagagguuc

SEQ ID NO: 287404 - RNA, 22 nt, Human
cccaguuguugccggcucugga

SEQ ID NO: 287405 - RNA, 22 nt, Human
acagugucugacacguaggaag

SEQ ID NO: 287406 - RNA, 22 nt, Human
ggccugacuugaucggcucucu

SEQ ID NO: 287407 - RNA, 22 nt, Human
ggaaagcuuuguacuugaaaac

SEQ ID NO: 287408 - RNA, 22 nt, Human
cuccuggcaggcugagugaaau

SEQ ID NO: 287409 - RNA, 23 nt, Human
gcacagagcaguuaggggaagau

SEQ ID NO: 287410 - RNA, 22 nt, Human
gcaggcaggagcccaacugccu

SEQ ID NO: 287411 - RNA, 23 nt, Human
uuucuucagaagccuugcgaggc

SEQ ID NO: 287412 - RNA, 22 nt, Human
gcaugucuguaauuacagagcc

SEQ ID NO: 287413 - RNA, 22 nt, Human
acagaaagauaggcacaagguc

SEQ ID NO: 287414 - RNA, 22 nt, Human
ugauguccucaugucaagcucc

SEQ ID NO: 287415 - RNA, 22 nt, Human
acauuaaaauugggugggguaa

SEQ ID NO: 287416 - RNA, 22 nt, Human
ugauuucuucuaauuuccauca

SEQ ID NO: 287417 - RNA, 22 nt, Human
cuugcacacauguacaugugua

SEQ ID NO: 287418 - RNA, 22 nt, Human
gaugugucuccauacaccaccc

SEQ ID NO: 287419 - RNA, 22 nt, Human
gaagaggcaauugaauaagcua

SEQ ID NO: 287420 - RNA, 22 nt, Human
ggcaaggggucaggcugagaca

SEQ ID NO: 287421 - RNA, 22 nt, Human
ucuggcagaggaaggaggccug

SEQ ID NO: 287422 - RNA, 20 nt, Human
aagagucuuuacugagcuaa

SEQ ID NO: 287423 - RNA, 22 nt, Human
aaacaaguguaaacuagucugu

SEQ ID NO: 287424 - RNA, 22 nt, Human
auuugcuucugugaaaucaagu

SEQ ID NO: 287425 - RNA, 22 nt, Human
guucuucaucauuuuagauagg

SEQ ID NO: 287426 - RNA, 22 nt, Human
ugcucagcgccaaagcugaugg

SEQ ID NO: 287427 - RNA, 22 nt, Human
cucaggcugugaugugauggca

SEQ ID NO: 287428 - RNA, 22 nt, Human
uagguucacacaucuuccagau

SEQ ID NO: 287429 - RNA, 22 nt, Human
cagugcagucaaggaagaacca

SEQ ID NO: 287430 - RNA, 22 nt, Human
caggauaaauaguaaauguaag

SEQ ID NO: 287431 - RNA, 22 nt, Human
guuuuauaggcuguugcuauau

SEQ ID NO: 287432 - RNA, 22 nt, Human
auuauucuuaugucaucauggc

SEQ ID NO: 287433 - RNA, 22 nt, Human
auugugcaaauauuaucuguag

SEQ ID NO: 287434 - RNA, 22 nt, Human
ccagcuuuucuuaucauuauaa

SEQ ID NO: 287435 - RNA, 22 nt, Human
uuucagauggagguuuaggaca

SEQ ID NO: 287436 - RNA, 22 nt, Human
guguaaaaacauacuauuucua

SEQ ID NO: 287437 - RNA, 22 nt, Human
cuuaauuuaaaauaguucaggc

SEQ ID NO: 287438 - RNA, 22 nt, Human
cugcagggagaggggacagccu

SEQ ID NO: 287439 - RNA, 22 nt, Human
ugcaaacaggagaguaaguaua

SEQ ID NO: 287440 - RNA, 22 nt, Human
gaucuucucuuuaguagaaaca

SEQ ID NO: 287441 - RNA, 22 nt, Human
cauuuguaguaucuguuuauau

SEQ ID NO: 287442 - RNA, 22 nt, Human
acuugccuguuacauuucuagu

SEQ ID NO: 287443 - RNA, 22 nt, Human
cuuccuggccauugccauggca

SEQ ID NO: 287444 - RNA, 22 nt, Human
ucagauagugauaauagcaugu

SEQ ID NO: 287445 - RNA, 22 nt, Human
ccugugacuuggcaaaccucca

SEQ ID NO: 287446 - RNA, 22 nt, Human
ugucugagugcauaugugcugg

SEQ ID NO: 287447 - RNA, 22 nt, Human
uccugguggcuuucccugccuu

SEQ ID NO: 287448 - RNA, 20 nt, Human
ucaaaauaggugugggcgga

SEQ ID NO: 287449 - RNA, 22 nt, Human
ucacauuuuuuacuggacuuaa

SEQ ID NO: 287450 - RNA, 21 nt, Human
gcaaauguucaggaaaaaaga

SEQ ID NO: 287451 - RNA, 22 nt, Human
gcuuugugaauuauuacucaca

SEQ ID NO: 287452 - RNA, 22 nt, Human
ugcuuuauuaagagagaaauuu

SEQ ID NO: 287453 - RNA, 22 nt, Human
uauugauaaggauggcugcaau

SEQ ID NO: 287454 - RNA, 22 nt, Human
ccuuugguaauucuguguagag

SEQ ID NO: 287455 - RNA, 22 nt, Human
guuucauacagauuauucaugg

SEQ ID NO: 287456 - RNA, 22 nt, Human
uccaggcauaaugcccaguggu

SEQ ID NO: 287457 - RNA, 22 nt, Human
uuauuacacugaaagaauugcg

SEQ ID NO: 287458 - RNA, 23 nt, Human
cuucaugagagcccugaggaaaa

SEQ ID NO: 287459 - RNA, 22 nt, Human
uuucaaagcaacugaaaaggaa

SEQ ID NO: 287460 - RNA, 22 nt, Human
gauguacuugccuuaucuaucc

SEQ ID NO: 287461 - RNA, 22 nt, Human
augguaaacauuuaacaacuag

SEQ ID NO: 287462 - RNA, 22 nt, Human
aucuuucucugcacuauacaau

SEQ ID NO: 287463 - RNA, 22 nt, Human
uuucaguugccaagcuaauucu

SEQ ID NO: 287464 - RNA, 22 nt, Human
gcuuuggaaauauagacucaag

SEQ ID NO: 287465 - RNA, 22 nt, Human
accaaggagacaaagguguauu

SEQ ID NO: 287466 - RNA, 22 nt, Human
ugcaggcucaucucaagaguag

SEQ ID NO: 287467 - RNA, 22 nt, Human
ggaacaggaaaggagggaugcu

SEQ ID NO: 287468 - RNA, 22 nt, Human
aaaagcaagaggcuggauuaaa

SEQ ID NO: 287469 - RNA, 22 nt, Human
uuguuagugcaauguuugguga

SEQ ID NO: 287470 - RNA, 22 nt, Human
uggcagguacccauuggcugua

SEQ ID NO: 287471 - RNA, 22 nt, Human
cuugccuguggcuaguuggcuc

SEQ ID NO: 287472 - RNA, 22 nt, Human
guuacaaauguaaauucugggg

SEQ ID NO: 287473 - RNA, 22 nt, Human
ccuucuucaccaguuuaccuga

SEQ ID NO: 287474 - RNA, 22 nt, Human
uuccugguuuauaccuguauca

SEQ ID NO: 287475 - RNA, 22 nt, Human
cagucuaaucuguuacucauua

SEQ ID NO: 287476 - RNA, 22 nt, Human
aacaugaaaacuaccugugauu

SEQ ID NO: 287477 - RNA, 22 nt, Human
agacagacauagaaauuaguaa

SEQ ID NO: 287478 - RNA, 22 nt, Human
gaauugcuaaccaauucaaaau

SEQ ID NO: 287479 - RNA, 21 nt, Human
uucauaaaccauucucaugca

SEQ ID NO: 287480 - RNA, 22 nt, Human
agaaugcuccagagcugaaaga

SEQ ID NO: 287481 - RNA, 22 nt, Human
ucagaaaauaacuguuaguuug

SEQ ID NO: 287482 - RNA, 22 nt, Human
aaagauuauggcauugaaauac

SEQ ID NO: 287483 - RNA, 23 nt, Human
uuuuccagaaucgacucuguaga

SEQ ID NO: 287484 - RNA, 22 nt, Human
gcuguucacaucuggaccauuu

SEQ ID NO: 287485 - RNA, 22 nt, Human
uauugcugccauuuuccaaugu

SEQ ID NO: 287486 - RNA, 22 nt, Human
aaauacaaaaauuagccaggca

SEQ ID NO: 287487 - RNA, 22 nt, Human
ucccagccuuucuuuucugcug

SEQ ID NO: 287488 - RNA, 22 nt, Human
aauuuuacaagaaggccucgua

SEQ ID NO: 287489 - RNA, 22 nt, Human
uuucuaguucuaccacaguaau

SEQ ID NO: 287490 - RNA, 22 nt, Human
gacaugcaguucucaaggguag

SEQ ID NO: 287491 - RNA, 23 nt, Human
aggcagguuugggcucuucuugu

SEQ ID NO: 287492 - RNA, 22 nt, Human
cauuuugugcuagacacuaugg

SEQ ID NO: 287493 - RNA, 22 nt, Human
uuuucauuagaaugacugagaa

SEQ ID NO: 287494 - RNA, 22 nt, Human
uuccaggacucguucuggcuca

SEQ ID NO: 287495 - RNA, 21 nt, Human
gcaugugugggacuggauccu

SEQ ID NO: 287496 - RNA, 22 nt, Human
uuuaguauauaaaaagagaagu

SEQ ID NO: 287497 - RNA, 21 nt, Human
gccugcagaccccaccaggcu

SEQ ID NO: 287498 - RNA, 22 nt, Human
uuucaaaguugggaauuguaau

SEQ ID NO: 287499 - RNA, 22 nt, Human
uuucacuagaacguucuuguuu

SEQ ID NO: 287500 - RNA, 22 nt, Human
cauuucacaguaaagugauuuc

SEQ ID NO: 287501 - RNA, 22 nt, Human
accugcaggcacaggugugcgc

SEQ ID NO: 287502 - RNA, 22 nt, Human
ugucucagaguguuguauuaga

SEQ ID NO: 287503 - RNA, 22 nt, Human
gagcucagcacuaaaaucaugu

SEQ ID NO: 287504 - RNA, 22 nt, Human
ucacccagcgggcgcacacucg

SEQ ID NO: 287505 - RNA, 20 nt, Human
aaaguguaagcauauaauua

SEQ ID NO: 287506 - RNA, 22 nt, Human
cuucagaaccagccagaagagg

SEQ ID NO: 287507 - RNA, 22 nt, Human
aagcacagacucccucugagug

SEQ ID NO: 287508 - RNA, 22 nt, Human
ucaggagcuugguagugugauu

SEQ ID NO: 287509 - RNA, 22 nt, Human
gcagagaggaaugaagccaucc

SEQ ID NO: 287510 - RNA, 22 nt, Human
cuuccugcuccccugccaauuc

SEQ ID NO: 287511 - RNA, 22 nt, Human
uaaaacuuaacuauccagauua

SEQ ID NO: 287512 - RNA, 21 nt, Human
uggcagggguaguaguacagc

SEQ ID NO: 287513 - RNA, 22 nt, Human
auuugcauaauagugauuugua

SEQ ID NO: 287514 - RNA, 22 nt, Human
uucauauaaauggaaucagaau

SEQ ID NO: 287515 - RNA, 22 nt, Human
agggccaggaacaccugaaggg

SEQ ID NO: 287516 - RNA, 22 nt, Human
agauggcuuagccuggcuccca

SEQ ID NO: 287517 - RNA, 22 nt, Human
guuacaaaggaagcuucacugc

SEQ ID NO: 287518 - RNA, 22 nt, Human
augacagaggagugcaggugau

SEQ ID NO: 287519 - RNA, 22 nt, Human
ugaauaugugacuuugauuuca

SEQ ID NO: 287520 - RNA, 22 nt, Human
aucauucuauuguugagcugcc

SEQ ID NO: 287521 - RNA, 22 nt, Human
cacuggucagucggucagucuc

SEQ ID NO: 287522 - RNA, 22 nt, Human
aaauuagaagugcucaggaaua

SEQ ID NO: 287523 - RNA, 22 nt, Human
auuucuacaguacacaugcauu

SEQ ID NO: 287524 - RNA, 22 nt, Human
ccuccugguaauuagcgaaagg

SEQ ID NO: 287525 - RNA, 22 nt, Human
ugacauuuaucuucuacaauga

SEQ ID NO: 287526 - RNA, 22 nt, Human
aagucucuuuucuuccuguauu

SEQ ID NO: 287527 - RNA, 22 nt, Human
ucugucccugagagcucaggag

SEQ ID NO: 287528 - RNA, 22 nt, Human
uccaggcuggcucuucaaaauu

SEQ ID NO: 287529 - RNA, 22 nt, Human
gcuggcaggagaccauacccua

SEQ ID NO: 287530 - RNA, 22 nt, Human
caugagagauccuucaugagag

SEQ ID NO: 287531 - RNA, 22 nt, Human
uggaccugcguaggugcugggc

SEQ ID NO: 287532 - RNA, 22 nt, Human
aagguggugaguacaguuaggu

SEQ ID NO: 287533 - RNA, 22 nt, Human
ggagagcugguauaugaagaca

SEQ ID NO: 287534 - RNA, 22 nt, Human
uacauucacuuguugaaggugg

SEQ ID NO: 287535 - RNA, 22 nt, Human
gaggccuggaauuccagccugg

SEQ ID NO: 287536 - RNA, 22 nt, Human
cuggaggcaguugccccaguca

SEQ ID NO: 287537 - RNA, 22 nt, Human
cuguccagucagaacgucauua

SEQ ID NO: 287538 - RNA, 22 nt, Human
gcauucuuguuuuuccuacccu

SEQ ID NO: 287539 - RNA, 22 nt, Human
uguguccugcagacagacucag

SEQ ID NO: 287540 - RNA, 22 nt, Human
gagacaaagcuuccugugggua

SEQ ID NO: 287541 - RNA, 22 nt, Human
uagggcucagcucuagcuccug

SEQ ID NO: 287542 - RNA, 22 nt, Human
ucccaggcuggcaggcagcagu

SEQ ID NO: 287543 - RNA, 22 nt, Human
uggggaggaagucagauuucag

SEQ ID NO: 287544 - RNA, 22 nt, Human
auuaaauuggaucugcauaguu

SEQ ID NO: 287545 - RNA, 22 nt, Human
gggcaggugaccucuuguccug

SEQ ID NO: 287546 - RNA, 22 nt, Human
uggagcagaguucagcggggag

SEQ ID NO: 287547 - RNA, 21 nt, Human
agcacagcuuuaagccaugug

SEQ ID NO: 287548 - RNA, 22 nt, Human
ugggaugucuuuaggggaagag

SEQ ID NO: 287549 - RNA, 16 nt, Human
cuacccagugagaagg

SEQ ID NO: 287550 - RNA, 22 nt, Human
gaauugcuaauccaagugacug

SEQ ID NO: 287551 - RNA, 22 nt, Human
uucccucucuagcuuuccccaa

SEQ ID NO: 287552 - RNA, 22 nt, Human
agauaacugguuuacauuauug

SEQ ID NO: 287553 - RNA, 22 nt, Human
uuagaaaauuugcuucuuugga

SEQ ID NO: 287554 - RNA, 22 nt, Human
aaggucaaagacaguaacuuuu

SEQ ID NO: 287555 - RNA, 22 nt, Human
cuggcucuaucuccaaggcugg

SEQ ID NO: 287556 - RNA, 22 nt, Human
ucauuuggaagccugagagugu

SEQ ID NO: 287557 - RNA, 22 nt, Human
acacaagauuguguauugaauu

SEQ ID NO: 287558 - RNA, 22 nt, Human
ucuaggguccacagggucagcc

SEQ ID NO: 287559 - RNA, 23 nt, Human
gagagcccauuggcagggguacc

SEQ ID NO: 287560 - RNA, 22 nt, Human
cuggaggaauaauggcaucuug

SEQ ID NO: 287561 - RNA, 16 nt, Human
uccuggccccuaugga

SEQ ID NO: 287562 - RNA, 22 nt, Human
ucagcuuucucagaggccuaac

SEQ ID NO: 287563 - RNA, 22 nt, Human
ugcaguggaaagacucagacuu

SEQ ID NO: 287564 - RNA, 22 nt, Human
aggaugggucagcuagagucca

SEQ ID NO: 287565 - RNA, 22 nt, Human
gguggggcuaggaccucaggau

SEQ ID NO: 287566 - RNA, 22 nt, Human
aacaugaaaguugcuaagugca

SEQ ID NO: 287567 - RNA, 22 nt, Human
ugucaguuuggcucuaaaguuu

SEQ ID NO: 287568 - RNA, 22 nt, Human
acagaaaugauguuuggcaaua

SEQ ID NO: 287569 - RNA, 19 nt, Human
acauuuaaauucagaucuc

SEQ ID NO: 287570 - RNA, 22 nt, Human
uccuggcuucugucuccuuauu

SEQ ID NO: 287571 - RNA, 22 nt, Human
uguuuuaguucugucuugcaug

SEQ ID NO: 287572 - RNA, 22 nt, Human
uugcuuuaccauuugaucucua

SEQ ID NO: 287573 - RNA, 18 nt, Human
aguuuuuaggaagaaaug

SEQ ID NO: 287574 - RNA, 22 nt, Human
ugagaugucauaguucaguuca

SEQ ID NO: 287575 - RNA, 22 nt, Human
acauaucuuucccucuccugaa

SEQ ID NO: 287576 - RNA, 22 nt, Human
aguguugggucuuuagaauuua

SEQ ID NO: 287577 - RNA, 23 nt, Human
gcucagagguuuuucucuggaug

SEQ ID NO: 287578 - RNA, 22 nt, Human
gcuguggccgggcccaggccgc

SEQ ID NO: 287579 - RNA, 22 nt, Human
ggaucuguuuugccucugaggg

SEQ ID NO: 287580 - RNA, 22 nt, Human
uuucauuauacagcuucauaaa

SEQ ID NO: 287581 - RNA, 22 nt, Human
agagaaaacucauugagguguc

SEQ ID NO: 287582 - RNA, 17 nt, Human
cccguucucuucgcugg

SEQ ID NO: 287583 - RNA, 22 nt, Human
guguguucagcaagagguaagg

SEQ ID NO: 287584 - RNA, 22 nt, Human
uguaaacaaaugcauucuugcu

SEQ ID NO: 287585 - RNA, 22 nt, Human
cagaaagaccugauuggcaguu

SEQ ID NO: 287586 - RNA, 22 nt, Human
uucuuguucugguucuguuagc

SEQ ID NO: 287587 - RNA, 22 nt, Human
uagcuuuaagacauggugaaug

SEQ ID NO: 287588 - RNA, 22 nt, Human
caggcugcguuugugaaaggua

SEQ ID NO: 287589 - RNA, 23 nt, Human
gcagacagagcagacuaagacaa

SEQ ID NO: 287590 - RNA, 22 nt, Human
ucuuuggucaucaugggaagca

SEQ ID NO: 287591 - RNA, 22 nt, Human
cuguccugucugcuuuuaauuu

SEQ ID NO: 287592 - RNA, 22 nt, Human
cuggaggagcaauaugguuagg

SEQ ID NO: 287593 - RNA, 22 nt, Human
gcaaauacauguugagcaccua

SEQ ID NO: 287594 - RNA, 22 nt, Human
agaagucauuuauguuagauga

SEQ ID NO: 287595 - RNA, 22 nt, Human
ggaacuggguuagggucucuuc

SEQ ID NO: 287596 - RNA, 22 nt, Human
aaacaguggccaauucuggaga

SEQ ID NO: 287597 - RNA, 22 nt, Human
uuccagaaaacucugccuggua

SEQ ID NO: 287598 - RNA, 22 nt, Human
uucuuacaaguauuccaggucc

SEQ ID NO: 287599 - RNA, 22 nt, Human
uauuccaguucaccuuuucauc

SEQ ID NO: 287600 - RNA, 23 nt, Human
uggucucagccugugagagcuga

SEQ ID NO: 287601 - RNA, 22 nt, Human
ccagagacgucggucagggcgc

SEQ ID NO: 287602 - RNA, 22 nt, Human
agcauucaaguaauucacuugg

SEQ ID NO: 287603 - RNA, 22 nt, Human
caguaaaagauggaaauagaau

SEQ ID NO: 287604 - RNA, 22 nt, Human
uguuuucuuccuaauugcucau

SEQ ID NO: 287605 - RNA, 22 nt, Human
ucuuccuggcauugaugcugca

SEQ ID NO: 287606 - RNA, 18 nt, Human
uuaaggauaagcagacua

SEQ ID NO: 287607 - RNA, 22 nt, Human
uuucaaguacuguaaacaugcu

SEQ ID NO: 287608 - RNA, 22 nt, Human
ucagagaaaugaaguagggauu

SEQ ID NO: 287609 - RNA, 22 nt, Human
uaaagauaagacaucaacugag

SEQ ID NO: 287610 - RNA, 22 nt, Human
ggcugcaaaggaaaagugguga

SEQ ID NO: 287611 - RNA, 22 nt, Human
uuuaugaacuacagauauaacu

SEQ ID NO: 287612 - RNA, 22 nt, Human
gagugucagugccuggcuuguu

SEQ ID NO: 287613 - RNA, 22 nt, Human
uuccugggauuauugucaagca

SEQ ID NO: 287614 - RNA, 22 nt, Human
agucuucacucuucacuacuau

SEQ ID NO: 287615 - RNA, 20 nt, Human
uauuuguauuugggaaaguu

SEQ ID NO: 287616 - RNA, 22 nt, Human
ucacuggguaggacaugcugau

SEQ ID NO: 287617 - RNA, 22 nt, Human
auguccagagccggccugcuga

SEQ ID NO: 287618 - RNA, 22 nt, Human
augaggagcccucauuuagguu

SEQ ID NO: 287619 - RNA, 22 nt, Human
aaaagacaucuauuucaggcag

SEQ ID NO: 287620 - RNA, 22 nt, Human
uccaaggacuaaauucuagauu

SEQ ID NO: 287621 - RNA, 22 nt, Human
uggcugugccucuuuccaggcc

SEQ ID NO: 287622 - RNA, 17 nt, Human
agugucagaagacaguu

SEQ ID NO: 287623 - RNA, 22 nt, Human
aguccaugguucugacucaucu

SEQ ID NO: 287624 - RNA, 22 nt, Human
gcagguggaucaccacgucagg

SEQ ID NO: 287625 - RNA, 22 nt, Human
aguauacaguaaugacauaucu

SEQ ID NO: 287626 - RNA, 22 nt, Human
uugguaaauguugauuguggcu

SEQ ID NO: 287627 - RNA, 22 nt, Human
guccugucccccaaggcugugg

SEQ ID NO: 287628 - RNA, 22 nt, Human
ugcagggcacggugcgcguggg

SEQ ID NO: 287629 - RNA, 22 nt, Human
uauacauguuuuacauaaguga

SEQ ID NO: 287630 - RNA, 22 nt, Human
uuacauucuuaucucaguuauu

SEQ ID NO: 287631 - RNA, 22 nt, Human
acaacauuauacauagaaagcu

SEQ ID NO: 287632 - RNA, 22 nt, Human
auacaaaaauuagccgggagua

SEQ ID NO: 287633 - RNA, 22 nt, Human
uuugacaugcaaagcacuuuag

SEQ ID NO: 287634 - RNA, 22 nt, Human
acaaaugugucuaauugugccu

SEQ ID NO: 287635 - RNA, 22 nt, Human
uggaauuuaguuaauuccauuu

SEQ ID NO: 287636 - RNA, 22 nt, Human
uuccagaacaauguggacguau

SEQ ID NO: 287637 - RNA, 22 nt, Human
guaaucucagcuacuugggagg

SEQ ID NO: 287638 - RNA, 22 nt, Human
aaggagggaaagcagugcuucu

SEQ ID NO: 287639 - RNA, 22 nt, Human
uuucuuuaggcuguguugccaa

SEQ ID NO: 287640 - RNA, 22 nt, Human
aaguaaaauucaaucuucacug

SEQ ID NO: 287641 - RNA, 22 nt, Human
aagcugugaaauagauuacaca

SEQ ID NO: 287642 - RNA, 17 nt, Human
uuuaaacuacuacaagg

SEQ ID NO: 287643 - RNA, 22 nt, Human
uggaaugucauaccauaaaaga

SEQ ID NO: 287644 - RNA, 22 nt, Human
uccugcaggggcugaggaacca

SEQ ID NO: 287645 - RNA, 17 nt, Human
ucuucucuuccagucuu

SEQ ID NO: 287646 - RNA, 22 nt, Human
aacugacagcaggaaccauucc

SEQ ID NO: 287647 - RNA, 22 nt, Human
ugcccagccaguuuaugguaau

SEQ ID NO: 287648 - RNA, 22 nt, Human
cacauuaaaauccuaacuucca

SEQ ID NO: 287649 - RNA, 22 nt, Human
agguucaaauuguugcaguuuc

SEQ ID NO: 287650 - RNA, 22 nt, Human
auuucuucagguucuucuagga

SEQ ID NO: 287651 - RNA, 22 nt, Human
ccuggcugguggcagcgacaag

SEQ ID NO: 287652 - RNA, 22 nt, Human
uugcaggguuaaaguaagguag

SEQ ID NO: 287653 - RNA, 22 nt, Human
ggccucagagaaggcugugcgg

SEQ ID NO: 287654 - RNA, 22 nt, Human
acauucuggaugucugaugaga

SEQ ID NO: 287655 - RNA, 22 nt, Human
uauguacauacaugugcauacg

SEQ ID NO: 287656 - RNA, 22 nt, Human
ggccugagucccaccuggcugu

SEQ ID NO: 287657 - RNA, 22 nt, Human
uccuggcucaggccccuggugc

SEQ ID NO: 287658 - RNA, 22 nt, Human
acaagucucaacagcagccagc

SEQ ID NO: 287659 - RNA, 22 nt, Human
cucugugugguccucuguauug

SEQ ID NO: 287660 - RNA, 22 nt, Human
uuauuguagcacuuuggcagug

SEQ ID NO: 287661 - RNA, 22 nt, Human
agcagggcagugaucagaaagg

SEQ ID NO: 287662 - RNA, 22 nt, Human
aaggaugaacauuaauacauca

SEQ ID NO: 287663 - RNA, 22 nt, Human
gugucacuggaauacugucugu

SEQ ID NO: 287664 - RNA, 22 nt, Human
uuccagaauugggagccuugag

SEQ ID NO: 287665 - RNA, 22 nt, Human
cuuaaagaugucaaggcuguuu

SEQ ID NO: 287666 - RNA, 22 nt, Human
acagggcauuuccucuaugugu

SEQ ID NO: 287667 - RNA, 22 nt, Human
ucuagggugugcggcagggcua

SEQ ID NO: 287668 - RNA, 22 nt, Human
cauuuauucaugaucuguagcu

SEQ ID NO: 287669 - RNA, 22 nt, Human
aagccuuggggcuccucuguau

SEQ ID NO: 287670 - RNA, 22 nt, Human
uuggcuuuuaugcagcuuaggu

SEQ ID NO: 287671 - RNA, 17 nt, Human
ccagguggaaucgugga

SEQ ID NO: 287672 - RNA, 22 nt, Human
guuucuuuuaaaauauguagac

SEQ ID NO: 287673 - RNA, 22 nt, Human
uccucuggggcgugguccugga

SEQ ID NO: 287674 - RNA, 22 nt, Human
cuuuauuagauguagacuuucu

SEQ ID NO: 287675 - RNA, 22 nt, Human
cagggacccgcacagguagcau

SEQ ID NO: 287676 - RNA, 22 nt, Human
cauuuguauguuccuccuuagg

SEQ ID NO: 287677 - RNA, 22 nt, Human
caacuucuuggcuuccuaaugg

SEQ ID NO: 287678 - RNA, 22 nt, Human
aaugagauggaggacucuuaau

SEQ ID NO: 287679 - RNA, 22 nt, Human
uggcagugggaagcuggaaguc

SEQ ID NO: 287680 - RNA, 22 nt, Human
gcaccuuucuauauucaguggc

SEQ ID NO: 287681 - RNA, 22 nt, Human
agaggcucugccgccucaggua

SEQ ID NO: 287682 - RNA, 22 nt, Human
cugaaagcaaaguaauucuuaa

SEQ ID NO: 287683 - RNA, 22 nt, Human
aaauggaauguguuuauaauuc

SEQ ID NO: 287684 - RNA, 22 nt, Human
uggcaaaguaauuggguuucuc

SEQ ID NO: 287685 - RNA, 20 nt, Human
ugugcccagcagaggcugcc

SEQ ID NO: 287686 - RNA, 22 nt, Human
caggcugcuccaggguaggaaa

SEQ ID NO: 287687 - RNA, 21 nt, Human
aaagaaaucucccauugguag

SEQ ID NO: 287688 - RNA, 23 nt, Human
gcucuggcagcuugugucagcac

SEQ ID NO: 287689 - RNA, 22 nt, Human
ucugggccucaguuucuucauc

SEQ ID NO: 287690 - RNA, 22 nt, Human
guguccugccacccugggcuuu

SEQ ID NO: 287691 - RNA, 22 nt, Human
uucacacuuuggaauuccaccu

SEQ ID NO: 287692 - RNA, 22 nt, Human
ugucucagaguaucccugaacu

SEQ ID NO: 287693 - RNA, 22 nt, Human
augaaaacggaccagagcuauu

SEQ ID NO: 287694 - RNA, 22 nt, Human
auguagagcuccuugauccucc

SEQ ID NO: 287695 - RNA, 22 nt, Human
acauuaaauuucauagugauua

SEQ ID NO: 287696 - RNA, 22 nt, Human
ccucuccuugcacccgucccgc

SEQ ID NO: 287697 - RNA, 22 nt, Human
agaguaaaguacuuggaauacc

SEQ ID NO: 287698 - RNA, 22 nt, Human
uggcaggaaaguaacagagcac

SEQ ID NO: 287699 - RNA, 22 nt, Human
uaagaauuaucucauggauaau

SEQ ID NO: 287700 - RNA, 22 nt, Human
cagagcaucgcgcagagagccu

SEQ ID NO: 287701 - RNA, 22 nt, Human
gggaggagggugcuggcuaaac

SEQ ID NO: 287702 - RNA, 22 nt, Human
acaugacaagguuuauaaggcu

SEQ ID NO: 287703 - RNA, 22 nt, Human
ccaaaauaacagcccaauucac

SEQ ID NO: 287704 - RNA, 22 nt, Human
ugcccuggggagcccagccagg

SEQ ID NO: 287705 - RNA, 22 nt, Human
gaucaugugauuugaaguaaug

SEQ ID NO: 287706 - RNA, 22 nt, Human
ucugagcuaauccuguugccga

SEQ ID NO: 287707 - RNA, 19 nt, Human
uauugguaugugugaggca

SEQ ID NO: 287708 - RNA, 22 nt, Human
cacagcugcccuacuccaugug

SEQ ID NO: 287709 - RNA, 22 nt, Human
cuggcugugcagucuuccagaa

SEQ ID NO: 287710 - RNA, 22 nt, Human
guucaaaauucaaaugguauac

SEQ ID NO: 287711 - RNA, 22 nt, Human
auggcuuguucauugguaccug

SEQ ID NO: 287712 - RNA, 22 nt, Human
agauauuuguaucuugcuauug

SEQ ID NO: 287713 - RNA, 22 nt, Human
aaaauugucgaacaguaguaac

SEQ ID NO: 287714 - RNA, 22 nt, Human
cagugucaccaggcgagucucc

SEQ ID NO: 287715 - RNA, 22 nt, Human
ccuggaagucauuccucguucc

SEQ ID NO: 287716 - RNA, 22 nt, Human
ugccaaauugcccuauaaauga

SEQ ID NO: 287717 - RNA, 22 nt, Human
ccagccuuacugcccuucagug

SEQ ID NO: 287718 - RNA, 22 nt, Human
aggagccaaauuuuagacucug

SEQ ID NO: 287719 - RNA, 22 nt, Human
ucuuaguuguuugcugucuaac

SEQ ID NO: 287720 - RNA, 22 nt, Human
aggaauguuaguucuguauaca

SEQ ID NO: 287721 - RNA, 22 nt, Human
cauuuguauagugcuuagacca

SEQ ID NO: 287722 - RNA, 22 nt, Human
ggaccugcauuuuaacaagauc

SEQ ID NO: 287723 - RNA, 22 nt, Human
auguuaaauagccauuuguuug

SEQ ID NO: 287724 - RNA, 22 nt, Human
gaaggagggugcggaucugagc

SEQ ID NO: 287725 - RNA, 22 nt, Human
auuugggaauuauuugccuaau

SEQ ID NO: 287726 - RNA, 22 nt, Human
augucagucuuucugucucaga

SEQ ID NO: 287727 - RNA, 22 nt, Human
cccagccagccucuucccauau

SEQ ID NO: 287728 - RNA, 22 nt, Human
gcugaaaugucuuuagcagugu

SEQ ID NO: 287729 - RNA, 23 nt, Human
ucagagaggcccccugcagagau

SEQ ID NO: 287730 - RNA, 21 nt, Human
cuguccuggucuagaggcaca

SEQ ID NO: 287731 - RNA, 22 nt, Human
acuacauucaugcucguguugg

SEQ ID NO: 287732 - RNA, 22 nt, Human
acagaagaccagagagcuaacu

SEQ ID NO: 287733 - RNA, 22 nt, Human
aaacaucaauugcaucucccaa

SEQ ID NO: 287734 - RNA, 22 nt, Human
cugggucccaauagcuuuuguu

SEQ ID NO: 287735 - RNA, 19 nt, Human
uuucuuuuccccucagcac

SEQ ID NO: 287736 - RNA, 22 nt, Human
gagagcacggucuugggcaugg

SEQ ID NO: 287737 - RNA, 22 nt, Human
acaagauuuuaugacucuuuuu

SEQ ID NO: 287738 - RNA, 22 nt, Human
aggccaggguagggcccauugu

SEQ ID NO: 287739 - RNA, 22 nt, Human
ccuugcucaucccccagugccu

SEQ ID NO: 287740 - RNA, 22 nt, Human
ucugaaauaggaaagcaaaugg

SEQ ID NO: 287741 - RNA, 22 nt, Human
uccaaggaggcuuugacgucca

SEQ ID NO: 287742 - RNA, 22 nt, Human
uguuugcucugacuaucuugcg

SEQ ID NO: 287743 - RNA, 22 nt, Human
auuugcuggugaauguauagcu

SEQ ID NO: 287744 - RNA, 22 nt, Human
cauguuaacuaagauuaacuau

SEQ ID NO: 287745 - RNA, 22 nt, Human
ucucuucacaugcuugcuccaa

SEQ ID NO: 287746 - RNA, 22 nt, Human
ccccacagcuuguggagagaau

SEQ ID NO: 287747 - RNA, 22 nt, Human
ucuguacaguaccagauaguaa

SEQ ID NO: 287748 - RNA, 22 nt, Human
acaaauauuuacugaauccacu

SEQ ID NO: 287749 - RNA, 21 nt, Human
uucuggguuguuaaucugaac

SEQ ID NO: 287750 - RNA, 20 nt, Human
cugagcccagaucccagguc

SEQ ID NO: 287751 - RNA, 22 nt, Human
cauagaauggauugacaagauu

SEQ ID NO: 287752 - RNA, 22 nt, Human
cauuuguaucugggcugcugug

SEQ ID NO: 287753 - RNA, 22 nt, Human
uccugagcuacaguaguaugau

SEQ ID NO: 287754 - RNA, 22 nt, Human
cccugagagugagugccaccuu

SEQ ID NO: 287755 - RNA, 22 nt, Human
gggaacuugccccagaggaauu

SEQ ID NO: 287756 - RNA, 22 nt, Human
cagugcagaggugcaagcaugu

SEQ ID NO: 287757 - RNA, 22 nt, Human
uuuguauaagaacauucuagca

SEQ ID NO: 287758 - RNA, 22 nt, Human
uugguaaauacucuuuggagac

SEQ ID NO: 287759 - RNA, 19 nt, Human
uucacaauuaugaaauuag

SEQ ID NO: 287760 - RNA, 22 nt, Human
uauuucaucuggaacaagguaa

SEQ ID NO: 287761 - RNA, 22 nt, Human
cugccguguuuuucauguuaaa

SEQ ID NO: 287762 - RNA, 22 nt, Human
ugucucaguucccuucucugga

SEQ ID NO: 287763 - RNA, 22 nt, Human
uauuucugaauccaaaagguca

SEQ ID NO: 287764 - RNA, 22 nt, Human
ugaaauguagauuaggcauucu

SEQ ID NO: 287765 - RNA, 22 nt, Human
cuauuagguaugugguugcuau

SEQ ID NO: 287766 - RNA, 22 nt, Human
uuccuacagcccugaaucucua

SEQ ID NO: 287767 - RNA, 22 nt, Human
uugccauuaaaacauguuaucu

SEQ ID NO: 287768 - RNA, 22 nt, Human
aagccuugauucacucugugga

SEQ ID NO: 287769 - RNA, 22 nt, Human
uaaaguagcaaguuuagacuga

SEQ ID NO: 287770 - RNA, 22 nt, Human
uuagauaauguagagauaugag

SEQ ID NO: 287771 - RNA, 21 nt, Human
ggcuuuaugcucacccagccu

SEQ ID NO: 287772 - RNA, 22 nt, Human
ucucagguaaaaggguaucuac

SEQ ID NO: 287773 - RNA, 22 nt, Human
cuccuggcucucuguuuagugu

SEQ ID NO: 287774 - RNA, 22 nt, Human
ugcuuagacgucaaguacagcc

SEQ ID NO: 287775 - RNA, 22 nt, Human
caaacuuacguagucuuacuac

SEQ ID NO: 287776 - RNA, 22 nt, Human
aagagcacuaacagagcugaua

SEQ ID NO: 287777 - RNA, 22 nt, Human
agcaggugggcaugaaagcuga

SEQ ID NO: 287778 - RNA, 22 nt, Human
uuaaagcuagguggaacaaauu

SEQ ID NO: 287779 - RNA, 22 nt, Human
gucuggaaauuuaagguaugag

SEQ ID NO: 287780 - RNA, 22 nt, Human
guuacaaagcacuucaagugaa

SEQ ID NO: 287781 - RNA, 22 nt, Human
guggaggacaaaagaagccuuu

SEQ ID NO: 287782 - RNA, 22 nt, Human
uugccuuacugcauucaguaaa

SEQ ID NO: 287783 - RNA, 22 nt, Human
gugaggcagcaggagccucugu

SEQ ID NO: 287784 - RNA, 22 nt, Human
cuggguuuuauuacagugagcu

SEQ ID NO: 287785 - RNA, 22 nt, Human
acauucuuccagcuggcuguug

SEQ ID NO: 287786 - RNA, 22 nt, Human
ccacccagccagaugcaggaag

SEQ ID NO: 287787 - RNA, 22 nt, Human
uuauccaacaugacuuaugucc

SEQ ID NO: 287788 - RNA, 22 nt, Human
cacccagccuucacacaggagu

SEQ ID NO: 287789 - RNA, 20 nt, Human
aggagcugaauuagaggguu

SEQ ID NO: 287790 - RNA, 22 nt, Human
uaaaagcucuucuguugaguua

SEQ ID NO: 287791 - RNA, 22 nt, Human
gaaaggcaucuucagucucuga

SEQ ID NO: 287792 - RNA, 22 nt, Human
agaggacacaucuuuccucaaa

SEQ ID NO: 287793 - RNA, 22 nt, Human
ugucucaguauacgaaacacuu

SEQ ID NO: 287794 - RNA, 22 nt, Human
ugguaugaccguggugcaagca

SEQ ID NO: 287795 - RNA, 22 nt, Human
aggcucuguaugaagguuuggg

SEQ ID NO: 287796 - RNA, 22 nt, Human
aguggcuugcucugccucagcc

SEQ ID NO: 287797 - RNA, 22 nt, Human
guauauaugugugaacauguau

SEQ ID NO: 287798 - RNA, 22 nt, Human
uguguccucauguggcagagag

SEQ ID NO: 287799 - RNA, 22 nt, Human
ucagugugaggucuuccacccg

SEQ ID NO: 287800 - RNA, 22 nt, Human
acagugcaggucucaacaauua

SEQ ID NO: 287801 - RNA, 22 nt, Human
gugcaugguaagaugcuucaca

SEQ ID NO: 287802 - RNA, 21 nt, Human
aagcuguguuccacugauagc

SEQ ID NO: 287803 - RNA, 22 nt, Human
guacuacaguuucucauuaaau

SEQ ID NO: 287804 - RNA, 22 nt, Human
agaggccucuguuguucagacg

SEQ ID NO: 287805 - RNA, 22 nt, Human
cugaaaauguuacacaggaaga

SEQ ID NO: 287806 - RNA, 22 nt, Human
uacaacauuguguugcuucaua

SEQ ID NO: 287807 - RNA, 22 nt, Human
aaggaagggaaauagugauguc

SEQ ID NO: 287808 - RNA, 22 nt, Human
acagguguagcaggagcaucaa

SEQ ID NO: 287809 - RNA, 20 nt, Human
ccuguggcucuuguaauuca

SEQ ID NO: 287810 - RNA, 22 nt, Human
augucacuccagggacacaggu

SEQ ID NO: 287811 - RNA, 22 nt, Human
guguccugggcauuaggcuuag

SEQ ID NO: 287812 - RNA, 22 nt, Human
ggaggccagccugaggcugagg

SEQ ID NO: 287813 - RNA, 21 nt, Human
uuguguuuccccagucacuuu

SEQ ID NO: 287814 - RNA, 22 nt, Human
aguacaaacuguuucaaaguag

SEQ ID NO: 287815 - RNA, 19 nt, Human
uagcugauagcuacuuuau

SEQ ID NO: 287816 - RNA, 22 nt, Human
agcuccaggugcaagucauggu

SEQ ID NO: 287817 - RNA, 19 nt, Human
uacaagcuuaaaguaaugu

SEQ ID NO: 287818 - RNA, 22 nt, Human
cugagcccuggcucgccuggag

SEQ ID NO: 287819 - RNA, 22 nt, Human
caguauuuauggcuugaguauu

SEQ ID NO: 287820 - RNA, 19 nt, Human
gggagcugaggucuuuggu

SEQ ID NO: 287821 - RNA, 22 nt, Human
gggaggugauggcaagcagcgg

SEQ ID NO: 287822 - RNA, 22 nt, Human
gaggccuggcucugcccuccug

SEQ ID NO: 287823 - RNA, 22 nt, Human
uucuggaucugagggggaagau

SEQ ID NO: 287824 - RNA, 22 nt, Human
gcuuuuggccagauggggaaac

SEQ ID NO: 287825 - RNA, 22 nt, Human
aauugcuucauuaacauuuagg

SEQ ID NO: 287826 - RNA, 22 nt, Human
ccuggaucagucacuguugcug

SEQ ID NO: 287827 - RNA, 22 nt, Human
ucccugccugacagcacccacc

SEQ ID NO: 287828 - RNA, 22 nt, Human
ggagcugagguaacagugagug

SEQ ID NO: 287829 - RNA, 22 nt, Human
uuauuccagcuaagaguccugg

SEQ ID NO: 287830 - RNA, 22 nt, Human
uagggcucgggcacaggacagg

SEQ ID NO: 287831 - RNA, 22 nt, Human
ucaggcccuuugcugcugcccc

SEQ ID NO: 287832 - RNA, 22 nt, Human
ugucagagcaaggccaggccag

SEQ ID NO: 287833 - RNA, 22 nt, Human
uacauguggaguuuucuaguca

SEQ ID NO: 287834 - RNA, 22 nt, Human
gcuaaugacugaguuuuuagca

SEQ ID NO: 287835 - RNA, 22 nt, Human
uagcuauuguugguaguuaccc

SEQ ID NO: 287836 - RNA, 22 nt, Human
ccccagggucaguguguggagg

SEQ ID NO: 287837 - RNA, 22 nt, Human
uagcugacagauacaaucagau

SEQ ID NO: 287838 - RNA, 22 nt, Human
uugcugauucaugauuugagaa

SEQ ID NO: 287839 - RNA, 22 nt, Human
auauuaggaguuaaauguauua

SEQ ID NO: 287840 - RNA, 22 nt, Human
aacuuucuuggaugucucaaca

SEQ ID NO: 287841 - RNA, 22 nt, Human
ucauguuuguuggaaauguggc

SEQ ID NO: 287842 - RNA, 22 nt, Human
uguaaaauaccauuccuuguca

SEQ ID NO: 287843 - RNA, 22 nt, Human
ucugauuagagcauucuugagu

SEQ ID NO: 287844 - RNA, 19 nt, Human
auucuucagcagugagacc

SEQ ID NO: 287845 - RNA, 22 nt, Human
gagacacaggcacagaagaggc

SEQ ID NO: 287846 - RNA, 19 nt, Human
aaaauugcguauuuugagg

SEQ ID NO: 287847 - RNA, 22 nt, Human
uggcaaggcugugggggcagag

SEQ ID NO: 287848 - RNA, 22 nt, Human
aagacauguuuuaagaauauuu

SEQ ID NO: 287849 - RNA, 22 nt, Human
uuccacuuuucucucucaugcc

SEQ ID NO: 287850 - RNA, 22 nt, Human
uauuugaaaguguacaaaaacu

SEQ ID NO: 287851 - RNA, 22 nt, Human
cagaugaaguaggugacgagca

SEQ ID NO: 287852 - RNA, 22 nt, Human
ggguggagcuuggacaccagua

SEQ ID NO: 287853 - RNA, 22 nt, Human
uggcugcugcagacagacagga

SEQ ID NO: 287854 - RNA, 22 nt, Human
gcaugugugagaccuuuuagca

SEQ ID NO: 287855 - RNA, 22 nt, Human
gauaaauugcacuuuuucuuac

SEQ ID NO: 287856 - RNA, 21 nt, Human
uucaacaaagggaauaaguuu

SEQ ID NO: 287857 - RNA, 22 nt, Human
ggcagagguagcuggaaccagg

SEQ ID NO: 287858 - RNA, 22 nt, Human
auaugaaaauguuuuagcugua

SEQ ID NO: 287859 - RNA, 16 nt, Human
ucagggcagaauggca

SEQ ID NO: 287860 - RNA, 17 nt, Human
acaggcagaucaccuga

SEQ ID NO: 287861 - RNA, 22 nt, Human
gugacccagguagguaagcaau

SEQ ID NO: 287862 - RNA, 22 nt, Human
uacauucagcaaaagaaugguu

SEQ ID NO: 287863 - RNA, 22 nt, Human
auggccugaugcaccuguccca

SEQ ID NO: 287864 - RNA, 23 nt, Human
ccugugacacuguuugugguaag

SEQ ID NO: 287865 - RNA, 22 nt, Human
ccagggcacguugggacaguac

SEQ ID NO: 287866 - RNA, 22 nt, Human
gggaacacuccagggcuuggaa

SEQ ID NO: 287867 - RNA, 22 nt, Human
ugccagcacuucuggcugucug

SEQ ID NO: 287868 - RNA, 22 nt, Human
aucucacagaggcccaccagga

SEQ ID NO: 287869 - RNA, 22 nt, Human
acacacagguaaaggagccugg

SEQ ID NO: 287870 - RNA, 22 nt, Human
uuuagggaaauugaggguuaag

SEQ ID NO: 287871 - RNA, 22 nt, Human
aaacaugaauagauauuaaaca

SEQ ID NO: 287872 - RNA, 22 nt, Human
gacuguggggggcggacacaag

SEQ ID NO: 287873 - RNA, 22 nt, Human
cccuccucaacucuggcuucca

SEQ ID NO: 287874 - RNA, 22 nt, Human
gucaggcagccuggagauucag

SEQ ID NO: 287875 - RNA, 22 nt, Human
accucacaagucucugucagcu

SEQ ID NO: 287876 - RNA, 22 nt, Human
uucuaucauacuugaauacauu

SEQ ID NO: 287877 - RNA, 22 nt, Human
uucagaaaggauaauuggaagg

SEQ ID NO: 287878 - RNA, 22 nt, Human
gugggugugagugacggcgucc

SEQ ID NO: 287879 - RNA, 22 nt, Human
cucaaaaugguuaauuuuaaua

SEQ ID NO: 287880 - RNA, 22 nt, Human
gaaucaaugguagauuaaguaa

SEQ ID NO: 287881 - RNA, 22 nt, Human
augaaauugaucuugaacuuuu

SEQ ID NO: 287882 - RNA, 22 nt, Human
aaagcagaacugagagagcugg

SEQ ID NO: 287883 - RNA, 22 nt, Human
ccagggcagugggagaaggugc

SEQ ID NO: 287884 - RNA, 22 nt, Human
uuccugagaacauggcagcuua

SEQ ID NO: 287885 - RNA, 22 nt, Human
gcagucuauaaaucagcuuugc

SEQ ID NO: 287886 - RNA, 22 nt, Human
guggcagguuccguagacagca

SEQ ID NO: 287887 - RNA, 22 nt, Human
agcuggagcuucaagcagguaa

SEQ ID NO: 287888 - RNA, 22 nt, Human
uugugcagaguugccuuuauuu

SEQ ID NO: 287889 - RNA, 22 nt, Human
auccaaaaccagugcauuuucc

SEQ ID NO: 287890 - RNA, 22 nt, Human
gacuuuggcaucuagacauugu

SEQ ID NO: 287891 - RNA, 22 nt, Human
gcaaaugaagguggugcuacag

SEQ ID NO: 287892 - RNA, 22 nt, Human
gccugcagccucaagggcugag

SEQ ID NO: 287893 - RNA, 22 nt, Human
aauuuucacagugcugugagau

SEQ ID NO: 287894 - RNA, 22 nt, Human
acauucaagaugcauucacuua

SEQ ID NO: 287895 - RNA, 23 nt, Human
agcuucauugaccuccgcagggg

SEQ ID NO: 287896 - RNA, 22 nt, Human
uaauaauuaacagugauggguc

SEQ ID NO: 287897 - RNA, 22 nt, Human
aaaugcuacacaggaauucuca

SEQ ID NO: 287898 - RNA, 22 nt, Human
ucaucaguguccuuaucacuua

SEQ ID NO: 287899 - RNA, 21 nt, Human
uagggcaggcauuggaagaga

SEQ ID NO: 287900 - RNA, 22 nt, Human
caggcagaaauuuuguuucauu

SEQ ID NO: 287901 - RNA, 22 nt, Human
aacuggaaccuuuuauucaguc

SEQ ID NO: 287902 - RNA, 22 nt, Human
gauaccagacagggagggagaa

SEQ ID NO: 287903 - RNA, 22 nt, Human
ugcuggagaccugcuugcacca

SEQ ID NO: 287904 - RNA, 21 nt, Human
uucagcaguccucuagagaua

SEQ ID NO: 287905 - RNA, 22 nt, Human
gagcuuuaccuuagguucuguu

SEQ ID NO: 287906 - RNA, 22 nt, Human
cauguugaauggccuugauuuu

SEQ ID NO: 287907 - RNA, 22 nt, Human
cuauuuuccgcagcaggaagua

SEQ ID NO: 287908 - RNA, 19 nt, Human
uuccaaaaucaggauuuga

SEQ ID NO: 287909 - RNA, 22 nt, Human
agccggccauguggucuugugc

SEQ ID NO: 287910 - RNA, 22 nt, Human
aggcuguguggucaugguggcu

SEQ ID NO: 287911 - RNA, 22 nt, Human
ccaaggcugagguuuccaguug

SEQ ID NO: 287912 - RNA, 22 nt, Human
agcaccuccuuagcuaugacca

SEQ ID NO: 287913 - RNA, 22 nt, Human
gcuccaggugucccagguaaaa

SEQ ID NO: 287914 - RNA, 21 nt, Human
ucuggcaggcacgggcccagc

SEQ ID NO: 287915 - RNA, 22 nt, Human
uuucaaagucaauaucauuacc

SEQ ID NO: 287916 - RNA, 22 nt, Human
uucaugaauggaaucaaugcuc

SEQ ID NO: 287917 - RNA, 22 nt, Human
ucauuuuuuuccgguaggaaua

SEQ ID NO: 287918 - RNA, 22 nt, Human
ugugugucagagucuccauggu

SEQ ID NO: 287919 - RNA, 22 nt, Human
uucaauaucucuaagaaugagg

SEQ ID NO: 287920 - RNA, 22 nt, Human
ccaggccuuccaguacgcagaa

SEQ ID NO: 287921 - RNA, 22 nt, Human
ccauuugugcuucuucaaagca

SEQ ID NO: 287922 - RNA, 22 nt, Human
uggcacagagggacccagcagc

SEQ ID NO: 287923 - RNA, 23 nt, Human
cauggaaaacugaaagcugaccu

SEQ ID NO: 287924 - RNA, 22 nt, Human
aggcaggggagcuggaagggua

SEQ ID NO: 287925 - RNA, 22 nt, Human
cagacaggcaggugcugcuuug

SEQ ID NO: 287926 - RNA, 22 nt, Human
gacccaggcccaaggcugccag

SEQ ID NO: 287927 - RNA, 22 nt, Human
uuccagugacuaagcuucugcu

SEQ ID NO: 287928 - RNA, 22 nt, Human
uuucauugagacuauagacauc

SEQ ID NO: 287929 - RNA, 22 nt, Human
uguguccuuucuaaugcccaga

SEQ ID NO: 287930 - RNA, 22 nt, Human
gauccugugcauggggugaugg

SEQ ID NO: 287931 - RNA, 22 nt, Human
acagccagguaaaggcauggca

SEQ ID NO: 287932 - RNA, 22 nt, Human
aaacuucauggauaauauaaag

SEQ ID NO: 287933 - RNA, 22 nt, Human
uccugcagagacagaggccuca

SEQ ID NO: 287934 - RNA, 22 nt, Human
uucuucaaagaugucuguugga

SEQ ID NO: 287935 - RNA, 22 nt, Human
gggaccugaggagggguuucag

SEQ ID NO: 287936 - RNA, 22 nt, Human
gaaggccuagggaugcucugcg

SEQ ID NO: 287937 - RNA, 22 nt, Human
agguuaaaaaggauucaguuaa

SEQ ID NO: 287938 - RNA, 22 nt, Human
gagggaccuuuacacagacauu

SEQ ID NO: 287939 - RNA, 22 nt, Human
gaggugucaucaggcagcucug

SEQ ID NO: 287940 - RNA, 22 nt, Human
uuuaucugagcugauagauagu

SEQ ID NO: 287941 - RNA, 22 nt, Human
uugacacaguuuucucauuaag

SEQ ID NO: 287942 - RNA, 22 nt, Human
uacaugugauaaauugauuaaa

SEQ ID NO: 287943 - RNA, 22 nt, Human
uagucaguugggucuaguggca

SEQ ID NO: 287944 - RNA, 22 nt, Human
ggccagccuggggcucccagac

SEQ ID NO: 287945 - RNA, 22 nt, Human
ccauccugaauggucucagcca

SEQ ID NO: 287946 - RNA, 22 nt, Human
gcagcuuucuuuuugcaugucu

SEQ ID NO: 287947 - RNA, 17 nt, Human
cagcuuuaugcuacugu

SEQ ID NO: 287948 - RNA, 22 nt, Human
ugcuuuauaucucucuucuuag

SEQ ID NO: 287949 - RNA, 22 nt, Human
aaauuucaagcaaaguagcuau

SEQ ID NO: 287950 - RNA, 22 nt, Human
aggagcaaaugaugagacagca

SEQ ID NO: 287951 - RNA, 22 nt, Human
cuuguccuuuacuugagacuca

SEQ ID NO: 287952 - RNA, 22 nt, Human
cgacccuacagacagugcugag

SEQ ID NO: 287953 - RNA, 22 nt, Human
ucacugugcucucuagauaggc

SEQ ID NO: 287954 - RNA, 22 nt, Human
uuaugauuugccacagauuggu

SEQ ID NO: 287955 - RNA, 22 nt, Human
auaacauuuugacaacugguga

SEQ ID NO: 287956 - RNA, 22 nt, Human
uagaaacagaaaacuguaauag

SEQ ID NO: 287957 - RNA, 22 nt, Human
uguccuggugcuucuugggauu

SEQ ID NO: 287958 - RNA, 22 nt, Human
uacagugcaaugugauguagau

SEQ ID NO: 287959 - RNA, 22 nt, Human
gacagacauuuccugauccaau

SEQ ID NO: 287960 - RNA, 22 nt, Human
acagggcaaccucugggagacu

SEQ ID NO: 287961 - RNA, 22 nt, Human
cacaaggagguccugaggaagc

SEQ ID NO: 287962 - RNA, 22 nt, Human
aggugucuggauggguguccuu

SEQ ID NO: 287963 - RNA, 22 nt, Human
cuuccugggcaauguucugcuu

SEQ ID NO: 287964 - RNA, 22 nt, Human
aaauuucuaagucaagaagaac

SEQ ID NO: 287965 - RNA, 22 nt, Human
guuuauuauucaacuucauguu

SEQ ID NO: 287966 - RNA, 22 nt, Human
uagggaugaagaugguauuucu

SEQ ID NO: 287967 - RNA, 23 nt, Human
caggacaugggaggaaguauggc

SEQ ID NO: 287968 - RNA, 22 nt, Human
uuaaauuuuagaaacagacucu

SEQ ID NO: 287969 - RNA, 22 nt, Human
uggucugguuauuucuuaauga

SEQ ID NO: 287970 - RNA, 22 nt, Human
aaucucuuuggcucaaggaucc

SEQ ID NO: 287971 - RNA, 22 nt, Human
cuguggaaaauuuguauguaau

SEQ ID NO: 287972 - RNA, 22 nt, Human
aaaagugaugggauggcacuuc

SEQ ID NO: 287973 - RNA, 22 nt, Human
augauugcagcccuacagcugu

SEQ ID NO: 287974 - RNA, 22 nt, Human
ccuucccaggcuagaccaacau

SEQ ID NO: 287975 - RNA, 22 nt, Human
auguaauuugcccucaaguuaa

SEQ ID NO: 287976 - RNA, 22 nt, Human
ucugaaauacugcagguucucu

SEQ ID NO: 287977 - RNA, 22 nt, Human
auacacauguguaugugcaugc

SEQ ID NO: 287978 - RNA, 22 nt, Human
acacagcuucaaagucuaauuc

SEQ ID NO: 287979 - RNA, 22 nt, Human
aguauuugaucagaugauagua

SEQ ID NO: 287980 - RNA, 22 nt, Human
aaguguuuaacggugauugagc

SEQ ID NO: 287981 - RNA, 22 nt, Human
gguguccuuguccuuugguacc

SEQ ID NO: 287982 - RNA, 22 nt, Human
ggcucccaggagggccuggagg

SEQ ID NO: 287983 - RNA, 22 nt, Human
ucugcauauuguuaauggaaug

SEQ ID NO: 287984 - RNA, 22 nt, Human
aaauauaguaaaugcauaguuc

SEQ ID NO: 287985 - RNA, 22 nt, Human
cugagcaggauauucacagcag

SEQ ID NO: 287986 - RNA, 22 nt, Human
uauuuguagaauggauuaaggg

SEQ ID NO: 287987 - RNA, 22 nt, Human
ugcuuucauauugccuaugacu

SEQ ID NO: 287988 - RNA, 22 nt, Human
agcgugaauuaguugguacaca

SEQ ID NO: 287989 - RNA, 22 nt, Human
cugaggaguuggugaauaagcc

SEQ ID NO: 287990 - RNA, 22 nt, Human
ucccugaugccuugauccgugg

SEQ ID NO: 287991 - RNA, 22 nt, Human
gaaaauuauugaaaauggcucu

SEQ ID NO: 287992 - RNA, 22 nt, Human
agcucccauuaucuucugaaac

SEQ ID NO: 287993 - RNA, 22 nt, Human
caaauaguaugagcaaugauuc

SEQ ID NO: 287994 - RNA, 22 nt, Human
gcuggaggauggacuggaagaa

SEQ ID NO: 287995 - RNA, 17 nt, Human
uuucuggaaugggcaaa

SEQ ID NO: 287996 - RNA, 22 nt, Human
uaagcaaugcuguaguucaguc

SEQ ID NO: 287997 - RNA, 22 nt, Human
uaguuuuuacugcgaguuauaa

SEQ ID NO: 287998 - RNA, 19 nt, Human
auucuuguuaagugucauc

SEQ ID NO: 287999 - RNA, 21 nt, Human
cuggacugaggagacagucgc

SEQ ID NO: 288000 - RNA, 22 nt, Human
uagcuauuuggaaaauuccaau

SEQ ID NO: 288001 - RNA, 22 nt, Human
ugauuauauucuaacuucauaa

SEQ ID NO: 288002 - RNA, 22 nt, Human
uauuuccaccuauuauuuucug

SEQ ID NO: 288003 - RNA, 22 nt, Human
uuucauugucaauaaacuguau

SEQ ID NO: 288004 - RNA, 22 nt, Human
acaugacagugcuuagcaaacu

SEQ ID NO: 288005 - RNA, 22 nt, Human
cuguccugaaguuuucaugaga

SEQ ID NO: 288006 - RNA, 22 nt, Human
gccaggcucuugguuauguuuu

SEQ ID NO: 288007 - RNA, 22 nt, Human
aggcuuagaaauucagcugagu

SEQ ID NO: 288008 - RNA, 22 nt, Human
aauugcuuguuuucggucauaa

SEQ ID NO: 288009 - RNA, 22 nt, Human
auuauuauauagggaaaguccc

SEQ ID NO: 288010 - RNA, 22 nt, Human
uuccuggccccauccaucuuca

SEQ ID NO: 288011 - RNA, 22 nt, Human
ugccugggaucugugcccuuug

SEQ ID NO: 288012 - RNA, 17 nt, Human
ggaagaaaaggaucauc

SEQ ID NO: 288013 - RNA, 22 nt, Human
agguggggaguauauguaauug

SEQ ID NO: 288014 - RNA, 22 nt, Human
cucugcccucgcacaucugcca

SEQ ID NO: 288015 - RNA, 22 nt, Human
aagggcucugugcuugucccau

SEQ ID NO: 288016 - RNA, 22 nt, Human
uuccccaggcuggagugcagug

SEQ ID NO: 288017 - RNA, 22 nt, Human
agaaagcaucuccauuguaggu

SEQ ID NO: 288018 - RNA, 22 nt, Human
agcuuuauagaaaggaucagug

SEQ ID NO: 288019 - RNA, 22 nt, Human
aaagcuaccuuuguguucauag

SEQ ID NO: 288020 - RNA, 22 nt, Human
ucuucaaacugaaaauuuagaa

SEQ ID NO: 288021 - RNA, 22 nt, Human
aaguaacaucugaacaugaugu

SEQ ID NO: 288022 - RNA, 20 nt, Human
agugucuggauuuuguaacc

SEQ ID NO: 288023 - RNA, 22 nt, Human
aauaucuucuaaggauagaacu

SEQ ID NO: 288024 - RNA, 22 nt, Human
cuucauuaaugucuauaaguuu

SEQ ID NO: 288025 - RNA, 22 nt, Human
ccaaggagaaaugcugugcuuu

SEQ ID NO: 288026 - RNA, 22 nt, Human
gucccaggugggcuccaccucu

SEQ ID NO: 288027 - RNA, 22 nt, Human
ugcuuucagauaucuguuucaa

SEQ ID NO: 288028 - RNA, 22 nt, Human
acaguuuggcgugauugauagu

SEQ ID NO: 288029 - RNA, 22 nt, Human
agacagacauucuagagccacc

SEQ ID NO: 288030 - RNA, 22 nt, Human
aagcugauucuaaaauuuauua

SEQ ID NO: 288031 - RNA, 22 nt, Human
aucaaaaugcuccagugauggu

SEQ ID NO: 288032 - RNA, 19 nt, Human
uucacauuuuuguggcacu

SEQ ID NO: 288033 - RNA, 22 nt, Human
auaguacacauccuacaauguu

SEQ ID NO: 288034 - RNA, 22 nt, Human
auucacaugugcuucuuaucac

SEQ ID NO: 288035 - RNA, 22 nt, Human
cuuaauuuuuguaguagaugga

SEQ ID NO: 288036 - RNA, 22 nt, Human
agggccagccgacuuccagccu

SEQ ID NO: 288037 - RNA, 22 nt, Human
auuuaaaugcuuaagaggguuu

SEQ ID NO: 288038 - RNA, 22 nt, Human
uuucaaacauaucuucauuacu

SEQ ID NO: 288039 - RNA, 22 nt, Human
gagggauggugugagaggcuca

SEQ ID NO: 288040 - RNA, 22 nt, Human
uuuauauuguaaaaaugguucu

SEQ ID NO: 288041 - RNA, 22 nt, Human
uucccucuccaggagcccugag

SEQ ID NO: 288042 - RNA, 23 nt, Human
agacagaggcugaggcuggccgc

SEQ ID NO: 288043 - RNA, 22 nt, Human
ccugaccuauuuuucucagcug

SEQ ID NO: 288044 - RNA, 22 nt, Human
aggcaguguauugcuagcggcu

SEQ ID NO: 288045 - RNA, 22 nt, Human
aaacuugaggcaaugaaggugu

SEQ ID NO: 288046 - RNA, 17 nt, Human
agccugccccaugcugc

SEQ ID NO: 288047 - RNA, 22 nt, Human
cagaggaaaugggaaggagaua

SEQ ID NO: 288048 - RNA, 22 nt, Human
uuuaaauuuagaagaaacacug

SEQ ID NO: 288049 - RNA, 22 nt, Human
uuucccaggcuggaaugcagug

SEQ ID NO: 288050 - RNA, 22 nt, Human
ugcuuuauaggggauugcaggc

SEQ ID NO: 288051 - RNA, 22 nt, Human
aggaccuggaucacagagaucu

SEQ ID NO: 288052 - RNA, 22 nt, Human
gugcagggcagccgaaugggcu

SEQ ID NO: 288053 - RNA, 22 nt, Human
caucuaaauuugacuccaagga

SEQ ID NO: 288054 - RNA, 22 nt, Human
cacaugugcaaauacugaggcu

SEQ ID NO: 288055 - RNA, 22 nt, Human
gaauacaugauacaugaacugc

SEQ ID NO: 288056 - RNA, 22 nt, Human
ucuuucuugguauucugagcua

SEQ ID NO: 288057 - RNA, 22 nt, Human
auucuucauuguugauucaugu

SEQ ID NO: 288058 - RNA, 22 nt, Human
guccuggcugguucuguggggc

SEQ ID NO: 288059 - RNA, 22 nt, Human
cagagcagggguuucccagguu

SEQ ID NO: 288060 - RNA, 22 nt, Human
uaguccuugcugggcacagagu

SEQ ID NO: 288061 - RNA, 23 nt, Human
acugaaaggauccuagcagagac

SEQ ID NO: 288062 - RNA, 22 nt, Human
guguccugggucucugauucuu

SEQ ID NO: 288063 - RNA, 22 nt, Human
gaucugaaauagcuacugcaga

SEQ ID NO: 288064 - RNA, 22 nt, Human
ucuggcuccacaccucacugca

SEQ ID NO: 288065 - RNA, 22 nt, Human
aggaauguaauaguguggcuca

SEQ ID NO: 288066 - RNA, 22 nt, Human
aacaaaggccguuaauaaccac

SEQ ID NO: 288067 - RNA, 22 nt, Human
aacuuaggaaaauaaggcauga

SEQ ID NO: 288068 - RNA, 22 nt, Human
uucaguuucuucccugugaaau

SEQ ID NO: 288069 - RNA, 22 nt, Human
gcucucagaugcuccagcagcc

SEQ ID NO: 288070 - RNA, 22 nt, Human
ucuucaaagaauuuuaguaauu

SEQ ID NO: 288071 - RNA, 22 nt, Human
uccuggcccuguggccugcagu

SEQ ID NO: 288072 - RNA, 22 nt, Human
ucccagggacucucugccuucc

SEQ ID NO: 288073 - RNA, 22 nt, Human
guuuccaaccccaccaaagugc

SEQ ID NO: 288074 - RNA, 22 nt, Human
cagguucucagaaggcagucac

SEQ ID NO: 288075 - RNA, 22 nt, Human
uucuucaaaacaacacuggccu

SEQ ID NO: 288076 - RNA, 22 nt, Human
gcauucuugagguguggacuca

SEQ ID NO: 288077 - RNA, 22 nt, Human
uagucagucuuacauauuugaa

SEQ ID NO: 288078 - RNA, 22 nt, Human
cucucagugccugcccuaggcu

SEQ ID NO: 288079 - RNA, 22 nt, Human
aggcaguggagcuggaauaggc

SEQ ID NO: 288080 - RNA, 23 nt, Human
aaugauuucaugaugauagcagc

SEQ ID NO: 288081 - RNA, 22 nt, Human
ucacuuuacagaugggaaaacu

SEQ ID NO: 288082 - RNA, 22 nt, Human
ucaggcaccccuugaguagggg

SEQ ID NO: 288083 - RNA, 22 nt, Human
ggagagguguauucaguggguc

SEQ ID NO: 288084 - RNA, 22 nt, Human
guguguccacacauacauacau

SEQ ID NO: 288085 - RNA, 22 nt, Human
ugcuuucauugugauaggaagc

SEQ ID NO: 288086 - RNA, 22 nt, Human
aauguuuuagauuacugcuggg

SEQ ID NO: 288087 - RNA, 22 nt, Human
caacagaagguguacuacugaa

SEQ ID NO: 288088 - RNA, 22 nt, Human
gucacacucuucccuccacaug

SEQ ID NO: 288089 - RNA, 22 nt, Human
agccucuggcccuagacugcuu

SEQ ID NO: 288090 - RNA, 22 nt, Human
uccaugagacagauacuguaag

SEQ ID NO: 288091 - RNA, 22 nt, Human
uuccucagcucagcgagagaga

SEQ ID NO: 288092 - RNA, 22 nt, Human
ucagggcaggacaguguaggcc

SEQ ID NO: 288093 - RNA, 22 nt, Human
aaggccuugguucugagcaaua

SEQ ID NO: 288094 - RNA, 22 nt, Human
caagauuuaagagucagccuug

SEQ ID NO: 288095 - RNA, 22 nt, Human
ccuuccagaguucagucugccc

SEQ ID NO: 288096 - RNA, 22 nt, Human
uuucuguaaggacuuaaugcaa

SEQ ID NO: 288097 - RNA, 22 nt, Human
ucagcuuugggggucucaggag

SEQ ID NO: 288098 - RNA, 22 nt, Human
uguuuacugcauucuauuugcu

SEQ ID NO: 288099 - RNA, 22 nt, Human
cucuccaggacuuuggcccaau

SEQ ID NO: 288100 - RNA, 21 nt, Human
ugagucucccuuagcccacgc

SEQ ID NO: 288101 - RNA, 22 nt, Human
gccuggcacucaaucaucugcu

SEQ ID NO: 288102 - RNA, 22 nt, Human
uccuggcuccugaucugucacu

SEQ ID NO: 288103 - RNA, 22 nt, Human
cucugugaaccccuccuuucuu

SEQ ID NO: 288104 - RNA, 22 nt, Human
cugcagggaccacaagcagguu

SEQ ID NO: 288105 - RNA, 22 nt, Human
agacagguaaauagagaugcug

SEQ ID NO: 288106 - RNA, 22 nt, Human
acagcuuuucaauucugcugag

SEQ ID NO: 288107 - RNA, 18 nt, Human
auugcuuuuguaccaacc

SEQ ID NO: 288108 - RNA, 22 nt, Human
uuuuuguagucauuagaagagg

SEQ ID NO: 288109 - RNA, 22 nt, Human
uccugggcuucacagacucugu

SEQ ID NO: 288110 - RNA, 22 nt, Human
auauuuaaacaggguaccaaua

SEQ ID NO: 288111 - RNA, 22 nt, Human
ccuguggccgcgucgggcggcg

SEQ ID NO: 288112 - RNA, 22 nt, Human
gucucaguaagaaaggcuccug

SEQ ID NO: 288113 - RNA, 22 nt, Human
agagccaguuacaacuguggag

SEQ ID NO: 288114 - RNA, 22 nt, Human
ggcugcucugccuuccagcugg

SEQ ID NO: 288115 - RNA, 22 nt, Human
guuucgucaggcuuauucuauc

SEQ ID NO: 288116 - RNA, 22 nt, Human
ccugcaagaccugagacacacc

SEQ ID NO: 288117 - RNA, 22 nt, Human
uggguggauuaggauaggguau

SEQ ID NO: 288118 - RNA, 20 nt, Human
gcuguggcaagugcucacug

SEQ ID NO: 288119 - RNA, 22 nt, Human
uccaugcagagaacugaaguac

SEQ ID NO: 288120 - RNA, 22 nt, Human
guuuuucuagaaaucuccuccu

SEQ ID NO: 288121 - RNA, 22 nt, Human
acuagaaauuacucagaauaaa

SEQ ID NO: 288122 - RNA, 22 nt, Human
cucaggcuaagaaggccaagug

SEQ ID NO: 288123 - RNA, 22 nt, Human
ccugcuccugcuauucuucugg

SEQ ID NO: 288124 - RNA, 22 nt, Human
cccaggccuggucugggccagu

SEQ ID NO: 288125 - RNA, 20 nt, Human
gcugaggucauuaugccuca

SEQ ID NO: 288126 - RNA, 22 nt, Human
aaagcugcugccaaucaggcuu

SEQ ID NO: 288127 - RNA, 22 nt, Human
ucugggugaugaaaugcacugu

SEQ ID NO: 288128 - RNA, 22 nt, Human
uucauuccugagcccauauuua

SEQ ID NO: 288129 - RNA, 22 nt, Human
acacauauauuugcauauacac

SEQ ID NO: 288130 - RNA, 22 nt, Human
ugcuggaauaauuucauguuaa

SEQ ID NO: 288131 - RNA, 23 nt, Human
ccaauucagauauuggcuugugc

SEQ ID NO: 288132 - RNA, 22 nt, Human
uacacaguagaguauaaugcgu

SEQ ID NO: 288133 - RNA, 22 nt, Human
agagggugggcacgugauggau

SEQ ID NO: 288134 - RNA, 22 nt, Human
auguccuuuguaucccuaggca

SEQ ID NO: 288135 - RNA, 18 nt, Human
aagucucugaaagcuuuu

SEQ ID NO: 288136 - RNA, 22 nt, Human
aagagucagcuucuguaugggu

SEQ ID NO: 288137 - RNA, 22 nt, Human
gcugguccacucccuggaggcu

SEQ ID NO: 288138 - RNA, 22 nt, Human
auccacccugugguggcuuucu

SEQ ID NO: 288139 - RNA, 22 nt, Human
gcuugccuaucugguggucguu

SEQ ID NO: 288140 - RNA, 22 nt, Human
uuaaaaaccaucuuccuuuccu

SEQ ID NO: 288141 - RNA, 22 nt, Human
uagucuaagaaaucuuuacuuu

SEQ ID NO: 288142 - RNA, 22 nt, Human
cacaguuugcauaggaaaaaca

SEQ ID NO: 288143 - RNA, 22 nt, Human
cucagagaaaugucacaacaau

SEQ ID NO: 288144 - RNA, 19 nt, Human
uggcucuguuucucuggag

SEQ ID NO: 288145 - RNA, 20 nt, Human
aggagggaccuggauuggcg

SEQ ID NO: 288146 - RNA, 22 nt, Human
ugaccugcguaggugguuucug

SEQ ID NO: 288147 - RNA, 22 nt, Human
uaauaauuuuaaagaaggcuag

SEQ ID NO: 288148 - RNA, 22 nt, Human
uccuagagaguaauacaguuuu

SEQ ID NO: 288149 - RNA, 22 nt, Human
uaaugucaaggugauagauuug

SEQ ID NO: 288150 - RNA, 22 nt, Human
acucugcuguuuacucucuaua

SEQ ID NO: 288151 - RNA, 21 nt, Human
uuugacuccucauuuuuauau

SEQ ID NO: 288152 - RNA, 22 nt, Human
ccugauuagggucuuucaaaug

SEQ ID NO: 288153 - RNA, 22 nt, Human
ucaguuaauggauucugucaga

SEQ ID NO: 288154 - RNA, 22 nt, Human
gcagggaaggggcaugcuggag

SEQ ID NO: 288155 - RNA, 22 nt, Human
uuaguuguaaaauggaauuugu

SEQ ID NO: 288156 - RNA, 22 nt, Human
cuuuuucugauguuccaugauu

SEQ ID NO: 288157 - RNA, 22 nt, Human
guuguaaguuuaaugucaauug

SEQ ID NO: 288158 - RNA, 22 nt, Human
uaggugguuaugucagccuaga

SEQ ID NO: 288159 - RNA, 22 nt, Human
acaagauuuggcugaaacucca

SEQ ID NO: 288160 - RNA, 22 nt, Human
uucacaguggcugugccauuug

SEQ ID NO: 288161 - RNA, 22 nt, Human
acacaugaccuccgcagcagca

SEQ ID NO: 288162 - RNA, 22 nt, Human
uucugugcccauuuuaaaaugg

SEQ ID NO: 288163 - RNA, 22 nt, Human
ugccuugaacauaguggacagu

SEQ ID NO: 288164 - RNA, 17 nt, Human
ucccaggaacagggaau

SEQ ID NO: 288165 - RNA, 22 nt, Human
ucauguguccuaguucauauaa

SEQ ID NO: 288166 - RNA, 22 nt, Human
aaggcuggcaauauauuuguua

SEQ ID NO: 288167 - RNA, 22 nt, Human
cuguccccauuguuugaggguu

SEQ ID NO: 288168 - RNA, 21 nt, Human
ugucacuuuaagcuagcucua

SEQ ID NO: 288169 - RNA, 22 nt, Human
auuucucaucuuugugaauggu

SEQ ID NO: 288170 - RNA, 22 nt, Human
uguguucagaauuugcugcuuu

SEQ ID NO: 288171 - RNA, 20 nt, Human
ugggugagaguguuugcucu

SEQ ID NO: 288172 - RNA, 22 nt, Human
auucucugaagucuuucagggc

SEQ ID NO: 288173 - RNA, 21 nt, Human
agcuguuugaagcuauauugg

SEQ ID NO: 288174 - RNA, 22 nt, Human
agugucugccugggaggagcau

SEQ ID NO: 288175 - RNA, 22 nt, Human
auagagugauguaagguaugug

SEQ ID NO: 288176 - RNA, 22 nt, Human
ucugcccaguuugugcucaggu

SEQ ID NO: 288177 - RNA, 22 nt, Human
uucuuccucacacucucaccca

SEQ ID NO: 288178 - RNA, 16 nt, Human
ucaggugugacuuuuu

SEQ ID NO: 288179 - RNA, 21 nt, Human
acagacaguccagagaaaaga

SEQ ID NO: 288180 - RNA, 19 nt, Human
ucagggcaguccggucccc

SEQ ID NO: 288181 - RNA, 22 nt, Human
uacaugugguagggagggcagu

SEQ ID NO: 288182 - RNA, 22 nt, Human
guucuucaguaaaauuaaaugu

SEQ ID NO: 288183 - RNA, 22 nt, Human
agacacagcugcaggagguggg

SEQ ID NO: 288184 - RNA, 22 nt, Human
aaacaucauaggcaugcaugau

SEQ ID NO: 288185 - RNA, 22 nt, Human
gccgugcgugcgcaggugcugu

SEQ ID NO: 288186 - RNA, 19 nt, Human
cccagagagaucucuugcc

SEQ ID NO: 288187 - RNA, 22 nt, Human
caauuucuggaacuaauucuga

SEQ ID NO: 288188 - RNA, 22 nt, Human
guuguacaggcagggaaacuga

SEQ ID NO: 288189 - RNA, 22 nt, Human
ucugaaauaaaugcacuguuag

SEQ ID NO: 288190 - RNA, 22 nt, Human
ucuggcagagauauccauccca

SEQ ID NO: 288191 - RNA, 22 nt, Human
uguauacaugucugugugcaca

SEQ ID NO: 288192 - RNA, 22 nt, Human
agaaaauauucauugagaggcu

SEQ ID NO: 288193 - RNA, 22 nt, Human
acagugugugcuuucccuuacg

SEQ ID NO: 288194 - RNA, 21 nt, Human
ugagcaggagucaugggaaug

SEQ ID NO: 288195 - RNA, 22 nt, Human
uuccuucuaauauucugccugu

SEQ ID NO: 288196 - RNA, 22 nt, Human
aaaagcaaggcagucugucuga

SEQ ID NO: 288197 - RNA, 22 nt, Human
ucacauucucagcaucuauaca

SEQ ID NO: 288198 - RNA, 22 nt, Human
ccagcuuuuggggugacaauuu

SEQ ID NO: 288199 - RNA, 22 nt, Human
uuucuuauauucugucauuguu

SEQ ID NO: 288200 - RNA, 20 nt, Human
guuuagcauggcagugaaag

SEQ ID NO: 288201 - RNA, 22 nt, Human
cagccaggccuggugaccaaag

SEQ ID NO: 288202 - RNA, 22 nt, Human
aacaggcaacaguugacucuga

SEQ ID NO: 288203 - RNA, 22 nt, Human
caggcugccaaggcuggggagg

SEQ ID NO: 288204 - RNA, 22 nt, Human
cucuggaagaugaccuggguaa

SEQ ID NO: 288205 - RNA, 21 nt, Human
cagugcagggguuagcgugua

SEQ ID NO: 288206 - RNA, 22 nt, Human
uggcaaaguuuaucaggaauau

SEQ ID NO: 288207 - RNA, 22 nt, Human
cuguccuggccgcccuugugag

SEQ ID NO: 288208 - RNA, 20 nt, Human
agcugcaacagacuguaugg

SEQ ID NO: 288209 - RNA, 22 nt, Human
caguguuuaaucauugugaauu

SEQ ID NO: 288210 - RNA, 22 nt, Human
ugggaguccaagguuuuuauag

SEQ ID NO: 288211 - RNA, 22 nt, Human
gccagugggacccgcugugggc

SEQ ID NO: 288212 - RNA, 22 nt, Human
gggacuuaaugcagagagggac

SEQ ID NO: 288213 - RNA, 22 nt, Human
uagacacaagagaaggguauaa

SEQ ID NO: 288214 - RNA, 22 nt, Human
gucauauacacugcauguaauc

SEQ ID NO: 288215 - RNA, 22 nt, Human
aguucuucauaaccuuacugug

SEQ ID NO: 288216 - RNA, 22 nt, Human
auucuucaucagagaugcacua

SEQ ID NO: 288217 - RNA, 22 nt, Human
cugcccgucccuuugcucucgc

SEQ ID NO: 288218 - RNA, 22 nt, Human
ugccucccucucugccacugga

SEQ ID NO: 288219 - RNA, 22 nt, Human
cucccugguguccccuccagga

SEQ ID NO: 288220 - RNA, 22 nt, Human
acaugccaugguuguuugcugc

SEQ ID NO: 288221 - RNA, 22 nt, Human
acuguggccugcuguaugggcu

SEQ ID NO: 288222 - RNA, 20 nt, Human
ugcagguguuggagaaggua

SEQ ID NO: 288223 - RNA, 22 nt, Human
agucaguuuucuuaaagggaag

SEQ ID NO: 288224 - RNA, 21 nt, Human
uuacagcaauguuagcaggaa

SEQ ID NO: 288225 - RNA, 22 nt, Human
ucugaaagaagggcagucuuuu

SEQ ID NO: 288226 - RNA, 18 nt, Human
gggcccuggcguccgccc

SEQ ID NO: 288227 - RNA, 22 nt, Human
agggaauggaugauggcagguu

SEQ ID NO: 288228 - RNA, 22 nt, Human
gcccagagagaugcuguagacc

SEQ ID NO: 288229 - RNA, 22 nt, Human
agcacaggaccaaggaagcugu

SEQ ID NO: 288230 - RNA, 22 nt, Human
guuuauugauaaaagcuggaca

SEQ ID NO: 288231 - RNA, 22 nt, Human
agugcagguuaaggaacuggcc

SEQ ID NO: 288232 - RNA, 22 nt, Human
uccaaggagcagucuucaaccu

SEQ ID NO: 288233 - RNA, 22 nt, Human
aucuccaggauuuucacacuca

SEQ ID NO: 288234 - RNA, 22 nt, Human
ucagggcauggcugcacuuggc

SEQ ID NO: 288235 - RNA, 22 nt, Human
cuuuacauccuguuucccguuu

SEQ ID NO: 288236 - RNA, 22 nt, Human
uuucacauguauauaggcauua

SEQ ID NO: 288237 - RNA, 22 nt, Human
guccuucaagaguccccuacug

SEQ ID NO: 288238 - RNA, 22 nt, Human
uaugugaagagauuaaaaaaua

SEQ ID NO: 288239 - RNA, 22 nt, Human
uuguauuuggguaguauagaga

SEQ ID NO: 288240 - RNA, 22 nt, Human
aaaugucagaagcuuuacuucu

SEQ ID NO: 288241 - RNA, 22 nt, Human
ccuggaucuaaggaagcuggga

SEQ ID NO: 288242 - RNA, 22 nt, Human
acugggaggcaaagagcaagga

SEQ ID NO: 288243 - RNA, 22 nt, Human
ugcuugaacccaggaaguggag

SEQ ID NO: 288244 - RNA, 22 nt, Human
ccugggagagucuguggucucc

SEQ ID NO: 288245 - RNA, 22 nt, Human
cccuguuuauuuuuggagagaa

SEQ ID NO: 288246 - RNA, 22 nt, Human
ccuugguccaacccugcacagc

SEQ ID NO: 288247 - RNA, 22 nt, Human
acagacaguaaauaguguggcu

SEQ ID NO: 288248 - RNA, 22 nt, Human
agacagacugguuugaauuggu

SEQ ID NO: 288249 - RNA, 22 nt, Human
ugguggagccuaggcuaagucu

SEQ ID NO: 288250 - RNA, 22 nt, Human
gucuggccugccagcucuggug

SEQ ID NO: 288251 - RNA, 22 nt, Human
gccucaagacauuuuuaauugc

SEQ ID NO: 288252 - RNA, 22 nt, Human
uucuuggaaauacauucaauaa

SEQ ID NO: 288253 - RNA, 22 nt, Human
uuguccugcaaccucacauggc

SEQ ID NO: 288254 - RNA, 22 nt, Human
aguuaggaguauaggaaugccu

SEQ ID NO: 288255 - RNA, 22 nt, Human
aucagcaagauguaauuucuau

SEQ ID NO: 288256 - RNA, 22 nt, Human
uuagggacaaauuugcagaacc

SEQ ID NO: 288257 - RNA, 22 nt, Human
aaggugcucguuauggccagug

SEQ ID NO: 288258 - RNA, 22 nt, Human
uuucagacuccaaauucauaag

SEQ ID NO: 288259 - RNA, 22 nt, Human
ucagaagaaagauguuauuacu

SEQ ID NO: 288260 - RNA, 22 nt, Human
acuccuggugcugaugaagaga

SEQ ID NO: 288261 - RNA, 22 nt, Human
uagaaagagcauaguauuauaa

SEQ ID NO: 288262 - RNA, 14 nt, Human
gcaggcagaccacc

SEQ ID NO: 288263 - RNA, 22 nt, Human
uguuuagcauaaagauuuucca

SEQ ID NO: 288264 - RNA, 22 nt, Human
agcauauaggaaauguugaauc

SEQ ID NO: 288265 - RNA, 21 nt, Human
ucccagggucuuaugggaugu

SEQ ID NO: 288266 - RNA, 22 nt, Human
cuuggcaggguggaggaugcag

SEQ ID NO: 288267 - RNA, 22 nt, Human
auuacaguucuacacauccuuu

SEQ ID NO: 288268 - RNA, 22 nt, Human
uuguguccugauuugacacaau

SEQ ID NO: 288269 - RNA, 22 nt, Human
aagcccugggguugcacaaggc

SEQ ID NO: 288270 - RNA, 22 nt, Human
ucacagacgccuccccucgccu

SEQ ID NO: 288271 - RNA, 22 nt, Human
cggcagggcuccaugcauuucu

SEQ ID NO: 288272 - RNA, 22 nt, Human
agaaaguuuugugcuauauaug

SEQ ID NO: 288273 - RNA, 22 nt, Human
gcuuugcuggcuugaaaugcug

SEQ ID NO: 288274 - RNA, 22 nt, Human
gcauucuuuuuaggagguuccu

SEQ ID NO: 288275 - RNA, 22 nt, Human
uaguuuuagucccauuuuacag

SEQ ID NO: 288276 - RNA, 22 nt, Human
cugggaggugaacagaaaaacu

SEQ ID NO: 288277 - RNA, 22 nt, Human
acaggugucuaaggcagacagc

SEQ ID NO: 288278 - RNA, 22 nt, Human
cagugaggaguccagggcagag

SEQ ID NO: 288279 - RNA, 21 nt, Human
uguuucaugcuauuuucuugu

SEQ ID NO: 288280 - RNA, 22 nt, Human
uaugugucccuugguguagcaa

SEQ ID NO: 288281 - RNA, 22 nt, Human
ggccucucagggcagagacccu

SEQ ID NO: 288282 - RNA, 22 nt, Human
acuugguggcgaacgaggguca

SEQ ID NO: 288283 - RNA, 22 nt, Human
accuucaaguaugugggcugaa

SEQ ID NO: 288284 - RNA, 22 nt, Human
acagugugguuugagcacuggg

SEQ ID NO: 288285 - RNA, 22 nt, Human
uauugcugacuuguucaguguu

SEQ ID NO: 288286 - RNA, 22 nt, Human
gcacagcuccugguaagcuggg

SEQ ID NO: 288287 - RNA, 22 nt, Human
ugguggggcuuuccuucugcuu

SEQ ID NO: 288288 - RNA, 22 nt, Human
cugguacagggaaauaaaggaa

SEQ ID NO: 288289 - RNA, 22 nt, Human
gucuucuuguguugccugucuu

SEQ ID NO: 288290 - RNA, 19 nt, Human
acaaagugcgugcucuuuu

SEQ ID NO: 288291 - RNA, 22 nt, Human
gacagacagagaaugggcuuga

SEQ ID NO: 288292 - RNA, 21 nt, Human
uuauugagacauuuguggaaa

SEQ ID NO: 288293 - RNA, 22 nt, Human
ccuuccuugagaagcaauuccu

SEQ ID NO: 288294 - RNA, 22 nt, Human
uccuggcagugcuuguuuugga

SEQ ID NO: 288295 - RNA, 22 nt, Human
aagugugacacuguguuaauua

SEQ ID NO: 288296 - RNA, 22 nt, Human
uaaacaucugucauguguuuau

SEQ ID NO: 288297 - RNA, 22 nt, Human
acaagauuuaaugcaacccaag

SEQ ID NO: 288298 - RNA, 22 nt, Human
auauuugucaauucacuguuca

SEQ ID NO: 288299 - RNA, 22 nt, Human
uauuaggguaaauuugacaugc

SEQ ID NO: 288300 - RNA, 23 nt, Human
uucaugagauuaucugcaugugu

SEQ ID NO: 288301 - RNA, 22 nt, Human
ugacaggaggcuugaggccagg

SEQ ID NO: 288302 - RNA, 22 nt, Human
aaauucuaaggucacaauguug

SEQ ID NO: 288303 - RNA, 22 nt, Human
agcagggccucuggcacugguc

SEQ ID NO: 288304 - RNA, 22 nt, Human
cucugaagccccaaauaguccg

SEQ ID NO: 288305 - RNA, 22 nt, Human
gcaguguuuguguucucacaug

SEQ ID NO: 288306 - RNA, 22 nt, Human
ugucaguuaccuagcacaagaa

SEQ ID NO: 288307 - RNA, 22 nt, Human
cauuucacaaauggccacauca

SEQ ID NO: 288308 - RNA, 22 nt, Human
uucaggaagguccuauagcaga

SEQ ID NO: 288309 - RNA, 22 nt, Human
ugcuagggauacaguggugaau

SEQ ID NO: 288310 - RNA, 22 nt, Human
aacaucaucaugaacaacuaau

SEQ ID NO: 288311 - RNA, 22 nt, Human
caguguggugugcacagcuuag

SEQ ID NO: 288312 - RNA, 22 nt, Human
cuggcuuucucugugguguuca

SEQ ID NO: 288313 - RNA, 22 nt, Human
gucugcccugagcucccagugc

SEQ ID NO: 288314 - RNA, 22 nt, Human
cuucuuuccuuccuccaguggc

SEQ ID NO: 288315 - RNA, 22 nt, Human
uuaaauuccagccucauaauag

SEQ ID NO: 288316 - RNA, 22 nt, Human
cacaugaccacucuuuacuucu

SEQ ID NO: 288317 - RNA, 22 nt, Human
uccugugauauuguuuguuaua

SEQ ID NO: 288318 - RNA, 22 nt, Human
cugugacccaguuccuggcacc

SEQ ID NO: 288319 - RNA, 22 nt, Human
gucagcaaggugcaagcggcug

SEQ ID NO: 288320 - RNA, 23 nt, Human
uuuauauuccuaaugucuugagc

SEQ ID NO: 288321 - RNA, 22 nt, Human
uccauguguuuuccuguccaca

SEQ ID NO: 288322 - RNA, 22 nt, Human
guauuuucaagagcaguaguau

SEQ ID NO: 288323 - RNA, 22 nt, Human
uaauaguugugacuuuguaaag

SEQ ID NO: 288324 - RNA, 22 nt, Human
gcauggcuauuaugaggcagaa

SEQ ID NO: 288325 - RNA, 22 nt, Human
uugcuaggauucauucuauacu

SEQ ID NO: 288326 - RNA, 22 nt, Human
uauugguagauggagagagaca

SEQ ID NO: 288327 - RNA, 22 nt, Human
guuuacauuaaguauuagcauc

SEQ ID NO: 288328 - RNA, 22 nt, Human
uguuuccuucugucucuuugga

SEQ ID NO: 288329 - RNA, 22 nt, Human
agcccuuaguacauuucucaag

SEQ ID NO: 288330 - RNA, 22 nt, Human
ugguggggauucccucccuggc

SEQ ID NO: 288331 - RNA, 22 nt, Human
uacaugugcuauuuguuuugua

SEQ ID NO: 288332 - RNA, 20 nt, Human
uucuuaaagaccucacuuug

SEQ ID NO: 288333 - RNA, 22 nt, Human
uccugugauggcuugcgaugug

SEQ ID NO: 288334 - RNA, 22 nt, Human
ccuggccagcagccccuuccuc

SEQ ID NO: 288335 - RNA, 22 nt, Human
ucagggcagguuaacuugggug

SEQ ID NO: 288336 - RNA, 19 nt, Human
ugugugguuggugaaacuc

SEQ ID NO: 288337 - RNA, 22 nt, Human
accacugcccauggugaaaacu

SEQ ID NO: 288338 - RNA, 22 nt, Human
auguauuucuauguagugaaga

SEQ ID NO: 288339 - RNA, 22 nt, Human
uucacauucucacaagaggaaa

SEQ ID NO: 288340 - RNA, 23 nt, Human
caugacaaaggaucucaugggcc

SEQ ID NO: 288341 - RNA, 22 nt, Human
auccuggcgggggaacugccca

SEQ ID NO: 288342 - RNA, 19 nt, Human
uguguccuagcagccaguc

SEQ ID NO: 288343 - RNA, 22 nt, Human
augacaugauugccauuugaua

SEQ ID NO: 288344 - RNA, 22 nt, Human
acaggugugggcugggcucuga

SEQ ID NO: 288345 - RNA, 22 nt, Human
gaggaaaugguuguucaggugg

SEQ ID NO: 288346 - RNA, 22 nt, Human
uccugugacggagcgccagagg

SEQ ID NO: 288347 - RNA, 22 nt, Human
agcuccugcuugacagaagagg

SEQ ID NO: 288348 - RNA, 22 nt, Human
ugccucagucuaaagucucuca

SEQ ID NO: 288349 - RNA, 22 nt, Human
ucucugugucucauguuccuau

SEQ ID NO: 288350 - RNA, 22 nt, Human
uccuggccuugcuccugaugcc

SEQ ID NO: 288351 - RNA, 22 nt, Human
cgcgguggcggccuccagcgcc

SEQ ID NO: 288352 - RNA, 19 nt, Human
guccuggcgccgccacacc

SEQ ID NO: 288353 - RNA, 22 nt, Human
acuuucugcaguguuggaaaug

SEQ ID NO: 288354 - RNA, 22 nt, Human
agaaauuccuaagguacacaag

SEQ ID NO: 288355 - RNA, 22 nt, Human
uauugcuggggugggccauguu

SEQ ID NO: 288356 - RNA, 22 nt, Human
ucaguuaagcacuauacccuaa

SEQ ID NO: 288357 - RNA, 22 nt, Human
agacagcuagggcugcagggac

SEQ ID NO: 288358 - RNA, 22 nt, Human
agacauauuggcuugcuuuaau

SEQ ID NO: 288359 - RNA, 22 nt, Human
auuucucaguuccuacuguuua

SEQ ID NO: 288360 - RNA, 22 nt, Human
uuaauuuuuauguauagugugu

SEQ ID NO: 288361 - RNA, 22 nt, Human
ccagguggugaaagugggcccu

SEQ ID NO: 288362 - RNA, 22 nt, Human
aaugucaauaacuuuaucccuc

SEQ ID NO: 288363 - RNA, 18 nt, Human
uccuggcagucagagagg

SEQ ID NO: 288364 - RNA, 22 nt, Human
acccaggggcagccuugcugug

SEQ ID NO: 288365 - RNA, 22 nt, Human
uacacauguccaaggugucacc

SEQ ID NO: 288366 - RNA, 22 nt, Human
cagaaagcucuuucaaucuugc

SEQ ID NO: 288367 - RNA, 22 nt, Human
ucauuguaauuaucugugguau

SEQ ID NO: 288368 - RNA, 23 nt, Human
aaguucuuuuagaugucuucgug

SEQ ID NO: 288369 - RNA, 22 nt, Human
ugccagcuuguggucagaggcu

SEQ ID NO: 288370 - RNA, 22 nt, Human
ugcauauacccgcauuuacaua

SEQ ID NO: 288371 - RNA, 22 nt, Human
ugcagggauuauguagggguug

SEQ ID NO: 288372 - RNA, 22 nt, Human
guacacauuaugcuucucuaaa

SEQ ID NO: 288373 - RNA, 22 nt, Human
gugcgggccuggggguuucucu

SEQ ID NO: 288374 - RNA, 22 nt, Human
ccaggccugugcaaggagggag

SEQ ID NO: 288375 - RNA, 22 nt, Human
acagauuuuugguaaauaauuu

SEQ ID NO: 288376 - RNA, 22 nt, Human
guccuggcuuaguucgcuguaa

SEQ ID NO: 288377 - RNA, 22 nt, Human
aaauuugauaagccauuguuac

SEQ ID NO: 288378 - RNA, 22 nt, Human
uagcaaagaagauauuauugca

SEQ ID NO: 288379 - RNA, 22 nt, Human
cuccauugaacauccucucaga

SEQ ID NO: 288380 - RNA, 22 nt, Human
ucccagugagguccuggcuguc

SEQ ID NO: 288381 - RNA, 22 nt, Human
guccagaaagggcagugauuug

SEQ ID NO: 288382 - RNA, 22 nt, Human
uuucuagcuguaggaagcugag

SEQ ID NO: 288383 - RNA, 22 nt, Human
uggcuuggugagcagaguguag

SEQ ID NO: 288384 - RNA, 22 nt, Human
gucuggcuguuccugccuguga

SEQ ID NO: 288385 - RNA, 22 nt, Human
ccaugcugugacacaguaguua

SEQ ID NO: 288386 - RNA, 22 nt, Human
aagagguugucugugaugaguu

SEQ ID NO: 288387 - RNA, 22 nt, Human
ugggcagggaucucuuuugcaa

SEQ ID NO: 288388 - RNA, 22 nt, Human
caaaguuuuaguaaacauauau

SEQ ID NO: 288389 - RNA, 23 nt, Human
uggccagguagaggagguaguga

SEQ ID NO: 288390 - RNA, 22 nt, Human
uuuuguuuguguccacugcagu

SEQ ID NO: 288391 - RNA, 22 nt, Human
ucugccccugcugggcacagag

SEQ ID NO: 288392 - RNA, 22 nt, Human
augagauuuuaaaacuucacuu

SEQ ID NO: 288393 - RNA, 21 nt, Human
agacagacugccugacccacg

SEQ ID NO: 288394 - RNA, 22 nt, Human
ugaaagauugugauucaauaug

SEQ ID NO: 288395 - RNA, 22 nt, Human
cuugauuuauuacccacuauau

SEQ ID NO: 288396 - RNA, 21 nt, Human
uugcugcccucccuuuccuca

SEQ ID NO: 288397 - RNA, 22 nt, Human
acauauuuugaaagcuuucuaa

SEQ ID NO: 288398 - RNA, 22 nt, Human
agacagacaugcuaguuuucuu

SEQ ID NO: 288399 - RNA, 22 nt, Human
gcagggaccuugcccacccucc

SEQ ID NO: 288400 - RNA, 22 nt, Human
cugugauggucaggcccuaucu

SEQ ID NO: 288401 - RNA, 23 nt, Human
uugggaaauaguuaagacaugag

SEQ ID NO: 288402 - RNA, 22 nt, Human
gaaguuuauuucaaucuauuca

SEQ ID NO: 288403 - RNA, 22 nt, Human
uugauuucaaaauauaugcuug

SEQ ID NO: 288404 - RNA, 22 nt, Human
gcccagcuggcuuccagcacau

SEQ ID NO: 288405 - RNA, 22 nt, Human
gguuccugugccucuagcuggc

SEQ ID NO: 288406 - RNA, 22 nt, Human
uccagcauauauagagaaugag

SEQ ID NO: 288407 - RNA, 22 nt, Human
uguugcugacaagagaggagca

SEQ ID NO: 288408 - RNA, 22 nt, Human
uguuuuaaagccauugccuuuc

SEQ ID NO: 288409 - RNA, 22 nt, Human
cagcuauugguccacagguaug

SEQ ID NO: 288410 - RNA, 22 nt, Human
uagguucaugaaauuuucagga

SEQ ID NO: 288411 - RNA, 22 nt, Human
aaguuucuggaccuuaccugcu

SEQ ID NO: 288412 - RNA, 22 nt, Human
cuuaacauccugcauuuuucuu

SEQ ID NO: 288413 - RNA, 22 nt, Human
uuugcuuucuguugaacagagu

SEQ ID NO: 288414 - RNA, 22 nt, Human
aacuucugccaaacagcuguua

SEQ ID NO: 288415 - RNA, 22 nt, Human
augcagcugugggcaagaaaug

SEQ ID NO: 288416 - RNA, 22 nt, Human
aggaaacuguccccucauccua

SEQ ID NO: 288417 - RNA, 22 nt, Human
ccugugcccuggaaggagagag

SEQ ID NO: 288418 - RNA, 22 nt, Human
agcacuuuccuggcaaaugugg

SEQ ID NO: 288419 - RNA, 22 nt, Human
ugacaggugcugggggcagugu

SEQ ID NO: 288420 - RNA, 22 nt, Human
auauuuguuagagucuaugugu

SEQ ID NO: 288421 - RNA, 23 nt, Human
uuguccagcugguuugggccaca

SEQ ID NO: 288422 - RNA, 22 nt, Human
ucuggcaguugccgcuucaguc

SEQ ID NO: 288423 - RNA, 22 nt, Human
aggaaugugaaacagguggcug

SEQ ID NO: 288424 - RNA, 22 nt, Human
aacaaaagccgaaguagguguc

SEQ ID NO: 288425 - RNA, 18 nt, Human
cugcccagagcauuucau

SEQ ID NO: 288426 - RNA, 22 nt, Human
cccugcagaaccacagacaaac

SEQ ID NO: 288427 - RNA, 22 nt, Human
uucaacucuucaagaucacauc

SEQ ID NO: 288428 - RNA, 21 nt, Human
gugaauuaauuauaugccuua

SEQ ID NO: 288429 - RNA, 22 nt, Human
uuccucagcacaaagccaagau

SEQ ID NO: 288430 - RNA, 22 nt, Human
acagaauugaaaguauaaucug

SEQ ID NO: 288431 - RNA, 22 nt, Human
uaucuaaauggaauauuccaga

SEQ ID NO: 288432 - RNA, 23 nt, Human
uuggcaaagccuaugaaguccuc

SEQ ID NO: 288433 - RNA, 22 nt, Human
agacaugugguauaaucagggg

SEQ ID NO: 288434 - RNA, 22 nt, Human
ccugaguggugcuaagcagaua

SEQ ID NO: 288435 - RNA, 22 nt, Human
ucugggaacacacgucacuuca

SEQ ID NO: 288436 - RNA, 22 nt, Human
gguuucaacucagcuaguaagg

SEQ ID NO: 288437 - RNA, 22 nt, Human
cacauaauacauguuccacuua

SEQ ID NO: 288438 - RNA, 23 nt, Human
aaacuacaacgccaggcacugag

SEQ ID NO: 288439 - RNA, 21 nt, Human
ugaucauuuguguaaaggaga

SEQ ID NO: 288440 - RNA, 22 nt, Human
ucuugccucuuccccuuuccau

SEQ ID NO: 288441 - RNA, 22 nt, Human
ucagacaguuugcagugugccu

SEQ ID NO: 288442 - RNA, 22 nt, Human
gcauguaaucacucuaggaagg

SEQ ID NO: 288443 - RNA, 22 nt, Human
cagaguuuugugaacaacuugg

SEQ ID NO: 288444 - RNA, 22 nt, Human
ggcaggcacuguguuuuguguu

SEQ ID NO: 288445 - RNA, 22 nt, Human
ugacccauuggucccuagaucc

SEQ ID NO: 288446 - RNA, 22 nt, Human
ugccuuccugcuuugaguucug

SEQ ID NO: 288447 - RNA, 22 nt, Human
uugaggagucaggggcacggaa

SEQ ID NO: 288448 - RNA, 20 nt, Human
uacagaaugcaauaaaaugg

SEQ ID NO: 288449 - RNA, 22 nt, Human
uccugcagagccgcccucaggu

SEQ ID NO: 288450 - RNA, 22 nt, Human
acuagaaagcacuaagcuaggc

SEQ ID NO: 288451 - RNA, 22 nt, Human
ugaacaugcuguugauggccug

SEQ ID NO: 288452 - RNA, 22 nt, Human
aauuucagauauuaaagaauga

SEQ ID NO: 288453 - RNA, 22 nt, Human
gaagaagggagugacaaaugca

SEQ ID NO: 288454 - RNA, 22 nt, Human
ggauuaagaccugucaguacac

SEQ ID NO: 288455 - RNA, 22 nt, Human
gugagcagccucaccugagggu

SEQ ID NO: 288456 - RNA, 22 nt, Human
ucugugauaguuuuucagcuau

SEQ ID NO: 288457 - RNA, 22 nt, Human
agauaaauuccuaagauuucag

SEQ ID NO: 288458 - RNA, 22 nt, Human
ucuguggcauguugcacuugua

SEQ ID NO: 288459 - RNA, 18 nt, Human
uguuuauucuccugacag

SEQ ID NO: 288460 - RNA, 22 nt, Human
caggaggggguggaguuucgcc

SEQ ID NO: 288461 - RNA, 22 nt, Human
ucaauucugguccucaggaacu

SEQ ID NO: 288462 - RNA, 22 nt, Human
cagggcagggauguugcggcag

SEQ ID NO: 288463 - RNA, 22 nt, Human
cuggaaaaugaagaagcagagg

SEQ ID NO: 288464 - RNA, 22 nt, Human
agggcaugcuggaggagagaca

SEQ ID NO: 288465 - RNA, 22 nt, Human
gcagacaauuuauuagcagauu

SEQ ID NO: 288466 - RNA, 22 nt, Human
ugauggcucccaugggcauaug

SEQ ID NO: 288467 - RNA, 20 nt, Human
auauuucuuaagaacuuuca

SEQ ID NO: 288468 - RNA, 22 nt, Human
ggaaaaaugacacauaucucaa

SEQ ID NO: 288469 - RNA, 20 nt, Human
aguaacuuagcaacucuagg

SEQ ID NO: 288470 - RNA, 22 nt, Human
uccuggguaaacacugaccuuu

SEQ ID NO: 288471 - RNA, 22 nt, Human
ccagguguuuggccugcaugau

SEQ ID NO: 288472 - RNA, 22 nt, Human
ccuuacacugccuggggccacg

SEQ ID NO: 288473 - RNA, 22 nt, Human
ccauaaucguguguuaaauaau

SEQ ID NO: 288474 - RNA, 22 nt, Human
ugcccaggcuucacccucagag

SEQ ID NO: 288475 - RNA, 22 nt, Human
guacaaauugauacagauuuga

SEQ ID NO: 288476 - RNA, 22 nt, Human
agcugugugugcuugggauuau

SEQ ID NO: 288477 - RNA, 22 nt, Human
cuuguauugcaaacuggccagg

SEQ ID NO: 288478 - RNA, 22 nt, Human
uucagcaacucaaaccuauuag

SEQ ID NO: 288479 - RNA, 18 nt, Human
ugucucaggcugaaacag

SEQ ID NO: 288480 - RNA, 22 nt, Human
gaggcaggguguugauuacaga

SEQ ID NO: 288481 - RNA, 16 nt, Human
uaugugucucaucuac

SEQ ID NO: 288482 - RNA, 22 nt, Human
uuuccagagggugcucagggcg

SEQ ID NO: 288483 - RNA, 22 nt, Human
uacacauguauuuauguguaca

SEQ ID NO: 288484 - RNA, 22 nt, Human
ucggagcuguagaugaaacccu

SEQ ID NO: 288485 - RNA, 22 nt, Human
ccugaagaugcuguggccuggu

SEQ ID NO: 288486 - RNA, 22 nt, Human
aucagagaccggucaagucaug

SEQ ID NO: 288487 - RNA, 22 nt, Human
guuucauucggcagcucauaag

SEQ ID NO: 288488 - RNA, 22 nt, Human
gagcaguggucugaucuucuaa

SEQ ID NO: 288489 - RNA, 22 nt, Human
uuucaugagauuccuccacauc

SEQ ID NO: 288490 - RNA, 22 nt, Human
aaggugucauccaggauggugg

SEQ ID NO: 288491 - RNA, 22 nt, Human
gcagggacagggcagggccuuu

SEQ ID NO: 288492 - RNA, 22 nt, Human
cuguggucacuguuggggaaug

SEQ ID NO: 288493 - RNA, 22 nt, Human
uuaccuaaaauagcucaauuua

SEQ ID NO: 288494 - RNA, 22 nt, Human
gggcucugagcucugggaauua

SEQ ID NO: 288495 - RNA, 22 nt, Human
ggaaggggagcuggaaagggua

SEQ ID NO: 288496 - RNA, 21 nt, Human
gcaggugugguaucagcuucc

SEQ ID NO: 288497 - RNA, 22 nt, Human
ccagagaggccuuggcaagaca

SEQ ID NO: 288498 - RNA, 22 nt, Human
ugcugaggagguggcugugcuu

SEQ ID NO: 288499 - RNA, 22 nt, Human
uguuugcuauauccuacuucau

SEQ ID NO: 288500 - RNA, 19 nt, Human
ugaggcaagauggcucugg

SEQ ID NO: 288501 - RNA, 22 nt, Human
aagucacagaguuggaagucag

SEQ ID NO: 288502 - RNA, 22 nt, Human
acauguaaaaggaacaugcaug

SEQ ID NO: 288503 - RNA, 22 nt, Human
ccuugcucucccaagcccgcag

SEQ ID NO: 288504 - RNA, 22 nt, Human
guuagggagucagguggcucuu

SEQ ID NO: 288505 - RNA, 22 nt, Human
ccugagugaccugaggucuagu

SEQ ID NO: 288506 - RNA, 22 nt, Human
aggcuuggcuggcagcccuggg

SEQ ID NO: 288507 - RNA, 22 nt, Human
auccugagguacugcagggccg

SEQ ID NO: 288508 - RNA, 22 nt, Human
aaugaguucugguucauuuuau

SEQ ID NO: 288509 - RNA, 22 nt, Human
cuccccaagccuuggcuucucc

SEQ ID NO: 288510 - RNA, 22 nt, Human
uuuugcuguguccuugagccgg

SEQ ID NO: 288511 - RNA, 22 nt, Human
uauugaggaucuccugcuaauu

SEQ ID NO: 288512 - RNA, 22 nt, Human
agugauguugacuagcuauaag

SEQ ID NO: 288513 - RNA, 19 nt, Human
gcuaggguugguggcgugc

SEQ ID NO: 288514 - RNA, 22 nt, Human
cauguguguccaugugacuaag

SEQ ID NO: 288515 - RNA, 22 nt, Human
cugaggcuuggaggggucuggu

SEQ ID NO: 288516 - RNA, 22 nt, Human
cccugccaggguccugacagac

SEQ ID NO: 288517 - RNA, 22 nt, Human
accugguuccuccucacugcug

SEQ ID NO: 288518 - RNA, 22 nt, Human
cacaggcuuccaguccccagcu

SEQ ID NO: 288519 - RNA, 22 nt, Human
gcauguguaugguaggaauauu

SEQ ID NO: 288520 - RNA, 22 nt, Human
cagagcucugacagcuacagcc

SEQ ID NO: 288521 - RNA, 20 nt, Human
gaacuugggcaaguggcuua

SEQ ID NO: 288522 - RNA, 22 nt, Human
gcauucuuccugggcugggggc

SEQ ID NO: 288523 - RNA, 22 nt, Human
cagacaaggccaucuuucauuu

SEQ ID NO: 288524 - RNA, 22 nt, Human
ugugugaggugguucugagaag

SEQ ID NO: 288525 - RNA, 22 nt, Human
caggcacaugggagcucaucau

SEQ ID NO: 288526 - RNA, 22 nt, Human
augauucucauuuuauaaacuu

SEQ ID NO: 288527 - RNA, 22 nt, Human
cugaggagaugggcuuuuuagg

SEQ ID NO: 288528 - RNA, 22 nt, Human
aacuguuucagaaauauuguug

SEQ ID NO: 288529 - RNA, 22 nt, Human
gcucagagagaggauauguuau

SEQ ID NO: 288530 - RNA, 22 nt, Human
cucugagcagaggccguggcua

SEQ ID NO: 288531 - RNA, 22 nt, Human
ucacugcuuucaaaaauuauug

SEQ ID NO: 288532 - RNA, 22 nt, Human
ucuuuuguugccuacuuauuaa

SEQ ID NO: 288533 - RNA, 22 nt, Human
ugagguggcacacacuuccugc

SEQ ID NO: 288534 - RNA, 22 nt, Human
aaugucaguguuacugcuauug

SEQ ID NO: 288535 - RNA, 22 nt, Human
auguuacagagaaaguggaagc

SEQ ID NO: 288536 - RNA, 22 nt, Human
acacagaguaucuuuugccuag

SEQ ID NO: 288537 - RNA, 22 nt, Human
cccugcagugugaccucaccua

SEQ ID NO: 288538 - RNA, 22 nt, Human
ccugugcccucugcauagcagc

SEQ ID NO: 288539 - RNA, 22 nt, Human
uuacacagaugguuaguagagg

SEQ ID NO: 288540 - RNA, 22 nt, Human
aguuuacauaaaaaggcagagg

SEQ ID NO: 288541 - RNA, 22 nt, Human
ggcaggugcucaaaaauauuug

SEQ ID NO: 288542 - RNA, 22 nt, Human
ggcaggcuccagagcccucucc

SEQ ID NO: 288543 - RNA, 22 nt, Human
aguguauuaguuguccagcagu

SEQ ID NO: 288544 - RNA, 22 nt, Human
ucagggcacauucugcaguggc

SEQ ID NO: 288545 - RNA, 22 nt, Human
uacaucauaauaauacuuagaa

SEQ ID NO: 288546 - RNA, 22 nt, Human
gaggagcuggcagcgucuccgc

SEQ ID NO: 288547 - RNA, 22 nt, Human
gcaaggacucccugggucauuc

SEQ ID NO: 288548 - RNA, 22 nt, Human
ucccugccuccuggcagugcca

SEQ ID NO: 288549 - RNA, 22 nt, Human
acaagauugauaagucugcccu

SEQ ID NO: 288550 - RNA, 22 nt, Human
acuuuguuccuuucacaaagaa

SEQ ID NO: 288551 - RNA, 22 nt, Human
guuuucuuccugcaauuggcau

SEQ ID NO: 288552 - RNA, 22 nt, Human
ggcuccagguuuaaggguaugu

SEQ ID NO: 288553 - RNA, 21 nt, Human
auucagaaagggaauaaacuc

SEQ ID NO: 288554 - RNA, 21 nt, Human
acaugucucuaaucucaguga

SEQ ID NO: 288555 - RNA, 22 nt, Human
gggcuugguggagagaaugcug

SEQ ID NO: 288556 - RNA, 22 nt, Human
agucccuucucaaagugugcgg

SEQ ID NO: 288557 - RNA, 22 nt, Human
ugcuauuuuagacauacuuugu

SEQ ID NO: 288558 - RNA, 22 nt, Human
aggggauggagcuggaaggcag

SEQ ID NO: 288559 - RNA, 22 nt, Human
cauuuccacuucugaaaacugg

SEQ ID NO: 288560 - RNA, 22 nt, Human
auacuacaaucauaauuguaca

SEQ ID NO: 288561 - RNA, 22 nt, Human
aggagggagcuuaagccaggca

SEQ ID NO: 288562 - RNA, 18 nt, Human
aguccaugcauggcuaua

SEQ ID NO: 288563 - RNA, 22 nt, Human
ccagggcaggggcuggaguuca

SEQ ID NO: 288564 - RNA, 22 nt, Human
ccugguuuaaugcucacuguug

SEQ ID NO: 288565 - RNA, 22 nt, Human
cuguccuggagggcauaggacg

SEQ ID NO: 288566 - RNA, 22 nt, Human
agcuagaaguccuagauaaagg

SEQ ID NO: 288567 - RNA, 22 nt, Human
uuguuacagcagcaauagaaaa

SEQ ID NO: 288568 - RNA, 19 nt, Human
cuccucagucccagagguc

SEQ ID NO: 288569 - RNA, 22 nt, Human
uuugcaaauauguguuucuauu

SEQ ID NO: 288570 - RNA, 21 nt, Human
ugacagguuuaggauuaaaau

SEQ ID NO: 288571 - RNA, 22 nt, Human
ucacuccucaggcuagcaucau

SEQ ID NO: 288572 - RNA, 23 nt, Human
ggacaugucucuggguauuuuga

SEQ ID NO: 288573 - RNA, 22 nt, Human
ugcuuuaucugugagaaccuga

SEQ ID NO: 288574 - RNA, 22 nt, Human
gacaagaugacaucauggcuuc

SEQ ID NO: 288575 - RNA, 22 nt, Human
ucuagaaaguuuguacugauuu

SEQ ID NO: 288576 - RNA, 19 nt, Human
agaaucaggucaggugaca

SEQ ID NO: 288577 - RNA, 22 nt, Human
ugggugcucugcuucccugcac

SEQ ID NO: 288578 - RNA, 22 nt, Human
cccaggagcuucucucugccuc

SEQ ID NO: 288579 - RNA, 22 nt, Human
gacagacacaauugauccauga

SEQ ID NO: 288580 - RNA, 22 nt, Human
agagggaaaaacucaugucauu

SEQ ID NO: 288581 - RNA, 22 nt, Human
gaacuguggguaauauauuaga

SEQ ID NO: 288582 - RNA, 22 nt, Human
guuuccugcgugugccacucau

SEQ ID NO: 288583 - RNA, 22 nt, Human
gguggcagggagugucccuggg

SEQ ID NO: 288584 - RNA, 22 nt, Human
uggcaguagauccagucucucu

SEQ ID NO: 288585 - RNA, 22 nt, Human
gguggcucucuuaagggcagcg

SEQ ID NO: 288586 - RNA, 22 nt, Human
acuccccagacugccaugcugg

SEQ ID NO: 288587 - RNA, 22 nt, Human
uagggaccuuagaauuguaugu

SEQ ID NO: 288588 - RNA, 22 nt, Human
agggcagccucucagccuaggu

SEQ ID NO: 288589 - RNA, 22 nt, Human
acagugcaaacuuuugucuccu

SEQ ID NO: 288590 - RNA, 22 nt, Human
uuucauaaccucaagcuacagu

SEQ ID NO: 288591 - RNA, 22 nt, Human
uccuccuuguuuugucucugcu

SEQ ID NO: 288592 - RNA, 22 nt, Human
cagugagguggaguaguuccca

SEQ ID NO: 288593 - RNA, 22 nt, Human
aaagauuuaagaauaauuugug

SEQ ID NO: 288594 - RNA, 17 nt, Human
gaauuucuuggucaaaa

SEQ ID NO: 288595 - RNA, 19 nt, Human
uggucccauacugcuggcc

SEQ ID NO: 288596 - RNA, 22 nt, Human
ugcagcucauugguguccuggu

SEQ ID NO: 288597 - RNA, 22 nt, Human
aucuagauuagguauaagagcu

SEQ ID NO: 288598 - RNA, 22 nt, Human
ucuccauuuuauagauaaugaa

SEQ ID NO: 288599 - RNA, 22 nt, Human
auuuguucacaaucagggcagg

SEQ ID NO: 288600 - RNA, 22 nt, Human
uaauaauagcaguagcugccac

SEQ ID NO: 288601 - RNA, 22 nt, Human
aggggagaaaaaugccuucugu

SEQ ID NO: 288602 - RNA, 22 nt, Human
aggggugugcauccuggaggau

SEQ ID NO: 288603 - RNA, 22 nt, Human
uuugcugugggauauccaugug

SEQ ID NO: 288604 - RNA, 22 nt, Human
auguaauuuauguuauccauaa

SEQ ID NO: 288605 - RNA, 22 nt, Human
aagaaagggagaaggauggugu

SEQ ID NO: 288606 - RNA, 23 nt, Human
ucuuugguaaauaaaguggggau

SEQ ID NO: 288607 - RNA, 22 nt, Human
uuccuggccuaagguaggugac

SEQ ID NO: 288608 - RNA, 22 nt, Human
gcucccucugcucaggcacuug

SEQ ID NO: 288609 - RNA, 22 nt, Human
gauaauuugauaccucaaucag

SEQ ID NO: 288610 - RNA, 22 nt, Human
uugguacaaugugcuagguagg

SEQ ID NO: 288611 - RNA, 22 nt, Human
ucugaauucaguauggucuuuc

SEQ ID NO: 288612 - RNA, 22 nt, Human
gccagguggcugagcagcugca

SEQ ID NO: 288613 - RNA, 22 nt, Human
cagcuuugcaggcuggucagug

SEQ ID NO: 288614 - RNA, 22 nt, Human
accuaaauucuggcugauuagg

SEQ ID NO: 288615 - RNA, 22 nt, Human
gacugccagaaugugaggccug

SEQ ID NO: 288616 - RNA, 19 nt, Human
ugcagggcugcgccugggg

SEQ ID NO: 288617 - RNA, 22 nt, Human
aaggcuuuaugugaccaaaaga

SEQ ID NO: 288618 - RNA, 22 nt, Human
ugaguuuuuucaacauaugaag

SEQ ID NO: 288619 - RNA, 22 nt, Human
uugugcuccugugagaaucuag

SEQ ID NO: 288620 - RNA, 22 nt, Human
uggcccugcuggacacgccugc

SEQ ID NO: 288621 - RNA, 18 nt, Human
cccagcuuagcgccccuc

SEQ ID NO: 288622 - RNA, 22 nt, Human
uuuccccagguagauagauaau

SEQ ID NO: 288623 - RNA, 21 nt, Human
guuauugaccuccaggcuggc

SEQ ID NO: 288624 - RNA, 22 nt, Human
gagcuccagaguuagacacccg

SEQ ID NO: 288625 - RNA, 22 nt, Human
aagcuuucagagcagaauguga

SEQ ID NO: 288626 - RNA, 22 nt, Human
ggcuuuauuuugcaugaaugcu

SEQ ID NO: 288627 - RNA, 22 nt, Human
ccaguguccuuccuuuccaugg

SEQ ID NO: 288628 - RNA, 19 nt, Human
acuggcagggcugcggugg

SEQ ID NO: 288629 - RNA, 22 nt, Human
ucauaaaaugcuccugauauug

SEQ ID NO: 288630 - RNA, 22 nt, Human
acugccuucaaacagcgccacc

SEQ ID NO: 288631 - RNA, 22 nt, Human
caggaaggaaaggguguggaga

SEQ ID NO: 288632 - RNA, 17 nt, Human
agcugagcuggccaggg

SEQ ID NO: 288633 - RNA, 22 nt, Human
ucuccacauucuauuggcuaua

SEQ ID NO: 288634 - RNA, 22 nt, Human
gaggaauguuauuaaaggagcu

SEQ ID NO: 288635 - RNA, 22 nt, Human
ucccagggcuuuucucaugcuu

SEQ ID NO: 288636 - RNA, 22 nt, Human
ucuuccucuucugcugagaagu

SEQ ID NO: 288637 - RNA, 22 nt, Human
uuucuucuugauuuaaacaggg

SEQ ID NO: 288638 - RNA, 22 nt, Human
ucagagaguuagugucuuagcu

SEQ ID NO: 288639 - RNA, 22 nt, Human
ccugagcugaacuaagcaguuu

SEQ ID NO: 288640 - RNA, 22 nt, Human
auucuuuaauucaauugaagga

SEQ ID NO: 288641 - RNA, 22 nt, Human
uccaugaggcagggaggcuggc

SEQ ID NO: 288642 - RNA, 22 nt, Human
caaggcaugcaaugucuucagg

SEQ ID NO: 288643 - RNA, 22 nt, Human
ugcagggccuugggaugugucc

SEQ ID NO: 288644 - RNA, 20 nt, Human
ugacacaaauugcuuucuca

SEQ ID NO: 288645 - RNA, 22 nt, Human
uuuaugagcaaugcugagggga

SEQ ID NO: 288646 - RNA, 22 nt, Human
ccuggaccugcagcaucagcau

SEQ ID NO: 288647 - RNA, 22 nt, Human
uccaggaagccacacugggccu

SEQ ID NO: 288648 - RNA, 22 nt, Human
auucuuuggacaauaaguggug

SEQ ID NO: 288649 - RNA, 22 nt, Human
caaauaauuacuauccucacuu

SEQ ID NO: 288650 - RNA, 22 nt, Human
uccuccuuguuuuccuguuuac

SEQ ID NO: 288651 - RNA, 22 nt, Human
ucauuguuucugcuuuucauga

SEQ ID NO: 288652 - RNA, 22 nt, Human
uuggaggaugcaaugagggagu

SEQ ID NO: 288653 - RNA, 22 nt, Human
uuauucagucugucuagggagu

SEQ ID NO: 288654 - RNA, 19 nt, Human
guucaaacacugauucagc

SEQ ID NO: 288655 - RNA, 22 nt, Human
ucuuuucuguaacucagugucu

SEQ ID NO: 288656 - RNA, 22 nt, Human
aaaagcagguacucagcuuggg

SEQ ID NO: 288657 - RNA, 22 nt, Human
aaaguugaccgaaagauuuuga

SEQ ID NO: 288658 - RNA, 22 nt, Human
ugcuggguggacuuggcucuca

SEQ ID NO: 288659 - RNA, 22 nt, Human
ugcaggugucucugucuagcgu

SEQ ID NO: 288660 - RNA, 22 nt, Human
uuacaguguuacuugaugucca

SEQ ID NO: 288661 - RNA, 22 nt, Human
uugcuuuagaaucugcuucugg

SEQ ID NO: 288662 - RNA, 22 nt, Human
uaauuccaaguugagacaugca

SEQ ID NO: 288663 - RNA, 22 nt, Human
cagagcaugaauaaaaguuaca

SEQ ID NO: 288664 - RNA, 22 nt, Human
auuaagacuauugauauuuaca

SEQ ID NO: 288665 - RNA, 22 nt, Human
ucugcccuggggucagccucca

SEQ ID NO: 288666 - RNA, 22 nt, Human
gcauggcugguguccugaggga

SEQ ID NO: 288667 - RNA, 22 nt, Human
aacugucuuaauaacaaaagcu

SEQ ID NO: 288668 - RNA, 22 nt, Human
aggaauguuuagaaugucagaa

SEQ ID NO: 288669 - RNA, 22 nt, Human
ucuguucauguugggcuuuucc

SEQ ID NO: 288670 - RNA, 22 nt, Human
acuucuuuucaaaucaugcaaa

SEQ ID NO: 288671 - RNA, 22 nt, Human
uuauugacugaucagagaggga

SEQ ID NO: 288672 - RNA, 22 nt, Human
auuuuuaugacaaaccauccuc

SEQ ID NO: 288673 - RNA, 22 nt, Human
uuucuaaaauagauuuuauggu

SEQ ID NO: 288674 - RNA, 22 nt, Human
ucugaaauuccuuccagacuuu

SEQ ID NO: 288675 - RNA, 22 nt, Human
guaacagaaagucaugcucauu

SEQ ID NO: 288676 - RNA, 22 nt, Human
uguuuauucauggcuaaugaaa

SEQ ID NO: 288677 - RNA, 22 nt, Human
gaugaaaaaagacgagcauaua

SEQ ID NO: 288678 - RNA, 22 nt, Human
ucauggcauuguuaaggguuuu

SEQ ID NO: 288679 - RNA, 22 nt, Human
aaggucagagcaggaaggaguc

SEQ ID NO: 288680 - RNA, 22 nt, Human
cacauuccuggugcucagcagc

SEQ ID NO: 288681 - RNA, 22 nt, Human
aacaguuuggguagguauguag

SEQ ID NO: 288682 - RNA, 22 nt, Human
uacagugcauagaggcaugaua

SEQ ID NO: 288683 - RNA, 22 nt, Human
aauguaguucacaauugguacu

SEQ ID NO: 288684 - RNA, 23 nt, Human
agggaaaguaguaauggccuuug

SEQ ID NO: 288685 - RNA, 22 nt, Human
aauauguuuauaagauaucuuc

SEQ ID NO: 288686 - RNA, 22 nt, Human
acugugcugcucuccgcagccc

SEQ ID NO: 288687 - RNA, 22 nt, Human
aacaguuuaugagauaugcuau

SEQ ID NO: 288688 - RNA, 22 nt, Human
aauaauuuuagcucagaguugu

SEQ ID NO: 288689 - RNA, 22 nt, Human
uuccugagggacuuuugagauu

SEQ ID NO: 288690 - RNA, 22 nt, Human
guaaaauucuagcaucugaaag

SEQ ID NO: 288691 - RNA, 22 nt, Human
ggcugcugaaguguggcaaucu

SEQ ID NO: 288692 - RNA, 22 nt, Human
uuccaggaggagguacuagagg

SEQ ID NO: 288693 - RNA, 22 nt, Human
aaauacuagaauucagaguuga

SEQ ID NO: 288694 - RNA, 22 nt, Human
ucaagcaacugaauucuaaaag

SEQ ID NO: 288695 - RNA, 22 nt, Human
aaacacugaaaauuuuggucau

SEQ ID NO: 288696 - RNA, 22 nt, Human
ccagguguccccgucacugcag

SEQ ID NO: 288697 - RNA, 22 nt, Human
auuucacaucuaucucagauuu

SEQ ID NO: 288698 - RNA, 21 nt, Human
aagaguggcugaggaggugau

SEQ ID NO: 288699 - RNA, 22 nt, Human
gaaggaggcguuagcccuagga

SEQ ID NO: 288700 - RNA, 23 nt, Human
acagaaaucauuuguaagguacc

SEQ ID NO: 288701 - RNA, 22 nt, Human
uguggggcagcuagccggccug

SEQ ID NO: 288702 - RNA, 22 nt, Human
cccacucccuacgacacgcucc

SEQ ID NO: 288703 - RNA, 22 nt, Human
aaggguuggggaagagcaaauu

SEQ ID NO: 288704 - RNA, 22 nt, Human
ccuggaggagcgcugaccagcu

SEQ ID NO: 288705 - RNA, 22 nt, Human
uucaggaauaauuaucauauga

SEQ ID NO: 288706 - RNA, 22 nt, Human
gcagguaagagaggcuggcuuc

SEQ ID NO: 288707 - RNA, 22 nt, Human
aguuuacaucuucaaucucauu

SEQ ID NO: 288708 - RNA, 22 nt, Human
agaggcacaacagucccauugu

SEQ ID NO: 288709 - RNA, 19 nt, Human
uucagcagugucugcucuu

SEQ ID NO: 288710 - RNA, 21 nt, Human
agaagcuagucacuaaaucca

SEQ ID NO: 288711 - RNA, 22 nt, Human
gagcacagggaauagacagaua

SEQ ID NO: 288712 - RNA, 22 nt, Human
ucugaaauucacaguugaguca

SEQ ID NO: 288713 - RNA, 22 nt, Human
aauguaaaguugggcacaaaug

SEQ ID NO: 288714 - RNA, 22 nt, Human
gauaagcacuauauaaguauuu

SEQ ID NO: 288715 - RNA, 22 nt, Human
uucaggaaucaaccaagucauu

SEQ ID NO: 288716 - RNA, 22 nt, Human
ugggaagaguuagagacagcug

SEQ ID NO: 288717 - RNA, 22 nt, Human
uuucaaguucuguuccuaaacu

SEQ ID NO: 288718 - RNA, 22 nt, Human
uuucacaucagagguagauuag

SEQ ID NO: 288719 - RNA, 20 nt, Human
ggcaggugcucgcuuggucu

SEQ ID NO: 288720 - RNA, 22 nt, Human
uucuguuucuggggucucugac

SEQ ID NO: 288721 - RNA, 22 nt, Human
agggucaacauuucauugauuc

SEQ ID NO: 288722 - RNA, 22 nt, Human
aauaaauguuaagauugucuca

SEQ ID NO: 288723 - RNA, 19 nt, Human
ccugcagggaugagagguu

SEQ ID NO: 288724 - RNA, 19 nt, Human
uagaaagaugauggguggg

SEQ ID NO: 288725 - RNA, 22 nt, Human
gggcaaguccggugcccagagc

SEQ ID NO: 288726 - RNA, 22 nt, Human
ucugccugagcagagggaggcc

SEQ ID NO: 288727 - RNA, 22 nt, Human
caugacaauaagccagcagaaa

SEQ ID NO: 288728 - RNA, 22 nt, Human
gagggcagagacagugauucac

SEQ ID NO: 288729 - RNA, 22 nt, Human
gggacccugggaggcuggcgca

SEQ ID NO: 288730 - RNA, 23 nt, Human
uuucaguugagaaugcacggacc

SEQ ID NO: 288731 - RNA, 22 nt, Human
gcuggaggaucacuugagccca

SEQ ID NO: 288732 - RNA, 22 nt, Human
aggaggaagggaagacaaguaa

SEQ ID NO: 288733 - RNA, 22 nt, Human
aggcuguguucugguucuuagc

SEQ ID NO: 288734 - RNA, 22 nt, Human
aagugccccaggcuguuaacau

SEQ ID NO: 288735 - RNA, 22 nt, Human
auuuaagaggcugcuagaguau

SEQ ID NO: 288736 - RNA, 22 nt, Human
aagaaaacaaugacuugccagc

SEQ ID NO: 288737 - RNA, 16 nt, Human
ucuuaguuguguggua

SEQ ID NO: 288738 - RNA, 22 nt, Human
auuucuggauuuuggaugcugc

SEQ ID NO: 288739 - RNA, 22 nt, Human
gaaucagccugaguuugcagcu

SEQ ID NO: 288740 - RNA, 22 nt, Human
uucuuuauggaauggugauagu

SEQ ID NO: 288741 - RNA, 22 nt, Human
ggcucugggucuguggggagcg

SEQ ID NO: 288742 - RNA, 22 nt, Human
aaguccuuggagaauagaaagg

SEQ ID NO: 288743 - RNA, 22 nt, Human
cuguauuaguccauuugagcug

SEQ ID NO: 288744 - RNA, 22 nt, Human
acaggugguaaaauggacuguc

SEQ ID NO: 288745 - RNA, 22 nt, Human
uagcuucucauaauuuaugcug

SEQ ID NO: 288746 - RNA, 22 nt, Human
cagguuuacaaaguaaagugug

SEQ ID NO: 288747 - RNA, 22 nt, Human
gccuguuuguuugcaaaggagc

SEQ ID NO: 288748 - RNA, 22 nt, Human
gccuguuuggcugcugacauug

SEQ ID NO: 288749 - RNA, 22 nt, Human
aguccuggugacacuccucuuc

SEQ ID NO: 288750 - RNA, 22 nt, Human
accugcaggggugcucucuggg

SEQ ID NO: 288751 - RNA, 22 nt, Human
gcaugcaguaaaauucagcaac

SEQ ID NO: 288752 - RNA, 22 nt, Human
uccaggcuggagugcaguggca

SEQ ID NO: 288753 - RNA, 22 nt, Human
gcuggcagcauuagacccuggg

SEQ ID NO: 288754 - RNA, 22 nt, Human
uucuuuauagcuauuggaugag

SEQ ID NO: 288755 - RNA, 22 nt, Human
auuucacagcugucaguguuac

SEQ ID NO: 288756 - RNA, 22 nt, Human
uuccuuccauagcaaaacaugc

SEQ ID NO: 288757 - RNA, 21 nt, Human
gauuugcagaaacuagacagg

SEQ ID NO: 288758 - RNA, 22 nt, Human
agucucaagcaccgaaagcugu

SEQ ID NO: 288759 - RNA, 22 nt, Human
ucagagagcagaacuuuuuuac

SEQ ID NO: 288760 - RNA, 22 nt, Human
uggaaugaauuuggcuuccucc

SEQ ID NO: 288761 - RNA, 20 nt, Human
ccuucuccagcuuguucuug

SEQ ID NO: 288762 - RNA, 22 nt, Human
ucacagaaugucuagcauaauu

SEQ ID NO: 288763 - RNA, 22 nt, Human
cugccugccacguucagcugua

SEQ ID NO: 288764 - RNA, 22 nt, Human
ccuguggcucucuuuggagguc

SEQ ID NO: 288765 - RNA, 22 nt, Human
aggccaggcaacauucugaagu

SEQ ID NO: 288766 - RNA, 22 nt, Human
cuggggugucucgucugccauu

SEQ ID NO: 288767 - RNA, 21 nt, Human
ccuagccucuuacccagcuuu

SEQ ID NO: 288768 - RNA, 22 nt, Human
gcccagcaggggauggcagcuc

SEQ ID NO: 288769 - RNA, 22 nt, Human
gaaaacuaacggaaaaguuagg

SEQ ID NO: 288770 - RNA, 22 nt, Human
uguaauuauuucugugcaguca

SEQ ID NO: 288771 - RNA, 22 nt, Human
uguaagaauaaugauuucuaag

SEQ ID NO: 288772 - RNA, 18 nt, Human
cuccuggcugauggugag

SEQ ID NO: 288773 - RNA, 22 nt, Human
ugauggucaacaauuuugagug

SEQ ID NO: 288774 - RNA, 22 nt, Human
ggggcucaguucggacagccug

SEQ ID NO: 288775 - RNA, 22 nt, Human
cauaaauuguacccauuccaac

SEQ ID NO: 288776 - RNA, 22 nt, Human
aagaacuuccuaauauauuuuc

SEQ ID NO: 288777 - RNA, 22 nt, Human
agggccugggccagcacccuuu

SEQ ID NO: 288778 - RNA, 22 nt, Human
uuccaggcuauccggugaaggg

SEQ ID NO: 288779 - RNA, 22 nt, Human
cuguuauuuagaacauggaauc

SEQ ID NO: 288780 - RNA, 22 nt, Human
gucaauauagguuucaaacaug

SEQ ID NO: 288781 - RNA, 22 nt, Human
agauggucaaggauacuguuca

SEQ ID NO: 288782 - RNA, 22 nt, Human
cccuuccugggugucccggagu

SEQ ID NO: 288783 - RNA, 22 nt, Human
cugucccuucauuauucacuac

SEQ ID NO: 288784 - RNA, 22 nt, Human
aagcauuuuagauaaagcauca

SEQ ID NO: 288785 - RNA, 22 nt, Human
uauacaguuaaguuucuucagu

SEQ ID NO: 288786 - RNA, 22 nt, Human
ggacagacuuuacagccccggg

SEQ ID NO: 288787 - RNA, 22 nt, Human
caggacugauguuccuccagcc

SEQ ID NO: 288788 - RNA, 22 nt, Human
gcagacagcauguugggcuauu

SEQ ID NO: 288789 - RNA, 22 nt, Human
agggcuuucuuuguaaaagaag

SEQ ID NO: 288790 - RNA, 22 nt, Human
uuguagaaaauucucuuggaua

SEQ ID NO: 288791 - RNA, 22 nt, Human
ggcagaccucuccagccccaca

SEQ ID NO: 288792 - RNA, 20 nt, Human
cccagggaccugagcuccau

SEQ ID NO: 288793 - RNA, 22 nt, Human
aguuguaagaggcacaaggaag

SEQ ID NO: 288794 - RNA, 22 nt, Human
ccuccuggugacaaggcaaagc

SEQ ID NO: 288795 - RNA, 17 nt, Human
uuuacauugcucgcagu

SEQ ID NO: 288796 - RNA, 22 nt, Human
gcuggcagcuggaaguugggcu

SEQ ID NO: 288797 - RNA, 22 nt, Human
ucugaaagaugagugguccauu

SEQ ID NO: 288798 - RNA, 22 nt, Human
ucuggcucccagccugcucuca

SEQ ID NO: 288799 - RNA, 22 nt, Human
uugcagggaaaucagugaggau

SEQ ID NO: 288800 - RNA, 19 nt, Human
uccagaugauauggauuac

SEQ ID NO: 288801 - RNA, 22 nt, Human
agggccaguauuaagguaauua

SEQ ID NO: 288802 - RNA, 22 nt, Human
gcaguguuguuaaaagauuaga

SEQ ID NO: 288803 - RNA, 22 nt, Human
ucauggcuuuuauuauguugag

SEQ ID NO: 288804 - RNA, 22 nt, Human
ggaggccagggacccagucagc

SEQ ID NO: 288805 - RNA, 22 nt, Human
caccagccagagugacagcucc

SEQ ID NO: 288806 - RNA, 22 nt, Human
uuucuuuauccuccuuugcaca

SEQ ID NO: 288807 - RNA, 22 nt, Human
ucaaaguauaauugcuuuuuug

SEQ ID NO: 288808 - RNA, 22 nt, Human
ucugggugccacugucuguaca

SEQ ID NO: 288809 - RNA, 22 nt, Human
uugaauuauaagugugucuacu

SEQ ID NO: 288810 - RNA, 22 nt, Human
agucucagggccacccggggaa

SEQ ID NO: 288811 - RNA, 22 nt, Human
aaggugucucucugcuucuugg

SEQ ID NO: 288812 - RNA, 22 nt, Human
uuaugcaaaggggccucuuccu

SEQ ID NO: 288813 - RNA, 22 nt, Human
ucaucuguggcugcuuuugugc

SEQ ID NO: 288814 - RNA, 19 nt, Human
cugaaaaacauucucagga

SEQ ID NO: 288815 - RNA, 22 nt, Human
auguagaguagaauaguacaac

SEQ ID NO: 288816 - RNA, 23 nt, Human
aaauaggaguaucuggaucauga

SEQ ID NO: 288817 - RNA, 22 nt, Human
uguuuauugagugccuacuaua

SEQ ID NO: 288818 - RNA, 22 nt, Human
uuauguaccugaauuaguaaag

SEQ ID NO: 288819 - RNA, 21 nt, Human
ccuucuccacagggucuccgg

SEQ ID NO: 288820 - RNA, 23 nt, Human
cucaacccuaguaagggaguagg

SEQ ID NO: 288821 - RNA, 22 nt, Human
uggagagguuuaaacaaaaguu

SEQ ID NO: 288822 - RNA, 22 nt, Human
uuacauucauugaagugauuca

SEQ ID NO: 288823 - RNA, 22 nt, Human
agcuuuaugggagcuuagauaa

SEQ ID NO: 288824 - RNA, 22 nt, Human
guugucuuagucagaaauaugc

SEQ ID NO: 288825 - RNA, 22 nt, Human
aauuuuguuuaagugaucugcu

SEQ ID NO: 288826 - RNA, 22 nt, Human
aagggcucucugcauugaaauu

SEQ ID NO: 288827 - RNA, 22 nt, Human
cagugccacuuaaugaggcugc

SEQ ID NO: 288828 - RNA, 22 nt, Human
aucucccaaauuagccucuuga

SEQ ID NO: 288829 - RNA, 22 nt, Human
uauuugaagauucuucugaugu

SEQ ID NO: 288830 - RNA, 22 nt, Human
gcaaagcugggugugaaugcac

SEQ ID NO: 288831 - RNA, 22 nt, Human
gccuccuguuaugccaugugcc

SEQ ID NO: 288832 - RNA, 22 nt, Human
acagagcucccagccaucuccu

SEQ ID NO: 288833 - RNA, 22 nt, Human
cagcaacaugugguaguguagg

SEQ ID NO: 288834 - RNA, 23 nt, Human
cccagggacacgaugacaccucc

SEQ ID NO: 288835 - RNA, 22 nt, Human
aucaauaucagaucagacagga

SEQ ID NO: 288836 - RNA, 22 nt, Human
cuguccugaggcagguggccug

SEQ ID NO: 288837 - RNA, 21 nt, Human
agcuuacauuaccauuguugc

SEQ ID NO: 288838 - RNA, 22 nt, Human
cuaguuuaaagcagcugaaagg

SEQ ID NO: 288839 - RNA, 22 nt, Human
agcugcaacuguccuugccuug

SEQ ID NO: 288840 - RNA, 22 nt, Human
uauuuaauuagugauuguagag

SEQ ID NO: 288841 - RNA, 22 nt, Human
uaccugcacagccagccaugug

SEQ ID NO: 288842 - RNA, 18 nt, Human
aguguucucguuuuauaa

SEQ ID NO: 288843 - RNA, 22 nt, Human
gcugagcugggacaguccuggg

SEQ ID NO: 288844 - RNA, 22 nt, Human
auccuucuccagucguauuuuu

SEQ ID NO: 288845 - RNA, 22 nt, Human
acuuagaagaugcaguaaagca

SEQ ID NO: 288846 - RNA, 22 nt, Human
cauuuguaucauauguaucuua

SEQ ID NO: 288847 - RNA, 22 nt, Human
uuggugaauugagaccauuugu

SEQ ID NO: 288848 - RNA, 21 nt, Human
auuucagagcacacaaguaaa

SEQ ID NO: 288849 - RNA, 20 nt, Human
cauuuguuagcuuucuacug

SEQ ID NO: 288850 - RNA, 22 nt, Human
cccagugucuccaacaucagau

SEQ ID NO: 288851 - RNA, 22 nt, Human
cagcaugaauguguucguaggg

SEQ ID NO: 288852 - RNA, 22 nt, Human
acagcacuuuacuucucaguga

SEQ ID NO: 288853 - RNA, 22 nt, Human
auucgcacauuaacacucauau

SEQ ID NO: 288854 - RNA, 22 nt, Human
agcacaggaacauggagauggg

SEQ ID NO: 288855 - RNA, 19 nt, Human
cuguccugguuuggucccu

SEQ ID NO: 288856 - RNA, 22 nt, Human
ccuguggcugccccgcuguugg

SEQ ID NO: 288857 - RNA, 22 nt, Human
ucccagggugcgccugcccucg

SEQ ID NO: 288858 - RNA, 22 nt, Human
uauaaaacagaaagcacuaccu

SEQ ID NO: 288859 - RNA, 22 nt, Human
cccugcagcuuuugcauaguca

SEQ ID NO: 288860 - RNA, 22 nt, Human
uugggugguggggagaguucag

SEQ ID NO: 288861 - RNA, 22 nt, Human
uagggaugagcaacugguagug

SEQ ID NO: 288862 - RNA, 22 nt, Human
aguuauaaucugcuacugauau

SEQ ID NO: 288863 - RNA, 22 nt, Human
ccagagaaagcucacaggcagu

SEQ ID NO: 288864 - RNA, 22 nt, Human
uguagaaaauuggagcauucau

SEQ ID NO: 288865 - RNA, 22 nt, Human
acauuguaaauaccuuuaucac

SEQ ID NO: 288866 - RNA, 22 nt, Human
acuuaaaaacagauccagcagg

SEQ ID NO: 288867 - RNA, 22 nt, Human
ccuacaguuauauucuugauug

SEQ ID NO: 288868 - RNA, 22 nt, Human
aagagcaucaaugacucgcagu

SEQ ID NO: 288869 - RNA, 22 nt, Human
uuugcugaacuaaaauucugaa

SEQ ID NO: 288870 - RNA, 22 nt, Human
gcuggaggcaguucagacacca

SEQ ID NO: 288871 - RNA, 22 nt, Human
uuggaaaauguauuucuagaag

SEQ ID NO: 288872 - RNA, 22 nt, Human
ccugagugccaugagagcaccc

SEQ ID NO: 288873 - RNA, 21 nt, Human
aggcugcuggcucaggguccu

SEQ ID NO: 288874 - RNA, 22 nt, Human
gcaugugucuccccaguggagg

SEQ ID NO: 288875 - RNA, 22 nt, Human
accacuguacuauuugaguggc

SEQ ID NO: 288876 - RNA, 22 nt, Human
gagggcaggggucuugcacggu

SEQ ID NO: 288877 - RNA, 22 nt, Human
agaaagcacgggccccaggcuc

SEQ ID NO: 288878 - RNA, 22 nt, Human
gcuuccuggagggagagagcug

SEQ ID NO: 288879 - RNA, 22 nt, Human
guguaaguaucuuuguaucuuu

SEQ ID NO: 288880 - RNA, 22 nt, Human
ucuguucaagacugaggugaca

SEQ ID NO: 288881 - RNA, 22 nt, Human
acagucuaggccuaggucaaaa

SEQ ID NO: 288882 - RNA, 22 nt, Human
acagaggguguggaggaagacg

SEQ ID NO: 288883 - RNA, 22 nt, Human
uaacaguuuugaguuuugcuuc

SEQ ID NO: 288884 - RNA, 22 nt, Human
gcaggugguggcgcgcgcccug

SEQ ID NO: 288885 - RNA, 20 nt, Human
acuggcagccugccugcugu

SEQ ID NO: 288886 - RNA, 22 nt, Human
auuggcuuugauaucuaaaggg

SEQ ID NO: 288887 - RNA, 22 nt, Human
gagggaggugauacugaacgua

SEQ ID NO: 288888 - RNA, 22 nt, Human
auuguacaaugcugagguuugg

SEQ ID NO: 288889 - RNA, 20 nt, Human
accuacauguauagugaggg

SEQ ID NO: 288890 - RNA, 22 nt, Human
agagggugcuggagagacauug

SEQ ID NO: 288891 - RNA, 22 nt, Human
ggcaagagggcagauggagugc

SEQ ID NO: 288892 - RNA, 22 nt, Human
uguccaggucagcagcagggac

SEQ ID NO: 288893 - RNA, 22 nt, Human
caaagcaguuuuaaucaaguag

SEQ ID NO: 288894 - RNA, 23 nt, Human
gggcuccagucucugcucaguug

SEQ ID NO: 288895 - RNA, 22 nt, Human
cuggaggagagucugaaugaca

SEQ ID NO: 288896 - RNA, 22 nt, Human
uauuuuacuauuuggcaaaguc

SEQ ID NO: 288897 - RNA, 22 nt, Human
cugcugucuuuauuucacugcu

SEQ ID NO: 288898 - RNA, 22 nt, Human
uccuggguagagaccugaugaa

SEQ ID NO: 288899 - RNA, 22 nt, Human
gcaaggaggcugguggaggaag

SEQ ID NO: 288900 - RNA, 22 nt, Human
gacaguuuugcugaaauugagc

SEQ ID NO: 288901 - RNA, 22 nt, Human
uuauuuuuaaaaguucacacag

SEQ ID NO: 288902 - RNA, 22 nt, Human
cucagagaaaaggagcaagggu

SEQ ID NO: 288903 - RNA, 22 nt, Human
accauucuuuacacuuauuucu

SEQ ID NO: 288904 - RNA, 22 nt, Human
ucuaaccuuugaaacugcuuuc

SEQ ID NO: 288905 - RNA, 16 nt, Human
gcaggcagaucacaug

SEQ ID NO: 288906 - RNA, 22 nt, Human
cugucuguuaucucaccagucc

SEQ ID NO: 288907 - RNA, 22 nt, Human
gugcaggggaucagguugcagc

SEQ ID NO: 288908 - RNA, 22 nt, Human
cagcuuugugcaaugcagucuc

SEQ ID NO: 288909 - RNA, 22 nt, Human
gaaaaaugagcugaugucaggg

SEQ ID NO: 288910 - RNA, 22 nt, Human
ugcugugggauauauguucaaa

SEQ ID NO: 288911 - RNA, 22 nt, Human
ugcuggcugcagugcugucaaa

SEQ ID NO: 288912 - RNA, 22 nt, Human
ccuggcaguggugaagaagagg

SEQ ID NO: 288913 - RNA, 22 nt, Human
uucaacaaugaaagcuaaggaa

SEQ ID NO: 288914 - RNA, 22 nt, Human
ccagggcagggaccacgugucu

SEQ ID NO: 288915 - RNA, 22 nt, Human
uuucacauucagauauagacuu

SEQ ID NO: 288916 - RNA, 22 nt, Human
aauguuaaaaccuucagugcuu

SEQ ID NO: 288917 - RNA, 22 nt, Human
acauaacaaucauaggacauag

SEQ ID NO: 288918 - RNA, 22 nt, Human
gaggacucugggcguguauggg

SEQ ID NO: 288919 - RNA, 22 nt, Human
ucuuugaaagcuguucuagagu

SEQ ID NO: 288920 - RNA, 22 nt, Human
uaggaaauugccaauauaugac

SEQ ID NO: 288921 - RNA, 22 nt, Human
ugcaggugcuccgggggugccc

SEQ ID NO: 288922 - RNA, 19 nt, Human
auucagcauucugcacuuc

SEQ ID NO: 288923 - RNA, 22 nt, Human
cuucuucauguauugauagucu

SEQ ID NO: 288924 - RNA, 22 nt, Human
cacaggcuccggccuugcagcc

SEQ ID NO: 288925 - RNA, 22 nt, Human
aggggaaggccagccuguagag

SEQ ID NO: 288926 - RNA, 22 nt, Human
acauauuuccaugcagcauguc

SEQ ID NO: 288927 - RNA, 22 nt, Human
aggacuuagaacauuauguacu

SEQ ID NO: 288928 - RNA, 23 nt, Human
gagaccagggccagcugugucau

SEQ ID NO: 288929 - RNA, 22 nt, Human
cccuuccuugugacuggugggg

SEQ ID NO: 288930 - RNA, 22 nt, Human
cagggaugagaaagcucucuaa

SEQ ID NO: 288931 - RNA, 22 nt, Human
ggacagaggguugacagaguau

SEQ ID NO: 288932 - RNA, 22 nt, Human
uagcagggauacaaggucgccu

SEQ ID NO: 288933 - RNA, 22 nt, Human
acccagggcucaagcguaggca

SEQ ID NO: 288934 - RNA, 23 nt, Human
caugugugacaguaucacuguuu

SEQ ID NO: 288935 - RNA, 22 nt, Human
ucucuucccuuuaugguaugug

SEQ ID NO: 288936 - RNA, 22 nt, Human
aauguguuuuaugagagaauau

SEQ ID NO: 288937 - RNA, 21 nt, Human
ccuguggauuuuaaaauugga

SEQ ID NO: 288938 - RNA, 22 nt, Human
ucauuucuguugugcaucacug

SEQ ID NO: 288939 - RNA, 22 nt, Human
gccuacaugcuuuuaguguuuc

SEQ ID NO: 288940 - RNA, 22 nt, Human
gacuggggcucuagccaggccu

SEQ ID NO: 288941 - RNA, 22 nt, Human
acaugucaauuuaguacucuua

SEQ ID NO: 288942 - RNA, 22 nt, Human
ugaggaugguuaaagaacauug

SEQ ID NO: 288943 - RNA, 17 nt, Human
cagugcagagcccuuuc

SEQ ID NO: 288944 - RNA, 22 nt, Human
guguuuuggccauuagugugau

SEQ ID NO: 288945 - RNA, 22 nt, Human
cggacccacucggaucccagcc

SEQ ID NO: 288946 - RNA, 22 nt, Human
uccuggcccucugcaaacgcca

SEQ ID NO: 288947 - RNA, 22 nt, Human
caguauguucuuccaggacaga

SEQ ID NO: 288948 - RNA, 22 nt, Human
uccuggcacuuugggggcucgc

SEQ ID NO: 288949 - RNA, 22 nt, Human
augcaaacauguuuccucuaag

SEQ ID NO: 288950 - RNA, 22 nt, Human
cagagacaggaucucgaagacu

SEQ ID NO: 288951 - RNA, 23 nt, Human
aguuaggucaaguuaggucaauu

SEQ ID NO: 288952 - RNA, 22 nt, Human
ccacugucugugacaucagaaa

SEQ ID NO: 288953 - RNA, 17 nt, Human
ugccagccugucccagg

SEQ ID NO: 288954 - RNA, 18 nt, Human
agacccucuaagggcagu

SEQ ID NO: 288955 - RNA, 22 nt, Human
aagcccuguucuuucucucacc

SEQ ID NO: 288956 - RNA, 22 nt, Human
ucagggcauccauugccuguug

SEQ ID NO: 288957 - RNA, 22 nt, Human
ugauggcucauguuuggggaug

SEQ ID NO: 288958 - RNA, 21 nt, Human
acagcagggcuggcaugacag

SEQ ID NO: 288959 - RNA, 22 nt, Human
cauuuguuggucagauuguagu

SEQ ID NO: 288960 - RNA, 23 nt, Human
ucucuuucaagagcuuaaugugc

SEQ ID NO: 288961 - RNA, 22 nt, Human
uccaaggaggagcuggagauug

SEQ ID NO: 288962 - RNA, 22 nt, Human
agagggaaauccaggagugcuu

SEQ ID NO: 288963 - RNA, 22 nt, Human
cuuccagguccuucuugagaag

SEQ ID NO: 288964 - RNA, 22 nt, Human
uacacugugacaaucaugacag

SEQ ID NO: 288965 - RNA, 22 nt, Human
ugucugggagggacagggcuac

SEQ ID NO: 288966 - RNA, 22 nt, Human
cccaggcagcggggucuccuug

SEQ ID NO: 288967 - RNA, 22 nt, Human
ggcuguggacacugagcucaga

SEQ ID NO: 288968 - RNA, 22 nt, Human
uacccagcccaugccuaccuca

SEQ ID NO: 288969 - RNA, 22 nt, Human
caugaaacaucagagauuucuc

SEQ ID NO: 288970 - RNA, 22 nt, Human
gccauugagauugaaguaagca

SEQ ID NO: 288971 - RNA, 22 nt, Human
ugcucagcuucagaggaucccc

SEQ ID NO: 288972 - RNA, 22 nt, Human
aaacuucagacuccccacuucu

SEQ ID NO: 288973 - RNA, 22 nt, Human
auguuuguugaacaucuacugc

SEQ ID NO: 288974 - RNA, 22 nt, Human
augcaucuaugacuuagacauu

SEQ ID NO: 288975 - RNA, 22 nt, Human
cccaggcacacugaagugacau

SEQ ID NO: 288976 - RNA, 22 nt, Human
ugcuccaggugugccucucaug

SEQ ID NO: 288977 - RNA, 21 nt, Human
guuuucaugauagagucugua

SEQ ID NO: 288978 - RNA, 22 nt, Human
gcaggcagagagggguuuccag

SEQ ID NO: 288979 - RNA, 22 nt, Human
ugcccagcgcccacauucuguc

SEQ ID NO: 288980 - RNA, 22 nt, Human
cagaggccaggcugccugacug

SEQ ID NO: 288981 - RNA, 22 nt, Human
uauuuguauguguguacauaua

SEQ ID NO: 288982 - RNA, 22 nt, Human
gacacaguucuguucuaguagg

SEQ ID NO: 288983 - RNA, 22 nt, Human
cagggcuccaugcagggacucc

SEQ ID NO: 288984 - RNA, 22 nt, Human
uuucaaaccuacuuguauguuu

SEQ ID NO: 288985 - RNA, 22 nt, Human
gccucuguggcucagccuugcu

SEQ ID NO: 288986 - RNA, 22 nt, Human
uuuaaauguuuaaaacucguga

SEQ ID NO: 288987 - RNA, 22 nt, Human
cggccaggcacaguggcccacg

SEQ ID NO: 288988 - RNA, 22 nt, Human
ugaggccagugacauauauuaa

SEQ ID NO: 288989 - RNA, 22 nt, Human
aacaucagaauauccauguugg

SEQ ID NO: 288990 - RNA, 22 nt, Human
uuugcaaagaaauuauugcugu

SEQ ID NO: 288991 - RNA, 22 nt, Human
acauauauuacuaguaaagaca

SEQ ID NO: 288992 - RNA, 22 nt, Human
cucagagauauagucccugcuu

SEQ ID NO: 288993 - RNA, 22 nt, Human
accugccuucucaaggacauga

SEQ ID NO: 288994 - RNA, 22 nt, Human
cuccuggcagcaacauuuauau

SEQ ID NO: 288995 - RNA, 19 nt, Human
cagaugagaaaagugaggu

SEQ ID NO: 288996 - RNA, 22 nt, Human
ugggaucuuuugagauacugug

SEQ ID NO: 288997 - RNA, 20 nt, Human
gaggccucagccucagcucc

SEQ ID NO: 288998 - RNA, 22 nt, Human
uccaggcagucauuaaucucua

SEQ ID NO: 288999 - RNA, 22 nt, Human
augccaguaagucucagcuagg

SEQ ID NO: 289000 - RNA, 22 nt, Human
uguccuggccaaggccuugcuu

SEQ ID NO: 289001 - RNA, 22 nt, Human
guuauaaaugacugcaaaaguu

SEQ ID NO: 289002 - RNA, 23 nt, Human
aaaugacauaugguuucugaagg

SEQ ID NO: 289003 - RNA, 22 nt, Human
cagaagagaugaaauaguauua

SEQ ID NO: 289004 - RNA, 22 nt, Human
ggaggcaggaaagacagguuca

SEQ ID NO: 289005 - RNA, 22 nt, Human
uccuggcagggucuaggucuag

SEQ ID NO: 289006 - RNA, 22 nt, Human
uaucacaggugugauuuacauu

SEQ ID NO: 289007 - RNA, 23 nt, Human
uuaaggagcuugcacucugggug

SEQ ID NO: 289008 - RNA, 22 nt, Human
agaaagcuccccaugagaugau

SEQ ID NO: 289009 - RNA, 22 nt, Human
gagcccuguucaggccuccuca

SEQ ID NO: 289010 - RNA, 23 nt, Human
uguaaaaugggguaguguuacca

SEQ ID NO: 289011 - RNA, 22 nt, Human
gacuggaaagccuguccucaga

SEQ ID NO: 289012 - RNA, 22 nt, Human
aucaauucuuaggaaaauagcu

SEQ ID NO: 289013 - RNA, 22 nt, Human
ugacuuccagcaacuuccucca

SEQ ID NO: 289014 - RNA, 22 nt, Human
aaggccugaacaugaggagaug

SEQ ID NO: 289015 - RNA, 22 nt, Human
agaggccuuucuguugagugaa

SEQ ID NO: 289016 - RNA, 22 nt, Human
ucauguuucucuuacagcagcu

SEQ ID NO: 289017 - RNA, 22 nt, Human
caaauucaaauuucaucagugu

SEQ ID NO: 289018 - RNA, 22 nt, Human
caggcuugugucucagcugcag

SEQ ID NO: 289019 - RNA, 22 nt, Human
uaaaaaacauuacucuguccug

SEQ ID NO: 289020 - RNA, 22 nt, Human
cugccugccuuggccuccagga

SEQ ID NO: 289021 - RNA, 22 nt, Human
ucuccugggcuugguugaaguu

SEQ ID NO: 289022 - RNA, 22 nt, Human
gcuggcagggacagcugcgugu

SEQ ID NO: 289023 - RNA, 22 nt, Human
cccgagugucuacucacuccca

SEQ ID NO: 289024 - RNA, 19 nt, Human
ugucagugauacaugcuuu

SEQ ID NO: 289025 - RNA, 23 nt, Human
cacagguguuucaucuucucagu

SEQ ID NO: 289026 - RNA, 22 nt, Human
ugugcaggugcaggaagggggc

SEQ ID NO: 289027 - RNA, 22 nt, Human
acauuuuaauaugcuuagugug

SEQ ID NO: 289028 - RNA, 22 nt, Human
gaaacccaaacuaagacaguag

SEQ ID NO: 289029 - RNA, 22 nt, Human
acuggguguauuagugguguuu

SEQ ID NO: 289030 - RNA, 22 nt, Human
uugcuuuagggcaaauauuuca

SEQ ID NO: 289031 - RNA, 22 nt, Human
aacauuucagcaaauaagaaca

SEQ ID NO: 289032 - RNA, 22 nt, Human
agagccaggcucccauggggca

SEQ ID NO: 289033 - RNA, 22 nt, Human
ucucccucuuugucugcuuugg

SEQ ID NO: 289034 - RNA, 22 nt, Human
cggccgcagcagugucggccca

SEQ ID NO: 289035 - RNA, 22 nt, Human
ccuggcuccugcacagaucuuu

SEQ ID NO: 289036 - RNA, 22 nt, Human
cuggugcauguggccuugcucu

SEQ ID NO: 289037 - RNA, 22 nt, Human
acagguguaugaauauguucca

SEQ ID NO: 289038 - RNA, 23 nt, Human
uuuauccaacucuguaaucucuc

SEQ ID NO: 289039 - RNA, 22 nt, Human
ugcagguggcuccagggacugc

SEQ ID NO: 289040 - RNA, 22 nt, Human
gggagggagaggacaguucuau

SEQ ID NO: 289041 - RNA, 22 nt, Human
uccugcagcugaagcucaugug

SEQ ID NO: 289042 - RNA, 22 nt, Human
cccagcagccuugucccuucuc

SEQ ID NO: 289043 - RNA, 22 nt, Human
caggucccugcgccccggccuc

SEQ ID NO: 289044 - RNA, 22 nt, Human
ccagggaugccaagcuuuacca

SEQ ID NO: 289045 - RNA, 22 nt, Human
aauguuauuacacuugugaaau

SEQ ID NO: 289046 - RNA, 22 nt, Human
aacaggcagcagacugaaucug

SEQ ID NO: 289047 - RNA, 22 nt, Human
aaggccucaggugaggcugccc

SEQ ID NO: 289048 - RNA, 22 nt, Human
guccuggcccacuggcaggcug

SEQ ID NO: 289049 - RNA, 22 nt, Human
ugaggcuccagccaggccagca

SEQ ID NO: 289050 - RNA, 22 nt, Human
auagcaaauauuuuaaugagca

SEQ ID NO: 289051 - RNA, 22 nt, Human
cucuuccuacagucugcuaugc

SEQ ID NO: 289052 - RNA, 22 nt, Human
aagauuuucagcuaauggugca

SEQ ID NO: 289053 - RNA, 22 nt, Human
uucacauuccgcggcuauuuuc

SEQ ID NO: 289054 - RNA, 22 nt, Human
agguucuuggugagcauuuggu

SEQ ID NO: 289055 - RNA, 22 nt, Human
uauugcugcuauugucaguuca

SEQ ID NO: 289056 - RNA, 22 nt, Human
cucuuaguaaugccaugaagca

SEQ ID NO: 289057 - RNA, 22 nt, Human
augugguuuuggauuauucaug

SEQ ID NO: 289058 - RNA, 22 nt, Human
ccaggugucuguggccagcccu

SEQ ID NO: 289059 - RNA, 22 nt, Human
aggacaugugccuccagggcag

SEQ ID NO: 289060 - RNA, 22 nt, Human
ucagguagugguuaaguucugu

SEQ ID NO: 289061 - RNA, 22 nt, Human
ucaaauaccagcaauuucaugu

SEQ ID NO: 289062 - RNA, 22 nt, Human
gaugugucuggcuccccugcaa

SEQ ID NO: 289063 - RNA, 22 nt, Human
uugaggaggacagaaacauuua

SEQ ID NO: 289064 - RNA, 22 nt, Human
ugagggaauccucacaucaauc

SEQ ID NO: 289065 - RNA, 22 nt, Human
agucucucuugggugugguuug

SEQ ID NO: 289066 - RNA, 22 nt, Human
uacacaugugcacgcguguccu

SEQ ID NO: 289067 - RNA, 22 nt, Human
uuugacucaagccuuucuuuag

SEQ ID NO: 289068 - RNA, 22 nt, Human
aagaagaaguguuauuuuuaga

SEQ ID NO: 289069 - RNA, 22 nt, Human
aggccaagauuuuggaucagcu

SEQ ID NO: 289070 - RNA, 22 nt, Human
uauuguuucuggcuguggcagc

SEQ ID NO: 289071 - RNA, 22 nt, Human
gaggagggcuuuguugauguua

SEQ ID NO: 289072 - RNA, 22 nt, Human
agcuguggccagaugugagcgg

SEQ ID NO: 289073 - RNA, 22 nt, Human
aaagcagagguugcagugagcu

SEQ ID NO: 289074 - RNA, 22 nt, Human
aaagccuuuuaugaucaguuaa

SEQ ID NO: 289075 - RNA, 22 nt, Human
accuugucuuuuauagaacaag

SEQ ID NO: 289076 - RNA, 22 nt, Human
guuauacauauguguuaacaaa

SEQ ID NO: 289077 - RNA, 22 nt, Human
aguuagcagcuuauuagaaaca

SEQ ID NO: 289078 - RNA, 22 nt, Human
acccaggguagaaccucagagc

SEQ ID NO: 289079 - RNA, 22 nt, Human
ggcaggcauugcaacauguaca

SEQ ID NO: 289080 - RNA, 22 nt, Human
ggugcaugguggaggugacccu

SEQ ID NO: 289081 - RNA, 23 nt, Human
uucauucaaaaggaaaagucaug

SEQ ID NO: 289082 - RNA, 22 nt, Human
uuaacaaggugacugcauuaaa

SEQ ID NO: 289083 - RNA, 22 nt, Human
gauugcugaagaaagugaguga

SEQ ID NO: 289084 - RNA, 22 nt, Human
ccagugucuacuguggcauauc

SEQ ID NO: 289085 - RNA, 19 nt, Human
gaaggggaagguggguacc

SEQ ID NO: 289086 - RNA, 22 nt, Human
uucaaauacauucuuugccacu

SEQ ID NO: 289087 - RNA, 22 nt, Human
gcuguggcuugcagcuggggcu

SEQ ID NO: 289088 - RNA, 22 nt, Human
cauuuccacucugggagucaga

SEQ ID NO: 289089 - RNA, 22 nt, Human
ugggcaggauaauaucucaugu

SEQ ID NO: 289090 - RNA, 22 nt, Human
guuuauaaauucugcuuuuguu

SEQ ID NO: 289091 - RNA, 22 nt, Human
agggaugaucaggguagaggcu

SEQ ID NO: 289092 - RNA, 22 nt, Human
uuugaacugauaaucuucuguu

SEQ ID NO: 289093 - RNA, 22 nt, Human
caauaaagaagauuuuugcaau

SEQ ID NO: 289094 - RNA, 21 nt, Human
ucagagagucacagugaacug

SEQ ID NO: 289095 - RNA, 22 nt, Human
ucugcaaacuggcucuuacugc

SEQ ID NO: 289096 - RNA, 22 nt, Human
ugguccuggaagguccugaggg

SEQ ID NO: 289097 - RNA, 22 nt, Human
aggaauguguuucuaggcuguu

SEQ ID NO: 289098 - RNA, 22 nt, Human
ggucuggauaauuccaguaccu

SEQ ID NO: 289099 - RNA, 22 nt, Human
gccaggcaaauuaaggaaugca

SEQ ID NO: 289100 - RNA, 22 nt, Human
ccccagggacugguuucaugga

SEQ ID NO: 289101 - RNA, 22 nt, Human
ucucugggccucccuuuccaag

SEQ ID NO: 289102 - RNA, 22 nt, Human
gaaacugaauauaagaaaggua

SEQ ID NO: 289103 - RNA, 22 nt, Human
gugcaaaaguaaaugugguuuu

SEQ ID NO: 289104 - RNA, 22 nt, Human
uuucauuacguguuugacuugu

SEQ ID NO: 289105 - RNA, 22 nt, Human
gauaaauuaucagggguuuaaa

SEQ ID NO: 289106 - RNA, 23 nt, Human
acuuuauugaccccaggucaguu

SEQ ID NO: 289107 - RNA, 22 nt, Human
agcuuuaucccuugcccaucga

SEQ ID NO: 289108 - RNA, 22 nt, Human
ccuccuggaaaaauucccuggc

SEQ ID NO: 289109 - RNA, 22 nt, Human
uagacauuucugguuauugaca

SEQ ID NO: 289110 - RNA, 22 nt, Human
gaacuugguauuccuuuuaaca

SEQ ID NO: 289111 - RNA, 22 nt, Human
cagagcugcacauucuaugaug

SEQ ID NO: 289112 - RNA, 19 nt, Human
gucacauuugucucccagg

SEQ ID NO: 289113 - RNA, 19 nt, Human
aguuuauuauaggugauuc

SEQ ID NO: 289114 - RNA, 22 nt, Human
aagaaagauaagguuugcuugg

SEQ ID NO: 289115 - RNA, 22 nt, Human
ugucaaaaauaagagagauugu

SEQ ID NO: 289116 - RNA, 22 nt, Human
aaguuccugggccaaguccagg

SEQ ID NO: 289117 - RNA, 22 nt, Human
cuauuuucauucuuacauuguc

SEQ ID NO: 289118 - RNA, 22 nt, Human
gccaacaggccuugcucugcuc

SEQ ID NO: 289119 - RNA, 22 nt, Human
cugggcucagugucucacuccu

SEQ ID NO: 289120 - RNA, 22 nt, Human
ccauccaggcugugggugagcu

SEQ ID NO: 289121 - RNA, 22 nt, Human
uggcagaaagaaccaugugcaa

SEQ ID NO: 289122 - RNA, 23 nt, Human
cagaaagcccuuuccccacagua

SEQ ID NO: 289123 - RNA, 23 nt, Human
uuuguacauugaggaggcagaau

SEQ ID NO: 289124 - RNA, 22 nt, Human
caggcugcagcagcaguggccc

SEQ ID NO: 289125 - RNA, 21 nt, Human
uucaaaguuugccuaaagauu

SEQ ID NO: 289126 - RNA, 22 nt, Human
ucugggaacagccuggcugugu

SEQ ID NO: 289127 - RNA, 22 nt, Human
cacagacagugucccuuuguug

SEQ ID NO: 289128 - RNA, 21 nt, Human
uccugugaggaccugucagug

SEQ ID NO: 289129 - RNA, 22 nt, Human
ugagaugaauaacuccugcuaa

SEQ ID NO: 289130 - RNA, 22 nt, Human
acagucaaucagaacagcaugu

SEQ ID NO: 289131 - RNA, 22 nt, Human
uaucaucuuguugucaugcagc

SEQ ID NO: 289132 - RNA, 22 nt, Human
uuuuguguccuucacaucaugu

SEQ ID NO: 289133 - RNA, 17 nt, Human
gcuccuucuaacuucca

SEQ ID NO: 289134 - RNA, 22 nt, Human
uaggaaauauuugaacauagga

SEQ ID NO: 289135 - RNA, 22 nt, Human
uugcucauauuugcauguguuu

SEQ ID NO: 289136 - RNA, 22 nt, Human
aauuucaguugcuaauaaguuc

SEQ ID NO: 289137 - RNA, 22 nt, Human
uucuucugauugccuucugcaa

SEQ ID NO: 289138 - RNA, 22 nt, Human
aaauuagaccagggcuccugga

SEQ ID NO: 289139 - RNA, 22 nt, Human
agucaguugcaaacaucaggca

SEQ ID NO: 289140 - RNA, 22 nt, Human
guuaaagugaucuugucagguu

SEQ ID NO: 289141 - RNA, 22 nt, Human
gggccccuugcugcucugcugg

SEQ ID NO: 289142 - RNA, 22 nt, Human
gacuguggccuuggaccauggg

SEQ ID NO: 289143 - RNA, 22 nt, Human
acuguggccuuguggguucagg

SEQ ID NO: 289144 - RNA, 18 nt, Human
gguccugggccuggcuca

SEQ ID NO: 289145 - RNA, 22 nt, Human
ugcugggucagugagagcaggg

SEQ ID NO: 289146 - RNA, 22 nt, Human
uuuucauuguuacuaugagcua

SEQ ID NO: 289147 - RNA, 18 nt, Human
agcagguggcgucugcag

SEQ ID NO: 289148 - RNA, 22 nt, Human
gggccagcaguaucggaggcau

SEQ ID NO: 289149 - RNA, 22 nt, Human
cagcagccuacaaugcacagaa

SEQ ID NO: 289150 - RNA, 22 nt, Human
acacauaagaaacuacaaagag

SEQ ID NO: 289151 - RNA, 18 nt, Human
ccuguggcucagcccaca

SEQ ID NO: 289152 - RNA, 22 nt, Human
uguccucacacguagggaguaa

SEQ ID NO: 289153 - RNA, 22 nt, Human
cuuuccaaugcauuuccaaugu

SEQ ID NO: 289154 - RNA, 22 nt, Human
uggucaagggacagagcugaac

SEQ ID NO: 289155 - RNA, 22 nt, Human
gaaauguuuuacaaggcauacu

SEQ ID NO: 289156 - RNA, 22 nt, Human
uguguggauucaucucaaagag

SEQ ID NO: 289157 - RNA, 22 nt, Human
gugcccaguccugccuugacag

SEQ ID NO: 289158 - RNA, 23 nt, Human
auaagccuuuucuuucugcccca

SEQ ID NO: 289159 - RNA, 22 nt, Human
gcauucaggaaccggaagggua

SEQ ID NO: 289160 - RNA, 20 nt, Human
gggcuagguagccauuuggc

SEQ ID NO: 289161 - RNA, 22 nt, Human
ggcuuuugcuguguuuuccaga

SEQ ID NO: 289162 - RNA, 22 nt, Human
guuaggaacacuggagccuaaa

SEQ ID NO: 289163 - RNA, 22 nt, Human
cacaaugugguuugucaucuuu

SEQ ID NO: 289164 - RNA, 22 nt, Human
gacagacacuguguccucacuu

SEQ ID NO: 289165 - RNA, 22 nt, Human
aggcagguuucccggcugucaa

SEQ ID NO: 289166 - RNA, 22 nt, Human
ugcccuugggauuuagguaagg

SEQ ID NO: 289167 - RNA, 22 nt, Human
ucauggcuaaugcaguauauuc

SEQ ID NO: 289168 - RNA, 18 nt, Human
uccugccugugccccagg

SEQ ID NO: 289169 - RNA, 22 nt, Human
ucagcugcucaaauuuauguca

SEQ ID NO: 289170 - RNA, 22 nt, Human
aucuuguuaaaaugcagauucu

SEQ ID NO: 289171 - RNA, 22 nt, Human
agggcuccugaggcccuucugg

SEQ ID NO: 289172 - RNA, 22 nt, Human
aaggugguuugcagacagaaua

SEQ ID NO: 289173 - RNA, 22 nt, Human
cagcuuuuuagaaucuagggca

SEQ ID NO: 289174 - RNA, 22 nt, Human
guucuguacuccaagcucuucc

SEQ ID NO: 289175 - RNA, 20 nt, Human
uauucaacuuuaaaaacuua

SEQ ID NO: 289176 - RNA, 22 nt, Human
aagaauaaauuaagauacuuag

SEQ ID NO: 289177 - RNA, 22 nt, Human
aaaaccagguagcaaaggagac

SEQ ID NO: 289178 - RNA, 20 nt, Human
ccuuuauuauuuguaugaug

SEQ ID NO: 289179 - RNA, 22 nt, Human
cauagaaugcagcaggaaaguu

SEQ ID NO: 289180 - RNA, 21 nt, Human
aaucauacaaaacaugucagg

SEQ ID NO: 289181 - RNA, 22 nt, Human
aauacuauguagccaaaauaau

SEQ ID NO: 289182 - RNA, 22 nt, Human
guagccagaucugcugugucug

SEQ ID NO: 289183 - RNA, 22 nt, Human
ggauguagugcaaggagugaau

SEQ ID NO: 289184 - RNA, 20 nt, Human
agccaagaacaggcagaacc

SEQ ID NO: 289185 - RNA, 22 nt, Human
auacaugugugugcauacaugu

SEQ ID NO: 289186 - RNA, 22 nt, Human
ugaaagcagcaccaauaccauu

SEQ ID NO: 289187 - RNA, 22 nt, Human
ucccacacuacacgguuguugg

SEQ ID NO: 289188 - RNA, 22 nt, Human
aucugaaauagucuuaucugag

SEQ ID NO: 289189 - RNA, 22 nt, Human
aauguauuccucaugcaagagu

SEQ ID NO: 289190 - RNA, 22 nt, Human
caggaugggauguagugggccc

SEQ ID NO: 289191 - RNA, 22 nt, Human
gagggcaguagccucguacccu

SEQ ID NO: 289192 - RNA, 22 nt, Human
auauucuuccaaaacaucauuu

SEQ ID NO: 289193 - RNA, 22 nt, Human
cagcccuggcgcccccagaucu

SEQ ID NO: 289194 - RNA, 22 nt, Human
ucuguccuguuuccuccugaca

SEQ ID NO: 289195 - RNA, 22 nt, Human
gccugaaguuucaugccucuau

SEQ ID NO: 289196 - RNA, 22 nt, Human
uaaauuguuuucuagaaguugu

SEQ ID NO: 289197 - RNA, 22 nt, Human
gacugaggagguaagguuugaa

SEQ ID NO: 289198 - RNA, 22 nt, Human
gaugagguguguggccacuaga

SEQ ID NO: 289199 - RNA, 22 nt, Human
auucuuuacauuggcuucuucc

SEQ ID NO: 289200 - RNA, 22 nt, Human
gugaggcagaaguucccuuuua

SEQ ID NO: 289201 - RNA, 22 nt, Human
ccaggcucugcgcuggacaugg

SEQ ID NO: 289202 - RNA, 22 nt, Human
uaugccagggacuguuucacca

SEQ ID NO: 289203 - RNA, 22 nt, Human
agaaaauuagauuuuacugugu

SEQ ID NO: 289204 - RNA, 22 nt, Human
guccagaaggaggucaaguugg

SEQ ID NO: 289205 - RNA, 22 nt, Human
ucuuuccucugagcuccuguag

SEQ ID NO: 289206 - RNA, 22 nt, Human
uggaauguuuuccuaaaucaga

SEQ ID NO: 289207 - RNA, 22 nt, Human
uacuuuaucagcgucaaaggua

SEQ ID NO: 289208 - RNA, 22 nt, Human
ucuggcuucuccuagagcaaug

SEQ ID NO: 289209 - RNA, 22 nt, Human
gucaggaaaacccggguugacu

SEQ ID NO: 289210 - RNA, 23 nt, Human
uuccaggcagagcagggauuaga

SEQ ID NO: 289211 - RNA, 15 nt, Human
gcaggcagaucaccg

SEQ ID NO: 289212 - RNA, 22 nt, Human
aaaaaucacuuuuauaggcagc

SEQ ID NO: 289213 - RNA, 22 nt, Human
aagccuuuuccaccuaauagag

SEQ ID NO: 289214 - RNA, 19 nt, Human
uacauuccacacaaucucu

SEQ ID NO: 289215 - RNA, 22 nt, Human
gaggugagaagggggucagaug

SEQ ID NO: 289216 - RNA, 22 nt, Human
aggcaauccccugaggauacuu

SEQ ID NO: 289217 - RNA, 22 nt, Human
gggaccuggcgagggucacaca

SEQ ID NO: 289218 - RNA, 22 nt, Human
acuguucugccaacuuugguua

SEQ ID NO: 289219 - RNA, 22 nt, Human
cugucccaggauccugacucca

SEQ ID NO: 289220 - RNA, 22 nt, Human
cucuguuucucagccuauuucc

SEQ ID NO: 289221 - RNA, 22 nt, Human
acuguccucgaaguaccugugc

SEQ ID NO: 289222 - RNA, 22 nt, Human
cugugcugauucagcacaggcc

SEQ ID NO: 289223 - RNA, 22 nt, Human
uuccuucuuguaaugaucugcc

SEQ ID NO: 289224 - RNA, 22 nt, Human
uucugcuuauucaaaugaucuu

SEQ ID NO: 289225 - RNA, 22 nt, Human
uccuggguggcucugcccggcu

SEQ ID NO: 289226 - RNA, 22 nt, Human
auuuauuaccucggaguuucug

SEQ ID NO: 289227 - RNA, 22 nt, Human
gucaaaacaaaguuaagaauuc

SEQ ID NO: 289228 - RNA, 22 nt, Human
cagcaugaaacaauugagccca

SEQ ID NO: 289229 - RNA, 22 nt, Human
ucucagagugacaaugagaauu

SEQ ID NO: 289230 - RNA, 22 nt, Human
ugacaguuaagguauacauuca

SEQ ID NO: 289231 - RNA, 22 nt, Human
gaaaugaaacaggcuuuuaagg

SEQ ID NO: 289232 - RNA, 22 nt, Human
uucauucaucacaugcagcugg

SEQ ID NO: 289233 - RNA, 21 nt, Human
aggaagaucuggaggucggcg

SEQ ID NO: 289234 - RNA, 22 nt, Human
ucaagagauugaauaauaacug

SEQ ID NO: 289235 - RNA, 22 nt, Human
agaugcugauugaauagauuuc

SEQ ID NO: 289236 - RNA, 22 nt, Human
acacuuuacucuuacaccauug

SEQ ID NO: 289237 - RNA, 22 nt, Human
cuccuaggacgccgcugcuccu

SEQ ID NO: 289238 - RNA, 22 nt, Human
ccugaagagugaauguggcagu

SEQ ID NO: 289239 - RNA, 18 nt, Human
cacaauuuacagaugaca

SEQ ID NO: 289240 - RNA, 22 nt, Human
ucagggcauucaagaggccugg

SEQ ID NO: 289241 - RNA, 23 nt, Human
acauacauggagauaaagugaug

SEQ ID NO: 289242 - RNA, 19 nt, Human
uccaggcauccuucaggcu

SEQ ID NO: 289243 - RNA, 22 nt, Human
acagagagcugugauugaguua

SEQ ID NO: 289244 - RNA, 22 nt, Human
ugaaugauguauaauauugaga

SEQ ID NO: 289245 - RNA, 22 nt, Human
acaggacaggcugggcuagacu

SEQ ID NO: 289246 - RNA, 22 nt, Human
aguggcaaaagcaggcuuaggc

SEQ ID NO: 289247 - RNA, 22 nt, Human
auucuguuacuuggugaucuuc

SEQ ID NO: 289248 - RNA, 22 nt, Human
uuuguaaauagcaguacucaug

SEQ ID NO: 289249 - RNA, 22 nt, Human
acuguucaagcaaaugacauug

SEQ ID NO: 289250 - RNA, 22 nt, Human
ucugaggaccaucggggagcug

SEQ ID NO: 289251 - RNA, 22 nt, Human
cuuucucaaugccggaaggcac

SEQ ID NO: 289252 - RNA, 22 nt, Human
uuaaaugaggcugauguagauu

SEQ ID NO: 289253 - RNA, 22 nt, Human
agcugcaagucuguguggggag

SEQ ID NO: 289254 - RNA, 22 nt, Human
augacagacagaagggauuuuu

SEQ ID NO: 289255 - RNA, 22 nt, Human
uccuggcaguaauuugauguug

SEQ ID NO: 289256 - RNA, 22 nt, Human
uugucucugccaugcuugaggg

SEQ ID NO: 289257 - RNA, 22 nt, Human
acauguggaggaggcgagggua

SEQ ID NO: 289258 - RNA, 22 nt, Human
uuuauugacuucagugagucuu

SEQ ID NO: 289259 - RNA, 22 nt, Human
agguucaaaugcaagagaugcu

SEQ ID NO: 289260 - RNA, 22 nt, Human
auugagcuguuuuguaggauaa

SEQ ID NO: 289261 - RNA, 19 nt, Human
cuuccuggaggagagccuc

SEQ ID NO: 289262 - RNA, 22 nt, Human
ccuggcugcuuccucugccaug

SEQ ID NO: 289263 - RNA, 22 nt, Human
uccugcagccaagggucaucga

SEQ ID NO: 289264 - RNA, 17 nt, Human
ggcaguggaggaagaga

SEQ ID NO: 289265 - RNA, 22 nt, Human
aagccagauuucacucuuaauu

SEQ ID NO: 289266 - RNA, 22 nt, Human
agguauuauuagcaucucuauu

SEQ ID NO: 289267 - RNA, 22 nt, Human
uuucauguggcgaugucucugg

SEQ ID NO: 289268 - RNA, 22 nt, Human
cagagcugugauaaauagauau

SEQ ID NO: 289269 - RNA, 23 nt, Human
uggaauguuucuuguacugaaug

SEQ ID NO: 289270 - RNA, 20 nt, Human
cucucccagcacagcuuccu

SEQ ID NO: 289271 - RNA, 22 nt, Human
aacccgggaggcagagguugug

SEQ ID NO: 289272 - RNA, 22 nt, Human
aguuauuuacuccuuugucucu

SEQ ID NO: 289273 - RNA, 22 nt, Human
uuauucuucuucucuugccagg

SEQ ID NO: 289274 - RNA, 23 nt, Human
ugaaagcaaugggucuauaguau

SEQ ID NO: 289275 - RNA, 22 nt, Human
auguuuguguuucccauucagg

SEQ ID NO: 289276 - RNA, 22 nt, Human
acagaguccuagcugcaaagaa

SEQ ID NO: 289277 - RNA, 22 nt, Human
agcccaaggcuucccugcuggc

SEQ ID NO: 289278 - RNA, 22 nt, Human
gaggacagugugaucugccagc

SEQ ID NO: 289279 - RNA, 20 nt, Human
acaaaguauugaggacaagu

SEQ ID NO: 289280 - RNA, 22 nt, Human
ggaauguuuuccagaccuagau

SEQ ID NO: 289281 - RNA, 19 nt, Human
aaggaauggcuuuaaguag

SEQ ID NO: 289282 - RNA, 22 nt, Human
gaggcugggaaguccaagacca

SEQ ID NO: 289283 - RNA, 22 nt, Human
cuucuagauuuuuguaauuguu

SEQ ID NO: 289284 - RNA, 22 nt, Human
cucgggcaggagggcccucucc

SEQ ID NO: 289285 - RNA, 22 nt, Human
caugaaaaauuuacuguuaaca

SEQ ID NO: 289286 - RNA, 20 nt, Human
aggcagcuggccaggcaggu

SEQ ID NO: 289287 - RNA, 22 nt, Human
cuauugaggacauaaggacucu

SEQ ID NO: 289288 - RNA, 22 nt, Human
gacugccucaguuucccugcag

SEQ ID NO: 289289 - RNA, 22 nt, Human
gauguguccccagaggauugaa

SEQ ID NO: 289290 - RNA, 22 nt, Human
aaaucuguuguaauguuuuuua

SEQ ID NO: 289291 - RNA, 22 nt, Human
aagcacagcagagccuugcuug

SEQ ID NO: 289292 - RNA, 22 nt, Human
cuacauaaucuggauuugucug

SEQ ID NO: 289293 - RNA, 22 nt, Human
agcccagagccccggccauguu

SEQ ID NO: 289294 - RNA, 22 nt, Human
ccagguggacuugauuugaaua

SEQ ID NO: 289295 - RNA, 22 nt, Human
cagauggaaggcauagagguuu

SEQ ID NO: 289296 - RNA, 20 nt, Human
gauuacaaaaugaaaugcau

SEQ ID NO: 289297 - RNA, 22 nt, Human
uuauuuaaaagugguaagauuc

SEQ ID NO: 289298 - RNA, 22 nt, Human
ugugcccaucccucuggagugu

SEQ ID NO: 289299 - RNA, 22 nt, Human
agcugccauggccugaauuuac

SEQ ID NO: 289300 - RNA, 22 nt, Human
agcagguggacagaggaagaaa

SEQ ID NO: 289301 - RNA, 22 nt, Human
accaggcaaaaccacaggagca

SEQ ID NO: 289302 - RNA, 22 nt, Human
cuuguucaguccugacuuccug

SEQ ID NO: 289303 - RNA, 22 nt, Human
caagauuuguauugggccucug

SEQ ID NO: 289304 - RNA, 22 nt, Human
ucuggaggcaacuaaccuaguu

SEQ ID NO: 289305 - RNA, 22 nt, Human
ugucccugccugcccacucugu

SEQ ID NO: 289306 - RNA, 22 nt, Human
gacccauaggaaucuguugucc

SEQ ID NO: 289307 - RNA, 23 nt, Human
uucugaaaauagauaguggcucc

SEQ ID NO: 289308 - RNA, 22 nt, Human
uuguuucagcuguaugcuaugu

SEQ ID NO: 289309 - RNA, 22 nt, Human
agaaucaggaccuguggcuguc

SEQ ID NO: 289310 - RNA, 20 nt, Human
uuccuguauacaaagaguuc

SEQ ID NO: 289311 - RNA, 22 nt, Human
aguguggcaggaaugacuagaa

SEQ ID NO: 289312 - RNA, 22 nt, Human
uugguaaacuugacagagaauc

SEQ ID NO: 289313 - RNA, 22 nt, Human
uuuaauuuucugggcccagcag

SEQ ID NO: 289314 - RNA, 22 nt, Human
uuuuauacuuaagacagaguuu

SEQ ID NO: 289315 - RNA, 22 nt, Human
uucaugaaauucucguguaccu

SEQ ID NO: 289316 - RNA, 22 nt, Human
guuccuuccuaucccgagagcc

SEQ ID NO: 289317 - RNA, 22 nt, Human
gaaguacaguuuuaucuagcca

SEQ ID NO: 289318 - RNA, 19 nt, Human
acaugacaacaggggaggc

SEQ ID NO: 289319 - RNA, 22 nt, Human
aacuacaauauguauguaugua

SEQ ID NO: 289320 - RNA, 22 nt, Human
aagugaggccuaggcacugggu

SEQ ID NO: 289321 - RNA, 22 nt, Human
acuggcagaggauagcacuaau

SEQ ID NO: 289322 - RNA, 22 nt, Human
guccuuccccagccagcucugg

SEQ ID NO: 289323 - RNA, 22 nt, Human
agauuuuauagauaauuuccca

SEQ ID NO: 289324 - RNA, 22 nt, Human
uggcuaagcuggggaggccugg

SEQ ID NO: 289325 - RNA, 18 nt, Human
guguccuggcugcggcgc

SEQ ID NO: 289326 - RNA, 22 nt, Human
acagguggagugguuagcaggc

SEQ ID NO: 289327 - RNA, 22 nt, Human
uucuuuauaucugcuagugggu

SEQ ID NO: 289328 - RNA, 22 nt, Human
ucccagggacccagccugauac

SEQ ID NO: 289329 - RNA, 22 nt, Human
cugccugggccggccacccucu

SEQ ID NO: 289330 - RNA, 21 nt, Human
auuuuguacauagaauuuguc

SEQ ID NO: 289331 - RNA, 22 nt, Human
uggagggauacaaagaugaaaa

SEQ ID NO: 289332 - RNA, 22 nt, Human
agagagagggaaacugcuaaac

SEQ ID NO: 289333 - RNA, 20 nt, Human
aaaggaauauaugaaguaua

SEQ ID NO: 289334 - RNA, 22 nt, Human
aaggacucuccagcuagcaaau

SEQ ID NO: 289335 - RNA, 22 nt, Human
uuucauaaacaguagaagacua

SEQ ID NO: 289336 - RNA, 22 nt, Human
cuuagggagaaugccucugcag

SEQ ID NO: 289337 - RNA, 22 nt, Human
ugacaugugcucaucuuggcua

SEQ ID NO: 289338 - RNA, 22 nt, Human
caugaaggcugccagcaggcau

SEQ ID NO: 289339 - RNA, 22 nt, Human
aaaauuuugcccuauccuucau

SEQ ID NO: 289340 - RNA, 22 nt, Human
uccagaccuagggcaccccagu

SEQ ID NO: 289341 - RNA, 22 nt, Human
gcauccagucuuggcuccugga

SEQ ID NO: 289342 - RNA, 18 nt, Human
agagggaaucaguuggau

SEQ ID NO: 289343 - RNA, 22 nt, Human
gggcagguguugucaaucuaau

SEQ ID NO: 289344 - RNA, 22 nt, Human
aauguuuuguaugccucugagc

SEQ ID NO: 289345 - RNA, 22 nt, Human
uacagucaagcauaagaaguca

SEQ ID NO: 289346 - RNA, 21 nt, Human
gaguccuuccaauguccucag

SEQ ID NO: 289347 - RNA, 22 nt, Human
ugaauaaucuuggguauuaaua

SEQ ID NO: 289348 - RNA, 22 nt, Human
cuucuucaaccugaaaguuuca

SEQ ID NO: 289349 - RNA, 22 nt, Human
guccagaagcucaaguugaacu

SEQ ID NO: 289350 - RNA, 22 nt, Human
uucuuuauuaguuuagugagcu

SEQ ID NO: 289351 - RNA, 22 nt, Human
aaaauaacuucuacuauuugca

SEQ ID NO: 289352 - RNA, 22 nt, Human
aagugcuuaaaaggguggucua

SEQ ID NO: 289353 - RNA, 22 nt, Human
ccuggcucccggaacagggucu

SEQ ID NO: 289354 - RNA, 22 nt, Human
gcuguggcggcagcagcuggug

SEQ ID NO: 289355 - RNA, 22 nt, Human
gugcagagugucuguggacuga

SEQ ID NO: 289356 - RNA, 22 nt, Human
cguccucagaggccauccgaaa

SEQ ID NO: 289357 - RNA, 22 nt, Human
gcagcuuugaagacuuauuugc

SEQ ID NO: 289358 - RNA, 22 nt, Human
aaaguuuuauaugcugcagcga

SEQ ID NO: 289359 - RNA, 22 nt, Human
agcccaggugacucauacaccc

SEQ ID NO: 289360 - RNA, 22 nt, Human
cuacugaguccuucagcugcca

SEQ ID NO: 289361 - RNA, 22 nt, Human
ugaggcaaaguucaagcugaaa

SEQ ID NO: 289362 - RNA, 22 nt, Human
ugcagggcauaggguccaguuu

SEQ ID NO: 289363 - RNA, 22 nt, Human
uuucacauuuaggcgugaauug

SEQ ID NO: 289364 - RNA, 22 nt, Human
cugcccaggcugaaggaacauc

SEQ ID NO: 289365 - RNA, 22 nt, Human
gaaggcauucuauucuacauau

SEQ ID NO: 289366 - RNA, 22 nt, Human
accuguuucucucugaguuacu

SEQ ID NO: 289367 - RNA, 22 nt, Human
ugagcagagucgcuccagagug

SEQ ID NO: 289368 - RNA, 22 nt, Human
uggauaaaacguucugaaaaac

SEQ ID NO: 289369 - RNA, 17 nt, Human
ugguggcuggagucagg

SEQ ID NO: 289370 - RNA, 22 nt, Human
uagaaagaacuucauguaaaac

SEQ ID NO: 289371 - RNA, 22 nt, Human
gaauauuuuuaaagggacuaau

SEQ ID NO: 289372 - RNA, 22 nt, Human
agcagccacccagcugcucauu

SEQ ID NO: 289373 - RNA, 22 nt, Human
uuccaagagcuuuaauuguuga

SEQ ID NO: 289374 - RNA, 21 nt, Human
uuagaaagcucacuacaguua

SEQ ID NO: 289375 - RNA, 22 nt, Human
cuuucuuugcagugagccagag

SEQ ID NO: 289376 - RNA, 22 nt, Human
gagguggugguggaggcauagc

SEQ ID NO: 289377 - RNA, 22 nt, Human
uccugaagaacgaagucaugua

SEQ ID NO: 289378 - RNA, 23 nt, Human
agaggcaggaguggcuugcccgg

SEQ ID NO: 289379 - RNA, 22 nt, Human
gacagguggggaaacuaaggua

SEQ ID NO: 289380 - RNA, 18 nt, Human
gcuuucuguagaaaaggg

SEQ ID NO: 289381 - RNA, 22 nt, Human
gcuuuacaaguggugcagauua

SEQ ID NO: 289382 - RNA, 22 nt, Human
cuucaggaaaaucucuaaggau

SEQ ID NO: 289383 - RNA, 22 nt, Human
uggcuccuaaugcugcccagac

SEQ ID NO: 289384 - RNA, 22 nt, Human
aaagguuuugguaaggcuuuaa

SEQ ID NO: 289385 - RNA, 22 nt, Human
ggaugucuuuacuuugggauuu

SEQ ID NO: 289386 - RNA, 20 nt, Human
cccaggcagagcuagcggca

SEQ ID NO: 289387 - RNA, 22 nt, Human
ggcuuaggugucucucugcacc

SEQ ID NO: 289388 - RNA, 22 nt, Human
ucuguagucugugccauagcug

SEQ ID NO: 289389 - RNA, 22 nt, Human
aggcucaggucucaggucuggc

SEQ ID NO: 289390 - RNA, 22 nt, Human
ccuccuggggugaaggauggga

SEQ ID NO: 289391 - RNA, 22 nt, Human
guaaauauaaaugcuagcugcc

SEQ ID NO: 289392 - RNA, 22 nt, Human
uggucagguaccucuggcuguc

SEQ ID NO: 289393 - RNA, 22 nt, Human
augcauaauguauguauugacu

SEQ ID NO: 289394 - RNA, 22 nt, Human
ccuggcagacagcacugaagcu

SEQ ID NO: 289395 - RNA, 22 nt, Human
uuggaauucaaguuguagcuua

SEQ ID NO: 289396 - RNA, 22 nt, Human
cuuaggaacgcucugccuagug

SEQ ID NO: 289397 - RNA, 22 nt, Human
cucuuccuuaagacuauaaaga

SEQ ID NO: 289398 - RNA, 22 nt, Human
uuaguucucaugaauuuuaagu

SEQ ID NO: 289399 - RNA, 20 nt, Human
cuggguggcaagcaaggggg

SEQ ID NO: 289400 - RNA, 22 nt, Human
acugucuccucaucaugccugg

SEQ ID NO: 289401 - RNA, 22 nt, Human
cuuuaauuaggaaguauaauga

SEQ ID NO: 289402 - RNA, 22 nt, Human
agaucauaugcaguaaugaacu

SEQ ID NO: 289403 - RNA, 22 nt, Human
cagagggacaguguaaugcaua

SEQ ID NO: 289404 - RNA, 16 nt, Human
gagggcagaggcggaa

SEQ ID NO: 289405 - RNA, 22 nt, Human
uuacaaagugcugcaccauuuu

SEQ ID NO: 289406 - RNA, 22 nt, Human
gccagauguagauagcaaggua

SEQ ID NO: 289407 - RNA, 22 nt, Human
uguuucuuauccaaguggucug

SEQ ID NO: 289408 - RNA, 22 nt, Human
caagauuuggcauucugaggag

SEQ ID NO: 289409 - RNA, 23 nt, Human
ggcucugaggauggagcuggugg

SEQ ID NO: 289410 - RNA, 22 nt, Human
ugcaggugucugggggcaacag

SEQ ID NO: 289411 - RNA, 22 nt, Human
uauagacaagcguaacaagaag

SEQ ID NO: 289412 - RNA, 22 nt, Human
uuguaaagcugauuagaaagcc

SEQ ID NO: 289413 - RNA, 22 nt, Human
auucucaguucacuaguuucuu

SEQ ID NO: 289414 - RNA, 22 nt, Human
agaaagcuuaugaaugggcaag

SEQ ID NO: 289415 - RNA, 22 nt, Human
cugaugccccuggaccugugac

SEQ ID NO: 289416 - RNA, 22 nt, Human
gacuuuauuuuaacggagauuc

SEQ ID NO: 289417 - RNA, 22 nt, Human
gccugcaguucugugcuaggca

SEQ ID NO: 289418 - RNA, 22 nt, Human
uccuggccuuagcgaggcgguc

SEQ ID NO: 289419 - RNA, 22 nt, Human
agcagcuguuuguugaauuggu

SEQ ID NO: 289420 - RNA, 22 nt, Human
gcuguucaagacuaggaaauuu

SEQ ID NO: 289421 - RNA, 21 nt, Human
auaauguacaaaaacugucuu

SEQ ID NO: 289422 - RNA, 22 nt, Human
gaauucuuuucuuucugaaagu

SEQ ID NO: 289423 - RNA, 22 nt, Human
ucugcgcccugucgccugcucc

SEQ ID NO: 289424 - RNA, 22 nt, Human
aagguugcuguuuugcuucaaa

SEQ ID NO: 289425 - RNA, 22 nt, Human
uuauacuaaaacgcauugaauu

SEQ ID NO: 289426 - RNA, 23 nt, Human
uucucuuuagauuuacauuacuc

SEQ ID NO: 289427 - RNA, 22 nt, Human
caggcauaaguaauguuuuaug

SEQ ID NO: 289428 - RNA, 21 nt, Human
agguacaggucuugugagucu

SEQ ID NO: 289429 - RNA, 22 nt, Human
ugcuuuauucgacaucugguag

SEQ ID NO: 289430 - RNA, 22 nt, Human
uuacaucagcaagaguguaugu

SEQ ID NO: 289431 - RNA, 22 nt, Human
ucugacuuccuuuucugaucca

SEQ ID NO: 289432 - RNA, 22 nt, Human
uuuaaagugcugcuccuauccu

SEQ ID NO: 289433 - RNA, 22 nt, Human
auguucuacagauggaaagggg

SEQ ID NO: 289434 - RNA, 22 nt, Human
ggagaggggaacuuguugcuug

SEQ ID NO: 289435 - RNA, 22 nt, Human
gccuguuuacuuugccgcagga

SEQ ID NO: 289436 - RNA, 22 nt, Human
uuguuuuuaaacaugugacuga

SEQ ID NO: 289437 - RNA, 22 nt, Human
accaugaugggaagcucagggc

SEQ ID NO: 289438 - RNA, 22 nt, Human
ucaguaaaugaaugaauauaug

SEQ ID NO: 289439 - RNA, 22 nt, Human
gaccugccugagcugccucugc

SEQ ID NO: 289440 - RNA, 22 nt, Human
agcugcaauacccuucuuccuu

SEQ ID NO: 289441 - RNA, 22 nt, Human
auugguggugaggacaugccag

SEQ ID NO: 289442 - RNA, 22 nt, Human
uuuuauugucuguauugccuau

SEQ ID NO: 289443 - RNA, 22 nt, Human
gagccucguggcggccacugcg

SEQ ID NO: 289444 - RNA, 22 nt, Human
ucugaagaacugaguaaacaug

SEQ ID NO: 289445 - RNA, 22 nt, Human
aagggcuccauccuuauaaaug

SEQ ID NO: 289446 - RNA, 21 nt, Human
ucagcuuugcaacugcacauc

SEQ ID NO: 289447 - RNA, 16 nt, Human
gucuuuauucacuuag

SEQ ID NO: 289448 - RNA, 22 nt, Human
ggcaggugguaaggauuucaua

SEQ ID NO: 289449 - RNA, 22 nt, Human
agugcagggggaaagggugucu

SEQ ID NO: 289450 - RNA, 22 nt, Human
auucucagcuuucaaauagaca

SEQ ID NO: 289451 - RNA, 22 nt, Human
cucagauguguuggauggaaaa

SEQ ID NO: 289452 - RNA, 22 nt, Human
ccaaggacguacaggagauaau

SEQ ID NO: 289453 - RNA, 22 nt, Human
agcuuucguuccuuagacacau

SEQ ID NO: 289454 - RNA, 23 nt, Human
acagacauuccauaauguacacc

SEQ ID NO: 289455 - RNA, 22 nt, Human
uccaggcauaagccuugagugu

SEQ ID NO: 289456 - RNA, 22 nt, Human
cagguccuuguuuguaaagcag

SEQ ID NO: 289457 - RNA, 22 nt, Human
gggcaggucugggucagccuga

SEQ ID NO: 289458 - RNA, 20 nt, Human
acagaugaggaaaaugaagu

SEQ ID NO: 289459 - RNA, 22 nt, Human
acucuacuguaguaugggcacu

SEQ ID NO: 289460 - RNA, 22 nt, Human
cagacaggguuuuggucuuugg

SEQ ID NO: 289461 - RNA, 22 nt, Human
acugaaaugaaaucuaucaucu

SEQ ID NO: 289462 - RNA, 22 nt, Human
uaaaaugccagaccaguucacg

SEQ ID NO: 289463 - RNA, 22 nt, Human
cagcuauucucugaaaugaaua

SEQ ID NO: 289464 - RNA, 22 nt, Human
caauuucuuguuaauucucagg

SEQ ID NO: 289465 - RNA, 22 nt, Human
cacagguguaugaauaugucca

SEQ ID NO: 289466 - RNA, 22 nt, Human
cauuuguuuagaagucuuuaua

SEQ ID NO: 289467 - RNA, 22 nt, Human
ucuggcagcgaagcguguacuu

SEQ ID NO: 289468 - RNA, 22 nt, Human
aagguggugaucaucuugaagg

SEQ ID NO: 289469 - RNA, 22 nt, Human
gcaccaggcagcugagcaggcc

SEQ ID NO: 289470 - RNA, 22 nt, Human
ugcugaggcagaugucugugac

SEQ ID NO: 289471 - RNA, 22 nt, Human
auauauuuacucuccuguugca

SEQ ID NO: 289472 - RNA, 22 nt, Human
uaugaagaaaccuauccucuag

SEQ ID NO: 289473 - RNA, 22 nt, Human
auaguuuacaaaaaugaugcau

SEQ ID NO: 289474 - RNA, 22 nt, Human
agccucugcuggcccuggcacu

SEQ ID NO: 289475 - RNA, 20 nt, Human
aacuagaaagcacccaugga

SEQ ID NO: 289476 - RNA, 22 nt, Human
agaacaaaauuagaggagugca

SEQ ID NO: 289477 - RNA, 22 nt, Human
agggcuccaaggaaguguagcu

SEQ ID NO: 289478 - RNA, 21 nt, Human
auucagaguaauucaucuuua

SEQ ID NO: 289479 - RNA, 22 nt, Human
gcagggcagaaggugcugagga

SEQ ID NO: 289480 - RNA, 22 nt, Human
ccagcagggcagugcccuggac

SEQ ID NO: 289481 - RNA, 22 nt, Human
cuccagugagugagcaggcgac

SEQ ID NO: 289482 - RNA, 22 nt, Human
ucuggcagagugauaggauaag

SEQ ID NO: 289483 - RNA, 22 nt, Human
ccagguguggccacauggcugg

SEQ ID NO: 289484 - RNA, 22 nt, Human
ucugucaucuguaacaggaggg

SEQ ID NO: 289485 - RNA, 22 nt, Human
ggagggaaugucuagcauucuu

SEQ ID NO: 289486 - RNA, 20 nt, Human
auguccucagccacugcccu

SEQ ID NO: 289487 - RNA, 22 nt, Human
cagguugguauucaucuccaca

SEQ ID NO: 289488 - RNA, 23 nt, Human
uauacacauguggcaguauagug

SEQ ID NO: 289489 - RNA, 22 nt, Human
uuccugugcuuaauucucacug

SEQ ID NO: 289490 - RNA, 22 nt, Human
uguccucacaggaaugaacuuu

SEQ ID NO: 289491 - RNA, 22 nt, Human
cccaguggugcuggcaucugug

SEQ ID NO: 289492 - RNA, 22 nt, Human
uguguccucuuaccucugaccc

SEQ ID NO: 289493 - RNA, 22 nt, Human
ccucacccacuacacucaaggg

SEQ ID NO: 289494 - RNA, 22 nt, Human
ccuggguccuggcagccuccug

SEQ ID NO: 289495 - RNA, 22 nt, Human
cuguucuuuaguuccacugcaa

SEQ ID NO: 289496 - RNA, 22 nt, Human
uggacauguccggccagacaau

SEQ ID NO: 289497 - RNA, 22 nt, Human
auuuacauuuauuugagaaggu

SEQ ID NO: 289498 - RNA, 22 nt, Human
ucaggaaauggcuucaugguuu

SEQ ID NO: 289499 - RNA, 22 nt, Human
aaacaugagcacuugcuucaua

SEQ ID NO: 289500 - RNA, 22 nt, Human
gcacugguuacccugaguggcu

SEQ ID NO: 289501 - RNA, 22 nt, Human
aggcuguggugcugaaggaggg

SEQ ID NO: 289502 - RNA, 20 nt, Human
cuuaaacacagagauagauu

SEQ ID NO: 289503 - RNA, 22 nt, Human
cuagaaagauacuuaaaucaag

SEQ ID NO: 289504 - RNA, 22 nt, Human
aaagagaaaaugaucuguacau

SEQ ID NO: 289505 - RNA, 22 nt, Human
cuuggcaguuucggaaggauga

SEQ ID NO: 289506 - RNA, 22 nt, Human
ucaggcuuuuucucaaccucuu

SEQ ID NO: 289507 - RNA, 22 nt, Human
ucagacagucaucagagcuugu

SEQ ID NO: 289508 - RNA, 22 nt, Human
guguguccuguuuuaaaauagu

SEQ ID NO: 289509 - RNA, 22 nt, Human
aaagugcugugggcuguaagug

SEQ ID NO: 289510 - RNA, 22 nt, Human
ucuguucaucaucuggacacau

SEQ ID NO: 289511 - RNA, 22 nt, Human
cuuggcuguugggcauugagaa

SEQ ID NO: 289512 - RNA, 22 nt, Human
auaaauuaggaucugggguucc

SEQ ID NO: 289513 - RNA, 22 nt, Human
uuuaucagaaguuagagaaaga

SEQ ID NO: 289514 - RNA, 22 nt, Human
uuccuccacgugacaggagcca

SEQ ID NO: 289515 - RNA, 22 nt, Human
uuccugguuuauggaaagcaug

SEQ ID NO: 289516 - RNA, 22 nt, Human
ugcuggcacguggaccaggaga

SEQ ID NO: 289517 - RNA, 22 nt, Human
gaacuuggaacuggggcuacug

SEQ ID NO: 289518 - RNA, 22 nt, Human
aauguccuaggcaugauuuugu

SEQ ID NO: 289519 - RNA, 22 nt, Human
aacuucauggguucaaagcugg

SEQ ID NO: 289520 - RNA, 22 nt, Human
uuauugcuuuggaaaacacuca

SEQ ID NO: 289521 - RNA, 22 nt, Human
agcucagcuuccucuccaugcu

SEQ ID NO: 289522 - RNA, 22 nt, Human
ucagguguucuccacucaguuu

SEQ ID NO: 289523 - RNA, 22 nt, Human
ucuuuaaaguuggagcuugcaa

SEQ ID NO: 289524 - RNA, 22 nt, Human
ccacagagcauuagauuucaga

SEQ ID NO: 289525 - RNA, 22 nt, Human
gcaggggaguggcaggcccgga

SEQ ID NO: 289526 - RNA, 22 nt, Human
gucaggcauuuaggaugaguuc

SEQ ID NO: 289527 - RNA, 22 nt, Human
agacagugcaagaagagcaggc

SEQ ID NO: 289528 - RNA, 22 nt, Human
cacuguauuauuaggaaugaca

SEQ ID NO: 289529 - RNA, 22 nt, Human
caucaggaggagaugaagaaaa

SEQ ID NO: 289530 - RNA, 21 nt, Human
aauuagggugccucuuauaau

SEQ ID NO: 289531 - RNA, 22 nt, Human
gaggagcuguucccucaccucu

SEQ ID NO: 289532 - RNA, 22 nt, Human
ccagacaggaacacacaucucc

SEQ ID NO: 289533 - RNA, 22 nt, Human
uccuggcagagagcaugaggcc

SEQ ID NO: 289534 - RNA, 22 nt, Human
caggacauugauccauuggcac

SEQ ID NO: 289535 - RNA, 22 nt, Human
ucugccuguugcuagaauguca

SEQ ID NO: 289536 - RNA, 22 nt, Human
gaaacagcacguuuggagagau

SEQ ID NO: 289537 - RNA, 22 nt, Human
caaaagauacuugcaucuaacu

SEQ ID NO: 289538 - RNA, 22 nt, Human
gucccauaaguagugcaacuug

SEQ ID NO: 289539 - RNA, 17 nt, Human
auuuacauugucaccga

SEQ ID NO: 289540 - RNA, 20 nt, Human
agacaaaaugacuucaugca

SEQ ID NO: 289541 - RNA, 22 nt, Human
gccccaccuugagagcagaaac

SEQ ID NO: 289542 - RNA, 22 nt, Human
aggacccagaaggugcagcaga

SEQ ID NO: 289543 - RNA, 19 nt, Human
aguguccuagucauuugcc

SEQ ID NO: 289544 - RNA, 22 nt, Human
aacauuaauuacagucaaacau

SEQ ID NO: 289545 - RNA, 19 nt, Human
cuggaauguggcuggugca

SEQ ID NO: 289546 - RNA, 22 nt, Human
ugugauuucacuggugacaugu

SEQ ID NO: 289547 - RNA, 22 nt, Human
ccaggccuggaccaugccaggg

SEQ ID NO: 289548 - RNA, 22 nt, Human
ccugugacccuuccagucuacu

SEQ ID NO: 289549 - RNA, 22 nt, Human
gagucaggcaugaagguaauua

SEQ ID NO: 289550 - RNA, 22 nt, Human
cuggcacaacuccaccucagcg

SEQ ID NO: 289551 - RNA, 22 nt, Human
cuugcuuuugcugaugauuaag

SEQ ID NO: 289552 - RNA, 22 nt, Human
aaaguucauugaugacugaggu

SEQ ID NO: 289553 - RNA, 22 nt, Human
ggagcugaugacgucaccaugg

SEQ ID NO: 289554 - RNA, 22 nt, Human
cuucccagcaccucagucuggc

SEQ ID NO: 289555 - RNA, 22 nt, Human
augaggcagcccuucccuucuc

SEQ ID NO: 289556 - RNA, 22 nt, Human
cugugaccuuagcaagggaaau

SEQ ID NO: 289557 - RNA, 22 nt, Human
agauauuaggaggauucauaau

SEQ ID NO: 289558 - RNA, 23 nt, Human
uggcucuguggaucccucaggag

SEQ ID NO: 289559 - RNA, 22 nt, Human
cuccuggugacucccagauaaa

SEQ ID NO: 289560 - RNA, 22 nt, Human
uaguucaggaagagaaacaaca

SEQ ID NO: 289561 - RNA, 20 nt, Human
aagggcagagggaacagacu

SEQ ID NO: 289562 - RNA, 22 nt, Human
uccuggagugucuuccccaagg

SEQ ID NO: 289563 - RNA, 22 nt, Human
caaagcugacgaggucagcauc

SEQ ID NO: 289564 - RNA, 22 nt, Human
uagaaauaaaucugcagcuggg

SEQ ID NO: 289565 - RNA, 22 nt, Human
cagccagaucagggcagggguu

SEQ ID NO: 289566 - RNA, 22 nt, Human
agcugcaaagaugauuuguugu

SEQ ID NO: 289567 - RNA, 22 nt, Human
ccuccuggguucaagcgauucu

SEQ ID NO: 289568 - RNA, 22 nt, Human
acuuuuaaaugaguuucaguug

SEQ ID NO: 289569 - RNA, 22 nt, Human
aggccugccuggagccuggcug

SEQ ID NO: 289570 - RNA, 22 nt, Human
uccgggcaacugaagggagguu

SEQ ID NO: 289571 - RNA, 22 nt, Human
aggugagguuugggagguguca

SEQ ID NO: 289572 - RNA, 20 nt, Human
ucucgcacucggagcagccg

SEQ ID NO: 289573 - RNA, 22 nt, Human
ccagagaguaucauggagagua

SEQ ID NO: 289574 - RNA, 22 nt, Human
uuucaguuugaaggaaaggcca

SEQ ID NO: 289575 - RNA, 22 nt, Human
ucaaaggcauugccaauaagua

SEQ ID NO: 289576 - RNA, 22 nt, Human
gaaguuuuagucaaaauguaga

SEQ ID NO: 289577 - RNA, 22 nt, Human
acagaggccgccucucucacgg

SEQ ID NO: 289578 - RNA, 22 nt, Human
uuccuggcauuaugggaggcug

SEQ ID NO: 289579 - RNA, 22 nt, Human
uucagcaagaccaccauguacc

SEQ ID NO: 289580 - RNA, 22 nt, Human
gcugaaaugccuuguaaauauu

SEQ ID NO: 289581 - RNA, 22 nt, Human
ggcagguggccaagugucuaag

SEQ ID NO: 289582 - RNA, 22 nt, Human
ucuggguggcuucagaggccac

SEQ ID NO: 289583 - RNA, 22 nt, Human
acucugugaagaugcaggcuug

SEQ ID NO: 289584 - RNA, 22 nt, Human
auacaaauuuauagaugcauuu

SEQ ID NO: 289585 - RNA, 22 nt, Human
auguccucuucugccucaggcc

SEQ ID NO: 289586 - RNA, 22 nt, Human
ucuggcaggguguguauuuaca

SEQ ID NO: 289587 - RNA, 22 nt, Human
aguugcugauucugucugugau

SEQ ID NO: 289588 - RNA, 22 nt, Human
aaaguucucuaugguguaaaaa

SEQ ID NO: 289589 - RNA, 22 nt, Human
aauucuucaagugcuuuggaga

SEQ ID NO: 289590 - RNA, 22 nt, Human
agaguugcuauagaaggaugga

SEQ ID NO: 289591 - RNA, 22 nt, Human
agaggccucccucccagcuggu

SEQ ID NO: 289592 - RNA, 22 nt, Human
auaguguuacccuucuuaaagu

SEQ ID NO: 289593 - RNA, 22 nt, Human
ccaggccugcaucugcugcgca

SEQ ID NO: 289594 - RNA, 22 nt, Human
uaaaacuagugguugggacuaa

SEQ ID NO: 289595 - RNA, 22 nt, Human
uccccagcauugagggucucuc

SEQ ID NO: 289596 - RNA, 22 nt, Human
gagagucuaggaaccucauaua

SEQ ID NO: 289597 - RNA, 22 nt, Human
agaagccucauccucucuagug

SEQ ID NO: 289598 - RNA, 22 nt, Human
uuggaacacagcagcugauuuu

SEQ ID NO: 289599 - RNA, 22 nt, Human
agaugaguagguagcauuagua

SEQ ID NO: 289600 - RNA, 22 nt, Human
ccugcagguugcagaggcggaa

SEQ ID NO: 289601 - RNA, 22 nt, Human
auauuaggcaaggagauuauuu

SEQ ID NO: 289602 - RNA, 22 nt, Human
ugugcuugucguggagccaggc

SEQ ID NO: 289603 - RNA, 22 nt, Human
aggaggcugggcacaguggccu

SEQ ID NO: 289604 - RNA, 22 nt, Human
accucaaggaaaaucuagacag

SEQ ID NO: 289605 - RNA, 22 nt, Human
agagcccagguccuggagaggg

SEQ ID NO: 289606 - RNA, 22 nt, Human
uauugguaugguaagaauugaa

SEQ ID NO: 289607 - RNA, 22 nt, Human
gccaggcaauguguuagaagcg

SEQ ID NO: 289608 - RNA, 22 nt, Human
uucagagauggaaggcagaaug

SEQ ID NO: 289609 - RNA, 22 nt, Human
aggcuuggaaguggcagaacug

SEQ ID NO: 289610 - RNA, 22 nt, Human
uuucaguuaaguggcuaguccc

SEQ ID NO: 289611 - RNA, 22 nt, Human
uuccuccagccuggagcacuuc

SEQ ID NO: 289612 - RNA, 22 nt, Human
caaagagcuguucagugucgcu

SEQ ID NO: 289613 - RNA, 19 nt, Human
uccaccccagccagcucug

SEQ ID NO: 289614 - RNA, 22 nt, Human
acaguuuagagcaugaugacca

SEQ ID NO: 289615 - RNA, 22 nt, Human
ucauuguauucagaacugaaga

SEQ ID NO: 289616 - RNA, 22 nt, Human
uuuucuuccuggauuuuggcau

SEQ ID NO: 289617 - RNA, 22 nt, Human
auuauguauuugguauaguuug

SEQ ID NO: 289618 - RNA, 22 nt, Human
aaagugcuuucccacauuuguu

SEQ ID NO: 289619 - RNA, 22 nt, Human
ucagagucuaaauagaagaaua

SEQ ID NO: 289620 - RNA, 22 nt, Human
gcagguggugggggagccguuc

SEQ ID NO: 289621 - RNA, 22 nt, Human
ugaaagcagauagcucuguugu

SEQ ID NO: 289622 - RNA, 22 nt, Human
gggaauguaaucauggaaugcu

SEQ ID NO: 289623 - RNA, 22 nt, Human
gucuggcuuugcucagaugcug

SEQ ID NO: 289624 - RNA, 22 nt, Human
ccucucagcgauuccucuugga

SEQ ID NO: 289625 - RNA, 22 nt, Human
uuugauaauuaaaaauuguagu

SEQ ID NO: 289626 - RNA, 22 nt, Human
cagaaucucgacuucuggcccc

SEQ ID NO: 289627 - RNA, 22 nt, Human
aauggcuggguuucauuuugua

SEQ ID NO: 289628 - RNA, 20 nt, Human
ucuaaaguacaguuugugug

SEQ ID NO: 289629 - RNA, 22 nt, Human
uuccuucuauucagcuccaaga

SEQ ID NO: 289630 - RNA, 22 nt, Human
aaacacaagauggccucuucug

SEQ ID NO: 289631 - RNA, 22 nt, Human
auuuucaucauggguuuaacau

SEQ ID NO: 289632 - RNA, 22 nt, Human
cuguguccuuuuaguugcugug

SEQ ID NO: 289633 - RNA, 22 nt, Human
uuugacucuagucauagaagug

SEQ ID NO: 289634 - RNA, 22 nt, Human
ccauggcuccuugcccuguagc

SEQ ID NO: 289635 - RNA, 18 nt, Human
uguaaacacuuucauucu

SEQ ID NO: 289636 - RNA, 22 nt, Human
uugcuuuaucuaagcauggcca

SEQ ID NO: 289637 - RNA, 19 nt, Human
uuugauagggcauaauaua

SEQ ID NO: 289638 - RNA, 22 nt, Human
ugaaugaugcaguauaaugaua

SEQ ID NO: 289639 - RNA, 22 nt, Human
uaaguguugguaauuacaauga

SEQ ID NO: 289640 - RNA, 22 nt, Human
uguguccugcaggugcugccug

SEQ ID NO: 289641 - RNA, 21 nt, Human
guuauuuuaagugagcuuugc

SEQ ID NO: 289642 - RNA, 20 nt, Human
ucuuacaaucguuacaucca

SEQ ID NO: 289643 - RNA, 22 nt, Human
gcaaagcaaucaggaguagcau

SEQ ID NO: 289644 - RNA, 22 nt, Human
gccugggaaaugguggggucag

SEQ ID NO: 289645 - RNA, 22 nt, Human
cuguuauuucugccaggugagu

SEQ ID NO: 289646 - RNA, 22 nt, Human
gcuucuuuccuugggcuggaac

SEQ ID NO: 289647 - RNA, 22 nt, Human
uugggaucuacauagcuaugua

SEQ ID NO: 289648 - RNA, 22 nt, Human
gcuguggcugaagaugcaggga

SEQ ID NO: 289649 - RNA, 22 nt, Human
caugcaggccuauggagcagug

SEQ ID NO: 289650 - RNA, 22 nt, Human
cagggacugagauccagacugu

SEQ ID NO: 289651 - RNA, 22 nt, Human
gauugcugggucccacucccag

SEQ ID NO: 289652 - RNA, 20 nt, Human
ccacaggaguccagucgacc

SEQ ID NO: 289653 - RNA, 22 nt, Human
gacccugguguccagguccugc

SEQ ID NO: 289654 - RNA, 22 nt, Human
ccuggcacaucuaacucacucu

SEQ ID NO: 289655 - RNA, 22 nt, Human
auauaacauacauacagaaaag

SEQ ID NO: 289656 - RNA, 22 nt, Human
aagggcucugcugucucucccc

SEQ ID NO: 289657 - RNA, 22 nt, Human
cagauuuaccuaacuccaaguu

SEQ ID NO: 289658 - RNA, 23 nt, Human
uccugugaagccauguuuguugu

SEQ ID NO: 289659 - RNA, 22 nt, Human
caagauuugggggcacggaauc

SEQ ID NO: 289660 - RNA, 22 nt, Human
caucaguggauauagauuagcg

SEQ ID NO: 289661 - RNA, 22 nt, Human
cuuaauuacccaaugugguagg

SEQ ID NO: 289662 - RNA, 22 nt, Human
uccaguaugacugauguccuuc

SEQ ID NO: 289663 - RNA, 22 nt, Human
ucuggagggcccacauccacaa

SEQ ID NO: 289664 - RNA, 22 nt, Human
ugcuguaauacuuaagguuaag

SEQ ID NO: 289665 - RNA, 22 nt, Human
ugcucagcagaucucaggagau

SEQ ID NO: 289666 - RNA, 22 nt, Human
caguuaaaugaugugcccuaga

SEQ ID NO: 289667 - RNA, 22 nt, Human
uuuuuuauaucaacugaagucu

SEQ ID NO: 289668 - RNA, 22 nt, Human
ccuggcacaugcaguacucaag

SEQ ID NO: 289669 - RNA, 16 nt, Human
ccagguggggcuguga

SEQ ID NO: 289670 - RNA, 22 nt, Human
auuugggaguugcuagugaguu

SEQ ID NO: 289671 - RNA, 22 nt, Human
cuggcuggguuccaggauucca

SEQ ID NO: 289672 - RNA, 22 nt, Human
cuucauuggcuuccauagaugc

SEQ ID NO: 289673 - RNA, 22 nt, Human
cauuugcagagggugacacucu

SEQ ID NO: 289674 - RNA, 20 nt, Human
uuuuccagaaaguaucauug

SEQ ID NO: 289675 - RNA, 22 nt, Human
guccaggucuggacccugagcc

SEQ ID NO: 289676 - RNA, 22 nt, Human
aaggcuuuuguuccuauuuagu

SEQ ID NO: 289677 - RNA, 22 nt, Human
agcauccugcuugcugucugug

SEQ ID NO: 289678 - RNA, 22 nt, Human
uauuuuacaaaugggaaugcug

SEQ ID NO: 289679 - RNA, 22 nt, Human
caaaauuagggagugagcugga

SEQ ID NO: 289680 - RNA, 22 nt, Human
cccaguggggagcuucugccuu

SEQ ID NO: 289681 - RNA, 22 nt, Human
aggaaagcaauggcugagaaca

SEQ ID NO: 289682 - RNA, 22 nt, Human
cuucaguuagaguuuacaaagu

SEQ ID NO: 289683 - RNA, 22 nt, Human
aacuuucaggcaaugaauauuu

SEQ ID NO: 289684 - RNA, 22 nt, Human
gucucuguuauuuccaggguca

SEQ ID NO: 289685 - RNA, 22 nt, Human
uuccaugacaccgagggaaguc

SEQ ID NO: 289686 - RNA, 22 nt, Human
guuagggagggugcauaugugu

SEQ ID NO: 289687 - RNA, 22 nt, Human
ccaggugugucaccauugccca

SEQ ID NO: 289688 - RNA, 22 nt, Human
ucuuguuucuguauauaaugac

SEQ ID NO: 289689 - RNA, 18 nt, Human
gaauaucuagcacauagu

SEQ ID NO: 289690 - RNA, 19 nt, Human
uggugcuggccucccaugg

SEQ ID NO: 289691 - RNA, 22 nt, Human
gccagcagguggagagaucaag

SEQ ID NO: 289692 - RNA, 22 nt, Human
uuuuuacacuuagcauugagcg

SEQ ID NO: 289693 - RNA, 22 nt, Human
uuuccugagucagagacaccag

SEQ ID NO: 289694 - RNA, 22 nt, Human
cccaggacucugacacccccaa

SEQ ID NO: 289695 - RNA, 22 nt, Human
ggcacuggaagucccauugucu

SEQ ID NO: 289696 - RNA, 22 nt, Human
gcagggcagaccuccagccuau

SEQ ID NO: 289697 - RNA, 22 nt, Human
ugugugcuaauguaugcucuaa

SEQ ID NO: 289698 - RNA, 22 nt, Human
acagugcagugugaugaguauu

SEQ ID NO: 289699 - RNA, 22 nt, Human
auuuucauggcuucugcucagu

SEQ ID NO: 289700 - RNA, 22 nt, Human
ggucaaagggugagauggcagg

SEQ ID NO: 289701 - RNA, 22 nt, Human
gagguucacaggcuaucacagu

SEQ ID NO: 289702 - RNA, 22 nt, Human
gugucccaggccucuggaauua

SEQ ID NO: 289703 - RNA, 22 nt, Human
ucugaaauaggcuucuuuuggu

SEQ ID NO: 289704 - RNA, 22 nt, Human
agaaauguauucuguauguuuu

SEQ ID NO: 289705 - RNA, 22 nt, Human
uuguuucaaauauuucagaaua

SEQ ID NO: 289706 - RNA, 22 nt, Human
agcuuuauauaaaagaguacau

SEQ ID NO: 289707 - RNA, 22 nt, Human
ugauuuuauugaaacuucacuu

SEQ ID NO: 289708 - RNA, 22 nt, Human
uaauuucaauagcuugcauaau

SEQ ID NO: 289709 - RNA, 22 nt, Human
uuuaauuuuccugguaggccug

SEQ ID NO: 289710 - RNA, 22 nt, Human
ucuuccuugcuccuugucacuu

SEQ ID NO: 289711 - RNA, 22 nt, Human
cugaggagcagcuggcccgcua

SEQ ID NO: 289712 - RNA, 22 nt, Human
aagauaauauucauuaacuaga

SEQ ID NO: 289713 - RNA, 22 nt, Human
cugcauuagucaugcuuugcag

SEQ ID NO: 289714 - RNA, 21 nt, Human
gccuggcagguggaagggcuc

SEQ ID NO: 289715 - RNA, 22 nt, Human
acagagccacuuuggugccuac

SEQ ID NO: 289716 - RNA, 22 nt, Human
acuggcagaacuggugauuguc

SEQ ID NO: 289717 - RNA, 22 nt, Human
aaauguauugcauaggauauuu

SEQ ID NO: 289718 - RNA, 22 nt, Human
agucaaaggguauuuggauuga

SEQ ID NO: 289719 - RNA, 23 nt, Human
uggcaggugguuagauguuuugu

SEQ ID NO: 289720 - RNA, 22 nt, Human
ccaggccuucugaggacacucu

SEQ ID NO: 289721 - RNA, 17 nt, Human
aggggagagugggaaga

SEQ ID NO: 289722 - RNA, 21 nt, Human
ucuguacaucauugagucccc

SEQ ID NO: 289723 - RNA, 22 nt, Human
cuggugaccggaccucaguuuu

SEQ ID NO: 289724 - RNA, 22 nt, Human
auaugcaagcacauagaauacu

SEQ ID NO: 289725 - RNA, 22 nt, Human
auauucaaauuacauuuacuaa

SEQ ID NO: 289726 - RNA, 22 nt, Human
aggccucauaguagaccugccc

SEQ ID NO: 289727 - RNA, 22 nt, Human
ucuuucggccauagcgaugauu

SEQ ID NO: 289728 - RNA, 22 nt, Human
uucagaauauuuguuuuacaug

SEQ ID NO: 289729 - RNA, 22 nt, Human
gaggcugcagcuaucagacauu

SEQ ID NO: 289730 - RNA, 22 nt, Human
uuacacaucuagacccauuuuu

SEQ ID NO: 289731 - RNA, 22 nt, Human
ccucccaccauuuagagagagc

SEQ ID NO: 289732 - RNA, 22 nt, Human
acaguuauuuucccagcauuua

SEQ ID NO: 289733 - RNA, 22 nt, Human
aaggcucccucuucucgagugu

SEQ ID NO: 289734 - RNA, 22 nt, Human
cccucucagucagagccagaua

SEQ ID NO: 289735 - RNA, 22 nt, Human
gcugggucagaaucucccugug

SEQ ID NO: 289736 - RNA, 22 nt, Human
ucccagagauuuccucuccuuc

SEQ ID NO: 289737 - RNA, 22 nt, Human
gggccagguggaccccagccuc

SEQ ID NO: 289738 - RNA, 22 nt, Human
auuauuucucacucacauaaua

SEQ ID NO: 289739 - RNA, 22 nt, Human
cauggaaugguugaaugacgaa

SEQ ID NO: 289740 - RNA, 22 nt, Human
cacagugcaugaugggcagaag

SEQ ID NO: 289741 - RNA, 22 nt, Human
auucaguuuuuauuggaccagc

SEQ ID NO: 289742 - RNA, 22 nt, Human
aaaguauucuugacuguuuuuc

SEQ ID NO: 289743 - RNA, 22 nt, Human
ucuaggguguauaaggaagccu

SEQ ID NO: 289744 - RNA, 20 nt, Human
ucagauuuuucuaacuuuga

SEQ ID NO: 289745 - RNA, 22 nt, Human
uacacugaagugucuugguaua

SEQ ID NO: 289746 - RNA, 21 nt, Human
ugcucaugagcccacagcugc

SEQ ID NO: 289747 - RNA, 22 nt, Human
gaacaaauuggagaaaucagga

SEQ ID NO: 289748 - RNA, 22 nt, Human
agacaauggaccaagcaccuuc

SEQ ID NO: 289749 - RNA, 22 nt, Human
aagcauuucagguagagauauu

SEQ ID NO: 289750 - RNA, 17 nt, Human
ugaaacaccaagacugu

SEQ ID NO: 289751 - RNA, 22 nt, Human
cagcuauuuucucauuaaggau

SEQ ID NO: 289752 - RNA, 22 nt, Human
uuuuuacagucauggucacuca

SEQ ID NO: 289753 - RNA, 22 nt, Human
ucaagagaaggggaaauagacu

SEQ ID NO: 289754 - RNA, 22 nt, Human
gaggggcuggguagggcaaccc

SEQ ID NO: 289755 - RNA, 19 nt, Human
agaggcaaggguggaagua

SEQ ID NO: 289756 - RNA, 22 nt, Human
agagccaaucuucagagcagag

SEQ ID NO: 289757 - RNA, 22 nt, Human
gaggugucuguuaggaauaggc

SEQ ID NO: 289758 - RNA, 17 nt, Human
aggagggaaauagcuug

SEQ ID NO: 289759 - RNA, 20 nt, Human
aaagcauuuacuugugauug

SEQ ID NO: 289760 - RNA, 22 nt, Human
ccuggcaguuuugcccaggauu

SEQ ID NO: 289761 - RNA, 22 nt, Human
ucuccacaagcuuucuccuuuu

SEQ ID NO: 289762 - RNA, 22 nt, Human
aaagagucguguuccagguuug

SEQ ID NO: 289763 - RNA, 22 nt, Human
auguuucaaauauauagaguug

SEQ ID NO: 289764 - RNA, 22 nt, Human
uggaaauguauuugggcaugcc

SEQ ID NO: 289765 - RNA, 22 nt, Human
uggacacacauguaugucagag

SEQ ID NO: 289766 - RNA, 22 nt, Human
aggagcugcagauucugccuug

SEQ ID NO: 289767 - RNA, 22 nt, Human
uaaaagauuuuauaggaacaag

SEQ ID NO: 289768 - RNA, 22 nt, Human
uauccaaacauauagucucucu

SEQ ID NO: 289769 - RNA, 22 nt, Human
aggaccuguagggccugcaucc

SEQ ID NO: 289770 - RNA, 22 nt, Human
ucuguggcuuccuauuucuugg

SEQ ID NO: 289771 - RNA, 22 nt, Human
acuguauuuggauauaagaucu

SEQ ID NO: 289772 - RNA, 14 nt, Human
gcagguggaucacc

SEQ ID NO: 289773 - RNA, 22 nt, Human
ccuaaggaaagccaaagaggcc

SEQ ID NO: 289774 - RNA, 22 nt, Human
uaaugucuccaggguugaccua

SEQ ID NO: 289775 - RNA, 22 nt, Human
cuuuacagcuuagugguaugga

SEQ ID NO: 289776 - RNA, 22 nt, Human
aagaaucuccaucugauucacu

SEQ ID NO: 289777 - RNA, 18 nt, Human
uuugcaaaggaaguaugg

SEQ ID NO: 289778 - RNA, 22 nt, Human
uuacauguaaucuaaaauaauu

SEQ ID NO: 289779 - RNA, 22 nt, Human
gugcauuccaccgugcagguug

SEQ ID NO: 289780 - RNA, 23 nt, Human
agggcaugaagcagaggacgugg

SEQ ID NO: 289781 - RNA, 22 nt, Human
ccugcagguuucccccggacgg

SEQ ID NO: 289782 - RNA, 22 nt, Human
cauauuuaguguuuggagaucg

SEQ ID NO: 289783 - RNA, 22 nt, Human
gcuuccuuccuuacauuggugg

SEQ ID NO: 289784 - RNA, 22 nt, Human
cugaggagaaagaugguccaag

SEQ ID NO: 289785 - RNA, 22 nt, Human
cucuucuuuaguccagaccauc

SEQ ID NO: 289786 - RNA, 22 nt, Human
gggcuucuugcaggggcaacau

SEQ ID NO: 289787 - RNA, 22 nt, Human
agcuccugaaaagcgcuugcuu

SEQ ID NO: 289788 - RNA, 22 nt, Human
uggcauuucaccuuucauuucc

SEQ ID NO: 289789 - RNA, 22 nt, Human
aaugagaaccuugaaaggaacu

SEQ ID NO: 289790 - RNA, 22 nt, Human
cuucugugguaaacuuuguugu

SEQ ID NO: 289791 - RNA, 22 nt, Human
ggaagaaaugcucuucuaugcg

SEQ ID NO: 289792 - RNA, 17 nt, Human
uccaggcauaucuccua

SEQ ID NO: 289793 - RNA, 22 nt, Human
uuguagaacaugcagcacaaug

SEQ ID NO: 289794 - RNA, 22 nt, Human
ccagagaggcaaaacuccuucc

SEQ ID NO: 289795 - RNA, 22 nt, Human
ugguauuacuucuagacacaag

SEQ ID NO: 289796 - RNA, 22 nt, Human
uuaguacauagaugaugguuga

SEQ ID NO: 289797 - RNA, 22 nt, Human
uacaguauggaaaauguauagu

SEQ ID NO: 289798 - RNA, 22 nt, Human
ccagcuuucugggugguuucug

SEQ ID NO: 289799 - RNA, 22 nt, Human
cuuauuagaguuguguucuguu

SEQ ID NO: 289800 - RNA, 22 nt, Human
aguaauaauagcuguaaagugc

SEQ ID NO: 289801 - RNA, 22 nt, Human
guuucauuuacaucuguaggua

SEQ ID NO: 289802 - RNA, 19 nt, Human
gggcuuggggcugaagccu

SEQ ID NO: 289803 - RNA, 22 nt, Human
uuccagucuaguaccuggaugc

SEQ ID NO: 289804 - RNA, 22 nt, Human
ucagagaauucgauuaaaugca

SEQ ID NO: 289805 - RNA, 22 nt, Human
cuguccagcugaccagagcagc

SEQ ID NO: 289806 - RNA, 22 nt, Human
gaggccugaggcugccuggagc

SEQ ID NO: 289807 - RNA, 16 nt, Human
ugguggggaggacagc

SEQ ID NO: 289808 - RNA, 22 nt, Human
gcugggucuggcugugagccgg

SEQ ID NO: 289809 - RNA, 19 nt, Human
acagggcagcaauaggaua

SEQ ID NO: 289810 - RNA, 22 nt, Human
ccacugucuuuuccaggcugaa

SEQ ID NO: 289811 - RNA, 22 nt, Human
ugagaagcccacacucuuuccu

SEQ ID NO: 289812 - RNA, 22 nt, Human
uuagaaagaacuuuagauauca

SEQ ID NO: 289813 - RNA, 22 nt, Human
ggcagggaagcuggcaucacgg

SEQ ID NO: 289814 - RNA, 23 nt, Human
uuuuagugacuccuuuaucugcc

SEQ ID NO: 289815 - RNA, 22 nt, Human
ucaggugugaacuauuuggaaa

SEQ ID NO: 289816 - RNA, 19 nt, Human
ugguggaggccccauguuc

SEQ ID NO: 289817 - RNA, 22 nt, Human
uaugcacauucacacaaaaaug

SEQ ID NO: 289818 - RNA, 22 nt, Human
accauuugacucucuaaggaua

SEQ ID NO: 289819 - RNA, 22 nt, Human
uugaaucuauguauucagugua

SEQ ID NO: 289820 - RNA, 22 nt, Human
gugagggcagaacccccaggcc

SEQ ID NO: 289821 - RNA, 22 nt, Human
aaaagcaaguugccuagguuga

SEQ ID NO: 289822 - RNA, 23 nt, Human
uuucaguuccagaaaaggggagc

SEQ ID NO: 289823 - RNA, 22 nt, Human
acuaguuugaaaauaucugauu

SEQ ID NO: 289824 - RNA, 19 nt, Human
gcaucagagcagaaggggu

SEQ ID NO: 289825 - RNA, 22 nt, Human
acaugauuaaaagauuuuaaag

SEQ ID NO: 289826 - RNA, 22 nt, Human
gugugagagaagcugccaugga

SEQ ID NO: 289827 - RNA, 22 nt, Human
ucagaggcuugaagcccaagcc

SEQ ID NO: 289828 - RNA, 22 nt, Human
gggcuucuauucuggcacaaga

SEQ ID NO: 289829 - RNA, 22 nt, Human
cauagaaaagaguagguaaugu

SEQ ID NO: 289830 - RNA, 22 nt, Human
aaaaucuaaguagcgaguaagg

SEQ ID NO: 289831 - RNA, 22 nt, Human
uccuggccucgcuguccaccuu

SEQ ID NO: 289832 - RNA, 22 nt, Human
gucugcccuuccucuccacgau

SEQ ID NO: 289833 - RNA, 22 nt, Human
cagcgucucguugugggccucg

SEQ ID NO: 289834 - RNA, 22 nt, Human
uccugccuguuuaccuguacuu

SEQ ID NO: 289835 - RNA, 22 nt, Human
ucuguggcaugaggaaauaggc

SEQ ID NO: 289836 - RNA, 22 nt, Human
aaugaggucauuaaugguggga

SEQ ID NO: 289837 - RNA, 22 nt, Human
ucuagaauuugcguagguuaga

SEQ ID NO: 289838 - RNA, 22 nt, Human
cccagugugguugugaauucug

SEQ ID NO: 289839 - RNA, 22 nt, Human
ugcaaacagaaaguuuauugug

SEQ ID NO: 289840 - RNA, 22 nt, Human
agguauaugaagaugaaauaac

SEQ ID NO: 289841 - RNA, 22 nt, Human
ugagguggaaggauccuuugaa

SEQ ID NO: 289842 - RNA, 22 nt, Human
aauugcuuacuguuuuucaccu

SEQ ID NO: 289843 - RNA, 22 nt, Human
uuugagaaaaccagaaagaucu

SEQ ID NO: 289844 - RNA, 22 nt, Human
cuggauuuaauuaacuguugcu

SEQ ID NO: 289845 - RNA, 22 nt, Human
augaaggcaguuaaacgucauc

SEQ ID NO: 289846 - RNA, 22 nt, Human
cuuuauguccaccagacugcaa

SEQ ID NO: 289847 - RNA, 22 nt, Human
cccaggccagaacuugguugcu

SEQ ID NO: 289848 - RNA, 22 nt, Human
uuauuccauucaguucaacaag

SEQ ID NO: 289849 - RNA, 22 nt, Human
cugucuguucagauucauuacu

SEQ ID NO: 289850 - RNA, 19 nt, Human
uuuuguguagcugcugguu

SEQ ID NO: 289851 - RNA, 22 nt, Human
ggugcauggaaagaguaaguaa

SEQ ID NO: 289852 - RNA, 22 nt, Human
ggugaggaauuggggacugacc

SEQ ID NO: 289853 - RNA, 22 nt, Human
ucuuuuggaaaugaugugcagg

SEQ ID NO: 289854 - RNA, 22 nt, Human
gacugaaggucucagcauguga

SEQ ID NO: 289855 - RNA, 22 nt, Human
aagaacuagucuuacagccuca

SEQ ID NO: 289856 - RNA, 22 nt, Human
cuccugugggucaccaauaggc

SEQ ID NO: 289857 - RNA, 22 nt, Human
auguccaguuucuacacacaua

SEQ ID NO: 289858 - RNA, 22 nt, Human
uggagcugagagccaggcuggc

SEQ ID NO: 289859 - RNA, 22 nt, Human
acagacugugaguaugcauagu

SEQ ID NO: 289860 - RNA, 19 nt, Human
uaggaauguagaauccuag

SEQ ID NO: 289861 - RNA, 22 nt, Human
uacaagcugacccugaagauga

SEQ ID NO: 289862 - RNA, 22 nt, Human
ggccugacauuugcaucaacac

SEQ ID NO: 289863 - RNA, 22 nt, Human
agugaggggauucaggcaaggu

SEQ ID NO: 289864 - RNA, 22 nt, Human
acagucuaaucuuguguucugu

SEQ ID NO: 289865 - RNA, 22 nt, Human
cuggacccuguuucccuagguc

SEQ ID NO: 289866 - RNA, 19 nt, Human
ugcugggucauauggaaac

SEQ ID NO: 289867 - RNA, 22 nt, Human
auugcuuuuagugaaauuauau

SEQ ID NO: 289868 - RNA, 22 nt, Human
cuggaggugggggcaagagugu

SEQ ID NO: 289869 - RNA, 22 nt, Human
ucuggaugcucugagcccaagg

SEQ ID NO: 289870 - RNA, 23 nt, Human
uccaggcacgcauuucuucuagc

SEQ ID NO: 289871 - RNA, 22 nt, Human
uuccagugaaacaugaggugug

SEQ ID NO: 289872 - RNA, 22 nt, Human
ucagcuuugcaaguuagaaaau

SEQ ID NO: 289873 - RNA, 22 nt, Human
cacagggaggcggucacuggcu

SEQ ID NO: 289874 - RNA, 22 nt, Human
uuuguucugcaucacagaaaaa

SEQ ID NO: 289875 - RNA, 22 nt, Human
ggccacuguccucuagcccaga

SEQ ID NO: 289876 - RNA, 22 nt, Human
cuuuaagacuaaauuagaguuu

SEQ ID NO: 289877 - RNA, 22 nt, Human
uggauuauuguaagacaaagua

SEQ ID NO: 289878 - RNA, 22 nt, Human
uggccagguguggguucucaga

SEQ ID NO: 289879 - RNA, 22 nt, Human
uucacaauuaacuuuauacuua

SEQ ID NO: 289880 - RNA, 22 nt, Human
agagaucucugaagcugcugcu

SEQ ID NO: 289881 - RNA, 22 nt, Human
cuggccaccaagagcuugcuca

SEQ ID NO: 289882 - RNA, 22 nt, Human
ccagaugagaccacacugcugg

SEQ ID NO: 289883 - RNA, 22 nt, Human
ccacagaggacaacugccuggc

SEQ ID NO: 289884 - RNA, 22 nt, Human
cauguaaagaauuucacacaag

SEQ ID NO: 289885 - RNA, 22 nt, Human
ucuuccucaugaauucucguau

SEQ ID NO: 289886 - RNA, 20 nt, Human
ucuuuagauuuaucuuaugu

SEQ ID NO: 289887 - RNA, 22 nt, Human
uuaguuuucccaucuuuauggu

SEQ ID NO: 289888 - RNA, 22 nt, Human
ucaugccagcuuugcuuguccc

SEQ ID NO: 289889 - RNA, 21 nt, Human
uccuucucuaugauugucuga

SEQ ID NO: 289890 - RNA, 23 nt, Human
agucucagcuggaaacauguguc

SEQ ID NO: 289891 - RNA, 22 nt, Human
caguguggcugagacagaggcu

SEQ ID NO: 289892 - RNA, 22 nt, Human
uccuucaagaugccacagcuuu

SEQ ID NO: 289893 - RNA, 22 nt, Human
cagcuuauucaguaagcacaua

SEQ ID NO: 289894 - RNA, 21 nt, Human
uuucuggguggcugcauagug

SEQ ID NO: 289895 - RNA, 22 nt, Human
uuuuucauauuccccucucugg

SEQ ID NO: 289896 - RNA, 22 nt, Human
uuccuucuggagcccggggagc

SEQ ID NO: 289897 - RNA, 22 nt, Human
uacauguuugguaaaugauggc

SEQ ID NO: 289898 - RNA, 22 nt, Human
uugugucuaugguuugagcauc

SEQ ID NO: 289899 - RNA, 21 nt, Human
ucuuuuccuuucugugugcaa

SEQ ID NO: 289900 - RNA, 22 nt, Human
gagaaaagcgaaggaccuggag

SEQ ID NO: 289901 - RNA, 22 nt, Human
auaaucaaaguccuaugacauc

SEQ ID NO: 289902 - RNA, 22 nt, Human
cagggccagcgcccaggcccag

SEQ ID NO: 289903 - RNA, 22 nt, Human
ggcuggguacagggcagugugc

SEQ ID NO: 289904 - RNA, 22 nt, Human
caugugugaaucuugugaucau

SEQ ID NO: 289905 - RNA, 22 nt, Human
agacaaagacagcaucucaggu

SEQ ID NO: 289906 - RNA, 22 nt, Human
caaagcaggaagaauauugaaa

SEQ ID NO: 289907 - RNA, 23 nt, Human
cccagagcacagccuccagaugc

SEQ ID NO: 289908 - RNA, 22 nt, Human
gaggauggaggcaguuagggcc

SEQ ID NO: 289909 - RNA, 22 nt, Human
aguugcagacgcagagauguug

SEQ ID NO: 289910 - RNA, 22 nt, Human
ucuggcaguuugagaaaggcua

SEQ ID NO: 289911 - RNA, 22 nt, Human
gaagcacauggcuauagcuauu

SEQ ID NO: 289912 - RNA, 22 nt, Human
ugcaggugauucugaugcaguu

SEQ ID NO: 289913 - RNA, 22 nt, Human
uccuuucugucuuuacucugga

SEQ ID NO: 289914 - RNA, 22 nt, Human
ccaagcuacuuaggagucugag

SEQ ID NO: 289915 - RNA, 22 nt, Human
cacuuagucucaccaguucagu

SEQ ID NO: 289916 - RNA, 22 nt, Human
ucuccuggauagauacuaucca

SEQ ID NO: 289917 - RNA, 22 nt, Human
gaggccaaguuggagaccaggu

SEQ ID NO: 289918 - RNA, 22 nt, Human
uccugucuaaagaccugcaggc

SEQ ID NO: 289919 - RNA, 22 nt, Human
ucccaggguauccuguaguaaa

SEQ ID NO: 289920 - RNA, 22 nt, Human
aauauucauuugcagaagaagu

SEQ ID NO: 289921 - RNA, 22 nt, Human
gcugaggaaaggcuggaaggga

SEQ ID NO: 289922 - RNA, 17 nt, Human
ggcaggugcggggccgc

SEQ ID NO: 289923 - RNA, 22 nt, Human
cagcaugacagucugcagcaga

SEQ ID NO: 289924 - RNA, 22 nt, Human
ugcugauuuugccuacugaucc

SEQ ID NO: 289925 - RNA, 22 nt, Human
uuugguauugcacacugucuuc

SEQ ID NO: 289926 - RNA, 22 nt, Human
ggagaagggacagacucagcuu

SEQ ID NO: 289927 - RNA, 22 nt, Human
guuggugaugccacacauauuu

SEQ ID NO: 289928 - RNA, 22 nt, Human
ggcaggcaccagcucagcaaua

SEQ ID NO: 289929 - RNA, 22 nt, Human
uaaggaggcgagguggugagca

SEQ ID NO: 289930 - RNA, 22 nt, Human
acaaauuugaauccugacuucu

SEQ ID NO: 289931 - RNA, 22 nt, Human
caaagauaaucacagaauaccc

SEQ ID NO: 289932 - RNA, 23 nt, Human
uuuaccagaauagcaggggagag

SEQ ID NO: 289933 - RNA, 22 nt, Human
cagggccagagagggcuggcug

SEQ ID NO: 289934 - RNA, 22 nt, Human
guuuacauguaauguguuauug

SEQ ID NO: 289935 - RNA, 22 nt, Human
uuucagaaccgcuaaaauaaau

SEQ ID NO: 289936 - RNA, 22 nt, Human
guagcuuauuagggauaauagu

SEQ ID NO: 289937 - RNA, 22 nt, Human
ucugaacagaaaagaugcacaa

SEQ ID NO: 289938 - RNA, 22 nt, Human
ccucccaucccugcaagagagc

SEQ ID NO: 289939 - RNA, 15 nt, Human
uugcuuuaagacaug

SEQ ID NO: 289940 - RNA, 22 nt, Human
uaaacauggcuguuucaguuau

SEQ ID NO: 289941 - RNA, 22 nt, Human
ucaaaaauguuuuauauuggua

SEQ ID NO: 289942 - RNA, 22 nt, Human
cagcuggguuuaguggggugug

SEQ ID NO: 289943 - RNA, 22 nt, Human
gccaggcauuuauugauugaau

SEQ ID NO: 289944 - RNA, 23 nt, Human
ucuuuccuaaugaaacagugaaa

SEQ ID NO: 289945 - RNA, 22 nt, Human
ugugaaaaaaguucuagaagga

SEQ ID NO: 289946 - RNA, 22 nt, Human
gacaguuuuuaauccuuucaug

SEQ ID NO: 289947 - RNA, 23 nt, Human
cucuccaccuucccacccaggga

SEQ ID NO: 289948 - RNA, 23 nt, Human
uggccaggguacuacacccaccc

SEQ ID NO: 289949 - RNA, 22 nt, Human
ccagggagccuggugugucagc

SEQ ID NO: 289950 - RNA, 22 nt, Human
ugaauccagagcuauuucgucc

SEQ ID NO: 289951 - RNA, 22 nt, Human
uugcugaucugugaaucagcca

SEQ ID NO: 289952 - RNA, 22 nt, Human
ccuggcucugcagccacuccag

SEQ ID NO: 289953 - RNA, 22 nt, Human
guacccaggcacgccuugcuga

SEQ ID NO: 289954 - RNA, 22 nt, Human
ggaugaggaaaccacagugucc

SEQ ID NO: 289955 - RNA, 23 nt, Human
ugucuucgacuccugcgugcuuc

SEQ ID NO: 289956 - RNA, 22 nt, Human
gcauguuuugcaacaagugacc

SEQ ID NO: 289957 - RNA, 22 nt, Human
gagcugaauugcugccauuugc

SEQ ID NO: 289958 - RNA, 22 nt, Human
uauucaaaguaccuucauugcc

SEQ ID NO: 289959 - RNA, 22 nt, Human
gacauuucuagcccauaaaacu

SEQ ID NO: 289960 - RNA, 19 nt, Human
caagauuuguucacacaug

SEQ ID NO: 289961 - RNA, 22 nt, Human
gcuguggccuaguuuguuauau

SEQ ID NO: 289962 - RNA, 22 nt, Human
auauuaauuauuuacacaugag

SEQ ID NO: 289963 - RNA, 22 nt, Human
auagauauuugaguuguuucca

SEQ ID NO: 289964 - RNA, 22 nt, Human
aaaaaugucauuauggaacuga

SEQ ID NO: 289965 - RNA, 22 nt, Human
acacaugaggaugaggggauca

SEQ ID NO: 289966 - RNA, 22 nt, Human
uacauucaacaugucacuaugu

SEQ ID NO: 289967 - RNA, 22 nt, Human
cuuucauuugauaagaaugcca

SEQ ID NO: 289968 - RNA, 22 nt, Human
uuuacuugauauggagcugagg

SEQ ID NO: 289969 - RNA, 22 nt, Human
cuguauaaacauauuuucaagu

SEQ ID NO: 289970 - RNA, 22 nt, Human
uauuuccagcaguaagaagaca

SEQ ID NO: 289971 - RNA, 22 nt, Human
auggcaguguuucaguuuuugg

SEQ ID NO: 289972 - RNA, 22 nt, Human
ggccuugauguucuugggagau

SEQ ID NO: 289973 - RNA, 22 nt, Human
cauagacauucagcacucacua

SEQ ID NO: 289974 - RNA, 22 nt, Human
aguuuggaaaaugagacaagga

SEQ ID NO: 289975 - RNA, 22 nt, Human
cagccagagaggaaggaaugca

SEQ ID NO: 289976 - RNA, 22 nt, Human
gauguagacacuuggaggcuua

SEQ ID NO: 289977 - RNA, 22 nt, Human
aucauucuagcuguuguguuga

SEQ ID NO: 289978 - RNA, 20 nt, Human
cccugcagccaugggagugg

SEQ ID NO: 289979 - RNA, 22 nt, Human
auucaacuauguauagucuucu

SEQ ID NO: 289980 - RNA, 22 nt, Human
gagggugucugcguaacuggca

SEQ ID NO: 289981 - RNA, 22 nt, Human
uccaugagagguaacuuuacaa

SEQ ID NO: 289982 - RNA, 22 nt, Human
uuuucagaggccuaagagguuu

SEQ ID NO: 289983 - RNA, 22 nt, Human
ccugggagugugccaucucugu

SEQ ID NO: 289984 - RNA, 22 nt, Human
cuuguccagauguuuguuaggu

SEQ ID NO: 289985 - RNA, 22 nt, Human
ugaauagacuggggcugugaag

SEQ ID NO: 289986 - RNA, 22 nt, Human
gcuugggaagggcccuguguac

SEQ ID NO: 289987 - RNA, 22 nt, Human
aaauaugaaugauaagaguuau

SEQ ID NO: 289988 - RNA, 22 nt, Human
uuccaggcucccuuggaggugu

SEQ ID NO: 289989 - RNA, 22 nt, Human
agcacaggcuuuggugugaggg

SEQ ID NO: 289990 - RNA, 21 nt, Human
gcuccuggugcugcguggcgc

SEQ ID NO: 289991 - RNA, 22 nt, Human
ugaaaacuccaaguuucaucag

SEQ ID NO: 289992 - RNA, 22 nt, Human
gaugugucccuuucaacucaga

SEQ ID NO: 289993 - RNA, 22 nt, Human
gggacaugccccucagugggug

SEQ ID NO: 289994 - RNA, 22 nt, Human
cuugggaaugcuaacagaugac

SEQ ID NO: 289995 - RNA, 21 nt, Human
acagagaaagagcagccuccu

SEQ ID NO: 289996 - RNA, 22 nt, Human
ucagugucaucacuuaauauaa

SEQ ID NO: 289997 - RNA, 22 nt, Human
uuacaguaaucgaguguugugg

SEQ ID NO: 289998 - RNA, 22 nt, Human
uaugaacacacuuuggaaguga

SEQ ID NO: 289999 - RNA, 23 nt, Human
uuggagagggugaguagugucag

SEQ ID NO: 290000 - RNA, 22 nt, Human
ggcauccaaauaccaagaugua

SEQ ID NO: 290001 - RNA, 22 nt, Human
gccaggcagacaggucaucagg

SEQ ID NO: 290002 - RNA, 22 nt, Human
ggagcugagaguagucccuuuu

SEQ ID NO: 290003 - RNA, 22 nt, Human
gauugcugugcgccccaggugu

SEQ ID NO: 290004 - RNA, 22 nt, Human
agcuucuuggcucagcacuugg

SEQ ID NO: 290005 - RNA, 22 nt, Human
gcucucuuuuuccagugguggu

SEQ ID NO: 290006 - RNA, 22 nt, Human
caggcagcugcuggguucagcc

SEQ ID NO: 290007 - RNA, 19 nt, Human
aaaguuuuauucucauuug

SEQ ID NO: 290008 - RNA, 22 nt, Human
gguggggcugcaagcaguucgg

SEQ ID NO: 290009 - RNA, 22 nt, Human
uuccaggcuucucuggggcguc

SEQ ID NO: 290010 - RNA, 21 nt, Human
cucugcccagggccuccugcc

SEQ ID NO: 290011 - RNA, 22 nt, Human
uccccaccuaagauacccaucu

SEQ ID NO: 290012 - RNA, 22 nt, Human
uuacacaaaaauaagauauggc

SEQ ID NO: 290013 - RNA, 22 nt, Human
gccaccucuuugucucugccgc

SEQ ID NO: 290014 - RNA, 22 nt, Human
gauugcuggggcaggcuguagc

SEQ ID NO: 290015 - RNA, 22 nt, Human
ucuugggcauguguuugauuuc

SEQ ID NO: 290016 - RNA, 22 nt, Human
ggcaaagagacaugcaucgggg

SEQ ID NO: 290017 - RNA, 22 nt, Human
auuucucacugagcagauaaaa

SEQ ID NO: 290018 - RNA, 22 nt, Human
ugggcaggagagaagcuaaaga

SEQ ID NO: 290019 - RNA, 22 nt, Human
aguguccugugucccagacugu

SEQ ID NO: 290020 - RNA, 22 nt, Human
uuuugagauggagucuugcucu

SEQ ID NO: 290021 - RNA, 22 nt, Human
augagcaguuuuuaaguagcaa

SEQ ID NO: 290022 - RNA, 22 nt, Human
agcaagcagaauucuguccucu

SEQ ID NO: 290023 - RNA, 22 nt, Human
gcaccugcuggaaucagucugu

SEQ ID NO: 290024 - RNA, 22 nt, Human
gccugagauucccggagccgug

SEQ ID NO: 290025 - RNA, 22 nt, Human
gaaggagggagcggcgcggauu

SEQ ID NO: 290026 - RNA, 22 nt, Human
cuccagaauuguccauuggaaa

SEQ ID NO: 290027 - RNA, 22 nt, Human
gaaggcaucacagaggcugugg

SEQ ID NO: 290028 - RNA, 22 nt, Human
cugccugggccaugcccagucc

SEQ ID NO: 290029 - RNA, 22 nt, Human
acaaaugacuauuugguacagg

SEQ ID NO: 290030 - RNA, 22 nt, Human
uauuuguugaauaccccugucu

SEQ ID NO: 290031 - RNA, 22 nt, Human
ucuucagacccuuagcugugau

SEQ ID NO: 290032 - RNA, 22 nt, Human
acaauaugggauauacauuuua

SEQ ID NO: 290033 - RNA, 22 nt, Human
aaaauguaaagcuugaguguag

SEQ ID NO: 290034 - RNA, 22 nt, Human
acugagagcguguacaaacuua

SEQ ID NO: 290035 - RNA, 15 nt, Human
gcagguggaucacuu

SEQ ID NO: 290036 - RNA, 17 nt, Human
ucugaggccucuaggag

SEQ ID NO: 290037 - RNA, 22 nt, Human
aaguguuuauuuauaacgaucu

SEQ ID NO: 290038 - RNA, 23 nt, Human
ugggagcucaagggaggcugccc

SEQ ID NO: 290039 - RNA, 22 nt, Human
uuuagaaguucacacauuuaaa

SEQ ID NO: 290040 - RNA, 18 nt, Human
cagagcuccuggaugcag

SEQ ID NO: 290041 - RNA, 22 nt, Human
cacagcauaaugaaauauacuu

SEQ ID NO: 290042 - RNA, 22 nt, Human
gcuuuaaugcaauuucaccuca

SEQ ID NO: 290043 - RNA, 22 nt, Human
cuccugggcucauaucauucag

SEQ ID NO: 290044 - RNA, 22 nt, Human
uugcagggaaacaguuuaggaa

SEQ ID NO: 290045 - RNA, 22 nt, Human
uauccaauucaccauugauggg

SEQ ID NO: 290046 - RNA, 22 nt, Human
aaggcauaggacaaaucaguga

SEQ ID NO: 290047 - RNA, 22 nt, Human
agcaggugagcacagccaggcu

SEQ ID NO: 290048 - RNA, 22 nt, Human
aaagcagagcagggcacuuaug

SEQ ID NO: 290049 - RNA, 22 nt, Human
cauuguuaccaucuuuuaccua

SEQ ID NO: 290050 - RNA, 20 nt, Human
gccaggcacuguucucaaua

SEQ ID NO: 290051 - RNA, 22 nt, Human
cuggcccuguggccuaaggacu

SEQ ID NO: 290052 - RNA, 22 nt, Human
uaaaguguuuguaugcagauaa

SEQ ID NO: 290053 - RNA, 22 nt, Human
ugguaauauaugccagauaaaa

SEQ ID NO: 290054 - RNA, 22 nt, Human
ccuguggcugccacuuggguga

SEQ ID NO: 290055 - RNA, 22 nt, Human
gugagcagcucaggguggucuc

SEQ ID NO: 290056 - RNA, 22 nt, Human
ugucucuggcugcagccuguuc

SEQ ID NO: 290057 - RNA, 22 nt, Human
guguccugcauuggcucugccc

SEQ ID NO: 290058 - RNA, 22 nt, Human
augugaaaaauuucuuauuaca

SEQ ID NO: 290059 - RNA, 22 nt, Human
aguggcuuaucugggacagcua

SEQ ID NO: 290060 - RNA, 22 nt, Human
gggggaggugaaugcaauaagg

SEQ ID NO: 290061 - RNA, 22 nt, Human
agucugaagacucaugucugaa

SEQ ID NO: 290062 - RNA, 22 nt, Human
aguugggaguuauagacucuau

SEQ ID NO: 290063 - RNA, 22 nt, Human
acuuggaaaauucaaaauggca

SEQ ID NO: 290064 - RNA, 22 nt, Human
ugcuugucccucuuuaugaugg

SEQ ID NO: 290065 - RNA, 18 nt, Human
gaggccugagaaccaggu

SEQ ID NO: 290066 - RNA, 22 nt, Human
aucugguucuucuuaggcauca

SEQ ID NO: 290067 - RNA, 22 nt, Human
guaguucugcagugucaccuga

SEQ ID NO: 290068 - RNA, 22 nt, Human
cuucucagaucucagcuuugag

SEQ ID NO: 290069 - RNA, 22 nt, Human
ucagguggcuucggggaguggc

SEQ ID NO: 290070 - RNA, 22 nt, Human
agcaggugaugugagucuggaa

SEQ ID NO: 290071 - RNA, 22 nt, Human
uauuaggguuuugaagguuugu

SEQ ID NO: 290072 - RNA, 22 nt, Human
aacuaaaagugugucucuugua

SEQ ID NO: 290073 - RNA, 22 nt, Human
auuauucaaucauauuaaaagu

SEQ ID NO: 290074 - RNA, 22 nt, Human
gccuggcacaggaauuaggagg

SEQ ID NO: 290075 - RNA, 22 nt, Human
gacagacaggaggccaccugcu

SEQ ID NO: 290076 - RNA, 18 nt, Human
gcugggguugagcucucc

SEQ ID NO: 290077 - RNA, 23 nt, Human
uuucaacaaugcuuagagaaaac

SEQ ID NO: 290078 - RNA, 22 nt, Human
uugcugagcuuuggcaaggaag

SEQ ID NO: 290079 - RNA, 21 nt, Human
gggagggauggaaaugauguu

SEQ ID NO: 290080 - RNA, 22 nt, Human
gauggccuuguuuucucccuuc

SEQ ID NO: 290081 - RNA, 22 nt, Human
auacaaaauauauacuggagac

SEQ ID NO: 290082 - RNA, 22 nt, Human
gaugugucauuuggucaucugc

SEQ ID NO: 290083 - RNA, 22 nt, Human
ugguccuggggaucugcaguga

SEQ ID NO: 290084 - RNA, 22 nt, Human
ugcugguaccgcgccuccgcca

SEQ ID NO: 290085 - RNA, 22 nt, Human
caagaugugccuaaucagaccu

SEQ ID NO: 290086 - RNA, 22 nt, Human
aaaaguuuaagacucauucuag

SEQ ID NO: 290087 - RNA, 22 nt, Human
agagcacggccaccauuuacaa

SEQ ID NO: 290088 - RNA, 22 nt, Human
uagaaacauguucuguucuguu

SEQ ID NO: 290089 - RNA, 22 nt, Human
uccugcagcugauaaauacagu

SEQ ID NO: 290090 - RNA, 22 nt, Human
cccuguuuggauggggacccag

SEQ ID NO: 290091 - RNA, 20 nt, Human
gagucacagaagaagcugaa

SEQ ID NO: 290092 - RNA, 22 nt, Human
ucaaauaccagcuuuuccagaa

SEQ ID NO: 290093 - RNA, 22 nt, Human
ucuuccuucuuugaugacaagg

SEQ ID NO: 290094 - RNA, 22 nt, Human
guacaauaacuagucuuauagu

SEQ ID NO: 290095 - RNA, 22 nt, Human
uuagcuuucaugaaccuggucg

SEQ ID NO: 290096 - RNA, 22 nt, Human
aaaaaugugaccacaggguguu

SEQ ID NO: 290097 - RNA, 22 nt, Human
auauuucaugggguuccauacu

SEQ ID NO: 290098 - RNA, 22 nt, Human
uuuguacauauauaaaaucugu

SEQ ID NO: 290099 - RNA, 22 nt, Human
auagauacuggguauggagaug

SEQ ID NO: 290100 - RNA, 22 nt, Human
ggguaggaugguagaagggacc

SEQ ID NO: 290101 - RNA, 22 nt, Human
agccuugcaugauuucauucau

SEQ ID NO: 290102 - RNA, 22 nt, Human
augauacaagcaaaacuaauca

SEQ ID NO: 290103 - RNA, 22 nt, Human
uauuaugcauaggcaauaaugg

SEQ ID NO: 290104 - RNA, 22 nt, Human
ugcaaacacuucaacgugcauc

SEQ ID NO: 290105 - RNA, 22 nt, Human
ccacugaggcaggcaguaucua

SEQ ID NO: 290106 - RNA, 23 nt, Human
uccuuugucuuugcauagauggu

SEQ ID NO: 290107 - RNA, 22 nt, Human
cagccagaucaaacucagaugu

SEQ ID NO: 290108 - RNA, 22 nt, Human
aagcugucaauguaucuagucu

SEQ ID NO: 290109 - RNA, 22 nt, Human
uugaaauacugcauuguucagu

SEQ ID NO: 290110 - RNA, 22 nt, Human
cuaaauuaucaugagaauuaug

SEQ ID NO: 290111 - RNA, 22 nt, Human
uacaagucacuuccuuucuaaa

SEQ ID NO: 290112 - RNA, 19 nt, Human
ugccuggacaaaugugggg

SEQ ID NO: 290113 - RNA, 22 nt, Human
agaugaaaauacgugacuuuaa

SEQ ID NO: 290114 - RNA, 22 nt, Human
gcccuuggaacagccuccugcu

SEQ ID NO: 290115 - RNA, 17 nt, Human
gcaagggaugggagauu

SEQ ID NO: 290116 - RNA, 22 nt, Human
ucugaauuaaucaugccucuuu

SEQ ID NO: 290117 - RNA, 22 nt, Human
aagcuuuaagugucagucagcc

SEQ ID NO: 290118 - RNA, 22 nt, Human
acugucaugaucgaagauguca

SEQ ID NO: 290119 - RNA, 22 nt, Human
uggcuccuuccgcagcaugccu

SEQ ID NO: 290120 - RNA, 22 nt, Human
ugggaaagacucaggacaggag

SEQ ID NO: 290121 - RNA, 22 nt, Human
cuguuguucaucaucugucauu

SEQ ID NO: 290122 - RNA, 22 nt, Human
caaauucucaagguuuauccca

SEQ ID NO: 290123 - RNA, 22 nt, Human
aaguaaaauguuuccuuuauua

SEQ ID NO: 290124 - RNA, 22 nt, Human
uauucugugugauauguaaaug

SEQ ID NO: 290125 - RNA, 21 nt, Human
ugcauaaagaaauacaaauac

SEQ ID NO: 290126 - RNA, 22 nt, Human
ucccagccacaguuuccaccug

SEQ ID NO: 290127 - RNA, 18 nt, Human
uccaaagcugcugguuuu

SEQ ID NO: 290128 - RNA, 22 nt, Human
aagucagauaggugaguccaaa

SEQ ID NO: 290129 - RNA, 23 nt, Human
cucccuggcccuugggagaccug

SEQ ID NO: 290130 - RNA, 22 nt, Human
guacacagaugcuugagaaucu

SEQ ID NO: 290131 - RNA, 22 nt, Human
cauacuuuugcccugacauucu

SEQ ID NO: 290132 - RNA, 22 nt, Human
gagucagaaacucacucuauag

SEQ ID NO: 290133 - RNA, 23 nt, Human
uccuccuuuugcuugugcuuccc

SEQ ID NO: 290134 - RNA, 22 nt, Human
gagggagaaggacuaucaggcu

SEQ ID NO: 290135 - RNA, 22 nt, Human
guccuucucaaauccuguguuu

SEQ ID NO: 290136 - RNA, 22 nt, Human
ucaagcuggcuguugcuauuuc

SEQ ID NO: 290137 - RNA, 22 nt, Human
ugcagugccucggcagugcagc

SEQ ID NO: 290138 - RNA, 22 nt, Human
auaauucagguuuucuggcaca

SEQ ID NO: 290139 - RNA, 22 nt, Human
uucuuuuaauguucugaaguuu

SEQ ID NO: 290140 - RNA, 22 nt, Human
gcuggcagagcucugggcuggg

SEQ ID NO: 290141 - RNA, 22 nt, Human
ucccagggcagcuguccagaag

SEQ ID NO: 290142 - RNA, 22 nt, Human
uuccaggcaugucagacauagg

SEQ ID NO: 290143 - RNA, 19 nt, Human
aaauaucagagagaugaua

SEQ ID NO: 290144 - RNA, 18 nt, Human
auccaaaaagauggaagu

SEQ ID NO: 290145 - RNA, 22 nt, Human
auuauaaaccuuugaggguggg

SEQ ID NO: 290146 - RNA, 21 nt, Human
aaugcauuaacauaaagcuga

SEQ ID NO: 290147 - RNA, 22 nt, Human
gcuguggcugaccaccaggggg

SEQ ID NO: 290148 - RNA, 21 nt, Human
uauuaauaugucuaagcugau

SEQ ID NO: 290149 - RNA, 22 nt, Human
gugaggagucugaagcacauaa

SEQ ID NO: 290150 - RNA, 19 nt, Human
agcauccagucaugggauc

SEQ ID NO: 290151 - RNA, 22 nt, Human
uauaagcacauccuugacugau

SEQ ID NO: 290152 - RNA, 19 nt, Human
gacaggacgaagggaaguu

SEQ ID NO: 290153 - RNA, 22 nt, Human
aaugugaaaccgcacagaauaa

SEQ ID NO: 290154 - RNA, 22 nt, Human
uacauucaaacgauuuauugau

SEQ ID NO: 290155 - RNA, 22 nt, Human
ggucccaggaaucuguguucua

SEQ ID NO: 290156 - RNA, 22 nt, Human
uauacacauccuccaaagauag

SEQ ID NO: 290157 - RNA, 22 nt, Human
cucuuucucgccgcccgcaguc

SEQ ID NO: 290158 - RNA, 22 nt, Human
cauguccuucucauugccucau

SEQ ID NO: 290159 - RNA, 22 nt, Human
ccagguguggggaggacucaca

SEQ ID NO: 290160 - RNA, 22 nt, Human
cccacacauuuuucacuuaccg

SEQ ID NO: 290161 - RNA, 22 nt, Human
acagguguaauuugcccgaggu

SEQ ID NO: 290162 - RNA, 22 nt, Human
cucaggaggugguagaggcccu

SEQ ID NO: 290163 - RNA, 22 nt, Human
ugcaugaacacaugugcaugua

SEQ ID NO: 290164 - RNA, 22 nt, Human
uguuuacuccugauauauuuuu

SEQ ID NO: 290165 - RNA, 22 nt, Human
gaagauugaaggcugggaauua

SEQ ID NO: 290166 - RNA, 22 nt, Human
caggaggguguggaaaacuggg

SEQ ID NO: 290167 - RNA, 22 nt, Human
uguggucuuggaagaaguugcu

SEQ ID NO: 290168 - RNA, 22 nt, Human
cauagaaucauagcacauuuga

SEQ ID NO: 290169 - RNA, 22 nt, Human
uccuggcuuuucuuggcucauc

SEQ ID NO: 290170 - RNA, 22 nt, Human
ugucccuggagcuucugucccc

SEQ ID NO: 290171 - RNA, 22 nt, Human
uucccagagaaggaugaaaaag

SEQ ID NO: 290172 - RNA, 16 nt, Human
cacauauauuuauaug

SEQ ID NO: 290173 - RNA, 22 nt, Human
uuacacagugcacaagcagagu

SEQ ID NO: 290174 - RNA, 22 nt, Human
gaucuuuucagaauuuaucagu

SEQ ID NO: 290175 - RNA, 22 nt, Human
aguggggccggugaggccgagg

SEQ ID NO: 290176 - RNA, 22 nt, Human
aggcacaagaaacugcucccca

SEQ ID NO: 290177 - RNA, 22 nt, Human
agucacacugguuguuuacagu

SEQ ID NO: 290178 - RNA, 22 nt, Human
ucacaaaagcuuuugaauuugg

SEQ ID NO: 290179 - RNA, 22 nt, Human
uggcagggccugcucaucaucc

SEQ ID NO: 290180 - RNA, 22 nt, Human
aggcagguuuacucuuauuugg

SEQ ID NO: 290181 - RNA, 22 nt, Human
gaggaggguuggccuuagguag

SEQ ID NO: 290182 - RNA, 22 nt, Human
gggagccacaguagcagcuacu

SEQ ID NO: 290183 - RNA, 22 nt, Human
aagaggccuuggucugaccuga

SEQ ID NO: 290184 - RNA, 22 nt, Human
aggagaggcucuaacucugugu

SEQ ID NO: 290185 - RNA, 22 nt, Human
cuuucacagcacaagccugccu

SEQ ID NO: 290186 - RNA, 22 nt, Human
ucucuguaguugggcagcugcu

SEQ ID NO: 290187 - RNA, 22 nt, Human
uccuggcucugcugccuccuag

SEQ ID NO: 290188 - RNA, 22 nt, Human
ucaugaauauugaaugcuucau

SEQ ID NO: 290189 - RNA, 22 nt, Human
acuugguguauuagcucucacu

SEQ ID NO: 290190 - RNA, 22 nt, Human
aaaguucuuuuucuauaaaucc

SEQ ID NO: 290191 - RNA, 22 nt, Human
guccuggcuguguuugguuucu

SEQ ID NO: 290192 - RNA, 22 nt, Human
cuacaggucaagcaguagcucu

SEQ ID NO: 290193 - RNA, 22 nt, Human
ugcaguucaagguuguacagcu

SEQ ID NO: 290194 - RNA, 22 nt, Human
uuugacauggaauaacucauuu

SEQ ID NO: 290195 - RNA, 22 nt, Human
guccagucacugucaauguucc

SEQ ID NO: 290196 - RNA, 22 nt, Human
auaaugaggauuugcauauuag

SEQ ID NO: 290197 - RNA, 22 nt, Human
caaauagugucacauugugagg

SEQ ID NO: 290198 - RNA, 22 nt, Human
ggccacugccuccgccauggcu

SEQ ID NO: 290199 - RNA, 22 nt, Human
ccugccuucagcccugaagucu

SEQ ID NO: 290200 - RNA, 22 nt, Human
uuugugcagauguauauuugug

SEQ ID NO: 290201 - RNA, 22 nt, Human
caagauuuauauuuucacacaa

SEQ ID NO: 290202 - RNA, 22 nt, Human
agaauuguucuguagcuuggcu

SEQ ID NO: 290203 - RNA, 22 nt, Human
cgcaccacugaauuccagccug

SEQ ID NO: 290204 - RNA, 22 nt, Human
acagcauggauaacaaggcacu

SEQ ID NO: 290205 - RNA, 22 nt, Human
ucagacagauuuugacacuugc

SEQ ID NO: 290206 - RNA, 22 nt, Human
gcucugagacaguagagauggc

SEQ ID NO: 290207 - RNA, 22 nt, Human
uagaacauaagucauucauuug

SEQ ID NO: 290208 - RNA, 23 nt, Human
agcagcaaaaauuuaucuuucug

SEQ ID NO: 290209 - RNA, 22 nt, Human
ugaccaguuaagucauccuguc

SEQ ID NO: 290210 - RNA, 22 nt, Human
ccugagaguaggugucucuuua

SEQ ID NO: 290211 - RNA, 22 nt, Human
guccuuccugcagggauggaug

SEQ ID NO: 290212 - RNA, 22 nt, Human
aauauguucaaaauagaucacu

SEQ ID NO: 290213 - RNA, 22 nt, Human
agcacugauuuaaacuggauuu

SEQ ID NO: 290214 - RNA, 22 nt, Human
cuucucccuggcuucugcacac

SEQ ID NO: 290215 - RNA, 22 nt, Human
uuggaaaguuuuuacugaagac

SEQ ID NO: 290216 - RNA, 22 nt, Human
aaagcagguugcaauuacagug

SEQ ID NO: 290217 - RNA, 22 nt, Human
cuucagaauccagaaucagaau

SEQ ID NO: 290218 - RNA, 22 nt, Human
uagguggugugcgaagagcgug

SEQ ID NO: 290219 - RNA, 22 nt, Human
auucuucacauaagugcuguac

SEQ ID NO: 290220 - RNA, 22 nt, Human
gugaccauuugacauauccuug

SEQ ID NO: 290221 - RNA, 22 nt, Human
cuccuggccccagaucccaauc

SEQ ID NO: 290222 - RNA, 22 nt, Human
ucauuucucccggccaaaaacu

SEQ ID NO: 290223 - RNA, 22 nt, Human
cauucccaugacuccugcucag

SEQ ID NO: 290224 - RNA, 22 nt, Human
cucaggagaugacagaagguau

SEQ ID NO: 290225 - RNA, 22 nt, Human
gccuccccugcaauuguccuug

SEQ ID NO: 290226 - RNA, 22 nt, Human
ucuuauugugaugaugaagaac

SEQ ID NO: 290227 - RNA, 19 nt, Human
uuugugaagaaaaugaugc

SEQ ID NO: 290228 - RNA, 22 nt, Human
gaauuucuggacccuuugagaa

SEQ ID NO: 290229 - RNA, 22 nt, Human
ucuaaaaaagucuguucacuug

SEQ ID NO: 290230 - RNA, 22 nt, Human
accuguuuuccuaucuagauug

SEQ ID NO: 290231 - RNA, 22 nt, Human
acaguauacauugauuaggacc

SEQ ID NO: 290232 - RNA, 22 nt, Human
acaugccagcccauuuaaaugg

SEQ ID NO: 290233 - RNA, 22 nt, Human
agacaaaugguaauuaugucua

SEQ ID NO: 290234 - RNA, 20 nt, Human
ucccaaggaugccugggugu

SEQ ID NO: 290235 - RNA, 22 nt, Human
acacaguucuuucacuguuggu

SEQ ID NO: 290236 - RNA, 22 nt, Human
uuggaggaaauugcuuuugugg

SEQ ID NO: 290237 - RNA, 22 nt, Human
gagacacacauucuggagagaa

SEQ ID NO: 290238 - RNA, 22 nt, Human
acuuccaggaggugucacugaa

SEQ ID NO: 290239 - RNA, 22 nt, Human
agaugaagauaucugcaggggc

SEQ ID NO: 290240 - RNA, 22 nt, Human
ugggucuguagggcuguccaau

SEQ ID NO: 290241 - RNA, 22 nt, Human
gcuuucugguucucaaagcacu

SEQ ID NO: 290242 - RNA, 22 nt, Human
ucuggcaggccuugucaaucug

SEQ ID NO: 290243 - RNA, 22 nt, Human
auguaccucugcauuccugccu

SEQ ID NO: 290244 - RNA, 22 nt, Human
uccuucuguagucccugucccu

SEQ ID NO: 290245 - RNA, 22 nt, Human
ugcuggagucucuugacccugg

SEQ ID NO: 290246 - RNA, 22 nt, Human
acuaaauaguuuugacagaaca

SEQ ID NO: 290247 - RNA, 22 nt, Human
ugcuuuauagacaaggaaguag

SEQ ID NO: 290248 - RNA, 22 nt, Human
aguccaggcauuccagccauuc

SEQ ID NO: 290249 - RNA, 22 nt, Human
uguguuuugaacucaucuacug

SEQ ID NO: 290250 - RNA, 22 nt, Human
acagauggagcuacuagguaaa

SEQ ID NO: 290251 - RNA, 22 nt, Human
uuauuggaaaagggcuguaauu

SEQ ID NO: 290252 - RNA, 22 nt, Human
agccuucacugggaccuuggau

SEQ ID NO: 290253 - RNA, 22 nt, Human
aggaagaacagauaauggacgc

SEQ ID NO: 290254 - RNA, 22 nt, Human
cugauagacaaucaccauggga

SEQ ID NO: 290255 - RNA, 22 nt, Human
aaggcuuuugggaauuuucaac

SEQ ID NO: 290256 - RNA, 22 nt, Human
acagcaggauuuggcgauguug

SEQ ID NO: 290257 - RNA, 22 nt, Human
cuggcuguaacauuuugccaua

SEQ ID NO: 290258 - RNA, 22 nt, Human
cuagaugccaauuuuuauggau

SEQ ID NO: 290259 - RNA, 22 nt, Human
uaaaguuuauuugaacaucucu

SEQ ID NO: 290260 - RNA, 22 nt, Human
uccucuccaugucucacgccac

SEQ ID NO: 290261 - RNA, 20 nt, Human
gacaggugcuaaagaggggc

SEQ ID NO: 290262 - RNA, 20 nt, Human
uuagaaagagcgugauaaga

SEQ ID NO: 290263 - RNA, 22 nt, Human
aauauccacacugugucccugc

SEQ ID NO: 290264 - RNA, 23 nt, Human
agcuccugaggccagccucuccu

SEQ ID NO: 290265 - RNA, 22 nt, Human
uguucagagacagaaauucuaa

SEQ ID NO: 290266 - RNA, 22 nt, Human
auaguacagcauuuuuccugag

SEQ ID NO: 290267 - RNA, 19 nt, Human
auauauguauacaaugugg

SEQ ID NO: 290268 - RNA, 20 nt, Human
cuugguggcucugggaagug

SEQ ID NO: 290269 - RNA, 22 nt, Human
augacagaugcuguggggaggu

SEQ ID NO: 290270 - RNA, 22 nt, Human
ccuagacauuaagcuuggguuu

SEQ ID NO: 290271 - RNA, 22 nt, Human
uucuagaaugauaugagguacu

SEQ ID NO: 290272 - RNA, 22 nt, Human
ucacuggggagcacugacaugu

SEQ ID NO: 290273 - RNA, 22 nt, Human
ugaguacucggagugcuuugga

SEQ ID NO: 290274 - RNA, 22 nt, Human
uaaaaucagccgaccauggugg

SEQ ID NO: 290275 - RNA, 19 nt, Human
uuucagacauuucaaauuu

SEQ ID NO: 290276 - RNA, 22 nt, Human
uggagcaggugggaugucguga

SEQ ID NO: 290277 - RNA, 22 nt, Human
auucuggguucaugagugagcu

SEQ ID NO: 290278 - RNA, 22 nt, Human
gucugcccuggggcaucaguuu

SEQ ID NO: 290279 - RNA, 22 nt, Human
aagcugcagaugugccugugga

SEQ ID NO: 290280 - RNA, 23 nt, Human
uuuauacaagaaaccgcuggccu

SEQ ID NO: 290281 - RNA, 22 nt, Human
aggggagagaacauaaggaagu

SEQ ID NO: 290282 - RNA, 22 nt, Human
ugccuucaccaggccuucagcc

SEQ ID NO: 290283 - RNA, 22 nt, Human
agggccagcuagagcccucgcc

SEQ ID NO: 290284 - RNA, 23 nt, Human
ugcagggcaaguuagagacccca

SEQ ID NO: 290285 - RNA, 22 nt, Human
ugguggacauucuggaugugcu

SEQ ID NO: 290286 - RNA, 22 nt, Human
acaauuccugagaauacuuguu

SEQ ID NO: 290287 - RNA, 22 nt, Human
uuuacagucaccaaacuuugcu

SEQ ID NO: 290288 - RNA, 22 nt, Human
aaucaguuguccaaaguucaca

SEQ ID NO: 290289 - RNA, 22 nt, Human
gacagacaggugugguaggcac

SEQ ID NO: 290290 - RNA, 22 nt, Human
gcuaggaggaagaaugugaauu

SEQ ID NO: 290291 - RNA, 22 nt, Human
gagaaagauguaggcugggagg

SEQ ID NO: 290292 - RNA, 22 nt, Human
ggaggccaaggcagguggauca

SEQ ID NO: 290293 - RNA, 22 nt, Human
uaccuguugucacgauaacacu

SEQ ID NO: 290294 - RNA, 22 nt, Human
cucuuagaaagaaacacacugg

SEQ ID NO: 290295 - RNA, 22 nt, Human
accucaagugauccacucaccu

SEQ ID NO: 290296 - RNA, 22 nt, Human
auggaguucuuuaaauucacag

SEQ ID NO: 290297 - RNA, 21 nt, Human
gcugggucagcagguccucug

SEQ ID NO: 290298 - RNA, 22 nt, Human
uguccucagauaugucuacucu

SEQ ID NO: 290299 - RNA, 22 nt, Human
cagggcucccucuggcucccag

SEQ ID NO: 290300 - RNA, 19 nt, Human
uuuuuacaaguagguguga

SEQ ID NO: 290301 - RNA, 22 nt, Human
gcuggcagucccaucagcuggg

SEQ ID NO: 290302 - RNA, 22 nt, Human
ugagccagcuccuugccuguca

SEQ ID NO: 290303 - RNA, 22 nt, Human
gcacccagggacuuggcuggcc

SEQ ID NO: 290304 - RNA, 22 nt, Human
uccaggagggauugggcugugg

SEQ ID NO: 290305 - RNA, 22 nt, Human
caucuuuaguuauugaauauag

SEQ ID NO: 290306 - RNA, 22 nt, Human
ccaguccugugugacccugcac

SEQ ID NO: 290307 - RNA, 18 nt, Human
gcagguguggagaagggg

SEQ ID NO: 290308 - RNA, 17 nt, Human
ggcaggugacagacacc

SEQ ID NO: 290309 - RNA, 22 nt, Human
uggaaauggaucugaugagucu

SEQ ID NO: 290310 - RNA, 22 nt, Human
uuuacagugucuuguugacugu

SEQ ID NO: 290311 - RNA, 22 nt, Human
ccuggcacugaccaggcacuga

SEQ ID NO: 290312 - RNA, 17 nt, Human
gcagaaaagucaaggga

SEQ ID NO: 290313 - RNA, 22 nt, Human
uggggucccaacucugauugau

SEQ ID NO: 290314 - RNA, 22 nt, Human
uaggaaauggcucaguuacugc

SEQ ID NO: 290315 - RNA, 22 nt, Human
cccagcuugucugauucagccu

SEQ ID NO: 290316 - RNA, 22 nt, Human
auauuaaaacuaugguuuucag

SEQ ID NO: 290317 - RNA, 22 nt, Human
gcuagaaaaugaaagauaauuu

SEQ ID NO: 290318 - RNA, 22 nt, Human
aacaagauguuuugauauaugu

SEQ ID NO: 290319 - RNA, 18 nt, Human
uccugcagcuucuaugua

SEQ ID NO: 290320 - RNA, 15 nt, Human
uacauucauuuccac

SEQ ID NO: 290321 - RNA, 22 nt, Human
aggggaauggguagacuguuga

SEQ ID NO: 290322 - RNA, 22 nt, Human
uuuuauugucucccaguucugg

SEQ ID NO: 290323 - RNA, 22 nt, Human
ugucuucaucucagacacaguu

SEQ ID NO: 290324 - RNA, 21 nt, Human
cccuugccugcacuccucggc

SEQ ID NO: 290325 - RNA, 21 nt, Human
agcaggugaaccuccaguaca

SEQ ID NO: 290326 - RNA, 22 nt, Human
ccacaggcugcugcaggucccg

SEQ ID NO: 290327 - RNA, 22 nt, Human
cagcaugagaaaaugaaucaga

SEQ ID NO: 290328 - RNA, 22 nt, Human
ccuccugggacaggcuggcaca

SEQ ID NO: 290329 - RNA, 22 nt, Human
uuuuuauacuuugcucaagauu

SEQ ID NO: 290330 - RNA, 22 nt, Human
agcagguguuagggauccaaug

SEQ ID NO: 290331 - RNA, 22 nt, Human
augcuuuuaugucacaugguca

SEQ ID NO: 290332 - RNA, 22 nt, Human
caguucuuauuuggccaguguc

SEQ ID NO: 290333 - RNA, 22 nt, Human
aaacagcuaauggccaggaaua

SEQ ID NO: 290334 - RNA, 22 nt, Human
uuacacaacaucuguauuauua

SEQ ID NO: 290335 - RNA, 22 nt, Human
cuccuggcucugccacuuacua

SEQ ID NO: 290336 - RNA, 22 nt, Human
gggagggaggugcugguucacg

SEQ ID NO: 290337 - RNA, 22 nt, Human
uacauguggagauaacugaagc

SEQ ID NO: 290338 - RNA, 22 nt, Human
ucugacuuuucucacuguugug

SEQ ID NO: 290339 - RNA, 22 nt, Human
uggcagguuucguuaaaaaugg

SEQ ID NO: 290340 - RNA, 14 nt, Human
gcagguggaucacu

SEQ ID NO: 290341 - RNA, 22 nt, Human
gcuggaagaaugagugccucgu

SEQ ID NO: 290342 - RNA, 22 nt, Human
agcugugggccugggagagcug

SEQ ID NO: 290343 - RNA, 22 nt, Human
acaggcagcacuaaucucuggu

SEQ ID NO: 290344 - RNA, 22 nt, Human
aagggcucugggcuacgcacug

SEQ ID NO: 290345 - RNA, 22 nt, Human
auaugagaauuggaaaauauca

SEQ ID NO: 290346 - RNA, 22 nt, Human
agcaaacagugugcuaagaaau

SEQ ID NO: 290347 - RNA, 22 nt, Human
gcuggcuugauaguuucugcuu

SEQ ID NO: 290348 - RNA, 22 nt, Human
gaggccuggugcuguguccaca

SEQ ID NO: 290349 - RNA, 19 nt, Human
aaaaacuuaguccagaaag

SEQ ID NO: 290350 - RNA, 22 nt, Human
uccuucuccuccuugagugaca

SEQ ID NO: 290351 - RNA, 22 nt, Human
uuacauguggugugaagaagag

SEQ ID NO: 290352 - RNA, 22 nt, Human
acaugugucuaagaaugaaaga

SEQ ID NO: 290353 - RNA, 22 nt, Human
uuauguuuuaaguguguaucuu

SEQ ID NO: 290354 - RNA, 22 nt, Human
cagaucaagcuguauggucaga

SEQ ID NO: 290355 - RNA, 22 nt, Human
uuucacauuagauaugucauuu

SEQ ID NO: 290356 - RNA, 19 nt, Human
agguccucaggaugacccu

SEQ ID NO: 290357 - RNA, 22 nt, Human
aacuguuuggaacucuuccaca

SEQ ID NO: 290358 - RNA, 22 nt, Human
uuauuuguaaagguccauagua

SEQ ID NO: 290359 - RNA, 22 nt, Human
cacugucuugauuacuaugggu

SEQ ID NO: 290360 - RNA, 22 nt, Human
uauuuuagguaauauccauugu

SEQ ID NO: 290361 - RNA, 21 nt, Human
uuuaaagaauaggaagggagg

SEQ ID NO: 290362 - RNA, 22 nt, Human
acugugagugauuuccuucugg

SEQ ID NO: 290363 - RNA, 22 nt, Human
guagccauuggcaaugaagccu

SEQ ID NO: 290364 - RNA, 22 nt, Human
uuaugcaacaggugagcagaca

SEQ ID NO: 290365 - RNA, 22 nt, Human
ugacauuugagcauacauguaa

SEQ ID NO: 290366 - RNA, 22 nt, Human
uuuaauuugaaaugaguaaccc

SEQ ID NO: 290367 - RNA, 22 nt, Human
ugguuccaaucgcacuggcuca

SEQ ID NO: 290368 - RNA, 22 nt, Human
guguguccucaguaguggcaug

SEQ ID NO: 290369 - RNA, 19 nt, Human
gcuccugggccucacucau

SEQ ID NO: 290370 - RNA, 22 nt, Human
acagugcacauccugagugauu

SEQ ID NO: 290371 - RNA, 17 nt, Human
cauuuguugaucaguug

SEQ ID NO: 290372 - RNA, 22 nt, Human
ucaguguccuucguucuuguug

SEQ ID NO: 290373 - RNA, 22 nt, Human
uuauucuuuaaacauauauguu

SEQ ID NO: 290374 - RNA, 22 nt, Human
aggucagcccucucugggcagg

SEQ ID NO: 290375 - RNA, 22 nt, Human
gcccaggcuggagugcaguagc

SEQ ID NO: 290376 - RNA, 19 nt, Human
agcagguggguaagaaaau

SEQ ID NO: 290377 - RNA, 17 nt, Human
uuugauagaaucagagu

SEQ ID NO: 290378 - RNA, 22 nt, Human
ugucaguucagugauuacaaaa

SEQ ID NO: 290379 - RNA, 22 nt, Human
gguguccuugcagaaggcggcg

SEQ ID NO: 290380 - RNA, 22 nt, Human
uuaguacagaaucaaaagcaau

SEQ ID NO: 290381 - RNA, 22 nt, Human
gcaggugucuucauggaacucu

SEQ ID NO: 290382 - RNA, 22 nt, Human
cucuggaauugaccugggaggg

SEQ ID NO: 290383 - RNA, 22 nt, Human
guggacagcuucuaggugccag

SEQ ID NO: 290384 - RNA, 22 nt, Human
gccuguuuaaguauucugacau

SEQ ID NO: 290385 - RNA, 22 nt, Human
agacaucagcuugugugcaggg

SEQ ID NO: 290386 - RNA, 22 nt, Human
gagggcucugucuggaagggaa

SEQ ID NO: 290387 - RNA, 22 nt, Human
uuugacucuugucucuuguuag

SEQ ID NO: 290388 - RNA, 21 nt, Human
ucaugcaggcagaguuuggua

SEQ ID NO: 290389 - RNA, 22 nt, Human
ucuauuuuauacucaaaucuuc

SEQ ID NO: 290390 - RNA, 22 nt, Human
auuuauugagagggaggggaau

SEQ ID NO: 290391 - RNA, 22 nt, Human
agccauccuacuaccucagcau

SEQ ID NO: 290392 - RNA, 17 nt, Human
ucagggaaugagguugu

SEQ ID NO: 290393 - RNA, 22 nt, Human
uuugagguuagcuagcagauca

SEQ ID NO: 290394 - RNA, 22 nt, Human
cuuuucucugcgggucuuucau

SEQ ID NO: 290395 - RNA, 20 nt, Human
ucacaauaugagcucauaca

SEQ ID NO: 290396 - RNA, 22 nt, Human
uucugauugcugaugaggccca

SEQ ID NO: 290397 - RNA, 22 nt, Human
uuugaacagggaauguuccaca

SEQ ID NO: 290398 - RNA, 22 nt, Human
uucauucuugucuuuguauagu

SEQ ID NO: 290399 - RNA, 22 nt, Human
uuauacacguuuauggagcuac

SEQ ID NO: 290400 - RNA, 22 nt, Human
gaguccuuuucucuguccacug

SEQ ID NO: 290401 - RNA, 22 nt, Human
gccugcagggugaugggcugcc

SEQ ID NO: 290402 - RNA, 22 nt, Human
ucauuucucugagucugauaau

SEQ ID NO: 290403 - RNA, 22 nt, Human
caacaccuugaucuuggacuuc

SEQ ID NO: 290404 - RNA, 22 nt, Human
aggcagguguuaacccucugag

SEQ ID NO: 290405 - RNA, 22 nt, Human
ugacccauuugcuuuuccugua

SEQ ID NO: 290406 - RNA, 19 nt, Human
acagcagguguggggauaa

SEQ ID NO: 290407 - RNA, 22 nt, Human
ugaccuuucuuugagauuccug

SEQ ID NO: 290408 - RNA, 22 nt, Human
cauuaauaaacauuucagaaga

SEQ ID NO: 290409 - RNA, 22 nt, Human
aguuuucuguucuacaauuuga

SEQ ID NO: 290410 - RNA, 22 nt, Human
ucugaaauguucucuuguuuug

SEQ ID NO: 290411 - RNA, 22 nt, Human
auuuacaggacagcuuggcauu

SEQ ID NO: 290412 - RNA, 22 nt, Human
ccugugcccucagccuggcucu

SEQ ID NO: 290413 - RNA, 22 nt, Human
aaagcugcaagcuccugaggaa

SEQ ID NO: 290414 - RNA, 22 nt, Human
gagucagaauuguauuuuaaac

SEQ ID NO: 290415 - RNA, 22 nt, Human
agcuaggagauuuugugaggcu

SEQ ID NO: 290416 - RNA, 22 nt, Human
ccagacaguuccuugagguuca

SEQ ID NO: 290417 - RNA, 21 nt, Human
cuguggacaggcuggggcaug

SEQ ID NO: 290418 - RNA, 22 nt, Human
cuugaaguugcaaaacauuaau

SEQ ID NO: 290419 - RNA, 22 nt, Human
cccagcuucugagggggccuug

SEQ ID NO: 290420 - RNA, 22 nt, Human
ugagcccuccaaacccaggauu

SEQ ID NO: 290421 - RNA, 17 nt, Human
gcauccaguaacaugcc

SEQ ID NO: 290422 - RNA, 22 nt, Human
ucagcuuuccugcagcuaaggg

SEQ ID NO: 290423 - RNA, 21 nt, Human
uucuucuuggacuguuuuggc

SEQ ID NO: 290424 - RNA, 22 nt, Human
aagcacaggagacgcacagcca

SEQ ID NO: 290425 - RNA, 22 nt, Human
agcugcaaguaagcuugcuccu

SEQ ID NO: 290426 - RNA, 22 nt, Human
gcagggacaaggcagguguucu

SEQ ID NO: 290427 - RNA, 22 nt, Human
cugagcccuugaacccaagucc

SEQ ID NO: 290428 - RNA, 22 nt, Human
caggcucagcucuggccagugc

SEQ ID NO: 290429 - RNA, 22 nt, Human
cugccugcuucugagccagagg

SEQ ID NO: 290430 - RNA, 22 nt, Human
cagacagaccugcaagggcaca

SEQ ID NO: 290431 - RNA, 18 nt, Human
agcuccuggucucaggga

SEQ ID NO: 290432 - RNA, 22 nt, Human
gcugucuugaugauuggaugcu

SEQ ID NO: 290433 - RNA, 22 nt, Human
ugcugggugguugcuccucccg

SEQ ID NO: 290434 - RNA, 22 nt, Human
uccuggccgccgcguggggccg

SEQ ID NO: 290435 - RNA, 22 nt, Human
ggcuuuauaggguagaggauca

SEQ ID NO: 290436 - RNA, 22 nt, Human
uuccuuucccucacagccucgg

SEQ ID NO: 290437 - RNA, 22 nt, Human
cggcaggugugcucacucugcc

SEQ ID NO: 290438 - RNA, 22 nt, Human
auuucagaugaccaaauggaaa

SEQ ID NO: 290439 - RNA, 22 nt, Human
cacaggcuuuuuuggcugaugu

SEQ ID NO: 290440 - RNA, 18 nt, Human
gccucuguugcuugccug

SEQ ID NO: 290441 - RNA, 22 nt, Human
cuucuuuagggaucucuugcug

SEQ ID NO: 290442 - RNA, 22 nt, Human
ggaccugcucucccaguucucu

SEQ ID NO: 290443 - RNA, 22 nt, Human
aguggcaguagaugagcugguu

SEQ ID NO: 290444 - RNA, 22 nt, Human
gccuccuggccuuugcuccuca

SEQ ID NO: 290445 - RNA, 22 nt, Human
caugugucaaaugauguagcug

SEQ ID NO: 290446 - RNA, 22 nt, Human
gcagacaggcccaguggaggga

SEQ ID NO: 290447 - RNA, 22 nt, Human
gcugcgccggaucccacguucc

SEQ ID NO: 290448 - RNA, 22 nt, Human
ccagagcccagggucaugcagg

SEQ ID NO: 290449 - RNA, 22 nt, Human
agcuggucuuaaauguguccag

SEQ ID NO: 290450 - RNA, 22 nt, Human
caaggcauuucgcuuagagaga

SEQ ID NO: 290451 - RNA, 22 nt, Human
gauuuuuauauaaagugagaaa

SEQ ID NO: 290452 - RNA, 22 nt, Human
agaucauagcacaaaagugaca

SEQ ID NO: 290453 - RNA, 22 nt, Human
ccugaagaaaauuccacgagaa

SEQ ID NO: 290454 - RNA, 22 nt, Human
augaaaaguucgaucuagaagg

SEQ ID NO: 290455 - RNA, 22 nt, Human
ggcuguggucauuaggagguug

SEQ ID NO: 290456 - RNA, 22 nt, Human
gauucuuacuucuaagcaagcu

SEQ ID NO: 290457 - RNA, 22 nt, Human
ucccuagucgcaucuguggaga

SEQ ID NO: 290458 - RNA, 21 nt, Human
agagucugagugugcaagggc

SEQ ID NO: 290459 - RNA, 20 nt, Human
gauguguccucagcaguggu

SEQ ID NO: 290460 - RNA, 22 nt, Human
auauuaaugagcaaguaaguga

SEQ ID NO: 290461 - RNA, 22 nt, Human
ccagggcacuuaggcccagccc

SEQ ID NO: 290462 - RNA, 22 nt, Human
uauuuugcaaaccugaguuuga

SEQ ID NO: 290463 - RNA, 22 nt, Human
auccuucuaagagggacguaug

SEQ ID NO: 290464 - RNA, 22 nt, Human
aacuuaaacccacucauguaga

SEQ ID NO: 290465 - RNA, 22 nt, Human
gcgcacugggcgcacgcguagg

SEQ ID NO: 290466 - RNA, 22 nt, Human
cagauaugauaggauuagcaca

SEQ ID NO: 290467 - RNA, 22 nt, Human
acauuuaaguuaaaaccucagu

SEQ ID NO: 290468 - RNA, 22 nt, Human
cacauuccuuacauucauagag

SEQ ID NO: 290469 - RNA, 22 nt, Human
agcacagaguugcagagagcgu

SEQ ID NO: 290470 - RNA, 22 nt, Human
ccugugccuuccuuaggcaccu

SEQ ID NO: 290471 - RNA, 22 nt, Human
auuaaauuuucacuaggcuccc

SEQ ID NO: 290472 - RNA, 22 nt, Human
cugggugaauuugaaggaaagg

SEQ ID NO: 290473 - RNA, 22 nt, Human
uucugcuuucaguucuucuggg

SEQ ID NO: 290474 - RNA, 22 nt, Human
augguacaauuuucauuugugg

SEQ ID NO: 290475 - RNA, 22 nt, Human
auuuccauacacccauuucuga

SEQ ID NO: 290476 - RNA, 22 nt, Human
ccaaggagcugcaggcacuugu

SEQ ID NO: 290477 - RNA, 22 nt, Human
ucuucuggaucgaucacauugu

SEQ ID NO: 290478 - RNA, 22 nt, Human
ggaccugcccuggcucagaugc

SEQ ID NO: 290479 - RNA, 21 nt, Human
augauucugcaaaugaguagu

SEQ ID NO: 290480 - RNA, 22 nt, Human
agaggagguggugaugcuuuaa

SEQ ID NO: 290481 - RNA, 22 nt, Human
auuagauacacagauuuccacu

SEQ ID NO: 290482 - RNA, 21 nt, Human
uccugccuuaguccagagcag

SEQ ID NO: 290483 - RNA, 22 nt, Human
acuaaagaugucuaaauauauu

SEQ ID NO: 290484 - RNA, 22 nt, Human
cagguuggggacuuaggaugac

SEQ ID NO: 290485 - RNA, 21 nt, Human
uggaggaauaaagcacagaag

SEQ ID NO: 290486 - RNA, 22 nt, Human
uaguuuaauggucaacuaauga

SEQ ID NO: 290487 - RNA, 22 nt, Human
uauucccugauguacacuggca

SEQ ID NO: 290488 - RNA, 22 nt, Human
guguauguucuacuuaauauua

SEQ ID NO: 290489 - RNA, 22 nt, Human
gcauagucaguaggauucucaa

SEQ ID NO: 290490 - RNA, 22 nt, Human
acauguaacauauauguagcau

SEQ ID NO: 290491 - RNA, 22 nt, Human
uguauacauuuaacuagauaga

SEQ ID NO: 290492 - RNA, 22 nt, Human
uccuggcugucacucggguuga

SEQ ID NO: 290493 - RNA, 22 nt, Human
auucuuuaguuggcuucuugcc

SEQ ID NO: 290494 - RNA, 22 nt, Human
agcagcaauaauaaaguaauac

SEQ ID NO: 290495 - RNA, 22 nt, Human
cugaggagucagcuuacucacu

SEQ ID NO: 290496 - RNA, 22 nt, Human
uguaugcacauauauagguaca

SEQ ID NO: 290497 - RNA, 22 nt, Human
cacugucugagcuggugauuag

SEQ ID NO: 290498 - RNA, 22 nt, Human
cuggcagggugggcuuugcuuu

SEQ ID NO: 290499 - RNA, 22 nt, Human
aaaguguuuugauuuaguggua

SEQ ID NO: 290500 - RNA, 22 nt, Human
aggcaaagaggauauuuugggg

SEQ ID NO: 290501 - RNA, 22 nt, Human
uucuccauuuaacuuccuuaug

SEQ ID NO: 290502 - RNA, 22 nt, Human
ugccagccagggaagcucaccc

SEQ ID NO: 290503 - RNA, 22 nt, Human
ucauguguguuucauguaugga

SEQ ID NO: 290504 - RNA, 22 nt, Human
ggacacaaaagugaauaaaaua

SEQ ID NO: 290505 - RNA, 22 nt, Human
agccacugugugaccagcuguc

SEQ ID NO: 290506 - RNA, 22 nt, Human
uguuucauuaguacugacaaua

SEQ ID NO: 290507 - RNA, 22 nt, Human
ggcuuucucacagcauggcagc

SEQ ID NO: 290508 - RNA, 22 nt, Human
acagagagaaacaaucagcagc

SEQ ID NO: 290509 - RNA, 21 nt, Human
uaagugcaaagagacagauac

SEQ ID NO: 290510 - RNA, 22 nt, Human
ugacauuuuaucaauaucacag

SEQ ID NO: 290511 - RNA, 22 nt, Human
uauuuauuggacaguguugcug

SEQ ID NO: 290512 - RNA, 22 nt, Human
ugcagggccagacuggguugga

SEQ ID NO: 290513 - RNA, 22 nt, Human
ugauuucuuccuugucauuaga

SEQ ID NO: 290514 - RNA, 22 nt, Human
gcuggcaggagccuuucccuuu

SEQ ID NO: 290515 - RNA, 22 nt, Human
caaaaaacacagaugucugugu

SEQ ID NO: 290516 - RNA, 23 nt, Human
aaauauucuuuuuuaguaagugc

SEQ ID NO: 290517 - RNA, 22 nt, Human
uggcagggccugaaucuuauac

SEQ ID NO: 290518 - RNA, 22 nt, Human
uucuaagaaauggaaaacgauu

SEQ ID NO: 290519 - RNA, 22 nt, Human
gaacuguaguuaauacuacaca

SEQ ID NO: 290520 - RNA, 22 nt, Human
uuuaacauguucaagaaacaua

SEQ ID NO: 290521 - RNA, 22 nt, Human
uccuggccucugagucaagaac

SEQ ID NO: 290522 - RNA, 22 nt, Human
aggauucagaauguaugcagug

SEQ ID NO: 290523 - RNA, 22 nt, Human
gugagcauauauguaaucguuu

SEQ ID NO: 290524 - RNA, 22 nt, Human
gcaaagaaaugucagugagagg

SEQ ID NO: 290525 - RNA, 22 nt, Human
ugggcagggucucuguuaucag

SEQ ID NO: 290526 - RNA, 22 nt, Human
uugcaaguuccuuaugagaauc

SEQ ID NO: 290527 - RNA, 22 nt, Human
auuuccaggagaaaggauuuua

SEQ ID NO: 290528 - RNA, 19 nt, Human
ucucucuguacauuagaua

SEQ ID NO: 290529 - RNA, 22 nt, Human
acuguguggaccacucugaggc

SEQ ID NO: 290530 - RNA, 22 nt, Human
guuaaauucgaugauggauaaa

SEQ ID NO: 290531 - RNA, 22 nt, Human
ccuuuggucuugaugaacuguu

SEQ ID NO: 290532 - RNA, 22 nt, Human
agcuguggggcaggcagcgagg

SEQ ID NO: 290533 - RNA, 22 nt, Human
uugaauucauuucucauugagu

SEQ ID NO: 290534 - RNA, 22 nt, Human
auuuuguuauaggagcugaaau

SEQ ID NO: 290535 - RNA, 22 nt, Human
gaaauuauugcuagagacugca

SEQ ID NO: 290536 - RNA, 22 nt, Human
gauuucuaguaagucaugaagg

SEQ ID NO: 290537 - RNA, 22 nt, Human
uccuccuuguucuuuugccuac

SEQ ID NO: 290538 - RNA, 22 nt, Human
ucuccuggcccugucgccaucu

SEQ ID NO: 290539 - RNA, 22 nt, Human
ugcacaggaggcuguggagaag

SEQ ID NO: 290540 - RNA, 22 nt, Human
auuucucagugaaaugacaggc

SEQ ID NO: 290541 - RNA, 22 nt, Human
acaugacaaaaugcacaggauu

SEQ ID NO: 290542 - RNA, 22 nt, Human
uucuuucuguccauaaugagac

SEQ ID NO: 290543 - RNA, 22 nt, Human
uugcuaauaaaguuuuuaugug

SEQ ID NO: 290544 - RNA, 22 nt, Human
aguggggccgcgguccugcccu

SEQ ID NO: 290545 - RNA, 22 nt, Human
gugcccaggugucccugagaag

SEQ ID NO: 290546 - RNA, 22 nt, Human
uuuauuagauuaucaaagaggu

SEQ ID NO: 290547 - RNA, 22 nt, Human
cauuuucaugaguuucuguuca

SEQ ID NO: 290548 - RNA, 22 nt, Human
ccuuccuuucagggcuaugccu

SEQ ID NO: 290549 - RNA, 22 nt, Human
uuggaggaagcucaugggggau

SEQ ID NO: 290550 - RNA, 22 nt, Human
uuucaguuuaugucuugaauua

SEQ ID NO: 290551 - RNA, 22 nt, Human
agagccuugaagaucuggaaaa

SEQ ID NO: 290552 - RNA, 22 nt, Human
cucaggagacaguguccacaug

SEQ ID NO: 290553 - RNA, 22 nt, Human
uuccaggaccaggaagagggga

SEQ ID NO: 290554 - RNA, 22 nt, Human
uuguguccuauaugcauguucu

SEQ ID NO: 290555 - RNA, 22 nt, Human
acauuucuucccuuuagcagaa

SEQ ID NO: 290556 - RNA, 22 nt, Human
gacugugggcuccuugagggca

SEQ ID NO: 290557 - RNA, 22 nt, Human
gcauccagagguagccacugug

SEQ ID NO: 290558 - RNA, 22 nt, Human
cuguugcuaaguagugcaggua

SEQ ID NO: 290559 - RNA, 22 nt, Human
uuacauucaauuucuagaggua

SEQ ID NO: 290560 - RNA, 22 nt, Human
ucagggcaaugucccucagaag

SEQ ID NO: 290561 - RNA, 22 nt, Human
aacaggcaggagaauucugccu

SEQ ID NO: 290562 - RNA, 22 nt, Human
ccuucucccucugagaggaacc

SEQ ID NO: 290563 - RNA, 22 nt, Human
ggaaucagaugaggggcagagc

SEQ ID NO: 290564 - RNA, 22 nt, Human
uucaugugaauauauuugucuu

SEQ ID NO: 290565 - RNA, 22 nt, Human
ggccuugauccuccagagcacu

SEQ ID NO: 290566 - RNA, 23 nt, Human
agauuguuauucccaguucaugu

SEQ ID NO: 290567 - RNA, 22 nt, Human
uccaggcaugucccaagccgga

SEQ ID NO: 290568 - RNA, 22 nt, Human
cagcugucagccggugcaggcu

SEQ ID NO: 290569 - RNA, 22 nt, Human
ucuggaugggaugaggcaacaa

SEQ ID NO: 290570 - RNA, 22 nt, Human
acauuaaacuugcuuggcugua

SEQ ID NO: 290571 - RNA, 22 nt, Human
uuucuuuccauacauauugcua

SEQ ID NO: 290572 - RNA, 22 nt, Human
agggcagcuaaggugcugacug

SEQ ID NO: 290573 - RNA, 20 nt, Human
uucacauuucuguagugauu

SEQ ID NO: 290574 - RNA, 22 nt, Human
uggaauguaaaccucagguggg

SEQ ID NO: 290575 - RNA, 22 nt, Human
gcaaggagacuguagggccaag

SEQ ID NO: 290576 - RNA, 22 nt, Human
uuucacauucuucugaaucuac

SEQ ID NO: 290577 - RNA, 22 nt, Human
uuuguucaugccuauauucuca

SEQ ID NO: 290578 - RNA, 22 nt, Human
uaggaggcauuugcucccaggg

SEQ ID NO: 290579 - RNA, 22 nt, Human
uacauguaauuuucauaguaag

SEQ ID NO: 290580 - RNA, 22 nt, Human
uugugucccuggagcuucugug

SEQ ID NO: 290581 - RNA, 22 nt, Human
uacagguaaaauuaucagaaac

SEQ ID NO: 290582 - RNA, 22 nt, Human
acaggugugcggaaagcuguga

SEQ ID NO: 290583 - RNA, 22 nt, Human
caggagucccucuggccagcau

SEQ ID NO: 290584 - RNA, 22 nt, Human
ugcaggugcuacaagaacucac

SEQ ID NO: 290585 - RNA, 22 nt, Human
ggaaucagaauuacugaaugga

SEQ ID NO: 290586 - RNA, 22 nt, Human
cauguaaaaaauuaggucaucu

SEQ ID NO: 290587 - RNA, 22 nt, Human
aauucccaccuucucucuuuug

SEQ ID NO: 290588 - RNA, 22 nt, Human
agcacccuucagcccagccugg

SEQ ID NO: 290589 - RNA, 22 nt, Human
uguucugagugcagcuuaauaa

SEQ ID NO: 290590 - RNA, 22 nt, Human
uggcaggucaugaguggccacc

SEQ ID NO: 290591 - RNA, 22 nt, Human
gagguggucgaggagggguacc

SEQ ID NO: 290592 - RNA, 22 nt, Human
ugcaggcuccaugaggacaggc

SEQ ID NO: 290593 - RNA, 22 nt, Human
ggcagguguggugaccagagau

SEQ ID NO: 290594 - RNA, 22 nt, Human
uucuucaguuugguaaauguaa

SEQ ID NO: 290595 - RNA, 22 nt, Human
aaugugucauuucccacaggug

SEQ ID NO: 290596 - RNA, 22 nt, Human
acauucuuauaagagugaggca

SEQ ID NO: 290597 - RNA, 22 nt, Human
cccagcagugacccagugauac

SEQ ID NO: 290598 - RNA, 22 nt, Human
aacaguaacgagauguccuaac

SEQ ID NO: 290599 - RNA, 22 nt, Human
cagagugaaaacugagcucaaa

SEQ ID NO: 290600 - RNA, 23 nt, Human
uuucuguuccucuagcuuugcau

SEQ ID NO: 290601 - RNA, 23 nt, Human
uggaggcaggaugcuaaggaguc

SEQ ID NO: 290602 - RNA, 20 nt, Human
uggucuggagccagugagga

SEQ ID NO: 290603 - RNA, 22 nt, Human
uuucaaaagcguacguagugaa

SEQ ID NO: 290604 - RNA, 22 nt, Human
aaagagucaaaggcaugucucu

SEQ ID NO: 290605 - RNA, 22 nt, Human
uacugucuggcaauuaagaauc

SEQ ID NO: 290606 - RNA, 22 nt, Human
cagcaugauuggugucugguga

SEQ ID NO: 290607 - RNA, 22 nt, Human
uuccaggcugaugggccacagg

SEQ ID NO: 290608 - RNA, 22 nt, Human
cuuccuggcaugggucucauga

SEQ ID NO: 290609 - RNA, 22 nt, Human
augucuuuuauggagaugucau

SEQ ID NO: 290610 - RNA, 22 nt, Human
ugcuggguguuccgcacuugac

SEQ ID NO: 290611 - RNA, 22 nt, Human
agggaccucuucuugcagcuga

SEQ ID NO: 290612 - RNA, 22 nt, Human
gcaggcaguugcaguuuucuag

SEQ ID NO: 290613 - RNA, 22 nt, Human
ucccagagaaagucaaggucuu

SEQ ID NO: 290614 - RNA, 22 nt, Human
aagaguaaaugucuaauuagga

SEQ ID NO: 290615 - RNA, 17 nt, Human
ggaacaaauacuaugca

SEQ ID NO: 290616 - RNA, 22 nt, Human
uugggaagaauggaggugguua

SEQ ID NO: 290617 - RNA, 22 nt, Human
uuuccuuugcccaauacauguc

SEQ ID NO: 290618 - RNA, 22 nt, Human
agcagacauggcuuggaugugg

SEQ ID NO: 290619 - RNA, 22 nt, Human
uagucagugcacagacacuugu

SEQ ID NO: 290620 - RNA, 22 nt, Human
aaagaaauagauggcauuuaaa

SEQ ID NO: 290621 - RNA, 22 nt, Human
acagacaugggccgcucuugag

SEQ ID NO: 290622 - RNA, 23 nt, Human
gggcagguuuuuauaggcuucag

SEQ ID NO: 290623 - RNA, 22 nt, Human
cuauuacauuucuggacauuca

SEQ ID NO: 290624 - RNA, 22 nt, Human
ggaaggaagugcagacuuuaaa

SEQ ID NO: 290625 - RNA, 22 nt, Human
aaaguuuuauucaagcauuagu

SEQ ID NO: 290626 - RNA, 22 nt, Human
caaaugaauauuuccauggguu

SEQ ID NO: 290627 - RNA, 22 nt, Human
caacuuuaauuugggugucaga

SEQ ID NO: 290628 - RNA, 22 nt, Human
agacaucauguuacagauuaag

SEQ ID NO: 290629 - RNA, 22 nt, Human
ucccaccccggucaagggcuga

SEQ ID NO: 290630 - RNA, 22 nt, Human
gugcagggcagguguccuucca

SEQ ID NO: 290631 - RNA, 22 nt, Human
acccagggcuuaaggcggugca

SEQ ID NO: 290632 - RNA, 22 nt, Human
cuccuggacauggagcggagga

SEQ ID NO: 290633 - RNA, 22 nt, Human
gcaguggcaugaugugggcuca

SEQ ID NO: 290634 - RNA, 22 nt, Human
gaaagcugugaaauagugcucu

SEQ ID NO: 290635 - RNA, 22 nt, Human
cagagcauuuggaagccacgug

SEQ ID NO: 290636 - RNA, 22 nt, Human
aaagcugcccagcugccuguuu

SEQ ID NO: 290637 - RNA, 20 nt, Human
uggccucugagaugccacgg

SEQ ID NO: 290638 - RNA, 17 nt, Human
gugaagagucauugaau

SEQ ID NO: 290639 - RNA, 19 nt, Human
cugcagggaugugcagagu

SEQ ID NO: 290640 - RNA, 22 nt, Human
uuucaugaggggcaaaaucuca

SEQ ID NO: 290641 - RNA, 22 nt, Human
gaggugguucagguagagccca

SEQ ID NO: 290642 - RNA, 22 nt, Human
ggucacuggucucugcuuccau

SEQ ID NO: 290643 - RNA, 22 nt, Human
uucuucaaugugcccuguuuuc

SEQ ID NO: 290644 - RNA, 22 nt, Human
cuguggcccugugaucuggcac

SEQ ID NO: 290645 - RNA, 22 nt, Human
uuaauaauaaugagcccauuuu

SEQ ID NO: 290646 - RNA, 22 nt, Human
augaaacaguguguauagcaaa

SEQ ID NO: 290647 - RNA, 21 nt, Human
uuccuggggacuuccguggga

SEQ ID NO: 290648 - RNA, 22 nt, Human
gcaguagugucaguacagcaaa

SEQ ID NO: 290649 - RNA, 22 nt, Human
aaggcauauauucuaaacagga

SEQ ID NO: 290650 - RNA, 22 nt, Human
gccuggcaggccuguuggggcu

SEQ ID NO: 290651 - RNA, 22 nt, Human
gcaggcagguggcaucuuguga

SEQ ID NO: 290652 - RNA, 22 nt, Human
ucuguucuugcuuuucuccaac

SEQ ID NO: 290653 - RNA, 18 nt, Human
aauuuccauaugaauugc

SEQ ID NO: 290654 - RNA, 22 nt, Human
uugaaugaggaagagcacuggc

SEQ ID NO: 290655 - RNA, 22 nt, Human
uuguaaaugaccuuuucuaauu

SEQ ID NO: 290656 - RNA, 22 nt, Human
uauuuguugcgggaauugcuau

SEQ ID NO: 290657 - RNA, 22 nt, Human
ucuggcuuggacacaaucuucc

SEQ ID NO: 290658 - RNA, 22 nt, Human
uuucaacaggaugauaauaggc

SEQ ID NO: 290659 - RNA, 22 nt, Human
uuuuuauaugaaggauagugcg

SEQ ID NO: 290660 - RNA, 22 nt, Human
uucuuuauguuaaugaaucuau

SEQ ID NO: 290661 - RNA, 22 nt, Human
ccagugucuagcagaugacagg

SEQ ID NO: 290662 - RNA, 22 nt, Human
acaacauucuuaaauacacuga

SEQ ID NO: 290663 - RNA, 22 nt, Human
acagugcauuauugcugaaugc

SEQ ID NO: 290664 - RNA, 22 nt, Human
cugugucccuugucccagagcc

SEQ ID NO: 290665 - RNA, 22 nt, Human
uuugacucuuagcccaggacuc

SEQ ID NO: 290666 - RNA, 22 nt, Human
ggcaggcauggccacucccuag

SEQ ID NO: 290667 - RNA, 22 nt, Human
cuugaagaaauggagacaggau

SEQ ID NO: 290668 - RNA, 22 nt, Human
cuacagaaacacuggacaugug

SEQ ID NO: 290669 - RNA, 22 nt, Human
ggcucugccucugacccucugg

SEQ ID NO: 290670 - RNA, 22 nt, Human
ugucaguuaaaugagguacaag

SEQ ID NO: 290671 - RNA, 22 nt, Human
uuaaacauuuauggaggcagca

SEQ ID NO: 290672 - RNA, 22 nt, Human
aagugauuucugccugcauguu

SEQ ID NO: 290673 - RNA, 22 nt, Human
ugaagaaacagaccaagaggau

SEQ ID NO: 290674 - RNA, 22 nt, Human
uugaggagguccuggguuuacu

SEQ ID NO: 290675 - RNA, 18 nt, Human
ccugaagccugugucuuu

SEQ ID NO: 290676 - RNA, 22 nt, Human
ugcuuuauucagucucugccau

SEQ ID NO: 290677 - RNA, 20 nt, Human
ucccaagggcugagaggauc

SEQ ID NO: 290678 - RNA, 22 nt, Human
acccaggccugagagacaggag

SEQ ID NO: 290679 - RNA, 22 nt, Human
uggcaaagaugguucucaccau

SEQ ID NO: 290680 - RNA, 22 nt, Human
caggaaauaucuccuggcagag

SEQ ID NO: 290681 - RNA, 22 nt, Human
aggaaaaaagucugugauuaua

SEQ ID NO: 290682 - RNA, 22 nt, Human
ucaaaugcugccuuugugugcc

SEQ ID NO: 290683 - RNA, 22 nt, Human
aagaguuuaugauauaacaugu

SEQ ID NO: 290684 - RNA, 20 nt, Human
agaggcuuccuugggaggag

SEQ ID NO: 290685 - RNA, 22 nt, Human
uauugcugccucguccaggcug

SEQ ID NO: 290686 - RNA, 22 nt, Human
cacgccagccggacacugggcc

SEQ ID NO: 290687 - RNA, 22 nt, Human
ucuccuggcauuugguugagua

SEQ ID NO: 290688 - RNA, 22 nt, Human
aaugucuuuaaagugcaauaga

SEQ ID NO: 290689 - RNA, 22 nt, Human
augucugcuuuccuuuuaauca

SEQ ID NO: 290690 - RNA, 22 nt, Human
uuuccuacugcccuauacacac

SEQ ID NO: 290691 - RNA, 22 nt, Human
agugaugugggagaguauagcu

SEQ ID NO: 290692 - RNA, 22 nt, Human
uucacauugugcagauuauggu

SEQ ID NO: 290693 - RNA, 22 nt, Human
ccucccuucaguagagcccaau

SEQ ID NO: 290694 - RNA, 22 nt, Human
uucuggcuucaucugacaagcc

SEQ ID NO: 290695 - RNA, 22 nt, Human
gugcccagcuccaccucacaga

SEQ ID NO: 290696 - RNA, 22 nt, Human
cucucuccuuagcugcagacca

SEQ ID NO: 290697 - RNA, 22 nt, Human
acaguuuaugccucugagccug

SEQ ID NO: 290698 - RNA, 22 nt, Human
acaggugugagaacaugccuug

SEQ ID NO: 290699 - RNA, 22 nt, Human
acugucuuugagcuggaggagg

SEQ ID NO: 290700 - RNA, 22 nt, Human
ucuccucaccaccagcagcaga

SEQ ID NO: 290701 - RNA, 21 nt, Human
uggcagguucaaaggccuauc

SEQ ID NO: 290702 - RNA, 23 nt, Human
uugcacauuggagcuggucuucu

SEQ ID NO: 290703 - RNA, 22 nt, Human
cuuacaaauacacuuaggagag

SEQ ID NO: 290704 - RNA, 22 nt, Human
gagacacacccaagguuaugag

SEQ ID NO: 290705 - RNA, 22 nt, Human
ucaguuaagacugcacuggacu

SEQ ID NO: 290706 - RNA, 22 nt, Human
agucaguuaaacuuuguaaagu

SEQ ID NO: 290707 - RNA, 22 nt, Human
gcugucuuggaaaaggcaaaga

SEQ ID NO: 290708 - RNA, 22 nt, Human
uucuuuucggccugugagaagg

SEQ ID NO: 290709 - RNA, 20 nt, Human
gaggcugcggacugcuggac

SEQ ID NO: 290710 - RNA, 22 nt, Human
cuacuucuaaguacauggugau

SEQ ID NO: 290711 - RNA, 22 nt, Human
gcuggccugggcagccugucgg

SEQ ID NO: 290712 - RNA, 22 nt, Human
cagaggcagaggucaucucugg

SEQ ID NO: 290713 - RNA, 22 nt, Human
agaaucaggaagacagccuggc

SEQ ID NO: 290714 - RNA, 22 nt, Human
accuguuuuagucuuuaaucau

SEQ ID NO: 290715 - RNA, 22 nt, Human
uugcuguagcucauuucacucu

SEQ ID NO: 290716 - RNA, 22 nt, Human
uuugguuuagggucauuuaaca

SEQ ID NO: 290717 - RNA, 22 nt, Human
ugauguuuaauacuaugcuuuu

SEQ ID NO: 290718 - RNA, 21 nt, Human
ccauaaucuuaggaucaaaau

SEQ ID NO: 290719 - RNA, 22 nt, Human
gugaccauccugguaaugaauc

SEQ ID NO: 290720 - RNA, 22 nt, Human
uacccagcuucaagucaggacu

SEQ ID NO: 290721 - RNA, 20 nt, Human
gagcaguggaguuuccaggg

SEQ ID NO: 290722 - RNA, 22 nt, Human
acaugccagcacugcuuuucag

SEQ ID NO: 290723 - RNA, 22 nt, Human
ucagacagaggagcucgugcag

SEQ ID NO: 290724 - RNA, 22 nt, Human
uggcacucacucucagagucug

SEQ ID NO: 290725 - RNA, 22 nt, Human
aggagugggggcgagaaguuaa

SEQ ID NO: 290726 - RNA, 22 nt, Human
uaaagcagccagggucuaagcc

SEQ ID NO: 290727 - RNA, 22 nt, Human
cacccagggcugugccugccca

SEQ ID NO: 290728 - RNA, 22 nt, Human
aaugucuucaguguauacaugg

SEQ ID NO: 290729 - RNA, 22 nt, Human
uucucuggauguuucucaguca

SEQ ID NO: 290730 - RNA, 22 nt, Human
uagcuuuaggaugguucucuug

SEQ ID NO: 290731 - RNA, 23 nt, Human
uaaugagaagcuuuguuuccuga

SEQ ID NO: 290732 - RNA, 22 nt, Human
acccagcaaagauaaacuuaug

SEQ ID NO: 290733 - RNA, 22 nt, Human
auucuucacaaauauauagaag

SEQ ID NO: 290734 - RNA, 22 nt, Human
cuguguccauguucuaauuugg

SEQ ID NO: 290735 - RNA, 22 nt, Human
uaauaucuacuucauagaguuu

SEQ ID NO: 290736 - RNA, 22 nt, Human
cauccagggcagccauggccug

SEQ ID NO: 290737 - RNA, 22 nt, Human
cauggaaagcacucagcccagu

SEQ ID NO: 290738 - RNA, 22 nt, Human
ggcacagcucaggucccagcuc

SEQ ID NO: 290739 - RNA, 22 nt, Human
caugcaugccgggcugacagag

SEQ ID NO: 290740 - RNA, 22 nt, Human
gcagggcagcuuagucccuguc

SEQ ID NO: 290741 - RNA, 16 nt, Human
cccaaggagcuccagg

SEQ ID NO: 290742 - RNA, 22 nt, Human
cagagcauuaaaaccagcucug

SEQ ID NO: 290743 - RNA, 22 nt, Human
aaaauucauggcuugggaaaag

SEQ ID NO: 290744 - RNA, 22 nt, Human
aguguccuagcaagccgguccu

SEQ ID NO: 290745 - RNA, 22 nt, Human
gggcagguauuuaucuucuauu

SEQ ID NO: 290746 - RNA, 22 nt, Human
aaugaguucugacacuucacga

SEQ ID NO: 290747 - RNA, 22 nt, Human
uagaaaagauaacauucugugc

SEQ ID NO: 290748 - RNA, 22 nt, Human
aguccugggugugcaaggcaga

SEQ ID NO: 290749 - RNA, 22 nt, Human
ucucaggaucuaauacauggua

SEQ ID NO: 290750 - RNA, 22 nt, Human
uucuacaauaugaauaaugaag

SEQ ID NO: 290751 - RNA, 22 nt, Human
aacuaaaacugguuuguucucu

SEQ ID NO: 290752 - RNA, 22 nt, Human
aaggugucaccagauuggcagg

SEQ ID NO: 290753 - RNA, 22 nt, Human
aagaauaagaggauuuagaaca

SEQ ID NO: 290754 - RNA, 22 nt, Human
uuuguuacauuaaaaaguaggu

SEQ ID NO: 290755 - RNA, 22 nt, Human
uccgccaggacugagggcccau

SEQ ID NO: 290756 - RNA, 22 nt, Human
aaaccuuugugugucugugccu

SEQ ID NO: 290757 - RNA, 22 nt, Human
uauacagucuuuugcuauauuc

SEQ ID NO: 290758 - RNA, 22 nt, Human
agaaggcagaaaguccagguau

SEQ ID NO: 290759 - RNA, 19 nt, Human
ugggcagguucaguaaugg

SEQ ID NO: 290760 - RNA, 22 nt, Human
uaugugucucaguugugauuga

SEQ ID NO: 290761 - RNA, 22 nt, Human
caaguccauccuacugccuucu

SEQ ID NO: 290762 - RNA, 22 nt, Human
aaauagcuacaugaucucuagg

SEQ ID NO: 290763 - RNA, 22 nt, Human
acacaugaaauaauauuaugca

SEQ ID NO: 290764 - RNA, 22 nt, Human
ucagagaggcaauacuguuuaa

SEQ ID NO: 290765 - RNA, 22 nt, Human
gcaggggaguccacucuaugca

SEQ ID NO: 290766 - RNA, 20 nt, Human
ugcagggcucugcuucucuc

SEQ ID NO: 290767 - RNA, 22 nt, Human
ccagccucacuggcaucaccua

SEQ ID NO: 290768 - RNA, 22 nt, Human
caaggaaguuuuaggagaggaa

SEQ ID NO: 290769 - RNA, 22 nt, Human
uguaaaguuacuuuugaaagga

SEQ ID NO: 290770 - RNA, 22 nt, Human
aauuuguuaaaagugagugaca

SEQ ID NO: 290771 - RNA, 22 nt, Human
aagggcaggagaagacggauau

SEQ ID NO: 290772 - RNA, 22 nt, Human
cugcgugucucugucucauggc

SEQ ID NO: 290773 - RNA, 17 nt, Human
gugcagggaugaaggau

SEQ ID NO: 290774 - RNA, 22 nt, Human
guuuuauaauugcuucauaaga

SEQ ID NO: 290775 - RNA, 22 nt, Human
agacagacaaaauuccugccug

SEQ ID NO: 290776 - RNA, 22 nt, Human
gccauugggcuguaguuuuuug

SEQ ID NO: 290777 - RNA, 22 nt, Human
aaauuucuaagcagccacuucc

SEQ ID NO: 290778 - RNA, 16 nt, Human
acagugucucaagcac

SEQ ID NO: 290779 - RNA, 22 nt, Human
cuggcagucugccucuucacug

SEQ ID NO: 290780 - RNA, 22 nt, Human
guggauuacaagacaguugaga

SEQ ID NO: 290781 - RNA, 22 nt, Human
cugagaucuuuauacgaggcac

SEQ ID NO: 290782 - RNA, 22 nt, Human
ucagugucuauagauaagguuu

SEQ ID NO: 290783 - RNA, 22 nt, Human
aaaguauucaaaaauauuuggu

SEQ ID NO: 290784 - RNA, 22 nt, Human
agcagggcucugccaugggccc

SEQ ID NO: 290785 - RNA, 22 nt, Human
cugaagagcaaaccaacuggac

SEQ ID NO: 290786 - RNA, 22 nt, Human
uacccaggaggaaacugaggcu

SEQ ID NO: 290787 - RNA, 22 nt, Human
uuucacaaaugucuuuaacuug

SEQ ID NO: 290788 - RNA, 22 nt, Human
caggaggcuccuagggcucugu

SEQ ID NO: 290789 - RNA, 22 nt, Human
ccagggccugagggcgacgccc

SEQ ID NO: 290790 - RNA, 22 nt, Human
uucacaaagcuggagcauuucc

SEQ ID NO: 290791 - RNA, 22 nt, Human
cauccaaacucucauuaucugu

SEQ ID NO: 290792 - RNA, 22 nt, Human
ucuuuggaguguuaucaguaau

SEQ ID NO: 290793 - RNA, 22 nt, Human
gucaggacucugacccgucccg

SEQ ID NO: 290794 - RNA, 22 nt, Human
uucuggaagcugcagguggccg

SEQ ID NO: 290795 - RNA, 22 nt, Human
uuggccaacauggugaaacccc

SEQ ID NO: 290796 - RNA, 22 nt, Human
aggacauguaaauggagaggga

SEQ ID NO: 290797 - RNA, 22 nt, Human
uguuucuugagaguauuacccu

SEQ ID NO: 290798 - RNA, 22 nt, Human
acagguggucuuugcuccuuuu

SEQ ID NO: 290799 - RNA, 22 nt, Human
agauuugcggcuuuacuuugca

SEQ ID NO: 290800 - RNA, 18 nt, Human
gacaaaaguacagacaga

SEQ ID NO: 290801 - RNA, 22 nt, Human
aaagcucuuauagcagagugug

SEQ ID NO: 290802 - RNA, 18 nt, Human
gacaggugggugagacca

SEQ ID NO: 290803 - RNA, 17 nt, Human
ccaggucuccuugcuuu

SEQ ID NO: 290804 - RNA, 22 nt, Human
ccugggaggcugugggucugcu

SEQ ID NO: 290805 - RNA, 22 nt, Human
aauguguuaguauugauuuguc

SEQ ID NO: 290806 - RNA, 22 nt, Human
gaggaggaaguucucuguaggc

SEQ ID NO: 290807 - RNA, 22 nt, Human
ucagguguauugaugucuguga

SEQ ID NO: 290808 - RNA, 23 nt, Human
uuuauuuauuuaggcugagggau

SEQ ID NO: 290809 - RNA, 22 nt, Human
uuauuaaaaugcggauuuggcu

SEQ ID NO: 290810 - RNA, 22 nt, Human
cagcaccuguuagcauuaaaua

SEQ ID NO: 290811 - RNA, 22 nt, Human
uuuuccaaaguaccaugucccu

SEQ ID NO: 290812 - RNA, 22 nt, Human
gccugaaggagucagagagggc

SEQ ID NO: 290813 - RNA, 22 nt, Human
aggccacaguacuuugcagacc

SEQ ID NO: 290814 - RNA, 22 nt, Human
agguuucugcacugucacuggu

SEQ ID NO: 290815 - RNA, 22 nt, Human
ucaaaugaggcugaugaaugug

SEQ ID NO: 290816 - RNA, 22 nt, Human
ucuguucagguuucagagaacu

SEQ ID NO: 290817 - RNA, 22 nt, Human
ugacaaagacaaagauaugucc

SEQ ID NO: 290818 - RNA, 22 nt, Human
auuaaauguuccuuaaauuaua

SEQ ID NO: 290819 - RNA, 22 nt, Human
gaaccauuucugaauaguuugu

SEQ ID NO: 290820 - RNA, 22 nt, Human
ccuggaggcucugggagggcag

SEQ ID NO: 290821 - RNA, 22 nt, Human
aguguuugggggccuuguaaca

SEQ ID NO: 290822 - RNA, 20 nt, Human
cuucuucauuaacccuacug

SEQ ID NO: 290823 - RNA, 22 nt, Human
aacaaugaggaucuguucugag

SEQ ID NO: 290824 - RNA, 22 nt, Human
gacuuuauaaaugagaggcgga

SEQ ID NO: 290825 - RNA, 22 nt, Human
gcagggcagugugucugugggg

SEQ ID NO: 290826 - RNA, 22 nt, Human
uaggccauucuuggagcuuacu

SEQ ID NO: 290827 - RNA, 22 nt, Human
aaaugucuguaggggcugcagg

SEQ ID NO: 290828 - RNA, 21 nt, Human
acccaggggaagcagaaacug

SEQ ID NO: 290829 - RNA, 22 nt, Human
cuguccuccggccaccuacagu

SEQ ID NO: 290830 - RNA, 22 nt, Human
ugaaaauuguuguacuugauaa

SEQ ID NO: 290831 - RNA, 19 nt, Human
uuugcugguucaggaaaga

SEQ ID NO: 290832 - RNA, 22 nt, Human
aauguauaaaguguuaauaacu

SEQ ID NO: 290833 - RNA, 22 nt, Human
caagugucuauaucagugcuug

SEQ ID NO: 290834 - RNA, 22 nt, Human
agugcauguaucuacagucaca

SEQ ID NO: 290835 - RNA, 22 nt, Human
aggcagcaauugaaaucauugu

SEQ ID NO: 290836 - RNA, 20 nt, Human
acaauauguagaugaauagc

SEQ ID NO: 290837 - RNA, 22 nt, Human
accauucugucucuuuacaaau

SEQ ID NO: 290838 - RNA, 22 nt, Human
ugagccagcaggccuccagugg

SEQ ID NO: 290839 - RNA, 22 nt, Human
uuguuucauggggauguuuauu

SEQ ID NO: 290840 - RNA, 22 nt, Human
acagugucaucaguuucucaac

SEQ ID NO: 290841 - RNA, 22 nt, Human
uuuaccaaauagauuaugucag

SEQ ID NO: 290842 - RNA, 22 nt, Human
aagggaugcaggaaagaagguu

SEQ ID NO: 290843 - RNA, 22 nt, Human
uuacaugcagagggaagggaga

SEQ ID NO: 290844 - RNA, 22 nt, Human
gaggccaacuuuggagaacagg

SEQ ID NO: 290845 - RNA, 22 nt, Human
aagauaaacucuugauuucuga

SEQ ID NO: 290846 - RNA, 22 nt, Human
uagggcucacugagaugaauau

SEQ ID NO: 290847 - RNA, 22 nt, Human
ucagggcucagcaucuggcauu

SEQ ID NO: 290848 - RNA, 22 nt, Human
gucaaauauacuaagagguaaa

SEQ ID NO: 290849 - RNA, 22 nt, Human
aguguuuaccccaaucaguuua

SEQ ID NO: 290850 - RNA, 22 nt, Human
ugcuauuuaacuuuuaugugua

SEQ ID NO: 290851 - RNA, 22 nt, Human
ucuccuggcaugugggucaucu

SEQ ID NO: 290852 - RNA, 22 nt, Human
agcaaagcaguggcuaagcuga

SEQ ID NO: 290853 - RNA, 22 nt, Human
guucuuuaggggcccaauuucc

SEQ ID NO: 290854 - RNA, 22 nt, Human
caugucugaguagagugugauu

SEQ ID NO: 290855 - RNA, 22 nt, Human
aaguccagcucuaaauaucuga

SEQ ID NO: 290856 - RNA, 19 nt, Human
uagaaugcccacuuaaaaa

SEQ ID NO: 290857 - RNA, 22 nt, Human
cgggguccgggcaguaggcugc

SEQ ID NO: 290858 - RNA, 23 nt, Human
auguuauuauuagcagucuugcc

SEQ ID NO: 290859 - RNA, 22 nt, Human
auugcugacaccaaguaguagc

SEQ ID NO: 290860 - RNA, 22 nt, Human
guccacccaugacaccugccug

SEQ ID NO: 290861 - RNA, 22 nt, Human
agagggaagaugguccaaucuu

SEQ ID NO: 290862 - RNA, 22 nt, Human
caccugcaaggagcuuucauuu

SEQ ID NO: 290863 - RNA, 22 nt, Human
uuggaggauaaggauauugauu

SEQ ID NO: 290864 - RNA, 22 nt, Human
uuuauuuauccuucuggauugc

SEQ ID NO: 290865 - RNA, 22 nt, Human
ccucccagugccuccagagcag

SEQ ID NO: 290866 - RNA, 22 nt, Human
accuucaagaaacauuuccuug

SEQ ID NO: 290867 - RNA, 22 nt, Human
cagaggcagacccuccagggcg

SEQ ID NO: 290868 - RNA, 22 nt, Human
augcacauaggccaaaucauuu

SEQ ID NO: 290869 - RNA, 22 nt, Human
uccugagcuuuacaguaaggac

SEQ ID NO: 290870 - RNA, 22 nt, Human
gaaugauuugguuguuuagauu

SEQ ID NO: 290871 - RNA, 22 nt, Human
agcuucuugggcuuuacacaaa

SEQ ID NO: 290872 - RNA, 20 nt, Human
agcuucuucugucuaauuuu

SEQ ID NO: 290873 - RNA, 22 nt, Human
uucuucuuuccaauuacauggu

SEQ ID NO: 290874 - RNA, 22 nt, Human
acagugugaugggccugccuga

SEQ ID NO: 290875 - RNA, 22 nt, Human
uuucuaguaaaagcuaauuacc

SEQ ID NO: 290876 - RNA, 22 nt, Human
ggggcagggagguuaucgccga

SEQ ID NO: 290877 - RNA, 22 nt, Human
accuucaauuauuuuuguucca

SEQ ID NO: 290878 - RNA, 22 nt, Human
ccagcuuuccaggguugacugg

SEQ ID NO: 290879 - RNA, 22 nt, Human
aggccccaaagcagugcaagua

SEQ ID NO: 290880 - RNA, 22 nt, Human
cuguaaaacacuguaguaucug

SEQ ID NO: 290881 - RNA, 22 nt, Human
cagaggaguucaguacacagcc

SEQ ID NO: 290882 - RNA, 22 nt, Human
uguagaaauuaguaagaucaac

SEQ ID NO: 290883 - RNA, 22 nt, Human
uuccuguguacguguuucgcug

SEQ ID NO: 290884 - RNA, 21 nt, Human
uuccuuuuuauggcuuagugg

SEQ ID NO: 290885 - RNA, 22 nt, Human
acacugucucauaugaggggac

SEQ ID NO: 290886 - RNA, 22 nt, Human
uggcagggaauacagauguuua

SEQ ID NO: 290887 - RNA, 22 nt, Human
aaggugucggguuagcucagcc

SEQ ID NO: 290888 - RNA, 22 nt, Human
agcagacauaucucaugucaca

SEQ ID NO: 290889 - RNA, 22 nt, Human
aaacaaguuuagaauaaugaau

SEQ ID NO: 290890 - RNA, 20 nt, Human
aaugaggucccacugaggag

SEQ ID NO: 290891 - RNA, 20 nt, Human
ucaaagcacugccugucauc

SEQ ID NO: 290892 - RNA, 22 nt, Human
uccugcaggcuugaguccucag

SEQ ID NO: 290893 - RNA, 20 nt, Human
uuuauuggccuuucaggaac

SEQ ID NO: 290894 - RNA, 22 nt, Human
cacagguguguccuggucuugu

SEQ ID NO: 290895 - RNA, 22 nt, Human
gccaggguucgaauccguaugg

SEQ ID NO: 290896 - RNA, 22 nt, Human
auuuauugagacuuaacaaccc

SEQ ID NO: 290897 - RNA, 22 nt, Human
acaugaaguggucagaucaaac

SEQ ID NO: 290898 - RNA, 22 nt, Human
uuguaaaguucuuaggaagcuc

SEQ ID NO: 290899 - RNA, 22 nt, Human
ucucccauucagcuugcaguca

SEQ ID NO: 290900 - RNA, 22 nt, Human
accuuauuaaaaugaugaugua

SEQ ID NO: 290901 - RNA, 22 nt, Human
aggcucuggaguuagccaggca

SEQ ID NO: 290902 - RNA, 22 nt, Human
uugguggagucauuggcauaug

SEQ ID NO: 290903 - RNA, 22 nt, Human
uucugggucacccuucugcuca

SEQ ID NO: 290904 - RNA, 22 nt, Human
aggcaacauaacacgaaagucu

SEQ ID NO: 290905 - RNA, 22 nt, Human
gaggacaaagcccaggugcugg

SEQ ID NO: 290906 - RNA, 22 nt, Human
auagaagaggaaacugagguug

SEQ ID NO: 290907 - RNA, 22 nt, Human
ucaguguccaaaaagaggcaag

SEQ ID NO: 290908 - RNA, 22 nt, Human
uuauacauguguuuugagauga

SEQ ID NO: 290909 - RNA, 20 nt, Human
uacaaauuuuccauguuucc

SEQ ID NO: 290910 - RNA, 22 nt, Human
ucuguggcugugcugggccaga

SEQ ID NO: 290911 - RNA, 22 nt, Human
auguacauuuuccuaauguuuu

SEQ ID NO: 290912 - RNA, 22 nt, Human
gccuguuuuagaugcauugaug

SEQ ID NO: 290913 - RNA, 22 nt, Human
acagaaacccagaaaaccucuc

SEQ ID NO: 290914 - RNA, 22 nt, Human
acaaguuuauuugauuagaaca

SEQ ID NO: 290915 - RNA, 22 nt, Human
cugaggaggggccugagugaga

SEQ ID NO: 290916 - RNA, 22 nt, Human
gaaggaggugucaguuggacug

SEQ ID NO: 290917 - RNA, 22 nt, Human
ucaggauguccaaaauccagcc

SEQ ID NO: 290918 - RNA, 22 nt, Human
agcugcaagauaaaagugaugu

SEQ ID NO: 290919 - RNA, 22 nt, Human
acuuggcaaguaucuauaaagu

SEQ ID NO: 290920 - RNA, 19 nt, Human
ugcuggagguugacagggu

SEQ ID NO: 290921 - RNA, 22 nt, Human
uauuccagguuucuuguuguau

SEQ ID NO: 290922 - RNA, 22 nt, Human
uucaaaguccugucagguagcc

SEQ ID NO: 290923 - RNA, 18 nt, Human
ucuccuggguaggggccu

SEQ ID NO: 290924 - RNA, 22 nt, Human
aggcagggcugggauuagacuc

SEQ ID NO: 290925 - RNA, 22 nt, Human
ugugagguaacgcugcucuguu

SEQ ID NO: 290926 - RNA, 22 nt, Human
uucuuuauccuauuuguaggug

SEQ ID NO: 290927 - RNA, 22 nt, Human
acaguguuuuagaaaagcuuga

SEQ ID NO: 290928 - RNA, 22 nt, Human
cucucugggcccaguuggcacc

SEQ ID NO: 290929 - RNA, 22 nt, Human
uccuggcuuagguuuccagaac

SEQ ID NO: 290930 - RNA, 22 nt, Human
acagcuuuaguguggguggugc

SEQ ID NO: 290931 - RNA, 22 nt, Human
auuuacagacguggauuagugc

SEQ ID NO: 290932 - RNA, 22 nt, Human
agccucugauggcucccaagga

SEQ ID NO: 290933 - RNA, 23 nt, Human
ugcuguggauggcagguccuugc

SEQ ID NO: 290934 - RNA, 22 nt, Human
uacauaauaaggggcauggugu

SEQ ID NO: 290935 - RNA, 22 nt, Human
uuccugguaaauuauguccagg

SEQ ID NO: 290936 - RNA, 22 nt, Human
agguucuccuuaucaaugaaga

SEQ ID NO: 290937 - RNA, 22 nt, Human
uaggagggcccugaaaauggca

SEQ ID NO: 290938 - RNA, 20 nt, Human
auuugcaucugaauaacuua

SEQ ID NO: 290939 - RNA, 22 nt, Human
aaugcacauauauuuccuuauu

SEQ ID NO: 290940 - RNA, 22 nt, Human
cccaaggacacgggcagggaca

SEQ ID NO: 290941 - RNA, 22 nt, Human
gcagugucuuugaccuccaccc

SEQ ID NO: 290942 - RNA, 22 nt, Human
auggaguucugccagcgcugcu

SEQ ID NO: 290943 - RNA, 22 nt, Human
uccugaaaugugcacaugacau

SEQ ID NO: 290944 - RNA, 22 nt, Human
uaaaugucuguuaacaugaaug

SEQ ID NO: 290945 - RNA, 22 nt, Human
uuucucuuaaugucucugugcu

SEQ ID NO: 290946 - RNA, 22 nt, Human
aggggagaguuaaugugaaugu

SEQ ID NO: 290947 - RNA, 22 nt, Human
ucuguggcuggagaacuugucu

SEQ ID NO: 290948 - RNA, 16 nt, Human
gggagggaguuggugg

SEQ ID NO: 290949 - RNA, 22 nt, Human
gugaggagcucuuugacucacg

SEQ ID NO: 290950 - RNA, 22 nt, Human
uccugggcacaagugagucucc

SEQ ID NO: 290951 - RNA, 22 nt, Human
ucugugucugcagaaguucagc

SEQ ID NO: 290952 - RNA, 22 nt, Human
cuacccagcaccuaggcugccu

SEQ ID NO: 290953 - RNA, 22 nt, Human
gcuggcugaguucugucgucug

SEQ ID NO: 290954 - RNA, 22 nt, Human
gggagccagccauccagaaccu

SEQ ID NO: 290955 - RNA, 22 nt, Human
auugacagaaaauuggauggca

SEQ ID NO: 290956 - RNA, 22 nt, Human
aauuugauuuucuuaaaccaua

SEQ ID NO: 290957 - RNA, 22 nt, Human
cagucucuggugaguugacagu

SEQ ID NO: 290958 - RNA, 22 nt, Human
cagcugucuuugcacaguuuag

SEQ ID NO: 290959 - RNA, 22 nt, Human
uccuguuuuuguaaucgacucu

SEQ ID NO: 290960 - RNA, 22 nt, Human
uaaauuauggcuggcagagcag

SEQ ID NO: 290961 - RNA, 22 nt, Human
acagagcuaauguugcauaggc

SEQ ID NO: 290962 - RNA, 22 nt, Human
uaggugucuuucuguccuuguu

SEQ ID NO: 290963 - RNA, 18 nt, Human
cucaguguuugcugaaaa

SEQ ID NO: 290964 - RNA, 22 nt, Human
guuacaaacucaggugccaaaa

SEQ ID NO: 290965 - RNA, 22 nt, Human
caggcuuggagggcaguggcau

SEQ ID NO: 290966 - RNA, 23 nt, Human
acuuggaagcagugaacaacuuu

SEQ ID NO: 290967 - RNA, 22 nt, Human
uucagugucaauuuuuaaauau

SEQ ID NO: 290968 - RNA, 21 nt, Human
aguacaaaaauuccuuucuca

SEQ ID NO: 290969 - RNA, 22 nt, Human
aguccagucucacucuuggcag

SEQ ID NO: 290970 - RNA, 22 nt, Human
uucacauucagaaaaagcccgu

SEQ ID NO: 290971 - RNA, 22 nt, Human
uagguuuaggagugaaggugaa

SEQ ID NO: 290972 - RNA, 23 nt, Human
uccuuccuuugagaggcuccauc

SEQ ID NO: 290973 - RNA, 21 nt, Human
uucuuucugaaucugaaguau

SEQ ID NO: 290974 - RNA, 22 nt, Human
ugcuuccugaggccgucuucuc

SEQ ID NO: 290975 - RNA, 22 nt, Human
accaggcagcacuuuccuugca

SEQ ID NO: 290976 - RNA, 22 nt, Human
gcuccuggcuccaggcagccaa

SEQ ID NO: 290977 - RNA, 22 nt, Human
acacaggaagcaauuucagagc

SEQ ID NO: 290978 - RNA, 22 nt, Human
cacuuauuaugggcuaggaacu

SEQ ID NO: 290979 - RNA, 22 nt, Human
ugugugaguaaggcugagagag

SEQ ID NO: 290980 - RNA, 22 nt, Human
cuucuuucuuuugaucacaggu

SEQ ID NO: 290981 - RNA, 22 nt, Human
uuggaauuugagaccaagaaaa

SEQ ID NO: 290982 - RNA, 22 nt, Human
ucuuuucuggacucugcaugga

SEQ ID NO: 290983 - RNA, 21 nt, Human
ggguguggaaauuacauccug

SEQ ID NO: 290984 - RNA, 21 nt, Human
gaggaaugguuugcaaagcac

SEQ ID NO: 290985 - RNA, 22 nt, Human
auggcuugucuaugagugcucu

SEQ ID NO: 290986 - RNA, 22 nt, Human
uauauucaaugauuaguaucag

SEQ ID NO: 290987 - RNA, 22 nt, Human
gcuggcagugugaaugacaagc

SEQ ID NO: 290988 - RNA, 22 nt, Human
gauuucuugauaauucaaaucc

SEQ ID NO: 290989 - RNA, 22 nt, Human
gaaggggacuggcagcugcaga

SEQ ID NO: 290990 - RNA, 22 nt, Human
gagggucagaagggccugguuc

SEQ ID NO: 290991 - RNA, 22 nt, Human
ucccaggguuacagccagggca

SEQ ID NO: 290992 - RNA, 22 nt, Human
agugucuuugucucucaagcac

SEQ ID NO: 290993 - RNA, 22 nt, Human
auucaagagcccauguuuccug

SEQ ID NO: 290994 - RNA, 22 nt, Human
ucucuguggcaagcaugcugcu

SEQ ID NO: 290995 - RNA, 22 nt, Human
aucaagaacuuauuuuggaaau

SEQ ID NO: 290996 - RNA, 22 nt, Human
cucucuggcacuucauugcugu

SEQ ID NO: 290997 - RNA, 22 nt, Human
gcauacagagaggauguggcau

SEQ ID NO: 290998 - RNA, 22 nt, Human
uuucuucagccacuccaaacug

SEQ ID NO: 290999 - RNA, 22 nt, Human
uuccucagagggcgcuggggaa

SEQ ID NO: 291000 - RNA, 22 nt, Human
aggaccugccaggugcaaagca

SEQ ID NO: 291001 - RNA, 22 nt, Human
gcauguguuauuucucuguggg

SEQ ID NO: 291002 - RNA, 22 nt, Human
uugcaaaaccauccuaaguaaa

SEQ ID NO: 291003 - RNA, 22 nt, Human
agcuguuccaggccucauugcu

SEQ ID NO: 291004 - RNA, 22 nt, Human
cagcccugcuuccccgcuaguu

SEQ ID NO: 291005 - RNA, 22 nt, Human
acagacuggagugagagaaaua

SEQ ID NO: 291006 - RNA, 22 nt, Human
ucaugaaaauagaucagaaauu

SEQ ID NO: 291007 - RNA, 22 nt, Human
ucucugugacagcuggguaugu

SEQ ID NO: 291008 - RNA, 21 nt, Human
ucuggcagcaguuuguugagu

SEQ ID NO: 291009 - RNA, 22 nt, Human
aaaaucuugacuguuuuuagaa

SEQ ID NO: 291010 - RNA, 18 nt, Human
ccagguggugacagagau

SEQ ID NO: 291011 - RNA, 22 nt, Human
auuugcuggugaaauagugaca

SEQ ID NO: 291012 - RNA, 23 nt, Human
uacauucauuugcacagccagua

SEQ ID NO: 291013 - RNA, 22 nt, Human
aucuucaaagggauguccaugg

SEQ ID NO: 291014 - RNA, 22 nt, Human
caugccauuugguggauugaga

SEQ ID NO: 291015 - RNA, 19 nt, Human
aucugccuguuaucacaua

SEQ ID NO: 291016 - RNA, 22 nt, Human
ucuucccuaaucaccaucuuca

SEQ ID NO: 291017 - RNA, 22 nt, Human
ucuggguggcagugauggcgug

SEQ ID NO: 291018 - RNA, 22 nt, Human
uuugcugaccccauucugaguc

SEQ ID NO: 291019 - RNA, 22 nt, Human
caguuuuagcuagagcaaacca

SEQ ID NO: 291020 - RNA, 22 nt, Human
augagguuuugauuggcacagg

SEQ ID NO: 291021 - RNA, 22 nt, Human
uuuaggaugcucuauucugacu

SEQ ID NO: 291022 - RNA, 22 nt, Human
uuuguucauuuugagcucauca

SEQ ID NO: 291023 - RNA, 22 nt, Human
ccacagaaaauaaagcacgauu

SEQ ID NO: 291024 - RNA, 22 nt, Human
uuuccucacacagaagaucuug

SEQ ID NO: 291025 - RNA, 22 nt, Human
agcugcaaagaucugucaguca

SEQ ID NO: 291026 - RNA, 22 nt, Human
guuuacuguuuucugauaagug

SEQ ID NO: 291027 - RNA, 22 nt, Human
cuuuuucauuggcuuuaggaca

SEQ ID NO: 291028 - RNA, 22 nt, Human
gcaugugucccucagucugugc

SEQ ID NO: 291029 - RNA, 22 nt, Human
cccagcagccuggauguucuuu

SEQ ID NO: 291030 - RNA, 22 nt, Human
agacaagaaacugggagucucu

SEQ ID NO: 291031 - RNA, 20 nt, Human
cgggacacucaagcucuggg

SEQ ID NO: 291032 - RNA, 22 nt, Human
gaggccugcagcguggucccug

SEQ ID NO: 291033 - RNA, 22 nt, Human
augucuuuuaugauuacgggau

SEQ ID NO: 291034 - RNA, 22 nt, Human
ccaggugugccagcagggacug

SEQ ID NO: 291035 - RNA, 22 nt, Human
cagcucuuugaguauuccauuu

SEQ ID NO: 291036 - RNA, 18 nt, Human
gaggauggaaggagaugc

SEQ ID NO: 291037 - RNA, 19 nt, Human
aucuuuagcaacuuucaaa

SEQ ID NO: 291038 - RNA, 22 nt, Human
uccaggagaggccugaccaggu

SEQ ID NO: 291039 - RNA, 22 nt, Human
uaaguuuucuggaauaacuugg

SEQ ID NO: 291040 - RNA, 22 nt, Human
uggcaggugccaugggcucaga

SEQ ID NO: 291041 - RNA, 22 nt, Human
ccagcccugccagagagagcug

SEQ ID NO: 291042 - RNA, 19 nt, Human
acugccugaggcucacagg

SEQ ID NO: 291043 - RNA, 22 nt, Human
ccaggugucaugcgugugaccc

SEQ ID NO: 291044 - RNA, 22 nt, Human
ucugccaguuuauagacaagcc

SEQ ID NO: 291045 - RNA, 22 nt, Human
gggacagacccaugggccaggu

SEQ ID NO: 291046 - RNA, 22 nt, Human
acuacauuucucaguaccugaa

SEQ ID NO: 291047 - RNA, 22 nt, Human
ugugucaauuuucauuccuacu

SEQ ID NO: 291048 - RNA, 22 nt, Human
ucugggcuuuaagaacucuguu

SEQ ID NO: 291049 - RNA, 22 nt, Human
aaacuugacagugagacaguuu

SEQ ID NO: 291050 - RNA, 22 nt, Human
auaaaaaggacagauguggucu

SEQ ID NO: 291051 - RNA, 22 nt, Human
uuaugggagcaauuggggaggu

SEQ ID NO: 291052 - RNA, 22 nt, Human
aucuguaaaugcaaauguagcu

SEQ ID NO: 291053 - RNA, 22 nt, Human
uaagauguuuugguuugauaag

SEQ ID NO: 291054 - RNA, 22 nt, Human
uuaacauuguccuuagcagauu

SEQ ID NO: 291055 - RNA, 22 nt, Human
uuggagagauuuaggucucagu

SEQ ID NO: 291056 - RNA, 22 nt, Human
cuuaaaaucuggcaguuagcua

SEQ ID NO: 291057 - RNA, 22 nt, Human
guugcucaggcaggaguacagu

SEQ ID NO: 291058 - RNA, 17 nt, Human
uccuggccuggugugug

SEQ ID NO: 291059 - RNA, 22 nt, Human
ccuggcugaggggccaaggacc

SEQ ID NO: 291060 - RNA, 22 nt, Human
uuguauuugauugucauaucgu

SEQ ID NO: 291061 - RNA, 22 nt, Human
acaguugacagggagaggguua

SEQ ID NO: 291062 - RNA, 23 nt, Human
agugacaaugggccagagguggc

SEQ ID NO: 291063 - RNA, 22 nt, Human
ugaaagaaacagguauauuggg

SEQ ID NO: 291064 - RNA, 22 nt, Human
uuugucaaagaucagaugcuuu

SEQ ID NO: 291065 - RNA, 22 nt, Human
ggggaggaagcuggaacacggg

SEQ ID NO: 291066 - RNA, 22 nt, Human
gacuccugccuccucuguuugc

SEQ ID NO: 291067 - RNA, 22 nt, Human
ugguacaagcagacucagcaga

SEQ ID NO: 291068 - RNA, 22 nt, Human
gaggcaaggccgcacgucucag

SEQ ID NO: 291069 - RNA, 22 nt, Human
cauaaaagguagcaguuugaaa

SEQ ID NO: 291070 - RNA, 22 nt, Human
cagaagaaaguggggagacaag

SEQ ID NO: 291071 - RNA, 22 nt, Human
aacaguuuaugauaaauucuua

SEQ ID NO: 291072 - RNA, 22 nt, Human
cagaagaauggugucugagcuc

SEQ ID NO: 291073 - RNA, 23 nt, Human
aaacuugcuauggcugaaaucau

SEQ ID NO: 291074 - RNA, 19 nt, Human
augcuuuauguuauuucuu

SEQ ID NO: 291075 - RNA, 22 nt, Human
ucuguucaguuguaccuucccc

SEQ ID NO: 291076 - RNA, 22 nt, Human
uuuguucuugcaacaguuauua

SEQ ID NO: 291077 - RNA, 22 nt, Human
ucuucagugcaccugaugucuu

SEQ ID NO: 291078 - RNA, 22 nt, Human
uuuaaagagaaugugaaggagu

SEQ ID NO: 291079 - RNA, 22 nt, Human
ggagcugaguucuucagccggg

SEQ ID NO: 291080 - RNA, 22 nt, Human
gcccagggcgauggucggggcc

SEQ ID NO: 291081 - RNA, 22 nt, Human
gcuguagguucagucuccaugc

SEQ ID NO: 291082 - RNA, 22 nt, Human
uaacauguuaagaaauuagaua

SEQ ID NO: 291083 - RNA, 22 nt, Human
auguccagggcacacagcagug

SEQ ID NO: 291084 - RNA, 22 nt, Human
aucaguaaauauucauugugca

SEQ ID NO: 291085 - RNA, 22 nt, Human
uccaaggaagucauuuaaacug

SEQ ID NO: 291086 - RNA, 22 nt, Human
aagcaaaggaaagcugacuuuu

SEQ ID NO: 291087 - RNA, 22 nt, Human
ucauguuuuaguaaagugaagg

SEQ ID NO: 291088 - RNA, 22 nt, Human
uauuucuuuucgugacuuauug

SEQ ID NO: 291089 - RNA, 22 nt, Human
ccacagcaccugcagccaguug

SEQ ID NO: 291090 - RNA, 22 nt, Human
ucuaccagggucacagaggccc

SEQ ID NO: 291091 - RNA, 22 nt, Human
aagcugugaagagcaagugagg

SEQ ID NO: 291092 - RNA, 22 nt, Human
auacagggacauccaguuuuuc

SEQ ID NO: 291093 - RNA, 22 nt, Human
uguuaggguccugugcaggggc

SEQ ID NO: 291094 - RNA, 22 nt, Human
gaggcagcugggauacaaggga

SEQ ID NO: 291095 - RNA, 22 nt, Human
acuguggcuaauucauuugguc

SEQ ID NO: 291096 - RNA, 22 nt, Human
ucaauguaauaaaauacucuau

SEQ ID NO: 291097 - RNA, 22 nt, Human
aacaugugagcagguuuuuuau

SEQ ID NO: 291098 - RNA, 22 nt, Human
acauuguauaaugauuaucaca

SEQ ID NO: 291099 - RNA, 22 nt, Human
uaacugugaaguaauuguggau

SEQ ID NO: 291100 - RNA, 22 nt, Human
gugcagugacccuggagagcug

SEQ ID NO: 291101 - RNA, 22 nt, Human
guacaaauuaggaagcuuugug

SEQ ID NO: 291102 - RNA, 22 nt, Human
ugauagagcacuaaguagugua

SEQ ID NO: 291103 - RNA, 22 nt, Human
uucuucaaacaaaaguggcaug

SEQ ID NO: 291104 - RNA, 22 nt, Human
ugucagaggcucagggucucag

SEQ ID NO: 291105 - RNA, 22 nt, Human
cagauaaauagauagauaaacu

SEQ ID NO: 291106 - RNA, 22 nt, Human
ucauaggaguagcagugagagg

SEQ ID NO: 291107 - RNA, 22 nt, Human
gagagcugggggacuguggaug

SEQ ID NO: 291108 - RNA, 19 nt, Human
aaaagucuauucaauuaca

SEQ ID NO: 291109 - RNA, 22 nt, Human
uuuauugcuggccaccuguagc

SEQ ID NO: 291110 - RNA, 22 nt, Human
gcagcuuuagaaacaagggcug

SEQ ID NO: 291111 - RNA, 22 nt, Human
gucauaaagcuuguugcauuua

SEQ ID NO: 291112 - RNA, 22 nt, Human
aaacugaaacaucaucauguug

SEQ ID NO: 291113 - RNA, 22 nt, Human
gauggccuggguccccuuccgg

SEQ ID NO: 291114 - RNA, 22 nt, Human
ugcagugguugagagcccagac

SEQ ID NO: 291115 - RNA, 22 nt, Human
auuuauuaugggauuuggcuca

SEQ ID NO: 291116 - RNA, 23 nt, Human
cuccuugguaugccaugcccagc

SEQ ID NO: 291117 - RNA, 22 nt, Human
gggagggaaggaccuuaugaau

SEQ ID NO: 291118 - RNA, 22 nt, Human
gccuggcacauugcaguggauu

SEQ ID NO: 291119 - RNA, 22 nt, Human
aaugauugcaaacauugagaac

SEQ ID NO: 291120 - RNA, 22 nt, Human
acaugauucuugauaggcauug

SEQ ID NO: 291121 - RNA, 22 nt, Human
cugugggagcacaugacagaua

SEQ ID NO: 291122 - RNA, 22 nt, Human
uaacacuugaagccauuuuugc

SEQ ID NO: 291123 - RNA, 22 nt, Human
aauugcuuaguugcaacuaugc

SEQ ID NO: 291124 - RNA, 18 nt, Human
ggcggguguuuuauucac

SEQ ID NO: 291125 - RNA, 23 nt, Human
uucaaaacuggaaaaucagaugc

SEQ ID NO: 291126 - RNA, 22 nt, Human
cauuguuauagcauuacacacc

SEQ ID NO: 291127 - RNA, 20 nt, Human
uacauuguagaaauauucaa

SEQ ID NO: 291128 - RNA, 22 nt, Human
uuuuccuucugauacuccauuu

SEQ ID NO: 291129 - RNA, 22 nt, Human
acagacagggcaccugccuccu

SEQ ID NO: 291130 - RNA, 23 nt, Human
uuccuggcagguacaacuuuuac

SEQ ID NO: 291131 - RNA, 22 nt, Human
uccuggucuacacugcauuggg

SEQ ID NO: 291132 - RNA, 22 nt, Human
auugcuggcugccaucuugccc

SEQ ID NO: 291133 - RNA, 22 nt, Human
auauuuaacuggucccaauaua

SEQ ID NO: 291134 - RNA, 22 nt, Human
ugugauauuugaguauugucaa

SEQ ID NO: 291135 - RNA, 23 nt, Human
acugccugcuacuaugcccacgg

SEQ ID NO: 291136 - RNA, 22 nt, Human
acagugcaaacccucgggaaag

SEQ ID NO: 291137 - RNA, 22 nt, Human
ccugggucuauagacuucaaga

SEQ ID NO: 291138 - RNA, 21 nt, Human
uagcuuuaauauucccacauu

SEQ ID NO: 291139 - RNA, 22 nt, Human
uggucagcguuugucagagcag

SEQ ID NO: 291140 - RNA, 22 nt, Human
aaauaguucagcuuguaaaccc

SEQ ID NO: 291141 - RNA, 16 nt, Human
auuuccagauuaugca

SEQ ID NO: 291142 - RNA, 22 nt, Human
ugggaccugcucuuggaaugag

SEQ ID NO: 291143 - RNA, 22 nt, Human
uggcugaaucugcagcaggaag

SEQ ID NO: 291144 - RNA, 22 nt, Human
cuuauaaaguccaucugaacaa

SEQ ID NO: 291145 - RNA, 22 nt, Human
uucaaauuaccacauuugcuua

SEQ ID NO: 291146 - RNA, 22 nt, Human
ugccuggauucgguuguuguca

SEQ ID NO: 291147 - RNA, 22 nt, Human
ucgagcucuggagccaaggaug

SEQ ID NO: 291148 - RNA, 22 nt, Human
aaagugaugccaggagucuggu

SEQ ID NO: 291149 - RNA, 22 nt, Human
ggucugcccacuacucuccauu

SEQ ID NO: 291150 - RNA, 22 nt, Human
gguggggccagggcuccaaccu

SEQ ID NO: 291151 - RNA, 22 nt, Human
ucuggcucuccagugcucuuag

SEQ ID NO: 291152 - RNA, 22 nt, Human
gccugcagcugcuuccacacac

SEQ ID NO: 291153 - RNA, 21 nt, Human
aguccaggaggaggccagguu

SEQ ID NO: 291154 - RNA, 22 nt, Human
ccagcuuuggaguguuguugcu

SEQ ID NO: 291155 - RNA, 22 nt, Human
gucaccucucaucacaugcuac

SEQ ID NO: 291156 - RNA, 20 nt, Human
uuucuauggggccagcacau

SEQ ID NO: 291157 - RNA, 22 nt, Human
aacccagccguguagcugccgc

SEQ ID NO: 291158 - RNA, 22 nt, Human
auggcuugcuuuuagagagauc

SEQ ID NO: 291159 - RNA, 22 nt, Human
gugacccagaggcugacuaaca

SEQ ID NO: 291160 - RNA, 22 nt, Human
uaaugaauaaacuugagaguca

SEQ ID NO: 291161 - RNA, 22 nt, Human
gagcagugacuggagcaugaga

SEQ ID NO: 291162 - RNA, 22 nt, Human
aauucuacauugguucacauuu

SEQ ID NO: 291163 - RNA, 22 nt, Human
cuucugugcuucacaguugcca

SEQ ID NO: 291164 - RNA, 22 nt, Human
acaggcagauuaaggguaggca

SEQ ID NO: 291165 - RNA, 19 nt, Human
acagugucuguauauaaau

SEQ ID NO: 291166 - RNA, 22 nt, Human
auuuucaagggagaggccucug

SEQ ID NO: 291167 - RNA, 22 nt, Human
cuguccugagauaaagaugagg

SEQ ID NO: 291168 - RNA, 22 nt, Human
uugcuuuagguauagaauccau

SEQ ID NO: 291169 - RNA, 22 nt, Human
aaauucuuuggccuacuuugaa

SEQ ID NO: 291170 - RNA, 22 nt, Human
ccugggugaaauaguccucaag

SEQ ID NO: 291171 - RNA, 22 nt, Human
gucacuguauccagguuccagc

SEQ ID NO: 291172 - RNA, 22 nt, Human
aauuuccagaccccauccacag

SEQ ID NO: 291173 - RNA, 22 nt, Human
ggcagguguuuuuauauuaaag

SEQ ID NO: 291174 - RNA, 22 nt, Human
uacuaguuuuuaggaaaaguga

SEQ ID NO: 291175 - RNA, 22 nt, Human
agggcacccucucugcaguacc

SEQ ID NO: 291176 - RNA, 22 nt, Human
uucccucugcgcauugaauuuc

SEQ ID NO: 291177 - RNA, 22 nt, Human
uuucauuuugguuaugccauaa

SEQ ID NO: 291178 - RNA, 22 nt, Human
agggcugcaucugccuggugaa

SEQ ID NO: 291179 - RNA, 18 nt, Human
uugaggaguucacugucu

SEQ ID NO: 291180 - RNA, 18 nt, Human
cuuguucuucucuuggcg

SEQ ID NO: 291181 - RNA, 22 nt, Human
ugccugaugcaggaguaucaga

SEQ ID NO: 291182 - RNA, 22 nt, Human
auaugaagucagacaaacuggg

SEQ ID NO: 291183 - RNA, 22 nt, Human
aaguguuuccauugugcaggcu

SEQ ID NO: 291184 - RNA, 22 nt, Human
accagucuguuguugcagagug

SEQ ID NO: 291185 - RNA, 22 nt, Human
augaagcagaauuucccacucu

SEQ ID NO: 291186 - RNA, 20 nt, Human
agagguucagucuggagaag

SEQ ID NO: 291187 - RNA, 22 nt, Human
agauggcucuuugaaggggaau

SEQ ID NO: 291188 - RNA, 22 nt, Human
ccuggagggacccuggcccugu

SEQ ID NO: 291189 - RNA, 22 nt, Human
cugucuuuaguacaaaaaaugu

SEQ ID NO: 291190 - RNA, 22 nt, Human
ccagguguaagacaugguccua

SEQ ID NO: 291191 - RNA, 22 nt, Human
uggcagugguaccggcucucag

SEQ ID NO: 291192 - RNA, 22 nt, Human
agcagggcagguaaggaucaga

SEQ ID NO: 291193 - RNA, 16 nt, Human
aaggaaugucauucug

SEQ ID NO: 291194 - RNA, 22 nt, Human
uuuuauacacaugaacaugcag

SEQ ID NO: 291195 - RNA, 22 nt, Human
agcugugguucugggcagcgac

SEQ ID NO: 291196 - RNA, 22 nt, Human
uuccuggcuucauacuuuguac

SEQ ID NO: 291197 - RNA, 18 nt, Human
caggccucuugaucuucc

SEQ ID NO: 291198 - RNA, 22 nt, Human
auuuccugggucucacuccaga

SEQ ID NO: 291199 - RNA, 22 nt, Human
aaagcaugauuagauagaugau

SEQ ID NO: 291200 - RNA, 22 nt, Human
gccuguuuaucuaucaugaacu

SEQ ID NO: 291201 - RNA, 22 nt, Human
ggggaccuaggcucugucucuu

SEQ ID NO: 291202 - RNA, 22 nt, Human
ucuggcagugagcaacuugaca

SEQ ID NO: 291203 - RNA, 22 nt, Human
ugcagguguaaauuuucaagag

SEQ ID NO: 291204 - RNA, 22 nt, Human
ucccaggcuaggccucugcguu

SEQ ID NO: 291205 - RNA, 22 nt, Human
uuauugaguuuacagcuuuaga

SEQ ID NO: 291206 - RNA, 22 nt, Human
ugacuugucucuuugggagaca

SEQ ID NO: 291207 - RNA, 22 nt, Human
uguacagagguguacauaugau

SEQ ID NO: 291208 - RNA, 22 nt, Human
uacacuuuauggauccuacuuu

SEQ ID NO: 291209 - RNA, 19 nt, Human
gguguccuagagauaagag

SEQ ID NO: 291210 - RNA, 22 nt, Human
agcagggcagcuuuuuucagaa

SEQ ID NO: 291211 - RNA, 22 nt, Human
gaaugaauagguguccagaugg

SEQ ID NO: 291212 - RNA, 22 nt, Human
aaugccuuggagagccuagagg

SEQ ID NO: 291213 - RNA, 22 nt, Human
cuugauuucagccuugugauau

SEQ ID NO: 291214 - RNA, 22 nt, Human
accuuauuuugaaauagauugu

SEQ ID NO: 291215 - RNA, 22 nt, Human
uucuuguaauuuggagaaauga

SEQ ID NO: 291216 - RNA, 22 nt, Human
cagaagaguagcugaacaaguu

SEQ ID NO: 291217 - RNA, 22 nt, Human
agaggaguauuuucuaagggaa

SEQ ID NO: 291218 - RNA, 22 nt, Human
agcagggcugcagugugucuuu

SEQ ID NO: 291219 - RNA, 22 nt, Human
gcagcuuuguggagaggcccau

SEQ ID NO: 291220 - RNA, 22 nt, Human
agcacagggacaaugccaggug

SEQ ID NO: 291221 - RNA, 22 nt, Human
cugaaggagcauagucaguuuu

SEQ ID NO: 291222 - RNA, 22 nt, Human
augacaggaggcagcugggcag

SEQ ID NO: 291223 - RNA, 22 nt, Human
gcaugcaggauagguugagcuc

SEQ ID NO: 291224 - RNA, 22 nt, Human
auuucuuuucaagagggugcuu

SEQ ID NO: 291225 - RNA, 22 nt, Human
auccuucuccaaaacuggcucc

SEQ ID NO: 291226 - RNA, 22 nt, Human
uacaggagcugcucugugauac

SEQ ID NO: 291227 - RNA, 22 nt, Human
gauguacuuuaaaauacuucag

SEQ ID NO: 291228 - RNA, 22 nt, Human
cugcggugggcugggcuguccc

SEQ ID NO: 291229 - RNA, 22 nt, Human
ccagcuuucauaucaugaggua

SEQ ID NO: 291230 - RNA, 19 nt, Human
cccagcuugaccaccugcu

SEQ ID NO: 291231 - RNA, 22 nt, Human
aggguagggcccggagacagac

SEQ ID NO: 291232 - RNA, 22 nt, Human
ggccgcugcgccuccaaccgag

SEQ ID NO: 291233 - RNA, 22 nt, Human
guauuagguuggugcaaaauug

SEQ ID NO: 291234 - RNA, 20 nt, Human
ugcaaacacagaguguauga

SEQ ID NO: 291235 - RNA, 22 nt, Human
cugggcugauuuagucacguuu

SEQ ID NO: 291236 - RNA, 22 nt, Human
ccaggugugauuuggcaguguc

SEQ ID NO: 291237 - RNA, 22 nt, Human
uccaccauguaacaagcucugu

SEQ ID NO: 291238 - RNA, 20 nt, Human
ucuccuggucugguccgugc

SEQ ID NO: 291239 - RNA, 17 nt, Human
cagugaggccuuuccuc

SEQ ID NO: 291240 - RNA, 22 nt, Human
aggcucuggcaacagcuggugu

SEQ ID NO: 291241 - RNA, 22 nt, Human
cuucuucuggacaggcagcucc

SEQ ID NO: 291242 - RNA, 22 nt, Human
cauuaagauuuuuuucuacugg

SEQ ID NO: 291243 - RNA, 22 nt, Human
gcaggugggggagaaguuguga

SEQ ID NO: 291244 - RNA, 22 nt, Human
guucucauaguggaaaauaggu

SEQ ID NO: 291245 - RNA, 22 nt, Human
augacaaggguugacacauguc

SEQ ID NO: 291246 - RNA, 20 nt, Human
ugcugagguugacaugccca

SEQ ID NO: 291247 - RNA, 22 nt, Human
ccaauucauccucuggggcuuc

SEQ ID NO: 291248 - RNA, 22 nt, Human
agcuccugggccaucacaacca

SEQ ID NO: 291249 - RNA, 22 nt, Human
uuugcugaauaaaugugugacu

SEQ ID NO: 291250 - RNA, 22 nt, Human
gggcaggugcccagggccagag

SEQ ID NO: 291251 - RNA, 22 nt, Human
ccagcuuucucagaggcuucua

SEQ ID NO: 291252 - RNA, 22 nt, Human
aagcugaagccggaucaaaaag

SEQ ID NO: 291253 - RNA, 22 nt, Human
auuugcuugugcuaugaaaguu

SEQ ID NO: 291254 - RNA, 22 nt, Human
ucugaaauauauuuugaguguu

SEQ ID NO: 291255 - RNA, 22 nt, Human
ugagccagugugguaaagcuga

SEQ ID NO: 291256 - RNA, 22 nt, Human
gggucuggagggcagcccuucu

SEQ ID NO: 291257 - RNA, 22 nt, Human
gagguucacuuccuggauccuu

SEQ ID NO: 291258 - RNA, 22 nt, Human
uguaauuaaacugaagacagaa

SEQ ID NO: 291259 - RNA, 22 nt, Human
uacagauauagagauuuauaga

SEQ ID NO: 291260 - RNA, 22 nt, Human
aauacuuaugugaccucauuuu

SEQ ID NO: 291261 - RNA, 22 nt, Human
gggaaagaagaagagccauuuu

SEQ ID NO: 291262 - RNA, 22 nt, Human
ugccuucauccauguuauagug

SEQ ID NO: 291263 - RNA, 22 nt, Human
aucauguacuugacaaauaugu

SEQ ID NO: 291264 - RNA, 22 nt, Human
acuuuugaagaauuaugcaaaa

SEQ ID NO: 291265 - RNA, 22 nt, Human
agaggcuuggaggugcaagguu

SEQ ID NO: 291266 - RNA, 22 nt, Human
uuuaacacuaguuucuuuaacu

SEQ ID NO: 291267 - RNA, 22 nt, Human
agacaauuaaaaaauuaugcuu

SEQ ID NO: 291268 - RNA, 22 nt, Human
aagcugucaggagguuaccuuu

SEQ ID NO: 291269 - RNA, 22 nt, Human
gggaccugcgccacucacuguc

SEQ ID NO: 291270 - RNA, 22 nt, Human
cacagcugccaugcagucagug

SEQ ID NO: 291271 - RNA, 22 nt, Human
augcagcugacauuuucauguu

SEQ ID NO: 291272 - RNA, 22 nt, Human
aauaauuauuugagagcagacc

SEQ ID NO: 291273 - RNA, 17 nt, Human
ccuuccucaucuccuuc

SEQ ID NO: 291274 - RNA, 22 nt, Human
cacugaaauauuaauaucuuau

SEQ ID NO: 291275 - RNA, 22 nt, Human
uuaagauagaacccaguagucu

SEQ ID NO: 291276 - RNA, 22 nt, Human
auuuacugcuugacacauuggu

SEQ ID NO: 291277 - RNA, 22 nt, Human
aggaauguuaaagauuaagagc

SEQ ID NO: 291278 - RNA, 22 nt, Human
ggguggaagccagagaggucau

SEQ ID NO: 291279 - RNA, 22 nt, Human
auacaacagaaaaugauuauuc

SEQ ID NO: 291280 - RNA, 22 nt, Human
gaagcacauggcugugagcaac

SEQ ID NO: 291281 - RNA, 22 nt, Human
uguuaaaaauucagcucuagau

SEQ ID NO: 291282 - RNA, 22 nt, Human
agcaguaagugaagacuaguuu

SEQ ID NO: 291283 - RNA, 22 nt, Human
acaggccugagauuuugcauuu

SEQ ID NO: 291284 - RNA, 22 nt, Human
cauucauaagacuuugcucuug

SEQ ID NO: 291285 - RNA, 22 nt, Human
aaggcuuuuaacuacuguuuua

SEQ ID NO: 291286 - RNA, 22 nt, Human
aaaauacuacugucuucuuccc

SEQ ID NO: 291287 - RNA, 22 nt, Human
acauguguuaaaauucucacca

SEQ ID NO: 291288 - RNA, 22 nt, Human
gaguaaaauaggugagaaucaa

SEQ ID NO: 291289 - RNA, 22 nt, Human
acagcuuuaucucagggaucag

SEQ ID NO: 291290 - RNA, 22 nt, Human
auucugggucugggugugauca

SEQ ID NO: 291291 - RNA, 22 nt, Human
ggguugaggcggaugucggcgg

SEQ ID NO: 291292 - RNA, 21 nt, Human
cuguccaaauuucauaacuuu

SEQ ID NO: 291293 - RNA, 22 nt, Human
aacauguuuccaguguaaggcc

SEQ ID NO: 291294 - RNA, 22 nt, Human
acagacaguaugguggggcuga

SEQ ID NO: 291295 - RNA, 22 nt, Human
uucacauugugguucaugugaa

SEQ ID NO: 291296 - RNA, 22 nt, Human
aagagcaucuauuucacagugg

SEQ ID NO: 291297 - RNA, 22 nt, Human
uccugaccucuugcucugaccu

SEQ ID NO: 291298 - RNA, 22 nt, Human
ccccacccucgcuccauuucgg

SEQ ID NO: 291299 - RNA, 23 nt, Human
aucuguucaucugacacagauuc

SEQ ID NO: 291300 - RNA, 22 nt, Human
ucucagaggcccgacguucucc

SEQ ID NO: 291301 - RNA, 22 nt, Human
cacaggcugggaagccuaggcc

SEQ ID NO: 291302 - RNA, 22 nt, Human
agucucagaaaauaugcuuuuu

SEQ ID NO: 291303 - RNA, 22 nt, Human
cuccccagcucgcgggugacgg

SEQ ID NO: 291304 - RNA, 22 nt, Human
auuuguuccaugaguaaggcua

SEQ ID NO: 291305 - RNA, 22 nt, Human
auuggagaagaacaugaauuag

SEQ ID NO: 291306 - RNA, 22 nt, Human
caguuuuaugucgaauguauac

SEQ ID NO: 291307 - RNA, 22 nt, Human
gggcugacgaaggccaugugug

SEQ ID NO: 291308 - RNA, 22 nt, Human
ucacagcuuucagauuguuccc

SEQ ID NO: 291309 - RNA, 22 nt, Human
uauuccuauggccacugcuacu

SEQ ID NO: 291310 - RNA, 22 nt, Human
ugcagggcuacaggacuacaac

SEQ ID NO: 291311 - RNA, 22 nt, Human
uuuacuuucucaaguauauagg

SEQ ID NO: 291312 - RNA, 22 nt, Human
uuccaggaacagaugaagguug

SEQ ID NO: 291313 - RNA, 19 nt, Human
cacauuuugagucugagau

SEQ ID NO: 291314 - RNA, 22 nt, Human
uuggcaccucccuaggaagaag

SEQ ID NO: 291315 - RNA, 22 nt, Human
cauuuguuaauuacuauuaucu

SEQ ID NO: 291316 - RNA, 22 nt, Human
acaaacagaguugaaaaauagg

SEQ ID NO: 291317 - RNA, 22 nt, Human
uuccuccuucccauuccugggg

SEQ ID NO: 291318 - RNA, 22 nt, Human
uauuuuguaauuggucauagcu

SEQ ID NO: 291319 - RNA, 22 nt, Human
gcucagagagaggcucaccauu

SEQ ID NO: 291320 - RNA, 22 nt, Human
uuucucauuuagaguggcaggg

SEQ ID NO: 291321 - RNA, 22 nt, Human
guaggguuggagagcacaacca

SEQ ID NO: 291322 - RNA, 22 nt, Human
ccaggaggcucugacuggaccc

SEQ ID NO: 291323 - RNA, 22 nt, Human
uccucccacauaggacaauggg

SEQ ID NO: 291324 - RNA, 22 nt, Human
uagguauaauauuuugaagaaa

SEQ ID NO: 291325 - RNA, 22 nt, Human
aaggcauugcugauccucaggu

SEQ ID NO: 291326 - RNA, 18 nt, Human
cuccugggcugcagaugc

SEQ ID NO: 291327 - RNA, 20 nt, Human
aaauuuaggaaauuuuacgc

SEQ ID NO: 291328 - RNA, 22 nt, Human
gacaagauaaugaagugcaauu

SEQ ID NO: 291329 - RNA, 22 nt, Human
ucauauaaguuuaaaacuaucu

SEQ ID NO: 291330 - RNA, 22 nt, Human
guggcagggcaaugcucccucu

SEQ ID NO: 291331 - RNA, 22 nt, Human
agauuacagaagaauaaguaga

SEQ ID NO: 291332 - RNA, 22 nt, Human
uauguguccuguuaccggcagc

SEQ ID NO: 291333 - RNA, 22 nt, Human
guuugugucaaugacuucugca

SEQ ID NO: 291334 - RNA, 19 nt, Human
ugguacaaaccaagagaga

SEQ ID NO: 291335 - RNA, 19 nt, Human
aagaggcaacccucgagcc

SEQ ID NO: 291336 - RNA, 22 nt, Human
acugggagggucuugaagaggg

SEQ ID NO: 291337 - RNA, 22 nt, Human
cauuguuaauugguaucuuaca

SEQ ID NO: 291338 - RNA, 21 nt, Human
aggcuuggaucuagacaggcc

SEQ ID NO: 291339 - RNA, 22 nt, Human
auugcuaggaacagguugcacc

SEQ ID NO: 291340 - RNA, 22 nt, Human
cuucucaaaguugugaaucagg

SEQ ID NO: 291341 - RNA, 17 nt, Human
uaaguuauagcagaaga

SEQ ID NO: 291342 - RNA, 22 nt, Human
uuguccuggagguuaauagagu

SEQ ID NO: 291343 - RNA, 20 nt, Human
cacaggcuuacaguuuagau

SEQ ID NO: 291344 - RNA, 22 nt, Human
ggaugaggaagauuacugagaa

SEQ ID NO: 291345 - RNA, 22 nt, Human
uuuacucuugcuacacaacugu

SEQ ID NO: 291346 - RNA, 22 nt, Human
uauuuagaacagacaauagaaa

SEQ ID NO: 291347 - RNA, 21 nt, Human
ugacauuuaguagcauuguca

SEQ ID NO: 291348 - RNA, 22 nt, Human
uuucaguugauugcuuggguua

SEQ ID NO: 291349 - RNA, 19 nt, Human
agacaaguuuccagaagcc

SEQ ID NO: 291350 - RNA, 22 nt, Human
uauugguaggacucagcugaga

SEQ ID NO: 291351 - RNA, 22 nt, Human
uaaauuauguuccauguccuuu

SEQ ID NO: 291352 - RNA, 22 nt, Human
gcagggcagccacaggcccccu

SEQ ID NO: 291353 - RNA, 22 nt, Human
uauuaaagggaaguuaugcaug

SEQ ID NO: 291354 - RNA, 22 nt, Human
aggcugugggaguugagagucu

SEQ ID NO: 291355 - RNA, 22 nt, Human
ggcuuucugagucaaacacuga

SEQ ID NO: 291356 - RNA, 22 nt, Human
ggccacugaccuacaucugggg

SEQ ID NO: 291357 - RNA, 22 nt, Human
cuguccugcccacccugcaggg

SEQ ID NO: 291358 - RNA, 22 nt, Human
uuuauaugugaagguuugcaga

SEQ ID NO: 291359 - RNA, 22 nt, Human
ccugcaguuuguugugaccccg

SEQ ID NO: 291360 - RNA, 22 nt, Human
uagaugaagggguucagcaugg

SEQ ID NO: 291361 - RNA, 22 nt, Human
auuuguaauuucuuaucugugu

SEQ ID NO: 291362 - RNA, 22 nt, Human
uuaacugugacaguuucucaga

SEQ ID NO: 291363 - RNA, 22 nt, Human
cuccuggaagcccgcccugcug

SEQ ID NO: 291364 - RNA, 22 nt, Human
aaggguugcaaggucagaggaa

SEQ ID NO: 291365 - RNA, 22 nt, Human
cuguccagugcagagaacagag

SEQ ID NO: 291366 - RNA, 21 nt, Human
agcugcaaaaacauacaguuc

SEQ ID NO: 291367 - RNA, 22 nt, Human
gcagccucaaacuccccagcuc

SEQ ID NO: 291368 - RNA, 22 nt, Human
aagugguuuuaagagguuccuu

SEQ ID NO: 291369 - RNA, 22 nt, Human
ugaaugauuugggugcauucag

SEQ ID NO: 291370 - RNA, 22 nt, Human
uucuucuuaauguccugggaac

SEQ ID NO: 291371 - RNA, 22 nt, Human
cgcaggugggcccuucauugau

SEQ ID NO: 291372 - RNA, 22 nt, Human
auuuccauuuucagccauuacu

SEQ ID NO: 291373 - RNA, 22 nt, Human
uuagucuccagcuuaggguuug

SEQ ID NO: 291374 - RNA, 22 nt, Human
agcuguggcagcacuuuggagu

SEQ ID NO: 291375 - RNA, 22 nt, Human
guagggacaauauguuauuaga

SEQ ID NO: 291376 - RNA, 22 nt, Human
ucuccagggagguagcccagug

SEQ ID NO: 291377 - RNA, 22 nt, Human
gugcaaaaguaauuacaguuuu

SEQ ID NO: 291378 - RNA, 22 nt, Human
cagugauuaaaacaugacagcc

SEQ ID NO: 291379 - RNA, 22 nt, Human
cacugucuccuagggggacuuc

SEQ ID NO: 291380 - RNA, 22 nt, Human
uaggugucuuguguaugguaca

SEQ ID NO: 291381 - RNA, 22 nt, Human
gcagcuuucugggacagaaagg

SEQ ID NO: 291382 - RNA, 16 nt, Human
guuccuucccacaccu

SEQ ID NO: 291383 - RNA, 22 nt, Human
ucaggugugugguggaaggcag

SEQ ID NO: 291384 - RNA, 22 nt, Human
ucagucuuugcuuaugacaaua

SEQ ID NO: 291385 - RNA, 19 nt, Human
ugcuggaacaucaguagcu

SEQ ID NO: 291386 - RNA, 22 nt, Human
gacuucuucaugucuuuuccac

SEQ ID NO: 291387 - RNA, 23 nt, Human
agaccugcaucugauaggcccug

SEQ ID NO: 291388 - RNA, 22 nt, Human
guuauugacucucuuguggcuu

SEQ ID NO: 291389 - RNA, 22 nt, Human
ggcuuuguggggugaaguaaag

SEQ ID NO: 291390 - RNA, 22 nt, Human
uagccauugacuuaaagcuuau

SEQ ID NO: 291391 - RNA, 22 nt, Human
aauuguaacuacauugagaaca

SEQ ID NO: 291392 - RNA, 22 nt, Human
acugaggaacauauauaagaug

SEQ ID NO: 291393 - RNA, 22 nt, Human
aauuuccagaucagaugacuca

SEQ ID NO: 291394 - RNA, 22 nt, Human
ggagcugaaccccaucgugcug

SEQ ID NO: 291395 - RNA, 22 nt, Human
uauuuuacaugacagguguuua

SEQ ID NO: 291396 - RNA, 22 nt, Human
ucauguuuuagcugcaaaauga

SEQ ID NO: 291397 - RNA, 22 nt, Human
cuccuggaucuuagccagauuc

SEQ ID NO: 291398 - RNA, 22 nt, Human
ggugacggggcccagguuuccu

SEQ ID NO: 291399 - RNA, 23 nt, Human
auuuacagguuaaaugaaaucag

SEQ ID NO: 291400 - RNA, 22 nt, Human
caugucacuuuaacaaauuagu

SEQ ID NO: 291401 - RNA, 22 nt, Human
caggauggucuucauuuggcuc

SEQ ID NO: 291402 - RNA, 22 nt, Human
ucaggaguaaagaagacuugac

SEQ ID NO: 291403 - RNA, 22 nt, Human
caguaacauuucaagguagagg

SEQ ID NO: 291404 - RNA, 21 nt, Human
ucugauguucacacccuguau

SEQ ID NO: 291405 - RNA, 22 nt, Human
aggaaacuaaagcccagagagg

SEQ ID NO: 291406 - RNA, 22 nt, Human
ucuuacgaauucuuagaggaca

SEQ ID NO: 291407 - RNA, 22 nt, Human
uuuaauuuguauuucuagaggg

SEQ ID NO: 291408 - RNA, 22 nt, Human
aaaccacacuuagcaguuucgu

SEQ ID NO: 291409 - RNA, 20 nt, Human
acaugaaaggaaacaggaaa

SEQ ID NO: 291410 - RNA, 22 nt, Human
gacaagauuuagagucugcuaa

SEQ ID NO: 291411 - RNA, 17 nt, Human
cagacaggcugucaccc

SEQ ID NO: 291412 - RNA, 22 nt, Human
uggaccugaagaauaggaagua

SEQ ID NO: 291413 - RNA, 22 nt, Human
uuacauuuugggguaaggauaa

SEQ ID NO: 291414 - RNA, 22 nt, Human
uaagaaacccaggaauuucuua

SEQ ID NO: 291415 - RNA, 22 nt, Human
ugaacaacugcaaaaaucucca

SEQ ID NO: 291416 - RNA, 22 nt, Human
gagucaggaguccugugugaga

SEQ ID NO: 291417 - RNA, 22 nt, Human
cuggauguucuucugcaauuau

SEQ ID NO: 291418 - RNA, 22 nt, Human
cuacauaaauauuuaugugucu

SEQ ID NO: 291419 - RNA, 22 nt, Human
aaugaguuauuuaauagaaagg

SEQ ID NO: 291420 - RNA, 22 nt, Human
cccuuccuccucgccugucaga

SEQ ID NO: 291421 - RNA, 22 nt, Human
uuugcagugauucuugcaguga

SEQ ID NO: 291422 - RNA, 22 nt, Human
ccagggcagaaaaagagggaau

SEQ ID NO: 291423 - RNA, 22 nt, Human
aauugcuuuucaaggguacagc

SEQ ID NO: 291424 - RNA, 22 nt, Human
gcagggacaucuucagaucacu

SEQ ID NO: 291425 - RNA, 22 nt, Human
acugucuuguuccaagacuaaa

SEQ ID NO: 291426 - RNA, 22 nt, Human
uuccuucuggaggcuccagggg

SEQ ID NO: 291427 - RNA, 22 nt, Human
uugcugauucuguauuuaaggu

SEQ ID NO: 291428 - RNA, 22 nt, Human
ccugucuuagggaaagacugga

SEQ ID NO: 291429 - RNA, 22 nt, Human
cuugccucccucagcucacagc

SEQ ID NO: 291430 - RNA, 22 nt, Human
ggaugucugucauuaugcuuuc

SEQ ID NO: 291431 - RNA, 22 nt, Human
acacauaucuaagauagaugac

SEQ ID NO: 291432 - RNA, 20 nt, Human
accuccuggaagcaggugcc

SEQ ID NO: 291433 - RNA, 22 nt, Human
aaauaguaaagugguagccauc

SEQ ID NO: 291434 - RNA, 18 nt, Human
gcuuuauuucuuggggaa

SEQ ID NO: 291435 - RNA, 22 nt, Human
ucuagguggaugaggaacauag

SEQ ID NO: 291436 - RNA, 22 nt, Human
ugugaaaagggcuuuguacaaa

SEQ ID NO: 291437 - RNA, 22 nt, Human
agggcucccgugaggugacugc

SEQ ID NO: 291438 - RNA, 22 nt, Human
ugcagggccuugggucuuucuu

SEQ ID NO: 291439 - RNA, 22 nt, Human
aggccagggucccacacucgca

SEQ ID NO: 291440 - RNA, 22 nt, Human
ccuagggucaguguggcaggag

SEQ ID NO: 291441 - RNA, 22 nt, Human
uaggaaguagauagguuguucu

SEQ ID NO: 291442 - RNA, 22 nt, Human
aaggcagaaagggaugugagug

SEQ ID NO: 291443 - RNA, 22 nt, Human
uuuaagaucauuuguauuaucc

SEQ ID NO: 291444 - RNA, 22 nt, Human
uaugaaaugguaguaggaaggg

SEQ ID NO: 291445 - RNA, 22 nt, Human
gcauuauuaauagcugcaugag

SEQ ID NO: 291446 - RNA, 22 nt, Human
acagauuugacugguaccuggc

SEQ ID NO: 291447 - RNA, 22 nt, Human
cacacuuugugcuaaucuauuu

SEQ ID NO: 291448 - RNA, 22 nt, Human
agcuccuggcuuuccucucacc

SEQ ID NO: 291449 - RNA, 22 nt, Human
cacaagggcuuuguaggcuuug

SEQ ID NO: 291450 - RNA, 22 nt, Human
cuccuucuccucgggaggccag

SEQ ID NO: 291451 - RNA, 22 nt, Human
cuggaggacagaggccaugucu

SEQ ID NO: 291452 - RNA, 22 nt, Human
cucuguaugaaucauauggagu

SEQ ID NO: 291453 - RNA, 22 nt, Human
acaaaauagaguucuccccugg

SEQ ID NO: 291454 - RNA, 20 nt, Human
uccagaggccacauccagug

SEQ ID NO: 291455 - RNA, 22 nt, Human
gaaagcauguagccuguaucca

SEQ ID NO: 291456 - RNA, 22 nt, Human
aaggcacagccacuugaucauc

SEQ ID NO: 291457 - RNA, 22 nt, Human
aguaaaaucaccaucucuuugu

SEQ ID NO: 291458 - RNA, 22 nt, Human
uucugugauugacauguggcuu

SEQ ID NO: 291459 - RNA, 22 nt, Human
augaggagaccaaggccugaug

SEQ ID NO: 291460 - RNA, 22 nt, Human
acagcuuuguguuaaugggaag

SEQ ID NO: 291461 - RNA, 22 nt, Human
uguuauuuauuucaccuccaga

SEQ ID NO: 291462 - RNA, 22 nt, Human
ggucccagcugcucaagaggcu

SEQ ID NO: 291463 - RNA, 22 nt, Human
ccagaggcuggguucaccucag

SEQ ID NO: 291464 - RNA, 22 nt, Human
aaguguccucauucaacaugca

SEQ ID NO: 291465 - RNA, 22 nt, Human
ugagaaugaaucuuuugcuuuc

SEQ ID NO: 291466 - RNA, 22 nt, Human
ucugagacacucuugugauggg

SEQ ID NO: 291467 - RNA, 22 nt, Human
auuccacagaggacuccgauug

SEQ ID NO: 291468 - RNA, 22 nt, Human
uuacaguagauuuugaaugugg

SEQ ID NO: 291469 - RNA, 22 nt, Human
cccaggcacagauuaucccaau

SEQ ID NO: 291470 - RNA, 22 nt, Human
uguguccucaugagguuugcag

SEQ ID NO: 291471 - RNA, 22 nt, Human
uauuuguugaguuguuaugucu

SEQ ID NO: 291472 - RNA, 22 nt, Human
agcagggcuccugaaagccgcg

SEQ ID NO: 291473 - RNA, 22 nt, Human
uauugcugaaaugcugaguuca

SEQ ID NO: 291474 - RNA, 22 nt, Human
aaacaaguuuguagacuagcca

SEQ ID NO: 291475 - RNA, 21 nt, Human
uagggcucucugugucaggug

SEQ ID NO: 291476 - RNA, 21 nt, Human
uccuggcuuuaugcuaccucu

SEQ ID NO: 291477 - RNA, 22 nt, Human
gcgacuguacagaauugccccu

SEQ ID NO: 291478 - RNA, 22 nt, Human
cacagcuucccaaaguggaccu

SEQ ID NO: 291479 - RNA, 22 nt, Human
cagggaugguaaauauguaaag

SEQ ID NO: 291480 - RNA, 22 nt, Human
cuaaaugacuuccagugguuau

SEQ ID NO: 291481 - RNA, 22 nt, Human
uuuuuauaggucagggcaaguc

SEQ ID NO: 291482 - RNA, 20 nt, Human
uguaggaaggacccugucug

SEQ ID NO: 291483 - RNA, 22 nt, Human
uucuauugggcagcauugcuuc

SEQ ID NO: 291484 - RNA, 22 nt, Human
gugagauuugaguggggauaca

SEQ ID NO: 291485 - RNA, 19 nt, Human
auucauuggccaggguggu

SEQ ID NO: 291486 - RNA, 22 nt, Human
auagacauagccguaauuuauu

SEQ ID NO: 291487 - RNA, 22 nt, Human
aacuucuuugagcuccaguuuu

SEQ ID NO: 291488 - RNA, 22 nt, Human
gcauucuugguggagugcuaaa

SEQ ID NO: 291489 - RNA, 22 nt, Human
ccuguucauuuguauuugucuu

SEQ ID NO: 291490 - RNA, 22 nt, Human
aucuuuaccaccaaagaaugcu

SEQ ID NO: 291491 - RNA, 22 nt, Human
aagccuugccuauuugaugaca

SEQ ID NO: 291492 - RNA, 22 nt, Human
uuuaaugugacaucuuuuagag

SEQ ID NO: 291493 - RNA, 22 nt, Human
uggccugguuguugcugccguu

SEQ ID NO: 291494 - RNA, 22 nt, Human
uuucacagcuggguggcagagu

SEQ ID NO: 291495 - RNA, 22 nt, Human
cuuuguuaucuguaaaugguua

SEQ ID NO: 291496 - RNA, 22 nt, Human
gaaugagggagauguuggugca

SEQ ID NO: 291497 - RNA, 22 nt, Human
aauugcuuaugccaggugagag

SEQ ID NO: 291498 - RNA, 19 nt, Human
cucuuaaauugucucuugc

SEQ ID NO: 291499 - RNA, 22 nt, Human
cagguuuagguggacgugcagg

SEQ ID NO: 291500 - RNA, 19 nt, Human
gcaggugugaauccguaga

SEQ ID NO: 291501 - RNA, 22 nt, Human
gucucaguccgugcuguucagg

SEQ ID NO: 291502 - RNA, 22 nt, Human
uuuccuucaucaucugagagcu

SEQ ID NO: 291503 - RNA, 22 nt, Human
ucauuuguugcuguuaccugag

SEQ ID NO: 291504 - RNA, 22 nt, Human
aaaagagugacugauaaguaua

SEQ ID NO: 291505 - RNA, 22 nt, Human
cugcaggagugaaagcaggccu

SEQ ID NO: 291506 - RNA, 22 nt, Human
uuuacagagaauguacauaaag

SEQ ID NO: 291507 - RNA, 22 nt, Human
uggaccugcuggaugggcaggu

SEQ ID NO: 291508 - RNA, 22 nt, Human
ucaggugugggcagagaaacca

SEQ ID NO: 291509 - RNA, 22 nt, Human
uggucucccagagcagggacgc

SEQ ID NO: 291510 - RNA, 19 nt, Human
uagaaagccagaaaacaga

SEQ ID NO: 291511 - RNA, 18 nt, Human
uuuuaauuucaggggugg

SEQ ID NO: 291512 - RNA, 22 nt, Human
gacauuagacuaauguagcauu

SEQ ID NO: 291513 - RNA, 22 nt, Human
cccuugagccuggaggagcucu

SEQ ID NO: 291514 - RNA, 21 nt, Human
gauuuuaaagagacugccaca

SEQ ID NO: 291515 - RNA, 22 nt, Human
uaaaaguuuuaguuguacauaa

SEQ ID NO: 291516 - RNA, 23 nt, Human
uucuuucaagaaguucacagugc

SEQ ID NO: 291517 - RNA, 22 nt, Human
ugagcaggucaggaaguacauu

SEQ ID NO: 291518 - RNA, 22 nt, Human
aaacauuguaauuuuagcaugg

SEQ ID NO: 291519 - RNA, 22 nt, Human
ucaugucagcuguugaugugca

SEQ ID NO: 291520 - RNA, 22 nt, Human
cacgguggcccacaggugcaag

SEQ ID NO: 291521 - RNA, 22 nt, Human
uagguacagcuaaaaauuaucu

SEQ ID NO: 291522 - RNA, 22 nt, Human
aaaaugagcauauugauccuuu

SEQ ID NO: 291523 - RNA, 22 nt, Human
uuuaguucacaccaggguagca

SEQ ID NO: 291524 - RNA, 22 nt, Human
uggugggggaggcugucuagca

SEQ ID NO: 291525 - RNA, 21 nt, Human
uuacauucagaggaguggaag

SEQ ID NO: 291526 - RNA, 22 nt, Human
uccugugagacuuguccauuau

SEQ ID NO: 291527 - RNA, 22 nt, Human
uuguuucuucaggcuuuuagga

SEQ ID NO: 291528 - RNA, 19 nt, Human
uuuagcuuacguuucauug

SEQ ID NO: 291529 - RNA, 22 nt, Human
cagaguguuucuuugggugggu

SEQ ID NO: 291530 - RNA, 22 nt, Human
uggaggaauaacagcaaccuua

SEQ ID NO: 291531 - RNA, 22 nt, Human
ccuggcuccaaagcugugacuc

SEQ ID NO: 291532 - RNA, 22 nt, Human
ccagguguuacacgaguguuaa

SEQ ID NO: 291533 - RNA, 21 nt, Human
ccaggucuugguccuuggacu

SEQ ID NO: 291534 - RNA, 22 nt, Human
agagaaggaaagcugacauggg

SEQ ID NO: 291535 - RNA, 22 nt, Human
acugguaacaauggaagcuucu

SEQ ID NO: 291536 - RNA, 22 nt, Human
acugaaauggggacaguccuua

SEQ ID NO: 291537 - RNA, 22 nt, Human
ucaugugucugcugcagcuguu

SEQ ID NO: 291538 - RNA, 19 nt, Human
gaacuuggccaggcacagu

SEQ ID NO: 291539 - RNA, 22 nt, Human
aagaugauguuguguuuucacu

SEQ ID NO: 291540 - RNA, 22 nt, Human
agugaguugaacauugauaaug

SEQ ID NO: 291541 - RNA, 23 nt, Human
gagggcucugagugcuugggcca

SEQ ID NO: 291542 - RNA, 22 nt, Human
gaaaaugugccuuuggguauug

SEQ ID NO: 291543 - RNA, 22 nt, Human
uuaaauauuuucagcaggguca

SEQ ID NO: 291544 - RNA, 22 nt, Human
uugcugggcaugucuuaauucu

SEQ ID NO: 291545 - RNA, 22 nt, Human
cggcugcugccugagucgcugu

SEQ ID NO: 291546 - RNA, 22 nt, Human
caagcuuuccauuacacacauu

SEQ ID NO: 291547 - RNA, 23 nt, Human
ccaggccucucagagggugugcc

SEQ ID NO: 291548 - RNA, 21 nt, Human
acucaggagacuaacuauguc

SEQ ID NO: 291549 - RNA, 22 nt, Human
cagggcucccuugcaaggaggg

SEQ ID NO: 291550 - RNA, 22 nt, Human
ucccagccugacagugcaucaa

SEQ ID NO: 291551 - RNA, 21 nt, Human
aauuacagauggaauuacaga

SEQ ID NO: 291552 - RNA, 22 nt, Human
cugggugacagagugagauggu

SEQ ID NO: 291553 - RNA, 22 nt, Human
uuauacaccaucacugccuugg

SEQ ID NO: 291554 - RNA, 22 nt, Human
cagugagggaagaucucagcac

SEQ ID NO: 291555 - RNA, 22 nt, Human
ccuccccacccacggcuggugg

SEQ ID NO: 291556 - RNA, 22 nt, Human
uauaucauggagauuaacauuc

SEQ ID NO: 291557 - RNA, 17 nt, Human
aaggaaugucagaaguu

SEQ ID NO: 291558 - RNA, 22 nt, Human
uucugcuuauucuguagccuuu

SEQ ID NO: 291559 - RNA, 22 nt, Human
gagacaggcagcuaguggguca

SEQ ID NO: 291560 - RNA, 22 nt, Human
ccugcagggaaucgaggcagaa

SEQ ID NO: 291561 - RNA, 22 nt, Human
ugagcaccaggcaccacagcuc

SEQ ID NO: 291562 - RNA, 22 nt, Human
ccuccccacaggccaaauaggc

SEQ ID NO: 291563 - RNA, 22 nt, Human
gagaaacaacacuugaugccuu

SEQ ID NO: 291564 - RNA, 22 nt, Human
ggugaggaaagauggugacagu

SEQ ID NO: 291565 - RNA, 22 nt, Human
uguguacacacagauauauaca

SEQ ID NO: 291566 - RNA, 22 nt, Human
ucuuucuuauuagccauuguuc

SEQ ID NO: 291567 - RNA, 22 nt, Human
ggagaucuugcuugaaggcaug

SEQ ID NO: 291568 - RNA, 22 nt, Human
uuugacucauuaaagucuccgu

SEQ ID NO: 291569 - RNA, 22 nt, Human
uuggaacaggauucaauuaaag

SEQ ID NO: 291570 - RNA, 22 nt, Human
aauacaguagguaauaguucau

SEQ ID NO: 291571 - RNA, 22 nt, Human
ucuaccuggaguccguuguuaa

SEQ ID NO: 291572 - RNA, 22 nt, Human
gucugcccggccuuccuccacc

SEQ ID NO: 291573 - RNA, 21 nt, Human
gagccuucccucugcccuuuc

SEQ ID NO: 291574 - RNA, 22 nt, Human
cacgcauguggaucagaugaag

SEQ ID NO: 291575 - RNA, 22 nt, Human
uuauucuuuucuccagaauccc

SEQ ID NO: 291576 - RNA, 22 nt, Human
uuccaggagacuuccagaaaua

SEQ ID NO: 291577 - RNA, 22 nt, Human
cagacagggguaaccuuccuca

SEQ ID NO: 291578 - RNA, 22 nt, Human
aaaguugaguuuuauguguuac

SEQ ID NO: 291579 - RNA, 22 nt, Human
gucucccaucucuguccuugug

SEQ ID NO: 291580 - RNA, 22 nt, Human
aaacaucucaaagagguauuug

SEQ ID NO: 291581 - RNA, 22 nt, Human
ccaguguguuaguggauuuccc

SEQ ID NO: 291582 - RNA, 21 nt, Human
gggaucuuguacuggcgugga

SEQ ID NO: 291583 - RNA, 22 nt, Human
uauuaucauuaacuguugaauu

SEQ ID NO: 291584 - RNA, 22 nt, Human
aaugggaagucacuacuguuac

SEQ ID NO: 291585 - RNA, 22 nt, Human
gggcugacaccacccaggcgca

SEQ ID NO: 291586 - RNA, 20 nt, Human
cugcccagccacugagggau

SEQ ID NO: 291587 - RNA, 22 nt, Human
ggcugugggugugacaggccuc

SEQ ID NO: 291588 - RNA, 22 nt, Human
acugugccacaauucaccaggg

SEQ ID NO: 291589 - RNA, 22 nt, Human
agcuccuacucuaugccagaca

SEQ ID NO: 291590 - RNA, 22 nt, Human
aucauguguaauuucaagcuac

SEQ ID NO: 291591 - RNA, 18 nt, Human
uucuuuaauucaguuuga

SEQ ID NO: 291592 - RNA, 22 nt, Human
acuggaggggaaaaugguagua

SEQ ID NO: 291593 - RNA, 22 nt, Human
uucagccuguucaugcuguugc

SEQ ID NO: 291594 - RNA, 22 nt, Human
gggacauggcuaggauuccaau

SEQ ID NO: 291595 - RNA, 22 nt, Human
auacuucuuuaagaguaagucu

SEQ ID NO: 291596 - RNA, 22 nt, Human
auggccuggggauuccugagca

SEQ ID NO: 291597 - RNA, 22 nt, Human
auuuggaaacaauuauauucuu

SEQ ID NO: 291598 - RNA, 22 nt, Human
caggaguggugugagggacucc

SEQ ID NO: 291599 - RNA, 20 nt, Human
caauaauuuacuucccuauu

SEQ ID NO: 291600 - RNA, 22 nt, Human
ugcugccaauuucuggucuuga

SEQ ID NO: 291601 - RNA, 22 nt, Human
aaaaugaggucaauauccuuuu

SEQ ID NO: 291602 - RNA, 22 nt, Human
cagguucuauacugaauaauuu

SEQ ID NO: 291603 - RNA, 22 nt, Human
gugguaaagcugauugaauuga

SEQ ID NO: 291604 - RNA, 19 nt, Human
ccaugccaucauuuuaaag

SEQ ID NO: 291605 - RNA, 22 nt, Human
gcugagguuuucugccugcuca

SEQ ID NO: 291606 - RNA, 22 nt, Human
uaucaauaucucagugugcuuc

SEQ ID NO: 291607 - RNA, 18 nt, Human
guguggcugagaugaggc

SEQ ID NO: 291608 - RNA, 22 nt, Human
uugcaacuucucccaucacucu

SEQ ID NO: 291609 - RNA, 22 nt, Human
gugcaaaaauaauugugguuuu

SEQ ID NO: 291610 - RNA, 22 nt, Human
auacacauauguguguauaugu

SEQ ID NO: 291611 - RNA, 22 nt, Human
gcugucuuuccccugcuccaga

SEQ ID NO: 291612 - RNA, 22 nt, Human
auuucccaugugaaucaauugg

SEQ ID NO: 291613 - RNA, 16 nt, Human
uuuuauugugacagcc

SEQ ID NO: 291614 - RNA, 22 nt, Human
uuccugaggaggaccaggacca

SEQ ID NO: 291615 - RNA, 22 nt, Human
accugcagcugagaaaaugacu

SEQ ID NO: 291616 - RNA, 22 nt, Human
uggugcaguagagcugucuggg

SEQ ID NO: 291617 - RNA, 22 nt, Human
ggauguugauugaauggccauu

SEQ ID NO: 291618 - RNA, 22 nt, Human
uccuggaucuacucucaauugg

SEQ ID NO: 291619 - RNA, 22 nt, Human
aggccaggaccauuagcccaga

SEQ ID NO: 291620 - RNA, 22 nt, Human
acaugacagugacuuuauaaga

SEQ ID NO: 291621 - RNA, 22 nt, Human
auguuaaaagugaggauggcca

SEQ ID NO: 291622 - RNA, 23 nt, Human
augccaggcugccuggccagccu

SEQ ID NO: 291623 - RNA, 22 nt, Human
aguugaauaauuagacauaucu

SEQ ID NO: 291624 - RNA, 22 nt, Human
acacaugagaaacaucaguugu

SEQ ID NO: 291625 - RNA, 22 nt, Human
agaaugucaacagccucucaag

SEQ ID NO: 291626 - RNA, 23 nt, Human
auuuaaugcugaguugaauguua

SEQ ID NO: 291627 - RNA, 22 nt, Human
aagcccugggauguucagcagu

SEQ ID NO: 291628 - RNA, 22 nt, Human
uucaaaaagguauguucaaguc

SEQ ID NO: 291629 - RNA, 19 nt, Human
cuccuggcucugucauuuu

SEQ ID NO: 291630 - RNA, 22 nt, Human
ucuccccagcugagcugcccuu

SEQ ID NO: 291631 - RNA, 22 nt, Human
auacacauuacuuucugucuga

SEQ ID NO: 291632 - RNA, 22 nt, Human
auguucuuggauguuguguaua

SEQ ID NO: 291633 - RNA, 22 nt, Human
auggcagggcacagcucuaguu

SEQ ID NO: 291634 - RNA, 22 nt, Human
auauuuucacagaacuugcaaa

SEQ ID NO: 291635 - RNA, 22 nt, Human
ucccagggcacucacccucccu

SEQ ID NO: 291636 - RNA, 22 nt, Human
ucaugucaguuucuucuauaaa

SEQ ID NO: 291637 - RNA, 22 nt, Human
aaugaaauguagcuuauccaua

SEQ ID NO: 291638 - RNA, 22 nt, Human
acaggacauguaccaggugguc

SEQ ID NO: 291639 - RNA, 22 nt, Human
ugguguggggauaagcacucug

SEQ ID NO: 291640 - RNA, 22 nt, Human
cgucacuucuuagucuauuuuc

SEQ ID NO: 291641 - RNA, 22 nt, Human
cuagggacugggaccuuaguua

SEQ ID NO: 291642 - RNA, 22 nt, Human
uguguccuaugaaagaggguua

SEQ ID NO: 291643 - RNA, 22 nt, Human
uuugggaauaauugcacagauu

SEQ ID NO: 291644 - RNA, 22 nt, Human
uauguauccguguguguacaga

SEQ ID NO: 291645 - RNA, 22 nt, Human
gcuuccagaucccaugcucuua

SEQ ID NO: 291646 - RNA, 22 nt, Human
aggaaugugaggcaaguuguga

SEQ ID NO: 291647 - RNA, 22 nt, Human
ggagaaggguauguguggcgga

SEQ ID NO: 291648 - RNA, 22 nt, Human
cucuuuccucagccacagucua

SEQ ID NO: 291649 - RNA, 22 nt, Human
auucuuauuauaguaaaacagu

SEQ ID NO: 291650 - RNA, 22 nt, Human
ccugagagcccuagccaggcgc

SEQ ID NO: 291651 - RNA, 22 nt, Human
cccucagcuucucccugcagcu

SEQ ID NO: 291652 - RNA, 22 nt, Human
cccugcagaucuaggguccuuc

SEQ ID NO: 291653 - RNA, 22 nt, Human
acucugaaugugcauguaaauc

SEQ ID NO: 291654 - RNA, 22 nt, Human
acccaggcugcuucucaguggc

SEQ ID NO: 291655 - RNA, 22 nt, Human
uuccuucuuccagaggcugccc

SEQ ID NO: 291656 - RNA, 22 nt, Human
ccaugugucuccccuggaagua

SEQ ID NO: 291657 - RNA, 22 nt, Human
uuucuuuaucauagcaucuuug

SEQ ID NO: 291658 - RNA, 22 nt, Human
ugacaaguacauaauuucaugu

SEQ ID NO: 291659 - RNA, 22 nt, Human
aauuuacaggugcacucgccau

SEQ ID NO: 291660 - RNA, 23 nt, Human
aggauguaggauguauggcagag

SEQ ID NO: 291661 - RNA, 22 nt, Human
ugcagggcuaagucagagccug

SEQ ID NO: 291662 - RNA, 22 nt, Human
uggcaggggaggugcuugcuua

SEQ ID NO: 291663 - RNA, 22 nt, Human
ugagccaggcuccaugccaccu

SEQ ID NO: 291664 - RNA, 22 nt, Human
uuuuauaagcaagaaagggaaa

SEQ ID NO: 291665 - RNA, 22 nt, Human
auuguuaaacugaagcauuacu

SEQ ID NO: 291666 - RNA, 22 nt, Human
cuugcuggugucgugccuucac

SEQ ID NO: 291667 - RNA, 22 nt, Human
gccacuguuccaccaucuugau

SEQ ID NO: 291668 - RNA, 23 nt, Human
aacugagauaauguauguaaagc

SEQ ID NO: 291669 - RNA, 23 nt, Human
acaucaugauagccaacuuggga

SEQ ID NO: 291670 - RNA, 22 nt, Human
ucccaggguccucuucuggaau

SEQ ID NO: 291671 - RNA, 22 nt, Human
aggaaugucaaguagaugugcg

SEQ ID NO: 291672 - RNA, 22 nt, Human
uagcaaguagauacucauuuag

SEQ ID NO: 291673 - RNA, 22 nt, Human
auuucaggguaaaaaguguuca

SEQ ID NO: 291674 - RNA, 22 nt, Human
ggagaagguggcucagcaaagg

SEQ ID NO: 291675 - RNA, 22 nt, Human
acaggcauauuucuagauuaca

SEQ ID NO: 291676 - RNA, 22 nt, Human
aagggagacaguugugugagga

SEQ ID NO: 291677 - RNA, 22 nt, Human
agaggugacauaggagaggcuc

SEQ ID NO: 291678 - RNA, 22 nt, Human
acaguuauucuuuaugcaacca

SEQ ID NO: 291679 - RNA, 22 nt, Human
aauucuugguccuaguguauaa

SEQ ID NO: 291680 - RNA, 22 nt, Human
uggccugggccugccggugcaa

SEQ ID NO: 291681 - RNA, 20 nt, Human
cugcugcccugucagccucu

SEQ ID NO: 291682 - RNA, 22 nt, Human
agcuuuaucuucaccugggaau

SEQ ID NO: 291683 - RNA, 22 nt, Human
agcuggaggauaacucacuucu

SEQ ID NO: 291684 - RNA, 22 nt, Human
ucuguggcuugggccugccugu

SEQ ID NO: 291685 - RNA, 21 nt, Human
agggccagaucaccaaggagc

SEQ ID NO: 291686 - RNA, 22 nt, Human
auauuuugaaguuaauaaugug

SEQ ID NO: 291687 - RNA, 22 nt, Human
cacaucagguagaccuacagag

SEQ ID NO: 291688 - RNA, 22 nt, Human
uugcagcugcaguaaauguuca

SEQ ID NO: 291689 - RNA, 22 nt, Human
cacaccagagguuaccugcaaa

SEQ ID NO: 291690 - RNA, 23 nt, Human
uuccugugguauauuuuauaggg

SEQ ID NO: 291691 - RNA, 22 nt, Human
uuuugagauggugucucgcucc

SEQ ID NO: 291692 - RNA, 22 nt, Human
uugggacaucuggcauacaguu

SEQ ID NO: 291693 - RNA, 22 nt, Human
uagggacccucccugcucuaac

SEQ ID NO: 291694 - RNA, 22 nt, Human
gcuuucuugguucugcaggggc

SEQ ID NO: 291695 - RNA, 22 nt, Human
gguggcaguggucucugacaga

SEQ ID NO: 291696 - RNA, 22 nt, Human
uuuuuugucccagagagccugg

SEQ ID NO: 291697 - RNA, 22 nt, Human
aggcaucuauacauuauguuca

SEQ ID NO: 291698 - RNA, 22 nt, Human
ucuuucaaugagcauucuuucc

SEQ ID NO: 291699 - RNA, 20 nt, Human
acaugcaguggucauuucag

SEQ ID NO: 291700 - RNA, 20 nt, Human
caugccagaaugugagguag

SEQ ID NO: 291701 - RNA, 23 nt, Human
ugggaccuguuugcccacagaug

SEQ ID NO: 291702 - RNA, 22 nt, Human
gcagggcaaauguggaaaggag

SEQ ID NO: 291703 - RNA, 22 nt, Human
agcagggcuccauuucacugcc

SEQ ID NO: 291704 - RNA, 22 nt, Human
uuucagaaggggagaaagguca

SEQ ID NO: 291705 - RNA, 22 nt, Human
ggcuggcagugugagagaggga

SEQ ID NO: 291706 - RNA, 22 nt, Human
acaaugcuugguuuuucuagaa

SEQ ID NO: 291707 - RNA, 22 nt, Human
agagaaacaggucagcugggag

SEQ ID NO: 291708 - RNA, 20 nt, Human
agcaggugacggggccugcu

SEQ ID NO: 291709 - RNA, 22 nt, Human
caggacagagcccagacugugu

SEQ ID NO: 291710 - RNA, 22 nt, Human
gcaagcuguccuuuugcauggc

SEQ ID NO: 291711 - RNA, 22 nt, Human
uuccuggcaugaaaaauaucac

SEQ ID NO: 291712 - RNA, 22 nt, Human
agaagcuaauucaugucuuaug

SEQ ID NO: 291713 - RNA, 22 nt, Human
uaauucuucaggccuuuugucu

SEQ ID NO: 291714 - RNA, 22 nt, Human
ucagcaaaggaccagcacaggc

SEQ ID NO: 291715 - RNA, 22 nt, Human
uguuucauguggacauaguugu

SEQ ID NO: 291716 - RNA, 22 nt, Human
ccuguucaauauucuuccuugu

SEQ ID NO: 291717 - RNA, 22 nt, Human
cccagggaggcccaggcucugc

SEQ ID NO: 291718 - RNA, 22 nt, Human
acaguguccuuguggucccugu

SEQ ID NO: 291719 - RNA, 21 nt, Human
gcagccacugccuucaacaau

SEQ ID NO: 291720 - RNA, 22 nt, Human
gucugcccagaagacauccccu

SEQ ID NO: 291721 - RNA, 22 nt, Human
uaaauguaccuucugccuuacu

SEQ ID NO: 291722 - RNA, 21 nt, Human
ucuccuggguccaacccaugc

SEQ ID NO: 291723 - RNA, 22 nt, Human
gaugagguaagaauguaacacc

SEQ ID NO: 291724 - RNA, 22 nt, Human
auuuaacaagacagagaacugg

SEQ ID NO: 291725 - RNA, 22 nt, Human
ccagcuuuagguugccugccag

SEQ ID NO: 291726 - RNA, 22 nt, Human
auacuguaauaccuaaaugaac

SEQ ID NO: 291727 - RNA, 22 nt, Human
cucuggaaaaccacuagcagga

SEQ ID NO: 291728 - RNA, 22 nt, Human
uuacuucuuuggccuucagcca

SEQ ID NO: 291729 - RNA, 22 nt, Human
uccuucaaucacccagugggga

SEQ ID NO: 291730 - RNA, 22 nt, Human
aaugaaugaaccacauauaaca

SEQ ID NO: 291731 - RNA, 23 nt, Human
acacugucucauggauagacugc

SEQ ID NO: 291732 - RNA, 22 nt, Human
augcaacaaaugcuacgaaucg

SEQ ID NO: 291733 - RNA, 20 nt, Human
uauuuacaacuuagagccuc

SEQ ID NO: 291734 - RNA, 22 nt, Human
uccuggccuagcucacccugga

SEQ ID NO: 291735 - RNA, 22 nt, Human
uucaugaauauauugaauuagc

SEQ ID NO: 291736 - RNA, 22 nt, Human
uggaggaaguggacaguugugu

SEQ ID NO: 291737 - RNA, 22 nt, Human
auuuccauguccaaaaauuagu

SEQ ID NO: 291738 - RNA, 22 nt, Human
cuucuuccugcugcagccucca

SEQ ID NO: 291739 - RNA, 22 nt, Human
auuaauuuuucugacagccaca

SEQ ID NO: 291740 - RNA, 22 nt, Human
cuuccuuccacaccuucagaau

SEQ ID NO: 291741 - RNA, 22 nt, Human
ucuccuggccuuuagguuaagg

SEQ ID NO: 291742 - RNA, 22 nt, Human
cagugcagacguggagggggca

SEQ ID NO: 291743 - RNA, 20 nt, Human
aggugcaagcaguaaauugc

SEQ ID NO: 291744 - RNA, 22 nt, Human
auucuuuauugcugaugguuau

SEQ ID NO: 291745 - RNA, 22 nt, Human
gcuggcagaagagcugguucaa

SEQ ID NO: 291746 - RNA, 22 nt, Human
ugauggucaggaugcauggaga

SEQ ID NO: 291747 - RNA, 22 nt, Human
cccacccugggaagcuaggcag

SEQ ID NO: 291748 - RNA, 22 nt, Human
uauugcugaugcugaagggaag

SEQ ID NO: 291749 - RNA, 22 nt, Human
uucugggugccaccuaagacau

SEQ ID NO: 291750 - RNA, 22 nt, Human
uuuuauugcaauaaagugugua

SEQ ID NO: 291751 - RNA, 22 nt, Human
uccaaauucuagggccuugguu

SEQ ID NO: 291752 - RNA, 23 nt, Human
acagggcauugcuggccucgagg

SEQ ID NO: 291753 - RNA, 22 nt, Human
aauuuuacauaggggauauggg

SEQ ID NO: 291754 - RNA, 22 nt, Human
cugccaugugugaaaggggagg

SEQ ID NO: 291755 - RNA, 23 nt, Human
uggauaaaauacuuacauucaac

SEQ ID NO: 291756 - RNA, 22 nt, Human
auacacaugcacacaugugugu

SEQ ID NO: 291757 - RNA, 23 nt, Human
caugucugcuuucaugcuacaac

SEQ ID NO: 291758 - RNA, 20 nt, Human
agaggaggauuauuuuauuc

SEQ ID NO: 291759 - RNA, 22 nt, Human
ugcagggaaaacccaggaugcu

SEQ ID NO: 291760 - RNA, 22 nt, Human
ggcccagugucccggucguggc

SEQ ID NO: 291761 - RNA, 22 nt, Human
cugauuccagagucuguguucu

SEQ ID NO: 291762 - RNA, 22 nt, Human
aaguaacacauguuacuucugc

SEQ ID NO: 291763 - RNA, 22 nt, Human
ucuucaaaugcuaguaauauca

SEQ ID NO: 291764 - RNA, 22 nt, Human
ucuagaaaaccaauauuacaug

SEQ ID NO: 291765 - RNA, 22 nt, Human
acuggcaguagagggagcgcau

SEQ ID NO: 291766 - RNA, 22 nt, Human
auuucucauuuugcuucaaagg

SEQ ID NO: 291767 - RNA, 22 nt, Human
agcuuuauauguuguuucucca

SEQ ID NO: 291768 - RNA, 22 nt, Human
aagggcucugugugccucccca

SEQ ID NO: 291769 - RNA, 22 nt, Human
cuucucggccguguggaugcgc

SEQ ID NO: 291770 - RNA, 22 nt, Human
uggagggaacaaaggaguccca

SEQ ID NO: 291771 - RNA, 22 nt, Human
gguacaaaguuagauuuaacuu

SEQ ID NO: 291772 - RNA, 19 nt, Human
ugcucuggagccagcucuc

SEQ ID NO: 291773 - RNA, 23 nt, Human
ugugaccccuaggaguggggacc

SEQ ID NO: 291774 - RNA, 22 nt, Human
accauccugaaaccuucaugcu

SEQ ID NO: 291775 - RNA, 22 nt, Human
ccugccagucacuaugucaccu

SEQ ID NO: 291776 - RNA, 22 nt, Human
cacagaacauccuuagcucaug

SEQ ID NO: 291777 - RNA, 22 nt, Human
uacaagcucgggcagcucauua

SEQ ID NO: 291778 - RNA, 22 nt, Human
accauuuaaggaaaauguauca

SEQ ID NO: 291779 - RNA, 22 nt, Human
gaaaggccacgugccaagauua

SEQ ID NO: 291780 - RNA, 22 nt, Human
aaucuucuuucuuaacaguaca

SEQ ID NO: 291781 - RNA, 22 nt, Human
uaaauucugaucaaguuccuuc

SEQ ID NO: 291782 - RNA, 22 nt, Human
uguggugguaaugagccagaug

SEQ ID NO: 291783 - RNA, 22 nt, Human
uuaaauagucaaaucaguggca

SEQ ID NO: 291784 - RNA, 22 nt, Human
uuugcauuguaauauuuaguuc

SEQ ID NO: 291785 - RNA, 22 nt, Human
uuucaguuacugcuauaucauu

SEQ ID NO: 291786 - RNA, 22 nt, Human
uuucuaggucuuccauacugcc

SEQ ID NO: 291787 - RNA, 22 nt, Human
augcuucagugcuaccuucaaa

SEQ ID NO: 291788 - RNA, 22 nt, Human
uugcaaggagccacucugccug

SEQ ID NO: 291789 - RNA, 22 nt, Human
aggcugcucugcgaagucagcu

SEQ ID NO: 291790 - RNA, 22 nt, Human
uaaggagggggaaugauuggca

SEQ ID NO: 291791 - RNA, 22 nt, Human
agggaccucauguaaguggauu

SEQ ID NO: 291792 - RNA, 22 nt, Human
gcagagaggauauuauugucca

SEQ ID NO: 291793 - RNA, 22 nt, Human
aacaaguaaguuuauauauauu

SEQ ID NO: 291794 - RNA, 22 nt, Human
agggcugaagggaggugcucau

SEQ ID NO: 291795 - RNA, 22 nt, Human
ccccacccaccuaagagaaacu

SEQ ID NO: 291796 - RNA, 22 nt, Human
aaaugucauauuuaaguaggaa

SEQ ID NO: 291797 - RNA, 22 nt, Human
auggcucugcugggcaaagcaa

SEQ ID NO: 291798 - RNA, 22 nt, Human
uucaugagguaccugugaucau

SEQ ID NO: 291799 - RNA, 22 nt, Human
cagucuuauccugaaaacaaca

SEQ ID NO: 291800 - RNA, 22 nt, Human
cagggaugagagauggcacaga

SEQ ID NO: 291801 - RNA, 22 nt, Human
acuuuguucuaauaguaucucu

SEQ ID NO: 291802 - RNA, 23 nt, Human
uuuugugugacuuaauaucucuu

SEQ ID NO: 291803 - RNA, 22 nt, Human
uuaaaguguuaacugaagcuua

SEQ ID NO: 291804 - RNA, 22 nt, Human
uguguccucacuguaugcaagg

SEQ ID NO: 291805 - RNA, 22 nt, Human
guggaaugaauagauuugcauu

SEQ ID NO: 291806 - RNA, 22 nt, Human
guuuuacaaaugacggcauuca

SEQ ID NO: 291807 - RNA, 22 nt, Human
agacaggcagggcauggaaaaa

SEQ ID NO: 291808 - RNA, 22 nt, Human
cuggcagcauuaacagagagca

SEQ ID NO: 291809 - RNA, 22 nt, Human
uucucaacucucaagagaagcu

SEQ ID NO: 291810 - RNA, 22 nt, Human
cccaguauugagcuacaggccu

SEQ ID NO: 291811 - RNA, 22 nt, Human
acaagcaugggcuuugacauca

SEQ ID NO: 291812 - RNA, 22 nt, Human
ccagggcagccaacccagaugc

SEQ ID NO: 291813 - RNA, 22 nt, Human
cuugggauguaaccuuuguucc

SEQ ID NO: 291814 - RNA, 22 nt, Human
augugaaauagcuggauaugaa

SEQ ID NO: 291815 - RNA, 22 nt, Human
aggcagugagaaauagcaagau

SEQ ID NO: 291816 - RNA, 18 nt, Human
gcucuggcucaccuccag

SEQ ID NO: 291817 - RNA, 22 nt, Human
cacaggcugcccgcagcuggga

SEQ ID NO: 291818 - RNA, 22 nt, Human
cugagguguugaugaccuaugc

SEQ ID NO: 291819 - RNA, 22 nt, Human
ggcagcacugcagcuuguuggg

SEQ ID NO: 291820 - RNA, 16 nt, Human
gcugggagggagaggu

SEQ ID NO: 291821 - RNA, 22 nt, Human
aggcaggucuguaucuagucuc

SEQ ID NO: 291822 - RNA, 22 nt, Human
guucuauuccccuuaucuguga

SEQ ID NO: 291823 - RNA, 21 nt, Human
ucucugugguccaaucccagc

SEQ ID NO: 291824 - RNA, 22 nt, Human
uacuuguucuuucaagagauag

SEQ ID NO: 291825 - RNA, 18 nt, Human
gcugaaauucuaaacaaa

SEQ ID NO: 291826 - RNA, 22 nt, Human
gugguaaaaugugaaauggauu

SEQ ID NO: 291827 - RNA, 22 nt, Human
auauucacugagcauaaagcca

SEQ ID NO: 291828 - RNA, 22 nt, Human
aauaaugauaaugguuauagcu

SEQ ID NO: 291829 - RNA, 23 nt, Human
acaaugucuguucauaaaauacc

SEQ ID NO: 291830 - RNA, 22 nt, Human
gccccagcccuguggaccaugg

SEQ ID NO: 291831 - RNA, 22 nt, Human
acacacagaaggaagccccacu

SEQ ID NO: 291832 - RNA, 22 nt, Human
acauuuuacaccaagacuucuu

SEQ ID NO: 291833 - RNA, 22 nt, Human
ugacagacacaccuuaggaaag

SEQ ID NO: 291834 - RNA, 22 nt, Human
cauaauccauuugcacugcaga

SEQ ID NO: 291835 - RNA, 22 nt, Human
ucacuuuacuuuguuaaucugg

SEQ ID NO: 291836 - RNA, 22 nt, Human
cugcaggggcuggaguuggcuu

SEQ ID NO: 291837 - RNA, 22 nt, Human
auaguacauggguguccucaca

SEQ ID NO: 291838 - RNA, 22 nt, Human
uugcuucaguagcucuuuaaag

SEQ ID NO: 291839 - RNA, 22 nt, Human
auaucaaacgaaguuauuuuaa

SEQ ID NO: 291840 - RNA, 22 nt, Human
uggcuugggugucucagcucuu

SEQ ID NO: 291841 - RNA, 22 nt, Human
cuucugaaguguuugaugauug

SEQ ID NO: 291842 - RNA, 22 nt, Human
accuguuuagaaagcuuaugag

SEQ ID NO: 291843 - RNA, 22 nt, Human
gggccccuuguaucucuggcuc

SEQ ID NO: 291844 - RNA, 22 nt, Human
aaggcuuucagcuaacuugauu

SEQ ID NO: 291845 - RNA, 22 nt, Human
cacagcugcccccucucuaacu

SEQ ID NO: 291846 - RNA, 23 nt, Human
cacuccuguuucuaagccagcau

SEQ ID NO: 291847 - RNA, 23 nt, Human
cguguccuucagggagagugugg

SEQ ID NO: 291848 - RNA, 22 nt, Human
ucccaggauuuuaggcucucag

SEQ ID NO: 291849 - RNA, 19 nt, Human
cacaucagcagggcugugg

SEQ ID NO: 291850 - RNA, 22 nt, Human
ccacagagacaggguccuugcu

SEQ ID NO: 291851 - RNA, 22 nt, Human
agggaaggaggccauguguccc

SEQ ID NO: 291852 - RNA, 22 nt, Human
aucauuacuccuguaaaauugu

SEQ ID NO: 291853 - RNA, 22 nt, Human
aagcuuuagagaugaguuccuu

SEQ ID NO: 291854 - RNA, 22 nt, Human
uuugcuugacccuugugcugaa

SEQ ID NO: 291855 - RNA, 19 nt, Human
gcucagagacaccuguugc

SEQ ID NO: 291856 - RNA, 22 nt, Human
gaaucagauacugauuucaguc

SEQ ID NO: 291857 - RNA, 22 nt, Human
ucuguuaucucaagucacaaga

SEQ ID NO: 291858 - RNA, 22 nt, Human
ugacagacauggaagccagagu

SEQ ID NO: 291859 - RNA, 22 nt, Human
aaagccuucaaguagauguaag

SEQ ID NO: 291860 - RNA, 22 nt, Human
gcagggcagcugaagcuaggug

SEQ ID NO: 291861 - RNA, 22 nt, Human
acauggugagcggcaggccuau

SEQ ID NO: 291862 - RNA, 22 nt, Human
uuuacuucugcauuuccccuag

SEQ ID NO: 291863 - RNA, 22 nt, Human
caguuuauuuccaagaugacaa

SEQ ID NO: 291864 - RNA, 22 nt, Human
uucauucugcaguucucagcuc

SEQ ID NO: 291865 - RNA, 22 nt, Human
agggccaggaucacagccaaga

SEQ ID NO: 291866 - RNA, 22 nt, Human
ggcaggcaacggaccacuaguc

SEQ ID NO: 291867 - RNA, 22 nt, Human
gaggugucguagauuauucuca

SEQ ID NO: 291868 - RNA, 22 nt, Human
agcccuaaauuaucuuuauuuu

SEQ ID NO: 291869 - RNA, 22 nt, Human
gagauuuaauuggauuaacuua

SEQ ID NO: 291870 - RNA, 22 nt, Human
gcaaagcacacuggagaugucg

SEQ ID NO: 291871 - RNA, 22 nt, Human
uccucccuguaccauuccucug

SEQ ID NO: 291872 - RNA, 17 nt, Human
aagagaggcugagcugg

SEQ ID NO: 291873 - RNA, 22 nt, Human
caggagggcccgagacucuucc

SEQ ID NO: 291874 - RNA, 22 nt, Human
ggccuaggaaggggauguaacu

SEQ ID NO: 291875 - RNA, 22 nt, Human
cccuggcagagggggcaggugc

SEQ ID NO: 291876 - RNA, 22 nt, Human
ucaggagcugcacugggcccac

SEQ ID NO: 291877 - RNA, 23 nt, Human
uaggugucuaguguccacuaugu

SEQ ID NO: 291878 - RNA, 22 nt, Human
uucuguuuuagaaauaaguagu

SEQ ID NO: 291879 - RNA, 19 nt, Human
aggcuugguugcagcaagc

SEQ ID NO: 291880 - RNA, 18 nt, Human
guuuacauuacugaauag

SEQ ID NO: 291881 - RNA, 22 nt, Human
uucugguaccgugucagaaacc

SEQ ID NO: 291882 - RNA, 22 nt, Human
ugguggacaucccagggugaaa

SEQ ID NO: 291883 - RNA, 22 nt, Human
acacugaauaauugagaguuga

SEQ ID NO: 291884 - RNA, 22 nt, Human
agaggcaaggcaggauucuucu

SEQ ID NO: 291885 - RNA, 22 nt, Human
cccaugagguggagguugcagu

SEQ ID NO: 291886 - RNA, 22 nt, Human
uaggugucuggacaacuuugua

SEQ ID NO: 291887 - RNA, 22 nt, Human
uuagcuuuagagccauuacugg

SEQ ID NO: 291888 - RNA, 22 nt, Human
cucacagcagccagucugccuu

SEQ ID NO: 291889 - RNA, 22 nt, Human
ccacugcuccugaccaagguca

SEQ ID NO: 291890 - RNA, 22 nt, Human
cugaggagugggugggcaguga

SEQ ID NO: 291891 - RNA, 22 nt, Human
uagucaguagcaagguauuuug

SEQ ID NO: 291892 - RNA, 22 nt, Human
uggcaacaugucgaagugcugu

SEQ ID NO: 291893 - RNA, 22 nt, Human
agcuuguuagaaauguagacuc

SEQ ID NO: 291894 - RNA, 22 nt, Human
uccaaauucuauguucuuucca

SEQ ID NO: 291895 - RNA, 22 nt, Human
auccuucuucaaagagggaaaa

SEQ ID NO: 291896 - RNA, 22 nt, Human
auucuuaauugccaugcuguau

SEQ ID NO: 291897 - RNA, 22 nt, Human
uaccaugucuucaauaagucua

SEQ ID NO: 291898 - RNA, 22 nt, Human
ucugccugcaguguggcagggc

SEQ ID NO: 291899 - RNA, 22 nt, Human
aaaggccuugagcugggugcca

SEQ ID NO: 291900 - RNA, 22 nt, Human
gguguccuacugcuugguugcu

SEQ ID NO: 291901 - RNA, 22 nt, Human
acauucuauucugcaggacaag

SEQ ID NO: 291902 - RNA, 22 nt, Human
gcuguggcgauugguaucgauu

SEQ ID NO: 291903 - RNA, 22 nt, Human
uugcagcuucuaccacuguuuc

SEQ ID NO: 291904 - RNA, 22 nt, Human
ccugcagggugcugccacagau

SEQ ID NO: 291905 - RNA, 22 nt, Human
gaucuuuucagucuugguaguu

SEQ ID NO: 291906 - RNA, 22 nt, Human
ucuuauugguaaugauggcauu

SEQ ID NO: 291907 - RNA, 22 nt, Human
acuucuauuggucaugauaaaa

SEQ ID NO: 291908 - RNA, 22 nt, Human
cccugcagagggaugggggcag

SEQ ID NO: 291909 - RNA, 21 nt, Human
uggcuaaacccuaguaaauua

SEQ ID NO: 291910 - RNA, 22 nt, Human
agguucucacacgucuacaccc

SEQ ID NO: 291911 - RNA, 22 nt, Human
cugaggagcugaaggcccucca

SEQ ID NO: 291912 - RNA, 22 nt, Human
cuuccugggucagccuggaggu

SEQ ID NO: 291913 - RNA, 22 nt, Human
ugggcaggcaagugaauaccuu

SEQ ID NO: 291914 - RNA, 23 nt, Human
aaauaugucugagggcaaagaau

SEQ ID NO: 291915 - RNA, 22 nt, Human
gccaucugcgcgguguccagcu

SEQ ID NO: 291916 - RNA, 22 nt, Human
uucuuucaauagcuggcauaug

SEQ ID NO: 291917 - RNA, 22 nt, Human
uccucaguuauaaauaggaaac

SEQ ID NO: 291918 - RNA, 22 nt, Human
auuuacagguagaauuuuaagu

SEQ ID NO: 291919 - RNA, 20 nt, Human
aggccugagagaugacuggg

SEQ ID NO: 291920 - RNA, 22 nt, Human
gagagcuggauucuggauaggu

SEQ ID NO: 291921 - RNA, 22 nt, Human
uuccugaauauaaagacacuag

SEQ ID NO: 291922 - RNA, 20 nt, Human
gcacagagaugagcaaagua

SEQ ID NO: 291923 - RNA, 22 nt, Human
caggccugguugagcccugaga

SEQ ID NO: 291924 - RNA, 22 nt, Human
uucugggagagaaagggccuug

SEQ ID NO: 291925 - RNA, 22 nt, Human
uaaaaaucuuaugaauggcaag

SEQ ID NO: 291926 - RNA, 22 nt, Human
uuugaagacagaucaauauaag

SEQ ID NO: 291927 - RNA, 22 nt, Human
ccaggugugcucugcaguggau

SEQ ID NO: 291928 - RNA, 22 nt, Human
ccaggugucugucucuuuuuca

SEQ ID NO: 291929 - RNA, 22 nt, Human
guuuucauuacugcugugauuu

SEQ ID NO: 291930 - RNA, 22 nt, Human
cuggauguuuaugaaggaccca

SEQ ID NO: 291931 - RNA, 22 nt, Human
uccacagaauguaagauccaca

SEQ ID NO: 291932 - RNA, 22 nt, Human
auucuacauuuggagugauguc

SEQ ID NO: 291933 - RNA, 22 nt, Human
uauuauuaaauggcagaauuuu

SEQ ID NO: 291934 - RNA, 22 nt, Human
aagccuucagaguuggcugguc

SEQ ID NO: 291935 - RNA, 21 nt, Human
cuacuuaaguaggggauuagg

SEQ ID NO: 291936 - RNA, 22 nt, Human
aaugauuggcacuagauacaca

SEQ ID NO: 291937 - RNA, 22 nt, Human
guuucacagucugcagaauuuu

SEQ ID NO: 291938 - RNA, 22 nt, Human
uuaaagaugcagcuuuagagaa

SEQ ID NO: 291939 - RNA, 23 nt, Human
cacacccaucacuaagagcuccu

SEQ ID NO: 291940 - RNA, 22 nt, Human
gaagggagaagguugggugacg

SEQ ID NO: 291941 - RNA, 22 nt, Human
ggaaguagaaguaaugaaauca

SEQ ID NO: 291942 - RNA, 22 nt, Human
acauuuauauaacucacuagga

SEQ ID NO: 291943 - RNA, 22 nt, Human
ugggguccagugccaccccaag

SEQ ID NO: 291944 - RNA, 23 nt, Human
cagagcugauuaaacuuaaucuc

SEQ ID NO: 291945 - RNA, 22 nt, Human
uugaaaacuuucuagaccaaga

SEQ ID NO: 291946 - RNA, 21 nt, Human
ucucuuucuggaagcuucccu

SEQ ID NO: 291947 - RNA, 22 nt, Human
ccugggucuccuccugcuggcu

SEQ ID NO: 291948 - RNA, 22 nt, Human
gcauucuuugaaugcuucuaau

SEQ ID NO: 291949 - RNA, 22 nt, Human
cuccuggagcagcaggcgcagg

SEQ ID NO: 291950 - RNA, 20 nt, Human
ucugagacuuguagugugga

SEQ ID NO: 291951 - RNA, 22 nt, Human
aagggcuccaagagguagcugg

SEQ ID NO: 291952 - RNA, 21 nt, Human
uggcaggcagcuggaagcuug

SEQ ID NO: 291953 - RNA, 22 nt, Human
gcuggguccaugguccucgggu

SEQ ID NO: 291954 - RNA, 19 nt, Human
cugggccagagcuguccuc

SEQ ID NO: 291955 - RNA, 22 nt, Human
ggcaggugccuucugugcuagc

SEQ ID NO: 291956 - RNA, 22 nt, Human
uuugcagaagaaaacaugaaca

SEQ ID NO: 291957 - RNA, 22 nt, Human
cuguggaauugaugcuuagugu

SEQ ID NO: 291958 - RNA, 22 nt, Human
uuccuggcacccuuguuagccu

SEQ ID NO: 291959 - RNA, 21 nt, Human
ugagcaggugcugcuuuuaug

SEQ ID NO: 291960 - RNA, 22 nt, Human
gggagcuggagcuggaagacuc

SEQ ID NO: 291961 - RNA, 22 nt, Human
ggcagguguggaguguuauuuu

SEQ ID NO: 291962 - RNA, 22 nt, Human
ugcccagguuugagugcccaag

SEQ ID NO: 291963 - RNA, 22 nt, Human
uucacauuggugauauguuucu

SEQ ID NO: 291964 - RNA, 22 nt, Human
gcacagcucuccccaagacgaa

SEQ ID NO: 291965 - RNA, 22 nt, Human
ucuguucagacacuuuacaugu

SEQ ID NO: 291966 - RNA, 22 nt, Human
aguguucagugauugucaaccg

SEQ ID NO: 291967 - RNA, 22 nt, Human
aaaggcuggggacugaggaagg

SEQ ID NO: 291968 - RNA, 22 nt, Human
acauuccugaaugggcacauuu

SEQ ID NO: 291969 - RNA, 22 nt, Human
caguguggugagauuccaggug

SEQ ID NO: 291970 - RNA, 22 nt, Human
cugaggagcccccucucagcau

SEQ ID NO: 291971 - RNA, 22 nt, Human
augguguuuauaggcaaagauc

SEQ ID NO: 291972 - RNA, 22 nt, Human
aauuaaaaaaggagagcuugcu

SEQ ID NO: 291973 - RNA, 22 nt, Human
uagcuauuuagcccagauaagu

SEQ ID NO: 291974 - RNA, 22 nt, Human
ccagagaccagaacauggggau

SEQ ID NO: 291975 - RNA, 17 nt, Human
cucuuuauaaagaguua

SEQ ID NO: 291976 - RNA, 22 nt, Human
cuaaaauuaucaagauaauucc

SEQ ID NO: 291977 - RNA, 22 nt, Human
ucucuguauucugauauucacu

SEQ ID NO: 291978 - RNA, 22 nt, Human
acaagagcccuuucagauugac

SEQ ID NO: 291979 - RNA, 22 nt, Human
aaaaagauagcauugugcuccu

SEQ ID NO: 291980 - RNA, 22 nt, Human
ucugcaagaucauuaaagcaga

SEQ ID NO: 291981 - RNA, 20 nt, Human
uucuuuguuccuuacauuug

SEQ ID NO: 291982 - RNA, 22 nt, Human
ugcaaaaagagcgaggagcccu

SEQ ID NO: 291983 - RNA, 22 nt, Human
caucugaauuugccuuaguuuc

SEQ ID NO: 291984 - RNA, 22 nt, Human
ccugccagggccagaggccagc

SEQ ID NO: 291985 - RNA, 22 nt, Human
acauuucuauagugcaucuguu

SEQ ID NO: 291986 - RNA, 22 nt, Human
ucuagaaugacaugcaagagua

SEQ ID NO: 291987 - RNA, 22 nt, Human
cuguucauggaaaaauaguugg

SEQ ID NO: 291988 - RNA, 22 nt, Human
uuucugaacuugguacuggagc

SEQ ID NO: 291989 - RNA, 20 nt, Human
acugugaaugcugaauuagc

SEQ ID NO: 291990 - RNA, 22 nt, Human
uuuuauaaagagagucaguugg

SEQ ID NO: 291991 - RNA, 22 nt, Human
cagcaggggaacugugggccag

SEQ ID NO: 291992 - RNA, 23 nt, Human
uggucucacuugguaagaugaag

SEQ ID NO: 291993 - RNA, 22 nt, Human
uucuucagacuacugaugauug

SEQ ID NO: 291994 - RNA, 22 nt, Human
ugcaaacauccgacugaaagcc

SEQ ID NO: 291995 - RNA, 22 nt, Human
cuggcccuucucuugcuuccug

SEQ ID NO: 291996 - RNA, 22 nt, Human
auaaaauuugcuacuguuaaau

SEQ ID NO: 291997 - RNA, 22 nt, Human
caagauuuagcucccuuaucuc

SEQ ID NO: 291998 - RNA, 22 nt, Human
uuccuggccccaccccuggaga

SEQ ID NO: 291999 - RNA, 22 nt, Human
caggcauaucuacauuauccaa

SEQ ID NO: 292000 - RNA, 22 nt, Human
ugucuuuaagcaaacaguguuu

SEQ ID NO: 292001 - RNA, 22 nt, Human
agaaacucauccuggagaugac

SEQ ID NO: 292002 - RNA, 22 nt, Human
aagguugcagcaguguugauga

SEQ ID NO: 292003 - RNA, 21 nt, Human
uggcugacucuuccuaucauu

SEQ ID NO: 292004 - RNA, 22 nt, Human
uuguagcuagguuuuuguagaa

SEQ ID NO: 292005 - RNA, 22 nt, Human
gccuggagggauagaaugcaag

SEQ ID NO: 292006 - RNA, 23 nt, Human
accaugaugggagugcaaauaag

SEQ ID NO: 292007 - RNA, 22 nt, Human
ucucuagggaucuguuuuaauu

SEQ ID NO: 292008 - RNA, 21 nt, Human
uucaauacuauuucaauaguc

SEQ ID NO: 292009 - RNA, 22 nt, Human
ugacaauugugggcaguuugug

SEQ ID NO: 292010 - RNA, 22 nt, Human
uucagcaaauggacuguucagg

SEQ ID NO: 292011 - RNA, 22 nt, Human
uuccuggcacccuggacccggc

SEQ ID NO: 292012 - RNA, 22 nt, Human
cauuuauucauuugcuagggcu

SEQ ID NO: 292013 - RNA, 22 nt, Human
aggccuccagccacaugccagu

SEQ ID NO: 292014 - RNA, 22 nt, Human
uagcacagcuucuugaugucac

SEQ ID NO: 292015 - RNA, 22 nt, Human
gcuggcaggguucucacugaaa

SEQ ID NO: 292016 - RNA, 22 nt, Human
uacaaaaguaauuacgguuuuu

SEQ ID NO: 292017 - RNA, 22 nt, Human
uuucuguuguuggugucuggcu

SEQ ID NO: 292018 - RNA, 22 nt, Human
aaagauuucagaagccugugcc

SEQ ID NO: 292019 - RNA, 22 nt, Human
cgcagguguucaguaaauguau

SEQ ID NO: 292020 - RNA, 22 nt, Human
ggugcaaaaguaauuugguuuu

SEQ ID NO: 292021 - RNA, 22 nt, Human
cucugcccucacuuggggccug

SEQ ID NO: 292022 - RNA, 22 nt, Human
aaacucuguagcuaaacauaau

SEQ ID NO: 292023 - RNA, 22 nt, Human
uuccuacaucaccagggggagu

SEQ ID NO: 292024 - RNA, 22 nt, Human
cuucuucaagagaaugggagac

SEQ ID NO: 292025 - RNA, 22 nt, Human
ucagcuuuugucagaaauugua

SEQ ID NO: 292026 - RNA, 22 nt, Human
ggcuuuaugcacagcagauggu

SEQ ID NO: 292027 - RNA, 22 nt, Human
ucaguuaaugguaagggugaaa

SEQ ID NO: 292028 - RNA, 22 nt, Human
ucugggugugguaucuuagcca

SEQ ID NO: 292029 - RNA, 22 nt, Human
uuuuuaucuacagauucucagc

SEQ ID NO: 292030 - RNA, 22 nt, Human
uuggaggaaagaagguugauau

SEQ ID NO: 292031 - RNA, 20 nt, Human
guauuagguguuccucuuuc

SEQ ID NO: 292032 - RNA, 22 nt, Human
ugcauaaaacaugauuucugcu

SEQ ID NO: 292033 - RNA, 22 nt, Human
uguccagagucacagagcucaa

SEQ ID NO: 292034 - RNA, 22 nt, Human
aacugucuugccuacucagcau

SEQ ID NO: 292035 - RNA, 22 nt, Human
gcacuuuaaauguucacggaaa

SEQ ID NO: 292036 - RNA, 22 nt, Human
cucuggccgcagcucagcucug

SEQ ID NO: 292037 - RNA, 22 nt, Human
uuugaaauaugugaugagagag

SEQ ID NO: 292038 - RNA, 21 nt, Human
ucagaacuggugcagaugaau

SEQ ID NO: 292039 - RNA, 22 nt, Human
cagggauggagagacuacuggc

SEQ ID NO: 292040 - RNA, 22 nt, Human
agaggaggcuggguccagauaa

SEQ ID NO: 292041 - RNA, 22 nt, Human
caggugguuugauaggauaacu

SEQ ID NO: 292042 - RNA, 20 nt, Human
uccuucugaggugaggagga

SEQ ID NO: 292043 - RNA, 22 nt, Human
uaagagaacuggauagauagga

SEQ ID NO: 292044 - RNA, 18 nt, Human
aaagcuguuauuccagaa

SEQ ID NO: 292045 - RNA, 22 nt, Human
auuuucaugacuaccuuaaaua

SEQ ID NO: 292046 - RNA, 20 nt, Human
uccaggagguuaguguggcu

SEQ ID NO: 292047 - RNA, 22 nt, Human
aggcugcuucagcugcagggag

SEQ ID NO: 292048 - RNA, 22 nt, Human
cccagggaagggcuaccugagg

SEQ ID NO: 292049 - RNA, 22 nt, Human
cuccagauguauacuuuccaag

SEQ ID NO: 292050 - RNA, 22 nt, Human
uccugggcagccucucuggaag

SEQ ID NO: 292051 - RNA, 22 nt, Human
ugcagggaauccagucuagggu

SEQ ID NO: 292052 - RNA, 22 nt, Human
uucauugcaguucuucagguua

SEQ ID NO: 292053 - RNA, 23 nt, Human
aaggugucauugaugggauucua

SEQ ID NO: 292054 - RNA, 22 nt, Human
acuguggcacuaggcaccuuac

SEQ ID NO: 292055 - RNA, 22 nt, Human
ucuagaaaaacaaaguaucuga

SEQ ID NO: 292056 - RNA, 17 nt, Human
gcccacccuuaggagcu

SEQ ID NO: 292057 - RNA, 22 nt, Human
aggacauguuuguaucuuccuu

SEQ ID NO: 292058 - RNA, 22 nt, Human
ucagugucagucuuuuagauau

SEQ ID NO: 292059 - RNA, 22 nt, Human
agcugcaaaggcacacuugggc

SEQ ID NO: 292060 - RNA, 22 nt, Human
uaagguuuguggggagcaaaag

SEQ ID NO: 292061 - RNA, 22 nt, Human
cauccugguuaccccauaguca

SEQ ID NO: 292062 - RNA, 20 nt, Human
agguguccuguagcuugagu

SEQ ID NO: 292063 - RNA, 22 nt, Human
cauuuguuaagaaggaaaaagg

SEQ ID NO: 292064 - RNA, 22 nt, Human
uuauuuucuccucagaaagugg

SEQ ID NO: 292065 - RNA, 22 nt, Human
aacuugguaccaccuucugaag

SEQ ID NO: 292066 - RNA, 22 nt, Human
auucagugugagguuuucaagu

SEQ ID NO: 292067 - RNA, 22 nt, Human
aaggccuuugccccgauacagg

SEQ ID NO: 292068 - RNA, 22 nt, Human
acuuucuuaggcuguauaaaug

SEQ ID NO: 292069 - RNA, 22 nt, Human
ggaaggguuuaagcaggagagu

SEQ ID NO: 292070 - RNA, 22 nt, Human
gcacaggaugauggguugaggg

SEQ ID NO: 292071 - RNA, 22 nt, Human
gauuuauugucccuguccugcu

SEQ ID NO: 292072 - RNA, 22 nt, Human
agcagggcaugaauaaggguuu

SEQ ID NO: 292073 - RNA, 22 nt, Human
caucagugagccccuugaugag

SEQ ID NO: 292074 - RNA, 22 nt, Human
uugaaaauaucacaggagcagc

SEQ ID NO: 292075 - RNA, 22 nt, Human
ucaugcaguuugaaguucaggg

SEQ ID NO: 292076 - RNA, 22 nt, Human
aaaguaaccuaguaauaguguc

SEQ ID NO: 292077 - RNA, 22 nt, Human
auacuacacauugacuauauuu

SEQ ID NO: 292078 - RNA, 22 nt, Human
cucuucaaaagucuaauccuua

SEQ ID NO: 292079 - RNA, 22 nt, Human
cugaggaguuucuuauaugugu

SEQ ID NO: 292080 - RNA, 22 nt, Human
uuuguacauguaagauugcauc

SEQ ID NO: 292081 - RNA, 22 nt, Human
cacaugugugcugaggacugug

SEQ ID NO: 292082 - RNA, 22 nt, Human
gugccaggugcuaagcugugcu

SEQ ID NO: 292083 - RNA, 22 nt, Human
agucucaaguguuaguauuauu

SEQ ID NO: 292084 - RNA, 21 nt, Human
ucuaaugacauccucugacaa

SEQ ID NO: 292085 - RNA, 22 nt, Human
aucaaaguaauuaacacugaga

SEQ ID NO: 292086 - RNA, 22 nt, Human
uggaaauacaagaaguauguca

SEQ ID NO: 292087 - RNA, 22 nt, Human
ucuacauuuuaacaagaugccc

SEQ ID NO: 292088 - RNA, 22 nt, Human
cuccuggcuucugaaaucgugg

SEQ ID NO: 292089 - RNA, 22 nt, Human
ucaauuucuugguuugauaaua

SEQ ID NO: 292090 - RNA, 22 nt, Human
uaacauuugcugucuccuaugu

SEQ ID NO: 292091 - RNA, 18 nt, Human
gccugccaacuccugauc

SEQ ID NO: 292092 - RNA, 22 nt, Human
ccuggcagcuaagugcuuugag

SEQ ID NO: 292093 - RNA, 22 nt, Human
gggcugaccccaccccucacuc

SEQ ID NO: 292094 - RNA, 22 nt, Human
augucacuguuuaccagcucca

SEQ ID NO: 292095 - RNA, 22 nt, Human
agaaagacaaaaugcaguggcu

SEQ ID NO: 292096 - RNA, 22 nt, Human
aggcaguguucuucuaagggca

SEQ ID NO: 292097 - RNA, 22 nt, Human
gaaaagaguccugugugaggag

SEQ ID NO: 292098 - RNA, 22 nt, Human
uucuucaacaaggacacuguua

SEQ ID NO: 292099 - RNA, 22 nt, Human
acagacauuuuaagacacuuua

SEQ ID NO: 292100 - RNA, 21 nt, Human
cagaggcaggcucugugugug

SEQ ID NO: 292101 - RNA, 22 nt, Human
gugaccagccagugcugucugu

SEQ ID NO: 292102 - RNA, 22 nt, Human
gagucaggcuagaggugagucu

SEQ ID NO: 292103 - RNA, 22 nt, Human
aaggcagucaguuguuuugaaa

SEQ ID NO: 292104 - RNA, 22 nt, Human
ucauguuauugacucauaauau

SEQ ID NO: 292105 - RNA, 18 nt, Human
aaaaagugcucaggccua

SEQ ID NO: 292106 - RNA, 21 nt, Human
uuucuguccuuuccaucagcu

SEQ ID NO: 292107 - RNA, 22 nt, Human
ccagggcaggagaaagacucac

SEQ ID NO: 292108 - RNA, 22 nt, Human
auuacaguaacagcuacaaugc

SEQ ID NO: 292109 - RNA, 22 nt, Human
ugagaaggaaacaauggcuuuu

SEQ ID NO: 292110 - RNA, 22 nt, Human
ugacaggugauugugaacuaag

SEQ ID NO: 292111 - RNA, 22 nt, Human
uacaacauaacgggcauucagu

SEQ ID NO: 292112 - RNA, 22 nt, Human
auauacagggagaaacagcuua

SEQ ID NO: 292113 - RNA, 21 nt, Human
ugacagcauagagcagggagg

SEQ ID NO: 292114 - RNA, 22 nt, Human
acaguacauaauccugagucug

SEQ ID NO: 292115 - RNA, 22 nt, Human
uuguguacuguugguugauauu

SEQ ID NO: 292116 - RNA, 22 nt, Human
uccuggcacaacccuuuaccag

SEQ ID NO: 292117 - RNA, 17 nt, Human
ggccacagagcuugggg

SEQ ID NO: 292118 - RNA, 22 nt, Human
auccugaggaaggugcagagau

SEQ ID NO: 292119 - RNA, 22 nt, Human
uaagacugugagcucagagacu

SEQ ID NO: 292120 - RNA, 22 nt, Human
ucaggcaggaagggaggacuug

SEQ ID NO: 292121 - RNA, 22 nt, Human
cagaggccuggcuuggacaccu

SEQ ID NO: 292122 - RNA, 22 nt, Human
aacaagucauuccauuugacag

SEQ ID NO: 292123 - RNA, 22 nt, Human
ccagggcagcgccccuccacgc

SEQ ID NO: 292124 - RNA, 22 nt, Human
ugaaucaugccacugagcuccc

SEQ ID NO: 292125 - RNA, 22 nt, Human
ggacaaaaaucagccaucucua

SEQ ID NO: 292126 - RNA, 20 nt, Human
ugcagguguguccaagcacu

SEQ ID NO: 292127 - RNA, 22 nt, Human
ucuucuccuuugccauguguuu

SEQ ID NO: 292128 - RNA, 22 nt, Human
cucuggaauguuuacaugcccu

SEQ ID NO: 292129 - RNA, 22 nt, Human
cuuuaagagaucaccaaucaca

SEQ ID NO: 292130 - RNA, 22 nt, Human
uuuucauuuacauuagggaaga

SEQ ID NO: 292131 - RNA, 22 nt, Human
ggcaaacagacuugaccaucuu

SEQ ID NO: 292132 - RNA, 22 nt, Human
uggucucugcaggccaggcuca

SEQ ID NO: 292133 - RNA, 22 nt, Human
acuccuggggcugccaucacag

SEQ ID NO: 292134 - RNA, 22 nt, Human
agcuuuaugcuuccuacaagcu

SEQ ID NO: 292135 - RNA, 22 nt, Human
cagauucugggcccagcuuguc

SEQ ID NO: 292136 - RNA, 22 nt, Human
gggcaggugauuuuggcuccau

SEQ ID NO: 292137 - RNA, 22 nt, Human
cguggggcggguggacacuugc

SEQ ID NO: 292138 - RNA, 22 nt, Human
uucacauuuacugguuuguccg

SEQ ID NO: 292139 - RNA, 22 nt, Human
acggugcuggguauugggguuc

SEQ ID NO: 292140 - RNA, 22 nt, Human
agguauuucaaagcccacuucc

SEQ ID NO: 292141 - RNA, 23 nt, Human
ucucagaaaggagaaguaauuug

SEQ ID NO: 292142 - RNA, 22 nt, Human
cagacagguugcaaaacuucaa

SEQ ID NO: 292143 - RNA, 22 nt, Human
cauuagggucucucagcugaau

SEQ ID NO: 292144 - RNA, 22 nt, Human
acaaggagagcacacaugggga

SEQ ID NO: 292145 - RNA, 22 nt, Human
ucccagagguugagucacuuau

SEQ ID NO: 292146 - RNA, 23 nt, Human
uggcaaggaaugggauggagacu

SEQ ID NO: 292147 - RNA, 22 nt, Human
cagccagagaaagggcacugcc

SEQ ID NO: 292148 - RNA, 22 nt, Human
uacugugggauguugugauuag

SEQ ID NO: 292149 - RNA, 22 nt, Human
acagguggcacugcuguuacuc

SEQ ID NO: 292150 - RNA, 22 nt, Human
gcugaaaucccagcauucccca

SEQ ID NO: 292151 - RNA, 22 nt, Human
uuccaugcaagaaguauggcuc

SEQ ID NO: 292152 - RNA, 22 nt, Human
cuuaaacaggaaagagccaggu

SEQ ID NO: 292153 - RNA, 22 nt, Human
aucauuucccuuuagaucacaa

SEQ ID NO: 292154 - RNA, 22 nt, Human
acacuguuccacacuaagaagg

SEQ ID NO: 292155 - RNA, 22 nt, Human
ucauggauuaaauuauuaaguu

SEQ ID NO: 292156 - RNA, 22 nt, Human
acagggcagagaggcaggcuug

SEQ ID NO: 292157 - RNA, 23 nt, Human
ugguggcagaaguagcagaugac

SEQ ID NO: 292158 - RNA, 22 nt, Human
ucuggcaggucaaucauucuuu

SEQ ID NO: 292159 - RNA, 21 nt, Human
uauacaugugugcauacgugu

SEQ ID NO: 292160 - RNA, 22 nt, Human
uggcccaggggcucuugguguu

SEQ ID NO: 292161 - RNA, 23 nt, Human
cauccaggagcugagucugacug

SEQ ID NO: 292162 - RNA, 22 nt, Human
agcuccugcucuuugucccuaa

SEQ ID NO: 292163 - RNA, 22 nt, Human
cagucucugugccagauccugg

SEQ ID NO: 292164 - RNA, 22 nt, Human
acugccuguagcucuucaucuc

SEQ ID NO: 292165 - RNA, 22 nt, Human
cuacuucuugaucugucgaccu

SEQ ID NO: 292166 - RNA, 22 nt, Human
ucuggguggcugccaaucugcc

SEQ ID NO: 292167 - RNA, 22 nt, Human
ugcagguguagaguugggcucc

SEQ ID NO: 292168 - RNA, 22 nt, Human
agcuaggauaagcagagacugg

SEQ ID NO: 292169 - RNA, 22 nt, Human
uacaguuuaacacuuuggagaa

SEQ ID NO: 292170 - RNA, 22 nt, Human
aaguccaguuucauuugagguc

SEQ ID NO: 292171 - RNA, 22 nt, Human
ugucagagagcaggcaguagaa

SEQ ID NO: 292172 - RNA, 22 nt, Human
uguuucaugauugcugucauuu

SEQ ID NO: 292173 - RNA, 22 nt, Human
acaugagagaaaaguauucuga

SEQ ID NO: 292174 - RNA, 22 nt, Human
gggagggaggugaugcuuggcu

SEQ ID NO: 292175 - RNA, 22 nt, Human
agaggcaugaucuuauaauuua

SEQ ID NO: 292176 - RNA, 22 nt, Human
uuguuucugaguuuucauguau

SEQ ID NO: 292177 - RNA, 22 nt, Human
guccuggcaccucacuggcuac

SEQ ID NO: 292178 - RNA, 22 nt, Human
uuucuagggcucuugucuucug

SEQ ID NO: 292179 - RNA, 22 nt, Human
gagcacugauuuauuuuugucu

SEQ ID NO: 292180 - RNA, 21 nt, Human
aucuggaaauucugccagaga

SEQ ID NO: 292181 - RNA, 22 nt, Human
gaggugguuuguggugacucau

SEQ ID NO: 292182 - RNA, 22 nt, Human
ucauuuaauugguuuugcucgu

SEQ ID NO: 292183 - RNA, 22 nt, Human
gggcagguguuuccaaggugag

SEQ ID NO: 292184 - RNA, 22 nt, Human
ucuccugguauguaugcaccug

SEQ ID NO: 292185 - RNA, 22 nt, Human
agcagggcuggauuuggcaaga

SEQ ID NO: 292186 - RNA, 22 nt, Human
ugcccagcacccagcaugaugc

SEQ ID NO: 292187 - RNA, 22 nt, Human
acaguguccccagcucugugag

SEQ ID NO: 292188 - RNA, 22 nt, Human
uuugaaucugauauggcagcau

SEQ ID NO: 292189 - RNA, 22 nt, Human
gaggagcugagccacguccugg

SEQ ID NO: 292190 - RNA, 22 nt, Human
ucaguuugaauguuagcacagu

SEQ ID NO: 292191 - RNA, 22 nt, Human
uggggucccacucagcuccccu

SEQ ID NO: 292192 - RNA, 22 nt, Human
aagagccagcuagugaagaggc

SEQ ID NO: 292193 - RNA, 18 nt, Human
gcuccugguuggaaagaa

SEQ ID NO: 292194 - RNA, 20 nt, Human
gcuggcagaugucuugagau

SEQ ID NO: 292195 - RNA, 23 nt, Human
gugcgccaggacaaccugacgga

SEQ ID NO: 292196 - RNA, 22 nt, Human
cuacaaaaguaauugugguuuu

SEQ ID NO: 292197 - RNA, 22 nt, Human
uccugagcaacacagcuaagug

SEQ ID NO: 292198 - RNA, 22 nt, Human
aagggcagggaguuugugucua

SEQ ID NO: 292199 - RNA, 22 nt, Human
ccuggcccuggaauagggcagg

SEQ ID NO: 292200 - RNA, 22 nt, Human
aggcagguguuaccucugguuu

SEQ ID NO: 292201 - RNA, 18 nt, Human
ccagcaugccagaggcug

SEQ ID NO: 292202 - RNA, 22 nt, Human
aucaagaauugggagcuauuga

SEQ ID NO: 292203 - RNA, 23 nt, Human
uauuacaauuggucuuauuaaga

SEQ ID NO: 292204 - RNA, 22 nt, Human
aagugguuugagcacagugcug

SEQ ID NO: 292205 - RNA, 22 nt, Human
uugaagaguuugauagaguuga

SEQ ID NO: 292206 - RNA, 20 nt, Human
uauuugaaauggccaagugu

SEQ ID NO: 292207 - RNA, 22 nt, Human
auguccaagucacagauuuuca

SEQ ID NO: 292208 - RNA, 22 nt, Human
ccuggcuccgugucacgugccc

SEQ ID NO: 292209 - RNA, 22 nt, Human
acauguguaaaaguggauaaaa

SEQ ID NO: 292210 - RNA, 22 nt, Human
ugcacuccaggcugggugacag

SEQ ID NO: 292211 - RNA, 22 nt, Human
aaaucacugauuaaaguuagaa

SEQ ID NO: 292212 - RNA, 22 nt, Human
ucagagcuuaucucuugcugga

SEQ ID NO: 292213 - RNA, 22 nt, Human
uuauuuauguuaacagucgaga

SEQ ID NO: 292214 - RNA, 22 nt, Human
uauuuagaugcauuuggauugc

SEQ ID NO: 292215 - RNA, 22 nt, Human
uuuucuagggugcuaaaugaac

SEQ ID NO: 292216 - RNA, 22 nt, Human
ugagccagguuaagacaggagc

SEQ ID NO: 292217 - RNA, 22 nt, Human
ucagggacgugagcucagaguc

SEQ ID NO: 292218 - RNA, 22 nt, Human
gagaagcaaucaguggccaccc

SEQ ID NO: 292219 - RNA, 22 nt, Human
acaaaguauuuuuagguuugua

SEQ ID NO: 292220 - RNA, 22 nt, Human
ccugucacgaugacugcacucu

SEQ ID NO: 292221 - RNA, 22 nt, Human
aaaagucugcuuucuauuauca

SEQ ID NO: 292222 - RNA, 22 nt, Human
agaguuaaggccacugucagua

SEQ ID NO: 292223 - RNA, 22 nt, Human
ugcagguggacacgggagacgg

SEQ ID NO: 292224 - RNA, 22 nt, Human
aaaaucuggcaacacuaaguuu

SEQ ID NO: 292225 - RNA, 22 nt, Human
aaaagcagaccacgcuuugugg

SEQ ID NO: 292226 - RNA, 22 nt, Human
ccugacaggagaagcgcagcau

SEQ ID NO: 292227 - RNA, 22 nt, Human
uuaacaauagaguuucuucagg

SEQ ID NO: 292228 - RNA, 22 nt, Human
agcagguguauauaaggcugag

SEQ ID NO: 292229 - RNA, 22 nt, Human
auguauuugcguauggacauac

SEQ ID NO: 292230 - RNA, 22 nt, Human
uuugaaauaugaggcauuauga

SEQ ID NO: 292231 - RNA, 22 nt, Human
uuccuggcgccacggagccggu

SEQ ID NO: 292232 - RNA, 22 nt, Human
gggcuuggcucauaaguggaug

SEQ ID NO: 292233 - RNA, 22 nt, Human
cccaggcagaauuaguguuuca

SEQ ID NO: 292234 - RNA, 22 nt, Human
cuuucccacgcaguggaugaga

SEQ ID NO: 292235 - RNA, 22 nt, Human
cucuuaaauaacaucauugcuu

SEQ ID NO: 292236 - RNA, 22 nt, Human
ucagcuuucuauguugcuaaac

SEQ ID NO: 292237 - RNA, 22 nt, Human
auacuuuggucacuauuauugg

SEQ ID NO: 292238 - RNA, 22 nt, Human
ucugugugguaguuucagugaa

SEQ ID NO: 292239 - RNA, 22 nt, Human
uguucuugagccuuuagaccua

SEQ ID NO: 292240 - RNA, 22 nt, Human
uuuuacaggugugagccaccau

SEQ ID NO: 292241 - RNA, 22 nt, Human
ccuggcucucugcagauccugg

SEQ ID NO: 292242 - RNA, 22 nt, Human
gaugaaaaucuugagaugucga

SEQ ID NO: 292243 - RNA, 22 nt, Human
guuucauuaccugacccaugag

SEQ ID NO: 292244 - RNA, 22 nt, Human
caggaggccaacugugggacuu

SEQ ID NO: 292245 - RNA, 22 nt, Human
cuauaauuaugcucaaaaugua

SEQ ID NO: 292246 - RNA, 22 nt, Human
uugaauggcuucuagguucucc

SEQ ID NO: 292247 - RNA, 22 nt, Human
uuggaugagguugagaaucauu

SEQ ID NO: 292248 - RNA, 22 nt, Human
aggaaacugaagcccagagagg

SEQ ID NO: 292249 - RNA, 22 nt, Human
uuccuucuagagcuuguuuagg

SEQ ID NO: 292250 - RNA, 22 nt, Human
cccaggcagcccuucugacgca

SEQ ID NO: 292251 - RNA, 22 nt, Human
ucccagggugaaaugcaguagg

SEQ ID NO: 292252 - RNA, 17 nt, Human
cacaggugugguuugag

SEQ ID NO: 292253 - RNA, 22 nt, Human
uaggccucaggaccccagggcu

SEQ ID NO: 292254 - RNA, 22 nt, Human
aaguuacauuuuggucuaauug

SEQ ID NO: 292255 - RNA, 22 nt, Human
ucagggcaaaagggaaaccauu

SEQ ID NO: 292256 - RNA, 22 nt, Human
cccuguuuaagaaaccuguaaa

SEQ ID NO: 292257 - RNA, 20 nt, Human
acacacagagacaugcgcau

SEQ ID NO: 292258 - RNA, 22 nt, Human
aaggcauacauauuguuauagg

SEQ ID NO: 292259 - RNA, 22 nt, Human
uagggacacugcucaugaguuc

SEQ ID NO: 292260 - RNA, 22 nt, Human
gccugcagccccucugcaguag

SEQ ID NO: 292261 - RNA, 22 nt, Human
auaaauugugcuuuugacaucu

SEQ ID NO: 292262 - RNA, 22 nt, Human
cccacaggcaggggcagagaca

SEQ ID NO: 292263 - RNA, 22 nt, Human
auuuggcaacauuaauugaauc

SEQ ID NO: 292264 - RNA, 19 nt, Human
ugcagccacgugagagacu

SEQ ID NO: 292265 - RNA, 22 nt, Human
ggucacugcccucccuuuugca

SEQ ID NO: 292266 - RNA, 22 nt, Human
ccuguucaagggaugauugacc

SEQ ID NO: 292267 - RNA, 22 nt, Human
ugaaguaggcagcaugcugaga

SEQ ID NO: 292268 - RNA, 22 nt, Human
ucuuucauucuagucugagguu

SEQ ID NO: 292269 - RNA, 22 nt, Human
caggccugaguguggaagucuu

SEQ ID NO: 292270 - RNA, 22 nt, Human
uuacacuuuugacaaaccugag

SEQ ID NO: 292271 - RNA, 22 nt, Human
uagcucaaagguuaagugugga

SEQ ID NO: 292272 - RNA, 22 nt, Human
acacuaaugagaaaggaauuaa

SEQ ID NO: 292273 - RNA, 22 nt, Human
cugguccuaaagcccuacucca

SEQ ID NO: 292274 - RNA, 22 nt, Human
gcuggcagggugguugagagag

SEQ ID NO: 292275 - RNA, 22 nt, Human
agucaguguucuggguuguaau

SEQ ID NO: 292276 - RNA, 17 nt, Human
cuacuucuucuauucuu

SEQ ID NO: 292277 - RNA, 22 nt, Human
cagacacacaagcaaucuaagu

SEQ ID NO: 292278 - RNA, 19 nt, Human
uuagggacaugaauucuag

SEQ ID NO: 292279 - RNA, 22 nt, Human
cagggcaguuuuacuucucucu

SEQ ID NO: 292280 - RNA, 22 nt, Human
aggguggcaccacauaucauag

SEQ ID NO: 292281 - RNA, 22 nt, Human
aggcugugaguuuugucucaga

SEQ ID NO: 292282 - RNA, 22 nt, Human
augugcaaauccaaugugaaug

SEQ ID NO: 292283 - RNA, 22 nt, Human
ccagugcccagcugcccaggca

SEQ ID NO: 292284 - RNA, 22 nt, Human
aggcucccaagcacugacccca

SEQ ID NO: 292285 - RNA, 22 nt, Human
cuggccucuguguucaccauag

SEQ ID NO: 292286 - RNA, 22 nt, Human
uguuacagggauaaaugaggua

SEQ ID NO: 292287 - RNA, 22 nt, Human
gcaaauauucaagacuuuucca

SEQ ID NO: 292288 - RNA, 22 nt, Human
aaggcugcuuuuaacaugcaua

SEQ ID NO: 292289 - RNA, 22 nt, Human
uccugcagguggaugauucucu

SEQ ID NO: 292290 - RNA, 22 nt, Human
caggacagugcagguccauccu

SEQ ID NO: 292291 - RNA, 22 nt, Human
aaaucucaauuugaauuguagc

SEQ ID NO: 292292 - RNA, 22 nt, Human
cucagcaauuaccugugucucu

SEQ ID NO: 292293 - RNA, 22 nt, Human
ccaggcccugcuccucacacca

SEQ ID NO: 292294 - RNA, 22 nt, Human
ugggugggagcgcccugucugg

SEQ ID NO: 292295 - RNA, 22 nt, Human
gccaggcauucuagaaguagug

SEQ ID NO: 292296 - RNA, 22 nt, Human
gcaggugugcugaauuacguga

SEQ ID NO: 292297 - RNA, 22 nt, Human
uccaggaguccugggagugauu

SEQ ID NO: 292298 - RNA, 22 nt, Human
cuguccugugucagccugaaau

SEQ ID NO: 292299 - RNA, 22 nt, Human
aauguauucucuuuauaagaua

SEQ ID NO: 292300 - RNA, 22 nt, Human
uggaccacucuggugcccaugu

SEQ ID NO: 292301 - RNA, 22 nt, Human
ggacaggugugaggcuggcaca

SEQ ID NO: 292302 - RNA, 22 nt, Human
uagcaaacucauacaugugggu

SEQ ID NO: 292303 - RNA, 22 nt, Human
caggccugggcuucggggcuga

SEQ ID NO: 292304 - RNA, 22 nt, Human
augcuuguacuaaaaaaauauu

SEQ ID NO: 292305 - RNA, 22 nt, Human
auggcuuggcaccaucuccuug

SEQ ID NO: 292306 - RNA, 21 nt, Human
ccuggcagaagccugauaugc

SEQ ID NO: 292307 - RNA, 22 nt, Human
cagcacuucagcauucagauuu

SEQ ID NO: 292308 - RNA, 23 nt, Human
gcaggugguucgaacagaaguuu

SEQ ID NO: 292309 - RNA, 22 nt, Human
acagaaaaugccagaagggugg

SEQ ID NO: 292310 - RNA, 22 nt, Human
ucucugugcccaguaguucucu

SEQ ID NO: 292311 - RNA, 22 nt, Human
gacuuuauuauaguggcaauag

SEQ ID NO: 292312 - RNA, 22 nt, Human
uccaagagaauacuggagagua

SEQ ID NO: 292313 - RNA, 22 nt, Human
auguuacacauaggcauaaaug

SEQ ID NO: 292314 - RNA, 22 nt, Human
acaaagcuuagaccuaagagau

SEQ ID NO: 292315 - RNA, 22 nt, Human
cagagcugguguuacaagucca

SEQ ID NO: 292316 - RNA, 22 nt, Human
uguucucucuccuuuugaagug

SEQ ID NO: 292317 - RNA, 20 nt, Human
acuagaaagucacugggggg

SEQ ID NO: 292318 - RNA, 22 nt, Human
gaaggccucacucugcagcaua

SEQ ID NO: 292319 - RNA, 19 nt, Human
uucacauuuugcucugagg

SEQ ID NO: 292320 - RNA, 22 nt, Human
acuuccuuuugggaaacuguuu

SEQ ID NO: 292321 - RNA, 22 nt, Human
cccacccugggcuacacaucca

SEQ ID NO: 292322 - RNA, 22 nt, Human
aguuuccaaagcauguucacac

SEQ ID NO: 292323 - RNA, 22 nt, Human
ugcuggcuuuaagguuaaagug

SEQ ID NO: 292324 - RNA, 22 nt, Human
aaagaaucagaagucucaaaca

SEQ ID NO: 292325 - RNA, 22 nt, Human
agcagggcagugcuucagcucu

SEQ ID NO: 292326 - RNA, 22 nt, Human
ucacaaauauuuuaacaguagg

SEQ ID NO: 292327 - RNA, 22 nt, Human
ggcuguggggccggguacagug

SEQ ID NO: 292328 - RNA, 21 nt, Human
agaauuaaauuggauuugugu

SEQ ID NO: 292329 - RNA, 23 nt, Human
aucugaaaagcauuugcaguuug

SEQ ID NO: 292330 - RNA, 22 nt, Human
aggcacaggaggugguaagaag

SEQ ID NO: 292331 - RNA, 22 nt, Human
acagguguugacucacaggccc

SEQ ID NO: 292332 - RNA, 22 nt, Human
uuauugagcacauaguaugugg

SEQ ID NO: 292333 - RNA, 22 nt, Human
aggcuggauuuauggggacuuc

SEQ ID NO: 292334 - RNA, 22 nt, Human
gcuccugggcccugggcuaacu

SEQ ID NO: 292335 - RNA, 22 nt, Human
cacuccuguuccacuaaaugag

SEQ ID NO: 292336 - RNA, 22 nt, Human
cugcuuuagacaacugcuggga

SEQ ID NO: 292337 - RNA, 22 nt, Human
gcuuccucccugcugcucacua

SEQ ID NO: 292338 - RNA, 22 nt, Human
agaagggcuacacgggcucucc

SEQ ID NO: 292339 - RNA, 22 nt, Human
agaaaauuacuccagagacaag

SEQ ID NO: 292340 - RNA, 22 nt, Human
ugcuuuauugcaucaguguggg

SEQ ID NO: 292341 - RNA, 22 nt, Human
cagcuucuucaguccuggagcu

SEQ ID NO: 292342 - RNA, 22 nt, Human
gagagcugggcuuugggugaag

SEQ ID NO: 292343 - RNA, 22 nt, Human
ucugaggcagcuugccacucua

SEQ ID NO: 292344 - RNA, 22 nt, Human
uucucacuauguauguagauug

SEQ ID NO: 292345 - RNA, 22 nt, Human
uagcuuuaagaugagaugugga

SEQ ID NO: 292346 - RNA, 22 nt, Human
cagggcucccugcagccucugu

SEQ ID NO: 292347 - RNA, 22 nt, Human
acccagcuggaugcauggaggc

SEQ ID NO: 292348 - RNA, 22 nt, Human
acacauuuuggcuagguggaga

SEQ ID NO: 292349 - RNA, 22 nt, Human
aaauccuaauaaugcacuagug

SEQ ID NO: 292350 - RNA, 22 nt, Human
uuuaaaaucagaugggaguugg

SEQ ID NO: 292351 - RNA, 22 nt, Human
ggaacuugaaaaucaagguggu

SEQ ID NO: 292352 - RNA, 22 nt, Human
uggcucugagucugcccuuggc

SEQ ID NO: 292353 - RNA, 22 nt, Human
ggcugugggaugcauaggagcu

SEQ ID NO: 292354 - RNA, 22 nt, Human
augcuauguaacuggcagauag

SEQ ID NO: 292355 - RNA, 22 nt, Human
cagugcagaggccagggaggau

SEQ ID NO: 292356 - RNA, 22 nt, Human
ucagggcacugucaccugauau

SEQ ID NO: 292357 - RNA, 22 nt, Human
augcaaacauucgcuugucucu

SEQ ID NO: 292358 - RNA, 22 nt, Human
uuccuggguugugcauuguaca

SEQ ID NO: 292359 - RNA, 22 nt, Human
gaggacuaacuuggcagacgca

SEQ ID NO: 292360 - RNA, 22 nt, Human
uagugaaagucaaagacagcua

SEQ ID NO: 292361 - RNA, 22 nt, Human
uuguuucaggaugguuuguuac

SEQ ID NO: 292362 - RNA, 17 nt, Human
uuauuuuuugggcugag

SEQ ID NO: 292363 - RNA, 22 nt, Human
ucuguggcuaucauacugaagg

SEQ ID NO: 292364 - RNA, 22 nt, Human
uuccaggaggcacugacagagg

SEQ ID NO: 292365 - RNA, 22 nt, Human
cugcacagucauuuccucucaa

SEQ ID NO: 292366 - RNA, 22 nt, Human
guuauaaaaugcacaguuguuu

SEQ ID NO: 292367 - RNA, 22 nt, Human
uuccuaauggcaaaacauguuu

SEQ ID NO: 292368 - RNA, 22 nt, Human
guuauugacauguauuaagcac

SEQ ID NO: 292369 - RNA, 22 nt, Human
uucauagcagucccuuucuggg

SEQ ID NO: 292370 - RNA, 22 nt, Human
agauggucuucauaaguuuuaa

SEQ ID NO: 292371 - RNA, 22 nt, Human
uccaguguuuuucuucacaggu

SEQ ID NO: 292372 - RNA, 22 nt, Human
aagggcucuguugccauuucag

SEQ ID NO: 292373 - RNA, 22 nt, Human
gucuaugauauuuuguuauagc

SEQ ID NO: 292374 - RNA, 22 nt, Human
accacugucuacacauugacuc

SEQ ID NO: 292375 - RNA, 22 nt, Human
aggcuugggucagaaggcuugu

SEQ ID NO: 292376 - RNA, 22 nt, Human
acagaaauugggcaaauggaag

SEQ ID NO: 292377 - RNA, 22 nt, Human
uuccccaguagugacaaucaaa

SEQ ID NO: 292378 - RNA, 21 nt, Human
uucaaugaaaacaaagugagg

SEQ ID NO: 292379 - RNA, 22 nt, Human
aucacaauguacguuaaaaugu

SEQ ID NO: 292380 - RNA, 18 nt, Human
gcagugcaggaagaagag

SEQ ID NO: 292381 - RNA, 22 nt, Human
ccagguguagcacugcucacag

SEQ ID NO: 292382 - RNA, 22 nt, Human
cagcaggacauggaggaguaaa

SEQ ID NO: 292383 - RNA, 22 nt, Human
gggauggggagcuggaaagggg

SEQ ID NO: 292384 - RNA, 22 nt, Human
gguuucaaugagaagugcuugu

SEQ ID NO: 292385 - RNA, 22 nt, Human
aaagaaauaccuuucucagcuu

SEQ ID NO: 292386 - RNA, 18 nt, Human
agcagguggauuuauugg

SEQ ID NO: 292387 - RNA, 22 nt, Human
agccuucucugaaauucuguuu

SEQ ID NO: 292388 - RNA, 22 nt, Human
ugaaagcaugcuugccaagcuu

SEQ ID NO: 292389 - RNA, 22 nt, Human
uauuugagcgaagcaguguuuu

SEQ ID NO: 292390 - RNA, 22 nt, Human
aucuaucaccuuuagguuuguu

SEQ ID NO: 292391 - RNA, 22 nt, Human
ucagagaaguaagguggggugc

SEQ ID NO: 292392 - RNA, 22 nt, Human
augagacuaccuguaauguggc

SEQ ID NO: 292393 - RNA, 22 nt, Human
ugaagaaacgcagagagguagg

SEQ ID NO: 292394 - RNA, 22 nt, Human
cagggcauaagaugaggcugua

SEQ ID NO: 292395 - RNA, 22 nt, Human
uggaaaaaaauuggcuagcuuc

SEQ ID NO: 292396 - RNA, 22 nt, Human
aagggcaggugggcauuucugg

SEQ ID NO: 292397 - RNA, 22 nt, Human
agaaugcaucuaaaagcagaga

SEQ ID NO: 292398 - RNA, 22 nt, Human
ugaaagaagccucccuuuggag

SEQ ID NO: 292399 - RNA, 22 nt, Human
gagacacaaacacauuuagagg

SEQ ID NO: 292400 - RNA, 22 nt, Human
cuccuggagggccaaagaaaua

SEQ ID NO: 292401 - RNA, 22 nt, Human
ccaggaggcagagguuguagug

SEQ ID NO: 292402 - RNA, 22 nt, Human
cuggaugucuuggggacuccug

SEQ ID NO: 292403 - RNA, 22 nt, Human
auguucuuguucaaaugucagu

SEQ ID NO: 292404 - RNA, 22 nt, Human
uuucuuguaagauguuuauuaa

SEQ ID NO: 292405 - RNA, 22 nt, Human
agccuugaguucaagugcuggc

SEQ ID NO: 292406 - RNA, 22 nt, Human
auguacaaaauguuuugaaaug

SEQ ID NO: 292407 - RNA, 22 nt, Human
uugugcuccuaugagaaucuaa

SEQ ID NO: 292408 - RNA, 18 nt, Human
auggcacagucuuucccu

SEQ ID NO: 292409 - RNA, 22 nt, Human
uucacauuguuuuaaugugaau

SEQ ID NO: 292410 - RNA, 22 nt, Human
accugcaguggccacuccuaau

SEQ ID NO: 292411 - RNA, 22 nt, Human
gagauggagucuuuuucuguca

SEQ ID NO: 292412 - RNA, 22 nt, Human
agacgagggcccccaggacagc

SEQ ID NO: 292413 - RNA, 22 nt, Human
ucugccugugguggaggaaguu

SEQ ID NO: 292414 - RNA, 22 nt, Human
agcaggugcauggcgagcgcgg

SEQ ID NO: 292415 - RNA, 22 nt, Human
uacaaauuaaugggcauguuua

SEQ ID NO: 292416 - RNA, 22 nt, Human
uuacuucuugucucaugccuau

SEQ ID NO: 292417 - RNA, 22 nt, Human
auuuccaguccuaaugaucugg

SEQ ID NO: 292418 - RNA, 22 nt, Human
agauacaaaagauaagauuuag

SEQ ID NO: 292419 - RNA, 22 nt, Human
uguugcuguaugaauaggaagg

SEQ ID NO: 292420 - RNA, 23 nt, Human
caggagggaaugaaguuagacaa

SEQ ID NO: 292421 - RNA, 22 nt, Human
ccuguggcugguaguaucguuu

SEQ ID NO: 292422 - RNA, 20 nt, Human
ucaggcaguggggaaaggca

SEQ ID NO: 292423 - RNA, 22 nt, Human
cgcaggugaaagaggcugggca

SEQ ID NO: 292424 - RNA, 22 nt, Human
cugauaauguccugcaguaaau

SEQ ID NO: 292425 - RNA, 22 nt, Human
uuucauuggcucccugaugaau

SEQ ID NO: 292426 - RNA, 22 nt, Human
cagggcucaggcucugggauuc

SEQ ID NO: 292427 - RNA, 22 nt, Human
ugucuucagcaaaugccuuucu

SEQ ID NO: 292428 - RNA, 22 nt, Human
acuuguuugaaucucucuagag

SEQ ID NO: 292429 - RNA, 22 nt, Human
agucagagcaaacuggacagac

SEQ ID NO: 292430 - RNA, 22 nt, Human
ccuuuguucauugccuucaguc

SEQ ID NO: 292431 - RNA, 20 nt, Human
cuggaguguagcaguggcug

SEQ ID NO: 292432 - RNA, 22 nt, Human
caggaaguagaguuggccagcc

SEQ ID NO: 292433 - RNA, 21 nt, Human
acagcauguuuguguguuugc

SEQ ID NO: 292434 - RNA, 22 nt, Human
agagggaacggaucccagcgcg

SEQ ID NO: 292435 - RNA, 22 nt, Human
gagggcagugaauuuugaagcu

SEQ ID NO: 292436 - RNA, 22 nt, Human
ccaguguucauaauuuuacacu

SEQ ID NO: 292437 - RNA, 22 nt, Human
ggcuuucuaugaacucaaaggc

SEQ ID NO: 292438 - RNA, 22 nt, Human
agaggaauaugggugcacuaga

SEQ ID NO: 292439 - RNA, 20 nt, Human
gcaggcagggaaugggggug

SEQ ID NO: 292440 - RNA, 22 nt, Human
ccuggcacagauccuucauaca

SEQ ID NO: 292441 - RNA, 22 nt, Human
acuguggcucaucaggcuggug

SEQ ID NO: 292442 - RNA, 22 nt, Human
ucacauaaauuauacaauuuca

SEQ ID NO: 292443 - RNA, 22 nt, Human
uccucagagcauagcgcugucu

SEQ ID NO: 292444 - RNA, 22 nt, Human
cuugccaguguugcagaagcuc

SEQ ID NO: 292445 - RNA, 22 nt, Human
agcauaaguugguacagccacu

SEQ ID NO: 292446 - RNA, 22 nt, Human
cugacaagguugaauuguccca

SEQ ID NO: 292447 - RNA, 22 nt, Human
ucuucuucccaucccucaaaug

SEQ ID NO: 292448 - RNA, 22 nt, Human
uggcuacauuuauacucucauu

SEQ ID NO: 292449 - RNA, 22 nt, Human
aguggcagaagccaagucugca

SEQ ID NO: 292450 - RNA, 23 nt, Human
ucucugugugccucaguuucuuc

SEQ ID NO: 292451 - RNA, 22 nt, Human
ugcugggucccuugagagcuca

SEQ ID NO: 292452 - RNA, 22 nt, Human
gcauucuucacaguauuccucc

SEQ ID NO: 292453 - RNA, 22 nt, Human
cucuucccagcuccacgagagg

SEQ ID NO: 292454 - RNA, 22 nt, Human
cugcaucacagcaggaggcaca

SEQ ID NO: 292455 - RNA, 22 nt, Human
gaucuuuucagguuucucuagu

SEQ ID NO: 292456 - RNA, 22 nt, Human
cugaaggacuuggugauaguug

SEQ ID NO: 292457 - RNA, 20 nt, Human
auuccucagccccagccuca

SEQ ID NO: 292458 - RNA, 20 nt, Human
augugucuguaaacaacucu

SEQ ID NO: 292459 - RNA, 22 nt, Human
uuuaucuguuccucuuggaggc

SEQ ID NO: 292460 - RNA, 22 nt, Human
gggaccucuggagucggccuua

SEQ ID NO: 292461 - RNA, 22 nt, Human
aaacagauaagggacaauuuca

SEQ ID NO: 292462 - RNA, 22 nt, Human
uuccuggcuggcgguuuuggug

SEQ ID NO: 292463 - RNA, 22 nt, Human
uuuuagacuuguauguaaagcc

SEQ ID NO: 292464 - RNA, 22 nt, Human
cugccguugugaagcucuuaga

SEQ ID NO: 292465 - RNA, 22 nt, Human
acuguccagaagauagaaauau

SEQ ID NO: 292466 - RNA, 22 nt, Human
gugcccaggggccagcugccgg

SEQ ID NO: 292467 - RNA, 22 nt, Human
ucaggugucaagcagggagcug

SEQ ID NO: 292468 - RNA, 23 nt, Human
cccagcugcagacaagggagggu

SEQ ID NO: 292469 - RNA, 22 nt, Human
cauuuaaagguuguggguaaaa

SEQ ID NO: 292470 - RNA, 22 nt, Human
cacagccuuuaggguacacaca

SEQ ID NO: 292471 - RNA, 22 nt, Human
uuggaauuuuccagguacagug

SEQ ID NO: 292472 - RNA, 22 nt, Human
ggcuuuauuauguggccaugug

SEQ ID NO: 292473 - RNA, 22 nt, Human
agcaugaaaacaugaaacagca

SEQ ID NO: 292474 - RNA, 17 nt, Human
uccuggauccauggugg

SEQ ID NO: 292475 - RNA, 22 nt, Human
acagguggcuuccauuuucuaa

SEQ ID NO: 292476 - RNA, 22 nt, Human
uaagaguuagggcuagcaauau

SEQ ID NO: 292477 - RNA, 22 nt, Human
aauacaguaauuuugaugaguu

SEQ ID NO: 292478 - RNA, 22 nt, Human
cugaaagaauaagauguuuaca

SEQ ID NO: 292479 - RNA, 22 nt, Human
gucccaggcuccauggcagcca

SEQ ID NO: 292480 - RNA, 22 nt, Human
ucuugauuacaaauaacaucau

SEQ ID NO: 292481 - RNA, 20 nt, Human
ucaugcagguguucuagguu

SEQ ID NO: 292482 - RNA, 20 nt, Human
ucagguagaucuuugagguc

SEQ ID NO: 292483 - RNA, 22 nt, Human
ugaccagugaucuacugggauu

SEQ ID NO: 292484 - RNA, 22 nt, Human
aaugucuuuuaaauguugaggu

SEQ ID NO: 292485 - RNA, 21 nt, Human
uucuucaggccaaugcucauu

SEQ ID NO: 292486 - RNA, 22 nt, Human
ucugcuucuccuacuucauggg

SEQ ID NO: 292487 - RNA, 22 nt, Human
cuuuaguucuagaaagugaaac

SEQ ID NO: 292488 - RNA, 22 nt, Human
caggcagcccugcaccaagugu

SEQ ID NO: 292489 - RNA, 22 nt, Human
aggcugugacagggucauggag

SEQ ID NO: 292490 - RNA, 22 nt, Human
aggcaccuugagagcaggagcu

SEQ ID NO: 292491 - RNA, 22 nt, Human
aggaaugucgucauaaacauga

SEQ ID NO: 292492 - RNA, 22 nt, Human
gaugcauuacaaaagugauuau

SEQ ID NO: 292493 - RNA, 21 nt, Human
gggcuuuuuauuuagcacugu

SEQ ID NO: 292494 - RNA, 22 nt, Human
uucaguuugaauucuguagaac

SEQ ID NO: 292495 - RNA, 22 nt, Human
ugggaucugcaguuuaacaaaa

SEQ ID NO: 292496 - RNA, 18 nt, Human
aggcccuggccucgaaca

SEQ ID NO: 292497 - RNA, 22 nt, Human
cuccugaguaguagcauuguca

SEQ ID NO: 292498 - RNA, 22 nt, Human
cugccugcuuaccaugcaucag

SEQ ID NO: 292499 - RNA, 22 nt, Human
uuucuacauucaaaaacuacca

SEQ ID NO: 292500 - RNA, 22 nt, Human
ggaugucuaggguuuaugugcc

SEQ ID NO: 292501 - RNA, 22 nt, Human
uauuuccuguggauacuuuuag

SEQ ID NO: 292502 - RNA, 22 nt, Human
acuuaaaaagaaucuuuucacg

SEQ ID NO: 292503 - RNA, 22 nt, Human
aagcacagggugucugcauuca

SEQ ID NO: 292504 - RNA, 21 nt, Human
gugguucuagagaaacagaau

SEQ ID NO: 292505 - RNA, 22 nt, Human
ugcagauucaaaugaaaugcaa

SEQ ID NO: 292506 - RNA, 22 nt, Human
guagggacuuguuuuacuagua

SEQ ID NO: 292507 - RNA, 22 nt, Human
ugacauguauguauuuguuuau

SEQ ID NO: 292508 - RNA, 22 nt, Human
cagcuucaccagggccaugguu

SEQ ID NO: 292509 - RNA, 22 nt, Human
uuggaggauggaguuagcaucu

SEQ ID NO: 292510 - RNA, 22 nt, Human
agcuguggggaggaggcuagca

SEQ ID NO: 292511 - RNA, 20 nt, Human
uuugagaccagucugcccaa

SEQ ID NO: 292512 - RNA, 22 nt, Human
aauuagggaaaacauuugcuuu

SEQ ID NO: 292513 - RNA, 22 nt, Human
ccagguggauaagguuucugga

SEQ ID NO: 292514 - RNA, 22 nt, Human
cgugagcaaaauggacacuccc

SEQ ID NO: 292515 - RNA, 22 nt, Human
uuuccuuccuugcuagccugag

SEQ ID NO: 292516 - RNA, 22 nt, Human
cauaauauacuacauugaugaa

SEQ ID NO: 292517 - RNA, 22 nt, Human
ucugaaauccuuuaucuuggcu

SEQ ID NO: 292518 - RNA, 23 nt, Human
cacaggcugcgcauaagcuucuc

SEQ ID NO: 292519 - RNA, 22 nt, Human
agcauaaaggucaacguuuuag

SEQ ID NO: 292520 - RNA, 17 nt, Human
uggccaggccccgccag

SEQ ID NO: 292521 - RNA, 22 nt, Human
uaaaguguguauauacauaugg

SEQ ID NO: 292522 - RNA, 22 nt, Human
cagccaggacucccauuuagga

SEQ ID NO: 292523 - RNA, 22 nt, Human
ccugagaggcccucucacuguc

SEQ ID NO: 292524 - RNA, 19 nt, Human
uggaccugugcccauggcu

SEQ ID NO: 292525 - RNA, 22 nt, Human
gaggagggccuggugucccuuc

SEQ ID NO: 292526 - RNA, 21 nt, Human
uuguuacaaugcaagaguaug

SEQ ID NO: 292527 - RNA, 22 nt, Human
ggacaaaacuucuugcauuucu

SEQ ID NO: 292528 - RNA, 22 nt, Human
cucuagggcucugugagguugg

SEQ ID NO: 292529 - RNA, 22 nt, Human
auguuuaugaccuccauaagga

SEQ ID NO: 292530 - RNA, 22 nt, Human
caugaaaauaacauuguuguga

SEQ ID NO: 292531 - RNA, 22 nt, Human
uaagacuuccaggaaaaggugg

SEQ ID NO: 292532 - RNA, 17 nt, Human
ucugucuugacugucac

SEQ ID NO: 292533 - RNA, 22 nt, Human
aaaauuauucauggcuuuugga

SEQ ID NO: 292534 - RNA, 17 nt, Human
uucagaagcauuuuggc

SEQ ID NO: 292535 - RNA, 22 nt, Human
acacauuuauggaucgcagaaa

SEQ ID NO: 292536 - RNA, 22 nt, Human
auacuuuagagcuagauugccu

SEQ ID NO: 292537 - RNA, 22 nt, Human
uggcuggagcauuccuugucuu

SEQ ID NO: 292538 - RNA, 22 nt, Human
ugcuuuaucugacuuggcgcug

SEQ ID NO: 292539 - RNA, 22 nt, Human
uuuugcuugagugcacaaaaug

SEQ ID NO: 292540 - RNA, 22 nt, Human
ccauuguaguaucuguuuuagu

SEQ ID NO: 292541 - RNA, 22 nt, Human
uggccucugugggagcugagca

SEQ ID NO: 292542 - RNA, 22 nt, Human
acauuucuuccacaugcugcug

SEQ ID NO: 292543 - RNA, 22 nt, Human
gccucaggccgcccugcugcuc

SEQ ID NO: 292544 - RNA, 22 nt, Human
aagucucugacucacacaaugu

SEQ ID NO: 292545 - RNA, 22 nt, Human
gaugugagugguagcugggauu

SEQ ID NO: 292546 - RNA, 22 nt, Human
ugacccuuagugaacauuagaa

SEQ ID NO: 292547 - RNA, 22 nt, Human
ucucucuucaacccuuaacuag

SEQ ID NO: 292548 - RNA, 22 nt, Human
ugugagcuuaggacagggcuau

SEQ ID NO: 292549 - RNA, 22 nt, Human
uauaauuuuaagugguaaauua

SEQ ID NO: 292550 - RNA, 20 nt, Human
agauuauuccuaagauuucu

SEQ ID NO: 292551 - RNA, 22 nt, Human
ucauguguuaaacuccaagaua

SEQ ID NO: 292552 - RNA, 23 nt, Human
cgcccagccucagugaccugggc

SEQ ID NO: 292553 - RNA, 22 nt, Human
ucugaagaacugucuagagaac

SEQ ID NO: 292554 - RNA, 22 nt, Human
ugacauuuaaucccuaaauauu

SEQ ID NO: 292555 - RNA, 22 nt, Human
acauuaaagaguaagguuaguu

SEQ ID NO: 292556 - RNA, 22 nt, Human
agaaugcuuccuuugaaacuga

SEQ ID NO: 292557 - RNA, 22 nt, Human
cuuggggaugcaaagccagugu

SEQ ID NO: 292558 - RNA, 22 nt, Human
ucucuguguucccuguuuucuc

SEQ ID NO: 292559 - RNA, 22 nt, Human
ugaaaaacuuuaauccauaaag

SEQ ID NO: 292560 - RNA, 22 nt, Human
ucccagggauccuccgggucgc

SEQ ID NO: 292561 - RNA, 20 nt, Human
ucccaaaauucuacuuuauc

SEQ ID NO: 292562 - RNA, 22 nt, Human
auguccagagaacauuugcuuu

SEQ ID NO: 292563 - RNA, 22 nt, Human
gacaagaugagcagcucagugu

SEQ ID NO: 292564 - RNA, 22 nt, Human
aaauggcaguagaaaagaaucc

SEQ ID NO: 292565 - RNA, 22 nt, Human
uuucuagucucgaucucuuaau

SEQ ID NO: 292566 - RNA, 22 nt, Human
cugccuggaccggcagcccucc

SEQ ID NO: 292567 - RNA, 22 nt, Human
aggugggggcuguguccuugac

SEQ ID NO: 292568 - RNA, 22 nt, Human
uguccugggucaaauccugguc

SEQ ID NO: 292569 - RNA, 22 nt, Human
ucuguggauuuuaguguucaug

SEQ ID NO: 292570 - RNA, 22 nt, Human
uaaaagagaauggauaacagag

SEQ ID NO: 292571 - RNA, 22 nt, Human
aggcuuuaaguggccuacagcu

SEQ ID NO: 292572 - RNA, 22 nt, Human
uaguacacucuguaaguuuaaa

SEQ ID NO: 292573 - RNA, 22 nt, Human
uucuaaaauaaguuuaucuggu

SEQ ID NO: 292574 - RNA, 22 nt, Human
uuauagaaggagcauucacuua

SEQ ID NO: 292575 - RNA, 22 nt, Human
agagccaggcggcugggcaccu

SEQ ID NO: 292576 - RNA, 22 nt, Human
ggcuuggaaaugguaaugagcu

SEQ ID NO: 292577 - RNA, 22 nt, Human
caaauagauuguucaauccuga

SEQ ID NO: 292578 - RNA, 23 nt, Human
gucucuagaguguggagcaaaga

SEQ ID NO: 292579 - RNA, 22 nt, Human
agacagaccauggcuauucaga

SEQ ID NO: 292580 - RNA, 22 nt, Human
auucagcaaacauuuauuaucu

SEQ ID NO: 292581 - RNA, 22 nt, Human
cccugccaaucccgucucucug

SEQ ID NO: 292582 - RNA, 22 nt, Human
uccugagcaccuaugccauggc

SEQ ID NO: 292583 - RNA, 22 nt, Human
agcuuccugucuucugcacaaa

SEQ ID NO: 292584 - RNA, 22 nt, Human
ggcucugaagggugacagguuu

SEQ ID NO: 292585 - RNA, 22 nt, Human
auucacauuuacaaagcacuca

SEQ ID NO: 292586 - RNA, 22 nt, Human
uccuucccaggugucgccgccu

SEQ ID NO: 292587 - RNA, 22 nt, Human
ccugagauuggcuaguaugagu

SEQ ID NO: 292588 - RNA, 22 nt, Human
aggcucugcauccaggcuuuau

SEQ ID NO: 292589 - RNA, 22 nt, Human
ucuggccccuggcaguccugga

SEQ ID NO: 292590 - RNA, 22 nt, Human
gcucugaggagccaagaaugug

SEQ ID NO: 292591 - RNA, 22 nt, Human
uggcuguagaaucagagacuug

SEQ ID NO: 292592 - RNA, 22 nt, Human
acuguucauuuguccuguaucu

SEQ ID NO: 292593 - RNA, 22 nt, Human
agucagguacuccgagggcaug

SEQ ID NO: 292594 - RNA, 22 nt, Human
auacacgugccauguuggugug

SEQ ID NO: 292595 - RNA, 22 nt, Human
uagaaacagauguuuuugaaga

SEQ ID NO: 292596 - RNA, 22 nt, Human
agcaggugacccaagcaggcug

SEQ ID NO: 292597 - RNA, 22 nt, Human
ucucacagugcaggucugucuc

SEQ ID NO: 292598 - RNA, 22 nt, Human
aauucauauggauaugcuagua

SEQ ID NO: 292599 - RNA, 22 nt, Human
aaagaucaaguaggcauggccu

SEQ ID NO: 292600 - RNA, 22 nt, Human
aggcuguggcccuggucuagca

SEQ ID NO: 292601 - RNA, 22 nt, Human
uaaagcacgucuauuuaaugau

SEQ ID NO: 292602 - RNA, 23 nt, Human
augaaaugcuggcucagggaggu

SEQ ID NO: 292603 - RNA, 23 nt, Human
aggaaugugcccacccaucuccu

SEQ ID NO: 292604 - RNA, 22 nt, Human
cacauuccugagcuucgaccug

SEQ ID NO: 292605 - RNA, 22 nt, Human
acaaggccaagcauucuagcaa

SEQ ID NO: 292606 - RNA, 22 nt, Human
uuugacauuggcuuauucuguu

SEQ ID NO: 292607 - RNA, 22 nt, Human
agagcaggcauaaagcuuugaa

SEQ ID NO: 292608 - RNA, 22 nt, Human
aaaguggucaccuucucauuuc

SEQ ID NO: 292609 - RNA, 22 nt, Human
cccagaggugcuucagaggugc

SEQ ID NO: 292610 - RNA, 22 nt, Human
caauaauuuacauuggauacca

SEQ ID NO: 292611 - RNA, 22 nt, Human
ggugccacugcacucuggccug

SEQ ID NO: 292612 - RNA, 22 nt, Human
agagccaggacugugucucacu

SEQ ID NO: 292613 - RNA, 22 nt, Human
cagugugcugcagagaacauuu

SEQ ID NO: 292614 - RNA, 21 nt, Human
uucuucaaagaagaaggcaca

SEQ ID NO: 292615 - RNA, 22 nt, Human
cucaggaggaggaaguucauug

SEQ ID NO: 292616 - RNA, 22 nt, Human
guguucugggaugauuguagug

SEQ ID NO: 292617 - RNA, 22 nt, Human
cccagcaggcauguugggagga

SEQ ID NO: 292618 - RNA, 22 nt, Human
guuauuuuaucucugagagguu

SEQ ID NO: 292619 - RNA, 22 nt, Human
aggcuuggagguucuguagcca

SEQ ID NO: 292620 - RNA, 22 nt, Human
caaauuuagguaacagucugua

SEQ ID NO: 292621 - RNA, 22 nt, Human
cagaucuaucuguugauggugc

SEQ ID NO: 292622 - RNA, 22 nt, Human
uuauuucuacuauuuugccuga

SEQ ID NO: 292623 - RNA, 22 nt, Human
aguguuuggggugauuguaacc

SEQ ID NO: 292624 - RNA, 22 nt, Human
gucuucaauagagccucaauuu

SEQ ID NO: 292625 - RNA, 22 nt, Human
uuccuggcacugcagugguuga

SEQ ID NO: 292626 - RNA, 22 nt, Human
ggggaccuggccacccauccuu

SEQ ID NO: 292627 - RNA, 22 nt, Human
uacuuuuagccuauuugauucu

SEQ ID NO: 292628 - RNA, 22 nt, Human
cagggcagagggaaacuccuuu

SEQ ID NO: 292629 - RNA, 22 nt, Human
uggagcagcucuagcgggcgcc

SEQ ID NO: 292630 - RNA, 22 nt, Human
uuucaguuuccagcuuugucau

SEQ ID NO: 292631 - RNA, 22 nt, Human
aaaauucauuccucagacugcc

SEQ ID NO: 292632 - RNA, 20 nt, Human
auccaugagagucuggauuc

SEQ ID NO: 292633 - RNA, 22 nt, Human
uguggcagaggaggcagcgucc

SEQ ID NO: 292634 - RNA, 22 nt, Human
ucacaggcuugugaacauugca

SEQ ID NO: 292635 - RNA, 22 nt, Human
gagagggauacugaguuuuggu

SEQ ID NO: 292636 - RNA, 22 nt, Human
cagugagggcauucagugcugg

SEQ ID NO: 292637 - RNA, 22 nt, Human
agaggucagaacaggaaagugu

SEQ ID NO: 292638 - RNA, 22 nt, Human
uuuuugcuccacaacuuugaag

SEQ ID NO: 292639 - RNA, 22 nt, Human
gggaggugauuaggaccaugua

SEQ ID NO: 292640 - RNA, 22 nt, Human
uuuccagagcaugucugcucag

SEQ ID NO: 292641 - RNA, 22 nt, Human
aggcacaggaacaggaaaagag

SEQ ID NO: 292642 - RNA, 22 nt, Human
uucuuucugggguccuucggcu

SEQ ID NO: 292643 - RNA, 20 nt, Human
caugccaugucuacugaggc

SEQ ID NO: 292644 - RNA, 22 nt, Human
ugcaaucagaaaguucagcggu

SEQ ID NO: 292645 - RNA, 22 nt, Human
uacagagacccacaagagacug

SEQ ID NO: 292646 - RNA, 22 nt, Human
ggacauuuuucuuccuacaaug

SEQ ID NO: 292647 - RNA, 22 nt, Human
ucaaagcaauuucaccagugcc

SEQ ID NO: 292648 - RNA, 22 nt, Human
uugaagauucuuuuuguuagua

SEQ ID NO: 292649 - RNA, 22 nt, Human
caguuaaauucuccaguuacca

SEQ ID NO: 292650 - RNA, 17 nt, Human
ugcuggcaacauacaaa

SEQ ID NO: 292651 - RNA, 22 nt, Human
gcuuccugucccucagccauga

SEQ ID NO: 292652 - RNA, 22 nt, Human
gcuccuggcaggcagugugugu

SEQ ID NO: 292653 - RNA, 22 nt, Human
uucaacaacuugguucaaaugg

SEQ ID NO: 292654 - RNA, 22 nt, Human
cuuaauuuaagccuagaaugca

SEQ ID NO: 292655 - RNA, 16 nt, Human
gcagguggggcgcgca

SEQ ID NO: 292656 - RNA, 21 nt, Human
ccuucuccauuacaguaagcu

SEQ ID NO: 292657 - RNA, 22 nt, Human
cauguacaaaaggcaaaugccu

SEQ ID NO: 292658 - RNA, 22 nt, Human
uccaaggacgcuggaccccugc

SEQ ID NO: 292659 - RNA, 22 nt, Human
ucagacagcuugcagggaggug

SEQ ID NO: 292660 - RNA, 22 nt, Human
auaaagcauuuccccugugugg

SEQ ID NO: 292661 - RNA, 22 nt, Human
uauuuucaucuuguccuuggau

SEQ ID NO: 292662 - RNA, 22 nt, Human
ccauggcuuacagauggagcau

SEQ ID NO: 292663 - RNA, 22 nt, Human
uuggaucacucugaagccuuac

SEQ ID NO: 292664 - RNA, 22 nt, Human
auucuuuagccagcagguauau

SEQ ID NO: 292665 - RNA, 22 nt, Human
gacaauaaaaugaucuuacagu

SEQ ID NO: 292666 - RNA, 22 nt, Human
cccacccucaagggugucuaua

SEQ ID NO: 292667 - RNA, 22 nt, Human
acagaugaauuuuaauuguguu

SEQ ID NO: 292668 - RNA, 22 nt, Human
ccuggcagguggagguugcagu

SEQ ID NO: 292669 - RNA, 22 nt, Human
ggcaggugaccuggccucccag

SEQ ID NO: 292670 - RNA, 22 nt, Human
ggagaagaggagcuggaagccu

SEQ ID NO: 292671 - RNA, 22 nt, Human
gaggaggggacaguacuugugc

SEQ ID NO: 292672 - RNA, 22 nt, Human
uuauugcuauggugagagggau

SEQ ID NO: 292673 - RNA, 22 nt, Human
guuucaaauagguuucagcaaa

SEQ ID NO: 292674 - RNA, 22 nt, Human
caggcacaauuauuucccuuuc

SEQ ID NO: 292675 - RNA, 22 nt, Human
cuguuuucuagggcugagguga

SEQ ID NO: 292676 - RNA, 22 nt, Human
auauuuguugaguucuuaugau

SEQ ID NO: 292677 - RNA, 22 nt, Human
aggggagcuugaggcauggccu

SEQ ID NO: 292678 - RNA, 22 nt, Human
aagaaaugcugauguuggaugg

SEQ ID NO: 292679 - RNA, 22 nt, Human
cuuccuggaugaacaguagaaa

SEQ ID NO: 292680 - RNA, 19 nt, Human
ucuuuguacaagucucugc

SEQ ID NO: 292681 - RNA, 22 nt, Human
aaggcaggaugggaaaagauuu

SEQ ID NO: 292682 - RNA, 23 nt, Human
ggagacaagguaccacguuaaca

SEQ ID NO: 292683 - RNA, 18 nt, Human
aaugugaauauuuacuuc

SEQ ID NO: 292684 - RNA, 22 nt, Human
cauuucagugucuugugaugaa

SEQ ID NO: 292685 - RNA, 22 nt, Human
aaggugguucgcugguacccag

SEQ ID NO: 292686 - RNA, 22 nt, Human
cuuugcaaacugucacacuuuc

SEQ ID NO: 292687 - RNA, 17 nt, Human
acuccuggucugaaggg

SEQ ID NO: 292688 - RNA, 22 nt, Human
cuggagagaccgaaagaggcug

SEQ ID NO: 292689 - RNA, 22 nt, Human
agagcaauggcauccagcugau

SEQ ID NO: 292690 - RNA, 22 nt, Human
ucauuuguaccauuuuuuaaga

SEQ ID NO: 292691 - RNA, 22 nt, Human
uuugguaaguacccaccugggu

SEQ ID NO: 292692 - RNA, 22 nt, Human
gacccagaaggagugcccuaga

SEQ ID NO: 292693 - RNA, 22 nt, Human
ccagagagaguacugggcucug

SEQ ID NO: 292694 - RNA, 22 nt, Human
uuguuauaaagacuaaauaugu

SEQ ID NO: 292695 - RNA, 22 nt, Human
ugaggaauguuuugagugccga

SEQ ID NO: 292696 - RNA, 22 nt, Human
acagcuuuugaaaaauuacugg

SEQ ID NO: 292697 - RNA, 22 nt, Human
aaagaagguagggcuggugacu

SEQ ID NO: 292698 - RNA, 22 nt, Human
ccugagcuagggaaggaagacc

SEQ ID NO: 292699 - RNA, 22 nt, Human
cugucuguuuuguauacaggcc

SEQ ID NO: 292700 - RNA, 22 nt, Human
acuggaggccccucccagugaa

SEQ ID NO: 292701 - RNA, 22 nt, Human
aauaguuugaauuuaucagaug

SEQ ID NO: 292702 - RNA, 22 nt, Human
gcaguguccaggguggucugca

SEQ ID NO: 292703 - RNA, 22 nt, Human
uaaaggauuuuguauaauauaa

SEQ ID NO: 292704 - RNA, 22 nt, Human
ugucuggcauaguugcucccug

SEQ ID NO: 292705 - RNA, 22 nt, Human
uucagagacagcaaccaggaca

SEQ ID NO: 292706 - RNA, 22 nt, Human
aaaauuuccaccaucuuugugu

SEQ ID NO: 292707 - RNA, 22 nt, Human
guuuuacacaccuaugaaagac

SEQ ID NO: 292708 - RNA, 22 nt, Human
agcuuagaauguguuaggaaag

SEQ ID NO: 292709 - RNA, 22 nt, Human
cugagaggcagccagagaaaau

SEQ ID NO: 292710 - RNA, 22 nt, Human
acauccagaucucagcauggcu

SEQ ID NO: 292711 - RNA, 18 nt, Human
uuacacuagccuugguuc

SEQ ID NO: 292712 - RNA, 22 nt, Human
gacauaaaauggaauucuguug

SEQ ID NO: 292713 - RNA, 22 nt, Human
aagcauuuauagauaagaauuu

SEQ ID NO: 292714 - RNA, 22 nt, Human
uuucuguuguacuuaaacuagg

SEQ ID NO: 292715 - RNA, 22 nt, Human
augguauacaauuauggacugu

SEQ ID NO: 292716 - RNA, 17 nt, Human
uuauugcuauaagcuga

SEQ ID NO: 292717 - RNA, 22 nt, Human
aucuuuagacaggaagcaauca

SEQ ID NO: 292718 - RNA, 22 nt, Human
ccuucuccugccuuggguucau

SEQ ID NO: 292719 - RNA, 22 nt, Human
gcaguguuuacauauuagaaac

SEQ ID NO: 292720 - RNA, 22 nt, Human
uccugagcuucaguuucuucau

SEQ ID NO: 292721 - RNA, 22 nt, Human
cagaaagaccugggcucaagag

SEQ ID NO: 292722 - RNA, 22 nt, Human
gcuucuauuauuuggagcugag

SEQ ID NO: 292723 - RNA, 22 nt, Human
acauuucucuugaugucucuau

SEQ ID NO: 292724 - RNA, 19 nt, Human
aggcuuggcuagauuuacu

SEQ ID NO: 292725 - RNA, 23 nt, Human
uguccuuuuugaggccuccuccu

SEQ ID NO: 292726 - RNA, 22 nt, Human
uggaggcaggggauacagguca

SEQ ID NO: 292727 - RNA, 22 nt, Human
gcuaaugaaaaauagauuauag

SEQ ID NO: 292728 - RNA, 22 nt, Human
uccugcagaucaaagccuuuga

SEQ ID NO: 292729 - RNA, 22 nt, Human
ccacaagaugcaaacucuaaca

SEQ ID NO: 292730 - RNA, 22 nt, Human
guggcagaguugcugacuagaa

SEQ ID NO: 292731 - RNA, 22 nt, Human
gccugcagccagggaguucucu

SEQ ID NO: 292732 - RNA, 22 nt, Human
acaggcagugauuuccucuggu

SEQ ID NO: 292733 - RNA, 22 nt, Human
uccuggcuuccacaccugucau

SEQ ID NO: 292734 - RNA, 22 nt, Human
cagcaaucgggugauaugcaau

SEQ ID NO: 292735 - RNA, 22 nt, Human
ggcacuggaaggaucaugugag

SEQ ID NO: 292736 - RNA, 22 nt, Human
cuguugcucugaacaggucuug

SEQ ID NO: 292737 - RNA, 22 nt, Human
uaaaguguuguacaaauguaug

SEQ ID NO: 292738 - RNA, 22 nt, Human
uuuccuaguucuaagaaaugua

SEQ ID NO: 292739 - RNA, 19 nt, Human
uuccaccaucacucuguuu

SEQ ID NO: 292740 - RNA, 22 nt, Human
ggaggcaaagcacuuugcuugg

SEQ ID NO: 292741 - RNA, 20 nt, Human
cuuuuucuccagcucugagc

SEQ ID NO: 292742 - RNA, 22 nt, Human
ugaguagagaauucagcuaagg

SEQ ID NO: 292743 - RNA, 22 nt, Human
ccaggugguucaggucaccaua

SEQ ID NO: 292744 - RNA, 22 nt, Human
cucugcagauucaucccuucac

SEQ ID NO: 292745 - RNA, 22 nt, Human
cuccuggcuaugacuacauuuc

SEQ ID NO: 292746 - RNA, 23 nt, Human
uacugucuucuauuaaguaagga

SEQ ID NO: 292747 - RNA, 22 nt, Human
aggagggagaugcccauccugg

SEQ ID NO: 292748 - RNA, 22 nt, Human
aauauaauuuuauuccuagagu

SEQ ID NO: 292749 - RNA, 22 nt, Human
aaaguggugggcgaacucauca

SEQ ID NO: 292750 - RNA, 22 nt, Human
aauaucagcacuuuugugguau

SEQ ID NO: 292751 - RNA, 22 nt, Human
cuccgcagcgggccaauccgga

SEQ ID NO: 292752 - RNA, 22 nt, Human
gauccuguuagaucccauuaga

SEQ ID NO: 292753 - RNA, 23 nt, Human
ggaauguuuaccugugaauguca

SEQ ID NO: 292754 - RNA, 22 nt, Human
cuggucacuccuccaccugcuu

SEQ ID NO: 292755 - RNA, 22 nt, Human
auacuaaaguauagaacuuagu

SEQ ID NO: 292756 - RNA, 22 nt, Human
ucaggaaagaguaauguauaca

SEQ ID NO: 292757 - RNA, 23 nt, Human
auguauuuaaauuucagugauga

SEQ ID NO: 292758 - RNA, 22 nt, Human
guuuuauuuccaugagagaccg

SEQ ID NO: 292759 - RNA, 21 nt, Human
ugcagaaaugguuuuucuaag

SEQ ID NO: 292760 - RNA, 21 nt, Human
uuuguucauagcucacucuuu

SEQ ID NO: 292761 - RNA, 22 nt, Human
acccaggggcgaagcuggccac

SEQ ID NO: 292762 - RNA, 22 nt, Human
uccucagauauaaaugagggug

SEQ ID NO: 292763 - RNA, 18 nt, Human
caggaauggaugggauuu

SEQ ID NO: 292764 - RNA, 22 nt, Human
uuacauaacgguaugaaaaaug

SEQ ID NO: 292765 - RNA, 19 nt, Human
augcaacaaaaguguaaga

SEQ ID NO: 292766 - RNA, 22 nt, Human
ggcaggaggugaguggcgggug

SEQ ID NO: 292767 - RNA, 22 nt, Human
uuacaguggcagaguuggguag

SEQ ID NO: 292768 - RNA, 17 nt, Human
cugaagaguccuggcua

SEQ ID NO: 292769 - RNA, 22 nt, Human
uggaauguugauaaacauaggc

SEQ ID NO: 292770 - RNA, 22 nt, Human
ucuuugguauucacuugugaag

SEQ ID NO: 292771 - RNA, 22 nt, Human
caggaaagaaaugagaacacca

SEQ ID NO: 292772 - RNA, 16 nt, Human
gcuccugggcccucga

SEQ ID NO: 292773 - RNA, 20 nt, Human
cuccacaccuguucgcaggc

SEQ ID NO: 292774 - RNA, 23 nt, Human
ucuguucaaggcuuucuccuuga

SEQ ID NO: 292775 - RNA, 17 nt, Human
cugaggagaacagaaag

SEQ ID NO: 292776 - RNA, 20 nt, Human
uuugcuguggguguaagaau

SEQ ID NO: 292777 - RNA, 22 nt, Human
acaugacacaggccuggccaau

SEQ ID NO: 292778 - RNA, 17 nt, Human
uggucuggaagaacuga

SEQ ID NO: 292779 - RNA, 22 nt, Human
uugaucaaaucagcuacugagg

SEQ ID NO: 292780 - RNA, 22 nt, Human
gacagcaggaugugaggggaug

SEQ ID NO: 292781 - RNA, 22 nt, Human
ggaauguucuggaacaccgcuu

SEQ ID NO: 292782 - RNA, 22 nt, Human
acacaaaguuggaugacaaaau

SEQ ID NO: 292783 - RNA, 22 nt, Human
aaacaugcauucaagaaaaucu

SEQ ID NO: 292784 - RNA, 22 nt, Human
uugcuuauagagaguuucauac

SEQ ID NO: 292785 - RNA, 22 nt, Human
ucauugccauggcauuugcaga

SEQ ID NO: 292786 - RNA, 22 nt, Human
cagagcauugagggucugccaa

SEQ ID NO: 292787 - RNA, 22 nt, Human
cugccugcugcccuccagagcc

SEQ ID NO: 292788 - RNA, 22 nt, Human
uggcaaagacugcaaggacuuu

SEQ ID NO: 292789 - RNA, 22 nt, Human
auguccagggggcuugacuggu

SEQ ID NO: 292790 - RNA, 22 nt, Human
cccaggaggugugcccaacucg

SEQ ID NO: 292791 - RNA, 22 nt, Human
gagaaagaugaagaguggcguu

SEQ ID NO: 292792 - RNA, 22 nt, Human
uguguucaagauuaguucuagu

SEQ ID NO: 292793 - RNA, 22 nt, Human
gagauuuauugacuuaacagua

SEQ ID NO: 292794 - RNA, 22 nt, Human
ggucuggcaggugaggacucag

SEQ ID NO: 292795 - RNA, 22 nt, Human
uauguuuuaggaauuaauuguu

SEQ ID NO: 292796 - RNA, 22 nt, Human
aaacuguaaacacagcaguaca

SEQ ID NO: 292797 - RNA, 22 nt, Human
uuguuugucauaauaucauuac

SEQ ID NO: 292798 - RNA, 22 nt, Human
gcucucagggugauggcauacu

SEQ ID NO: 292799 - RNA, 22 nt, Human
caugauaacuucauuacacaau

SEQ ID NO: 292800 - RNA, 22 nt, Human
uacacaugaucauuuaguagca

SEQ ID NO: 292801 - RNA, 22 nt, Human
caggcacacugucuacacugag

SEQ ID NO: 292802 - RNA, 22 nt, Human
ucuuuacaaucuaagcauaguu

SEQ ID NO: 292803 - RNA, 22 nt, Human
gggacaugaagcaucggaggca

SEQ ID NO: 292804 - RNA, 22 nt, Human
aaauggauguugaguuaaaugu

SEQ ID NO: 292805 - RNA, 22 nt, Human
augcucagggcacacucuggac

SEQ ID NO: 292806 - RNA, 22 nt, Human
uccagaauacucugaaaucauu

SEQ ID NO: 292807 - RNA, 22 nt, Human
cugagcagugguucuugagcgc

SEQ ID NO: 292808 - RNA, 22 nt, Human
ugucuggggaacugugcaucca

SEQ ID NO: 292809 - RNA, 17 nt, Human
agggggaaccugggagg

SEQ ID NO: 292810 - RNA, 21 nt, Human
ggccucugccuugccccacuc

SEQ ID NO: 292811 - RNA, 22 nt, Human
cauguuaaugaauuuuugcagu

SEQ ID NO: 292812 - RNA, 22 nt, Human
ugcacuacugugauacacagcc

SEQ ID NO: 292813 - RNA, 22 nt, Human
acuuuagaaaagcauccauaga

SEQ ID NO: 292814 - RNA, 22 nt, Human
uucuuauagaagcaaccauugu

SEQ ID NO: 292815 - RNA, 22 nt, Human
cugccccaggaccucuucugga

SEQ ID NO: 292816 - RNA, 22 nt, Human
cagagagagucaaaucuuugcu

SEQ ID NO: 292817 - RNA, 22 nt, Human
aauguucagaggacaauauaaa

SEQ ID NO: 292818 - RNA, 21 nt, Human
gccacugcacuccagccuggg

SEQ ID NO: 292819 - RNA, 19 nt, Human
uccuggcaucuuccucccu

SEQ ID NO: 292820 - RNA, 22 nt, Human
cuagagaaaaagcuuagguacg

SEQ ID NO: 292821 - RNA, 22 nt, Human
auuuacagugugccuacuauau

SEQ ID NO: 292822 - RNA, 22 nt, Human
ucagagagaaauaguuuuugac

SEQ ID NO: 292823 - RNA, 22 nt, Human
acagcaggaagcuggagggaaa

SEQ ID NO: 292824 - RNA, 22 nt, Human
uuuguuuucaaugugucauuca

SEQ ID NO: 292825 - RNA, 22 nt, Human
ccuggcucccccaucauagcug

SEQ ID NO: 292826 - RNA, 22 nt, Human
uuacaaguucagauuuucucau

SEQ ID NO: 292827 - RNA, 22 nt, Human
uguuuuagcugacacauggagc

SEQ ID NO: 292828 - RNA, 22 nt, Human
ugcuccuucccuucccagugag

SEQ ID NO: 292829 - RNA, 22 nt, Human
auagaauagcauagaaaauuga

SEQ ID NO: 292830 - RNA, 22 nt, Human
ucuccccagacccuggacauaa

SEQ ID NO: 292831 - RNA, 22 nt, Human
uuuaugucccuucaaauguuua

SEQ ID NO: 292832 - RNA, 22 nt, Human
ugaggcucagaaauguaaguuu

SEQ ID NO: 292833 - RNA, 22 nt, Human
acagaugaggcccaucagucug

SEQ ID NO: 292834 - RNA, 21 nt, Human
gggugggaggacacagcaggc

SEQ ID NO: 292835 - RNA, 22 nt, Human
ccauggagcgggugagugagug

SEQ ID NO: 292836 - RNA, 22 nt, Human
gcaggcaggcuuccuugaacug

SEQ ID NO: 292837 - RNA, 22 nt, Human
aaggcugccucugccagaggag

SEQ ID NO: 292838 - RNA, 22 nt, Human
agcucccagaaggcccugcgcc

SEQ ID NO: 292839 - RNA, 22 nt, Human
uggugaggccaaagccaugaca

SEQ ID NO: 292840 - RNA, 22 nt, Human
uugcuggggugugaaaucugau

SEQ ID NO: 292841 - RNA, 22 nt, Human
uuucuaggcacagugucuuccc

SEQ ID NO: 292842 - RNA, 22 nt, Human
aggguauguuuuaggcugaguu

SEQ ID NO: 292843 - RNA, 22 nt, Human
cagcugucugaagcaggagucc

SEQ ID NO: 292844 - RNA, 21 nt, Human
ucuccccauucuuauucccau

SEQ ID NO: 292845 - RNA, 22 nt, Human
agggcagcagcuccuccuagcu

SEQ ID NO: 292846 - RNA, 22 nt, Human
cccugcaggggaccugcagccu

SEQ ID NO: 292847 - RNA, 22 nt, Human
gagggaugucaggggaccuugg

SEQ ID NO: 292848 - RNA, 22 nt, Human
auguuuguguuacacucugcag

SEQ ID NO: 292849 - RNA, 22 nt, Human
guauuagggccaaaggcaggaa

SEQ ID NO: 292850 - RNA, 22 nt, Human
gcauggcuguugaagucagcuc

SEQ ID NO: 292851 - RNA, 23 nt, Human
agccuucaggcaaugucaguaga

SEQ ID NO: 292852 - RNA, 22 nt, Human
ugcuuuauaaccauuucugugg

SEQ ID NO: 292853 - RNA, 19 nt, Human
gucagcuggaacucugaaa

SEQ ID NO: 292854 - RNA, 22 nt, Human
uccugggccuguacuccauccg

SEQ ID NO: 292855 - RNA, 22 nt, Human
gcugagguccagcauucgccua

SEQ ID NO: 292856 - RNA, 22 nt, Human
aaauauagugacacuuauaguc

SEQ ID NO: 292857 - RNA, 22 nt, Human
gaugcgggcccgcuccacugcc

SEQ ID NO: 292858 - RNA, 22 nt, Human
gcaggcaccggguugcuccccu

SEQ ID NO: 292859 - RNA, 22 nt, Human
uuggaagcaguguacacuguac

SEQ ID NO: 292860 - RNA, 22 nt, Human
aaaggcuaugagauagaagaua

SEQ ID NO: 292861 - RNA, 22 nt, Human
cagauucuucauugccccauuc

SEQ ID NO: 292862 - RNA, 22 nt, Human
acacauuuucaacacugucaag

SEQ ID NO: 292863 - RNA, 22 nt, Human
uuuaaaaaacuagucugagucu

SEQ ID NO: 292864 - RNA, 22 nt, Human
guguucauugcuagugaggugu

SEQ ID NO: 292865 - RNA, 22 nt, Human
uuggaauccugagaugagaauu

SEQ ID NO: 292866 - RNA, 22 nt, Human
uggucuggaacuccuggcuuca

SEQ ID NO: 292867 - RNA, 22 nt, Human
gguggcauaagaacacuaaaga

SEQ ID NO: 292868 - RNA, 22 nt, Human
ccauguguugauucucugcaga

SEQ ID NO: 292869 - RNA, 22 nt, Human
agccuuguuggucugaguuugg

SEQ ID NO: 292870 - RNA, 22 nt, Human
agcuugauuucucugcagugug

SEQ ID NO: 292871 - RNA, 20 nt, Human
gaguccaggggccuguagca

SEQ ID NO: 292872 - RNA, 22 nt, Human
gacccaggguggucaccugaaa

SEQ ID NO: 292873 - RNA, 19 nt, Human
gcaggcacagcccugggug

SEQ ID NO: 292874 - RNA, 22 nt, Human
acacaguucaggaucaaauagc

SEQ ID NO: 292875 - RNA, 22 nt, Human
aacuagaaaucacuacagguau

SEQ ID NO: 292876 - RNA, 22 nt, Human
ccucacccagucaccuaggugg

SEQ ID NO: 292877 - RNA, 22 nt, Human
auuuccaugccuuagcuuaagg

SEQ ID NO: 292878 - RNA, 22 nt, Human
uacagacaguuuuucagauauu

SEQ ID NO: 292879 - RNA, 23 nt, Human
aaauuauugcucuucaauugccu

SEQ ID NO: 292880 - RNA, 22 nt, Human
ccuggcagcagcacaugccuuc

SEQ ID NO: 292881 - RNA, 22 nt, Human
acuugguugaugucauaagguu

SEQ ID NO: 292882 - RNA, 22 nt, Human
ucuguacauuuguguugugaau

SEQ ID NO: 292883 - RNA, 22 nt, Human
uccugccaccugcacagcuccc

SEQ ID NO: 292884 - RNA, 22 nt, Human
auaugcauuuaccuggcauaua

SEQ ID NO: 292885 - RNA, 22 nt, Human
uacuacaagggcccuaaaaggu

SEQ ID NO: 292886 - RNA, 22 nt, Human
aguacaaaugcagccagaguag

SEQ ID NO: 292887 - RNA, 22 nt, Human
gauuuuucaguauaaaauauau

SEQ ID NO: 292888 - RNA, 22 nt, Human
ggccugaggcgucccagcugug

SEQ ID NO: 292889 - RNA, 22 nt, Human
agggcccuaaggaaggcacaca

SEQ ID NO: 292890 - RNA, 22 nt, Human
ucuuccucccuacagagcucag

SEQ ID NO: 292891 - RNA, 22 nt, Human
uucuuuccuugccucagugaag

SEQ ID NO: 292892 - RNA, 22 nt, Human
gggaggaaugcaacuuauuuag

SEQ ID NO: 292893 - RNA, 22 nt, Human
gaaaaguauguuuauuuugacu

SEQ ID NO: 292894 - RNA, 22 nt, Human
cucugaaaaugugguggggaaa

SEQ ID NO: 292895 - RNA, 21 nt, Human
cauuucuauugaugagaaaag

SEQ ID NO: 292896 - RNA, 22 nt, Human
ccuggcuccagcugccuguccu

SEQ ID NO: 292897 - RNA, 22 nt, Human
uugcuuuacuuugccauucguu

SEQ ID NO: 292898 - RNA, 22 nt, Human
aagggcucgguagcaguccuga

SEQ ID NO: 292899 - RNA, 22 nt, Human
gccugagaucaggagaaagcca

SEQ ID NO: 292900 - RNA, 22 nt, Human
gccuguuucuccuccuuggccc

SEQ ID NO: 292901 - RNA, 22 nt, Human
cuuccuccgaagaaguugcugg

SEQ ID NO: 292902 - RNA, 22 nt, Human
aacauauaaacucuuaaguuca

SEQ ID NO: 292903 - RNA, 22 nt, Human
uuccaugccucuauuuagaauu

SEQ ID NO: 292904 - RNA, 22 nt, Human
uucauguaauuccauaagguaa

SEQ ID NO: 292905 - RNA, 22 nt, Human
ugucaauauguaauaacugaau

SEQ ID NO: 292906 - RNA, 22 nt, Human
gcccagggcugcaaguggacgc

SEQ ID NO: 292907 - RNA, 22 nt, Human
ucuuuuaagccucuggcauagg

SEQ ID NO: 292908 - RNA, 22 nt, Human
cagcuuuguggccuugaccucg

SEQ ID NO: 292909 - RNA, 22 nt, Human
cagagccuuccuagcagacucu

SEQ ID NO: 292910 - RNA, 22 nt, Human
gggaccuggucuagcacugagc

SEQ ID NO: 292911 - RNA, 22 nt, Human
uuagguaaguaggaucaaaaaa

SEQ ID NO: 292912 - RNA, 22 nt, Human
caugcacaaagguaagaugcgu

SEQ ID NO: 292913 - RNA, 22 nt, Human
uggcaaaggggaccauguugaa

SEQ ID NO: 292914 - RNA, 22 nt, Human
ucuccuggguaaaaggguugau

SEQ ID NO: 292915 - RNA, 22 nt, Human
ccuucuucuguguggcccaaga

SEQ ID NO: 292916 - RNA, 22 nt, Human
uuugauagggaaguaagaauga

SEQ ID NO: 292917 - RNA, 22 nt, Human
agcuccugcccaggaaggcucu

SEQ ID NO: 292918 - RNA, 20 nt, Human
cagagaccaggccagguguc

SEQ ID NO: 292919 - RNA, 22 nt, Human
agcccuugcagacugucagcau

SEQ ID NO: 292920 - RNA, 22 nt, Human
uaauuuuaugacaguguauuuu

SEQ ID NO: 292921 - RNA, 22 nt, Human
ggcagguggaaggucuccauuc

SEQ ID NO: 292922 - RNA, 18 nt, Human
acuguucucuccugcccu

SEQ ID NO: 292923 - RNA, 22 nt, Human
cagggcaggacagauacauuac

SEQ ID NO: 292924 - RNA, 22 nt, Human
ggucaaagugaggagucagguu

SEQ ID NO: 292925 - RNA, 22 nt, Human
accaugaucugcucugguguuu

SEQ ID NO: 292926 - RNA, 22 nt, Human
auuuccauuaucaugacaaauu

SEQ ID NO: 292927 - RNA, 22 nt, Human
ucacugcucugaaaguacaggg

SEQ ID NO: 292928 - RNA, 22 nt, Human
uuccuguggcugucacuccugg

SEQ ID NO: 292929 - RNA, 22 nt, Human
uuguguccccuguucuaccugu

SEQ ID NO: 292930 - RNA, 22 nt, Human
ucagagcaaauuccugugagcc

SEQ ID NO: 292931 - RNA, 22 nt, Human
auuucauugaaguuaauucuuc

SEQ ID NO: 292932 - RNA, 22 nt, Human
uugaggagugugaggucuccca

SEQ ID NO: 292933 - RNA, 22 nt, Human
uaacacauaucuacaacaugug

SEQ ID NO: 292934 - RNA, 22 nt, Human
cuuuucaugagucuguuauggg

SEQ ID NO: 292935 - RNA, 19 nt, Human
uaaaaugucuguggucagu

SEQ ID NO: 292936 - RNA, 22 nt, Human
cuuuacagaauaagaauacugg

SEQ ID NO: 292937 - RNA, 22 nt, Human
cagagagcuuagugugcugcau

SEQ ID NO: 292938 - RNA, 22 nt, Human
ucuuuuucugcacacguguccc

SEQ ID NO: 292939 - RNA, 22 nt, Human
auauuuucuggaacuaugccug

SEQ ID NO: 292940 - RNA, 21 nt, Human
cagugagguccccagccuagg

SEQ ID NO: 292941 - RNA, 22 nt, Human
aucuguaauuuugaaugcaaau

SEQ ID NO: 292942 - RNA, 22 nt, Human
ucuggcagguucccauguuaug

SEQ ID NO: 292943 - RNA, 22 nt, Human
gguaacaaggccgauagaaaca

SEQ ID NO: 292944 - RNA, 21 nt, Human
gccaaggaggcuagagaacau

SEQ ID NO: 292945 - RNA, 22 nt, Human
uacagugcuuuuugguggagaa

SEQ ID NO: 292946 - RNA, 22 nt, Human
ucaggugucuugugggauuuua

SEQ ID NO: 292947 - RNA, 22 nt, Human
cagguucuggggcuccacugug

SEQ ID NO: 292948 - RNA, 22 nt, Human
agaagcuaggcuagacaaguga

SEQ ID NO: 292949 - RNA, 22 nt, Human
gcuguucacauuuugggccaaa

SEQ ID NO: 292950 - RNA, 22 nt, Human
acuuucaauuugcacuaaccua

SEQ ID NO: 292951 - RNA, 22 nt, Human
ccuacauucucugaguuuuccu

SEQ ID NO: 292952 - RNA, 22 nt, Human
uuccuggcucacagcagugggg

SEQ ID NO: 292953 - RNA, 22 nt, Human
uagagaaaagcagggaucagga

SEQ ID NO: 292954 - RNA, 22 nt, Human
gccaggcuaagaaaggugugau

SEQ ID NO: 292955 - RNA, 22 nt, Human
gcagugucagugccuggguggu

SEQ ID NO: 292956 - RNA, 22 nt, Human
agccagaguugaaugugagucu

SEQ ID NO: 292957 - RNA, 22 nt, Human
uucuucuucaagugcugcauuc

SEQ ID NO: 292958 - RNA, 22 nt, Human
aaucuucauuuugacaagauuc

SEQ ID NO: 292959 - RNA, 22 nt, Human
uccuggccaaguuacucucugc

SEQ ID NO: 292960 - RNA, 22 nt, Human
acuggcaguggcagcagaaaga

SEQ ID NO: 292961 - RNA, 22 nt, Human
ccuggcaggccccuccuggauu

SEQ ID NO: 292962 - RNA, 22 nt, Human
cugaggagcguuggucacgugu

SEQ ID NO: 292963 - RNA, 22 nt, Human
acuuccuguaaauagaauucca

SEQ ID NO: 292964 - RNA, 22 nt, Human
ucagggcaucaucaugaauaua

SEQ ID NO: 292965 - RNA, 22 nt, Human
gauuuucugagccuucaaauuu

SEQ ID NO: 292966 - RNA, 22 nt, Human
ccugccuggagcugagugugga

SEQ ID NO: 292967 - RNA, 22 nt, Human
cccaugagauucugaauuuggc

SEQ ID NO: 292968 - RNA, 22 nt, Human
uuauuuuaccuuccucugagcu

SEQ ID NO: 292969 - RNA, 22 nt, Human
ucccuggggauguuggccugcc

SEQ ID NO: 292970 - RNA, 22 nt, Human
uauucuuguauacuacaaucuu

SEQ ID NO: 292971 - RNA, 22 nt, Human
gagcuuuaagggauaaaaugau

SEQ ID NO: 292972 - RNA, 22 nt, Human
gcacucuccuggcugccacagu

SEQ ID NO: 292973 - RNA, 22 nt, Human
ucguccugugcaccugccugca

SEQ ID NO: 292974 - RNA, 23 nt, Human
acagaugaaaguguggcucagag

SEQ ID NO: 292975 - RNA, 22 nt, Human
guuuaagaggguuucauuccca

SEQ ID NO: 292976 - RNA, 22 nt, Human
aucuuucaaucaggaaaaaucu

SEQ ID NO: 292977 - RNA, 22 nt, Human
aacuucauguaauuuaaaacag

SEQ ID NO: 292978 - RNA, 22 nt, Human
cagauucugaagucuagcugcu

SEQ ID NO: 292979 - RNA, 22 nt, Human
gguguccuacagggccgcaggc

SEQ ID NO: 292980 - RNA, 22 nt, Human
aaguauaagcuauucuucauga

SEQ ID NO: 292981 - RNA, 22 nt, Human
uccagaccaugugagaggcgca

SEQ ID NO: 292982 - RNA, 23 nt, Human
auaauaauuauggcagcaaagug

SEQ ID NO: 292983 - RNA, 22 nt, Human
uacaagcuggcgcaguuaagau

SEQ ID NO: 292984 - RNA, 22 nt, Human
gcagucagacaggaggagcucc

SEQ ID NO: 292985 - RNA, 22 nt, Human
gcuucauagcauucauugccug

SEQ ID NO: 292986 - RNA, 22 nt, Human
uaaaguguggacaguaucuaua

SEQ ID NO: 292987 - RNA, 22 nt, Human
uaucaauacauguuaucagugu

SEQ ID NO: 292988 - RNA, 22 nt, Human
uucuuuaaaauagugagaaaga

SEQ ID NO: 292989 - RNA, 22 nt, Human
agggcagcuggaagguggcuuc

SEQ ID NO: 292990 - RNA, 22 nt, Human
acaauuucugaucagugaauuu

SEQ ID NO: 292991 - RNA, 22 nt, Human
uguuuucuauuaccugagauug

SEQ ID NO: 292992 - RNA, 22 nt, Human
guguacaguaagugaaucuagg

SEQ ID NO: 292993 - RNA, 22 nt, Human
cuggauguccuuccccugaagc

SEQ ID NO: 292994 - RNA, 20 nt, Human
aagucccuaagucucuggcc

SEQ ID NO: 292995 - RNA, 22 nt, Human
uuucacauguggaaugccaggu

SEQ ID NO: 292996 - RNA, 22 nt, Human
augugguugaagaauuacaucu

SEQ ID NO: 292997 - RNA, 22 nt, Human
ggcacagggggcugaggacuag

SEQ ID NO: 292998 - RNA, 22 nt, Human
gagcccaggcugggguucagag

SEQ ID NO: 292999 - RNA, 22 nt, Human
uauaaagaaaugauuuccagaa

SEQ ID NO: 293000 - RNA, 22 nt, Human
aguacauauaguaauuuagcca

SEQ ID NO: 293001 - RNA, 18 nt, Human
gcuccuggaccaggucac

SEQ ID NO: 293002 - RNA, 22 nt, Human
uacauucagagaaaguuuccau

SEQ ID NO: 293003 - RNA, 21 nt, Human
acagggcaugcagcuggcugu

SEQ ID NO: 293004 - RNA, 22 nt, Human
ggacaggcugcaucugagcaug

SEQ ID NO: 293005 - RNA, 22 nt, Human
ccaaggagaaugacaccaugga

SEQ ID NO: 293006 - RNA, 22 nt, Human
cuugccuuugucuucaaaggcu

SEQ ID NO: 293007 - RNA, 22 nt, Human
ccaugccauacuggccacccgg

SEQ ID NO: 293008 - RNA, 22 nt, Human
gcugaggacaucauggaaggaa

SEQ ID NO: 293009 - RNA, 22 nt, Human
cucuucuugccugaugaggcag

SEQ ID NO: 293010 - RNA, 22 nt, Human
ugcacagcgggugucugucagg

SEQ ID NO: 293011 - RNA, 22 nt, Human
gccccagccuaguuuucuuuca

SEQ ID NO: 293012 - RNA, 20 nt, Human
cuguccugaucuuuucagaa

SEQ ID NO: 293013 - RNA, 21 nt, Human
ucuguggcagcaugaugaggu

SEQ ID NO: 293014 - RNA, 22 nt, Human
cuguccugcaguugggggcagg

SEQ ID NO: 293015 - RNA, 22 nt, Human
gacaugugucugcaaguugauc

SEQ ID NO: 293016 - RNA, 22 nt, Human
auggcuggauaguugaagcucu

SEQ ID NO: 293017 - RNA, 19 nt, Human
uuugacuccucauuuuuau

SEQ ID NO: 293018 - RNA, 21 nt, Human
agaauaaugguaucauuugcu

SEQ ID NO: 293019 - RNA, 22 nt, Human
acaaauuucauaggcaaauuuu

SEQ ID NO: 293020 - RNA, 22 nt, Human
ucccaggccauaaaacucagag

SEQ ID NO: 293021 - RNA, 22 nt, Human
aagaguuucugggucaaggauu

SEQ ID NO: 293022 - RNA, 22 nt, Human
agaaagcacucugucuuuuacc

SEQ ID NO: 293023 - RNA, 22 nt, Human
ccaaggaguagagcaggaagcu

SEQ ID NO: 293024 - RNA, 22 nt, Human
uuccuggcuuuugggcuaauuc

SEQ ID NO: 293025 - RNA, 22 nt, Human
gaaggaggucugauacaauaug

SEQ ID NO: 293026 - RNA, 16 nt, Human
ugggaccuguggccaa

SEQ ID NO: 293027 - RNA, 22 nt, Human
ccaugccagcugcuaggucaca

SEQ ID NO: 293028 - RNA, 22 nt, Human
uugggcagguguggcucuccuu

SEQ ID NO: 293029 - RNA, 22 nt, Human
gaggcaacacauuuggaaagca

SEQ ID NO: 293030 - RNA, 22 nt, Human
acugugaugcaguugccaucca

SEQ ID NO: 293031 - RNA, 22 nt, Human
aaggccuugccgaaggaugcca

SEQ ID NO: 293032 - RNA, 22 nt, Human
aagugcaggaguggggaaagua

SEQ ID NO: 293033 - RNA, 21 nt, Human
ugaacaaaguucuuaucguga

SEQ ID NO: 293034 - RNA, 22 nt, Human
guguguccaaggcacggaugac

SEQ ID NO: 293035 - RNA, 22 nt, Human
aagaaaaucaguucuggucagu

SEQ ID NO: 293036 - RNA, 20 nt, Human
acagugcauggggggacagc

SEQ ID NO: 293037 - RNA, 22 nt, Human
uugaggagguaguacagaguau

SEQ ID NO: 293038 - RNA, 22 nt, Human
aagggcauugaggcugagagac

SEQ ID NO: 293039 - RNA, 22 nt, Human
acacuuuaugucuagaucuggg

SEQ ID NO: 293040 - RNA, 22 nt, Human
ucacaucuguugauacagcauc

SEQ ID NO: 293041 - RNA, 22 nt, Human
uuggaauugaggauuuacauag

SEQ ID NO: 293042 - RNA, 22 nt, Human
ucauucuuuaccaaguugucac

SEQ ID NO: 293043 - RNA, 22 nt, Human
uuucuucacaggguauugggug

SEQ ID NO: 293044 - RNA, 22 nt, Human
ucucagagcuucaguuauuuuc

SEQ ID NO: 293045 - RNA, 18 nt, Human
gagaaggccacuuguuuu

SEQ ID NO: 293046 - RNA, 22 nt, Human
ggcaggugcccagagagcacga

SEQ ID NO: 293047 - RNA, 22 nt, Human
acugucaaaugcaaugaacuca

SEQ ID NO: 293048 - RNA, 22 nt, Human
cuccaggaaagccugaggcccg

SEQ ID NO: 293049 - RNA, 20 nt, Human
cccugagacgacugagcucc

SEQ ID NO: 293050 - RNA, 21 nt, Human
uccugcaggaggccugagagg

SEQ ID NO: 293051 - RNA, 22 nt, Human
cagggcucgcucuugcccuucg

SEQ ID NO: 293052 - RNA, 22 nt, Human
ccuguggcuggucaggccagca

SEQ ID NO: 293053 - RNA, 22 nt, Human
gccaggcauuuguuaggugcug

SEQ ID NO: 293054 - RNA, 22 nt, Human
ggcuuggaaauugcaggacaca

SEQ ID NO: 293055 - RNA, 22 nt, Human
guuagggaucaggaacaagagc

SEQ ID NO: 293056 - RNA, 22 nt, Human
agaaauguugaauacacaaaau

SEQ ID NO: 293057 - RNA, 22 nt, Human
uaaauacuuuacaggaugucuc

SEQ ID NO: 293058 - RNA, 22 nt, Human
gcaggugucugacugccuucuu

SEQ ID NO: 293059 - RNA, 22 nt, Human
uucuuuuacauuaagauuucag

SEQ ID NO: 293060 - RNA, 22 nt, Human
caggugucggucaggcgguuuu

SEQ ID NO: 293061 - RNA, 22 nt, Human
uguguccuacugaggagcuccu

SEQ ID NO: 293062 - RNA, 18 nt, Human
gacccagcagaugggcuu

SEQ ID NO: 293063 - RNA, 22 nt, Human
cuuauacacgaacacaaggugu

SEQ ID NO: 293064 - RNA, 22 nt, Human
gggaugagagcugggacagaag

SEQ ID NO: 293065 - RNA, 22 nt, Human
uaaauuaugucacaugacucug

SEQ ID NO: 293066 - RNA, 22 nt, Human
uccaggcuugagaccaggcucu

SEQ ID NO: 293067 - RNA, 22 nt, Human
ucauuucccuccuacaaagagg

SEQ ID NO: 293068 - RNA, 22 nt, Human
gguuucaacuuuugugaggaau

SEQ ID NO: 293069 - RNA, 22 nt, Human
uccuggccuuauccccaaacug

SEQ ID NO: 293070 - RNA, 18 nt, Human
uacaugcauaaaugaagc

SEQ ID NO: 293071 - RNA, 22 nt, Human
aaagcagauucugaugcaguag

SEQ ID NO: 293072 - RNA, 20 nt, Human
uaaauuagccuugaagauua

SEQ ID NO: 293073 - RNA, 22 nt, Human
ugacagacuacugccucuauug

SEQ ID NO: 293074 - RNA, 23 nt, Human
ucuguggcuccuucaggcugcug

SEQ ID NO: 293075 - RNA, 22 nt, Human
uccaugagaacccuuggagaua

SEQ ID NO: 293076 - RNA, 22 nt, Human
gagaagccgagucagcugagcc

SEQ ID NO: 293077 - RNA, 22 nt, Human
agugcuccuauggaucaguugu

SEQ ID NO: 293078 - RNA, 19 nt, Human
auguucuauccuccaaguu

SEQ ID NO: 293079 - RNA, 22 nt, Human
ucugggugcccuuugcucuguu

SEQ ID NO: 293080 - RNA, 19 nt, Human
uccagaagucccugagcgg

SEQ ID NO: 293081 - RNA, 20 nt, Human
cuucuucaguaguuuguucu

SEQ ID NO: 293082 - RNA, 22 nt, Human
guccuggccucuggggguaugg

SEQ ID NO: 293083 - RNA, 22 nt, Human
agagcacagaagaauaggugcu

SEQ ID NO: 293084 - RNA, 22 nt, Human
uccuggcaaagauguugguguu

SEQ ID NO: 293085 - RNA, 22 nt, Human
uggauuaguuucaaggcagcaa

SEQ ID NO: 293086 - RNA, 22 nt, Human
cuguucacacacuuguacucuc

SEQ ID NO: 293087 - RNA, 22 nt, Human
uguaauauuguagugacaguac

SEQ ID NO: 293088 - RNA, 22 nt, Human
uauguacaugauuucauuugcu

SEQ ID NO: 293089 - RNA, 22 nt, Human
auuuggaaaugcaucucuugag

SEQ ID NO: 293090 - RNA, 22 nt, Human
ucuucaauuagauuuaccaauu

SEQ ID NO: 293091 - RNA, 22 nt, Human
acaauucauuaaugugagguag

SEQ ID NO: 293092 - RNA, 22 nt, Human
uuucacauauaggggaagcuac

SEQ ID NO: 293093 - RNA, 19 nt, Human
uacauugcugguggggaug

SEQ ID NO: 293094 - RNA, 22 nt, Human
auugcuggcccagaugcuuuag

SEQ ID NO: 293095 - RNA, 22 nt, Human
cugggaggacaacuuggagcuc

SEQ ID NO: 293096 - RNA, 22 nt, Human
ccagugucugugguauagaaag

SEQ ID NO: 293097 - RNA, 22 nt, Human
gguuauauaauucagugcuuuc

SEQ ID NO: 293098 - RNA, 22 nt, Human
aaauuuguucaaugucuauuug

SEQ ID NO: 293099 - RNA, 22 nt, Human
uuuauugaauuguaacccuauu

SEQ ID NO: 293100 - RNA, 22 nt, Human
gcuuggggucaugaggcugcug

SEQ ID NO: 293101 - RNA, 22 nt, Human
gagccaggguuugaaacuagac

SEQ ID NO: 293102 - RNA, 22 nt, Human
ggaucuucagccagcaggugcc

SEQ ID NO: 293103 - RNA, 19 nt, Human
cugaggugcaguaagaggc

SEQ ID NO: 293104 - RNA, 18 nt, Human
uagggcucuagggaguga

SEQ ID NO: 293105 - RNA, 23 nt, Human
cacaaagguuccauucucucacc

SEQ ID NO: 293106 - RNA, 22 nt, Human
aauguguuacuguguaagagca

SEQ ID NO: 293107 - RNA, 22 nt, Human
uggcuucuucauaugugaucuu

SEQ ID NO: 293108 - RNA, 22 nt, Human
uaauuucuucaucucugcagcu

SEQ ID NO: 293109 - RNA, 22 nt, Human
ucaugccauccacaucuguuuc

SEQ ID NO: 293110 - RNA, 21 nt, Human
ugguggaccagugcugggaga

SEQ ID NO: 293111 - RNA, 22 nt, Human
cagugggggggccaugcugcag

SEQ ID NO: 293112 - RNA, 22 nt, Human
ugucuuuaaaauuaaacacauc

SEQ ID NO: 293113 - RNA, 22 nt, Human
ucauuucuccgaccugcugucc

SEQ ID NO: 293114 - RNA, 22 nt, Human
ucugggccucaccugcugcuca

SEQ ID NO: 293115 - RNA, 22 nt, Human
cugaggagaugauaaugucauu

SEQ ID NO: 293116 - RNA, 22 nt, Human
acugucacuugcaacugugagg

SEQ ID NO: 293117 - RNA, 22 nt, Human
cagagcugcuucccaguuugug

SEQ ID NO: 293118 - RNA, 22 nt, Human
acccagggccacagcccgcagu

SEQ ID NO: 293119 - RNA, 22 nt, Human
uauauuuaaauccagguugaaa

SEQ ID NO: 293120 - RNA, 21 nt, Human
uguaaguuucaucugaauugg

SEQ ID NO: 293121 - RNA, 22 nt, Human
acauacauauguuuaaaugcau

SEQ ID NO: 293122 - RNA, 22 nt, Human
augauugaaaaugacauugcca

SEQ ID NO: 293123 - RNA, 22 nt, Human
uuucucagucacaugaaccaau

SEQ ID NO: 293124 - RNA, 22 nt, Human
aucaguuuggugcuuucaguga

SEQ ID NO: 293125 - RNA, 22 nt, Human
cagggaaacuaggaaauaagcu

SEQ ID NO: 293126 - RNA, 22 nt, Human
auuauaaagaacaugugugugg

SEQ ID NO: 293127 - RNA, 21 nt, Human
uuuagggaggauauuuaacuu

SEQ ID NO: 293128 - RNA, 22 nt, Human
acuguccuagaaccugcagcuc

SEQ ID NO: 293129 - RNA, 22 nt, Human
guccaugauucuguguaguaga

SEQ ID NO: 293130 - RNA, 22 nt, Human
guaaacaucgacccaacagggg

SEQ ID NO: 293131 - RNA, 22 nt, Human
uguacagacuguauuuacaagu

SEQ ID NO: 293132 - RNA, 22 nt, Human
aacuucaccuuuuugccacacu

SEQ ID NO: 293133 - RNA, 22 nt, Human
guuagguagaaguuuacuuuga

SEQ ID NO: 293134 - RNA, 22 nt, Human
gguuucaaauuaaagucuuaag

SEQ ID NO: 293135 - RNA, 22 nt, Human
acuuuaaagcagaauggcuaug

SEQ ID NO: 293136 - RNA, 22 nt, Human
uccugggagagugggacuguau

SEQ ID NO: 293137 - RNA, 22 nt, Human
ucagugucugugggcaggaugg

SEQ ID NO: 293138 - RNA, 22 nt, Human
aacaguuuaucaaguuuuuaca

SEQ ID NO: 293139 - RNA, 22 nt, Human
auguuucauuuagauaucaggc

SEQ ID NO: 293140 - RNA, 22 nt, Human
ugcuuuauaacuuaguuuaugg

SEQ ID NO: 293141 - RNA, 22 nt, Human
cauugaaaaacguugacugagu

SEQ ID NO: 293142 - RNA, 22 nt, Human
gagguucaggaaaugggcaaag

SEQ ID NO: 293143 - RNA, 22 nt, Human
acaagucuguuaugcaccugga

SEQ ID NO: 293144 - RNA, 22 nt, Human
acaggcagugggccagauuugu

SEQ ID NO: 293145 - RNA, 23 nt, Human
caggaaaugaauccaggaggaug

SEQ ID NO: 293146 - RNA, 22 nt, Human
uuccuucuaauuuuacaccuga

SEQ ID NO: 293147 - RNA, 22 nt, Human
acuuccugcaaucguccacucc

SEQ ID NO: 293148 - RNA, 22 nt, Human
cucugaaagcaaaacuagagaa

SEQ ID NO: 293149 - RNA, 22 nt, Human
acaguuuauguaaagcugccaa

SEQ ID NO: 293150 - RNA, 22 nt, Human
cagggcucagaagacagaccuc

SEQ ID NO: 293151 - RNA, 22 nt, Human
ccuggcagucaggggaguccuu

SEQ ID NO: 293152 - RNA, 22 nt, Human
uuaccuguuuuacaugcacaac

SEQ ID NO: 293153 - RNA, 22 nt, Human
aggaauguggaagguggcggcg

SEQ ID NO: 293154 - RNA, 19 nt, Human
ucacuucuguuagcaugga

SEQ ID NO: 293155 - RNA, 22 nt, Human
auuaauuuuaccuuuguaaaca

SEQ ID NO: 293156 - RNA, 22 nt, Human
cuagggucaggggccugcgucg

SEQ ID NO: 293157 - RNA, 23 nt, Human
gaggagggucugacaaguguagc

SEQ ID NO: 293158 - RNA, 18 nt, Human
uggcucugccacucaccg

SEQ ID NO: 293159 - RNA, 22 nt, Human
uccugggagcccuugcuccacc

SEQ ID NO: 293160 - RNA, 22 nt, Human
uauguacucaucaacuauugaa

SEQ ID NO: 293161 - RNA, 20 nt, Human
ggguaaaaggcaguguugca

SEQ ID NO: 293162 - RNA, 22 nt, Human
gaggaugguaugaggcaagcaa

SEQ ID NO: 293163 - RNA, 22 nt, Human
acucagagaacauucccagucu

SEQ ID NO: 293164 - RNA, 22 nt, Human
guguguccucuuaacuauuaug

SEQ ID NO: 293165 - RNA, 22 nt, Human
cccugcagccggccagcucauu

SEQ ID NO: 293166 - RNA, 22 nt, Human
uucuuucuuagcaaucuauggu

SEQ ID NO: 293167 - RNA, 22 nt, Human
cuuugcuuuacucccacugugu

SEQ ID NO: 293168 - RNA, 22 nt, Human
ccagugucuucagaguaaaucu

SEQ ID NO: 293169 - RNA, 22 nt, Human
uaccuucaccagcgaauguuug

SEQ ID NO: 293170 - RNA, 22 nt, Human
ucaugacaggugaguuuuuagg

SEQ ID NO: 293171 - RNA, 22 nt, Human
agaucagacuuugugacuagga

SEQ ID NO: 293172 - RNA, 22 nt, Human
gauaauuuuagucugaaaauug

SEQ ID NO: 293173 - RNA, 22 nt, Human
uucuucaugcuguugcugcuug

SEQ ID NO: 293174 - RNA, 22 nt, Human
gagggcucuacucaccacccug

SEQ ID NO: 293175 - RNA, 22 nt, Human
agggaaaguaagcauuucauua

SEQ ID NO: 293176 - RNA, 22 nt, Human
caacaucaguccucaugagaca

SEQ ID NO: 293177 - RNA, 22 nt, Human
acaggcaggagcuccccauucc

SEQ ID NO: 293178 - RNA, 22 nt, Human
ccaggcagagggaauagcaagu

SEQ ID NO: 293179 - RNA, 22 nt, Human
ccuccugguccagcaucucuuu

SEQ ID NO: 293180 - RNA, 22 nt, Human
aucagagaaauggagggcgcuu

SEQ ID NO: 293181 - RNA, 22 nt, Human
uucacauaaugauacaaagcuu

SEQ ID NO: 293182 - RNA, 22 nt, Human
acccagcuaacccuacccugga

SEQ ID NO: 293183 - RNA, 22 nt, Human
ggagcccaagucugcacucggc

SEQ ID NO: 293184 - RNA, 22 nt, Human
uuucugaagggcagcagacucu

SEQ ID NO: 293185 - RNA, 22 nt, Human
uaacacaaaagaauaugugugu

SEQ ID NO: 293186 - RNA, 22 nt, Human
uucaguaaaacacugcaauguc

SEQ ID NO: 293187 - RNA, 22 nt, Human
caguuuauaugucagagcugua

SEQ ID NO: 293188 - RNA, 22 nt, Human
caggccucuauggucagcugag

SEQ ID NO: 293189 - RNA, 18 nt, Human
agcugguggggagacagc

SEQ ID NO: 293190 - RNA, 22 nt, Human
aauuagggaggacaaagguaca

SEQ ID NO: 293191 - RNA, 22 nt, Human
uucaugaagggugaauauaguc

SEQ ID NO: 293192 - RNA, 22 nt, Human
gcuggccucaucacugacuucu

SEQ ID NO: 293193 - RNA, 22 nt, Human
cagggcaggaauuugacauugc

SEQ ID NO: 293194 - RNA, 22 nt, Human
uuauguuugaguauaugacuca

SEQ ID NO: 293195 - RNA, 22 nt, Human
aaagaguucuaugaucuuucca

SEQ ID NO: 293196 - RNA, 22 nt, Human
agcugaagcaacaacaggaugg

SEQ ID NO: 293197 - RNA, 22 nt, Human
agcuaggggaccaagguggccc

SEQ ID NO: 293198 - RNA, 22 nt, Human
caugccauuaacauuagcuagc

SEQ ID NO: 293199 - RNA, 22 nt, Human
gccaggcagcaggaagccagug

SEQ ID NO: 293200 - RNA, 22 nt, Human
cucccagguuccgacgccucuu

SEQ ID NO: 293201 - RNA, 21 nt, Human
uuugcugaagauuuuaggcug

SEQ ID NO: 293202 - RNA, 22 nt, Human
uauguacuacacuagaacauuu

SEQ ID NO: 293203 - RNA, 19 nt, Human
guacagugguaagcuauga

SEQ ID NO: 293204 - RNA, 18 nt, Human
agcagggcauuuugccau

SEQ ID NO: 293205 - RNA, 22 nt, Human
aggcagggaccaguuguuuucu

SEQ ID NO: 293206 - RNA, 19 nt, Human
acuguucuaacuugcagcu

SEQ ID NO: 293207 - RNA, 22 nt, Human
cagacagggcccugugauggua

SEQ ID NO: 293208 - RNA, 22 nt, Human
acaguuuagaaugccacauagu

SEQ ID NO: 293209 - RNA, 22 nt, Human
uugcauuccaguccccacugug

SEQ ID NO: 293210 - RNA, 22 nt, Human
caaggcagcguuccuuucugga

SEQ ID NO: 293211 - RNA, 22 nt, Human
uucuuuguuguacuuuccuaca

SEQ ID NO: 293212 - RNA, 22 nt, Human
cugcucuucccacucacuccca

SEQ ID NO: 293213 - RNA, 18 nt, Human
ucagggaagagaauauga

SEQ ID NO: 293214 - RNA, 22 nt, Human
ccucccuuuuggugucugcaua

SEQ ID NO: 293215 - RNA, 22 nt, Human
aaaagcaauugcaguucuugcc

SEQ ID NO: 293216 - RNA, 21 nt, Human
uucauucauggcauaauauag

SEQ ID NO: 293217 - RNA, 22 nt, Human
cagguggucaggcaaggacacg

SEQ ID NO: 293218 - RNA, 22 nt, Human
gcugggucucucccugguccug

SEQ ID NO: 293219 - RNA, 22 nt, Human
ugggacacaaaccagaccagga

SEQ ID NO: 293220 - RNA, 22 nt, Human
ugggcaggggcccugcuuccgu

SEQ ID NO: 293221 - RNA, 22 nt, Human
uccuggguagccuguccaagau

SEQ ID NO: 293222 - RNA, 22 nt, Human
ucagggcaggcgagcagcugcu

SEQ ID NO: 293223 - RNA, 22 nt, Human
agcuuucucucagccaggcugc

SEQ ID NO: 293224 - RNA, 22 nt, Human
uuguuucuccuggugccugaua

SEQ ID NO: 293225 - RNA, 22 nt, Human
gaggagcugcagggggagucua

SEQ ID NO: 293226 - RNA, 22 nt, Human
ucuuccugcuuuggugaggcuu

SEQ ID NO: 293227 - RNA, 22 nt, Human
gcugccaggggcagcugucuca

SEQ ID NO: 293228 - RNA, 22 nt, Human
aaaguuuuguugauuguggaau

SEQ ID NO: 293229 - RNA, 22 nt, Human
ccuggcagcuccuccccggcgg

SEQ ID NO: 293230 - RNA, 22 nt, Human
agcugcaauuaaagacugugaa

SEQ ID NO: 293231 - RNA, 22 nt, Human
guccagugacaaguagcuggcc

SEQ ID NO: 293232 - RNA, 22 nt, Human
ggcucucuggaggagcucaccc

SEQ ID NO: 293233 - RNA, 22 nt, Human
aguuauuacucuuuaacauauu

SEQ ID NO: 293234 - RNA, 22 nt, Human
gccaggcugcuggcugcugucc

SEQ ID NO: 293235 - RNA, 22 nt, Human
uucuuuuccuacacagcgauuu

SEQ ID NO: 293236 - RNA, 21 nt, Human
acuguucauuugaugaacugg

SEQ ID NO: 293237 - RNA, 22 nt, Human
uccuggccgcuggccccugaga

SEQ ID NO: 293238 - RNA, 22 nt, Human
ucaauuucauucuauuaguuaa

SEQ ID NO: 293239 - RNA, 22 nt, Human
agaaaacagaaagucauuggug

SEQ ID NO: 293240 - RNA, 19 nt, Human
gcuguucugaccaucaccc

SEQ ID NO: 293241 - RNA, 22 nt, Human
auauugagauaagaacugacau

SEQ ID NO: 293242 - RNA, 22 nt, Human
ucugggugacccugggcaaggc

SEQ ID NO: 293243 - RNA, 20 nt, Human
aaacauucauguacaaguga

SEQ ID NO: 293244 - RNA, 23 nt, Human
ucauuucauccagccuugagagu

SEQ ID NO: 293245 - RNA, 22 nt, Human
uuuaaauuauaguuaaugucug

SEQ ID NO: 293246 - RNA, 22 nt, Human
cccacacacauuuaugauagga

SEQ ID NO: 293247 - RNA, 22 nt, Human
aguggggcggacaggaccagga

SEQ ID NO: 293248 - RNA, 22 nt, Human
acagagcaguaagaacacagcu

SEQ ID NO: 293249 - RNA, 22 nt, Human
gacccggcuccaggcccagcag

SEQ ID NO: 293250 - RNA, 22 nt, Human
acauuguaguuguucugcagca

SEQ ID NO: 293251 - RNA, 22 nt, Human
guaaauuauuucaagaucaucu

SEQ ID NO: 293252 - RNA, 22 nt, Human
ugaaaugagauaauuuaagugc

SEQ ID NO: 293253 - RNA, 21 nt, Human
uaaaggcuuuagaauggcaaa

SEQ ID NO: 293254 - RNA, 22 nt, Human
ucauuuuuagcgcgcaaaaguu

SEQ ID NO: 293255 - RNA, 22 nt, Human
cagcucuguucauagauggugc

SEQ ID NO: 293256 - RNA, 22 nt, Human
ucuggcuguuuuagaugagcuc

SEQ ID NO: 293257 - RNA, 22 nt, Human
gaaaguuuucauauauaccaaa

SEQ ID NO: 293258 - RNA, 22 nt, Human
ucuguggccuccuuccacuuac

SEQ ID NO: 293259 - RNA, 22 nt, Human
uuccuggcacacuccugaaugu

SEQ ID NO: 293260 - RNA, 22 nt, Human
ccagggaugcagagguugcagu

SEQ ID NO: 293261 - RNA, 20 nt, Human
agcccuguaaauccccugga

SEQ ID NO: 293262 - RNA, 22 nt, Human
aguuuacagaugcuacaggagc

SEQ ID NO: 293263 - RNA, 21 nt, Human
ggaggaaaaaggaaugacuug

SEQ ID NO: 293264 - RNA, 21 nt, Human
ucuucccucaggauguccugc

SEQ ID NO: 293265 - RNA, 22 nt, Human
uauaauuuaucaugucacaguu

SEQ ID NO: 293266 - RNA, 22 nt, Human
ggcuuucaaggaaaggccucau

SEQ ID NO: 293267 - RNA, 22 nt, Human
cagagggcucggcggccgcucc

SEQ ID NO: 293268 - RNA, 22 nt, Human
agcuguguaagucauguaggug

SEQ ID NO: 293269 - RNA, 22 nt, Human
ggcagaggaagcuggaaguggg

SEQ ID NO: 293270 - RNA, 22 nt, Human
acuuucaugcucugagcacugg

SEQ ID NO: 293271 - RNA, 22 nt, Human
aguaggacuagggguugaggca

SEQ ID NO: 293272 - RNA, 22 nt, Human
auuauaggcuugagccaccgug

SEQ ID NO: 293273 - RNA, 22 nt, Human
uacaguuuguauggucaggaau

SEQ ID NO: 293274 - RNA, 22 nt, Human
uuugacucaagcccucauguua

SEQ ID NO: 293275 - RNA, 23 nt, Human
aaacaugcagcacaugaaugcua

SEQ ID NO: 293276 - RNA, 22 nt, Human
aaacagaugaguuauaauagcc

SEQ ID NO: 293277 - RNA, 22 nt, Human
cagaggcaaaagagguggaggu

SEQ ID NO: 293278 - RNA, 22 nt, Human
cagaugcuuguuggcuggucuc

SEQ ID NO: 293279 - RNA, 22 nt, Human
cccagcuugcccaggacugagg

SEQ ID NO: 293280 - RNA, 22 nt, Human
uucucuuuauguauuuaguggg

SEQ ID NO: 293281 - RNA, 22 nt, Human
uaccugcagcgggaauccauua

SEQ ID NO: 293282 - RNA, 22 nt, Human
ucaauuuauguggcuauucauu

SEQ ID NO: 293283 - RNA, 22 nt, Human
ucacugcgcugacugcuacgau

SEQ ID NO: 293284 - RNA, 22 nt, Human
gcugggcuugguuucccugcuu

SEQ ID NO: 293285 - RNA, 18 nt, Human
ucuuccaacacugacacc

SEQ ID NO: 293286 - RNA, 22 nt, Human
auacucagcugcuagacagaag

SEQ ID NO: 293287 - RNA, 22 nt, Human
guacaaaugagaguucuguuuu

SEQ ID NO: 293288 - RNA, 22 nt, Human
aauugcuucccaagggaggucu

SEQ ID NO: 293289 - RNA, 22 nt, Human
ccagacagcaguuaaaggacau

SEQ ID NO: 293290 - RNA, 22 nt, Human
agcagggccaacaguaaacacc

SEQ ID NO: 293291 - RNA, 22 nt, Human
cagcacacagugacucgcaccu

SEQ ID NO: 293292 - RNA, 22 nt, Human
gccaggcaugggcuucugggcg

SEQ ID NO: 293293 - RNA, 22 nt, Human
agaugguuuugucuuuaugauu

SEQ ID NO: 293294 - RNA, 22 nt, Human
agcuccugaaaauccagacugg

SEQ ID NO: 293295 - RNA, 22 nt, Human
aggcaggucacaugcuuggcga

SEQ ID NO: 293296 - RNA, 19 nt, Human
gaggugucuuuccugagua

SEQ ID NO: 293297 - RNA, 22 nt, Human
agcagggcuucugugccugugc

SEQ ID NO: 293298 - RNA, 22 nt, Human
uuacaagauaaccugaugcugu

SEQ ID NO: 293299 - RNA, 22 nt, Human
uauguagguaaacacagacaua

SEQ ID NO: 293300 - RNA, 22 nt, Human
ccauuguaaagaguauacuuug

SEQ ID NO: 293301 - RNA, 22 nt, Human
ucaaauaaugccauucaucauc

SEQ ID NO: 293302 - RNA, 22 nt, Human
uguguccuguccccuugcugcu

SEQ ID NO: 293303 - RNA, 22 nt, Human
guuuucaugucuauugggcaua

SEQ ID NO: 293304 - RNA, 22 nt, Human
uacaacauuuacguuaggcugu

SEQ ID NO: 293305 - RNA, 22 nt, Human
ccugaaaugaguucugcucacu

SEQ ID NO: 293306 - RNA, 22 nt, Human
acacugaauguuuaagaacuug

SEQ ID NO: 293307 - RNA, 22 nt, Human
gggcaggugccagcucccuguc

SEQ ID NO: 293308 - RNA, 22 nt, Human
cauugcaacuucaaacuccugg

SEQ ID NO: 293309 - RNA, 22 nt, Human
uuaguguuuaaagguuucagag

SEQ ID NO: 293310 - RNA, 22 nt, Human
gcuuugugugaaguccauggcg

SEQ ID NO: 293311 - RNA, 22 nt, Human
acauuucuggaguuucucaaca

SEQ ID NO: 293312 - RNA, 18 nt, Human
ggaagaaaaggaacucag

SEQ ID NO: 293313 - RNA, 22 nt, Human
ucuggcagcucaguucaggucu

SEQ ID NO: 293314 - RNA, 22 nt, Human
uucuuucugggaagaguucaga

SEQ ID NO: 293315 - RNA, 22 nt, Human
cuucuuucaagaauggauuagg

SEQ ID NO: 293316 - RNA, 22 nt, Human
uuuagcauauuuaaggaaugau

SEQ ID NO: 293317 - RNA, 22 nt, Human
ucuucacagaugcauauacuuc

SEQ ID NO: 293318 - RNA, 22 nt, Human
ucuguggcgcauaguugucucu

SEQ ID NO: 293319 - RNA, 22 nt, Human
cacaggugcaagaaguugcagu

SEQ ID NO: 293320 - RNA, 19 nt, Human
acuggcagcuguagucugu

SEQ ID NO: 293321 - RNA, 22 nt, Human
acuuucaaauaucaugauucua

SEQ ID NO: 293322 - RNA, 22 nt, Human
gguggggcucagcaaucugugu

SEQ ID NO: 293323 - RNA, 22 nt, Human
gagagaaaggcuugcaggcugu

SEQ ID NO: 293324 - RNA, 22 nt, Human
uacauaaugagcuaguuaaguu

SEQ ID NO: 293325 - RNA, 23 nt, Human
uuauaaauauuuucagguguguu

SEQ ID NO: 293326 - RNA, 22 nt, Human
gccuggccugaacuaggaggug

SEQ ID NO: 293327 - RNA, 22 nt, Human
uacauucacaguuguucaucuc

SEQ ID NO: 293328 - RNA, 22 nt, Human
ucagugucuugggcuugaaugc

SEQ ID NO: 293329 - RNA, 22 nt, Human
caguuaaacgaugaugggguca

SEQ ID NO: 293330 - RNA, 22 nt, Human
acugucaugugcuaacugucca

SEQ ID NO: 293331 - RNA, 22 nt, Human
gacagguugaaguaucaaaggu

SEQ ID NO: 293332 - RNA, 20 nt, Human
aguuuauuccaggagaacug

SEQ ID NO: 293333 - RNA, 22 nt, Human
acuccuggguuccggagauucu

SEQ ID NO: 293334 - RNA, 22 nt, Human
ucaguuaagaggccacggcagu

SEQ ID NO: 293335 - RNA, 22 nt, Human
aggaauguuaagaaggucuacc

SEQ ID NO: 293336 - RNA, 22 nt, Human
aaucaaagaaugggcuaguugg

SEQ ID NO: 293337 - RNA, 22 nt, Human
aaauugcugaccaaguauauuc

SEQ ID NO: 293338 - RNA, 22 nt, Human
acuuuaaaacugaucaucagag

SEQ ID NO: 293339 - RNA, 22 nt, Human
auguuugucaggauuguaauua

SEQ ID NO: 293340 - RNA, 21 nt, Human
aguguccuuuuacugugaaua

SEQ ID NO: 293341 - RNA, 22 nt, Human
cuucaaaagccagaagccugcg

SEQ ID NO: 293342 - RNA, 22 nt, Human
gccaggcgggucucaaacuccu

SEQ ID NO: 293343 - RNA, 22 nt, Human
aagguggugcuucugcuccucu

SEQ ID NO: 293344 - RNA, 19 nt, Human
cucuccaccuaacagguau

SEQ ID NO: 293345 - RNA, 22 nt, Human
uuccaagaguaaauucaaauug

SEQ ID NO: 293346 - RNA, 22 nt, Human
cugcaggguuuuucaaggacaa

SEQ ID NO: 293347 - RNA, 20 nt, Human
ucauggcugcugagagguuc

SEQ ID NO: 293348 - RNA, 22 nt, Human
gauugcugccagcguguccgug

SEQ ID NO: 293349 - RNA, 22 nt, Human
auuguggugucaguuauaggca

SEQ ID NO: 293350 - RNA, 22 nt, Human
uguccuuuuggcugucuauggu

SEQ ID NO: 293351 - RNA, 22 nt, Human
uucugggugcaacucuguucug

SEQ ID NO: 293352 - RNA, 22 nt, Human
aaagcuaugaggcaugcauuuc

SEQ ID NO: 293353 - RNA, 22 nt, Human
aagcuguucucuaaguuucaug

SEQ ID NO: 293354 - RNA, 22 nt, Human
aacaugugucuugcauuucuug

SEQ ID NO: 293355 - RNA, 22 nt, Human
gaggccugggagccuguccucc

SEQ ID NO: 293356 - RNA, 22 nt, Human
uaauuagaguuugguaaacaau

SEQ ID NO: 293357 - RNA, 22 nt, Human
cuugaaauccagauuucagagg

SEQ ID NO: 293358 - RNA, 20 nt, Human
caaguguuauugugcauuua

SEQ ID NO: 293359 - RNA, 22 nt, Human
uggcagguccacucacagaucu

SEQ ID NO: 293360 - RNA, 22 nt, Human
uguguccuuccaguuuuuccug

SEQ ID NO: 293361 - RNA, 22 nt, Human
uggagagcaagucgcagacaug

SEQ ID NO: 293362 - RNA, 21 nt, Human
accucaagcaacaaccaaggu

SEQ ID NO: 293363 - RNA, 22 nt, Human
gcaaacaucuuuauuuggcaag

SEQ ID NO: 293364 - RNA, 22 nt, Human
gcuggcaggauagaagucuaau

SEQ ID NO: 293365 - RNA, 19 nt, Human
acuaaaaaugauguuugag

SEQ ID NO: 293366 - RNA, 22 nt, Human
ucucaagcuaguguuuauagua

SEQ ID NO: 293367 - RNA, 22 nt, Human
uuucagauuaucucaacuuugg

SEQ ID NO: 293368 - RNA, 22 nt, Human
cuguggcugcgcccugggggag

SEQ ID NO: 293369 - RNA, 22 nt, Human
uuucagaaauuauauuagaugc

SEQ ID NO: 293370 - RNA, 22 nt, Human
caggaggcauauuuaaauccaa

SEQ ID NO: 293371 - RNA, 22 nt, Human
aaucagacaguucuggauucaa

SEQ ID NO: 293372 - RNA, 19 nt, Human
ccucccacggauuccuucc

SEQ ID NO: 293373 - RNA, 22 nt, Human
uggcaagggauuguggagaacu

SEQ ID NO: 293374 - RNA, 22 nt, Human
uuucuauugaucuaauaaacau

SEQ ID NO: 293375 - RNA, 22 nt, Human
agcucagcccuccugugcagcu

SEQ ID NO: 293376 - RNA, 22 nt, Human
gaggaaaaugcaacaggaaugc

SEQ ID NO: 293377 - RNA, 22 nt, Human
aucugagacugaguuuggauuu

SEQ ID NO: 293378 - RNA, 22 nt, Human
guuuuuacuaagguugcuaagu

SEQ ID NO: 293379 - RNA, 22 nt, Human
gcugcuguuccuccaguggauc

SEQ ID NO: 293380 - RNA, 22 nt, Human
gagcaaagcuuuuagggccuuu

SEQ ID NO: 293381 - RNA, 22 nt, Human
acauguaagacuagcuuaaagu

SEQ ID NO: 293382 - RNA, 22 nt, Human
aagaauguggcauuuauuuaua

SEQ ID NO: 293383 - RNA, 22 nt, Human
augaaugggucauuauuugauc

SEQ ID NO: 293384 - RNA, 22 nt, Human
uucaaaauccgggaggcgcccc

SEQ ID NO: 293385 - RNA, 22 nt, Human
gggaccugccauugcucacagg

SEQ ID NO: 293386 - RNA, 22 nt, Human
cugaaaaauauguuuuggagaa

SEQ ID NO: 293387 - RNA, 22 nt, Human
guccugagaccauggccuuagu

SEQ ID NO: 293388 - RNA, 22 nt, Human
acagauuuauugaagcugcugc

SEQ ID NO: 293389 - RNA, 22 nt, Human
cauuugaaccuggauguucuua

SEQ ID NO: 293390 - RNA, 22 nt, Human
uccugugaccagcuuccaugcu

SEQ ID NO: 293391 - RNA, 22 nt, Human
caggaaagccgagugccauagg

SEQ ID NO: 293392 - RNA, 22 nt, Human
uacagugcgggugcgggccucu

SEQ ID NO: 293393 - RNA, 22 nt, Human
caaaugaagguggugggucauu

SEQ ID NO: 293394 - RNA, 22 nt, Human
gaucuucuauguaaugaagugu

SEQ ID NO: 293395 - RNA, 20 nt, Human
cugagcccccagccugcagg

SEQ ID NO: 293396 - RNA, 22 nt, Human
auguuuauguugggcuauauuu

SEQ ID NO: 293397 - RNA, 22 nt, Human
gcaaggauguacugcaauagga

SEQ ID NO: 293398 - RNA, 22 nt, Human
gaagugaagagauuagaaauca

SEQ ID NO: 293399 - RNA, 22 nt, Human
uuauuacagucccagggaguag

SEQ ID NO: 293400 - RNA, 22 nt, Human
agggccagggaagcuguauuuu

SEQ ID NO: 293401 - RNA, 22 nt, Human
aucagguagauuuaauauucug

SEQ ID NO: 293402 - RNA, 22 nt, Human
cuagccugggauuugaacuuau

SEQ ID NO: 293403 - RNA, 22 nt, Human
aaaaagauguccugaaguuuag

SEQ ID NO: 293404 - RNA, 22 nt, Human
uucugggacaucuggacaguuu

SEQ ID NO: 293405 - RNA, 22 nt, Human
ucagggcaagucucagaagguu

SEQ ID NO: 293406 - RNA, 22 nt, Human
uuauuccaauuucuccuacaaa

SEQ ID NO: 293407 - RNA, 22 nt, Human
cuucuuuacuuucuagaaauaa

SEQ ID NO: 293408 - RNA, 22 nt, Human
acaugacaccucuggcugggug

SEQ ID NO: 293409 - RNA, 22 nt, Human
uccaggcauagaaggcacgcac

SEQ ID NO: 293410 - RNA, 22 nt, Human
gauauuuacaaauuugccaaua

SEQ ID NO: 293411 - RNA, 22 nt, Human
uacugucuggguucccaagcaa

SEQ ID NO: 293412 - RNA, 22 nt, Human
aagcuuuaugacuuggagacag

SEQ ID NO: 293413 - RNA, 22 nt, Human
gauucuugggccuucugaaguu

SEQ ID NO: 293414 - RNA, 22 nt, Human
aguaaacacuaaaaugacugcg

SEQ ID NO: 293415 - RNA, 22 nt, Human
agacagugcuaucccaucugug

SEQ ID NO: 293416 - RNA, 22 nt, Human
uuaguuauacuacugaauggag

SEQ ID NO: 293417 - RNA, 22 nt, Human
cccaggcacucuuggucauuuu

SEQ ID NO: 293418 - RNA, 22 nt, Human
caccuguuagcucuaauuuucu

SEQ ID NO: 293419 - RNA, 22 nt, Human
gaguuaaaggaaaauaacuuua

SEQ ID NO: 293420 - RNA, 22 nt, Human
acagcaugagaguagcaaaagg

SEQ ID NO: 293421 - RNA, 22 nt, Human
aucagacaauuguugaguacug

SEQ ID NO: 293422 - RNA, 22 nt, Human
ggaacuugcaaccucuggucac

SEQ ID NO: 293423 - RNA, 22 nt, Human
ggcaggcagauggcugcaccaa

SEQ ID NO: 293424 - RNA, 22 nt, Human
cccgggaggaggaaguugcagu

SEQ ID NO: 293425 - RNA, 22 nt, Human
ggcucugaauuauuccugaguc

SEQ ID NO: 293426 - RNA, 22 nt, Human
gcauucuuagggccuggggugu

SEQ ID NO: 293427 - RNA, 22 nt, Human
cuauugcuaucauucugguggu

SEQ ID NO: 293428 - RNA, 22 nt, Human
aagucucuggcaaaugaucuug

SEQ ID NO: 293429 - RNA, 22 nt, Human
gcuguggcuccaauggugagcc

SEQ ID NO: 293430 - RNA, 22 nt, Human
uacauucuacuuuuucacuccc

SEQ ID NO: 293431 - RNA, 22 nt, Human
agaaauuauuagugaauagucu

SEQ ID NO: 293432 - RNA, 22 nt, Human
cugcaaaagucauugugguuuu

SEQ ID NO: 293433 - RNA, 19 nt, Human
agucaguucugaggaggaa

SEQ ID NO: 293434 - RNA, 22 nt, Human
ggcucugaacauggggaggagu

SEQ ID NO: 293435 - RNA, 22 nt, Human
uggagcagcuaagccucugaga

SEQ ID NO: 293436 - RNA, 22 nt, Human
aggcagcuggaggcagagacua

SEQ ID NO: 293437 - RNA, 22 nt, Human
aaggagaaaugguagaugugca

SEQ ID NO: 293438 - RNA, 22 nt, Human
cagacaggaauucuggcguggu

SEQ ID NO: 293439 - RNA, 18 nt, Human
uuucacaaccuccagagg

SEQ ID NO: 293440 - RNA, 22 nt, Human
aucuuucagggccauuuguauu

SEQ ID NO: 293441 - RNA, 22 nt, Human
auaacaugaccugugcuucaca

SEQ ID NO: 293442 - RNA, 22 nt, Human
acaccauacucauguugguucc

SEQ ID NO: 293443 - RNA, 18 nt, Human
uuugggauccucuuuucu

SEQ ID NO: 293444 - RNA, 20 nt, Human
auucagaauaggcauguaaa

SEQ ID NO: 293445 - RNA, 22 nt, Human
accuccuggcugcucauggaac

SEQ ID NO: 293446 - RNA, 22 nt, Human
cagcuuuggcccagucgggagg

SEQ ID NO: 293447 - RNA, 22 nt, Human
uacaaaguagaaauucaguaaa

SEQ ID NO: 293448 - RNA, 22 nt, Human
gaggccugguuugcaugagaau

SEQ ID NO: 293449 - RNA, 22 nt, Human
auucacaaaaugauauagauac

SEQ ID NO: 293450 - RNA, 22 nt, Human
guccagagauggacgagcagau

SEQ ID NO: 293451 - RNA, 17 nt, Human
uuccagcauguuacuaa

SEQ ID NO: 293452 - RNA, 22 nt, Human
gaaaacauccagagauagaccu

SEQ ID NO: 293453 - RNA, 22 nt, Human
aucucagaaacauaucuaaucc

SEQ ID NO: 293454 - RNA, 22 nt, Human
acuugguugcuucugaaaugac

SEQ ID NO: 293455 - RNA, 17 nt, Human
cgggcauggagggcagg

SEQ ID NO: 293456 - RNA, 21 nt, Human
agggaaagaaaaugagcuaau

SEQ ID NO: 293457 - RNA, 22 nt, Human
auuaauauugguucauuagcug

SEQ ID NO: 293458 - RNA, 22 nt, Human
ugcuggagagccuuggccaagg

SEQ ID NO: 293459 - RNA, 22 nt, Human
auuaaauuagcaaacugugaaa

SEQ ID NO: 293460 - RNA, 22 nt, Human
uugcagggcaucuaugucuggu

SEQ ID NO: 293461 - RNA, 22 nt, Human
auaaacagaguaguugcuacug

SEQ ID NO: 293462 - RNA, 22 nt, Human
ugacagacagcuucucauuuua

SEQ ID NO: 293463 - RNA, 22 nt, Human
gggaggaaggcuugggugagua

SEQ ID NO: 293464 - RNA, 22 nt, Human
aaagugguugcugucagccucu

SEQ ID NO: 293465 - RNA, 22 nt, Human
caguccugggcacagcccuggg

SEQ ID NO: 293466 - RNA, 22 nt, Human
uauacacauguguguauucaua

SEQ ID NO: 293467 - RNA, 22 nt, Human
acuuucuucuacuacuuggaga

SEQ ID NO: 293468 - RNA, 22 nt, Human
uugcaacaucugaacauuuauc

SEQ ID NO: 293469 - RNA, 22 nt, Human
uacagguggaucacuaguauag

SEQ ID NO: 293470 - RNA, 22 nt, Human
uuuuuagaguguuaccaguaua

SEQ ID NO: 293471 - RNA, 22 nt, Human
acaagagcauugcagguguguu

SEQ ID NO: 293472 - RNA, 22 nt, Human
agucaguuucccuggaaagcag

SEQ ID NO: 293473 - RNA, 22 nt, Human
auuagggcuggaugcaaggaaa

SEQ ID NO: 293474 - RNA, 22 nt, Human
aguauacaaauaaauguguaau

SEQ ID NO: 293475 - RNA, 21 nt, Human
cagagcagcguucugcugugg

SEQ ID NO: 293476 - RNA, 22 nt, Human
cuucucccaaguaugcaguuug

SEQ ID NO: 293477 - RNA, 22 nt, Human
ucuugggauagugucucauggc

SEQ ID NO: 293478 - RNA, 22 nt, Human
uuaaauuaggacucuaguucug

SEQ ID NO: 293479 - RNA, 22 nt, Human
aaauccuaccaagaaauucccu

SEQ ID NO: 293480 - RNA, 22 nt, Human
ggucuggauuucugcuucuuuc

SEQ ID NO: 293481 - RNA, 22 nt, Human
auacagauugcuauacuuacaa

SEQ ID NO: 293482 - RNA, 22 nt, Human
caguuaaaaugugcuauaagaa

SEQ ID NO: 293483 - RNA, 22 nt, Human
aauauguuccacuuaaagcugg

SEQ ID NO: 293484 - RNA, 22 nt, Human
accugagaccuaaucugacugu

SEQ ID NO: 293485 - RNA, 22 nt, Human
uggaaagcaguucuuagaaucg

SEQ ID NO: 293486 - RNA, 22 nt, Human
uaguuucagcuccuucauccug

SEQ ID NO: 293487 - RNA, 22 nt, Human
aagagcauggaauggagaucca

SEQ ID NO: 293488 - RNA, 22 nt, Human
uccaugagcuagggauucauca

SEQ ID NO: 293489 - RNA, 22 nt, Human
acaagauuuagcuuaaagggcu

SEQ ID NO: 293490 - RNA, 22 nt, Human
aaccagaucgacuguuaacagc

SEQ ID NO: 293491 - RNA, 22 nt, Human
gcagggcauagaggcacggagg

SEQ ID NO: 293492 - RNA, 22 nt, Human
auucaguuucauggcacagcua

SEQ ID NO: 293493 - RNA, 20 nt, Human
ccagcauguacacaugugga

SEQ ID NO: 293494 - RNA, 18 nt, Human
uucauguuggcuuaggga

SEQ ID NO: 293495 - RNA, 22 nt, Human
ucugaauuuugaugugcauuga

SEQ ID NO: 293496 - RNA, 22 nt, Human
aguguccuuguuauuacugcuc

SEQ ID NO: 293497 - RNA, 22 nt, Human
agggcuccaggggcugggugac

SEQ ID NO: 293498 - RNA, 22 nt, Human
cuagagaagagguuaagcauga

SEQ ID NO: 293499 - RNA, 22 nt, Human
uguuuccauggugacagcagcu

SEQ ID NO: 293500 - RNA, 22 nt, Human
cagcuuuaggacucauaauaaa

SEQ ID NO: 293501 - RNA, 22 nt, Human
gguggcagaggugcaucagccc

SEQ ID NO: 293502 - RNA, 22 nt, Human
cauaaucccaggcuugcauuca

SEQ ID NO: 293503 - RNA, 22 nt, Human
uaucuuuguaucaaucuccauu

SEQ ID NO: 293504 - RNA, 20 nt, Human
caccuggcugacugucucca

SEQ ID NO: 293505 - RNA, 22 nt, Human
aguaucagaugugauuaaaggg

SEQ ID NO: 293506 - RNA, 22 nt, Human
acuaaauauuugagagguguag

SEQ ID NO: 293507 - RNA, 22 nt, Human
ugggcucaaucugcuucuguuu

SEQ ID NO: 293508 - RNA, 22 nt, Human
cccacccacucugaccagaagc

SEQ ID NO: 293509 - RNA, 23 nt, Human
agcagggccagaauacuugcugu

SEQ ID NO: 293510 - RNA, 22 nt, Human
uggaggcaguuuaagucugaga

SEQ ID NO: 293511 - RNA, 22 nt, Human
uugguacauguuaaggaagagu

SEQ ID NO: 293512 - RNA, 22 nt, Human
auuguuggguaguuuguucagc

SEQ ID NO: 293513 - RNA, 22 nt, Human
ggcuuuaucaaaugagacccug

SEQ ID NO: 293514 - RNA, 22 nt, Human
aguuuauucugcuuggcccucc

SEQ ID NO: 293515 - RNA, 22 nt, Human
cccagcagcuugcacagugcug

SEQ ID NO: 293516 - RNA, 22 nt, Human
cagcagccucuugugccugugg

SEQ ID NO: 293517 - RNA, 22 nt, Human
ggaauguucuggucugguucau

SEQ ID NO: 293518 - RNA, 22 nt, Human
acacauuuauuacaugcaugug

SEQ ID NO: 293519 - RNA, 22 nt, Human
cacaucugacuuccagugcagg

SEQ ID NO: 293520 - RNA, 21 nt, Human
aagaugauauuuuaucuguag

SEQ ID NO: 293521 - RNA, 22 nt, Human
uggucauuaauucuuaccuuua

SEQ ID NO: 293522 - RNA, 22 nt, Human
ggcaaacacaccucggugagaa

SEQ ID NO: 293523 - RNA, 22 nt, Human
ggaugcaggaacacagcgaccu

SEQ ID NO: 293524 - RNA, 22 nt, Human
uggcaggugcacuuuugguuuc

SEQ ID NO: 293525 - RNA, 22 nt, Human
uuucuucaauugcuaacaagga

SEQ ID NO: 293526 - RNA, 22 nt, Human
ccaggcagggcucaaggaaccu

SEQ ID NO: 293527 - RNA, 22 nt, Human
aagggcucccugccugaggugg

SEQ ID NO: 293528 - RNA, 22 nt, Human
gacuacucaaacuuucucuaua

SEQ ID NO: 293529 - RNA, 21 nt, Human
cagaggcagguccugggacgg

SEQ ID NO: 293530 - RNA, 22 nt, Human
uauguuuuucagacguccuaca

SEQ ID NO: 293531 - RNA, 22 nt, Human
uuucugagaaauuaaacacuuu

SEQ ID NO: 293532 - RNA, 22 nt, Human
uauuucugucagccagauaugg

SEQ ID NO: 293533 - RNA, 21 nt, Human
aagugguuuagguuaccgggg

SEQ ID NO: 293534 - RNA, 22 nt, Human
uaaauguauaggcacuaaaccu

SEQ ID NO: 293535 - RNA, 22 nt, Human
cuuuggaggaaaauugagguca

SEQ ID NO: 293536 - RNA, 22 nt, Human
cacagggagaggaacagcgcag

SEQ ID NO: 293537 - RNA, 22 nt, Human
ugcaaacaacuguuuaaugcug

SEQ ID NO: 293538 - RNA, 22 nt, Human
ucagggaagagagaucuccuag

SEQ ID NO: 293539 - RNA, 22 nt, Human
acaggcacugucaagucaugaa

SEQ ID NO: 293540 - RNA, 22 nt, Human
cagccagaaccuaggaugagcu

SEQ ID NO: 293541 - RNA, 22 nt, Human
uuugggaaauaguagaaaaugu

SEQ ID NO: 293542 - RNA, 22 nt, Human
aggccaggggugagcacuucug

SEQ ID NO: 293543 - RNA, 22 nt, Human
uggcuggaguauaggaguagga

SEQ ID NO: 293544 - RNA, 18 nt, Human
cuccagggaacucaguca

SEQ ID NO: 293545 - RNA, 22 nt, Human
uccuguuguucgccugcgaugg

SEQ ID NO: 293546 - RNA, 22 nt, Human
aauuuagauugauaaacaugga

SEQ ID NO: 293547 - RNA, 22 nt, Human
augaaaagggagugauauuugu

SEQ ID NO: 293548 - RNA, 22 nt, Human
acuuucaauucccuuagcaacu

SEQ ID NO: 293549 - RNA, 22 nt, Human
uucugugaggacuucucaagga

SEQ ID NO: 293550 - RNA, 22 nt, Human
uucaguuucaaauccugugaag

SEQ ID NO: 293551 - RNA, 20 nt, Human
caugugucaguucucaccca

SEQ ID NO: 293552 - RNA, 22 nt, Human
aucacaaaggcugcuucaugau

SEQ ID NO: 293553 - RNA, 22 nt, Human
ucagggaacaauguuauggcuu

SEQ ID NO: 293554 - RNA, 22 nt, Human
uugggaucucaaauccagcuau

SEQ ID NO: 293555 - RNA, 21 nt, Human
gggaggaagcugcuucucucu

SEQ ID NO: 293556 - RNA, 23 nt, Human
cucaccaagcgccgccgcugugu

SEQ ID NO: 293557 - RNA, 22 nt, Human
augcaugaaagaauccaagccu

SEQ ID NO: 293558 - RNA, 22 nt, Human
uuguguacuacaguaugccaca

SEQ ID NO: 293559 - RNA, 22 nt, Human
agugugagaugauugaggagca

SEQ ID NO: 293560 - RNA, 22 nt, Human
aaugggcuuuggccaguaggag

SEQ ID NO: 293561 - RNA, 22 nt, Human
aagcccucauuagccauagccc

SEQ ID NO: 293562 - RNA, 19 nt, Human
aggaaggaaccugagucug

SEQ ID NO: 293563 - RNA, 21 nt, Human
uguguaaaguugaaauccugu

SEQ ID NO: 293564 - RNA, 22 nt, Human
aauuuaagagcauagcuccaac

SEQ ID NO: 293565 - RNA, 22 nt, Human
ccacugccagccgcccggaggc

SEQ ID NO: 293566 - RNA, 22 nt, Human
ucacuuuacagcuaagguuguu

SEQ ID NO: 293567 - RNA, 22 nt, Human
ucuuucccuguguuagccugua

SEQ ID NO: 293568 - RNA, 22 nt, Human
agcaauaugacauugcuacauc

SEQ ID NO: 293569 - RNA, 22 nt, Human
cuucguuuuuaguagcaauguu

SEQ ID NO: 293570 - RNA, 22 nt, Human
gcauucuugguaugaaggacag

SEQ ID NO: 293571 - RNA, 22 nt, Human
uggcaguggcucagagugcaga

SEQ ID NO: 293572 - RNA, 22 nt, Human
acagggauuuuccaggcuaccc

SEQ ID NO: 293573 - RNA, 22 nt, Human
aagauuuauuagaugcuuaccu

SEQ ID NO: 293574 - RNA, 22 nt, Human
ucagagagccucaggcacugcc

SEQ ID NO: 293575 - RNA, 22 nt, Human
aacuuuaucggaacagguacuc

SEQ ID NO: 293576 - RNA, 23 nt, Human
ggcacucggccgugaacucgugc

SEQ ID NO: 293577 - RNA, 22 nt, Human
uuuguguuguacuucugugcau

SEQ ID NO: 293578 - RNA, 16 nt, Human
uggcuuggguuucaug

SEQ ID NO: 293579 - RNA, 23 nt, Human
agucuuacugucccagaacaggg

SEQ ID NO: 293580 - RNA, 22 nt, Human
aauuaagaaaauguuuuaugau

SEQ ID NO: 293581 - RNA, 22 nt, Human
cugggucugggccuccuggagu

SEQ ID NO: 293582 - RNA, 22 nt, Human
gcucucacuuuagguuggaccg

SEQ ID NO: 293583 - RNA, 22 nt, Human
cauguguccuagcuauucuccu

SEQ ID NO: 293584 - RNA, 22 nt, Human
gcccaggauaaugcugucccug

SEQ ID NO: 293585 - RNA, 22 nt, Human
uuccagaagauggcagcaaagg

SEQ ID NO: 293586 - RNA, 22 nt, Human
uuucacauacaguguauaguag

SEQ ID NO: 293587 - RNA, 22 nt, Human
uuugcuuugggagguugucugg

SEQ ID NO: 293588 - RNA, 22 nt, Human
ucuagaaaguacuagagcuggu

SEQ ID NO: 293589 - RNA, 22 nt, Human
gcuuuauuuugugagggauuac

SEQ ID NO: 293590 - RNA, 22 nt, Human
gaguugaucauuauuugguuuc

SEQ ID NO: 293591 - RNA, 22 nt, Human
cauguaaagcauccuucuaggg

SEQ ID NO: 293592 - RNA, 19 nt, Human
aaggugguuugucucugua

SEQ ID NO: 293593 - RNA, 22 nt, Human
agagccaguuaagcacuuacag

SEQ ID NO: 293594 - RNA, 22 nt, Human
caggcucacuguaaggucagcu

SEQ ID NO: 293595 - RNA, 22 nt, Human
uauuucagcccuacuacuuggc

SEQ ID NO: 293596 - RNA, 22 nt, Human
uuuguagauucauugaacuuuu

SEQ ID NO: 293597 - RNA, 22 nt, Human
cagggcaguaacgggaacaucu

SEQ ID NO: 293598 - RNA, 22 nt, Human
aaaugacacucauucaguguca

SEQ ID NO: 293599 - RNA, 22 nt, Human
gcacccagaggucagcagugcu

SEQ ID NO: 293600 - RNA, 22 nt, Human
cuccuggaccagggcuauuggg

SEQ ID NO: 293601 - RNA, 22 nt, Human
agcagggccuggcacuccuggg

SEQ ID NO: 293602 - RNA, 22 nt, Human
gagguguccucagccaacucug

SEQ ID NO: 293603 - RNA, 22 nt, Human
ucuuuauuucugaaucccccau

SEQ ID NO: 293604 - RNA, 19 nt, Human
gauagcugaugaccaucau

SEQ ID NO: 293605 - RNA, 22 nt, Human
auucauuuagguauucacuuac

SEQ ID NO: 293606 - RNA, 22 nt, Human
cuguguccucccgcugcaccca

SEQ ID NO: 293607 - RNA, 22 nt, Human
aaaguuuucugccuucauuaga

SEQ ID NO: 293608 - RNA, 21 nt, Human
ugggugggcagagucucuuca

SEQ ID NO: 293609 - RNA, 22 nt, Human
uuguagaauuuggaucucggca

SEQ ID NO: 293610 - RNA, 22 nt, Human
uucaugaaagacagcaacugug

SEQ ID NO: 293611 - RNA, 22 nt, Human
uauucuuguaccuuaaaugauu

SEQ ID NO: 293612 - RNA, 22 nt, Human
auagucuuacuuuucucugcua

SEQ ID NO: 293613 - RNA, 22 nt, Human
auuaggucauggggaggcccua

SEQ ID NO: 293614 - RNA, 21 nt, Human
gcuggcuuccugagggcugag

SEQ ID NO: 293615 - RNA, 22 nt, Human
ccagcccaaacaagccgccuuc

SEQ ID NO: 293616 - RNA, 22 nt, Human
caauucuuucagcugcauuugu

SEQ ID NO: 293617 - RNA, 20 nt, Human
caggagggacauuucagcau

SEQ ID NO: 293618 - RNA, 22 nt, Human
uacuuacagaaggaagcaauug

SEQ ID NO: 293619 - RNA, 22 nt, Human
cagcucuccacccuccugguuc

SEQ ID NO: 293620 - RNA, 22 nt, Human
ucugaggcugaauggacuccgu

SEQ ID NO: 293621 - RNA, 21 nt, Human
ggagaaggacaauguugagua

SEQ ID NO: 293622 - RNA, 22 nt, Human
acaaaguagucaaaguagauga

SEQ ID NO: 293623 - RNA, 22 nt, Human
ucuuuucuccagaccugggauc

SEQ ID NO: 293624 - RNA, 22 nt, Human
aacugcucauuugagaguaugc

SEQ ID NO: 293625 - RNA, 21 nt, Human
uaaauaauaaguugcugagau

SEQ ID NO: 293626 - RNA, 22 nt, Human
aauuaaaagauaacccaugagu

SEQ ID NO: 293627 - RNA, 22 nt, Human
agaaaugaagagagucaagguu

SEQ ID NO: 293628 - RNA, 22 nt, Human
uccaaggacucuugucagcugu

SEQ ID NO: 293629 - RNA, 22 nt, Human
ccugaaaauauccucuccuuug

SEQ ID NO: 293630 - RNA, 22 nt, Human
cuuccagaggaacucugcagug

SEQ ID NO: 293631 - RNA, 22 nt, Human
ucacaauuuggauacagcuaug

SEQ ID NO: 293632 - RNA, 22 nt, Human
uggaccugagccuggcccugcc

SEQ ID NO: 293633 - RNA, 22 nt, Human
ugggguggauagaaagugaugu

SEQ ID NO: 293634 - RNA, 22 nt, Human
caaggcaggccaguuucaaggc

SEQ ID NO: 293635 - RNA, 22 nt, Human
uccaaggcuccggcccuggcgu

SEQ ID NO: 293636 - RNA, 22 nt, Human
uagucaguaugaaauugcucaa

SEQ ID NO: 293637 - RNA, 22 nt, Human
aguggguguagucuuccuccug

SEQ ID NO: 293638 - RNA, 20 nt, Human
ugaucaugugaaagucaugu

SEQ ID NO: 293639 - RNA, 22 nt, Human
agaggacagguuuuccaugggc

SEQ ID NO: 293640 - RNA, 22 nt, Human
acuguacucuuauagccaucug

SEQ ID NO: 293641 - RNA, 22 nt, Human
uuauacacaauucuuuuacuac

SEQ ID NO: 293642 - RNA, 22 nt, Human
uuagauaacaguagaauaucaa

SEQ ID NO: 293643 - RNA, 22 nt, Human
uucuggaaagcauuugaggccc

SEQ ID NO: 293644 - RNA, 22 nt, Human
ccugagagugagugccuccuua

SEQ ID NO: 293645 - RNA, 22 nt, Human
ggcaggugcaccugagccaucu

SEQ ID NO: 293646 - RNA, 22 nt, Human
auucaaaagaccaugcagacuc

SEQ ID NO: 293647 - RNA, 22 nt, Human
gggcccugggauucagagcaag

SEQ ID NO: 293648 - RNA, 22 nt, Human
agggauguucauuuuguggcug

SEQ ID NO: 293649 - RNA, 22 nt, Human
aagagacaaugucuuuuggaua

SEQ ID NO: 293650 - RNA, 22 nt, Human
gagagacagcacacaguguggg

SEQ ID NO: 293651 - RNA, 22 nt, Human
gcaaagcacacccucagaguuu

SEQ ID NO: 293652 - RNA, 22 nt, Human
acuggcaggcugcuggccggcg

SEQ ID NO: 293653 - RNA, 22 nt, Human
gcucuggccagacccucagugg

SEQ ID NO: 293654 - RNA, 22 nt, Human
ugcucagcagucaaggucauag

SEQ ID NO: 293655 - RNA, 22 nt, Human
guagggacccacagucuauauu

SEQ ID NO: 293656 - RNA, 22 nt, Human
uucuguauguacauauguguau

SEQ ID NO: 293657 - RNA, 18 nt, Human
uacuuuauucccccucca

SEQ ID NO: 293658 - RNA, 20 nt, Human
auuagcuuggagacaguggc

SEQ ID NO: 293659 - RNA, 22 nt, Human
ucccagagccaagcuauggaug

SEQ ID NO: 293660 - RNA, 22 nt, Human
uuccugaacauuucuaaguuga

SEQ ID NO: 293661 - RNA, 22 nt, Human
gggcuuggcacaugggcucagc

SEQ ID NO: 293662 - RNA, 22 nt, Human
uagggcagaguccaggaugggc

SEQ ID NO: 293663 - RNA, 22 nt, Human
agauguuaucauucagaguagc

SEQ ID NO: 293664 - RNA, 22 nt, Human
caaaauuagaaaugcagcuguu

SEQ ID NO: 293665 - RNA, 22 nt, Human
gaaagacuuccuuugagaguac

SEQ ID NO: 293666 - RNA, 22 nt, Human
uguguguguuccuccucagcua

SEQ ID NO: 293667 - RNA, 22 nt, Human
caugaaaaugucaaguucugcu

SEQ ID NO: 293668 - RNA, 22 nt, Human
gccugcagggccugggccuacc

SEQ ID NO: 293669 - RNA, 22 nt, Human
aguguccucaucuguaaaauga

SEQ ID NO: 293670 - RNA, 22 nt, Human
ccugcagguaaggcuaacugcc

SEQ ID NO: 293671 - RNA, 22 nt, Human
uaguuaggaaaguccagggagc

SEQ ID NO: 293672 - RNA, 22 nt, Human
ugaaauguuaaucacacaaagg

SEQ ID NO: 293673 - RNA, 22 nt, Human
ucuggagggguuuagagggaca

SEQ ID NO: 293674 - RNA, 22 nt, Human
ccuguggcacaugcagggauuc

SEQ ID NO: 293675 - RNA, 22 nt, Human
accagcaagauuuugcuuugca

SEQ ID NO: 293676 - RNA, 22 nt, Human
ggacaggugacugcccagagug

SEQ ID NO: 293677 - RNA, 22 nt, Human
agugacuggugugaaguuaaau

SEQ ID NO: 293678 - RNA, 19 nt, Human
ccccaggguaggcuagggg

SEQ ID NO: 293679 - RNA, 19 nt, Human
ugugccucuauagcaugug

SEQ ID NO: 293680 - RNA, 22 nt, Human
gagcugaaggagaaagcagggg

SEQ ID NO: 293681 - RNA, 22 nt, Human
gggcuucuugccauggggacgg

SEQ ID NO: 293682 - RNA, 22 nt, Human
aacuucauuccuuuuuaugacu

SEQ ID NO: 293683 - RNA, 22 nt, Human
cccacaggcaggugcaugggcu

SEQ ID NO: 293684 - RNA, 22 nt, Human
agcagagacaugaaauaugcuu

SEQ ID NO: 293685 - RNA, 22 nt, Human
aaacugugagcuaguaaauagg

SEQ ID NO: 293686 - RNA, 22 nt, Human
ggaagaaaucugguuaagagau

SEQ ID NO: 293687 - RNA, 20 nt, Human
auguucuucauuuaauguuc

SEQ ID NO: 293688 - RNA, 20 nt, Human
aggcucagcugagcucuugg

SEQ ID NO: 293689 - RNA, 22 nt, Human
ccuuuucuggccaccaagcgcu

SEQ ID NO: 293690 - RNA, 22 nt, Human
gucucagguucgagccuccuua

SEQ ID NO: 293691 - RNA, 22 nt, Human
cugggugagcuggccagagggu

SEQ ID NO: 293692 - RNA, 17 nt, Human
gauuuccugaaguucuu

SEQ ID NO: 293693 - RNA, 22 nt, Human
ggauguucugggguucucuugu

SEQ ID NO: 293694 - RNA, 22 nt, Human
gcaaaucaccaccuagcuggau

SEQ ID NO: 293695 - RNA, 22 nt, Human
auuuacuggaaaaacuaugagc

SEQ ID NO: 293696 - RNA, 20 nt, Human
caaaagcaaugaaguuauga

SEQ ID NO: 293697 - RNA, 22 nt, Human
ugaaagcacaaguucuaacagg

SEQ ID NO: 293698 - RNA, 22 nt, Human
ggaugugaaucugggcugagac

SEQ ID NO: 293699 - RNA, 22 nt, Human
cuuauuuugcugaugacccagg

SEQ ID NO: 293700 - RNA, 19 nt, Human
cuugaaaugagacugaagg

SEQ ID NO: 293701 - RNA, 22 nt, Human
uuagcaauuccagguaaguuau

SEQ ID NO: 293702 - RNA, 22 nt, Human
aaacaucuauuaugugcugagc

SEQ ID NO: 293703 - RNA, 22 nt, Human
cuuuauuguccuucuuaggugg

SEQ ID NO: 293704 - RNA, 22 nt, Human
uucccacaguguugaauccucu

SEQ ID NO: 293705 - RNA, 22 nt, Human
cuggcaguuugccaggagcucg

SEQ ID NO: 293706 - RNA, 22 nt, Human
ccugccaggcgagucuaggcca

SEQ ID NO: 293707 - RNA, 23 nt, Human
ugcugcccacucuuccagcccuc

SEQ ID NO: 293708 - RNA, 22 nt, Human
caaaugcagauucaggaguucu

SEQ ID NO: 293709 - RNA, 18 nt, Human
acagggaugggguaagug

SEQ ID NO: 293710 - RNA, 22 nt, Human
cagugagguggauggauggccu

SEQ ID NO: 293711 - RNA, 17 nt, Human
acugucuuuuacacccu

SEQ ID NO: 293712 - RNA, 22 nt, Human
ccuggcagccucagccaauucu

SEQ ID NO: 293713 - RNA, 20 nt, Human
uuucugugcccaggucuguu

SEQ ID NO: 293714 - RNA, 23 nt, Human
acagugucugcugcaagauaucu

SEQ ID NO: 293715 - RNA, 22 nt, Human
agcuggagaauguggaugaucc

SEQ ID NO: 293716 - RNA, 22 nt, Human
cugagccacugcuuguucagug

SEQ ID NO: 293717 - RNA, 22 nt, Human
ccaaaauauuagugcuuaagua

SEQ ID NO: 293718 - RNA, 20 nt, Human
ccagacagcaccugccuggu

SEQ ID NO: 293719 - RNA, 22 nt, Human
aaagcugcugugaaugguuugg

SEQ ID NO: 293720 - RNA, 22 nt, Human
agaugguccaucuauuuucuau

SEQ ID NO: 293721 - RNA, 22 nt, Human
accugagaaugggggcaugugu

SEQ ID NO: 293722 - RNA, 22 nt, Human
uuucuuuuccaauaucccuacu

SEQ ID NO: 293723 - RNA, 22 nt, Human
cuguacaaguccuucaucaggg

SEQ ID NO: 293724 - RNA, 22 nt, Human
cuguccuguacuuugaggcccu

SEQ ID NO: 293725 - RNA, 22 nt, Human
ucaucuguuaugggaguuuuug

SEQ ID NO: 293726 - RNA, 22 nt, Human
acagagagaggcccgaggcugc

SEQ ID NO: 293727 - RNA, 22 nt, Human
ugacagguuguguagguggcca

SEQ ID NO: 293728 - RNA, 22 nt, Human
gcuuggcuguguucaagggcgg

SEQ ID NO: 293729 - RNA, 22 nt, Human
agauugaagacugguggagcug

SEQ ID NO: 293730 - RNA, 22 nt, Human
aguccugucaccucuacuuucg

SEQ ID NO: 293731 - RNA, 22 nt, Human
auuugcuuaucuccacaguugu

SEQ ID NO: 293732 - RNA, 22 nt, Human
uuuacuuguucugcugaauucu

SEQ ID NO: 293733 - RNA, 22 nt, Human
auuuacagaugaugcuauuuga

SEQ ID NO: 293734 - RNA, 22 nt, Human
cacaugugggaaauggugcuua

SEQ ID NO: 293735 - RNA, 22 nt, Human
ugugacccagacucaucuucuu

SEQ ID NO: 293736 - RNA, 22 nt, Human
cuccuacauuccaccuuggacu

SEQ ID NO: 293737 - RNA, 22 nt, Human
aggggagguggcagaaaugugc

SEQ ID NO: 293738 - RNA, 19 nt, Human
accugcaguaauaauuccu

SEQ ID NO: 293739 - RNA, 22 nt, Human
uuugaaugcaggacauacagaa

SEQ ID NO: 293740 - RNA, 22 nt, Human
acacauauucauauguacuuac

SEQ ID NO: 293741 - RNA, 22 nt, Human
uguauuaacauuaauaaaaugg

SEQ ID NO: 293742 - RNA, 22 nt, Human
uggaagggaaaguuuggggucc

SEQ ID NO: 293743 - RNA, 17 nt, Human
ggcuggaggggacccgg

SEQ ID NO: 293744 - RNA, 22 nt, Human
augaggagcuguuuuaacugcu

SEQ ID NO: 293745 - RNA, 22 nt, Human
uauaauuuggggaaaguggugu

SEQ ID NO: 293746 - RNA, 22 nt, Human
ucuguucagcugccucagggua

SEQ ID NO: 293747 - RNA, 22 nt, Human
aacauaauguggccaaagucac

SEQ ID NO: 293748 - RNA, 22 nt, Human
uggcagggagccaccggucaug

SEQ ID NO: 293749 - RNA, 22 nt, Human
caaagcuggacugcucaguuca

SEQ ID NO: 293750 - RNA, 22 nt, Human
accagaggcaguuucggcuggu

SEQ ID NO: 293751 - RNA, 22 nt, Human
agugucuguuguucagaacucu

SEQ ID NO: 293752 - RNA, 22 nt, Human
ugaagcaguucucagaaguggg

SEQ ID NO: 293753 - RNA, 22 nt, Human
caaggcagaauucagacucagg

SEQ ID NO: 293754 - RNA, 22 nt, Human
aguggcagggcuggcugcugca

SEQ ID NO: 293755 - RNA, 22 nt, Human
uccaggcugggcugaagggugc

SEQ ID NO: 293756 - RNA, 22 nt, Human
gaauaucccgcuaugcaaagua

SEQ ID NO: 293757 - RNA, 22 nt, Human
ggccucugguucacagggagga

SEQ ID NO: 293758 - RNA, 22 nt, Human
aucuucccaggcuggggagagg

SEQ ID NO: 293759 - RNA, 22 nt, Human
uacacaugcucagauuccugug

SEQ ID NO: 293760 - RNA, 22 nt, Human
accuccuggugcccaaguguuu

SEQ ID NO: 293761 - RNA, 22 nt, Human
gaacauuugaugaugacauugg

SEQ ID NO: 293762 - RNA, 22 nt, Human
uucugcaucugaauuuaaguac

SEQ ID NO: 293763 - RNA, 22 nt, Human
gacaucugaggcccucagagcc

SEQ ID NO: 293764 - RNA, 22 nt, Human
uaugcacacauguaugcaugug

SEQ ID NO: 293765 - RNA, 23 nt, Human
auugugagauuacuaucacacug

SEQ ID NO: 293766 - RNA, 22 nt, Human
ugcuggcuuugcgagaugcauu

SEQ ID NO: 293767 - RNA, 22 nt, Human
uucucuuugacauuauucaggu

SEQ ID NO: 293768 - RNA, 22 nt, Human
ggacauguuccuuuucaucuuu

SEQ ID NO: 293769 - RNA, 23 nt, Human
ucucagaggauuccugggccuug

SEQ ID NO: 293770 - RNA, 22 nt, Human
uugcuuuauucacaucuauauu

SEQ ID NO: 293771 - RNA, 22 nt, Human
uacaggugcucuacagacagga

SEQ ID NO: 293772 - RNA, 22 nt, Human
aaacagauaaugcuauaaaugg

SEQ ID NO: 293773 - RNA, 18 nt, Human
uuuauauggauagagacc

SEQ ID NO: 293774 - RNA, 19 nt, Human
acccagggguuuaugugug

SEQ ID NO: 293775 - RNA, 21 nt, Human
agcuguggcgaggggaacaug

SEQ ID NO: 293776 - RNA, 22 nt, Human
uuuauauauggcuggucuggau

SEQ ID NO: 293777 - RNA, 22 nt, Human
ugcagaaauucagaaagcauaa

SEQ ID NO: 293778 - RNA, 22 nt, Human
acaugagaagcugcaacaugac

SEQ ID NO: 293779 - RNA, 19 nt, Human
gcuccuggaugaccugugg

SEQ ID NO: 293780 - RNA, 22 nt, Human
aucaguuuggaacauucaggcc

SEQ ID NO: 293781 - RNA, 22 nt, Human
agagacaggguuuugucguguu

SEQ ID NO: 293782 - RNA, 22 nt, Human
ucauuacaguguuuauaugucu

SEQ ID NO: 293783 - RNA, 21 nt, Human
acauguaagagaguuucaaga

SEQ ID NO: 293784 - RNA, 22 nt, Human
acuuccagcuagguucugcuaa

SEQ ID NO: 293785 - RNA, 22 nt, Human
ggggagaauaaaucagauuuua

SEQ ID NO: 293786 - RNA, 22 nt, Human
ucaggagcucuucccuggugug

SEQ ID NO: 293787 - RNA, 22 nt, Human
acagauuuggcccagccaaugc

SEQ ID NO: 293788 - RNA, 22 nt, Human
cagugcaguggcugagcuggag

SEQ ID NO: 293789 - RNA, 22 nt, Human
uccagcaugaaggggcuuuuau

SEQ ID NO: 293790 - RNA, 22 nt, Human
uagcuuuaaugaguugguaaga

SEQ ID NO: 293791 - RNA, 22 nt, Human
aguuuacacuuuugauucuuau

SEQ ID NO: 293792 - RNA, 22 nt, Human
agcugcaauucuggacauaguc

SEQ ID NO: 293793 - RNA, 22 nt, Human
uaguuuguagaaaucuagaaau

SEQ ID NO: 293794 - RNA, 22 nt, Human
augcaucuguaguguuauauga

SEQ ID NO: 293795 - RNA, 22 nt, Human
gucuccuaaaccauccugguac

SEQ ID NO: 293796 - RNA, 22 nt, Human
aaugcuaaaacacagauuuuug

SEQ ID NO: 293797 - RNA, 22 nt, Human
uuuacaguuaagaaauguuacc

SEQ ID NO: 293798 - RNA, 21 nt, Human
aguugcauaggccagccaucc

SEQ ID NO: 293799 - RNA, 22 nt, Human
acagcagguuauuguuauggca

SEQ ID NO: 293800 - RNA, 20 nt, Human
aaguuuucuccaaauacagu

SEQ ID NO: 293801 - RNA, 22 nt, Human
ucauuguagggcauuuagagag

SEQ ID NO: 293802 - RNA, 22 nt, Human
aagugguuauuuugaucuagaa

SEQ ID NO: 293803 - RNA, 22 nt, Human
gauacaaaauauaaauggagag

SEQ ID NO: 293804 - RNA, 22 nt, Human
ccagcaugagacgaugaugaag

SEQ ID NO: 293805 - RNA, 22 nt, Human
ggcuguggggggagccugcccg

SEQ ID NO: 293806 - RNA, 22 nt, Human
caucauuuuauuaaccaagaaa

SEQ ID NO: 293807 - RNA, 23 nt, Human
agucuucauuguauuuccagacc

SEQ ID NO: 293808 - RNA, 22 nt, Human
ccaaggagcaaggcucaacaag

SEQ ID NO: 293809 - RNA, 22 nt, Human
agagccagauggagccgugugu

SEQ ID NO: 293810 - RNA, 22 nt, Human
uucauguuuguaggacugaggc

SEQ ID NO: 293811 - RNA, 18 nt, Human
cagucuaauucccuuccc

SEQ ID NO: 293812 - RNA, 22 nt, Human
ucuguuuaugcauauuuaaaac

SEQ ID NO: 293813 - RNA, 14 nt, Human
gcaggcagaucauu

SEQ ID NO: 293814 - RNA, 22 nt, Human
ucagagagcuggugggcagagg

SEQ ID NO: 293815 - RNA, 22 nt, Human
aaaugcuacauacacaucaggg

SEQ ID NO: 293816 - RNA, 22 nt, Human
ggguguccagggcgugucugga

SEQ ID NO: 293817 - RNA, 22 nt, Human
uaguuucauaugcaaaauagua

SEQ ID NO: 293818 - RNA, 22 nt, Human
gugacccaggacacuguguauc

SEQ ID NO: 293819 - RNA, 22 nt, Human
auccaggccccaagaccccgac

SEQ ID NO: 293820 - RNA, 22 nt, Human
gcuuggcuggaaauagguugag

SEQ ID NO: 293821 - RNA, 22 nt, Human
aacaucuuugauaaacuuagug

SEQ ID NO: 293822 - RNA, 22 nt, Human
ucauucaucaguugguagagau

SEQ ID NO: 293823 - RNA, 22 nt, Human
gaauuguauugauuuuucagag

SEQ ID NO: 293824 - RNA, 20 nt, Human
uaucuaaaugcuuacauuac

SEQ ID NO: 293825 - RNA, 22 nt, Human
agggcugcccagugugagagcu

SEQ ID NO: 293826 - RNA, 22 nt, Human
uacuagaaauuaccuucucacu

SEQ ID NO: 293827 - RNA, 22 nt, Human
ccuugguuuccaggaugaggcu

SEQ ID NO: 293828 - RNA, 22 nt, Human
ggagcacaccgggagcuugccu

SEQ ID NO: 293829 - RNA, 22 nt, Human
auuuguuccacacauauuuacu

SEQ ID NO: 293830 - RNA, 22 nt, Human
ugcagggcacacgcacgggugu

SEQ ID NO: 293831 - RNA, 22 nt, Human
gagcaccgccuccacgaugccc

SEQ ID NO: 293832 - RNA, 22 nt, Human
ugcaggugaaaauuaugaggau

SEQ ID NO: 293833 - RNA, 19 nt, Human
aaagcagugcauccucuuu

SEQ ID NO: 293834 - RNA, 22 nt, Human
acuuucaagcaagaacacuuug

SEQ ID NO: 293835 - RNA, 22 nt, Human
aauuaugauuggucuaaaccag

SEQ ID NO: 293836 - RNA, 22 nt, Human
aggaccugacuggcuccugcuu

SEQ ID NO: 293837 - RNA, 22 nt, Human
acaguuuacuggccuugccguu

SEQ ID NO: 293838 - RNA, 22 nt, Human
uucugaaauaggagauagcugu

SEQ ID NO: 293839 - RNA, 22 nt, Human
cagaugagaguggccaggguuc

SEQ ID NO: 293840 - RNA, 22 nt, Human
ugacaugugucuccuuccgucu

SEQ ID NO: 293841 - RNA, 22 nt, Human
aguguucuucugggguaugcuc

SEQ ID NO: 293842 - RNA, 22 nt, Human
uuguacaacguuuuaaauuuga

SEQ ID NO: 293843 - RNA, 22 nt, Human
agccacugucugaacuucugug

SEQ ID NO: 293844 - RNA, 22 nt, Human
uacaacauguaaagugguuuaa

SEQ ID NO: 293845 - RNA, 22 nt, Human
ccuggcacaugauagaugcuca

SEQ ID NO: 293846 - RNA, 22 nt, Human
uaggcuaggcugaagguuuugg

SEQ ID NO: 293847 - RNA, 22 nt, Human
ucaggcccagagucacggaucc

SEQ ID NO: 293848 - RNA, 22 nt, Human
uucaggugucaaggauaggcug

SEQ ID NO: 293849 - RNA, 22 nt, Human
uaaaugaguaauauagcuguuu

SEQ ID NO: 293850 - RNA, 22 nt, Human
gugacccaugcagugguuuugg

SEQ ID NO: 293851 - RNA, 23 nt, Human
agagugcagagauaugcuugugu

SEQ ID NO: 293852 - RNA, 22 nt, Human
cauuuccagcuccugcaucaug

SEQ ID NO: 293853 - RNA, 22 nt, Human
agugucugccuauuuuucaagc

SEQ ID NO: 293854 - RNA, 21 nt, Human
ccagcuuucccaagucccuuu

SEQ ID NO: 293855 - RNA, 22 nt, Human
accaggcagcugggggugaugu

SEQ ID NO: 293856 - RNA, 22 nt, Human
uguccuuuucuuuagugcagcu

SEQ ID NO: 293857 - RNA, 22 nt, Human
guaggcagugguuggaagagaa

SEQ ID NO: 293858 - RNA, 22 nt, Human
uguguucaaucccuagucucag

SEQ ID NO: 293859 - RNA, 22 nt, Human
uaaaguuuggcagacaauaaca

SEQ ID NO: 293860 - RNA, 20 nt, Human
ugugccuggcuuuguccuga

SEQ ID NO: 293861 - RNA, 22 nt, Human
aacagcaauagcacuauucauu

SEQ ID NO: 293862 - RNA, 22 nt, Human
gcccacaguguagcagguacuc

SEQ ID NO: 293863 - RNA, 22 nt, Human
auuugcugagcucaaagaaaag

SEQ ID NO: 293864 - RNA, 19 nt, Human
aggaauggaauuaauucug

SEQ ID NO: 293865 - RNA, 22 nt, Human
acaguguucacuuaacaaugga

SEQ ID NO: 293866 - RNA, 22 nt, Human
uagaucaggcugcuuagauaga

SEQ ID NO: 293867 - RNA, 22 nt, Human
uuaagaagguacucaaagaucu

SEQ ID NO: 293868 - RNA, 22 nt, Human
agugcaggccccaggccaggcc

SEQ ID NO: 293869 - RNA, 22 nt, Human
auauuucucucagacauggaag

SEQ ID NO: 293870 - RNA, 22 nt, Human
caaaucuauauguugauauucu

SEQ ID NO: 293871 - RNA, 22 nt, Human
ucagaguuucugauuuaguagg

SEQ ID NO: 293872 - RNA, 22 nt, Human
ucagggaaccucuccuguuucu

SEQ ID NO: 293873 - RNA, 22 nt, Human
cagccagggucaggcagcuucu

SEQ ID NO: 293874 - RNA, 22 nt, Human
auuaaacaauguaaaguucuug

SEQ ID NO: 293875 - RNA, 22 nt, Human
ggucuggccuccgggcaggugg

SEQ ID NO: 293876 - RNA, 22 nt, Human
ugagcagagacuucaagggcag

SEQ ID NO: 293877 - RNA, 22 nt, Human
ucuuuggacuuuccaauuuguu

SEQ ID NO: 293878 - RNA, 22 nt, Human
gaggaggaaaggaguugaaaug

SEQ ID NO: 293879 - RNA, 22 nt, Human
caacauauaauauuugaguucu

SEQ ID NO: 293880 - RNA, 22 nt, Human
aaugagauggaauucccgccua

SEQ ID NO: 293881 - RNA, 22 nt, Human
accuguuuaccugcaccuguuu

SEQ ID NO: 293882 - RNA, 22 nt, Human
ggccauggaccccgagcugacc

SEQ ID NO: 293883 - RNA, 22 nt, Human
gcauguguucuugaaaggccac

SEQ ID NO: 293884 - RNA, 22 nt, Human
ucagugucacaggaugcuaugc

SEQ ID NO: 293885 - RNA, 22 nt, Human
caggccucuccuuagucuggca

SEQ ID NO: 293886 - RNA, 22 nt, Human
ugcaggcugcagucucaggugg

SEQ ID NO: 293887 - RNA, 19 nt, Human
cgcagguggaaggagccgc

SEQ ID NO: 293888 - RNA, 22 nt, Human
gaauccaggguuguuugagcua

SEQ ID NO: 293889 - RNA, 22 nt, Human
uaggcucuagauguggucuuug

SEQ ID NO: 293890 - RNA, 22 nt, Human
uucuucuccuaaggagaguccu

SEQ ID NO: 293891 - RNA, 19 nt, Human
aggcuuggaacagccuuau

SEQ ID NO: 293892 - RNA, 22 nt, Human
accugccucagugcagcuggau

SEQ ID NO: 293893 - RNA, 22 nt, Human
uaucuaaaggauuuaauuuagu

SEQ ID NO: 293894 - RNA, 22 nt, Human
cagagccucagaauccugugga

SEQ ID NO: 293895 - RNA, 22 nt, Human
aaaaguuagcuauuaguaggug

SEQ ID NO: 293896 - RNA, 22 nt, Human
agggcccucugggcacuguggc

SEQ ID NO: 293897 - RNA, 22 nt, Human
cuuuaguucuaaugcauugaaa

SEQ ID NO: 293898 - RNA, 22 nt, Human
uagauaaauuagaaaguuuacu

SEQ ID NO: 293899 - RNA, 21 nt, Human
uacagaugaggagaccaaggc

SEQ ID NO: 293900 - RNA, 22 nt, Human
uuucauggcuaggacuagagug

SEQ ID NO: 293901 - RNA, 22 nt, Human
uaauaacaauuguaggacauga

SEQ ID NO: 293902 - RNA, 22 nt, Human
ggcuccacugcugaccacucca

SEQ ID NO: 293903 - RNA, 23 nt, Human
uuucucugagaagcaguucucua

SEQ ID NO: 293904 - RNA, 22 nt, Human
cugagguguggucugggaguau

SEQ ID NO: 293905 - RNA, 18 nt, Human
gggcucacacaggucauc

SEQ ID NO: 293906 - RNA, 22 nt, Human
uccugagccugacaaucaccau

SEQ ID NO: 293907 - RNA, 22 nt, Human
ggccuugaucucucuaacugcu

SEQ ID NO: 293908 - RNA, 22 nt, Human
ucuucagagcauuucugaggua

SEQ ID NO: 293909 - RNA, 22 nt, Human
augccccagugugugcuuccuu

SEQ ID NO: 293910 - RNA, 22 nt, Human
caaagugccuguaccacuuugc

SEQ ID NO: 293911 - RNA, 22 nt, Human
cacccaggacaggccagaugug

SEQ ID NO: 293912 - RNA, 22 nt, Human
aaggccucccugugugcaggug

SEQ ID NO: 293913 - RNA, 22 nt, Human
auuaguaaaacauuguauaugu

SEQ ID NO: 293914 - RNA, 22 nt, Human
cccuccagggagccaugcuggg

SEQ ID NO: 293915 - RNA, 22 nt, Human
cagggcucuucaucacacagua

SEQ ID NO: 293916 - RNA, 19 nt, Human
gcuggcagaauuuugaacc

SEQ ID NO: 293917 - RNA, 22 nt, Human
aaaucaaaagacauguguuuua

SEQ ID NO: 293918 - RNA, 21 nt, Human
ucaaggaguuucucuuuucca

SEQ ID NO: 293919 - RNA, 22 nt, Human
aaagauaauguuuccuuauucu

SEQ ID NO: 293920 - RNA, 22 nt, Human
acauacagaccugcagggcagc

SEQ ID NO: 293921 - RNA, 22 nt, Human
agaaagugugucauacuaagug

SEQ ID NO: 293922 - RNA, 22 nt, Human
cuuucagucuuuacaagguugc

SEQ ID NO: 293923 - RNA, 22 nt, Human
acaagauagcuuagaagauuca

SEQ ID NO: 293924 - RNA, 22 nt, Human
ccaaugauggugcccacgauga

SEQ ID NO: 293925 - RNA, 22 nt, Human
gaggccaggggccuggagauga

SEQ ID NO: 293926 - RNA, 22 nt, Human
aggauuuacaaugauucuaggu

SEQ ID NO: 293927 - RNA, 22 nt, Human
acuuuguuuggcuauuagaguc

SEQ ID NO: 293928 - RNA, 20 nt, Human
cugagccaacucucuucuug

SEQ ID NO: 293929 - RNA, 22 nt, Human
cacugcacaauguagcaaagaa

SEQ ID NO: 293930 - RNA, 22 nt, Human
ggaguauuguagcuuccaguuc

SEQ ID NO: 293931 - RNA, 22 nt, Human
aaaaugaugcuguaauuuggca

SEQ ID NO: 293932 - RNA, 22 nt, Human
uuaaauauuauguugucugcaa

SEQ ID NO: 293933 - RNA, 22 nt, Human
uuccaggacaagauguuucagg

SEQ ID NO: 293934 - RNA, 22 nt, Human
gacagcuuagugaaaauguaaa

SEQ ID NO: 293935 - RNA, 22 nt, Human
aagucucuuaguaauauccaac

SEQ ID NO: 293936 - RNA, 22 nt, Human
gggagguucuguucgcacuuga

SEQ ID NO: 293937 - RNA, 20 nt, Human
acuuggaacucauuuuucuu

SEQ ID NO: 293938 - RNA, 22 nt, Human
gacucguucauaguuccaauuu

SEQ ID NO: 293939 - RNA, 22 nt, Human
aacaaacaaacauuuugucauc

SEQ ID NO: 293940 - RNA, 22 nt, Human
gcuuacaagaucgugcuccagu

SEQ ID NO: 293941 - RNA, 22 nt, Human
uccuggccaggaugaccuaaca

SEQ ID NO: 293942 - RNA, 22 nt, Human
cuugaaucuucugaguauuugc

SEQ ID NO: 293943 - RNA, 22 nt, Human
gcuguucauagaaauggucuca

SEQ ID NO: 293944 - RNA, 22 nt, Human
gccuccugguugcuucuccaac

SEQ ID NO: 293945 - RNA, 22 nt, Human
gauauuuugagaaauccuauga

SEQ ID NO: 293946 - RNA, 22 nt, Human
aaaauccucuaauucuagaaua

SEQ ID NO: 293947 - RNA, 22 nt, Human
acauuaaaaaauguugcaugaa

SEQ ID NO: 293948 - RNA, 19 nt, Human
ccagcccauaguccaucac

SEQ ID NO: 293949 - RNA, 22 nt, Human
gcugcagugagccaagaucgug

SEQ ID NO: 293950 - RNA, 22 nt, Human
guccaugauucugugacacccu

SEQ ID NO: 293951 - RNA, 20 nt, Human
ucugggcuucccccagcucc

SEQ ID NO: 293952 - RNA, 22 nt, Human
aguaggcauugugaaacugcau

SEQ ID NO: 293953 - RNA, 22 nt, Human
cagggaugguugagaauuggua

SEQ ID NO: 293954 - RNA, 22 nt, Human
agguuaggaaauagggcuguaa

SEQ ID NO: 293955 - RNA, 22 nt, Human
agccaugcucaguuccuggagc

SEQ ID NO: 293956 - RNA, 19 nt, Human
auuucaagagguuuauugg

SEQ ID NO: 293957 - RNA, 22 nt, Human
guaaaacugucuaaugguauau

SEQ ID NO: 293958 - RNA, 20 nt, Human
cugaagagacuggaggggca

SEQ ID NO: 293959 - RNA, 22 nt, Human
ucagggaacaucguuaaacuag

SEQ ID NO: 293960 - RNA, 22 nt, Human
ucauagaugugcugugcacaaa

SEQ ID NO: 293961 - RNA, 22 nt, Human
acagaagagcacauuuaguaug

SEQ ID NO: 293962 - RNA, 22 nt, Human
gggaggacgguccagggcaaag

SEQ ID NO: 293963 - RNA, 22 nt, Human
gccuggcauauaguaguugugc

SEQ ID NO: 293964 - RNA, 22 nt, Human
aggaaauguacaaaugaagaug

SEQ ID NO: 293965 - RNA, 22 nt, Human
uacaugcaugucacagaaugaa

SEQ ID NO: 293966 - RNA, 21 nt, Human
uuguguccuucuaaagggcca

SEQ ID NO: 293967 - RNA, 22 nt, Human
auuucccagcuuugaucaguuu

SEQ ID NO: 293968 - RNA, 22 nt, Human
agcagggcugugcuccuuccga

SEQ ID NO: 293969 - RNA, 19 nt, Human
uuuacucuccaaggugagu

SEQ ID NO: 293970 - RNA, 22 nt, Human
caugaaggaccauuucacgguc

SEQ ID NO: 293971 - RNA, 20 nt, Human
gcuccaggucagagaggacg

SEQ ID NO: 293972 - RNA, 22 nt, Human
caggaagccuuccuugucugcu

SEQ ID NO: 293973 - RNA, 22 nt, Human
gcauucuuuccacgaggaggua

SEQ ID NO: 293974 - RNA, 22 nt, Human
ugugacccucuccgaugggcag

SEQ ID NO: 293975 - RNA, 22 nt, Human
auauaucaugaguaaaacuuga

SEQ ID NO: 293976 - RNA, 22 nt, Human
accaugaugcauccuuaaggaa

SEQ ID NO: 293977 - RNA, 22 nt, Human
ugaaagcaaccuguaacaguga

SEQ ID NO: 293978 - RNA, 22 nt, Human
uagaaggcuuugagagauacuu

SEQ ID NO: 293979 - RNA, 22 nt, Human
caagauuuagccugcugccugu

SEQ ID NO: 293980 - RNA, 22 nt, Human
cagaugaggggcauauaacaau

SEQ ID NO: 293981 - RNA, 22 nt, Human
agcuuuauucaugauuucaggg

SEQ ID NO: 293982 - RNA, 22 nt, Human
ccagcccugucaccaacuggag

SEQ ID NO: 293983 - RNA, 20 nt, Human
gcagggcaagggauaugaaa

SEQ ID NO: 293984 - RNA, 23 nt, Human
ugacagaccuucccagacaguca

SEQ ID NO: 293985 - RNA, 22 nt, Human
uagggcagccacccaggcugcu

SEQ ID NO: 293986 - RNA, 22 nt, Human
aaaagcagagacucuggagcua

SEQ ID NO: 293987 - RNA, 22 nt, Human
cagggugacugcccuggccacu

SEQ ID NO: 293988 - RNA, 22 nt, Human
uccagcucaggguuggcucaag

SEQ ID NO: 293989 - RNA, 22 nt, Human
uuugcuuucuugauucagauua

SEQ ID NO: 293990 - RNA, 22 nt, Human
ugguaaaauauuacaaggcacu

SEQ ID NO: 293991 - RNA, 19 nt, Human
ucaaagcaagcauguucug

SEQ ID NO: 293992 - RNA, 22 nt, Human
ugcuuuauguuaucagaagggu

SEQ ID NO: 293993 - RNA, 22 nt, Human
cuuguugcuaacauaugcuucu

SEQ ID NO: 293994 - RNA, 22 nt, Human
aagaaauauugggccuuauaaa

SEQ ID NO: 293995 - RNA, 22 nt, Human
gauggcuggcuauaucagggga

SEQ ID NO: 293996 - RNA, 22 nt, Human
ggcuguggucucaucuagccuu

SEQ ID NO: 293997 - RNA, 22 nt, Human
uugaggaggccuuucagggcuu

SEQ ID NO: 293998 - RNA, 22 nt, Human
auuaaaauuccaagguaugcca

SEQ ID NO: 293999 - RNA, 22 nt, Human
aggcaggugggagugauuccuu

SEQ ID NO: 294000 - RNA, 22 nt, Human
aggagcugauaaaaggggguca

SEQ ID NO: 294001 - RNA, 22 nt, Human
ucacuuuggauuauguaauuuc

SEQ ID NO: 294002 - RNA, 22 nt, Human
ccuuccuuuuacugucuccgga

SEQ ID NO: 294003 - RNA, 23 nt, Human
agcaauaagaagggauacaugug

SEQ ID NO: 294004 - RNA, 22 nt, Human
cuagagaaaaugauagcaggaa

SEQ ID NO: 294005 - RNA, 22 nt, Human
uugcuuuauguguaugacuuga

SEQ ID NO: 294006 - RNA, 22 nt, Human
agggucuguuguuuguucugga

SEQ ID NO: 294007 - RNA, 22 nt, Human
cagggcucaggaaaucagacgu

SEQ ID NO: 294008 - RNA, 22 nt, Human
uccuggcuggaauuucucacuc

SEQ ID NO: 294009 - RNA, 22 nt, Human
caugccaacaacaagcaaugag

SEQ ID NO: 294010 - RNA, 22 nt, Human
auuauuagauucuuaauuguaa

SEQ ID NO: 294011 - RNA, 22 nt, Human
gugagguagcagagacagugaa

SEQ ID NO: 294012 - RNA, 22 nt, Human
ugcagguggauaucucaucaga

SEQ ID NO: 294013 - RNA, 22 nt, Human
ccaugcagugcuggagcugauu

SEQ ID NO: 294014 - RNA, 22 nt, Human
aauguuaauuuacugucuucau

SEQ ID NO: 294015 - RNA, 22 nt, Human
uucuuuaugcuucuguuuaggc

SEQ ID NO: 294016 - RNA, 22 nt, Human
agggacuugaugucagggagau

SEQ ID NO: 294017 - RNA, 22 nt, Human
auuucucaucaagugccaacuc

SEQ ID NO: 294018 - RNA, 22 nt, Human
accuucaaacuagauagaaguu

SEQ ID NO: 294019 - RNA, 22 nt, Human
uggaauggaaacaaacugagga

SEQ ID NO: 294020 - RNA, 22 nt, Human
uagggcucagaguccaguuucu

SEQ ID NO: 294021 - RNA, 22 nt, Human
auuucuguaguccacauucuuu

SEQ ID NO: 294022 - RNA, 22 nt, Human
acugagauuuacauguucuagu

SEQ ID NO: 294023 - RNA, 22 nt, Human
gugaggagcugacacuggggug

SEQ ID NO: 294024 - RNA, 18 nt, Human
ucugucuguacaaguauc

SEQ ID NO: 294025 - RNA, 22 nt, Human
uugauuucuuacucuuccaagg

SEQ ID NO: 294026 - RNA, 22 nt, Human
ucuccugguuuguuaaauaauu

SEQ ID NO: 294027 - RNA, 22 nt, Human
aaucuuucccuauuaaaugugg

SEQ ID NO: 294028 - RNA, 21 nt, Human
ugggaccuauuucaacuggau

SEQ ID NO: 294029 - RNA, 22 nt, Human
gcaggcaguuauuuaguagaau

SEQ ID NO: 294030 - RNA, 22 nt, Human
ggagacaauggaggccaaaaga

SEQ ID NO: 294031 - RNA, 22 nt, Human
agagagcagucuggaagaaaca

SEQ ID NO: 294032 - RNA, 22 nt, Human
uguugauuaguguuuagacuua

SEQ ID NO: 294033 - RNA, 22 nt, Human
ggcugugggccagcuagacccu

SEQ ID NO: 294034 - RNA, 22 nt, Human
uuuugcuguuauaugcuauuau

SEQ ID NO: 294035 - RNA, 22 nt, Human
cacaggugugugccuuaucaaa

SEQ ID NO: 294036 - RNA, 22 nt, Human
uggcagucugccucuucaccau

SEQ ID NO: 294037 - RNA, 22 nt, Human
auuuauuauugugguuacuucu

SEQ ID NO: 294038 - RNA, 22 nt, Human
cugagccagcgggcucacuuuu

SEQ ID NO: 294039 - RNA, 20 nt, Human
uaaagacauaagcuacuauc

SEQ ID NO: 294040 - RNA, 22 nt, Human
caugugucuaaucuacuaauau

SEQ ID NO: 294041 - RNA, 22 nt, Human
agaguugcuaccaagaugcuag

SEQ ID NO: 294042 - RNA, 22 nt, Human
aaucuggaauauuugcauugua

SEQ ID NO: 294043 - RNA, 22 nt, Human
aaaugcacagguuuuaaauccu

SEQ ID NO: 294044 - RNA, 22 nt, Human
aaauucauuuuucuuagugugc

SEQ ID NO: 294045 - RNA, 22 nt, Human
acccuaauaaucacagacuagu

SEQ ID NO: 294046 - RNA, 22 nt, Human
gagggccaaagagcaagagccu

SEQ ID NO: 294047 - RNA, 22 nt, Human
ggccucucugagagcagacguu

SEQ ID NO: 294048 - RNA, 22 nt, Human
cagucuaaguuaauuuccacaa

SEQ ID NO: 294049 - RNA, 22 nt, Human
guuacucuugagaggcugaggu

SEQ ID NO: 294050 - RNA, 22 nt, Human
aguggaggcacuaauuggauuu

SEQ ID NO: 294051 - RNA, 22 nt, Human
agugcauguucacuggcauggu

SEQ ID NO: 294052 - RNA, 22 nt, Human
ucugcccucauugcugccugga

SEQ ID NO: 294053 - RNA, 22 nt, Human
cuugauugcuucuacgugacug

SEQ ID NO: 294054 - RNA, 22 nt, Human
uggucugggcaaauccuucuga

SEQ ID NO: 294055 - RNA, 22 nt, Human
auaguuugaaggcuguucuacu

SEQ ID NO: 294056 - RNA, 22 nt, Human
gacugucucugugaaugguagg

SEQ ID NO: 294057 - RNA, 22 nt, Human
acagaagaaguucaaggugaag

SEQ ID NO: 294058 - RNA, 22 nt, Human
gagcaggucuuucauggugcau

SEQ ID NO: 294059 - RNA, 22 nt, Human
guacaaauugauacagguuuuc

SEQ ID NO: 294060 - RNA, 22 nt, Human
uaguuuugauuaguauugucuu

SEQ ID NO: 294061 - RNA, 22 nt, Human
uuucaguugcagugguugucua

SEQ ID NO: 294062 - RNA, 22 nt, Human
cugggcugcaguuccugguccu

SEQ ID NO: 294063 - RNA, 22 nt, Human
gggccaggaguggagauauggg

SEQ ID NO: 294064 - RNA, 22 nt, Human
gacuuuauuuccuuauuuguga

SEQ ID NO: 294065 - RNA, 18 nt, Human
gccugagggucaagugug

SEQ ID NO: 294066 - RNA, 22 nt, Human
uuauuccaguaaucucuguaau

SEQ ID NO: 294067 - RNA, 22 nt, Human
uuagaaguucaggucuguaauc

SEQ ID NO: 294068 - RNA, 22 nt, Human
cagugcagcugccccgcuggua

SEQ ID NO: 294069 - RNA, 22 nt, Human
uguccucaaggagcuucagucu

SEQ ID NO: 294070 - RNA, 22 nt, Human
gaccuggugcagguggacagag

SEQ ID NO: 294071 - RNA, 22 nt, Human
caguauuuguucccuaucaaug

SEQ ID NO: 294072 - RNA, 22 nt, Human
gccugcagaacugugaggcaau

SEQ ID NO: 294073 - RNA, 22 nt, Human
uucaacuaauguuuauuuuaug

SEQ ID NO: 294074 - RNA, 22 nt, Human
cagcaggauuugaaaggaagag

SEQ ID NO: 294075 - RNA, 22 nt, Human
gcagacagacugcagugauuuu

SEQ ID NO: 294076 - RNA, 22 nt, Human
cacagguucaccucagguaggu

SEQ ID NO: 294077 - RNA, 22 nt, Human
gcuggcagacugggggcagaac

SEQ ID NO: 294078 - RNA, 22 nt, Human
cugaggaagacagcagcugugu

SEQ ID NO: 294079 - RNA, 22 nt, Human
gagucuaaggaaaaauagagua

SEQ ID NO: 294080 - RNA, 22 nt, Human
caaggcaggaagccugucuuau

SEQ ID NO: 294081 - RNA, 22 nt, Human
uagacacauacccuugcccaaa

SEQ ID NO: 294082 - RNA, 22 nt, Human
cuggcacugaguggcuuaugac

SEQ ID NO: 294083 - RNA, 22 nt, Human
auucaacuguaaacuuguucac

SEQ ID NO: 294084 - RNA, 22 nt, Human
uaaguucauaagcuuauucuua

SEQ ID NO: 294085 - RNA, 22 nt, Human
auuauuagacuuauaugguagu

SEQ ID NO: 294086 - RNA, 20 nt, Human
agcaaacaggcuccaccaga

SEQ ID NO: 294087 - RNA, 19 nt, Human
ccuguggcagaguggaaac

SEQ ID NO: 294088 - RNA, 22 nt, Human
uggcagguagaguucugagaug

SEQ ID NO: 294089 - RNA, 22 nt, Human
aacaguuuauguaaauguccag

SEQ ID NO: 294090 - RNA, 22 nt, Human
gccuccuggaagucacauguuu

SEQ ID NO: 294091 - RNA, 22 nt, Human
uuucaguuuuugcucgauguau

SEQ ID NO: 294092 - RNA, 22 nt, Human
ucuaaacaguuucacucuuaau

SEQ ID NO: 294093 - RNA, 22 nt, Human
agagcggggauaguuaauauuc

SEQ ID NO: 294094 - RNA, 22 nt, Human
uucucugacccccuuaaauauu

SEQ ID NO: 294095 - RNA, 22 nt, Human
aggaccugacauuguguuuucu

SEQ ID NO: 294096 - RNA, 22 nt, Human
ugcaaacaggcauuucacaaac

SEQ ID NO: 294097 - RNA, 22 nt, Human
auauaguuggguuucauucuac

SEQ ID NO: 294098 - RNA, 22 nt, Human
aggguggccaccaaguauguca

SEQ ID NO: 294099 - RNA, 22 nt, Human
accucccagaaaguuuugcagg

SEQ ID NO: 294100 - RNA, 22 nt, Human
acucauugaaacuuaagaucua

SEQ ID NO: 294101 - RNA, 22 nt, Human
ucaggcaaggcccuuagagugu

SEQ ID NO: 294102 - RNA, 22 nt, Human
uauuccaguccuauccucuuuu

SEQ ID NO: 294103 - RNA, 22 nt, Human
ugcauguuaagaaaauauugag

SEQ ID NO: 294104 - RNA, 22 nt, Human
ugaaagcuuugggacaguguga

SEQ ID NO: 294105 - RNA, 22 nt, Human
uuggugaacacauacacauuuu

SEQ ID NO: 294106 - RNA, 22 nt, Human
ugaacauugucacauuccuagc

SEQ ID NO: 294107 - RNA, 22 nt, Human
gauucuuuacaucucugcugac

SEQ ID NO: 294108 - RNA, 22 nt, Human
gaagagaaaggcaaggaguuuu

SEQ ID NO: 294109 - RNA, 22 nt, Human
ucagggcacaggccuguggguu

SEQ ID NO: 294110 - RNA, 21 nt, Human
acaguuuauuagaguaagugc

SEQ ID NO: 294111 - RNA, 15 nt, Human
uuucaaaaugaggcc

SEQ ID NO: 294112 - RNA, 22 nt, Human
ugcguacuguuuauacaugugu

SEQ ID NO: 294113 - RNA, 19 nt, Human
aguguauuuuuuucuguag

SEQ ID NO: 294114 - RNA, 22 nt, Human
uggagcugguaaacagugacau

SEQ ID NO: 294115 - RNA, 20 nt, Human
aaauuacugccacacauuuc

SEQ ID NO: 294116 - RNA, 21 nt, Human
uuuguucaggcaaguuacagu

SEQ ID NO: 294117 - RNA, 22 nt, Human
agcuguguuuccagaugguagc

SEQ ID NO: 294118 - RNA, 22 nt, Human
cuuaggaagcuuuugaggacaa

SEQ ID NO: 294119 - RNA, 20 nt, Human
ugaaagcaugugguauuugg

SEQ ID NO: 294120 - RNA, 22 nt, Human
agguguccaggaagaugcuggc

SEQ ID NO: 294121 - RNA, 22 nt, Human
gcagccacuaguuuuccuguuu

SEQ ID NO: 294122 - RNA, 22 nt, Human
uucaugaauguuccaugugagu

SEQ ID NO: 294123 - RNA, 22 nt, Human
ugagggaauauugauagauccg

SEQ ID NO: 294124 - RNA, 22 nt, Human
ucuuucuuuaucaccugauaug

SEQ ID NO: 294125 - RNA, 22 nt, Human
uggcucaguuuagcagcucagu

SEQ ID NO: 294126 - RNA, 22 nt, Human
aguuuguaaguucauuaugagu

SEQ ID NO: 294127 - RNA, 22 nt, Human
uuccugugaaauauagguccau

SEQ ID NO: 294128 - RNA, 22 nt, Human
aacaguuuguggauagcuugua

SEQ ID NO: 294129 - RNA, 22 nt, Human
auuguauuuguacaagacaugu

SEQ ID NO: 294130 - RNA, 22 nt, Human
ugacauguggcuuugacccagg

SEQ ID NO: 294131 - RNA, 22 nt, Human
agugucugagccagaauuagaa

SEQ ID NO: 294132 - RNA, 22 nt, Human
gcuggcaguguauuguuagcug

SEQ ID NO: 294133 - RNA, 19 nt, Human
uccugcugugugaagggga

SEQ ID NO: 294134 - RNA, 22 nt, Human
uccuggccagaggacaaagcug

SEQ ID NO: 294135 - RNA, 22 nt, Human
uuacacacaauuagcauaguaa

SEQ ID NO: 294136 - RNA, 22 nt, Human
uagggcagccuuauagcuccca

SEQ ID NO: 294137 - RNA, 22 nt, Human
uauuucuaagagauaucuguac

SEQ ID NO: 294138 - RNA, 22 nt, Human
uacauccaaaugaauuagaauu

SEQ ID NO: 294139 - RNA, 19 nt, Human
uccaggaggcugccauuga

SEQ ID NO: 294140 - RNA, 22 nt, Human
ugccugucuucaggagugucac

SEQ ID NO: 294141 - RNA, 22 nt, Human
uguggggccaaagcccagccac

SEQ ID NO: 294142 - RNA, 22 nt, Human
uggucacacauguaucucaaug

SEQ ID NO: 294143 - RNA, 22 nt, Human
gaugaggucauguuuuacauau

SEQ ID NO: 294144 - RNA, 22 nt, Human
aucuauuucugcuaauaacaau

SEQ ID NO: 294145 - RNA, 22 nt, Human
guaaaauugcaauuacuuuugc

SEQ ID NO: 294146 - RNA, 22 nt, Human
aagcagaguuagcuugucaccu

SEQ ID NO: 294147 - RNA, 18 nt, Human
ugucucaguucugcuaug

SEQ ID NO: 294148 - RNA, 22 nt, Human
ugacaagagaccccuccgcagg

SEQ ID NO: 294149 - RNA, 22 nt, Human
agagccaggugcugcuguuuga

SEQ ID NO: 294150 - RNA, 22 nt, Human
cauuguaagaggcuuugcagca

SEQ ID NO: 294151 - RNA, 21 nt, Human
uuucuuucuggcucucacagu

SEQ ID NO: 294152 - RNA, 22 nt, Human
aaauaaguuagcagauuccagu

SEQ ID NO: 294153 - RNA, 22 nt, Human
gauuuucaugauaaacuuguga

SEQ ID NO: 294154 - RNA, 22 nt, Human
agggacucccugggccgacacg

SEQ ID NO: 294155 - RNA, 22 nt, Human
acagugucugacacauuguagc

SEQ ID NO: 294156 - RNA, 22 nt, Human
uucuuaacucaaauauauaucc

SEQ ID NO: 294157 - RNA, 22 nt, Human
uuguuucuuugaaguuucuaga

SEQ ID NO: 294158 - RNA, 22 nt, Human
uuaaggagcagaaugcuuggac

SEQ ID NO: 294159 - RNA, 22 nt, Human
uuucacauaaauggaguaaaga

SEQ ID NO: 294160 - RNA, 22 nt, Human
uuggauuacaugaaaugcagaa

SEQ ID NO: 294161 - RNA, 18 nt, Human
gugcaaugaauagcagag

SEQ ID NO: 294162 - RNA, 22 nt, Human
uguuuacauggagguuuucagc

SEQ ID NO: 294163 - RNA, 22 nt, Human
aaguuuauguugguaagauauc

SEQ ID NO: 294164 - RNA, 22 nt, Human
uggcagguuaugcgggccacau

SEQ ID NO: 294165 - RNA, 22 nt, Human
uuccaugccuagaacaggauuc

SEQ ID NO: 294166 - RNA, 22 nt, Human
acaugccaagauccucgucuuu

SEQ ID NO: 294167 - RNA, 22 nt, Human
agggcccuagggaaugagacau

SEQ ID NO: 294168 - RNA, 22 nt, Human
uacaugugcuggguucuuggcc

SEQ ID NO: 294169 - RNA, 22 nt, Human
cuuguucaguugccucuccugc

SEQ ID NO: 294170 - RNA, 22 nt, Human
gguccuuugccaucucuccacc

SEQ ID NO: 294171 - RNA, 22 nt, Human
ugagggagucaugauuaaggaa

SEQ ID NO: 294172 - RNA, 22 nt, Human
cgcaggugccggcagauggggu

SEQ ID NO: 294173 - RNA, 22 nt, Human
gcagagcacccugcagugguau

SEQ ID NO: 294174 - RNA, 22 nt, Human
cugaggagagaucacguggugu

SEQ ID NO: 294175 - RNA, 22 nt, Human
agggacuauuuacccaucucac

SEQ ID NO: 294176 - RNA, 22 nt, Human
gaguccuuuugugccacaggga

SEQ ID NO: 294177 - RNA, 22 nt, Human
ugggugaggagaggcugucuaa

SEQ ID NO: 294178 - RNA, 21 nt, Human
gguggcucaccugauuggaua

SEQ ID NO: 294179 - RNA, 22 nt, Human
cugaggagauccccccagaagu

SEQ ID NO: 294180 - RNA, 22 nt, Human
accaggcaacugugaaugggcu

SEQ ID NO: 294181 - RNA, 22 nt, Human
aauuuguuauaacuugggcuga

SEQ ID NO: 294182 - RNA, 22 nt, Human
uaaagcugaaaugauuaugaca

SEQ ID NO: 294183 - RNA, 22 nt, Human
ugcagggccaugguggcggcug

SEQ ID NO: 294184 - RNA, 18 nt, Human
ccuagccuccaagcucau

SEQ ID NO: 294185 - RNA, 22 nt, Human
aagagcauauuaauaguggaga

SEQ ID NO: 294186 - RNA, 22 nt, Human
gcuggguggaucggaggcucug

SEQ ID NO: 294187 - RNA, 22 nt, Human
aauuaugagguagauaucacau

SEQ ID NO: 294188 - RNA, 22 nt, Human
guucauguggaaauuuaaaaca

SEQ ID NO: 294189 - RNA, 20 nt, Human
agacucaguuucuaugcucu

SEQ ID NO: 294190 - RNA, 22 nt, Human
gcagcucaguaaaagaggagca

SEQ ID NO: 294191 - RNA, 22 nt, Human
caucagugaaagugaauguucu

SEQ ID NO: 294192 - RNA, 22 nt, Human
uagaacacuugaccacugcucc

SEQ ID NO: 294193 - RNA, 22 nt, Human
acacaugaaagacauuaaggug

SEQ ID NO: 294194 - RNA, 22 nt, Human
acuucaugcagaagagagcugu

SEQ ID NO: 294195 - RNA, 19 nt, Human
auacagauguauccaugau

SEQ ID NO: 294196 - RNA, 22 nt, Human
agccuugaucuugguaacagga

SEQ ID NO: 294197 - RNA, 19 nt, Human
ucuguggccuucccugaug

SEQ ID NO: 294198 - RNA, 22 nt, Human
gacaggcuuccuaagugccaga

SEQ ID NO: 294199 - RNA, 22 nt, Human
uguuuuaagagcgcacuuuaua

SEQ ID NO: 294200 - RNA, 22 nt, Human
uucacaauaggagcaugcaaau

SEQ ID NO: 294201 - RNA, 23 nt, Human
ucugggccacuugucugcacuuc

SEQ ID NO: 294202 - RNA, 22 nt, Human
gcaggcagagaaggaacauuua

SEQ ID NO: 294203 - RNA, 22 nt, Human
agcugguccuuggcaguucuca

SEQ ID NO: 294204 - RNA, 19 nt, Human
agcuccuguucagcagcuc

SEQ ID NO: 294205 - RNA, 22 nt, Human
aauuaggggaggacguaucaua

SEQ ID NO: 294206 - RNA, 22 nt, Human
gccccagcucugccacaacuag

SEQ ID NO: 294207 - RNA, 19 nt, Human
ugucccagacuccgugucu

SEQ ID NO: 294208 - RNA, 22 nt, Human
uuaaaauuauggcccauuugga

SEQ ID NO: 294209 - RNA, 22 nt, Human
ugagcagggacuuugaguguag

SEQ ID NO: 294210 - RNA, 22 nt, Human
gucuuagauuucaccgauaaug

SEQ ID NO: 294211 - RNA, 22 nt, Human
cuugagaaaggaacaggaagcu

SEQ ID NO: 294212 - RNA, 22 nt, Human
cagagagcaugggaggcccgag

SEQ ID NO: 294213 - RNA, 19 nt, Human
uuugaauccagcugguaac

SEQ ID NO: 294214 - RNA, 22 nt, Human
uuccugugguguuucccagaca

SEQ ID NO: 294215 - RNA, 21 nt, Human
cuuuuacauucagucaugaug

SEQ ID NO: 294216 - RNA, 22 nt, Human
uucauuccuucuguaccuugcc

SEQ ID NO: 294217 - RNA, 22 nt, Human
augguaaaagauauacugugca

SEQ ID NO: 294218 - RNA, 22 nt, Human
cagauuuagaguggggcuugga

SEQ ID NO: 294219 - RNA, 22 nt, Human
auuuaaauuuucugauggagag

SEQ ID NO: 294220 - RNA, 22 nt, Human
acuggcagagacccugauggcc

SEQ ID NO: 294221 - RNA, 22 nt, Human
uuucaaauagaaucuuuccaaa

SEQ ID NO: 294222 - RNA, 22 nt, Human
agacauguccacaaagcauuca

SEQ ID NO: 294223 - RNA, 22 nt, Human
aggcucuggaguguggugcugg

SEQ ID NO: 294224 - RNA, 22 nt, Human
aacugauuguuggaugauagug

SEQ ID NO: 294225 - RNA, 22 nt, Human
aaauauguaaccaaggugaagu

SEQ ID NO: 294226 - RNA, 22 nt, Human
cagugaggugcccagccugccc

SEQ ID NO: 294227 - RNA, 22 nt, Human
gccugugaugcccccauaagua

SEQ ID NO: 294228 - RNA, 22 nt, Human
cacaugcauuggcaaaagugua

SEQ ID NO: 294229 - RNA, 22 nt, Human
uagcuuuaccauagaagaguau

SEQ ID NO: 294230 - RNA, 22 nt, Human
aagcccuguaaauugcccuuaa

SEQ ID NO: 294231 - RNA, 22 nt, Human
uacuuuaaaaacugauaauuca

SEQ ID NO: 294232 - RNA, 22 nt, Human
cuccuggcccugagcucccagg

SEQ ID NO: 294233 - RNA, 22 nt, Human
uacaaagagguaauugcauaua

SEQ ID NO: 294234 - RNA, 22 nt, Human
cccugcaguccuuucuuggcuc

SEQ ID NO: 294235 - RNA, 22 nt, Human
ccauggcuaaguaucuguagaa

SEQ ID NO: 294236 - RNA, 22 nt, Human
auaugaaaguaagcaugugugu

SEQ ID NO: 294237 - RNA, 22 nt, Human
ucuguggcaguucugguucauc

SEQ ID NO: 294238 - RNA, 20 nt, Human
agaaccuaaguuaaaacaca

SEQ ID NO: 294239 - RNA, 19 nt, Human
agggauauuuaaaaagcuc

SEQ ID NO: 294240 - RNA, 22 nt, Human
acaaauuauagaaaauugagcu

SEQ ID NO: 294241 - RNA, 22 nt, Human
ccaugcauauaauagugccugg

SEQ ID NO: 294242 - RNA, 22 nt, Human
agcagguggauuuagacgggag

SEQ ID NO: 294243 - RNA, 22 nt, Human
guguguccuugggccucugcag

SEQ ID NO: 294244 - RNA, 18 nt, Human
cuguucagcugaacuaca

SEQ ID NO: 294245 - RNA, 22 nt, Human
aauucaacagucaguuaucuca

SEQ ID NO: 294246 - RNA, 22 nt, Human
uggcaaggccacaggugcaguu

SEQ ID NO: 294247 - RNA, 22 nt, Human
agaggcaagggaccuuucuggg

SEQ ID NO: 294248 - RNA, 22 nt, Human
cugcagggaugugaggcccguu

SEQ ID NO: 294249 - RNA, 22 nt, Human
aaacaagucacuuuaucuugaa

SEQ ID NO: 294250 - RNA, 22 nt, Human
uugcagggaaauagaaauaaac

SEQ ID NO: 294251 - RNA, 22 nt, Human
ucugugcaggaagucauuauga

SEQ ID NO: 294252 - RNA, 22 nt, Human
ucacauuuucuacuacuguacg

SEQ ID NO: 294253 - RNA, 20 nt, Human
uuucuguagcucaguauuca

SEQ ID NO: 294254 - RNA, 22 nt, Human
aguuguaagagacagauauaaa

SEQ ID NO: 294255 - RNA, 22 nt, Human
cuaaagcucaacaggcacuauu

SEQ ID NO: 294256 - RNA, 18 nt, Human
agucaguugauggggacc

SEQ ID NO: 294257 - RNA, 22 nt, Human
uacaggugguaaaaauauuguu

SEQ ID NO: 294258 - RNA, 22 nt, Human
guaauagucucaaacuccugga

SEQ ID NO: 294259 - RNA, 22 nt, Human
cccacacacuggcugcugccaa

SEQ ID NO: 294260 - RNA, 22 nt, Human
acaaauaugguacucggagaaa

SEQ ID NO: 294261 - RNA, 22 nt, Human
agggaauguagcaagaugccaa

SEQ ID NO: 294262 - RNA, 22 nt, Human
ucucaguguguuuucucucaga

SEQ ID NO: 294263 - RNA, 22 nt, Human
auacaacuuuaucuguaaugag

SEQ ID NO: 294264 - RNA, 22 nt, Human
uaguuuuacuugcgaugauaau

SEQ ID NO: 294265 - RNA, 22 nt, Human
gaaugacauugaaaagacauug

SEQ ID NO: 294266 - RNA, 22 nt, Human
caaggaaacaugaaaugcauug

SEQ ID NO: 294267 - RNA, 22 nt, Human
auauuuuccgaacuugagguag

SEQ ID NO: 294268 - RNA, 22 nt, Human
cuuaauuucaaacugcuaguga

SEQ ID NO: 294269 - RNA, 22 nt, Human
guuaauuugcagcuuucgagcu

SEQ ID NO: 294270 - RNA, 18 nt, Human
cagagcagagguggagcg

SEQ ID NO: 294271 - RNA, 22 nt, Human
agucucuuuaaucacagugucu

SEQ ID NO: 294272 - RNA, 22 nt, Human
guauacaugugguaaaaugcac

SEQ ID NO: 294273 - RNA, 22 nt, Human
uaaauuuacccaaggaacaugu

SEQ ID NO: 294274 - RNA, 22 nt, Human
ugauagaaaggaaauuaauugg

SEQ ID NO: 294275 - RNA, 22 nt, Human
caccaucagcagcaggugucaa

SEQ ID NO: 294276 - RNA, 23 nt, Human
auguuaaacauaacugaagagcc

SEQ ID NO: 294277 - RNA, 22 nt, Human
gcagagaccccgcagugaggcc

SEQ ID NO: 294278 - RNA, 23 nt, Human
cuggccaccaucuuucuggcuuc

SEQ ID NO: 294279 - RNA, 19 nt, Human
aauacaguguuauagaauu

SEQ ID NO: 294280 - RNA, 22 nt, Human
uccucagaauggauggcagggg

SEQ ID NO: 294281 - RNA, 22 nt, Human
gaagggaaggaaagaaccagca

SEQ ID NO: 294282 - RNA, 22 nt, Human
uuuccaaauaaggucacauucu

SEQ ID NO: 294283 - RNA, 22 nt, Human
ugaugguuuuauuaauaggacc

SEQ ID NO: 294284 - RNA, 22 nt, Human
cauccaaagcaaauaucuuaaa

SEQ ID NO: 294285 - RNA, 20 nt, Human
uuucugugagaaacacuguu

SEQ ID NO: 294286 - RNA, 22 nt, Human
auucuuucauauaaaggcucag

SEQ ID NO: 294287 - RNA, 22 nt, Human
aaaaugaggaacggaucauggc

SEQ ID NO: 294288 - RNA, 22 nt, Human
cauuagggacugaggaauaagg

SEQ ID NO: 294289 - RNA, 22 nt, Human
gcagggcacaaggacgcacagg

SEQ ID NO: 294290 - RNA, 22 nt, Human
aaguaguuaguccgccugcucu

SEQ ID NO: 294291 - RNA, 22 nt, Human
cagggcucgcucgcucgcucgc

SEQ ID NO: 294292 - RNA, 22 nt, Human
uuuccaagagcuuauuucugaa

SEQ ID NO: 294293 - RNA, 22 nt, Human
gacagguggguucucguaucug

SEQ ID NO: 294294 - RNA, 22 nt, Human
cuccagugagcgcggggcaugg

SEQ ID NO: 294295 - RNA, 22 nt, Human
ugccuugacaguuguaagaccu

SEQ ID NO: 294296 - RNA, 22 nt, Human
uuucucauagucaugccucuua

SEQ ID NO: 294297 - RNA, 20 nt, Human
ucaggaugugcugagugaag

SEQ ID NO: 294298 - RNA, 22 nt, Human
cagguggugccuccaggcuggu

SEQ ID NO: 294299 - RNA, 22 nt, Human
gaagccuugaacugcaaacccc

SEQ ID NO: 294300 - RNA, 22 nt, Human
gauugcuguucccagggggcug

SEQ ID NO: 294301 - RNA, 22 nt, Human
acuuggugaagucaggugauua

SEQ ID NO: 294302 - RNA, 21 nt, Human
gcugccaccgcgugcuccagg

SEQ ID NO: 294303 - RNA, 22 nt, Human
cuuccuucaauauaauuuuuac

SEQ ID NO: 294304 - RNA, 22 nt, Human
uuaccuguguguuugauacaua

SEQ ID NO: 294305 - RNA, 22 nt, Human
gcaaggagcaccuuucuggaac

SEQ ID NO: 294306 - RNA, 22 nt, Human
agagcaauuagcuuagguaaaa

SEQ ID NO: 294307 - RNA, 22 nt, Human
agagucaguuagcgaauacuua

SEQ ID NO: 294308 - RNA, 19 nt, Human
acacaaugacacauauaua

SEQ ID NO: 294309 - RNA, 22 nt, Human
guucuucaucauuaacacucug

SEQ ID NO: 294310 - RNA, 22 nt, Human
uuaaauuauugagggauuguca

SEQ ID NO: 294311 - RNA, 22 nt, Human
uaguuuaccaaauugaucuucc

SEQ ID NO: 294312 - RNA, 22 nt, Human
cuugccugaggaacagagggua

SEQ ID NO: 294313 - RNA, 22 nt, Human
gacaagcucgccugccccggaa

SEQ ID NO: 294314 - RNA, 22 nt, Human
acagguguuuuggaggaugauu

SEQ ID NO: 294315 - RNA, 22 nt, Human
gcacccagagggcagggucucc

SEQ ID NO: 294316 - RNA, 22 nt, Human
caggcucacuuucucagucaca

SEQ ID NO: 294317 - RNA, 23 nt, Human
ugucucagacugagggguuuccc

SEQ ID NO: 294318 - RNA, 22 nt, Human
ggaacuggagaaugcccucuuu

SEQ ID NO: 294319 - RNA, 22 nt, Human
uuuauugucuucguggugccua

SEQ ID NO: 294320 - RNA, 22 nt, Human
acagagagaauuggguuuacag

SEQ ID NO: 294321 - RNA, 22 nt, Human
uaaagcuguuagaguaguaaga

SEQ ID NO: 294322 - RNA, 22 nt, Human
gucagcauaguucacacacagu

SEQ ID NO: 294323 - RNA, 22 nt, Human
ccuguucaagguauuaauuauc

SEQ ID NO: 294324 - RNA, 22 nt, Human
uuuacugaauuugguauauucc

SEQ ID NO: 294325 - RNA, 22 nt, Human
cuccugggcuucgaaggcuccc

SEQ ID NO: 294326 - RNA, 22 nt, Human
cuugcuggaaacucucucugcc

SEQ ID NO: 294327 - RNA, 22 nt, Human
acaguguagaauccuguacuua

SEQ ID NO: 294328 - RNA, 22 nt, Human
ccugaguguaauaaugaaggca

SEQ ID NO: 294329 - RNA, 22 nt, Human
acauuuaaauaccuauguuucu

SEQ ID NO: 294330 - RNA, 22 nt, Human
auccaugaucaauuuauuacua

SEQ ID NO: 294331 - RNA, 22 nt, Human
uguccucaggaccuggcacagu

SEQ ID NO: 294332 - RNA, 22 nt, Human
gccaggcaggccacgcuguguu

SEQ ID NO: 294333 - RNA, 17 nt, Human
uccaggcagcaacugag

SEQ ID NO: 294334 - RNA, 22 nt, Human
ugugcucuucuguuacuuguag

SEQ ID NO: 294335 - RNA, 22 nt, Human
ggccagggggcuucagacucca

SEQ ID NO: 294336 - RNA, 22 nt, Human
uaaagcacauaucuuacaauaa

SEQ ID NO: 294337 - RNA, 22 nt, Human
gauuguaauuuucaagagguaa

SEQ ID NO: 294338 - RNA, 22 nt, Human
ugcuggcuggagugccucugga

SEQ ID NO: 294339 - RNA, 22 nt, Human
agagggaaugugauugcaccau

SEQ ID NO: 294340 - RNA, 16 nt, Human
cagcuuuaugucagug

SEQ ID NO: 294341 - RNA, 22 nt, Human
acaggaggggcaugaaagacgg

SEQ ID NO: 294342 - RNA, 22 nt, Human
ucuggaugauaugugaacuuga

SEQ ID NO: 294343 - RNA, 22 nt, Human
ucagaagccaccuuuuguuggg

SEQ ID NO: 294344 - RNA, 22 nt, Human
uucucuuaucuggcauuauugg

SEQ ID NO: 294345 - RNA, 20 nt, Human
aauuuuacuguccuauagag

SEQ ID NO: 294346 - RNA, 22 nt, Human
uagggauguccugagacuuggc

SEQ ID NO: 294347 - RNA, 22 nt, Human
uuuguuacaaagaaagaagagc

SEQ ID NO: 294348 - RNA, 22 nt, Human
gagcacugaggaaagcugguua

SEQ ID NO: 294349 - RNA, 22 nt, Human
ucugaagagcuuuggaaguaug

SEQ ID NO: 294350 - RNA, 22 nt, Human
gagugcaggccugagcaccauc

SEQ ID NO: 294351 - RNA, 22 nt, Human
uuguuuuggaagaacuuacucu

SEQ ID NO: 294352 - RNA, 22 nt, Human
aagauuuaccacuuuauucaag

SEQ ID NO: 294353 - RNA, 22 nt, Human
ccagugucuagucacagguacu

SEQ ID NO: 294354 - RNA, 23 nt, Human
aguguugguugggaagccaagca

SEQ ID NO: 294355 - RNA, 22 nt, Human
ccccugaagacaauggagaggu

SEQ ID NO: 294356 - RNA, 22 nt, Human
uacagcuaggcaaaaaugacau

SEQ ID NO: 294357 - RNA, 22 nt, Human
cuucuucagcacaauauugaug

SEQ ID NO: 294358 - RNA, 22 nt, Human
uagcgagguguuucuaggacug

SEQ ID NO: 294359 - RNA, 22 nt, Human
cauaaauucaguucugccucuu

SEQ ID NO: 294360 - RNA, 22 nt, Human
uccuggcauugugcagggugug

SEQ ID NO: 294361 - RNA, 23 nt, Human
uacuauaacgcugugucagcucc

SEQ ID NO: 294362 - RNA, 22 nt, Human
aaaugaguagcgaugcacauua

SEQ ID NO: 294363 - RNA, 22 nt, Human
cuuuucaugccagcccaucaca

SEQ ID NO: 294364 - RNA, 22 nt, Human
acuguucauuuggauuucucug

SEQ ID NO: 294365 - RNA, 22 nt, Human
acaguguuuauguacagauugu

SEQ ID NO: 294366 - RNA, 17 nt, Human
ugacagacaucaugagc

SEQ ID NO: 294367 - RNA, 22 nt, Human
ccuggcagguuacaaccaguua

SEQ ID NO: 294368 - RNA, 22 nt, Human
cacuuuauuauaaauuugagag

SEQ ID NO: 294369 - RNA, 22 nt, Human
gagucagaugaagauaaaaggg

SEQ ID NO: 294370 - RNA, 22 nt, Human
ucugggcccuaaaccagcucua

SEQ ID NO: 294371 - RNA, 22 nt, Human
gagagaaaugugcaguuugggc

SEQ ID NO: 294372 - RNA, 22 nt, Human
agauuuacaaaggauuugcuuu

SEQ ID NO: 294373 - RNA, 22 nt, Human
agucagagaauguuuucaugga

SEQ ID NO: 294374 - RNA, 22 nt, Human
auuucuguggcuucauucuccu

SEQ ID NO: 294375 - RNA, 22 nt, Human
auguacaagcuguuuuacugca

SEQ ID NO: 294376 - RNA, 22 nt, Human
ugcagggauuagaggccgggga

SEQ ID NO: 294377 - RNA, 22 nt, Human
aaagugguuucccaguucagua

SEQ ID NO: 294378 - RNA, 22 nt, Human
gcugguagaccucacugcacuc

SEQ ID NO: 294379 - RNA, 19 nt, Human
agacacacuuacguggaau

SEQ ID NO: 294380 - RNA, 22 nt, Human
aguguccuuaguuagcuuuggg

SEQ ID NO: 294381 - RNA, 22 nt, Human
aggaggaauugacacagaagcc

SEQ ID NO: 294382 - RNA, 22 nt, Human
cuucuuucccaggcauguuuua

SEQ ID NO: 294383 - RNA, 22 nt, Human
aauguugagcuugaaaguaggu

SEQ ID NO: 294384 - RNA, 22 nt, Human
ucuucuguuaccacagcgauga

SEQ ID NO: 294385 - RNA, 22 nt, Human
ccagagagcuacaaggcauaaa

SEQ ID NO: 294386 - RNA, 22 nt, Human
agcagggcuggggcacgagcca

SEQ ID NO: 294387 - RNA, 22 nt, Human
uagcuauuuugcuuggaaauac

SEQ ID NO: 294388 - RNA, 22 nt, Human
ucaacguuuguuaaaugaguau

SEQ ID NO: 294389 - RNA, 22 nt, Human
augcaggagcccucuugagggc

SEQ ID NO: 294390 - RNA, 22 nt, Human
aggaaauguaguccucaucucc

SEQ ID NO: 294391 - RNA, 22 nt, Human
agguccugucuaucacccucgc

SEQ ID NO: 294392 - RNA, 22 nt, Human
ugcaggugguccauuugggaac

SEQ ID NO: 294393 - RNA, 22 nt, Human
aagugucuagcaccuggaugca

SEQ ID NO: 294394 - RNA, 22 nt, Human
cuuguuuuggcuaguaugaugu

SEQ ID NO: 294395 - RNA, 23 nt, Human
ccacagagcugccaauuccugug

SEQ ID NO: 294396 - RNA, 20 nt, Human
ugcuuuaugcuauacuuugu

SEQ ID NO: 294397 - RNA, 22 nt, Human
ucagcuuugaucucaggcaauc

SEQ ID NO: 294398 - RNA, 22 nt, Human
cuuccuucugaagcauagaagc

SEQ ID NO: 294399 - RNA, 22 nt, Human
uucagaaagugaaucuuguuau

SEQ ID NO: 294400 - RNA, 22 nt, Human
ucuacauuuucacaaggucucc

SEQ ID NO: 294401 - RNA, 20 nt, Human
gccugcagguuggaugggau

SEQ ID NO: 294402 - RNA, 22 nt, Human
aaaugcuaacaaggaaugcugc

SEQ ID NO: 294403 - RNA, 22 nt, Human
acagcuuuguuuucccugcuga

SEQ ID NO: 294404 - RNA, 22 nt, Human
ucccucucuagccuguucagua

SEQ ID NO: 294405 - RNA, 22 nt, Human
ucuugcagaggcacugugucag

SEQ ID NO: 294406 - RNA, 22 nt, Human
aggaauguguguccaccgggga

SEQ ID NO: 294407 - RNA, 22 nt, Human
gcaaagcaucaguagaaauguu

SEQ ID NO: 294408 - RNA, 22 nt, Human
ggagcccugcccuaggcagcuc

SEQ ID NO: 294409 - RNA, 22 nt, Human
ccuggcaggacuguuguaagaa

SEQ ID NO: 294410 - RNA, 18 nt, Human
uggcagugagguaggcau

SEQ ID NO: 294411 - RNA, 22 nt, Human
guuguaaauacagcagauaauu

SEQ ID NO: 294412 - RNA, 22 nt, Human
ucaauguucaaguaugacaaug

SEQ ID NO: 294413 - RNA, 22 nt, Human
gggugggguucaggaaucuuca

SEQ ID NO: 294414 - RNA, 22 nt, Human
aaggcagauaagaauucagcaa

SEQ ID NO: 294415 - RNA, 22 nt, Human
caagcuuuauccgccauguagg

SEQ ID NO: 294416 - RNA, 22 nt, Human
ugcuauuugggggcuacaugau

SEQ ID NO: 294417 - RNA, 22 nt, Human
acccagggucaccccguagggu

SEQ ID NO: 294418 - RNA, 22 nt, Human
ucugugccaccucuccaguguc

SEQ ID NO: 294419 - RNA, 22 nt, Human
gauuuuacaaacugcaggaccc

SEQ ID NO: 294420 - RNA, 22 nt, Human
uuuccauguuaucuugcagacu

SEQ ID NO: 294421 - RNA, 22 nt, Human
uuucaguucaguuuauuauauc

SEQ ID NO: 294422 - RNA, 22 nt, Human
acaugacauaguagaaaagccc

SEQ ID NO: 294423 - RNA, 22 nt, Human
gcauucauguccuuccugaacg

SEQ ID NO: 294424 - RNA, 22 nt, Human
uuugcugacuggaugcaguugg

SEQ ID NO: 294425 - RNA, 22 nt, Human
cuguuauuugagaguguugaau

SEQ ID NO: 294426 - RNA, 22 nt, Human
uuucacauuuguuuuaagaagu

SEQ ID NO: 294427 - RNA, 22 nt, Human
caaaagcagcaaguuuauaugu

SEQ ID NO: 294428 - RNA, 22 nt, Human
ccagcaggagaugccugugucu

SEQ ID NO: 294429 - RNA, 22 nt, Human
uuagcuuucagccuuucucacc

SEQ ID NO: 294430 - RNA, 22 nt, Human
ugaaaugauuauaugguguuug

SEQ ID NO: 294431 - RNA, 22 nt, Human
acccagggcagccagcggggag

SEQ ID NO: 294432 - RNA, 22 nt, Human
ucacauucuucccugacuucuu

SEQ ID NO: 294433 - RNA, 22 nt, Human
agucucaggcagaggaaggcua

SEQ ID NO: 294434 - RNA, 18 nt, Human
ccauggcucccuccugcc

SEQ ID NO: 294435 - RNA, 22 nt, Human
gguuccuucugaggucccugua

SEQ ID NO: 294436 - RNA, 22 nt, Human
gaggccugucgcuaggccucug

SEQ ID NO: 294437 - RNA, 21 nt, Human
uaaaucucuguauucuucagu

SEQ ID NO: 294438 - RNA, 20 nt, Human
ucagagagagggugccacuu

SEQ ID NO: 294439 - RNA, 22 nt, Human
cugucuguguggacacggcugc

SEQ ID NO: 294440 - RNA, 22 nt, Human
agcuucuguucaucuuccaggc

SEQ ID NO: 294441 - RNA, 22 nt, Human
agauguuuuggagacacuaacc

SEQ ID NO: 294442 - RNA, 18 nt, Human
ggugagggagcuggaagc

SEQ ID NO: 294443 - RNA, 21 nt, Human
aggaggaacccguggcugggc

SEQ ID NO: 294444 - RNA, 20 nt, Human
ccagguggugccuggagagg

SEQ ID NO: 294445 - RNA, 22 nt, Human
ccuggagggcagcccauucugg

SEQ ID NO: 294446 - RNA, 22 nt, Human
aucuuauuuaacacagcaaaac

SEQ ID NO: 294447 - RNA, 22 nt, Human
ugcugagcgcauccggcggccg

SEQ ID NO: 294448 - RNA, 19 nt, Human
gccugcagaaaaggcaggg

SEQ ID NO: 294449 - RNA, 21 nt, Human
cagcuucuucugugaccuggu

SEQ ID NO: 294450 - RNA, 22 nt, Human
gcugaaaggggugacauucuuu

SEQ ID NO: 294451 - RNA, 22 nt, Human
agucacccuccaacucuccacu

SEQ ID NO: 294452 - RNA, 22 nt, Human
cuuaggcaagcagagcccaucc

SEQ ID NO: 294453 - RNA, 22 nt, Human
cccuguuuuaaguugauauuga

SEQ ID NO: 294454 - RNA, 22 nt, Human
ucuggcuagauugaugaguccc

SEQ ID NO: 294455 - RNA, 19 nt, Human
gcaggcagcugggguaucc

SEQ ID NO: 294456 - RNA, 22 nt, Human
caaguguccaugauagucuuag

SEQ ID NO: 294457 - RNA, 22 nt, Human
uacaguaagaugaaauagcaau

SEQ ID NO: 294458 - RNA, 22 nt, Human
uuuguuuacaaaaauaagcagu

SEQ ID NO: 294459 - RNA, 22 nt, Human
auccagaacaccuguaucacca

SEQ ID NO: 294460 - RNA, 22 nt, Human
agaggacagacggaaagugcca

SEQ ID NO: 294461 - RNA, 22 nt, Human
uguccucaucuuuuccagaaau

SEQ ID NO: 294462 - RNA, 22 nt, Human
uuccaggauagcuuucaggaau

SEQ ID NO: 294463 - RNA, 19 nt, Human
uuucugucuguguuuugcc

SEQ ID NO: 294464 - RNA, 22 nt, Human
ugcaaaaacagccuugaggccu

SEQ ID NO: 294465 - RNA, 22 nt, Human
guuucaaagcacagcucacauu

SEQ ID NO: 294466 - RNA, 22 nt, Human
ccuggagguggagguugcagug

SEQ ID NO: 294467 - RNA, 22 nt, Human
uuuacaguccccaggugaggau

SEQ ID NO: 294468 - RNA, 22 nt, Human
uggaauguuuccccagccugca

SEQ ID NO: 294469 - RNA, 22 nt, Human
uauaguuucaugagcuuuuuaa

SEQ ID NO: 294470 - RNA, 22 nt, Human
ugcccacauggugccauggcca

SEQ ID NO: 294471 - RNA, 22 nt, Human
uugccaucccuuaccucaguca

SEQ ID NO: 294472 - RNA, 22 nt, Human
uuguuuaauaucgugaaguacu

SEQ ID NO: 294473 - RNA, 22 nt, Human
uccaugagcuagcuuuccaaag

SEQ ID NO: 294474 - RNA, 22 nt, Human
agauggucugguuauuuuuagu

SEQ ID NO: 294475 - RNA, 22 nt, Human
caggugguuguuuggauucuaa

SEQ ID NO: 294476 - RNA, 22 nt, Human
acuuguuucaacuguacucuca

SEQ ID NO: 294477 - RNA, 22 nt, Human
uaugugucaaaccauucaucug

SEQ ID NO: 294478 - RNA, 21 nt, Human
gccugcccucugugauggcca

SEQ ID NO: 294479 - RNA, 22 nt, Human
gggcugaccaaugccuugcuuu

SEQ ID NO: 294480 - RNA, 22 nt, Human
aaauucagcagugaaaugcccc

SEQ ID NO: 294481 - RNA, 22 nt, Human
ggacagacaaaaauaguaagca

SEQ ID NO: 294482 - RNA, 22 nt, Human
cacccaggcagguggcugagaa

SEQ ID NO: 294483 - RNA, 22 nt, Human
acugucaucuuguaagcaaugu

SEQ ID NO: 294484 - RNA, 22 nt, Human
ugaggcaaucccuaggguaagg

SEQ ID NO: 294485 - RNA, 22 nt, Human
cagguucuuaacuuguucuucc

SEQ ID NO: 294486 - RNA, 22 nt, Human
cccagccuuugcuuccugguuc

SEQ ID NO: 294487 - RNA, 22 nt, Human
cacauuccccagagcuggggcu

SEQ ID NO: 294488 - RNA, 22 nt, Human
uggcaaaggaaaugauuuaaga

SEQ ID NO: 294489 - RNA, 22 nt, Human
acauuccucagugccaguugag

SEQ ID NO: 294490 - RNA, 22 nt, Human
uuagggaaggcugcugucagcu

SEQ ID NO: 294491 - RNA, 22 nt, Human
ugaaacacugcgauaaaauccu

SEQ ID NO: 294492 - RNA, 22 nt, Human
acagguggccccgagggagugg

SEQ ID NO: 294493 - RNA, 22 nt, Human
uucucugaaggccaugcucacu

SEQ ID NO: 294494 - RNA, 22 nt, Human
caaauucucuuacuguuugaca

SEQ ID NO: 294495 - RNA, 22 nt, Human
aaaauaugaaguugucaguaug

SEQ ID NO: 294496 - RNA, 22 nt, Human
acuguucaucucuuagaaagua

SEQ ID NO: 294497 - RNA, 22 nt, Human
cagcuuuagagaaaacauauuu

SEQ ID NO: 294498 - RNA, 22 nt, Human
cacaucagggcugcuugggggu

SEQ ID NO: 294499 - RNA, 22 nt, Human
uaacaauaguguuugcuaguca

SEQ ID NO: 294500 - RNA, 22 nt, Human
ucuguucacugagcaauggcaa

SEQ ID NO: 294501 - RNA, 22 nt, Human
uuuuucauugcagccucucucc

SEQ ID NO: 294502 - RNA, 22 nt, Human
gugcaaaagucauugugguuuu

SEQ ID NO: 294503 - RNA, 22 nt, Human
agcaaggccgagaggaugcuau

SEQ ID NO: 294504 - RNA, 22 nt, Human
caauagugucugcuuguuucua

SEQ ID NO: 294505 - RNA, 21 nt, Human
gcagugucaugguuucaaguu

SEQ ID NO: 294506 - RNA, 21 nt, Human
acagauuuuauaucucugcug

SEQ ID NO: 294507 - RNA, 22 nt, Human
augacauaaagcuaugcuaggu

SEQ ID NO: 294508 - RNA, 22 nt, Human
uugcacuaggaaaaggcagcca

SEQ ID NO: 294509 - RNA, 22 nt, Human
gguggcagagaggagguaguuu

SEQ ID NO: 294510 - RNA, 22 nt, Human
aguucucaagacaauuaccugu

SEQ ID NO: 294511 - RNA, 22 nt, Human
agcuccugauacaugcaggaau

SEQ ID NO: 294512 - RNA, 22 nt, Human
uuguguccaaggcuauggugau

SEQ ID NO: 294513 - RNA, 22 nt, Human
ucaucaguuuagaaaaaauaug

SEQ ID NO: 294514 - RNA, 22 nt, Human
aauuuuacuucccucaguguag

SEQ ID NO: 294515 - RNA, 22 nt, Human
ccagguguaggacaccaaggga

SEQ ID NO: 294516 - RNA, 22 nt, Human
gugcaaaaguaacugugguuuu

SEQ ID NO: 294517 - RNA, 22 nt, Human
ugggcuucauaauugguccuag

SEQ ID NO: 294518 - RNA, 22 nt, Human
uucauguaguguaaugucuuca

SEQ ID NO: 294519 - RNA, 22 nt, Human
uuuggaguuuaacaacuugaag

SEQ ID NO: 294520 - RNA, 22 nt, Human
uuucacauggaagcucucgaga

SEQ ID NO: 294521 - RNA, 22 nt, Human
aggcagggugaugauaaugauu

SEQ ID NO: 294522 - RNA, 22 nt, Human
uucacuuaacaucauaucauga

SEQ ID NO: 294523 - RNA, 22 nt, Human
uucagagaagcaaaggcagauu

SEQ ID NO: 294524 - RNA, 22 nt, Human
uauauuauaagcccuuucagaa

SEQ ID NO: 294525 - RNA, 17 nt, Human
caguggcagaucuucuc

SEQ ID NO: 294526 - RNA, 22 nt, Human
cuggagugacuuuguuccuuuu

SEQ ID NO: 294527 - RNA, 22 nt, Human
uuagagguucuaugugucugga

SEQ ID NO: 294528 - RNA, 22 nt, Human
uucuuuauugagacuucauugu

SEQ ID NO: 294529 - RNA, 22 nt, Human
aacuugguuguuggcaauuugc

SEQ ID NO: 294530 - RNA, 22 nt, Human
ucagggcagccuaaggcaccuc

SEQ ID NO: 294531 - RNA, 22 nt, Human
gcaugugugucacuuuccugcc

SEQ ID NO: 294532 - RNA, 22 nt, Human
gcagaagucagaccaucugaau

SEQ ID NO: 294533 - RNA, 22 nt, Human
cucaccccacuaccccuuggug

SEQ ID NO: 294534 - RNA, 22 nt, Human
guuuacaaauauuuuaaauggu

SEQ ID NO: 294535 - RNA, 21 nt, Human
gcugcccaacccugcaucucc

SEQ ID NO: 294536 - RNA, 22 nt, Human
aggcucugaucagguggcugug

SEQ ID NO: 294537 - RNA, 22 nt, Human
acaggugucugcaaguuacugg

SEQ ID NO: 294538 - RNA, 22 nt, Human
gagacugcauagauggccacaa

SEQ ID NO: 294539 - RNA, 22 nt, Human
ucuguggcugucuuuccagagg

SEQ ID NO: 294540 - RNA, 22 nt, Human
acauucuuugaguuuuguuaaa

SEQ ID NO: 294541 - RNA, 22 nt, Human
auucugauaucuuauucuagcu

SEQ ID NO: 294542 - RNA, 22 nt, Human
aaacaugagcaucucuucaagc

SEQ ID NO: 294543 - RNA, 22 nt, Human
uauuucaacguaugaaaagcug

SEQ ID NO: 294544 - RNA, 22 nt, Human
uaugcauacaaugagauauucc

SEQ ID NO: 294545 - RNA, 22 nt, Human
gcccagcacauugcugaggacc

SEQ ID NO: 294546 - RNA, 22 nt, Human
aaagcugcuuugguuucuggaa

SEQ ID NO: 294547 - RNA, 22 nt, Human
ucaguguuggcauucagaaaug

SEQ ID NO: 294548 - RNA, 22 nt, Human
cugagccagcuggcaugugcua

SEQ ID NO: 294549 - RNA, 22 nt, Human
uccuggcucucuacaaaccaga

SEQ ID NO: 294550 - RNA, 22 nt, Human
ggagggaaccuuggcuggauug

SEQ ID NO: 294551 - RNA, 22 nt, Human
aagcugcacuacuugagggacc

SEQ ID NO: 294552 - RNA, 22 nt, Human
uucugaaagccaauucauugaa

SEQ ID NO: 294553 - RNA, 22 nt, Human
agaccuggagugaagaguuccc

SEQ ID NO: 294554 - RNA, 22 nt, Human
agcaggugaauuccuggaugug

SEQ ID NO: 294555 - RNA, 22 nt, Human
gccugggugagggucuccuuca

SEQ ID NO: 294556 - RNA, 22 nt, Human
gaggccuggucuaugagauguu

SEQ ID NO: 294557 - RNA, 22 nt, Human
acauggcuaaauuagcuuuacu

SEQ ID NO: 294558 - RNA, 22 nt, Human
auugaaucugcacuaguauuuu

SEQ ID NO: 294559 - RNA, 22 nt, Human
uggcugugaacaaagagaauaa

SEQ ID NO: 294560 - RNA, 22 nt, Human
cugaaugagggauucugagggc

SEQ ID NO: 294561 - RNA, 22 nt, Human
gcuggcagguccaagauagagc

SEQ ID NO: 294562 - RNA, 17 nt, Human
uuucuccuuccaucuca

SEQ ID NO: 294563 - RNA, 22 nt, Human
cagcaugaugcucacacaaaac

SEQ ID NO: 294564 - RNA, 22 nt, Human
uuucuuagcgaugcuugauaaa

SEQ ID NO: 294565 - RNA, 22 nt, Human
cucugugcccuacugcucagcu

SEQ ID NO: 294566 - RNA, 22 nt, Human
aagaugaaucaguauguguccu

SEQ ID NO: 294567 - RNA, 22 nt, Human
cacuggaauucaagauacugag

SEQ ID NO: 294568 - RNA, 22 nt, Human
agcauccaggccagguugggca

SEQ ID NO: 294569 - RNA, 22 nt, Human
uuuguucagcucucauugauua

SEQ ID NO: 294570 - RNA, 22 nt, Human
cagggcucugccuugagggaug

SEQ ID NO: 294571 - RNA, 22 nt, Human
accaggcaguauggugcugcaa

SEQ ID NO: 294572 - RNA, 22 nt, Human
gaagacaagcugaguguugucc

SEQ ID NO: 294573 - RNA, 22 nt, Human
uccuggucagugccaaacuggu

SEQ ID NO: 294574 - RNA, 22 nt, Human
uuccagagaaaagguuuauuuc

SEQ ID NO: 294575 - RNA, 22 nt, Human
guuuguuagaagagcagaaucu

SEQ ID NO: 294576 - RNA, 22 nt, Human
ugacaagauagauugaguuuua

SEQ ID NO: 294577 - RNA, 22 nt, Human
cugggcucaaauccuggcccug

SEQ ID NO: 294578 - RNA, 22 nt, Human
ccaggccucaccugcccaccua

SEQ ID NO: 294579 - RNA, 22 nt, Human
acugucuuccaggucuggaggu

SEQ ID NO: 294580 - RNA, 22 nt, Human
uugauuccuugaaauauccuug

SEQ ID NO: 294581 - RNA, 22 nt, Human
gauggugcaggugaagugcugg

SEQ ID NO: 294582 - RNA, 22 nt, Human
ucuccugguacccuuccuagca

SEQ ID NO: 294583 - RNA, 22 nt, Human
gccuguuugacuggucucugcu

SEQ ID NO: 294584 - RNA, 22 nt, Human
aagcaaaagguuacacuucugg

SEQ ID NO: 294585 - RNA, 22 nt, Human
auuagcuuuauuugaaauagga

SEQ ID NO: 294586 - RNA, 22 nt, Human
cauuuacacacagaggugugcu

SEQ ID NO: 294587 - RNA, 21 nt, Human
auacauucuauuaagcauuua

SEQ ID NO: 294588 - RNA, 22 nt, Human
agaggucauaucucagaagaga

SEQ ID NO: 294589 - RNA, 22 nt, Human
gcuccuggagagauugagaaag

SEQ ID NO: 294590 - RNA, 22 nt, Human
ccucccugguggcucuggucua

SEQ ID NO: 294591 - RNA, 22 nt, Human
gcaugaaaugagcgaauauaau

SEQ ID NO: 294592 - RNA, 22 nt, Human
ugcaggugugguuccucagcca

SEQ ID NO: 294593 - RNA, 22 nt, Human
ggucacuccaccuucuccaccu

SEQ ID NO: 294594 - RNA, 22 nt, Human
ugauguucuguauaucauauag

SEQ ID NO: 294595 - RNA, 22 nt, Human
uauacacaggaaucugugaaaa

SEQ ID NO: 294596 - RNA, 22 nt, Human
ucuaaagaagaggguucugcgg

SEQ ID NO: 294597 - RNA, 23 nt, Human
uugaaagauugcuaaguaaaaau

SEQ ID NO: 294598 - RNA, 22 nt, Human
ucagugauuucuggggugaggg

SEQ ID NO: 294599 - RNA, 22 nt, Human
auauguauguacgcacauauuc

SEQ ID NO: 294600 - RNA, 22 nt, Human
uugggcagggaaaggacaggca

SEQ ID NO: 294601 - RNA, 19 nt, Human
acaguuugggaaaugagca

SEQ ID NO: 294602 - RNA, 22 nt, Human
uaaaguuuguagcaauugauau

SEQ ID NO: 294603 - RNA, 22 nt, Human
ccccacaggugucugaggcagg

SEQ ID NO: 294604 - RNA, 22 nt, Human
uuuuuuauagcaaugaacccac

SEQ ID NO: 294605 - RNA, 22 nt, Human
auguccagaguaaagcacauuc

SEQ ID NO: 294606 - RNA, 22 nt, Human
aauucuuaaucccauaaaguga

SEQ ID NO: 294607 - RNA, 22 nt, Human
caggcagggagcuggaaaggau

SEQ ID NO: 294608 - RNA, 22 nt, Human
ucuaguucuagaucccugagga

SEQ ID NO: 294609 - RNA, 22 nt, Human
uuccugggaggcuguguacuug

SEQ ID NO: 294610 - RNA, 21 nt, Human
cacuccacuuagaacaggguu

SEQ ID NO: 294611 - RNA, 22 nt, Human
ggcuuucuagaucuagcucugu

SEQ ID NO: 294612 - RNA, 22 nt, Human
aacagcuuuuuuggucagcauu

SEQ ID NO: 294613 - RNA, 22 nt, Human
uccaggagcauccaggugaagc

SEQ ID NO: 294614 - RNA, 21 nt, Human
acaggcucacgauccauuucu

SEQ ID NO: 294615 - RNA, 22 nt, Human
uuuauucaucaucuguucauau

SEQ ID NO: 294616 - RNA, 22 nt, Human
auugguauguauucugaaaacu

SEQ ID NO: 294617 - RNA, 21 nt, Human
auauuuuuguuuggacuguca

SEQ ID NO: 294618 - RNA, 22 nt, Human
ggucuggaauaagguccaggaa

SEQ ID NO: 294619 - RNA, 22 nt, Human
gggcugacucugcacugagcca

SEQ ID NO: 294620 - RNA, 22 nt, Human
aguguccuuucuguuccagcca

SEQ ID NO: 294621 - RNA, 22 nt, Human
acuggcagagguuggacaccau

SEQ ID NO: 294622 - RNA, 22 nt, Human
acugaauuuuaauuagaucugc

SEQ ID NO: 294623 - RNA, 22 nt, Human
uugggaagaaacauguccauca

SEQ ID NO: 294624 - RNA, 22 nt, Human
gagucagaagaaacuauuuaca

SEQ ID NO: 294625 - RNA, 22 nt, Human
agaaaacuugucacagcucuca

SEQ ID NO: 294626 - RNA, 22 nt, Human
agcucccagcagagcuggccac

SEQ ID NO: 294627 - RNA, 22 nt, Human
uacacauguuuggcaaguaugu

SEQ ID NO: 294628 - RNA, 21 nt, Human
uuuacugagcacuuacuaugu

SEQ ID NO: 294629 - RNA, 22 nt, Human
ugccuggcccugacagcccugg

SEQ ID NO: 294630 - RNA, 22 nt, Human
cccagcaggucggugcugccug

SEQ ID NO: 294631 - RNA, 22 nt, Human
acagaguauuggaaaggcagug

SEQ ID NO: 294632 - RNA, 22 nt, Human
uucuuaaagaggcaaaacacag

SEQ ID NO: 294633 - RNA, 22 nt, Human
ugaucuccugaccuuguaaucc

SEQ ID NO: 294634 - RNA, 22 nt, Human
agcagacaauugccuggaugga

SEQ ID NO: 294635 - RNA, 22 nt, Human
uugcuuuauuccuagcccuugu

SEQ ID NO: 294636 - RNA, 22 nt, Human
ucagcuuuuuacaugugaaaua

SEQ ID NO: 294637 - RNA, 22 nt, Human
uguguucauuucucucugcugu

SEQ ID NO: 294638 - RNA, 22 nt, Human
uguuuagaugcaaagucucaca

SEQ ID NO: 294639 - RNA, 22 nt, Human
cccaguuucaacuuuccagugg

SEQ ID NO: 294640 - RNA, 22 nt, Human
gcaugugucuuuauagcagcau

SEQ ID NO: 294641 - RNA, 18 nt, Human
cucucuuuccacucuuug

SEQ ID NO: 294642 - RNA, 22 nt, Human
uucagaaugugaccuuauuugg

SEQ ID NO: 294643 - RNA, 21 nt, Human
cuguggccuggcuagcaccgu

SEQ ID NO: 294644 - RNA, 22 nt, Human
cugaggagucaguuccacucag

SEQ ID NO: 294645 - RNA, 22 nt, Human
aagcagacaucccauacuuuug

SEQ ID NO: 294646 - RNA, 22 nt, Human
gacucugggcugagccagggcc

SEQ ID NO: 294647 - RNA, 20 nt, Human
uacagacaugacaauaaugg

SEQ ID NO: 294648 - RNA, 22 nt, Human
uggaagcuguggcauaacugag

SEQ ID NO: 294649 - RNA, 20 nt, Human
cccucccagaugcuucccaa

SEQ ID NO: 294650 - RNA, 22 nt, Human
auuuaugacuggugaauagaac

SEQ ID NO: 294651 - RNA, 20 nt, Human
cuguggcucaugcaucugcc

SEQ ID NO: 294652 - RNA, 22 nt, Human
gggacagaaggaagugagcaca

SEQ ID NO: 294653 - RNA, 18 nt, Human
uccuggccacacuaccuu

SEQ ID NO: 294654 - RNA, 22 nt, Human
aacauuuaugguagucauugca

SEQ ID NO: 294655 - RNA, 22 nt, Human
aaauauaauuucugccucaaua

SEQ ID NO: 294656 - RNA, 22 nt, Human
cuauuaaauacucuucaaauug

SEQ ID NO: 294657 - RNA, 22 nt, Human
cagggacccuacuagcucacac

SEQ ID NO: 294658 - RNA, 22 nt, Human
cuauuuucccauaugguugaca

SEQ ID NO: 294659 - RNA, 22 nt, Human
acaguauauauagucuaaaagc

SEQ ID NO: 294660 - RNA, 22 nt, Human
uuagcucuuuguagcuauuucu

SEQ ID NO: 294661 - RNA, 22 nt, Human
cuggcagucugguggaaggccu

SEQ ID NO: 294662 - RNA, 22 nt, Human
agaggaauaaauuucuguagug

SEQ ID NO: 294663 - RNA, 22 nt, Human
auaacagaugugaagugcuaau

SEQ ID NO: 294664 - RNA, 22 nt, Human
cuccuggcacugucuugaccca

SEQ ID NO: 294665 - RNA, 22 nt, Human
cagggcucacucggcuggcguc

SEQ ID NO: 294666 - RNA, 23 nt, Human
uucagggccucagaggugaagcu

SEQ ID NO: 294667 - RNA, 22 nt, Human
uagguucacuuagcugugggaa

SEQ ID NO: 294668 - RNA, 22 nt, Human
auuucagauucagaaauguagg

SEQ ID NO: 294669 - RNA, 22 nt, Human
uugcagggcaaauggucagaua

SEQ ID NO: 294670 - RNA, 22 nt, Human
cagacaggguggguuucugggc

SEQ ID NO: 294671 - RNA, 22 nt, Human
ugaaaacuugacaagugaggua

SEQ ID NO: 294672 - RNA, 22 nt, Human
auucucugugcagauuuaagac

SEQ ID NO: 294673 - RNA, 23 nt, Human
gcaugaagugcuacgucuacagc

SEQ ID NO: 294674 - RNA, 22 nt, Human
ucagaguccucacccugaggau

SEQ ID NO: 294675 - RNA, 22 nt, Human
caccagggccccaggcugugcc

SEQ ID NO: 294676 - RNA, 22 nt, Human
acaucuuugcucuuauagagcu

SEQ ID NO: 294677 - RNA, 17 nt, Human
ucuguucaugcauaccu

SEQ ID NO: 294678 - RNA, 22 nt, Human
gcagguggaagcagcagacuca

SEQ ID NO: 294679 - RNA, 17 nt, Human
aguuuugauauaauggc

SEQ ID NO: 294680 - RNA, 22 nt, Human
gccaggcagcugggagggugcc

SEQ ID NO: 294681 - RNA, 22 nt, Human
gggcagguaggugaaauaauga

SEQ ID NO: 294682 - RNA, 22 nt, Human
gauuuauuuuuaaucagcaggg

SEQ ID NO: 294683 - RNA, 22 nt, Human
uauccaaaguuucucagaaacu

SEQ ID NO: 294684 - RNA, 22 nt, Human
agagcccaucaguggcagugga

SEQ ID NO: 294685 - RNA, 22 nt, Human
uugaggaguuaggauguuuaua

SEQ ID NO: 294686 - RNA, 22 nt, Human
ugauggcuaucccuggaagggc

SEQ ID NO: 294687 - RNA, 22 nt, Human
ucuguucuucuccacuguaugu

SEQ ID NO: 294688 - RNA, 22 nt, Human
gggagccagccuuugccuauaa

SEQ ID NO: 294689 - RNA, 22 nt, Human
uugcuuuauuggguuuacugcc

SEQ ID NO: 294690 - RNA, 22 nt, Human
ccccagcagcaccuggggcagu

SEQ ID NO: 294691 - RNA, 22 nt, Human
ucuaggguggagcugggaaucc

SEQ ID NO: 294692 - RNA, 22 nt, Human
ggguggggccaggcaauuugca

SEQ ID NO: 294693 - RNA, 22 nt, Human
cuggauguuuugcuaaggacuc

SEQ ID NO: 294694 - RNA, 22 nt, Human
uauuuguuccagagauaaaaau

SEQ ID NO: 294695 - RNA, 22 nt, Human
aagaaaagauguuugguuuuca

SEQ ID NO: 294696 - RNA, 22 nt, Human
gggaucuugggaacacccuuac

SEQ ID NO: 294697 - RNA, 22 nt, Human
caggccugugacaccgugucug

SEQ ID NO: 294698 - RNA, 22 nt, Human
agugucugcaaaaugaaagagc

SEQ ID NO: 294699 - RNA, 22 nt, Human
uccaaggaaguuugcacuauug

SEQ ID NO: 294700 - RNA, 22 nt, Human
uucuacauauauuuuucucacu

SEQ ID NO: 294701 - RNA, 22 nt, Human
ggcaggcuuucagcaucaaguc

SEQ ID NO: 294702 - RNA, 22 nt, Human
uauuuauucauucagcaagcau

SEQ ID NO: 294703 - RNA, 22 nt, Human
ucuccaaaucaaucaauaugaa

SEQ ID NO: 294704 - RNA, 22 nt, Human
cagcuuguuuuauuuggggacc

SEQ ID NO: 294705 - RNA, 22 nt, Human
agucacuucuauucuauuaagu

SEQ ID NO: 294706 - RNA, 22 nt, Human
cagugcagguggcagaggacag

SEQ ID NO: 294707 - RNA, 22 nt, Human
ucucagugguguuuugagucca

SEQ ID NO: 294708 - RNA, 22 nt, Human
cuucaagaagacagcagagcau

SEQ ID NO: 294709 - RNA, 22 nt, Human
aagaauuaucugaaagcugugu

SEQ ID NO: 294710 - RNA, 22 nt, Human
ucagacagggcuucucaaacuu

SEQ ID NO: 294711 - RNA, 22 nt, Human
uauuaauaagugacuacuagcu

SEQ ID NO: 294712 - RNA, 22 nt, Human
cccugcagagagugcuuuugug

SEQ ID NO: 294713 - RNA, 22 nt, Human
ucaacaaugggucuguaaugga

SEQ ID NO: 294714 - RNA, 22 nt, Human
ccaaggagcucauauucuuguu

SEQ ID NO: 294715 - RNA, 22 nt, Human
cuuuguugugccugagugcacc

SEQ ID NO: 294716 - RNA, 22 nt, Human
ucagagagguuaaauaucuugu

SEQ ID NO: 294717 - RNA, 22 nt, Human
uaugaagacaaugauagcauga

SEQ ID NO: 294718 - RNA, 22 nt, Human
aagggcaggaaaagauggaugu

SEQ ID NO: 294719 - RNA, 22 nt, Human
ugccuucaagacccauccucca

SEQ ID NO: 294720 - RNA, 19 nt, Human
caggugguaaucugagccu

SEQ ID NO: 294721 - RNA, 22 nt, Human
ggcagggcuugucucugugaug

SEQ ID NO: 294722 - RNA, 22 nt, Human
gcacugguaucaccugagagcu

SEQ ID NO: 294723 - RNA, 22 nt, Human
agaaagaggaugcagaucucau

SEQ ID NO: 294724 - RNA, 22 nt, Human
acaguaaaucaacagaauaucu

SEQ ID NO: 294725 - RNA, 22 nt, Human
uuauuguuagugagacuguaga

SEQ ID NO: 294726 - RNA, 22 nt, Human
acauuguuugagaauacagaug

SEQ ID NO: 294727 - RNA, 22 nt, Human
uguuuugcuucucuguuuccca

SEQ ID NO: 294728 - RNA, 22 nt, Human
ucagaaaagaccacauuauucu

SEQ ID NO: 294729 - RNA, 22 nt, Human
uagggaugaggauagauuuuuc

SEQ ID NO: 294730 - RNA, 22 nt, Human
agaguguaccaaauauccuaca

SEQ ID NO: 294731 - RNA, 22 nt, Human
ucacuggggcccacaucaacau

SEQ ID NO: 294732 - RNA, 22 nt, Human
aguccagggagcccaggcuuug

SEQ ID NO: 294733 - RNA, 22 nt, Human
accccagcucugagccacacca

SEQ ID NO: 294734 - RNA, 22 nt, Human
ucaccagggcuccagccagccu

SEQ ID NO: 294735 - RNA, 22 nt, Human
aaagacuuggcuuaugauuugc

SEQ ID NO: 294736 - RNA, 23 nt, Human
gcccagggacugggaaucagugg

SEQ ID NO: 294737 - RNA, 22 nt, Human
aaagagucuggcacuguaccag

SEQ ID NO: 294738 - RNA, 22 nt, Human
ucauacaucuguccuggagcuc

SEQ ID NO: 294739 - RNA, 22 nt, Human
ucucugaagagcucagacuagu

SEQ ID NO: 294740 - RNA, 22 nt, Human
uuagagaagaugaaccaucguu

SEQ ID NO: 294741 - RNA, 22 nt, Human
uacuuuauucaggaaggcuggu

SEQ ID NO: 294742 - RNA, 22 nt, Human
aaaauuaagugucugggaagcc

SEQ ID NO: 294743 - RNA, 22 nt, Human
auacuuucugaccaauuaauug

SEQ ID NO: 294744 - RNA, 22 nt, Human
aaugcagaccaguaugaaaaac

SEQ ID NO: 294745 - RNA, 22 nt, Human
gagacaguguccauccaggggc

SEQ ID NO: 294746 - RNA, 22 nt, Human
cucuccacuguccuuugcuggu

SEQ ID NO: 294747 - RNA, 22 nt, Human
aggcugugggaauggcugcuug

SEQ ID NO: 294748 - RNA, 22 nt, Human
cacagguguuuguuauacucag

SEQ ID NO: 294749 - RNA, 22 nt, Human
acauuuuuauucaucaaagcag

SEQ ID NO: 294750 - RNA, 22 nt, Human
ucagggcauguauguuucuuua

SEQ ID NO: 294751 - RNA, 22 nt, Human
acagcuguguuuuauaaucagc

SEQ ID NO: 294752 - RNA, 22 nt, Human
ggcaggugaguucauuaucugc

SEQ ID NO: 294753 - RNA, 22 nt, Human
cagaugaagaucauagaauagu

SEQ ID NO: 294754 - RNA, 23 nt, Human
uugaaaaauauagucccauuguc

SEQ ID NO: 294755 - RNA, 22 nt, Human
uuccuuguaagaccuauuuuug

SEQ ID NO: 294756 - RNA, 22 nt, Human
uaaaucuuuaggaagcucaaac

SEQ ID NO: 294757 - RNA, 22 nt, Human
augcuacuauccuucugcuuaa

SEQ ID NO: 294758 - RNA, 22 nt, Human
gucaaaaugagcuuuguuauug

SEQ ID NO: 294759 - RNA, 19 nt, Human
uucauucuuucuacuuacc

SEQ ID NO: 294760 - RNA, 22 nt, Human
uuacagugacucacauuaacaa

SEQ ID NO: 294761 - RNA, 22 nt, Human
aauucaugaguagaaucuauau

SEQ ID NO: 294762 - RNA, 22 nt, Human
acugucuucaaaugaauauauu

SEQ ID NO: 294763 - RNA, 18 nt, Human
gcuuccugaaagcugccc

SEQ ID NO: 294764 - RNA, 18 nt, Human
uccuaacuuagauacucc

SEQ ID NO: 294765 - RNA, 22 nt, Human
ucucuguaucccagaaccaaaa

SEQ ID NO: 294766 - RNA, 22 nt, Human
aaugaguuagaugagaaaauaa

SEQ ID NO: 294767 - RNA, 22 nt, Human
agcuccuguggcagcucuucug

SEQ ID NO: 294768 - RNA, 22 nt, Human
uagaaacaucagcuaaccaaaa

SEQ ID NO: 294769 - RNA, 17 nt, Human
uuaagguggaucagcac

SEQ ID NO: 294770 - RNA, 22 nt, Human
acugucacuccaacugagucgu

SEQ ID NO: 294771 - RNA, 22 nt, Human
uugcaggguacauucuuagaau

SEQ ID NO: 294772 - RNA, 22 nt, Human
gacaugugagagcucgguuuuc

SEQ ID NO: 294773 - RNA, 22 nt, Human
acaagucuuuuucaugucuucu

SEQ ID NO: 294774 - RNA, 22 nt, Human
uagggaugcuuaguaggaccca

SEQ ID NO: 294775 - RNA, 22 nt, Human
gagcacccuuugcacaucaguc

SEQ ID NO: 294776 - RNA, 22 nt, Human
uagguguccauauaugugugua

SEQ ID NO: 294777 - RNA, 22 nt, Human
auuaaagaaacccagcauguga

SEQ ID NO: 294778 - RNA, 22 nt, Human
ugggcuccggcggccucaggcu

SEQ ID NO: 294779 - RNA, 18 nt, Human
ggucacugagaugcuacu

SEQ ID NO: 294780 - RNA, 22 nt, Human
uaaaguguggauaugauuagua

SEQ ID NO: 294781 - RNA, 22 nt, Human
acacaggacagggauguguuuu

SEQ ID NO: 294782 - RNA, 22 nt, Human
cauuccagaugaggccaggccc

SEQ ID NO: 294783 - RNA, 22 nt, Human
acuguuaaaguaauuaauuguc

SEQ ID NO: 294784 - RNA, 22 nt, Human
ggcagggcccugauuccugggg

SEQ ID NO: 294785 - RNA, 22 nt, Human
uuuguuaaaaugcagauucugu

SEQ ID NO: 294786 - RNA, 17 nt, Human
gaugaaaugaugcacac

SEQ ID NO: 294787 - RNA, 22 nt, Human
cagguggugccuccucccuucc

SEQ ID NO: 294788 - RNA, 22 nt, Human
uuuauugagcacccguugugcg

SEQ ID NO: 294789 - RNA, 22 nt, Human
uaacacauaagcugagaccaug

SEQ ID NO: 294790 - RNA, 22 nt, Human
uccuggccaaguagauguggcg

SEQ ID NO: 294791 - RNA, 22 nt, Human
gacaguuuagguucaaaucuca

SEQ ID NO: 294792 - RNA, 22 nt, Human
ccugaaaaucaagguaguuugg

SEQ ID NO: 294793 - RNA, 22 nt, Human
uuccuggugguggugacagcac

SEQ ID NO: 294794 - RNA, 22 nt, Human
acaaaauuguguuaaacuuuau

SEQ ID NO: 294795 - RNA, 22 nt, Human
uuuuuucagccugucugugcca

SEQ ID NO: 294796 - RNA, 22 nt, Human
cagguguauaaacucagugacu

SEQ ID NO: 294797 - RNA, 22 nt, Human
aagcugaagacacagcuccagu

SEQ ID NO: 294798 - RNA, 15 nt, Human
gcauguguaauaggc

SEQ ID NO: 294799 - RNA, 22 nt, Human
uuacaguuuacauaagaauugu

SEQ ID NO: 294800 - RNA, 19 nt, Human
ucugaagaauuagagagca

SEQ ID NO: 294801 - RNA, 22 nt, Human
uguaucaaggguuuauguaagc

SEQ ID NO: 294802 - RNA, 22 nt, Human
gaggcugcaggcaaugcugccc

SEQ ID NO: 294803 - RNA, 22 nt, Human
aggcccugcccagagcuccucg

SEQ ID NO: 294804 - RNA, 22 nt, Human
uacugucuggaguugccaaagg

SEQ ID NO: 294805 - RNA, 22 nt, Human
guauagguuuggcucucuccag

SEQ ID NO: 294806 - RNA, 22 nt, Human
ucaugcuaguuaagaacacaau

SEQ ID NO: 294807 - RNA, 22 nt, Human
ucaaagcacacuuagugguaga

SEQ ID NO: 294808 - RNA, 22 nt, Human
ccugaaauuugaagaccugaau

SEQ ID NO: 294809 - RNA, 21 nt, Human
ugcaccuguucacugcaguuc

SEQ ID NO: 294810 - RNA, 18 nt, Human
auaaagugcuaauaaugg

SEQ ID NO: 294811 - RNA, 22 nt, Human
cucugagguccuacagugaccc

SEQ ID NO: 294812 - RNA, 22 nt, Human
guuauauauaguauuucucuga

SEQ ID NO: 294813 - RNA, 22 nt, Human
cugugugcuguuagggagcugc

SEQ ID NO: 294814 - RNA, 22 nt, Human
gcuguucauuagaaauagaaug

SEQ ID NO: 294815 - RNA, 22 nt, Human
cugagagaaucaugcugcaggu

SEQ ID NO: 294816 - RNA, 22 nt, Human
aggagguggcaacugucgacag

SEQ ID NO: 294817 - RNA, 22 nt, Human
cuugaauccaaaugggagauga

SEQ ID NO: 294818 - RNA, 22 nt, Human
aaugagcugcugcuguuccacc

SEQ ID NO: 294819 - RNA, 22 nt, Human
acuguacucuucuagccaucug

SEQ ID NO: 294820 - RNA, 21 nt, Human
gguguccugagggauagguag

SEQ ID NO: 294821 - RNA, 22 nt, Human
uaauuuuccacucuguuuaucu

SEQ ID NO: 294822 - RNA, 22 nt, Human
gcaugcaggagagaaagacggc

SEQ ID NO: 294823 - RNA, 22 nt, Human
agguuuauguuuggugcaggag

SEQ ID NO: 294824 - RNA, 22 nt, Human
guucucucugcuuccaagaugg

SEQ ID NO: 294825 - RNA, 22 nt, Human
aggcagguuacaaaaacuuuau

SEQ ID NO: 294826 - RNA, 23 nt, Human
gaagcccucauugguucuccaga

SEQ ID NO: 294827 - RNA, 22 nt, Human
aauagcaaaguuaucaaauuaa

SEQ ID NO: 294828 - RNA, 22 nt, Human
auccaggcgaaugcagaaggcc

SEQ ID NO: 294829 - RNA, 22 nt, Human
auuucaguguuuuaagaguuca

SEQ ID NO: 294830 - RNA, 22 nt, Human
guuuauaagguaaaggagagag

SEQ ID NO: 294831 - RNA, 22 nt, Human
caggugucuaauucucaccccc

SEQ ID NO: 294832 - RNA, 22 nt, Human
gaguccuuuguuccuugccaca

SEQ ID NO: 294833 - RNA, 18 nt, Human
aggcaggugcuaauauuu

SEQ ID NO: 294834 - RNA, 22 nt, Human
aggaaaugggaauagaugguau

SEQ ID NO: 294835 - RNA, 19 nt, Human
uggcuuggcugcagaugcu

SEQ ID NO: 294836 - RNA, 22 nt, Human
aggcugcagaacagucaggugc

SEQ ID NO: 294837 - RNA, 22 nt, Human
cccagugggucacugcaucuca

SEQ ID NO: 294838 - RNA, 22 nt, Human
uacauucauggugacuuguaug

SEQ ID NO: 294839 - RNA, 22 nt, Human
uacauucagaauugggaggcaa

SEQ ID NO: 294840 - RNA, 22 nt, Human
gugaggagggcuggucccaggc

SEQ ID NO: 294841 - RNA, 22 nt, Human
agcagggcugcggccccaccac

SEQ ID NO: 294842 - RNA, 16 nt, Human
aaggagggaagagaau

SEQ ID NO: 294843 - RNA, 22 nt, Human
agugucaaugccaacaguauau

SEQ ID NO: 294844 - RNA, 22 nt, Human
uuuccuucccuggaugagaagu

SEQ ID NO: 294845 - RNA, 22 nt, Human
uuccagagcaguuuucagauca

SEQ ID NO: 294846 - RNA, 22 nt, Human
uugcaggggaaggagcagagcu

SEQ ID NO: 294847 - RNA, 22 nt, Human
uucuuucucuccacaaggcuug

SEQ ID NO: 294848 - RNA, 21 nt, Human
aaaaagcuggggcaugcaugc

SEQ ID NO: 294849 - RNA, 22 nt, Human
cuguccuguggaccugaggacg

SEQ ID NO: 294850 - RNA, 22 nt, Human
ugagggaguuggguguauagga

SEQ ID NO: 294851 - RNA, 20 nt, Human
uuacuugucucagcauggag

SEQ ID NO: 294852 - RNA, 22 nt, Human
cagggauggccuggcgggccac

SEQ ID NO: 294853 - RNA, 22 nt, Human
ggcaguggguuccccaaggcac

SEQ ID NO: 294854 - RNA, 22 nt, Human
cuuuaaauaauacaagguccag

SEQ ID NO: 294855 - RNA, 22 nt, Human
aaaguccuguuaacuguuaaca

SEQ ID NO: 294856 - RNA, 20 nt, Human
gggcuuggaggacucgaggg

SEQ ID NO: 294857 - RNA, 22 nt, Human
cagggcagggccacacccccug

SEQ ID NO: 294858 - RNA, 22 nt, Human
cccagaugcagguucaagagua

SEQ ID NO: 294859 - RNA, 22 nt, Human
uccuacaucagcucucaguagc

SEQ ID NO: 294860 - RNA, 22 nt, Human
gcagucaguguugacuacaugc

SEQ ID NO: 294861 - RNA, 22 nt, Human
aaauaguccugggaauaguacu

SEQ ID NO: 294862 - RNA, 19 nt, Human
ucagucuaggaaugagcua

SEQ ID NO: 294863 - RNA, 22 nt, Human
ucucuggucccaccuggccauu

SEQ ID NO: 294864 - RNA, 19 nt, Human
cuuuucaucaacagccaau

SEQ ID NO: 294865 - RNA, 22 nt, Human
uuuaaauucugucugccgcuua

SEQ ID NO: 294866 - RNA, 22 nt, Human
gggcagguggcagggucucugg

SEQ ID NO: 294867 - RNA, 22 nt, Human
ucagccugcgucauggugacac

SEQ ID NO: 294868 - RNA, 22 nt, Human
aagauucagccaaauuguucau

SEQ ID NO: 294869 - RNA, 22 nt, Human
aauaagauccugaagauauguu

SEQ ID NO: 294870 - RNA, 21 nt, Human
cacaugugaauuacugaacug

SEQ ID NO: 294871 - RNA, 20 nt, Human
auuuggcaugaaguauugau

SEQ ID NO: 294872 - RNA, 22 nt, Human
ucagguguggucaccacagggu

SEQ ID NO: 294873 - RNA, 22 nt, Human
acaggaucgcccuguugcccag

SEQ ID NO: 294874 - RNA, 21 nt, Human
cauucacagucuggcucuuga

SEQ ID NO: 294875 - RNA, 22 nt, Human
uucauucuugggaucagagagu

SEQ ID NO: 294876 - RNA, 20 nt, Human
ggcagggcaucaacagcucu

SEQ ID NO: 294877 - RNA, 22 nt, Human
uacugucucugcccuggccagg

SEQ ID NO: 294878 - RNA, 22 nt, Human
gcagcuuucugcaaugucaucc

SEQ ID NO: 294879 - RNA, 22 nt, Human
aggugucuucagggugagacag

SEQ ID NO: 294880 - RNA, 22 nt, Human
aauagugaacaggaacaugcuu

SEQ ID NO: 294881 - RNA, 22 nt, Human
uuuaauuuuccucuuccuggag

SEQ ID NO: 294882 - RNA, 22 nt, Human
ucugcagguaagcguucuugga

SEQ ID NO: 294883 - RNA, 22 nt, Human
uucauguaggcugcaaugcaca

SEQ ID NO: 294884 - RNA, 22 nt, Human
ggagcugaggcugaggccucac

SEQ ID NO: 294885 - RNA, 22 nt, Human
uaccuggcagucagucuuuccg

SEQ ID NO: 294886 - RNA, 22 nt, Human
aauguaaacagcaagagaaggg

SEQ ID NO: 294887 - RNA, 17 nt, Human
uccuguuuaucauugau

SEQ ID NO: 294888 - RNA, 22 nt, Human
ccaggugugucuggccccgaag

SEQ ID NO: 294889 - RNA, 20 nt, Human
ugagaaggggucagcuguac

SEQ ID NO: 294890 - RNA, 22 nt, Human
uuugcuuugacugucagcaagu

SEQ ID NO: 294891 - RNA, 22 nt, Human
aaucaagaaaaugaggauucuu

SEQ ID NO: 294892 - RNA, 22 nt, Human
acagcuggagugaggauggagu

SEQ ID NO: 294893 - RNA, 22 nt, Human
gagcugaagcgcuacagcaucc

SEQ ID NO: 294894 - RNA, 22 nt, Human
gaaagcacccaagauuuccuuc

SEQ ID NO: 294895 - RNA, 22 nt, Human
guccugagggcccaggcauucu

SEQ ID NO: 294896 - RNA, 22 nt, Human
aaagcagggaugaggcuagagg

SEQ ID NO: 294897 - RNA, 22 nt, Human
gggaagggacuuguuuaagguc

SEQ ID NO: 294898 - RNA, 22 nt, Human
uucaaaauuguucuaagcucug

SEQ ID NO: 294899 - RNA, 22 nt, Human
ccaaggcugucauucaguagcu

SEQ ID NO: 294900 - RNA, 22 nt, Human
cagcuuuaguaacccacugcuc

SEQ ID NO: 294901 - RNA, 22 nt, Human
ccuggguggcugccugccuuuc

SEQ ID NO: 294902 - RNA, 22 nt, Human
aagauguaaaggcaauauaaag

SEQ ID NO: 294903 - RNA, 22 nt, Human
ccagagguuacuuugccuugga

SEQ ID NO: 294904 - RNA, 22 nt, Human
aggcacagcacaccuggccccc

SEQ ID NO: 294905 - RNA, 22 nt, Human
ugcucauuggcgaucugaggga

SEQ ID NO: 294906 - RNA, 22 nt, Human
ugcugaggucauuuccaaguga

SEQ ID NO: 294907 - RNA, 22 nt, Human
gccccagccaaggugacacgaa

SEQ ID NO: 294908 - RNA, 21 nt, Human
acagagcauaaugguguggca

SEQ ID NO: 294909 - RNA, 22 nt, Human
caaaagucuuccuauucucuua

SEQ ID NO: 294910 - RNA, 19 nt, Human
ucccaguggggagaggugu

SEQ ID NO: 294911 - RNA, 22 nt, Human
aggagggagcacuauaugggga

SEQ ID NO: 294912 - RNA, 22 nt, Human
uuugacucuucuagcaagugug

SEQ ID NO: 294913 - RNA, 22 nt, Human
ggcaggugcucugugggccugg

SEQ ID NO: 294914 - RNA, 22 nt, Human
uagggcucagagaaguggggcc

SEQ ID NO: 294915 - RNA, 18 nt, Human
caguggcauaguugagua

SEQ ID NO: 294916 - RNA, 22 nt, Human
ccaggugggcgugucuucaccu

SEQ ID NO: 294917 - RNA, 17 nt, Human
uguuuucugcuaccuuu

SEQ ID NO: 294918 - RNA, 22 nt, Human
uucugagggcuaauguacugua

SEQ ID NO: 294919 - RNA, 22 nt, Human
cauuaggguaauugaacacuua

SEQ ID NO: 294920 - RNA, 22 nt, Human
caaggccuugcugucuccuccu

SEQ ID NO: 294921 - RNA, 22 nt, Human
agagucagcuuaugacacaguc

SEQ ID NO: 294922 - RNA, 22 nt, Human
aaguaacaugggaacaucugaa

SEQ ID NO: 294923 - RNA, 22 nt, Human
uccuucuggaggcuguaaagga

SEQ ID NO: 294924 - RNA, 22 nt, Human
ucaggcaggaucccagggaagg

SEQ ID NO: 294925 - RNA, 22 nt, Human
cuuuuacauuuguugaagagua

SEQ ID NO: 294926 - RNA, 22 nt, Human
ccuccuggcuuuucccauugaa

SEQ ID NO: 294927 - RNA, 22 nt, Human
uauuuucaccuucucuggauau

SEQ ID NO: 294928 - RNA, 22 nt, Human
ggcucuggugcccuggcuccca

SEQ ID NO: 294929 - RNA, 22 nt, Human
cccaggacucuucacugcagcc

SEQ ID NO: 294930 - RNA, 22 nt, Human
gguggggcccaggcaucugaug

SEQ ID NO: 294931 - RNA, 22 nt, Human
acugucaagagauucaaauuca

SEQ ID NO: 294932 - RNA, 22 nt, Human
ccuggaggggaccaggaccagg

SEQ ID NO: 294933 - RNA, 22 nt, Human
uuauugcucuauuauggccuaa

SEQ ID NO: 294934 - RNA, 22 nt, Human
aauugcuuuugggggcaguuac

SEQ ID NO: 294935 - RNA, 22 nt, Human
uuccugugauauuagccacugu

SEQ ID NO: 294936 - RNA, 22 nt, Human
uuuccuucucagggagcuucaa

SEQ ID NO: 294937 - RNA, 22 nt, Human
guggauggagcuggaagccauu

SEQ ID NO: 294938 - RNA, 22 nt, Human
gacaggguccaaaggcagggga

SEQ ID NO: 294939 - RNA, 22 nt, Human
ugcaggugcugauaccuacucc

SEQ ID NO: 294940 - RNA, 22 nt, Human
agcauccacucacugggagagg

SEQ ID NO: 294941 - RNA, 22 nt, Human
uuccuucuuugugguagaaagu

SEQ ID NO: 294942 - RNA, 22 nt, Human
caauuucucgaacucuaaucca

SEQ ID NO: 294943 - RNA, 22 nt, Human
agucccagcuucccccaugcag

SEQ ID NO: 294944 - RNA, 22 nt, Human
caggucuguuuucaaggucagu

SEQ ID NO: 294945 - RNA, 22 nt, Human
gcaaagcaagcugucagccuca

SEQ ID NO: 294946 - RNA, 22 nt, Human
ucugugaaugugaccuuauuug

SEQ ID NO: 294947 - RNA, 18 nt, Human
gcuccuggagucugacuc

SEQ ID NO: 294948 - RNA, 22 nt, Human
aauuuacacuucauuuggaggg

SEQ ID NO: 294949 - RNA, 22 nt, Human
ucaggugggaguagaaugcuag

SEQ ID NO: 294950 - RNA, 22 nt, Human
uagcaaaguuuuguggugauua

SEQ ID NO: 294951 - RNA, 22 nt, Human
ggagaaggaauauuggaguagg

SEQ ID NO: 294952 - RNA, 22 nt, Human
gagggcugcuggaaaaaugcag

SEQ ID NO: 294953 - RNA, 22 nt, Human
agcugcaaguccaaaggaauua

SEQ ID NO: 294954 - RNA, 22 nt, Human
ugcaaaaauugcuggaaucuuu

SEQ ID NO: 294955 - RNA, 22 nt, Human
uagggauggaaacccguuuucu

SEQ ID NO: 294956 - RNA, 22 nt, Human
cacagguggcuccaaguuagag

SEQ ID NO: 294957 - RNA, 22 nt, Human
ugcaaaagaauauagauauugu

SEQ ID NO: 294958 - RNA, 22 nt, Human
aguuaaaucauggccauuggaa

SEQ ID NO: 294959 - RNA, 22 nt, Human
uuuaaguuccuuuucaacaacu

SEQ ID NO: 294960 - RNA, 22 nt, Human
ucccagagcagaugugcuaaag

SEQ ID NO: 294961 - RNA, 22 nt, Human
gaaauguuugggaggagucaac

SEQ ID NO: 294962 - RNA, 22 nt, Human
cuagagaaaacuguguaucuug

SEQ ID NO: 294963 - RNA, 22 nt, Human
ucaauaauggcaggauaaauuu

SEQ ID NO: 294964 - RNA, 22 nt, Human
cuuuacugaagugaagaccugg

SEQ ID NO: 294965 - RNA, 22 nt, Human
ucaggcaggcucagaggaaaac

SEQ ID NO: 294966 - RNA, 20 nt, Human
uuucaguuaucuugaccuuc

SEQ ID NO: 294967 - RNA, 22 nt, Human
cuguccugugcauugucagaug

SEQ ID NO: 294968 - RNA, 22 nt, Human
agaggccuaaccaagauguccu

SEQ ID NO: 294969 - RNA, 22 nt, Human
cucuggaauggguguuucuaac

SEQ ID NO: 294970 - RNA, 22 nt, Human
ccacccagaccagggaucuggg

SEQ ID NO: 294971 - RNA, 22 nt, Human
agaacaucuaaauaucugagac

SEQ ID NO: 294972 - RNA, 22 nt, Human
uacagugcuugguaucuaguaa

SEQ ID NO: 294973 - RNA, 22 nt, Human
uugaggaguugugacagauacu

SEQ ID NO: 294974 - RNA, 22 nt, Human
uuuaacauguaauugcugcuuu

SEQ ID NO: 294975 - RNA, 22 nt, Human
ccuggaggcagaaauaggacuu

SEQ ID NO: 294976 - RNA, 19 nt, Human
ccacaaaauuauuuuaguu

SEQ ID NO: 294977 - RNA, 22 nt, Human
ucuuauuuuuuaaugacagaga

SEQ ID NO: 294978 - RNA, 22 nt, Human
uguuuuucaaauauugcucugu

SEQ ID NO: 294979 - RNA, 23 nt, Human
uccuucaaguuaggaagugaaca

SEQ ID NO: 294980 - RNA, 22 nt, Human
auugcuuuuaagcaccaccuaa

SEQ ID NO: 294981 - RNA, 22 nt, Human
ugaggugguucaagagccuugu

SEQ ID NO: 294982 - RNA, 22 nt, Human
ucauuugugugagugauuugac

SEQ ID NO: 294983 - RNA, 22 nt, Human
uuucuucauagaccuugucuug

SEQ ID NO: 294984 - RNA, 22 nt, Human
cacagagaauucccauauguga

SEQ ID NO: 294985 - RNA, 22 nt, Human
cagggcucuuccggagcaggga

SEQ ID NO: 294986 - RNA, 22 nt, Human
agucuuacaugagaaagaaccu

SEQ ID NO: 294987 - RNA, 22 nt, Human
aaaauccuuagccgagugaggu

SEQ ID NO: 294988 - RNA, 23 nt, Human
uuucaaauuacucugcagaugac

SEQ ID NO: 294989 - RNA, 21 nt, Human
agaaaaguauuugaaucaaga

SEQ ID NO: 294990 - RNA, 21 nt, Human
uuuagggaccaggucauaggc

SEQ ID NO: 294991 - RNA, 22 nt, Human
aggcucugggcucuagauuuug

SEQ ID NO: 294992 - RNA, 23 nt, Human
ugaaauauucuuuugcaugagcu

SEQ ID NO: 294993 - RNA, 22 nt, Human
gaaaaugugucaucccuacugu

SEQ ID NO: 294994 - RNA, 22 nt, Human
uguggggcugucaggcaacugg

SEQ ID NO: 294995 - RNA, 22 nt, Human
aaaaauguuaucuacuguccga

SEQ ID NO: 294996 - RNA, 22 nt, Human
gacaggcuuugagucccagaac

SEQ ID NO: 294997 - RNA, 22 nt, Human
uagaaagcccuguguucacugc

SEQ ID NO: 294998 - RNA, 22 nt, Human
uauuuaaaauaagccccagugg

SEQ ID NO: 294999 - RNA, 22 nt, Human
gggcccuggacguggcggcaga

SEQ ID NO: 295000 - RNA, 22 nt, Human
aucaaaguucguaacugauaac

SEQ ID NO: 295001 - RNA, 22 nt, Human
cagugcagguuuagggcugggg

SEQ ID NO: 295002 - RNA, 22 nt, Human
augcaauauagggaagauagau

SEQ ID NO: 295003 - RNA, 21 nt, Human
uggaccuguccuucucgcugu

SEQ ID NO: 295004 - RNA, 22 nt, Human
aaauuauaggugccaccuugga

SEQ ID NO: 295005 - RNA, 22 nt, Human
uuauuagggugguuuauguucu

SEQ ID NO: 295006 - RNA, 22 nt, Human
aacaagucuaagagaauggcag

SEQ ID NO: 295007 - RNA, 22 nt, Human
ugcaaaauaaugaacgauuuuu

SEQ ID NO: 295008 - RNA, 22 nt, Human
guuuacauauuuuaauugguga

SEQ ID NO: 295009 - RNA, 22 nt, Human
aagugguugcuugugagucccc

SEQ ID NO: 295010 - RNA, 22 nt, Human
ucugcaacauuccucuccccac

SEQ ID NO: 295011 - RNA, 22 nt, Human
caggaaaggugugucaugaugg

SEQ ID NO: 295012 - RNA, 22 nt, Human
aaacagcuggucucaaauguuc

SEQ ID NO: 295013 - RNA, 22 nt, Human
acagugcagggugggaagaagg

SEQ ID NO: 295014 - RNA, 22 nt, Human
uuucuuuccagagugauuggca

SEQ ID NO: 295015 - RNA, 22 nt, Human
ugacauguaguuagaaaauagg

SEQ ID NO: 295016 - RNA, 22 nt, Human
aaauuuaaggaggugcucacuu

SEQ ID NO: 295017 - RNA, 22 nt, Human
uuauccuggauuauauauguga

SEQ ID NO: 295018 - RNA, 22 nt, Human
uuauuagcugggcuucagggug

SEQ ID NO: 295019 - RNA, 22 nt, Human
aaacaacuucugcacuaugggu

SEQ ID NO: 295020 - RNA, 19 nt, Human
ccugugacuaucuuuguaa

SEQ ID NO: 295021 - RNA, 22 nt, Human
uguauuuuuagaccuuuagacc

SEQ ID NO: 295022 - RNA, 22 nt, Human
gcaucuaaacuugcaucauugu

SEQ ID NO: 295023 - RNA, 22 nt, Human
gccagggaaacugcagaccagc

SEQ ID NO: 295024 - RNA, 22 nt, Human
auacacaucuauuuaagagaca

SEQ ID NO: 295025 - RNA, 22 nt, Human
auauaaagaaguggaaaaugag

SEQ ID NO: 295026 - RNA, 22 nt, Human
cagccagguuagugcuaauugu

SEQ ID NO: 295027 - RNA, 20 nt, Human
ucucaguuucuagagucagg

SEQ ID NO: 295028 - RNA, 22 nt, Human
augaagcaggcacagcuucagg

SEQ ID NO: 295029 - RNA, 22 nt, Human
aucagagauggcuccagugcuc

SEQ ID NO: 295030 - RNA, 22 nt, Human
cuggguuuagggucuccccuug

SEQ ID NO: 295031 - RNA, 22 nt, Human
uguccuggggcgacuuggggcc

SEQ ID NO: 295032 - RNA, 22 nt, Human
uccaaaacagaacucugugaau

SEQ ID NO: 295033 - RNA, 22 nt, Human
uagguguccucguccaaagauu

SEQ ID NO: 295034 - RNA, 22 nt, Human
accaggcaugauguggagcaca

SEQ ID NO: 295035 - RNA, 22 nt, Human
uguccccagagccuguuccugc

SEQ ID NO: 295036 - RNA, 22 nt, Human
uuucaaguggcgagauaaggaa

SEQ ID NO: 295037 - RNA, 22 nt, Human
cugaggagggaaguccccaaag

SEQ ID NO: 295038 - RNA, 22 nt, Human
aaauucuaugucaauguuuauu

SEQ ID NO: 295039 - RNA, 22 nt, Human
uccuuggcuaguacuggccagc

SEQ ID NO: 295040 - RNA, 22 nt, Human
ucugagcugcuagguaugcauu

SEQ ID NO: 295041 - RNA, 22 nt, Human
caaagaagagauuuacagagcu

SEQ ID NO: 295042 - RNA, 22 nt, Human
aaggugucaggcuugggaaagu

SEQ ID NO: 295043 - RNA, 22 nt, Human
aggaggaauacaauccagcagc

SEQ ID NO: 295044 - RNA, 21 nt, Human
gcauuaaaagcaguuguuggu

SEQ ID NO: 295045 - RNA, 22 nt, Human
aacugucugaaacugggguuuc

SEQ ID NO: 295046 - RNA, 22 nt, Human
acaugacagggaaugaggugaa

SEQ ID NO: 295047 - RNA, 22 nt, Human
ugggccaggcaugugaucagca

SEQ ID NO: 295048 - RNA, 20 nt, Human
uuuacauuuugaaacaguga

SEQ ID NO: 295049 - RNA, 22 nt, Human
gagaguucuugccuggguauua

SEQ ID NO: 295050 - RNA, 22 nt, Human
cccagugugaugagguugcuaa

SEQ ID NO: 295051 - RNA, 22 nt, Human
accuacauguuccacauaguug

SEQ ID NO: 295052 - RNA, 22 nt, Human
aaagaucacgucccaggacucg

SEQ ID NO: 295053 - RNA, 22 nt, Human
ccugggagccaagccucugugu

SEQ ID NO: 295054 - RNA, 22 nt, Human
accacuguacagcagauauagu

SEQ ID NO: 295055 - RNA, 16 nt, Human
cagaggcaccuggcuc

SEQ ID NO: 295056 - RNA, 22 nt, Human
acauucuuucgaugucugauuu

SEQ ID NO: 295057 - RNA, 22 nt, Human
ugcagggacaggcucuggggau

SEQ ID NO: 295058 - RNA, 22 nt, Human
uacccagcuccucagaagacca

SEQ ID NO: 295059 - RNA, 22 nt, Human
aauuugauucccugcaccuguu

SEQ ID NO: 295060 - RNA, 22 nt, Human
caaacugagcaucagaaaguuu

SEQ ID NO: 295061 - RNA, 22 nt, Human
ucagacagugugaucagucucu

SEQ ID NO: 295062 - RNA, 22 nt, Human
agagcacaggguuuugugccgg

SEQ ID NO: 295063 - RNA, 22 nt, Human
aguuugaauugaaaugcagaug

SEQ ID NO: 295064 - RNA, 22 nt, Human
cuccaggccccuggccuucugc

SEQ ID NO: 295065 - RNA, 22 nt, Human
cuggcaggagcauucacagagg

SEQ ID NO: 295066 - RNA, 22 nt, Human
cuagagaaacgccgugggagga

SEQ ID NO: 295067 - RNA, 22 nt, Human
gaacuugggagaagggagugug

SEQ ID NO: 295068 - RNA, 22 nt, Human
caugaggucagggggagccggu

SEQ ID NO: 295069 - RNA, 22 nt, Human
acaguugagaugcaacuuuggg

SEQ ID NO: 295070 - RNA, 22 nt, Human
ucaacaaauacuuaaagcagag

SEQ ID NO: 295071 - RNA, 18 nt, Human
gccugcaggcacgggggu

SEQ ID NO: 295072 - RNA, 22 nt, Human
auuuccuucccagauuugguuc

SEQ ID NO: 295073 - RNA, 22 nt, Human
ucucuguagggcugcuugagua

SEQ ID NO: 295074 - RNA, 22 nt, Human
ccugggugucaugggcagcugg

SEQ ID NO: 295075 - RNA, 22 nt, Human
aguacaaaggcccuugauuacu

SEQ ID NO: 295076 - RNA, 19 nt, Human
ugcuuccucaccaucuccc

SEQ ID NO: 295077 - RNA, 22 nt, Human
aaauaucauuuauaacuuuuaa

SEQ ID NO: 295078 - RNA, 22 nt, Human
uaaaguuuauuggcaccaccau

SEQ ID NO: 295079 - RNA, 22 nt, Human
uacugucuuuagggguagaaau

SEQ ID NO: 295080 - RNA, 22 nt, Human
ggagcugagcagcgauggcgga

SEQ ID NO: 295081 - RNA, 22 nt, Human
cuuguugcugaauucaggauuc

SEQ ID NO: 295082 - RNA, 22 nt, Human
aagccggcugggccgaggcugc

SEQ ID NO: 295083 - RNA, 22 nt, Human
cugcagcuaaggaaugugguug

SEQ ID NO: 295084 - RNA, 22 nt, Human
guccugaaugccuuuaggcaga

SEQ ID NO: 295085 - RNA, 22 nt, Human
aaagccuugggauuugugauca

SEQ ID NO: 295086 - RNA, 22 nt, Human
agcuuuaucagaggagucucua

SEQ ID NO: 295087 - RNA, 20 nt, Human
caaggcagaccagagugagu

SEQ ID NO: 295088 - RNA, 22 nt, Human
aguuaggacacuugagggcuaa

SEQ ID NO: 295089 - RNA, 22 nt, Human
uuuauuuggcauccagggagaa

SEQ ID NO: 295090 - RNA, 22 nt, Human
gaauguuugacuaaagguagcu

SEQ ID NO: 295091 - RNA, 22 nt, Human
gcaguaagauguaagugcuaua

SEQ ID NO: 295092 - RNA, 22 nt, Human
agacagguguuuuacaacuucg

SEQ ID NO: 295093 - RNA, 22 nt, Human
uucuucaauuuuccauauacug

SEQ ID NO: 295094 - RNA, 22 nt, Human
aaauugcugacacuugaccauu

SEQ ID NO: 295095 - RNA, 22 nt, Human
aggaagagcuggaccagaggac

SEQ ID NO: 295096 - RNA, 17 nt, Human
ugucuucugaagagagc

SEQ ID NO: 295097 - RNA, 22 nt, Human
uacaacagacaggaauaagauu

SEQ ID NO: 295098 - RNA, 22 nt, Human
cuggaggaaucacagaaggcuu

SEQ ID NO: 295099 - RNA, 22 nt, Human
cuuuaguuugugauacgaagau

SEQ ID NO: 295100 - RNA, 21 nt, Human
ucuagaauccuguauaagacu

SEQ ID NO: 295101 - RNA, 21 nt, Human
cuguccucagauguggacgag

SEQ ID NO: 295102 - RNA, 22 nt, Human
gagccuucaucgcagccuuguu

SEQ ID NO: 295103 - RNA, 22 nt, Human
uuuccuccuagccuccagccgc

SEQ ID NO: 295104 - RNA, 21 nt, Human
gcauguguggugugcuccaca

SEQ ID NO: 295105 - RNA, 22 nt, Human
aagggcagcuuaaauugguagc

SEQ ID NO: 295106 - RNA, 22 nt, Human
caagauuuggcaacuuugucau

SEQ ID NO: 295107 - RNA, 22 nt, Human
ucuguucaguugauuagacaga

SEQ ID NO: 295108 - RNA, 22 nt, Human
ugcuuaaacccugaucaugugu

SEQ ID NO: 295109 - RNA, 22 nt, Human
cuggcagcucuacucagagccu

SEQ ID NO: 295110 - RNA, 16 nt, Human
agcagggcgggaagga

SEQ ID NO: 295111 - RNA, 21 nt, Human
uagggcucuauuuuuauuuca

SEQ ID NO: 295112 - RNA, 22 nt, Human
ucuccacacuuucucucccagg

SEQ ID NO: 295113 - RNA, 19 nt, Human
gcgaggaagucacuguggc

SEQ ID NO: 295114 - RNA, 21 nt, Human
uuguaaagguuuagaagaaug

SEQ ID NO: 295115 - RNA, 22 nt, Human
ugcaugaacggaggguaagcug

SEQ ID NO: 295116 - RNA, 20 nt, Human
cuucuucagccuaugcuuca

SEQ ID NO: 295117 - RNA, 22 nt, Human
cacagguuugacaaggauaaaa

SEQ ID NO: 295118 - RNA, 22 nt, Human
cagugcaggaagugagaugccu

SEQ ID NO: 295119 - RNA, 23 nt, Human
ugccagcagggaaugggaaggac

SEQ ID NO: 295120 - RNA, 22 nt, Human
uugaggaguagaagcuuugaau

SEQ ID NO: 295121 - RNA, 22 nt, Human
uggcuucauucagcaugacagu

SEQ ID NO: 295122 - RNA, 22 nt, Human
uaaaauagcaugugcagugaaa

SEQ ID NO: 295123 - RNA, 22 nt, Human
cagcacuuugagggcucuuaau

SEQ ID NO: 295124 - RNA, 22 nt, Human
augauuucuauauaaacuuaaa

SEQ ID NO: 295125 - RNA, 22 nt, Human
agcacacaucacuucugcucau

SEQ ID NO: 295126 - RNA, 22 nt, Human
cagcuauuaauguuuuugcuga

SEQ ID NO: 295127 - RNA, 22 nt, Human
ggcagguggaaguuggcagagc

SEQ ID NO: 295128 - RNA, 22 nt, Human
uuauuucauugauuucuaagac

SEQ ID NO: 295129 - RNA, 22 nt, Human
agguggagaagagaugggcagu

SEQ ID NO: 295130 - RNA, 22 nt, Human
ugcauguguuugccacagugag

SEQ ID NO: 295131 - RNA, 22 nt, Human
gcagguggucacucauccccag

SEQ ID NO: 295132 - RNA, 22 nt, Human
aagccagaucaaaguguccagg

SEQ ID NO: 295133 - RNA, 22 nt, Human
gccauugaugugaaaguaagac

SEQ ID NO: 295134 - RNA, 19 nt, Human
ggcauccacgaaugcagag

SEQ ID NO: 295135 - RNA, 22 nt, Human
uuuccucugucaugacagcuga

SEQ ID NO: 295136 - RNA, 22 nt, Human
gaaaacuauuggccuagaacaa

SEQ ID NO: 295137 - RNA, 22 nt, Human
ucuucaaaaaauauccaucagu

SEQ ID NO: 295138 - RNA, 22 nt, Human
caguuuuaggacauguggaugu

SEQ ID NO: 295139 - RNA, 21 nt, Human
ggggaugcgaccacaggcucc

SEQ ID NO: 295140 - RNA, 21 nt, Human
uuccagagauuguuucaccug

SEQ ID NO: 295141 - RNA, 22 nt, Human
ugcaugcaugugagcaugcaua

SEQ ID NO: 295142 - RNA, 22 nt, Human
ucuguagucucugauauaucug

SEQ ID NO: 295143 - RNA, 22 nt, Human
cugguaaagaagacaaacaggg

SEQ ID NO: 295144 - RNA, 22 nt, Human
uuucuguagugugguauguagg

SEQ ID NO: 295145 - RNA, 22 nt, Human
ggccuugagagccagugcaggc

SEQ ID NO: 295146 - RNA, 22 nt, Human
gggccagguaucgucuuuagua

SEQ ID NO: 295147 - RNA, 22 nt, Human
agggcuccuaugccccauggac

SEQ ID NO: 295148 - RNA, 22 nt, Human
aauggcuuuuaaaaauagcauu

SEQ ID NO: 295149 - RNA, 22 nt, Human
caaggaggcagugggacuugaa

SEQ ID NO: 295150 - RNA, 22 nt, Human
cuaaaucaucauuuauguuugu

SEQ ID NO: 295151 - RNA, 22 nt, Human
cuuccuggaugagcaggcugau

SEQ ID NO: 295152 - RNA, 22 nt, Human
ugaaagcuguacaugugguaca

SEQ ID NO: 295153 - RNA, 19 nt, Human
cuuauuagagugagagcuu

SEQ ID NO: 295154 - RNA, 22 nt, Human
gagaagaaauagaaucacauuu

SEQ ID NO: 295155 - RNA, 22 nt, Human
uucaacuagaggugauuuugcc

SEQ ID NO: 295156 - RNA, 22 nt, Human
gccuggcaggggccugggagug

SEQ ID NO: 295157 - RNA, 22 nt, Human
auuucuuccucugucaguaacu

SEQ ID NO: 295158 - RNA, 22 nt, Human
ugguuugacaaugaggacuggu

SEQ ID NO: 295159 - RNA, 22 nt, Human
ucccucucuugggcguggcuca

SEQ ID NO: 295160 - RNA, 22 nt, Human
guguccuuaugcauaccagagu

SEQ ID NO: 295161 - RNA, 22 nt, Human
agcuccugauucucagagauag

SEQ ID NO: 295162 - RNA, 22 nt, Human
guauuaggagguggagccuuug

SEQ ID NO: 295163 - RNA, 21 nt, Human
aaagugguaaggauuauuuug

SEQ ID NO: 295164 - RNA, 22 nt, Human
cacccagcauuggcuaagagag

SEQ ID NO: 295165 - RNA, 22 nt, Human
uuggcuaugcuuguguucaguu

SEQ ID NO: 295166 - RNA, 22 nt, Human
augggcuugacccuacagaaag

SEQ ID NO: 295167 - RNA, 22 nt, Human
gccagguugcugacgacgaucu

SEQ ID NO: 295168 - RNA, 22 nt, Human
ugcauaaacuucucugguguga

SEQ ID NO: 295169 - RNA, 22 nt, Human
uauguacaucguugaauucaaa

SEQ ID NO: 295170 - RNA, 17 nt, Human
uucugggucccagggcc

SEQ ID NO: 295171 - RNA, 22 nt, Human
cuuacaaaggagaggagauagg

SEQ ID NO: 295172 - RNA, 22 nt, Human
gcacccaggcuugggcagcaac

SEQ ID NO: 295173 - RNA, 22 nt, Human
cuggauccaacagaguuggguu

SEQ ID NO: 295174 - RNA, 22 nt, Human
cccagcucugcagaccugcccu

SEQ ID NO: 295175 - RNA, 22 nt, Human
ugucaagucucugaaugaaaug

SEQ ID NO: 295176 - RNA, 22 nt, Human
ucugggauuuuauagacaugcu

SEQ ID NO: 295177 - RNA, 22 nt, Human
caugaguucaucugcuucucuu

SEQ ID NO: 295178 - RNA, 22 nt, Human
uuaaauagcucuuguagaagaa

SEQ ID NO: 295179 - RNA, 22 nt, Human
agcugugggagaaucucugggu

SEQ ID NO: 295180 - RNA, 22 nt, Human
ugcagggccgcuggaggucaug

SEQ ID NO: 295181 - RNA, 23 nt, Human
uugaggagugcuuuuucuaucca

SEQ ID NO: 295182 - RNA, 22 nt, Human
caguuuauagcucuagcagcuu

SEQ ID NO: 295183 - RNA, 22 nt, Human
ugcuuuauuuauaaaauagcaa

SEQ ID NO: 295184 - RNA, 22 nt, Human
aauucuuguuguuaguauauuu

SEQ ID NO: 295185 - RNA, 22 nt, Human
gguccucaaucccaacaaggca

SEQ ID NO: 295186 - RNA, 20 nt, Human
uugcugggaccuuuuucaac

SEQ ID NO: 295187 - RNA, 22 nt, Human
uccuccagcuguauccugccug

SEQ ID NO: 295188 - RNA, 22 nt, Human
aggcaguguguagcuggaagag

SEQ ID NO: 295189 - RNA, 22 nt, Human
cucccuggucuuucccaucauu

SEQ ID NO: 295190 - RNA, 22 nt, Human
uucugcauucaaauuaugugag

SEQ ID NO: 295191 - RNA, 22 nt, Human
cacaugugcaguuacaugaauu

SEQ ID NO: 295192 - RNA, 22 nt, Human
aggcaggugggucacuugaguc

SEQ ID NO: 295193 - RNA, 22 nt, Human
agaccugcagggccaggccugc

SEQ ID NO: 295194 - RNA, 22 nt, Human
caaauagaacucacagacaaga

SEQ ID NO: 295195 - RNA, 22 nt, Human
accaaggaagaaucuauuugag

SEQ ID NO: 295196 - RNA, 19 nt, Human
aggaaagguggccuuagca

SEQ ID NO: 295197 - RNA, 22 nt, Human
agcuuuauauuuaaugaauucu

SEQ ID NO: 295198 - RNA, 22 nt, Human
caugccaguuuugagaugcacc

SEQ ID NO: 295199 - RNA, 21 nt, Human
cacaggugggucagugaggcc

SEQ ID NO: 295200 - RNA, 22 nt, Human
aauuuccaaauuucugucacac

SEQ ID NO: 295201 - RNA, 22 nt, Human
aguaaggcauuuuucauguuua

SEQ ID NO: 295202 - RNA, 22 nt, Human
uuucacauaugguuguugauug

SEQ ID NO: 295203 - RNA, 22 nt, Human
gggacaugaggccauagugauu

SEQ ID NO: 295204 - RNA, 22 nt, Human
uaaauacuuaguuuugugucua

SEQ ID NO: 295205 - RNA, 22 nt, Human
gcagggcaguaagagcuagagu

SEQ ID NO: 295206 - RNA, 22 nt, Human
gaggagcucaugaaagcggugu

SEQ ID NO: 295207 - RNA, 22 nt, Human
uuucacagcuuccacuuaagga

SEQ ID NO: 295208 - RNA, 22 nt, Human
aauugcuuaucuuguugaauag

SEQ ID NO: 295209 - RNA, 22 nt, Human
acaguguguuggaggagacugu

SEQ ID NO: 295210 - RNA, 22 nt, Human
aaugagaucagagauaacucaa

SEQ ID NO: 295211 - RNA, 22 nt, Human
ggcaagugcuuccccaaccaca

SEQ ID NO: 295212 - RNA, 22 nt, Human
acuccugguuuguguccuggcu

SEQ ID NO: 295213 - RNA, 22 nt, Human
gaugauuuugaugcaguaaaga

SEQ ID NO: 295214 - RNA, 22 nt, Human
ucuagaaaaaaacugcugugga

SEQ ID NO: 295215 - RNA, 22 nt, Human
gagcugaauuacggugagucau

SEQ ID NO: 295216 - RNA, 22 nt, Human
guuuucuggcaguuauuccuua

SEQ ID NO: 295217 - RNA, 22 nt, Human
ugggcuccuugggagcaaguga

SEQ ID NO: 295218 - RNA, 22 nt, Human
augcaucaggcacuaggaauag

SEQ ID NO: 295219 - RNA, 22 nt, Human
cucaguuugugugauauugucu

SEQ ID NO: 295220 - RNA, 22 nt, Human
cauagaauguaauaaagaguag

SEQ ID NO: 295221 - RNA, 22 nt, Human
uuugaaguaccugguucugacu

SEQ ID NO: 295222 - RNA, 22 nt, Human
caagcugaacacugucuucaag

SEQ ID NO: 295223 - RNA, 22 nt, Human
ucuccacagaagguuccaggcc

SEQ ID NO: 295224 - RNA, 22 nt, Human
auguauuaugguuuuccuuaag

SEQ ID NO: 295225 - RNA, 22 nt, Human
ggcaggugccaguuggcuuggg

SEQ ID NO: 295226 - RNA, 22 nt, Human
uguccauggauagagcugcucg

SEQ ID NO: 295227 - RNA, 22 nt, Human
uuggagauaucacaccuucaca

SEQ ID NO: 295228 - RNA, 22 nt, Human
uccagaggcaaaaagguaugga

SEQ ID NO: 295229 - RNA, 22 nt, Human
acaagaaagguaggauucaggu

SEQ ID NO: 295230 - RNA, 22 nt, Human
gcugcccagacauugaaucagg

SEQ ID NO: 295231 - RNA, 22 nt, Human
acaguuuacagggauuugagcu

SEQ ID NO: 295232 - RNA, 22 nt, Human
acacuuuaagcauuucacacug

SEQ ID NO: 295233 - RNA, 22 nt, Human
ucagggcuggcuuuugcagagc

SEQ ID NO: 295234 - RNA, 22 nt, Human
cucugugauucucauguaccac

SEQ ID NO: 295235 - RNA, 22 nt, Human
uagggcuccacucccagagauu

SEQ ID NO: 295236 - RNA, 22 nt, Human
uuuacagugagagcuuagugag

SEQ ID NO: 295237 - RNA, 19 nt, Human
ucccucagucugccaggcc

SEQ ID NO: 295238 - RNA, 22 nt, Human
guucacaagaguuacagacaga

SEQ ID NO: 295239 - RNA, 22 nt, Human
uuccaggaagcaguuagcagcc

SEQ ID NO: 295240 - RNA, 22 nt, Human
augaggcauauccuccuauggu

SEQ ID NO: 295241 - RNA, 22 nt, Human
gcccaggccggagagcagugcu

SEQ ID NO: 295242 - RNA, 22 nt, Human
cauuuguaguuaaaaaugucuc

SEQ ID NO: 295243 - RNA, 22 nt, Human
uuauugaaauggaagcuauaac

SEQ ID NO: 295244 - RNA, 22 nt, Human
cuuuaauucucaggugcacaua

SEQ ID NO: 295245 - RNA, 22 nt, Human
ucaagucuggagaucuggaacu

SEQ ID NO: 295246 - RNA, 22 nt, Human
ugcugccaagcccgugcuccug

SEQ ID NO: 295247 - RNA, 22 nt, Human
cuagugaaauuugcaaguaauu

SEQ ID NO: 295248 - RNA, 22 nt, Human
agcucuguuacugauuuuccug

SEQ ID NO: 295249 - RNA, 22 nt, Human
gaggggaugcagagaggcuuau

SEQ ID NO: 295250 - RNA, 22 nt, Human
aaugaucuacucucauuaucuc

SEQ ID NO: 295251 - RNA, 23 nt, Human
uuuggacuugugacucuucuccu

SEQ ID NO: 295252 - RNA, 21 nt, Human
ucagggcagcugcucuucaga

SEQ ID NO: 295253 - RNA, 23 nt, Human
guuuuacaggugagaaaauggag

SEQ ID NO: 295254 - RNA, 22 nt, Human
acaguguguucugggaccucca

SEQ ID NO: 295255 - RNA, 23 nt, Human
acaagauagggauaaaaagauaa

SEQ ID NO: 295256 - RNA, 22 nt, Human
aagugguuugauucaguuuaug

SEQ ID NO: 295257 - RNA, 22 nt, Human
ccuccugggacucauuagcacc

SEQ ID NO: 295258 - RNA, 22 nt, Human
agcuguuuucuaaugcauuuga

SEQ ID NO: 295259 - RNA, 22 nt, Human
cuggcuuucauuucaagcacgu

SEQ ID NO: 295260 - RNA, 19 nt, Human
ccaggccuccugggagguc

SEQ ID NO: 295261 - RNA, 22 nt, Human
aaauuaguacauugcaaagucc

SEQ ID NO: 295262 - RNA, 22 nt, Human
uuuucucaggugcuuaucuaag

SEQ ID NO: 295263 - RNA, 22 nt, Human
ucuagggaacaugggucaagcu

SEQ ID NO: 295264 - RNA, 18 nt, Human
uuuuacucauagcaggcc

SEQ ID NO: 295265 - RNA, 22 nt, Human
uccucuguggaccgggcuuugg

SEQ ID NO: 295266 - RNA, 23 nt, Human
acucaaaauuuggcauuugagga

SEQ ID NO: 295267 - RNA, 22 nt, Human
ucaguuaauauggguaaagcau

SEQ ID NO: 295268 - RNA, 22 nt, Human
ggugccagugggucucaggaua

SEQ ID NO: 295269 - RNA, 23 nt, Human
caugaagguagcacaaagccucu

SEQ ID NO: 295270 - RNA, 22 nt, Human
guggcuugagcaggggcagagg

SEQ ID NO: 295271 - RNA, 22 nt, Human
uguacaaagaguauagcuuuga

SEQ ID NO: 295272 - RNA, 22 nt, Human
caggguuucaccauguuagcag

SEQ ID NO: 295273 - RNA, 22 nt, Human
auuacagaagauaugcucaaca

SEQ ID NO: 295274 - RNA, 22 nt, Human
uagguucauauucuagaaucau

SEQ ID NO: 295275 - RNA, 22 nt, Human
uuccuugguagagagaauauuu

SEQ ID NO: 295276 - RNA, 22 nt, Human
acugucuucauaucugugucuc

SEQ ID NO: 295277 - RNA, 22 nt, Human
ugcuggcaucuuaauguucugu

SEQ ID NO: 295278 - RNA, 22 nt, Human
uguaucaaaccaaauuaauucu

SEQ ID NO: 295279 - RNA, 19 nt, Human
ggccagccaccucgccugg

SEQ ID NO: 295280 - RNA, 22 nt, Human
ugaccugcagucaagaggggaa

SEQ ID NO: 295281 - RNA, 22 nt, Human
auacacagcuacauugaacaau

SEQ ID NO: 295282 - RNA, 22 nt, Human
ugguccuguguucuuccugccu

SEQ ID NO: 295283 - RNA, 22 nt, Human
ucuuuuagaaaaguugaaugua

SEQ ID NO: 295284 - RNA, 22 nt, Human
uggagcagugguccuggagaug

SEQ ID NO: 295285 - RNA, 22 nt, Human
uguguguguuucugcucauaca

SEQ ID NO: 295286 - RNA, 22 nt, Human
guaugcaucgacucaagucuga

SEQ ID NO: 295287 - RNA, 22 nt, Human
acuggcagcagcagcccuuggg

SEQ ID NO: 295288 - RNA, 22 nt, Human
ccuggcacacgguggcauucaa

SEQ ID NO: 295289 - RNA, 22 nt, Human
cuccugagcucugaggaagcuu

SEQ ID NO: 295290 - RNA, 22 nt, Human
cccagugucugggccugcaggg

SEQ ID NO: 295291 - RNA, 22 nt, Human
uuguuuuggagaugagcuaaaa

SEQ ID NO: 295292 - RNA, 22 nt, Human
cccagugugccccuccugcagc

SEQ ID NO: 295293 - RNA, 22 nt, Human
acuugguuguuuuaacuuggca

SEQ ID NO: 295294 - RNA, 22 nt, Human
cccagggaaugacucuggccuu

SEQ ID NO: 295295 - RNA, 22 nt, Human
agaaaugacaagacugaucagg

SEQ ID NO: 295296 - RNA, 22 nt, Human
caugcauguuuacuacagugac

SEQ ID NO: 295297 - RNA, 22 nt, Human
aguuguaauaacaauaccaaaa

SEQ ID NO: 295298 - RNA, 22 nt, Human
aauguaaagcucaggucaggag

SEQ ID NO: 295299 - RNA, 22 nt, Human
aacaguaaagacagaauuuauc

SEQ ID NO: 295300 - RNA, 22 nt, Human
acacuuuagaaaaaagaauggu

SEQ ID NO: 295301 - RNA, 22 nt, Human
cuguccucaucugccccaaggg

SEQ ID NO: 295302 - RNA, 22 nt, Human
aggggagaggugagcaacuucu

SEQ ID NO: 295303 - RNA, 22 nt, Human
ccaggcuucccugagaggcugc

SEQ ID NO: 295304 - RNA, 23 nt, Human
gugagcagcccacuaggaaugcc

SEQ ID NO: 295305 - RNA, 22 nt, Human
ugagaacauuugcagggagagu

SEQ ID NO: 295306 - RNA, 22 nt, Human
gcacagcucgagcucaggaggg

SEQ ID NO: 295307 - RNA, 22 nt, Human
cagugucuacaguggcuggagg

SEQ ID NO: 295308 - RNA, 17 nt, Human
cugcuggcuggggcuug

SEQ ID NO: 295309 - RNA, 23 nt, Human
ucuguucuuuuagcugaucauuu

SEQ ID NO: 295310 - RNA, 22 nt, Human
caggucuuuguugcagcaugga

SEQ ID NO: 295311 - RNA, 22 nt, Human
aggucaaaaucaggcagggaag

SEQ ID NO: 295312 - RNA, 22 nt, Human
uuccaugaagggcagccucuca

SEQ ID NO: 295313 - RNA, 22 nt, Human
uguucuucuagauugccuuuua

SEQ ID NO: 295314 - RNA, 22 nt, Human
gagggcaaaacagagaagaugu

SEQ ID NO: 295315 - RNA, 22 nt, Human
uuugaacuucuccauucugaug

SEQ ID NO: 295316 - RNA, 22 nt, Human
caaaucuuuaauugaggaauca

SEQ ID NO: 295317 - RNA, 22 nt, Human
auugucauuggcuucuaugucu

SEQ ID NO: 295318 - RNA, 22 nt, Human
aaauuagaccaguucaggucca

SEQ ID NO: 295319 - RNA, 22 nt, Human
auccuacaaagcagggcuaugg

SEQ ID NO: 295320 - RNA, 22 nt, Human
uccaaggagucuuaaguuacau

SEQ ID NO: 295321 - RNA, 22 nt, Human
uaguuaugucugcaugcauauu

SEQ ID NO: 295322 - RNA, 22 nt, Human
uucccucuuucacugugauuuu

SEQ ID NO: 295323 - RNA, 22 nt, Human
ugaaauguuuggguccagaagu

SEQ ID NO: 295324 - RNA, 22 nt, Human
acagguggcuuauuggcugauu

SEQ ID NO: 295325 - RNA, 17 nt, Human
aaaauucuguaaagagg

SEQ ID NO: 295326 - RNA, 22 nt, Human
uucacauugguucuugauagcu

SEQ ID NO: 295327 - RNA, 22 nt, Human
aguuugaaauguuggcaauauu

SEQ ID NO: 295328 - RNA, 19 nt, Human
ucaaaacacaaaugguuga

SEQ ID NO: 295329 - RNA, 22 nt, Human
ucaugccaaaauccaguggcuu

SEQ ID NO: 295330 - RNA, 22 nt, Human
cuucagagugcagaagauuggg

SEQ ID NO: 295331 - RNA, 22 nt, Human
cuuugugucuguuaauaauuau

SEQ ID NO: 295332 - RNA, 22 nt, Human
cucagugugaaugcucaguaaa

SEQ ID NO: 295333 - RNA, 18 nt, Human
uuggaggauguccaugaa

SEQ ID NO: 295334 - RNA, 22 nt, Human
caugaaggaauaauuguuuaga

SEQ ID NO: 295335 - RNA, 22 nt, Human
gcacaguugugacaaccaucgc

SEQ ID NO: 295336 - RNA, 22 nt, Human
ugggagaaacugucucucccac

SEQ ID NO: 295337 - RNA, 22 nt, Human
ugucucagaauggcucauaaua

SEQ ID NO: 295338 - RNA, 22 nt, Human
aggccaggcgagacacccggcu

SEQ ID NO: 295339 - RNA, 22 nt, Human
uuuuucucuaugccaggggccu

SEQ ID NO: 295340 - RNA, 19 nt, Human
agaaauagccuuccuuguc

SEQ ID NO: 295341 - RNA, 22 nt, Human
uccaguguugucagaucaucug

SEQ ID NO: 295342 - RNA, 22 nt, Human
guacaaauuuugacaucuagga

SEQ ID NO: 295343 - RNA, 22 nt, Human
caaugauugcuauuuacauaaa

SEQ ID NO: 295344 - RNA, 22 nt, Human
guugggguaccuugaggcuggg

SEQ ID NO: 295345 - RNA, 18 nt, Human
uucuggguguuauguuua

SEQ ID NO: 295346 - RNA, 22 nt, Human
cuccauggcuuucgcaucugca

SEQ ID NO: 295347 - RNA, 22 nt, Human
ggaaaacugaggcucucagcag

SEQ ID NO: 295348 - RNA, 22 nt, Human
uggcaaagaugaagcauuucgu

SEQ ID NO: 295349 - RNA, 22 nt, Human
gggagaaggaggacugugcugu

SEQ ID NO: 295350 - RNA, 22 nt, Human
uguccuuuuucuuaggaaauau

SEQ ID NO: 295351 - RNA, 22 nt, Human
guccuaaucucuucuuauaagg

SEQ ID NO: 295352 - RNA, 22 nt, Human
cagccgucagaugugccgcagc

SEQ ID NO: 295353 - RNA, 19 nt, Human
ggccugaggccacagaucc

SEQ ID NO: 295354 - RNA, 22 nt, Human
uuccaugagcucugaguucaca

SEQ ID NO: 295355 - RNA, 22 nt, Human
ucauuucaugucucaggcacug

SEQ ID NO: 295356 - RNA, 22 nt, Human
gcagcuuugucacggagugucg

SEQ ID NO: 295357 - RNA, 22 nt, Human
uuacauucaaggaacucauucu

SEQ ID NO: 295358 - RNA, 22 nt, Human
uuucccagagguaugaauaagu

SEQ ID NO: 295359 - RNA, 22 nt, Human
cauguguuucgagacuguugag

SEQ ID NO: 295360 - RNA, 22 nt, Human
auccugaaaacuuacgaagugg

SEQ ID NO: 295361 - RNA, 22 nt, Human
aagaaaugugaauauugaauag

SEQ ID NO: 295362 - RNA, 22 nt, Human
uauguguuugacacccugcaag

SEQ ID NO: 295363 - RNA, 18 nt, Human
uuaguauaacugccugug

SEQ ID NO: 295364 - RNA, 19 nt, Human
ugcuauuugaagaagugua

SEQ ID NO: 295365 - RNA, 22 nt, Human
gccugcaggcuguaguuuguga

SEQ ID NO: 295366 - RNA, 22 nt, Human
uucuggaaggguggaguagcuu

SEQ ID NO: 295367 - RNA, 22 nt, Human
ggacauuugcaccuaccucagc

SEQ ID NO: 295368 - RNA, 22 nt, Human
uuguugaauggauaaauaaauu

SEQ ID NO: 295369 - RNA, 22 nt, Human
uguuuacagcugaucaggcauc

SEQ ID NO: 295370 - RNA, 22 nt, Human
acuguggcgucaggaagaaauu

SEQ ID NO: 295371 - RNA, 22 nt, Human
cgagcaugaugacggcuguggc

SEQ ID NO: 295372 - RNA, 22 nt, Human
ggcaggcacauuugggggccgu

SEQ ID NO: 295373 - RNA, 22 nt, Human
cauuguaagcuguugaauccuc

SEQ ID NO: 295374 - RNA, 22 nt, Human
cuuagauacaguagaaagacuc

SEQ ID NO: 295375 - RNA, 22 nt, Human
gggaccuggcaccuuugcucug

SEQ ID NO: 295376 - RNA, 22 nt, Human
acaacucucaguuaaauaaaga

SEQ ID NO: 295377 - RNA, 21 nt, Human
aagaaguuuggauuuuguccu

SEQ ID NO: 295378 - RNA, 22 nt, Human
uucagagagaccaaguggcgug

SEQ ID NO: 295379 - RNA, 22 nt, Human
cacauguguauaugugaggggg

SEQ ID NO: 295380 - RNA, 22 nt, Human
uuucaagacucauugaguauug

SEQ ID NO: 295381 - RNA, 22 nt, Human
aggaccugagaguuggaaaucc

SEQ ID NO: 295382 - RNA, 21 nt, Human
uccacccucucugcucccagu

SEQ ID NO: 295383 - RNA, 22 nt, Human
uccaggaggguuuucugccuuc

SEQ ID NO: 295384 - RNA, 22 nt, Human
uugaggagguaugacuagguac

SEQ ID NO: 295385 - RNA, 22 nt, Human
ucagacaggcuucuuucucccu

SEQ ID NO: 295386 - RNA, 20 nt, Human
ucuguggcagguggcgcuug

SEQ ID NO: 295387 - RNA, 22 nt, Human
cauuucauuccuuugaaagugg

SEQ ID NO: 295388 - RNA, 22 nt, Human
ucuaaacacgucucuuugaaua

SEQ ID NO: 295389 - RNA, 22 nt, Human
agauggucuuuugaguaaugaa

SEQ ID NO: 295390 - RNA, 22 nt, Human
acaggugggcuuaagagucggc

SEQ ID NO: 295391 - RNA, 22 nt, Human
acauuucagugagcuauugaag

SEQ ID NO: 295392 - RNA, 22 nt, Human
acugguaaauuaugcgacuuug

SEQ ID NO: 295393 - RNA, 22 nt, Human
acccagccuacaaagcucaccu

SEQ ID NO: 295394 - RNA, 22 nt, Human
caguguuugcuuaaguuauaug

SEQ ID NO: 295395 - RNA, 22 nt, Human
aaggcauuaccuaaguuuggga

SEQ ID NO: 295396 - RNA, 22 nt, Human
aagucucuuuaccucuccaggc

SEQ ID NO: 295397 - RNA, 22 nt, Human
ugcagggaaugcuugcagcaug

SEQ ID NO: 295398 - RNA, 22 nt, Human
uguuuucuggguggaagguacu

SEQ ID NO: 295399 - RNA, 22 nt, Human
agcagguggaaaauucuuauca

SEQ ID NO: 295400 - RNA, 22 nt, Human
cuuuuccacugagccucacaaa

SEQ ID NO: 295401 - RNA, 22 nt, Human
acagauuuguucuuuugggcua

SEQ ID NO: 295402 - RNA, 22 nt, Human
uuaauuuucucaucugugaaau

SEQ ID NO: 295403 - RNA, 22 nt, Human
cacaaauggccguguucaaaga

SEQ ID NO: 295404 - RNA, 22 nt, Human
agcuggagaauaggaauuagug

SEQ ID NO: 295405 - RNA, 22 nt, Human
uuuaauugauucacagucugua

SEQ ID NO: 295406 - RNA, 22 nt, Human
agggggugucucugauuggguu

SEQ ID NO: 295407 - RNA, 22 nt, Human
caggcuugcugcuagagcacuu

SEQ ID NO: 295408 - RNA, 22 nt, Human
uuuuucagccaugaauuacacu

SEQ ID NO: 295409 - RNA, 22 nt, Human
gaggcuguuaggagggacucug

SEQ ID NO: 295410 - RNA, 22 nt, Human
auguccuugagacccuccucgg

SEQ ID NO: 295411 - RNA, 22 nt, Human
uagcaaaggccuuggacacgcu

SEQ ID NO: 295412 - RNA, 22 nt, Human
auguguguguuuaauccucaaa

SEQ ID NO: 295413 - RNA, 22 nt, Human
gggggcucugacucccucagcu

SEQ ID NO: 295414 - RNA, 22 nt, Human
caaaugaaguccaaagggcuua

SEQ ID NO: 295415 - RNA, 22 nt, Human
uaaggcaaagugauuucuuaaa

SEQ ID NO: 295416 - RNA, 22 nt, Human
gauguuuauaucuaacuuaagu

SEQ ID NO: 295417 - RNA, 23 nt, Human
agggcuccuuguugauuagcauu

SEQ ID NO: 295418 - RNA, 22 nt, Human
uuuuccagauuggacuuagucc

SEQ ID NO: 295419 - RNA, 22 nt, Human
ugcuccuggaugagguacucca

SEQ ID NO: 295420 - RNA, 22 nt, Human
uuuuggcuuuuccucagcaagc

SEQ ID NO: 295421 - RNA, 22 nt, Human
gcacccagccagcaucucagag

SEQ ID NO: 295422 - RNA, 22 nt, Human
gcagacaggggcuuaggaaagg

SEQ ID NO: 295423 - RNA, 22 nt, Human
ccuggcagcaggugggcccgug

SEQ ID NO: 295424 - RNA, 22 nt, Human
uacugcauaacuggcauguggg

SEQ ID NO: 295425 - RNA, 22 nt, Human
agaauacaguucaguaauggau

SEQ ID NO: 295426 - RNA, 22 nt, Human
aagaguggagcuggaaaguggg

SEQ ID NO: 295427 - RNA, 22 nt, Human
guucuuaagaccacaauaaaaa

SEQ ID NO: 295428 - RNA, 22 nt, Human
aggaaugugacuauuuuuucag

SEQ ID NO: 295429 - RNA, 20 nt, Human
acaaaauagguacuggguag

SEQ ID NO: 295430 - RNA, 22 nt, Human
cauuuaagagaaauauuuaguu

SEQ ID NO: 295431 - RNA, 22 nt, Human
uugcccagagucacccagcuca

SEQ ID NO: 295432 - RNA, 22 nt, Human
acaguuuauugcacagguaacc

SEQ ID NO: 295433 - RNA, 22 nt, Human
ccuguucacccuccaugcacag

SEQ ID NO: 295434 - RNA, 15 nt, Human
auacacaugagggag

SEQ ID NO: 295435 - RNA, 22 nt, Human
cagcaaagguagaagcacagga

SEQ ID NO: 295436 - RNA, 19 nt, Human
uguccucacagagcauaac

SEQ ID NO: 295437 - RNA, 22 nt, Human
agcaggugcguuacuucacucu

SEQ ID NO: 295438 - RNA, 22 nt, Human
gccugcagaggugcugcuagcu

SEQ ID NO: 295439 - RNA, 22 nt, Human
auccugugcaaugacugcaucu

SEQ ID NO: 295440 - RNA, 22 nt, Human
uuauuuauuguguaccuacugu

SEQ ID NO: 295441 - RNA, 22 nt, Human
aauuuguuuucaagucacugga

SEQ ID NO: 295442 - RNA, 22 nt, Human
caggaauccagagugagccucc

SEQ ID NO: 295443 - RNA, 22 nt, Human
auuuucauuuugcagggugaga

SEQ ID NO: 295444 - RNA, 22 nt, Human
aaauguuuugcucccauguggu

SEQ ID NO: 295445 - RNA, 22 nt, Human
uugcccagagcugccuguuaca

SEQ ID NO: 295446 - RNA, 22 nt, Human
ucucuucuuguguuuuccugcc

SEQ ID NO: 295447 - RNA, 22 nt, Human
augaacagaggaauagaauucu

SEQ ID NO: 295448 - RNA, 20 nt, Human
uccuggccuucucgggcagu

SEQ ID NO: 295449 - RNA, 22 nt, Human
uauugcuggugcuguucugaau

SEQ ID NO: 295450 - RNA, 21 nt, Human
ugacugaggcuucuucacaca

SEQ ID NO: 295451 - RNA, 20 nt, Human
ugcaggugggcccuucuggg

SEQ ID NO: 295452 - RNA, 22 nt, Human
uccugagcccuguaggacccug

SEQ ID NO: 295453 - RNA, 22 nt, Human
uccuggguucauguccuggugc

SEQ ID NO: 295454 - RNA, 19 nt, Human
acauucccaucagcaaugu

SEQ ID NO: 295455 - RNA, 22 nt, Human
gaaagcugggaaauaaauauua

SEQ ID NO: 295456 - RNA, 22 nt, Human
cacaaggcacauuccuugucca

SEQ ID NO: 295457 - RNA, 22 nt, Human
uguagaaagcucuucugaaauc

SEQ ID NO: 295458 - RNA, 22 nt, Human
cugugggaacacugaggacuuc

SEQ ID NO: 295459 - RNA, 22 nt, Human
gcuguggccuggcgcagagcug

SEQ ID NO: 295460 - RNA, 23 nt, Human
agguuaugauuauagagcgagga

SEQ ID NO: 295461 - RNA, 22 nt, Human
acaggcaggcgggacagcccga

SEQ ID NO: 295462 - RNA, 22 nt, Human
aaauucaguuuuaauaaucacu

SEQ ID NO: 295463 - RNA, 22 nt, Human
cuggccccaggcagccugcugg

SEQ ID NO: 295464 - RNA, 22 nt, Human
ucccugagagcacuggggagcc

SEQ ID NO: 295465 - RNA, 22 nt, Human
uggcagguggagacagcagagc

SEQ ID NO: 295466 - RNA, 22 nt, Human
aaggugguuugauuaucccacu

SEQ ID NO: 295467 - RNA, 22 nt, Human
ucagggcacguuucugcaaugc

SEQ ID NO: 295468 - RNA, 20 nt, Human
ucuuauugucuugaggaguu

SEQ ID NO: 295469 - RNA, 22 nt, Human
cuacuucugugaugaaacuaca

SEQ ID NO: 295470 - RNA, 18 nt, Human
agaguccagggugaggug

SEQ ID NO: 295471 - RNA, 22 nt, Human
ucuuagauguuagcucugugug

SEQ ID NO: 295472 - RNA, 22 nt, Human
caauuucucuuuauaucucaca

SEQ ID NO: 295473 - RNA, 22 nt, Human
cagggcucaucugugugaccag

SEQ ID NO: 295474 - RNA, 22 nt, Human
uugaaauaucaaguuauuagug

SEQ ID NO: 295475 - RNA, 22 nt, Human
ugacacaugcaccagucuuuaa

SEQ ID NO: 295476 - RNA, 22 nt, Human
uacacaugcauguacuccagga

SEQ ID NO: 295477 - RNA, 22 nt, Human
uggagcaggaaacaucuagagg

SEQ ID NO: 295478 - RNA, 22 nt, Human
gcagguguggaguggggugagc

SEQ ID NO: 295479 - RNA, 22 nt, Human
uauuacagaaucaggcauaacu

SEQ ID NO: 295480 - RNA, 23 nt, Human
gaggagggucgugcuguguuccu

SEQ ID NO: 295481 - RNA, 20 nt, Human
aggguggcaaguuagugaca

SEQ ID NO: 295482 - RNA, 22 nt, Human
acaagaauuuacauguagugga

SEQ ID NO: 295483 - RNA, 20 nt, Human
agggugugggccuuagccau

SEQ ID NO: 295484 - RNA, 22 nt, Human
auguuuuaaauauguguguaaa

SEQ ID NO: 295485 - RNA, 22 nt, Human
gauuuucauuugcacucuagaa

SEQ ID NO: 295486 - RNA, 22 nt, Human
cugccugcaugcugccauagcu

SEQ ID NO: 295487 - RNA, 22 nt, Human
uucuuaacuggaaaaugucaga

SEQ ID NO: 295488 - RNA, 22 nt, Human
uugcaggguugacacugccugc

SEQ ID NO: 295489 - RNA, 21 nt, Human
ucgugcagcagcugaggcuug

SEQ ID NO: 295490 - RNA, 23 nt, Human
uuucacauuaauguuuagcagga

SEQ ID NO: 295491 - RNA, 22 nt, Human
gacugugggaagacuguagguu

SEQ ID NO: 295492 - RNA, 22 nt, Human
acuugguuggucucacccuguu

SEQ ID NO: 295493 - RNA, 18 nt, Human
cuggcauucuucccugga

SEQ ID NO: 295494 - RNA, 22 nt, Human
ugcaggcucaccugccagggcc

SEQ ID NO: 295495 - RNA, 22 nt, Human
ucuguccucuuugaagcugcuc

SEQ ID NO: 295496 - RNA, 22 nt, Human
cauuugaagacuuagaagagga

SEQ ID NO: 295497 - RNA, 22 nt, Human
acacaugauaagaaaguuuaaa

SEQ ID NO: 295498 - RNA, 22 nt, Human
uguuaaaaccacaggugaggac

SEQ ID NO: 295499 - RNA, 18 nt, Human
acuguuaucugauaaggc

SEQ ID NO: 295500 - RNA, 22 nt, Human
cugggugugggucaagcaacca

SEQ ID NO: 295501 - RNA, 22 nt, Human
ucaguuaacaacuauuuauuga

SEQ ID NO: 295502 - RNA, 20 nt, Human
auacacauauucuugcaacu

SEQ ID NO: 295503 - RNA, 22 nt, Human
uuauugaaggaacugaaauaaa

SEQ ID NO: 295504 - RNA, 22 nt, Human
aaacaucaccauuuuaccuaau

SEQ ID NO: 295505 - RNA, 21 nt, Human
uugcuuauggcacugcuuugc

SEQ ID NO: 295506 - RNA, 22 nt, Human
ggggaccugggcuucaaggguu

SEQ ID NO: 295507 - RNA, 22 nt, Human
agaggucagcugcaugccacau

SEQ ID NO: 295508 - RNA, 19 nt, Human
cucugggcugcaucuuggu

SEQ ID NO: 295509 - RNA, 22 nt, Human
guuuacauguacucauuauacu

SEQ ID NO: 295510 - RNA, 22 nt, Human
augaggcucucaacaccuugag

SEQ ID NO: 295511 - RNA, 22 nt, Human
cugugucccccucagccaggug

SEQ ID NO: 295512 - RNA, 22 nt, Human
ccaugagcuucaacugacacag

SEQ ID NO: 295513 - RNA, 22 nt, Human
ucuuuguaaaugccuagcauaa

SEQ ID NO: 295514 - RNA, 22 nt, Human
acagcuggacaggggagaguuu

SEQ ID NO: 295515 - RNA, 22 nt, Human
cacaugcauaccuauguguaua

SEQ ID NO: 295516 - RNA, 22 nt, Human
aaagaucaauagauaaagcuac

SEQ ID NO: 295517 - RNA, 22 nt, Human
agucaguuuuaccaaucucagu

SEQ ID NO: 295518 - RNA, 22 nt, Human
cacaggugcuccucggggagcu

SEQ ID NO: 295519 - RNA, 22 nt, Human
uaguacuacguuuucuacuauc

SEQ ID NO: 295520 - RNA, 22 nt, Human
aggugcaugaugcagagugcag

SEQ ID NO: 295521 - RNA, 21 nt, Human
ggcuguggagccaugacucac

SEQ ID NO: 295522 - RNA, 22 nt, Human
agccagagaguguuggagaugu

SEQ ID NO: 295523 - RNA, 22 nt, Human
acaauucugaugguuucccagu

SEQ ID NO: 295524 - RNA, 22 nt, Human
cacaguuuaugaucucagugaa

SEQ ID NO: 295525 - RNA, 18 nt, Human
agagggaaagcaggcuga

SEQ ID NO: 295526 - RNA, 22 nt, Human
cuccugaggacuucuauugggu

SEQ ID NO: 295527 - RNA, 22 nt, Human
uucauugagugguuuauucuaa

SEQ ID NO: 295528 - RNA, 22 nt, Human
agcugagguuaguauaaaugug

SEQ ID NO: 295529 - RNA, 22 nt, Human
gauuuacagaucuaagggucac

SEQ ID NO: 295530 - RNA, 22 nt, Human
agggcaugugggagaggagccu

SEQ ID NO: 295531 - RNA, 22 nt, Human
guucuuuaaacugcugcucugu

SEQ ID NO: 295532 - RNA, 22 nt, Human
ucccuccaggcagcuggguacu

SEQ ID NO: 295533 - RNA, 20 nt, Human
gggugggagagucugagggu

SEQ ID NO: 295534 - RNA, 22 nt, Human
cccuuccucccaggcuucugug

SEQ ID NO: 295535 - RNA, 22 nt, Human
auucuucauaccuacugagguu

SEQ ID NO: 295536 - RNA, 22 nt, Human
cuccuggaggcuccaagggaga

SEQ ID NO: 295537 - RNA, 22 nt, Human
caugcagcaggaucucauuccc

SEQ ID NO: 295538 - RNA, 22 nt, Human
guugcacaguuccucaagcagg

SEQ ID NO: 295539 - RNA, 22 nt, Human
gcucaggagcugacagccucaa

SEQ ID NO: 295540 - RNA, 23 nt, Human
ccagucucacguauacaggauuu

SEQ ID NO: 295541 - RNA, 22 nt, Human
ucccaauuaacagguaucaggc

SEQ ID NO: 295542 - RNA, 22 nt, Human
ugggaccucucuugagagagca

SEQ ID NO: 295543 - RNA, 22 nt, Human
agaggccuccgaaaggugggcu

SEQ ID NO: 295544 - RNA, 22 nt, Human
ucaugccacuuacaaaauaaug

SEQ ID NO: 295545 - RNA, 22 nt, Human
acaugccaauuugguuaguuca

SEQ ID NO: 295546 - RNA, 20 nt, Human
cauauauaccuagaagugga

SEQ ID NO: 295547 - RNA, 22 nt, Human
ucugggugagcugccucggguc

SEQ ID NO: 295548 - RNA, 22 nt, Human
auuuacauuccauggugguuac

SEQ ID NO: 295549 - RNA, 22 nt, Human
gacugucuccugucaugaggga

SEQ ID NO: 295550 - RNA, 22 nt, Human
uggggagguucgggaaucuugu

SEQ ID NO: 295551 - RNA, 22 nt, Human
gccuacauuucccaguugaaug

SEQ ID NO: 295552 - RNA, 22 nt, Human
aauuucuccaagaaugcuuaga

SEQ ID NO: 295553 - RNA, 22 nt, Human
gaaauaguacagcauaguucuu

SEQ ID NO: 295554 - RNA, 22 nt, Human
uggaucugguucccugagccuu

SEQ ID NO: 295555 - RNA, 22 nt, Human
aacaugcccgcuguaugccauu

SEQ ID NO: 295556 - RNA, 21 nt, Human
auuuucauuaauucagugugg

SEQ ID NO: 295557 - RNA, 22 nt, Human
gccagcucucauuguauaggcu

SEQ ID NO: 295558 - RNA, 22 nt, Human
acuguucacccagcacuagcag

SEQ ID NO: 295559 - RNA, 22 nt, Human
uaugccuggaaccuuucucuuu

SEQ ID NO: 295560 - RNA, 22 nt, Human
uacauuccauguguguguauuc

SEQ ID NO: 295561 - RNA, 22 nt, Human
gaaauuuauuaucuacaucauu

SEQ ID NO: 295562 - RNA, 22 nt, Human
auuuccaugucgguauuuuaua

SEQ ID NO: 295563 - RNA, 22 nt, Human
ucccagggcucuagagugcugg

SEQ ID NO: 295564 - RNA, 22 nt, Human
cuccugacacaguccacacuug

SEQ ID NO: 295565 - RNA, 22 nt, Human
gaauuuccucuaaaccccugag

SEQ ID NO: 295566 - RNA, 20 nt, Human
uugaagaggauauaucgcuc

SEQ ID NO: 295567 - RNA, 22 nt, Human
auguuauuaaaguacagauucu

SEQ ID NO: 295568 - RNA, 22 nt, Human
acagguguguucccggaaagcc

SEQ ID NO: 295569 - RNA, 22 nt, Human
ucugcaggcucuagaugagguu

SEQ ID NO: 295570 - RNA, 22 nt, Human
uucaacuauuaugaauaaaauu

SEQ ID NO: 295571 - RNA, 19 nt, Human
ugguggcaaugucagcuaa

SEQ ID NO: 295572 - RNA, 21 nt, Human
ugacccuucuagcagaacaca

SEQ ID NO: 295573 - RNA, 22 nt, Human
uuuauucugugcuacaugaaga

SEQ ID NO: 295574 - RNA, 22 nt, Human
gcauccaaaccauucaucagcc

SEQ ID NO: 295575 - RNA, 20 nt, Human
gucugcccaggccaccacgg

SEQ ID NO: 295576 - RNA, 22 nt, Human
uuauugagagcuguuuuauggc

SEQ ID NO: 295577 - RNA, 22 nt, Human
uacuuucuuucccaagaggugg

SEQ ID NO: 295578 - RNA, 22 nt, Human
gugguggaugucuguaaucuca

SEQ ID NO: 295579 - RNA, 22 nt, Human
gaggccugguuuccagcauccu

SEQ ID NO: 295580 - RNA, 22 nt, Human
gcccucucggcauagcaggggc

SEQ ID NO: 295581 - RNA, 22 nt, Human
ugucccucugaggcuucccugg

SEQ ID NO: 295582 - RNA, 22 nt, Human
aauacaaucaaauucacuagca

SEQ ID NO: 295583 - RNA, 22 nt, Human
ugcuggaguucgacauugcaaa

SEQ ID NO: 295584 - RNA, 22 nt, Human
uccugaggcucacuuugaaugu

SEQ ID NO: 295585 - RNA, 22 nt, Human
uucauuugccaucaguguaaug

SEQ ID NO: 295586 - RNA, 22 nt, Human
acauucuuaacaguuaaaaacu

SEQ ID NO: 295587 - RNA, 22 nt, Human
cagcuuuaccaauauuuggaaa

SEQ ID NO: 295588 - RNA, 17 nt, Human
ccugagugggagaggaa

SEQ ID NO: 295589 - RNA, 22 nt, Human
uuugcugaauagauuguaaacu

SEQ ID NO: 295590 - RNA, 22 nt, Human
caccugcagggggagucaagag

SEQ ID NO: 295591 - RNA, 22 nt, Human
uuuccuucuuagcgguguucuu

SEQ ID NO: 295592 - RNA, 22 nt, Human
cugauguucauuucuuuuguac

SEQ ID NO: 295593 - RNA, 22 nt, Human
gaggcuccccaugaggccccag

SEQ ID NO: 295594 - RNA, 22 nt, Human
ucaaggagacagaaagcaaugg

SEQ ID NO: 295595 - RNA, 22 nt, Human
gucuuucuaugaugaacuguug

SEQ ID NO: 295596 - RNA, 22 nt, Human
uuccugcagcaaggagaagcug

SEQ ID NO: 295597 - RNA, 22 nt, Human
gccacugucaucuugugaagca

SEQ ID NO: 295598 - RNA, 22 nt, Human
acauguguauagccuguauaga

SEQ ID NO: 295599 - RNA, 22 nt, Human
ggacggggagcuggaaagggga

SEQ ID NO: 295600 - RNA, 21 nt, Human
agacaacugugacuauucccu

SEQ ID NO: 295601 - RNA, 22 nt, Human
uucuuuccccauggaguucgga

SEQ ID NO: 295602 - RNA, 22 nt, Human
ucccagggauuaggacauggau

SEQ ID NO: 295603 - RNA, 22 nt, Human
agaggccucuagggccccucag

SEQ ID NO: 295604 - RNA, 22 nt, Human
aagcugcagguugaauccaggu

SEQ ID NO: 295605 - RNA, 22 nt, Human
gaggaaugggugucucgugauu

SEQ ID NO: 295606 - RNA, 22 nt, Human
uuccaugaaauguguuaugcuu

SEQ ID NO: 295607 - RNA, 22 nt, Human
ggcaggugcgcauguugcauua

SEQ ID NO: 295608 - RNA, 22 nt, Human
agcagggcacuggaaggcacug

SEQ ID NO: 295609 - RNA, 22 nt, Human
gcuguggucccucuguccucau

SEQ ID NO: 295610 - RNA, 22 nt, Human
uacagaauguuaugaagcauag

SEQ ID NO: 295611 - RNA, 22 nt, Human
aagucucuggugaugcaggaaa

SEQ ID NO: 295612 - RNA, 22 nt, Human
uagaaggcccauucauuuguuc

SEQ ID NO: 295613 - RNA, 22 nt, Human
uccuuuaugugaguuguuuccc

SEQ ID NO: 295614 - RNA, 22 nt, Human
ugguauguaaauuguaacucaa

SEQ ID NO: 295615 - RNA, 20 nt, Human
gccugcagagaaggucagag

SEQ ID NO: 295616 - RNA, 22 nt, Human
uuuauguuugcauuuucaaaga

SEQ ID NO: 295617 - RNA, 22 nt, Human
gaacuuggaccugguccuuugg

SEQ ID NO: 295618 - RNA, 22 nt, Human
uucuuacagaguuuacagagcc

SEQ ID NO: 295619 - RNA, 22 nt, Human
aaauccuaagcagaggaauuua

SEQ ID NO: 295620 - RNA, 22 nt, Human
ccuguucacuuugacuucucca

SEQ ID NO: 295621 - RNA, 23 nt, Human
uguguacacaauagaugagguuu

SEQ ID NO: 295622 - RNA, 22 nt, Human
uaggaaauucucuugcuaaguu

SEQ ID NO: 295623 - RNA, 21 nt, Human
ucucuguguacagucucaccc

SEQ ID NO: 295624 - RNA, 22 nt, Human
aagacaauuugauacuaguugc

SEQ ID NO: 295625 - RNA, 22 nt, Human
ggccccaguucacuccuggccg

SEQ ID NO: 295626 - RNA, 22 nt, Human
agaugugacugggcaaguuacu

SEQ ID NO: 295627 - RNA, 22 nt, Human
ucugucuucuguagcuaauaau

SEQ ID NO: 295628 - RNA, 22 nt, Human
guucuucagcccucagguccua

SEQ ID NO: 295629 - RNA, 22 nt, Human
ggccuggaagaggacagagaaa

SEQ ID NO: 295630 - RNA, 22 nt, Human
ccuguucagagcuaagcaucau

SEQ ID NO: 295631 - RNA, 22 nt, Human
ccugggagcuguggaaaggcug

SEQ ID NO: 295632 - RNA, 22 nt, Human
uauuuuacagacuacuuuagau

SEQ ID NO: 295633 - RNA, 22 nt, Human
auaguguuagagccaguauguu

SEQ ID NO: 295634 - RNA, 20 nt, Human
cuguuaaaagguaugaauuc

SEQ ID NO: 295635 - RNA, 22 nt, Human
aaauaauuauagcgagucuauc

SEQ ID NO: 295636 - RNA, 22 nt, Human
uuuauaaaauagacugggucua

SEQ ID NO: 295637 - RNA, 22 nt, Human
uuucacaaugcaauccuacuuc

SEQ ID NO: 295638 - RNA, 22 nt, Human
agccauccucccaccucagccu

SEQ ID NO: 295639 - RNA, 22 nt, Human
gaauguuagagauucuuagguu

SEQ ID NO: 295640 - RNA, 22 nt, Human
ucauuugugcaauguagaugaa

SEQ ID NO: 295641 - RNA, 22 nt, Human
auuuccuucggacaguuugggu

SEQ ID NO: 295642 - RNA, 22 nt, Human
cauuuguugggacaaugaaaag

SEQ ID NO: 295643 - RNA, 22 nt, Human
acuuguucauugaguacauaug

SEQ ID NO: 295644 - RNA, 19 nt, Human
uggcagugugggguaugaa

SEQ ID NO: 295645 - RNA, 18 nt, Human
aaugaaauguacaccuuu

SEQ ID NO: 295646 - RNA, 21 nt, Human
agcaggugcuguuggaggaaa

SEQ ID NO: 295647 - RNA, 22 nt, Human
auucugcacuuccuuugcuucc

SEQ ID NO: 295648 - RNA, 22 nt, Human
ccugggugacagagugagaccu

SEQ ID NO: 295649 - RNA, 22 nt, Human
ucucuucuaacacuagaaauuc

SEQ ID NO: 295650 - RNA, 22 nt, Human
ugaguccgaaguugcagugagc

SEQ ID NO: 295651 - RNA, 22 nt, Human
ccagacaggggcuguuccugcu

SEQ ID NO: 295652 - RNA, 22 nt, Human
uggcagggaguucguucacaac

SEQ ID NO: 295653 - RNA, 22 nt, Human
ggaaggguuuggaaagccgaga

SEQ ID NO: 295654 - RNA, 22 nt, Human
gcuucuaucccuccacugcacu

SEQ ID NO: 295655 - RNA, 22 nt, Human
cagggcagcuuccuuuguuagg

SEQ ID NO: 295656 - RNA, 22 nt, Human
uucugucaugcucauguaauug

SEQ ID NO: 295657 - RNA, 19 nt, Human
gcaggcaguggcauucgga

SEQ ID NO: 295658 - RNA, 22 nt, Human
caaaaacugcaauuacuuuuac

SEQ ID NO: 295659 - RNA, 22 nt, Human
uguauuuucagaguggcauuuc

SEQ ID NO: 295660 - RNA, 22 nt, Human
aaaaaugcugugguagcugugu

SEQ ID NO: 295661 - RNA, 22 nt, Human
acaaggagaagaaauuggucau

SEQ ID NO: 295662 - RNA, 22 nt, Human
uucuuacauauuuucauauggu

SEQ ID NO: 295663 - RNA, 22 nt, Human
uagguaguuuccuguuguuggg

SEQ ID NO: 295664 - RNA, 22 nt, Human
gcugauggcuugcuggcugaca

SEQ ID NO: 295665 - RNA, 22 nt, Human
uucucaguuucacugauaacag

SEQ ID NO: 295666 - RNA, 20 nt, Human
ccuccuggucaggugugcag

SEQ ID NO: 295667 - RNA, 22 nt, Human
uuuagcaucgaaguaaauuuag

SEQ ID NO: 295668 - RNA, 22 nt, Human
guauuuucaugauuucagacca

SEQ ID NO: 295669 - RNA, 22 nt, Human
auccuucuaccuaggacuauuu

SEQ ID NO: 295670 - RNA, 22 nt, Human
auaugcauguacgugugcacaa

SEQ ID NO: 295671 - RNA, 22 nt, Human
ugccugacugcugccaccacua

SEQ ID NO: 295672 - RNA, 22 nt, Human
uccuggccugucuggaguagcu

SEQ ID NO: 295673 - RNA, 22 nt, Human
uuccugguaguaagacaucugg

SEQ ID NO: 295674 - RNA, 22 nt, Human
uguuugaacugaauaacauagu

SEQ ID NO: 295675 - RNA, 22 nt, Human
uuggcuuggagaguugaaaugu

SEQ ID NO: 295676 - RNA, 22 nt, Human
gcuuguuugugauuucuccaga

SEQ ID NO: 295677 - RNA, 22 nt, Human
cuguguccuuuaaaaaagacac

SEQ ID NO: 295678 - RNA, 21 nt, Human
ucucuccucaagcucgacccc

SEQ ID NO: 295679 - RNA, 22 nt, Human
cuuuccuccacucccuaggcuu

SEQ ID NO: 295680 - RNA, 21 nt, Human
aagagcuggaucaaggauaag

SEQ ID NO: 295681 - RNA, 22 nt, Human
ccugaaauccauaguuuacacu

SEQ ID NO: 295682 - RNA, 17 nt, Human
cuccuggccaccccucu

SEQ ID NO: 295683 - RNA, 22 nt, Human
ucugggaagcugguccuguucu

SEQ ID NO: 295684 - RNA, 22 nt, Human
uugagguauugauauuuuauga

SEQ ID NO: 295685 - RNA, 22 nt, Human
augagguuuuacugccauuuuc

SEQ ID NO: 295686 - RNA, 22 nt, Human
uuuguucaauccagacaauagc

SEQ ID NO: 295687 - RNA, 22 nt, Human
ggcaggcaagucugcucuguga

SEQ ID NO: 295688 - RNA, 22 nt, Human
augaaagaugauuuaaaguacu

SEQ ID NO: 295689 - RNA, 22 nt, Human
aggaaaagugugaaguauggag

SEQ ID NO: 295690 - RNA, 22 nt, Human
agcaggcacuaugccaggaucu

SEQ ID NO: 295691 - RNA, 22 nt, Human
uuuucaguaaugucuacauaau

SEQ ID NO: 295692 - RNA, 22 nt, Human
acagcuuuucugauagauccug

SEQ ID NO: 295693 - RNA, 22 nt, Human
aggacagugguguucuggagug

SEQ ID NO: 295694 - RNA, 22 nt, Human
uaacuuagaaguuuaauuguau

SEQ ID NO: 295695 - RNA, 22 nt, Human
ccuacaggaaauuguaucaaaa

SEQ ID NO: 295696 - RNA, 22 nt, Human
ugagcuuacgugggaacagacu

SEQ ID NO: 295697 - RNA, 22 nt, Human
ucagcuuucucaaagaagcugg

SEQ ID NO: 295698 - RNA, 22 nt, Human
uggaaaaacugagacuuagaca

SEQ ID NO: 295699 - RNA, 22 nt, Human
uucuaaaaccaauucugcuucu

SEQ ID NO: 295700 - RNA, 22 nt, Human
aggucagaaaaggagagcauug

SEQ ID NO: 295701 - RNA, 22 nt, Human
auguccucggcucugugcugcu

SEQ ID NO: 295702 - RNA, 22 nt, Human
auuccuucuuugagaauaagca

SEQ ID NO: 295703 - RNA, 19 nt, Human
ggguuguguggaagguauc

SEQ ID NO: 295704 - RNA, 20 nt, Human
uuucacagucccuguuuccu

SEQ ID NO: 295705 - RNA, 19 nt, Human
ugucugcugaugacucuau

SEQ ID NO: 295706 - RNA, 22 nt, Human
augcaaaaguaacugugauuuu

SEQ ID NO: 295707 - RNA, 22 nt, Human
gcuuggaaguaggauugggaga

SEQ ID NO: 295708 - RNA, 22 nt, Human
uagaaaauggccaagcaggacu

SEQ ID NO: 295709 - RNA, 19 nt, Human
cagcccucuuaccacugug

SEQ ID NO: 295710 - RNA, 22 nt, Human
ucuggcagggucagggcccagg

SEQ ID NO: 295711 - RNA, 21 nt, Human
cauuucaugauuauagaaaug

SEQ ID NO: 295712 - RNA, 22 nt, Human
ugggaccuguuacauugaguua

SEQ ID NO: 295713 - RNA, 22 nt, Human
gauucuuuagcccagaaaguua

SEQ ID NO: 295714 - RNA, 22 nt, Human
acauguguacauauauaugugc

SEQ ID NO: 295715 - RNA, 22 nt, Human
aacaguuugagcuuugaauuuc

SEQ ID NO: 295716 - RNA, 22 nt, Human
uuucaaagucaagaaggauacu

SEQ ID NO: 295717 - RNA, 22 nt, Human
aagccuugcucuugaaaaaguu

SEQ ID NO: 295718 - RNA, 22 nt, Human
ucuuuacaucacaauuguaugg

SEQ ID NO: 295719 - RNA, 22 nt, Human
cugugugugcuacaggcuucca

SEQ ID NO: 295720 - RNA, 20 nt, Human
aggaaagccugugugagucu

SEQ ID NO: 295721 - RNA, 22 nt, Human
caagggcucaaacggugguugc

SEQ ID NO: 295722 - RNA, 22 nt, Human
ugggcuccucgucacucgcugu

SEQ ID NO: 295723 - RNA, 22 nt, Human
gaugagcauuguuucauguguu

SEQ ID NO: 295724 - RNA, 22 nt, Human
cucuggaauuaaggaagccugu

SEQ ID NO: 295725 - RNA, 17 nt, Human
cuccuggcagccucagg

SEQ ID NO: 295726 - RNA, 22 nt, Human
gcacagugauaggcaguugugc

SEQ ID NO: 295727 - RNA, 22 nt, Human
gcauccaaauguuucauuucuu

SEQ ID NO: 295728 - RNA, 21 nt, Human
acacaaaccuccucagccugg

SEQ ID NO: 295729 - RNA, 22 nt, Human
ccagguguucuuugucccuguu

SEQ ID NO: 295730 - RNA, 22 nt, Human
ucugccugagggagcugaggaa

SEQ ID NO: 295731 - RNA, 22 nt, Human
auguucuuucagccagugcauc

SEQ ID NO: 295732 - RNA, 19 nt, Human
gagggcucauuugaacaau

SEQ ID NO: 295733 - RNA, 22 nt, Human
cuuccuucuguaagaccaguug

SEQ ID NO: 295734 - RNA, 22 nt, Human
cucacagcugcuucaggaucca

SEQ ID NO: 295735 - RNA, 20 nt, Human
gcagggcaucuuggccccca

SEQ ID NO: 295736 - RNA, 22 nt, Human
ccugguuuaugccagauccugu

SEQ ID NO: 295737 - RNA, 22 nt, Human
aaacauuagacaccauaugcuc

SEQ ID NO: 295738 - RNA, 23 nt, Human
ugcaggggaggcuuaaagcaggu

SEQ ID NO: 295739 - RNA, 22 nt, Human
gagaaggcuuccaaauucugug

SEQ ID NO: 295740 - RNA, 22 nt, Human
uccuggccucacaguccugggu

SEQ ID NO: 295741 - RNA, 22 nt, Human
ucucuguaaaauguggaugaua

SEQ ID NO: 295742 - RNA, 22 nt, Human
uauuucagacacugaucuugca

SEQ ID NO: 295743 - RNA, 21 nt, Human
acauuuucuguuuuaggaagu

SEQ ID NO: 295744 - RNA, 22 nt, Human
ucaucugaggcaccagagcaua

SEQ ID NO: 295745 - RNA, 22 nt, Human
uugugucccccuuugagagcca

SEQ ID NO: 295746 - RNA, 22 nt, Human
aaugucuuucucauaacagaua

SEQ ID NO: 295747 - RNA, 22 nt, Human
uguguccuuuggaggaucagcg

SEQ ID NO: 295748 - RNA, 22 nt, Human
ugcuuuaaccaucuuguuugga

SEQ ID NO: 295749 - RNA, 22 nt, Human
agggccagaggcaccuugcagc

SEQ ID NO: 295750 - RNA, 22 nt, Human
cuuauuuuaagucaguuugggu

SEQ ID NO: 295751 - RNA, 22 nt, Human
agcagguguaucggucaccuac

SEQ ID NO: 295752 - RNA, 22 nt, Human
aauaauuagugggacagagaac

SEQ ID NO: 295753 - RNA, 18 nt, Human
ggcugcuuaaggagaucc

SEQ ID NO: 295754 - RNA, 19 nt, Human
ucccagagucuagagguug

SEQ ID NO: 295755 - RNA, 22 nt, Human
uggaaugaaaaguacuucagaa

SEQ ID NO: 295756 - RNA, 22 nt, Human
agcaucugcuuaauggcuuaac

SEQ ID NO: 295757 - RNA, 22 nt, Human
cuuuacagaaagagaacucugg

SEQ ID NO: 295758 - RNA, 23 nt, Human
uagcaaaguuguuugggaaauuu

SEQ ID NO: 295759 - RNA, 22 nt, Human
uccucagaaaccccugugaggu

SEQ ID NO: 295760 - RNA, 22 nt, Human
ugcuggagugcaguggcuuaac

SEQ ID NO: 295761 - RNA, 23 nt, Human
ucuugaaaagccuacagcaguuc

SEQ ID NO: 295762 - RNA, 22 nt, Human
agggcugcaccggggcuucgcg

SEQ ID NO: 295763 - RNA, 22 nt, Human
aucuuuaggcaaguuacuuaac

SEQ ID NO: 295764 - RNA, 22 nt, Human
auguuucuacagcguccacuga

SEQ ID NO: 295765 - RNA, 22 nt, Human
gagcugcacuggggguggaaug

SEQ ID NO: 295766 - RNA, 22 nt, Human
cuuucuuucgaagacgugauua

SEQ ID NO: 295767 - RNA, 22 nt, Human
guuuaagaaaauucauguuguu

SEQ ID NO: 295768 - RNA, 23 nt, Human
cuggcuccgaagacuccaggauc

SEQ ID NO: 295769 - RNA, 22 nt, Human
gagggaugcagaaacagaggcc

SEQ ID NO: 295770 - RNA, 22 nt, Human
auccagagacuggggcugggau

SEQ ID NO: 295771 - RNA, 22 nt, Human
ugcugccagggcucugcccaca

SEQ ID NO: 295772 - RNA, 22 nt, Human
aggcugcuucuuguccuuggca

SEQ ID NO: 295773 - RNA, 22 nt, Human
uuccaugacugaagcaggggcg

SEQ ID NO: 295774 - RNA, 19 nt, Human
cccucauucacuuauucuc

SEQ ID NO: 295775 - RNA, 19 nt, Human
agcugcaaaagguggaacu

SEQ ID NO: 295776 - RNA, 22 nt, Human
uguggggaagaguaugacuugg

SEQ ID NO: 295777 - RNA, 22 nt, Human
ucagaggccuugguuaugguau

SEQ ID NO: 295778 - RNA, 22 nt, Human
agcagggcccacuaggggagau

SEQ ID NO: 295779 - RNA, 22 nt, Human
aguuggagugaacaugagauug

SEQ ID NO: 295780 - RNA, 19 nt, Human
ucuucccuggcugucaguc

SEQ ID NO: 295781 - RNA, 22 nt, Human
auuguacagguuggaggaagug

SEQ ID NO: 295782 - RNA, 22 nt, Human
acagagcuguacaugugccaug

SEQ ID NO: 295783 - RNA, 22 nt, Human
gaagauuuaagcacaauagucu

SEQ ID NO: 295784 - RNA, 22 nt, Human
ucagugaaaugcauauucuucg

SEQ ID NO: 295785 - RNA, 22 nt, Human
gggauggaucuuggcugaggcu

SEQ ID NO: 295786 - RNA, 22 nt, Human
aguugacauccauaacaggaag

SEQ ID NO: 295787 - RNA, 22 nt, Human
ccaggugugauuucaucugagg

SEQ ID NO: 295788 - RNA, 22 nt, Human
cucuucuugcuagacugagugc

SEQ ID NO: 295789 - RNA, 22 nt, Human
ugagcauuggaucaaaugacuu

SEQ ID NO: 295790 - RNA, 22 nt, Human
uccuggcagggaacuugucagc

SEQ ID NO: 295791 - RNA, 19 nt, Human
auuuauuguaugauuccau

SEQ ID NO: 295792 - RNA, 22 nt, Human
gcuggucuccgccgcucccuga

SEQ ID NO: 295793 - RNA, 22 nt, Human
ucuccuggauggaccuucucuu

SEQ ID NO: 295794 - RNA, 22 nt, Human
aaauuccauuuugugacuauuc

SEQ ID NO: 295795 - RNA, 22 nt, Human
cacugucugggacauguggucu

SEQ ID NO: 295796 - RNA, 22 nt, Human
acauucuucagcuuugucaggc

SEQ ID NO: 295797 - RNA, 22 nt, Human
cuggguguucacccgaggcgcu

SEQ ID NO: 295798 - RNA, 22 nt, Human
acugggagucaugaggaaggag

SEQ ID NO: 295799 - RNA, 22 nt, Human
caaauacuaaacauaagauuuu

SEQ ID NO: 295800 - RNA, 21 nt, Human
gugcucugggcagcagagggc

SEQ ID NO: 295801 - RNA, 22 nt, Human
ugucuucgcuacaaugaaaagg

SEQ ID NO: 295802 - RNA, 22 nt, Human
uguguuauugccacugaagacc

SEQ ID NO: 295803 - RNA, 22 nt, Human
uucuguauauuguaaagacuca

SEQ ID NO: 295804 - RNA, 22 nt, Human
uguuuugguagauugauuaugg

SEQ ID NO: 295805 - RNA, 22 nt, Human
caauucuuuguagaagcucucc

SEQ ID NO: 295806 - RNA, 18 nt, Human
gugggguguugugaggau

SEQ ID NO: 295807 - RNA, 22 nt, Human
ugucucagauacgccaucaagg

SEQ ID NO: 295808 - RNA, 22 nt, Human
uuccaggaaaacaguuggaagu

SEQ ID NO: 295809 - RNA, 22 nt, Human
uaugcagcaccacucacugcag

SEQ ID NO: 295810 - RNA, 22 nt, Human
aaaucagucccucuuggaauuu

SEQ ID NO: 295811 - RNA, 22 nt, Human
agcuccuguucugagagcagga

SEQ ID NO: 295812 - RNA, 22 nt, Human
agcagcauuaugauauaucuua

SEQ ID NO: 295813 - RNA, 22 nt, Human
uucuucagauggugagaccucc

SEQ ID NO: 295814 - RNA, 22 nt, Human
uguguccuuaugaaaauacugu

SEQ ID NO: 295815 - RNA, 20 nt, Human
ucugugugccaucaccuaac

SEQ ID NO: 295816 - RNA, 22 nt, Human
gaggugucauuuaguuaaucag

SEQ ID NO: 295817 - RNA, 22 nt, Human
gaaagaaugcuauagugacuuc

SEQ ID NO: 295818 - RNA, 22 nt, Human
uuuugcugggguggcuagcuua

SEQ ID NO: 295819 - RNA, 22 nt, Human
ucugagacaggaaguggagggu

SEQ ID NO: 295820 - RNA, 22 nt, Human
gccaucugcugcucuccagugu

SEQ ID NO: 295821 - RNA, 22 nt, Human
gcuccuggcucucugagggcug

SEQ ID NO: 295822 - RNA, 22 nt, Human
cuuuacagauggauaauuguuu

SEQ ID NO: 295823 - RNA, 22 nt, Human
aaugggaaaagaguaugauuua

SEQ ID NO: 295824 - RNA, 22 nt, Human
ccaugagccaggcugaggaagc

SEQ ID NO: 295825 - RNA, 22 nt, Human
cucaggaguuggaggcuacagu

SEQ ID NO: 295826 - RNA, 22 nt, Human
cagcugcaggaacaaaaaugug

SEQ ID NO: 295827 - RNA, 22 nt, Human
auucuucaucacuaccuuguga

SEQ ID NO: 295828 - RNA, 22 nt, Human
ugcagggaaagggcacugggcu

SEQ ID NO: 295829 - RNA, 22 nt, Human
uagaaacagcauauauuagccc

SEQ ID NO: 295830 - RNA, 22 nt, Human
auuuauugaacacugacuaugu

SEQ ID NO: 295831 - RNA, 22 nt, Human
uggcaaaggaaccuauuuuaaa

SEQ ID NO: 295832 - RNA, 22 nt, Human
agguauauauucugguccuuau

SEQ ID NO: 295833 - RNA, 22 nt, Human
aaucaguuucuuggcaaguuua

SEQ ID NO: 295834 - RNA, 22 nt, Human
aucuuuuuaucuguuuggaaca

SEQ ID NO: 295835 - RNA, 21 nt, Human
aaacaucucugcuuuuguguc

SEQ ID NO: 295836 - RNA, 22 nt, Human
agacaaguucugugggucaccu

SEQ ID NO: 295837 - RNA, 22 nt, Human
caggaucuuuuaaugucuccag

SEQ ID NO: 295838 - RNA, 22 nt, Human
ucuggagaggaggauguggaca

SEQ ID NO: 295839 - RNA, 22 nt, Human
cacagcuggugcacuagcucug

SEQ ID NO: 295840 - RNA, 22 nt, Human
uaaaaucauucuggugucagua

SEQ ID NO: 295841 - RNA, 22 nt, Human
augucuuggguuucaguuuacu

SEQ ID NO: 295842 - RNA, 18 nt, Human
gcacagcuaggagggucc

SEQ ID NO: 295843 - RNA, 22 nt, Human
aaaauuauggaguaucccaaag

SEQ ID NO: 295844 - RNA, 22 nt, Human
gcaaacauucaggaguacagga

SEQ ID NO: 295845 - RNA, 22 nt, Human
acaguggcucaugccugucauc

SEQ ID NO: 295846 - RNA, 22 nt, Human
ugcauuccauguguuuccugag

SEQ ID NO: 295847 - RNA, 22 nt, Human
cauuuacauuuaagguuaauau

SEQ ID NO: 295848 - RNA, 22 nt, Human
uugcagcuucgagucuaucugu

SEQ ID NO: 295849 - RNA, 22 nt, Human
uuguuucucuggucuugaguga

SEQ ID NO: 295850 - RNA, 22 nt, Human
agcugcaagaagaggucccuga

SEQ ID NO: 295851 - RNA, 22 nt, Human
ucuuagauggcagcuagagcuc

SEQ ID NO: 295852 - RNA, 22 nt, Human
agagucagaaccaagaugaggc

SEQ ID NO: 295853 - RNA, 22 nt, Human
uagggcaguuauaacauuagug

SEQ ID NO: 295854 - RNA, 22 nt, Human
guggcuuuggaauuguagacuc

SEQ ID NO: 295855 - RNA, 22 nt, Human
cugaggcucaagggcagguggg

SEQ ID NO: 295856 - RNA, 22 nt, Human
uccaguuuacaggguugcuuuu

SEQ ID NO: 295857 - RNA, 22 nt, Human
uuugcuuaaaguucuuucuggu

SEQ ID NO: 295858 - RNA, 22 nt, Human
acacauauaccacuguaaauga

SEQ ID NO: 295859 - RNA, 22 nt, Human
auguuucaucaguaagguuuug

SEQ ID NO: 295860 - RNA, 22 nt, Human
gcccaggggaguagucaauuua

SEQ ID NO: 295861 - RNA, 22 nt, Human
auacaaagacaaaucucaaucu

SEQ ID NO: 295862 - RNA, 22 nt, Human
acaaggcuguuggucacaaacc

SEQ ID NO: 295863 - RNA, 19 nt, Human
ugggugugaccaucucugc

SEQ ID NO: 295864 - RNA, 22 nt, Human
gauguguagagggaauuucaaa

SEQ ID NO: 295865 - RNA, 22 nt, Human
aaaaucugcuuccuuuuacaga

SEQ ID NO: 295866 - RNA, 22 nt, Human
caggacaaucucgucggguccu

SEQ ID NO: 295867 - RNA, 22 nt, Human
cuuguauucagaguggacauga

SEQ ID NO: 295868 - RNA, 22 nt, Human
aggaggaaagaaggcccccagc

SEQ ID NO: 295869 - RNA, 22 nt, Human
aagucucuuccucugccaaaga

SEQ ID NO: 295870 - RNA, 22 nt, Human
ggaugggagcagaggacgacca

SEQ ID NO: 295871 - RNA, 22 nt, Human
cccugcagccuugcaugccuuc

SEQ ID NO: 295872 - RNA, 22 nt, Human
aguguccucuauuaugacuuua

SEQ ID NO: 295873 - RNA, 22 nt, Human
gauucagugagggugagaagaa

SEQ ID NO: 295874 - RNA, 22 nt, Human
auaaacaguaaaugugagcagu

SEQ ID NO: 295875 - RNA, 22 nt, Human
agggccccauagucacugcccg

SEQ ID NO: 295876 - RNA, 22 nt, Human
ggcccucugcucacuuccuauu

SEQ ID NO: 295877 - RNA, 22 nt, Human
gguaaaaugcagauucuuagcc

SEQ ID NO: 295878 - RNA, 22 nt, Human
acuccugguucccaguugagau

SEQ ID NO: 295879 - RNA, 22 nt, Human
acagugcugucuaucucacuaa

SEQ ID NO: 295880 - RNA, 21 nt, Human
ucaggaagagccaguucaugc

SEQ ID NO: 295881 - RNA, 22 nt, Human
aguggcagagcugugucuugaa

SEQ ID NO: 295882 - RNA, 22 nt, Human
ucugaaaauguugacuuuguuu

SEQ ID NO: 295883 - RNA, 23 nt, Human
ugcaggugugcagagggcucuug

SEQ ID NO: 295884 - RNA, 22 nt, Human
aaaguuuuagcuguccaguucc

SEQ ID NO: 295885 - RNA, 22 nt, Human
ugacagagcauguagugacagc

SEQ ID NO: 295886 - RNA, 22 nt, Human
ugcuuuauucccuucugaugug

SEQ ID NO: 295887 - RNA, 21 nt, Human
uuucuucacuuugccccaugu

SEQ ID NO: 295888 - RNA, 22 nt, Human
acuuucaugguaguuguauucu

SEQ ID NO: 295889 - RNA, 22 nt, Human
gcuggagguggugagaaaaggu

SEQ ID NO: 295890 - RNA, 22 nt, Human
uggccaggcauucagauaagac

SEQ ID NO: 295891 - RNA, 22 nt, Human
aaagugcuuuaggauauuugga

SEQ ID NO: 295892 - RNA, 22 nt, Human
cagagaaagaagcccauucauu

SEQ ID NO: 295893 - RNA, 22 nt, Human
caaaugaagggagcugaagucu

SEQ ID NO: 295894 - RNA, 22 nt, Human
ugcuggaggaguuuacuguggc

SEQ ID NO: 295895 - RNA, 22 nt, Human
ggcccucuuuuauccaucauaa

SEQ ID NO: 295896 - RNA, 22 nt, Human
aacaaacaguuaaguguggaug

SEQ ID NO: 295897 - RNA, 22 nt, Human
ucucuggggaugcuuauucuug

SEQ ID NO: 295898 - RNA, 22 nt, Human
acccaggguuccugggucccag

SEQ ID NO: 295899 - RNA, 22 nt, Human
ucugccuggaugauggcagggc

SEQ ID NO: 295900 - RNA, 21 nt, Human
acuuuacaauuuacauaguga

SEQ ID NO: 295901 - RNA, 22 nt, Human
ggguuccuccaguuccuagagc

SEQ ID NO: 295902 - RNA, 22 nt, Human
aacagauaaguauaucuaugua

SEQ ID NO: 295903 - RNA, 22 nt, Human
gcuguucacagacucugcucug

SEQ ID NO: 295904 - RNA, 17 nt, Human
acagcagggaaguguug

SEQ ID NO: 295905 - RNA, 21 nt, Human
acagacagggccagugucccc

SEQ ID NO: 295906 - RNA, 22 nt, Human
uuggcugaugcaagagcuuccu

SEQ ID NO: 295907 - RNA, 22 nt, Human
cuguuauuuuccucugaacucu

SEQ ID NO: 295908 - RNA, 22 nt, Human
gcacaauuauuuaugcaguaug

SEQ ID NO: 295909 - RNA, 22 nt, Human
acaggccuuggcaggcauguga

SEQ ID NO: 295910 - RNA, 22 nt, Human
cccaggcaucccauuaaggagc

SEQ ID NO: 295911 - RNA, 22 nt, Human
uagcuuuacaaagugcugcacc

SEQ ID NO: 295912 - RNA, 19 nt, Human
ucuguucacauuguuucgc

SEQ ID NO: 295913 - RNA, 22 nt, Human
auauagaaggugcuauuuacau

SEQ ID NO: 295914 - RNA, 22 nt, Human
guuuuauaggugaaauauuacu

SEQ ID NO: 295915 - RNA, 22 nt, Human
gcaggugggggucggugcaucu

SEQ ID NO: 295916 - RNA, 22 nt, Human
ucaaggaggugcuuggcuucac

SEQ ID NO: 295917 - RNA, 22 nt, Human
uuuguuaaggaguauugcuucu

SEQ ID NO: 295918 - RNA, 22 nt, Human
gcaggacaggcguugguccagu

SEQ ID NO: 295919 - RNA, 21 nt, Human
guccagagagccggcuccuga

SEQ ID NO: 295920 - RNA, 19 nt, Human
uugagcagugcuuagcacc

SEQ ID NO: 295921 - RNA, 22 nt, Human
cucagcaacccuagaacauuug

SEQ ID NO: 295922 - RNA, 22 nt, Human
uuuccauguuggugaaaugagg

SEQ ID NO: 295923 - RNA, 22 nt, Human
uauaaaucuuuguuccuagaau

SEQ ID NO: 295924 - RNA, 22 nt, Human
gucuuuaucuuugaaauuaguc

SEQ ID NO: 295925 - RNA, 22 nt, Human
cacaggugccaucucuucaugg

SEQ ID NO: 295926 - RNA, 22 nt, Human
agggccagaaucccucagucua

SEQ ID NO: 295927 - RNA, 22 nt, Human
cagcugucacuucuaaguuuug

SEQ ID NO: 295928 - RNA, 22 nt, Human
aaauguaguugaaaaguuaagg

SEQ ID NO: 295929 - RNA, 22 nt, Human
aaggucucuguugagaacauuu

SEQ ID NO: 295930 - RNA, 22 nt, Human
ucauggcuuuuucacuguucgc

SEQ ID NO: 295931 - RNA, 22 nt, Human
aagaucagcucccgagucugag

SEQ ID NO: 295932 - RNA, 22 nt, Human
agcacaguuuucauugcagggu

SEQ ID NO: 295933 - RNA, 22 nt, Human
caaagucagccagcuaguaggu

SEQ ID NO: 295934 - RNA, 22 nt, Human
auucaguuagccacagcuauuc

SEQ ID NO: 295935 - RNA, 22 nt, Human
uaauuauucuagucacauagca

SEQ ID NO: 295936 - RNA, 22 nt, Human
cugaggagacagaagccaaaua

SEQ ID NO: 295937 - RNA, 22 nt, Human
aaauuuuaguaaggaaguugag

SEQ ID NO: 295938 - RNA, 22 nt, Human
uggccacaguguccagcagcag

SEQ ID NO: 295939 - RNA, 22 nt, Human
ugcuggcuuuuugguccuugcu

SEQ ID NO: 295940 - RNA, 22 nt, Human
uucagagagaaaccagugggaa

SEQ ID NO: 295941 - RNA, 22 nt, Human
agcagguguuggcugggccauc

SEQ ID NO: 295942 - RNA, 22 nt, Human
gcaggcagccacgauucccuug

SEQ ID NO: 295943 - RNA, 22 nt, Human
gcuccaggcagcauaguggaug

SEQ ID NO: 295944 - RNA, 22 nt, Human
uuuucauuuuuguagaugcaag

SEQ ID NO: 295945 - RNA, 22 nt, Human
ucuggaggcucugagggugagu

SEQ ID NO: 295946 - RNA, 22 nt, Human
uuugcaaagugacuauuauaug

SEQ ID NO: 295947 - RNA, 22 nt, Human
uaggugguuauaaauucaaggc

SEQ ID NO: 295948 - RNA, 23 nt, Human
uccugcagauaagcugguugaca

SEQ ID NO: 295949 - RNA, 22 nt, Human
agagguuguuagaauaguggag

SEQ ID NO: 295950 - RNA, 22 nt, Human
ugucaacacaccuaucucaauu

SEQ ID NO: 295951 - RNA, 22 nt, Human
agcaggugccagguguacccgc

SEQ ID NO: 295952 - RNA, 22 nt, Human
auucuuguuuaauuugcauccc

SEQ ID NO: 295953 - RNA, 22 nt, Human
gcaaguacaaacgcaucggcug

SEQ ID NO: 295954 - RNA, 22 nt, Human
ugucugguggguugacaggcag

SEQ ID NO: 295955 - RNA, 17 nt, Human
aguggcaggcagauggg

SEQ ID NO: 295956 - RNA, 23 nt, Human
uggcucugagagguucagaugcu

SEQ ID NO: 295957 - RNA, 22 nt, Human
uucauuccuucccuaagcaacu

SEQ ID NO: 295958 - RNA, 22 nt, Human
ggcucugaaggagacagcugcu

SEQ ID NO: 295959 - RNA, 22 nt, Human
aggaccaccgguccauccaccc

SEQ ID NO: 295960 - RNA, 17 nt, Human
uuuuguucaucuucaaa

SEQ ID NO: 295961 - RNA, 22 nt, Human
cccaggcuggagggcaguguca

SEQ ID NO: 295962 - RNA, 22 nt, Human
uuauuuaaaauguagguuggga

SEQ ID NO: 295963 - RNA, 20 nt, Human
ucaguuaaguugcugaaucu

SEQ ID NO: 295964 - RNA, 22 nt, Human
caguuugucuugauucagaaca

SEQ ID NO: 295965 - RNA, 22 nt, Human
uuuacagcauugcugaaaguuc

SEQ ID NO: 295966 - RNA, 22 nt, Human
gccaaggauaccagcugugaga

SEQ ID NO: 295967 - RNA, 22 nt, Human
ucuguggcccaagugauggcug

SEQ ID NO: 295968 - RNA, 22 nt, Human
gcuggccuugaggugucuuuau

SEQ ID NO: 295969 - RNA, 22 nt, Human
auacacuuuagaaaaacgcugc

SEQ ID NO: 295970 - RNA, 22 nt, Human
agcugaaacccaggccucagcu

SEQ ID NO: 295971 - RNA, 21 nt, Human
accuucaagccagaggugguc

SEQ ID NO: 295972 - RNA, 17 nt, Human
ugcaaacaaucacauau

SEQ ID NO: 295973 - RNA, 21 nt, Human
cucuuuauauaguaaagauau

SEQ ID NO: 295974 - RNA, 22 nt, Human
ugcagggcagauaugacuguag

SEQ ID NO: 295975 - RNA, 22 nt, Human
ugcugucuuuucccaauccugg

SEQ ID NO: 295976 - RNA, 22 nt, Human
agaagccaauccuugucucucu

SEQ ID NO: 295977 - RNA, 22 nt, Human
cugaaggaagcagguggccugu

SEQ ID NO: 295978 - RNA, 22 nt, Human
uuucaaagaccauuaacuauca

SEQ ID NO: 295979 - RNA, 23 nt, Human
uuugaaguugacugccuuccaga

SEQ ID NO: 295980 - RNA, 20 nt, Human
ucaaagcaaagggagaugau

SEQ ID NO: 295981 - RNA, 22 nt, Human
agugaaaaccuaaucaugcagu

SEQ ID NO: 295982 - RNA, 22 nt, Human
uagggaugggagauucucaaac

SEQ ID NO: 295983 - RNA, 22 nt, Human
gaagccuuaucagucacuuaua

SEQ ID NO: 295984 - RNA, 22 nt, Human
aagcugaauuuucuaaaagaau

SEQ ID NO: 295985 - RNA, 22 nt, Human
aagcacaggaucuugaggagcg

SEQ ID NO: 295986 - RNA, 22 nt, Human
uugauacaggcucuauuucauc

SEQ ID NO: 295987 - RNA, 17 nt, Human
agcuccuggggucuuua

SEQ ID NO: 295988 - RNA, 22 nt, Human
aagaggucauaccagauaaggg

SEQ ID NO: 295989 - RNA, 22 nt, Human
gaaggaagucauuagugcagac

SEQ ID NO: 295990 - RNA, 21 nt, Human
aagugguuuacauccagcugu

SEQ ID NO: 295991 - RNA, 22 nt, Human
aaaacacaagaagcaggguaca

SEQ ID NO: 295992 - RNA, 22 nt, Human
aggacacacaaagagugagaac

SEQ ID NO: 295993 - RNA, 22 nt, Human
gcagcccugcagcuccacaccg

SEQ ID NO: 295994 - RNA, 20 nt, Human
ugcagggccuaaaaagggaa

SEQ ID NO: 295995 - RNA, 22 nt, Human
ugcacaggugagacucaggaag

SEQ ID NO: 295996 - RNA, 22 nt, Human
aagauuuagggccaguuuacau

SEQ ID NO: 295997 - RNA, 22 nt, Human
agagggaucacccuguuucugg

SEQ ID NO: 295998 - RNA, 22 nt, Human
uaauaauuaguuauugaucgug

SEQ ID NO: 295999 - RNA, 22 nt, Human
ucuuaaagagcgcaauuugagg

SEQ ID NO: 296000 - RNA, 22 nt, Human
ccugugacgugucuccuggcac

SEQ ID NO: 296001 - RNA, 22 nt, Human
ugaacuuuuauuugaugacagg

SEQ ID NO: 296002 - RNA, 20 nt, Human
auggaggaagggcaagagaa

SEQ ID NO: 296003 - RNA, 22 nt, Human
ucugaagauggaggaacuuaga

SEQ ID NO: 296004 - RNA, 22 nt, Human
caggaaaugaacaggaaugaac

SEQ ID NO: 296005 - RNA, 22 nt, Human
gaaagaagcuuuagauggcuau

SEQ ID NO: 296006 - RNA, 22 nt, Human
caguuuuaaauuguuagauaau

SEQ ID NO: 296007 - RNA, 22 nt, Human
ggugggaguggaacguggaaga

SEQ ID NO: 296008 - RNA, 22 nt, Human
uguggcagcugcugcaggagcu

SEQ ID NO: 296009 - RNA, 22 nt, Human
cacaguuugguuuugcuguaau

SEQ ID NO: 296010 - RNA, 22 nt, Human
cagggcaguaccgcccucuggc

SEQ ID NO: 296011 - RNA, 22 nt, Human
aacacagcuaauuucugucaau

SEQ ID NO: 296012 - RNA, 22 nt, Human
acuggcagccacaacuggcagg

SEQ ID NO: 296013 - RNA, 22 nt, Human
uaaaauguuugcaagagaccag

SEQ ID NO: 296014 - RNA, 22 nt, Human
uuuuauuaucuuugaaugggac

SEQ ID NO: 296015 - RNA, 22 nt, Human
gacccauauaggacccuccaaa

SEQ ID NO: 296016 - RNA, 19 nt, Human
gggcaaagugaucguccug

SEQ ID NO: 296017 - RNA, 22 nt, Human
ugagguaggugucgagagaggu

SEQ ID NO: 296018 - RNA, 22 nt, Human
agaggcuguuacacucccagau

SEQ ID NO: 296019 - RNA, 22 nt, Human
ucaaagcaugguuuugaaagac

SEQ ID NO: 296020 - RNA, 22 nt, Human
acaugcauaggagaagucuuua

SEQ ID NO: 296021 - RNA, 22 nt, Human
agcuuuaccugccuuggggcac

SEQ ID NO: 296022 - RNA, 19 nt, Human
agugcagggagcacccuca

SEQ ID NO: 296023 - RNA, 22 nt, Human
ucucugugcaggaugcugaguu

SEQ ID NO: 296024 - RNA, 22 nt, Human
cacugggaguacaaagaauggg

SEQ ID NO: 296025 - RNA, 22 nt, Human
guuuauaauccaacucugcucc

SEQ ID NO: 296026 - RNA, 22 nt, Human
uuucagaaauggcacugaaauc

SEQ ID NO: 296027 - RNA, 22 nt, Human
aaaagcaguuuauagucaguug

SEQ ID NO: 296028 - RNA, 22 nt, Human
uccaggcuuuuucaugcugucu

SEQ ID NO: 296029 - RNA, 22 nt, Human
cagagcugagucuucaagguug

SEQ ID NO: 296030 - RNA, 23 nt, Human
accuacauuauagggauaugggu

SEQ ID NO: 296031 - RNA, 22 nt, Human
cagacccugggccacagaggag

SEQ ID NO: 296032 - RNA, 22 nt, Human
gaggugucaugagggccugcuc

SEQ ID NO: 296033 - RNA, 22 nt, Human
ucucuguagagacagcacugug

SEQ ID NO: 296034 - RNA, 22 nt, Human
aagggcagcugacagaugcuua

SEQ ID NO: 296035 - RNA, 22 nt, Human
cugugccaggcccagcugacuu

SEQ ID NO: 296036 - RNA, 22 nt, Human
ucagguggaauuaauuaagaga

SEQ ID NO: 296037 - RNA, 22 nt, Human
uucauagugauuguucagauag

SEQ ID NO: 296038 - RNA, 22 nt, Human
guuauaaaggugauaaugguca

SEQ ID NO: 296039 - RNA, 18 nt, Human
acucugcggaggccccag

SEQ ID NO: 296040 - RNA, 22 nt, Human
gagggcucugaaaggaggucac

SEQ ID NO: 296041 - RNA, 22 nt, Human
uuauucagcauuuagaggaagg

SEQ ID NO: 296042 - RNA, 22 nt, Human
cacauucagggaacauuggagg

SEQ ID NO: 296043 - RNA, 22 nt, Human
aacuggaaugaaauuuacgaug

SEQ ID NO: 296044 - RNA, 18 nt, Human
aucuuuccauagcauguu

SEQ ID NO: 296045 - RNA, 22 nt, Human
ugccucucuaacccaugcccaa

SEQ ID NO: 296046 - RNA, 22 nt, Human
cuccuacaguguuugaguccag

SEQ ID NO: 296047 - RNA, 22 nt, Human
uuuguacauccuaauucugagu

SEQ ID NO: 296048 - RNA, 22 nt, Human
uuauuguaggccuauuguagaa

SEQ ID NO: 296049 - RNA, 19 nt, Human
agcauuuggaauucuacac

SEQ ID NO: 296050 - RNA, 22 nt, Human
aaaaccaggcuugcugugcucg

SEQ ID NO: 296051 - RNA, 22 nt, Human
uuauuagguuuacauaaagguu

SEQ ID NO: 296052 - RNA, 22 nt, Human
ugcaggugucuccagggcaggu

SEQ ID NO: 296053 - RNA, 16 nt, Human
aggaauguggcggaac

SEQ ID NO: 296054 - RNA, 22 nt, Human
agagaauacaaagaagauaugu

SEQ ID NO: 296055 - RNA, 17 nt, Human
acagugucuaugaaaug

SEQ ID NO: 296056 - RNA, 22 nt, Human
aaucuucacagagaaaauuagg

SEQ ID NO: 296057 - RNA, 22 nt, Human
agaagggccagcuggacaccug

SEQ ID NO: 296058 - RNA, 22 nt, Human
gcccaggugcccucugccuuac

SEQ ID NO: 296059 - RNA, 22 nt, Human
uggugcagaugcaggucacugg

SEQ ID NO: 296060 - RNA, 22 nt, Human
ucuuacccggcaacgugugucg

SEQ ID NO: 296061 - RNA, 22 nt, Human
cagacaggcaggugagagcucc

SEQ ID NO: 296062 - RNA, 22 nt, Human
ugauggcuuauggagagagcaa

SEQ ID NO: 296063 - RNA, 22 nt, Human
agguaugccaauuaggucaagu

SEQ ID NO: 296064 - RNA, 22 nt, Human
uauuucuguaugcauaaaagga

SEQ ID NO: 296065 - RNA, 22 nt, Human
ucaguucugcuagaaaaacagu

SEQ ID NO: 296066 - RNA, 22 nt, Human
ugagcaucuuuuuacagguuua

SEQ ID NO: 296067 - RNA, 18 nt, Human
ucagguguuuucuguaua

SEQ ID NO: 296068 - RNA, 22 nt, Human
caaagucauggggaugcagguc

SEQ ID NO: 296069 - RNA, 22 nt, Human
aagacaaugcauuacuaagaag

SEQ ID NO: 296070 - RNA, 18 nt, Human
ucauggcuuuagucccuc

SEQ ID NO: 296071 - RNA, 22 nt, Human
agucauaugacccuucacaaac

SEQ ID NO: 296072 - RNA, 22 nt, Human
ccugagagugagugccaccuua

SEQ ID NO: 296073 - RNA, 22 nt, Human
gggugggaaggcuaagggauug

SEQ ID NO: 296074 - RNA, 22 nt, Human
ccucuaggauguggcuggagga

SEQ ID NO: 296075 - RNA, 21 nt, Human
ugcuggguuugcccaucaggc

SEQ ID NO: 296076 - RNA, 22 nt, Human
gaaaauguuuccuguuauuugc

SEQ ID NO: 296077 - RNA, 22 nt, Human
ucaggugggcguuccggugcgg

SEQ ID NO: 296078 - RNA, 22 nt, Human
uuccagauuucuacacaagacc

SEQ ID NO: 296079 - RNA, 22 nt, Human
ggcagugguuagaaacaugagc

SEQ ID NO: 296080 - RNA, 22 nt, Human
aacuguaagagaauaaaugugu

SEQ ID NO: 296081 - RNA, 19 nt, Human
agugugagacuccaucuca

SEQ ID NO: 296082 - RNA, 22 nt, Human
gcugggucucuggguguaacaa

SEQ ID NO: 296083 - RNA, 22 nt, Human
uucuuguacuggagauacauga

SEQ ID NO: 296084 - RNA, 22 nt, Human
uuucagaaagcaucaucaaagu

SEQ ID NO: 296085 - RNA, 22 nt, Human
uggauuaguuaagaaauguuag

SEQ ID NO: 296086 - RNA, 18 nt, Human
augcaagcuauggauuug

SEQ ID NO: 296087 - RNA, 22 nt, Human
ggguguggcugcgugccaauaa

SEQ ID NO: 296088 - RNA, 22 nt, Human
gguguccucaugauuuucuaga

SEQ ID NO: 296089 - RNA, 20 nt, Human
uccugcagucgcuagcgccc

SEQ ID NO: 296090 - RNA, 22 nt, Human
acuuucugugguuaccagggag

SEQ ID NO: 296091 - RNA, 22 nt, Human
uuauugagcaccuacuaugugu

SEQ ID NO: 296092 - RNA, 22 nt, Human
aucuuagaaguuugauaaaauc

SEQ ID NO: 296093 - RNA, 22 nt, Human
ugcagggcccucauuccugucc

SEQ ID NO: 296094 - RNA, 22 nt, Human
aaaguuuuuaagcaagacccuu

SEQ ID NO: 296095 - RNA, 22 nt, Human
caagugucuucaaaggcuaaaa

SEQ ID NO: 296096 - RNA, 22 nt, Human
acaaaugaaucauacauaaugu

SEQ ID NO: 296097 - RNA, 22 nt, Human
agcuggaggggccagcaggugu

SEQ ID NO: 296098 - RNA, 22 nt, Human
agcaaacacaagagguaauuuc

SEQ ID NO: 296099 - RNA, 21 nt, Human
cugcaggaugcugaagccagg

SEQ ID NO: 296100 - RNA, 20 nt, Human
uagggcucauuaugaucucc

SEQ ID NO: 296101 - RNA, 22 nt, Human
gugcuacuaguuucauuuuuca

SEQ ID NO: 296102 - RNA, 22 nt, Human
acagaugaaacccagcuaguug

SEQ ID NO: 296103 - RNA, 22 nt, Human
agcccagauaaaguacaaccau

SEQ ID NO: 296104 - RNA, 22 nt, Human
agaugaagaugccacuaagacc

SEQ ID NO: 296105 - RNA, 22 nt, Human
gcacccagcccagggcgugaug

SEQ ID NO: 296106 - RNA, 22 nt, Human
agugugagcccuggaguggugc

SEQ ID NO: 296107 - RNA, 22 nt, Human
ucuguauucuauggcaguuggu

SEQ ID NO: 296108 - RNA, 22 nt, Human
ucuuucuucuuucauaguguga

SEQ ID NO: 296109 - RNA, 22 nt, Human
uacacaaugacuuaagauguca

SEQ ID NO: 296110 - RNA, 17 nt, Human
cccaugagcccacuccc

SEQ ID NO: 296111 - RNA, 22 nt, Human
auagcuuuuugucauagagucu

SEQ ID NO: 296112 - RNA, 22 nt, Human
aaguuucaugauguaauuauug

SEQ ID NO: 296113 - RNA, 22 nt, Human
ugacugaaggacuagauugauu

SEQ ID NO: 296114 - RNA, 22 nt, Human
aaacaucuaucagcauuuuuua

SEQ ID NO: 296115 - RNA, 22 nt, Human
uaaaggcuucugcagggacuga

SEQ ID NO: 296116 - RNA, 22 nt, Human
ucaugugucugccaguguuuau

SEQ ID NO: 296117 - RNA, 22 nt, Human
uacaguuuuuauucaugacaag

SEQ ID NO: 296118 - RNA, 22 nt, Human
uuaauaaguaguaguuauuguu

SEQ ID NO: 296119 - RNA, 22 nt, Human
agagccuguuuugugggagaug

SEQ ID NO: 296120 - RNA, 22 nt, Human
uccagggagauacuggcugcca

SEQ ID NO: 296121 - RNA, 22 nt, Human
uuucugaagguuaaggaauuag

SEQ ID NO: 296122 - RNA, 21 nt, Human
acaguucaugauaacuccauc

SEQ ID NO: 296123 - RNA, 22 nt, Human
ugcaggggcuugucugggccug

SEQ ID NO: 296124 - RNA, 22 nt, Human
ucuggcagcucuccucggcgga

SEQ ID NO: 296125 - RNA, 22 nt, Human
agugcucaccugucaggucaag

SEQ ID NO: 296126 - RNA, 22 nt, Human
guauucuuauacucagugagcu

SEQ ID NO: 296127 - RNA, 22 nt, Human
ucauguuugcccuaagaaaaag

SEQ ID NO: 296128 - RNA, 22 nt, Human
ugagcaggcaaacaaugguuau

SEQ ID NO: 296129 - RNA, 22 nt, Human
caggccugucugcacaugaggc

SEQ ID NO: 296130 - RNA, 22 nt, Human
uuguuucagcccagaucuuuac

SEQ ID NO: 296131 - RNA, 23 nt, Human
cucuggguccgauguccugacag

SEQ ID NO: 296132 - RNA, 22 nt, Human
gcccagcagaucucagugucuc

SEQ ID NO: 296133 - RNA, 22 nt, Human
cagaagggcagcacugggaagg

SEQ ID NO: 296134 - RNA, 20 nt, Human
gcagagugugagagggugaa

SEQ ID NO: 296135 - RNA, 22 nt, Human
uggcagggaguugcaggauuuc

SEQ ID NO: 296136 - RNA, 22 nt, Human
ggaugucucccagcaccaaagu

SEQ ID NO: 296137 - RNA, 22 nt, Human
aaagcugcuaugaacauucuau

SEQ ID NO: 296138 - RNA, 22 nt, Human
ggcuuuugaauuccaaggcauu

SEQ ID NO: 296139 - RNA, 22 nt, Human
uguguucaccaaaguguagaaa

SEQ ID NO: 296140 - RNA, 22 nt, Human
uacaaagaguuuggucucuaga

SEQ ID NO: 296141 - RNA, 21 nt, Human
uaagcauaucagauagacucu

SEQ ID NO: 296142 - RNA, 22 nt, Human
uuacauguucucauacacagag

SEQ ID NO: 296143 - RNA, 22 nt, Human
ggcaggcaucauguggucauua

SEQ ID NO: 296144 - RNA, 22 nt, Human
ccuccuggaggcucuagggaaa

SEQ ID NO: 296145 - RNA, 22 nt, Human
uccaggcauuccagccauucca

SEQ ID NO: 296146 - RNA, 22 nt, Human
ccagugucagaaagauuauccu

SEQ ID NO: 296147 - RNA, 22 nt, Human
gcugaggauugaagaguugcca

SEQ ID NO: 296148 - RNA, 16 nt, Human
uccuggccuuuggaag

SEQ ID NO: 296149 - RNA, 22 nt, Human
cagggcagagccaggauuucaa

SEQ ID NO: 296150 - RNA, 22 nt, Human
gacaugugagcaagcgugcggc

SEQ ID NO: 296151 - RNA, 22 nt, Human
agacaggcuuugcuguauauca

SEQ ID NO: 296152 - RNA, 22 nt, Human
uaauuucuaauucauuuucagu

SEQ ID NO: 296153 - RNA, 22 nt, Human
cucaggagcuuccucagcccau

SEQ ID NO: 296154 - RNA, 22 nt, Human
gaggaagaaagcauaggugggg

SEQ ID NO: 296155 - RNA, 20 nt, Human
ggaaaaaugcaugcucaaga

SEQ ID NO: 296156 - RNA, 22 nt, Human
gggugugucuuuugcuccugga

SEQ ID NO: 296157 - RNA, 22 nt, Human
auacagaugggucagauuucau

SEQ ID NO: 296158 - RNA, 22 nt, Human
ucucccacagucucccauggcu

SEQ ID NO: 296159 - RNA, 22 nt, Human
acuccuggaaaagaacgcaggg

SEQ ID NO: 296160 - RNA, 22 nt, Human
gggcuucugcucuuuuggugcu

SEQ ID NO: 296161 - RNA, 22 nt, Human
caugagaaugaagaagacuuaa

SEQ ID NO: 296162 - RNA, 22 nt, Human
uuagcuuuccuacuaauaaaua

SEQ ID NO: 296163 - RNA, 22 nt, Human
ucauguacauguaagucagaaa

SEQ ID NO: 296164 - RNA, 22 nt, Human
caggcuugcuagaggagccaaa

SEQ ID NO: 296165 - RNA, 22 nt, Human
gcaagcaguuguggcuucugag

SEQ ID NO: 296166 - RNA, 22 nt, Human
cccugcagggaggauucugaag

SEQ ID NO: 296167 - RNA, 22 nt, Human
uucuucuuucccccugugguac

SEQ ID NO: 296168 - RNA, 22 nt, Human
uggccaggccggggacagaacu

SEQ ID NO: 296169 - RNA, 22 nt, Human
ugagcagaacacgggauccaug

SEQ ID NO: 296170 - RNA, 22 nt, Human
aggcuuggugccaaggagccug

SEQ ID NO: 296171 - RNA, 22 nt, Human
ugucucaguacacuccgauguu

SEQ ID NO: 296172 - RNA, 19 nt, Human
ugggaaaguaacauacaaa

SEQ ID NO: 296173 - RNA, 22 nt, Human
ucuauaaauuaugcagucucag

SEQ ID NO: 296174 - RNA, 19 nt, Human
gcauaaaaugucaaugugu

SEQ ID NO: 296175 - RNA, 22 nt, Human
gauuaguugauuaagagucaga

SEQ ID NO: 296176 - RNA, 22 nt, Human
ucugucuuagccaucucaggcu

SEQ ID NO: 296177 - RNA, 22 nt, Human
ggggugggcgugcagggacacc

SEQ ID NO: 296178 - RNA, 22 nt, Human
agcagggccugagugaccuaac

SEQ ID NO: 296179 - RNA, 22 nt, Human
augauauuugcaaugugcuugc

SEQ ID NO: 296180 - RNA, 22 nt, Human
aaaauccugcugacucgagaug

SEQ ID NO: 296181 - RNA, 22 nt, Human
aggaaaugcaggcaaauacucu

SEQ ID NO: 296182 - RNA, 22 nt, Human
gaggcagcgggucaggaccgug

SEQ ID NO: 296183 - RNA, 22 nt, Human
uucuggguggccaguauuuaga

SEQ ID NO: 296184 - RNA, 22 nt, Human
auuucaguguugguuagcaagc

SEQ ID NO: 296185 - RNA, 19 nt, Human
guugaaaguaggugagggu

SEQ ID NO: 296186 - RNA, 22 nt, Human
uuaucaguuguguguauacacg

SEQ ID NO: 296187 - RNA, 22 nt, Human
acagauggccauauuacuauau

SEQ ID NO: 296188 - RNA, 22 nt, Human
ucccaggcucuucaaggaagac

SEQ ID NO: 296189 - RNA, 22 nt, Human
guuugcaaauuguguuaaagcu

SEQ ID NO: 296190 - RNA, 22 nt, Human
uucuguuugccauauauaguag

SEQ ID NO: 296191 - RNA, 20 nt, Human
ucuguuauugcauguacaua

SEQ ID NO: 296192 - RNA, 22 nt, Human
cagauggagucccguggaguuc

SEQ ID NO: 296193 - RNA, 22 nt, Human
accaaggaagagauucucaguu

SEQ ID NO: 296194 - RNA, 22 nt, Human
guucuuuaaccuagucucauuu

SEQ ID NO: 296195 - RNA, 22 nt, Human
uuugucuuggccucaguuuucu

SEQ ID NO: 296196 - RNA, 22 nt, Human
uaauuucuggagggagaaagag

SEQ ID NO: 296197 - RNA, 22 nt, Human
gacagggaaacauugaaguguc

SEQ ID NO: 296198 - RNA, 22 nt, Human
uauuuguuucuaguggcagcaa

SEQ ID NO: 296199 - RNA, 20 nt, Human
agguggcucuuccugggcuu

SEQ ID NO: 296200 - RNA, 22 nt, Human
uugaggaguguuuagggugagg

SEQ ID NO: 296201 - RNA, 19 nt, Human
ucuuauugagcagcugagg

SEQ ID NO: 296202 - RNA, 22 nt, Human
agggacccugaugacugaggag

SEQ ID NO: 296203 - RNA, 22 nt, Human
uuguacuuaaauaugcaaauag

SEQ ID NO: 296204 - RNA, 22 nt, Human
gaggagggcaguuccucuuuua

SEQ ID NO: 296205 - RNA, 23 nt, Human
ucagagagcuguugagagcugcc

SEQ ID NO: 296206 - RNA, 22 nt, Human
auuauaugugggauagaauuua

SEQ ID NO: 296207 - RNA, 22 nt, Human
guucuguagucauagagcaauu

SEQ ID NO: 296208 - RNA, 22 nt, Human
uagacaggguggcuuagaaaca

SEQ ID NO: 296209 - RNA, 22 nt, Human
aggaccugcuaaugugccaagu

SEQ ID NO: 296210 - RNA, 19 nt, Human
agugugaguaauuggaguu

SEQ ID NO: 296211 - RNA, 21 nt, Human
cuucuuggggagcagcuagac

SEQ ID NO: 296212 - RNA, 22 nt, Human
cacaagcuccuuauguggagaa

SEQ ID NO: 296213 - RNA, 22 nt, Human
auguuacaauucaaaaugcugc

SEQ ID NO: 296214 - RNA, 22 nt, Human
aagaugauaggacuugcuuaag

SEQ ID NO: 296215 - RNA, 22 nt, Human
auuugcaugcuucuauugugaa

SEQ ID NO: 296216 - RNA, 22 nt, Human
aaugcacauguuguaauaaaua

SEQ ID NO: 296217 - RNA, 22 nt, Human
gacagggaggagcagagcuucu

SEQ ID NO: 296218 - RNA, 22 nt, Human
cucuucuugucucugguuagaa

SEQ ID NO: 296219 - RNA, 22 nt, Human
gaugaggucuacauuguuaaaa

SEQ ID NO: 296220 - RNA, 22 nt, Human
cacaugaguccugccagguaug

SEQ ID NO: 296221 - RNA, 22 nt, Human
uuccccaggggcuccugccuuu

SEQ ID NO: 296222 - RNA, 22 nt, Human
ugcuuuauuggaaccucauccu

SEQ ID NO: 296223 - RNA, 22 nt, Human
uagggcucuggugggcucuguu

SEQ ID NO: 296224 - RNA, 22 nt, Human
guugggaagcagauggaugagc

SEQ ID NO: 296225 - RNA, 22 nt, Human
uaugagcaagaguuugugaagg

SEQ ID NO: 296226 - RNA, 22 nt, Human
auuaaauuggacgcugggggaa

SEQ ID NO: 296227 - RNA, 22 nt, Human
caggggaguuuuaugcaacaga

SEQ ID NO: 296228 - RNA, 22 nt, Human
uauaaauuaaugugcccaugag

SEQ ID NO: 296229 - RNA, 21 nt, Human
aggcuuggguaaaaaggucau

SEQ ID NO: 296230 - RNA, 22 nt, Human
agggucagugaugagggagccc

SEQ ID NO: 296231 - RNA, 22 nt, Human
auucuacacaaagcaagaagac

SEQ ID NO: 296232 - RNA, 22 nt, Human
uucugggugacucacgcucccc

SEQ ID NO: 296233 - RNA, 22 nt, Human
ucaggaaagaguuagaugauua

SEQ ID NO: 296234 - RNA, 19 nt, Human
gucaggcacgugagagcau

SEQ ID NO: 296235 - RNA, 23 nt, Human
uggagcugggcucagacccuggg

SEQ ID NO: 296236 - RNA, 22 nt, Human
ucucucagggggaaggcugaag

SEQ ID NO: 296237 - RNA, 22 nt, Human
ucuucaguauuuggauaacauu

SEQ ID NO: 296238 - RNA, 22 nt, Human
auucuuuccagacacugauugc

SEQ ID NO: 296239 - RNA, 22 nt, Human
ugcugccacauuuaaagagggg

SEQ ID NO: 296240 - RNA, 22 nt, Human
uucuuuuggacucaaagagaac

SEQ ID NO: 296241 - RNA, 22 nt, Human
uuaaauuauuucuagugaggug

SEQ ID NO: 296242 - RNA, 22 nt, Human
uagcuuuuaguacuuaauggcu

SEQ ID NO: 296243 - RNA, 22 nt, Human
cuacaacauuaugcuuucuguc

SEQ ID NO: 296244 - RNA, 22 nt, Human
ccagaggcagacuuacacucca

SEQ ID NO: 296245 - RNA, 22 nt, Human
acuuguuucaacuguacucucc

SEQ ID NO: 296246 - RNA, 22 nt, Human
uagguauacagagauuucuggg

SEQ ID NO: 296247 - RNA, 22 nt, Human
aguacaaauuauagcgcuugga

SEQ ID NO: 296248 - RNA, 22 nt, Human
gcuggcaguuuccucaccgagg

SEQ ID NO: 296249 - RNA, 22 nt, Human
ugcagggcuauaacuccauucu

SEQ ID NO: 296250 - RNA, 22 nt, Human
uaggaaauuugaaauauguggg

SEQ ID NO: 296251 - RNA, 22 nt, Human
uuugggaugcuagacaccucag

SEQ ID NO: 296252 - RNA, 22 nt, Human
uccugggcccaggcugccaggg

SEQ ID NO: 296253 - RNA, 22 nt, Human
uuauugaguaucugcuuggugu

SEQ ID NO: 296254 - RNA, 22 nt, Human
gguaggggaagacaagugaaaa

SEQ ID NO: 296255 - RNA, 22 nt, Human
ucuuuucugccacagccugagc

SEQ ID NO: 296256 - RNA, 22 nt, Human
gaggggcaaugagggaaagagu

SEQ ID NO: 296257 - RNA, 22 nt, Human
uagaaauggagaacagauuaau

SEQ ID NO: 296258 - RNA, 22 nt, Human
uaaagcauaaugaauaucuaga

SEQ ID NO: 296259 - RNA, 22 nt, Human
gcuguggcucucacaagcaaau

SEQ ID NO: 296260 - RNA, 22 nt, Human
gaauguaaaauugccuacaaga

SEQ ID NO: 296261 - RNA, 22 nt, Human
aacagacaacuccuguggcuca

SEQ ID NO: 296262 - RNA, 22 nt, Human
acauuuaaugauccuacuguga

SEQ ID NO: 296263 - RNA, 22 nt, Human
ucucaguguggugcuuaggaua

SEQ ID NO: 296264 - RNA, 22 nt, Human
agaguggcagcaagucagguag

SEQ ID NO: 296265 - RNA, 19 nt, Human
auucuuggugcaccuugua

SEQ ID NO: 296266 - RNA, 23 nt, Human
ugcuggcuuccagcugcucccuc

SEQ ID NO: 296267 - RNA, 22 nt, Human
cuccugaggaaaagcuugguca

SEQ ID NO: 296268 - RNA, 20 nt, Human
aggcuuggcuuggcaggaac

SEQ ID NO: 296269 - RNA, 22 nt, Human
caguucuggaggauagaagucu

SEQ ID NO: 296270 - RNA, 22 nt, Human
ugaaagcuuguuggaaauguag

SEQ ID NO: 296271 - RNA, 22 nt, Human
uggugcagagagggaucuaggg

SEQ ID NO: 296272 - RNA, 22 nt, Human
cuggagggcuggacuaaggaaa

SEQ ID NO: 296273 - RNA, 22 nt, Human
uggcuaggaauccaugacucuc

SEQ ID NO: 296274 - RNA, 22 nt, Human
gcuucacagaaucaauaguugg

SEQ ID NO: 296275 - RNA, 19 nt, Human
ucccaggaagcaaauguca

SEQ ID NO: 296276 - RNA, 22 nt, Human
gaaguucaacugccaugcuugg

SEQ ID NO: 296277 - RNA, 22 nt, Human
gucuauauauugcuugaauaau

SEQ ID NO: 296278 - RNA, 22 nt, Human
auguuaaaugguuuauuauuaa

SEQ ID NO: 296279 - RNA, 22 nt, Human
uucuucugacacugaugcugua

SEQ ID NO: 296280 - RNA, 22 nt, Human
ccauuuguuguguauuaauauu

SEQ ID NO: 296281 - RNA, 22 nt, Human
ugaggacauuaggaagugaagg

SEQ ID NO: 296282 - RNA, 22 nt, Human
uggcuugguccuggcccuuccc

SEQ ID NO: 296283 - RNA, 22 nt, Human
gauuuugucaaauuccaaaugu

SEQ ID NO: 296284 - RNA, 22 nt, Human
caaguuuuagcaaguggaaagg

SEQ ID NO: 296285 - RNA, 22 nt, Human
ugacauuuuuaaaaccacuagu

SEQ ID NO: 296286 - RNA, 21 nt, Human
agaaaauggcguuuuagauuu

SEQ ID NO: 296287 - RNA, 22 nt, Human
gcagagaguugggcugcgccag

SEQ ID NO: 296288 - RNA, 22 nt, Human
ucauacaacuaagaguuucaga

SEQ ID NO: 296289 - RNA, 23 nt, Human
uccaggcaugagcucuggaugga

SEQ ID NO: 296290 - RNA, 19 nt, Human
acaaaugauguugcacuga

SEQ ID NO: 296291 - RNA, 22 nt, Human
ucucuggggccuuucuacauca

SEQ ID NO: 296292 - RNA, 22 nt, Human
uccuggacagauccccaucauc

SEQ ID NO: 296293 - RNA, 22 nt, Human
uggagggcuaagcugagggaua

SEQ ID NO: 296294 - RNA, 22 nt, Human
uuuacagucugucuagcaaugu

SEQ ID NO: 296295 - RNA, 22 nt, Human
cucuguauagaaaggaaacauu

SEQ ID NO: 296296 - RNA, 22 nt, Human
aaaccuuuucagcugaauggag

SEQ ID NO: 296297 - RNA, 22 nt, Human
gagggcuccacacgggcccagc

SEQ ID NO: 296298 - RNA, 22 nt, Human
aauuagggaaguauuuaguagu

SEQ ID NO: 296299 - RNA, 17 nt, Human
uuuagaauacaauguuu

SEQ ID NO: 296300 - RNA, 22 nt, Human
aguuauuucaguaacauaauag

SEQ ID NO: 296301 - RNA, 22 nt, Human
uauuucugaggcccaggaagug

SEQ ID NO: 296302 - RNA, 18 nt, Human
agcaugagagaggcugug

SEQ ID NO: 296303 - RNA, 22 nt, Human
aaaaugagacacaugugacucc

SEQ ID NO: 296304 - RNA, 22 nt, Human
uggaagaauaggauagaagaac

SEQ ID NO: 296305 - RNA, 22 nt, Human
gcgcaccaccuccagguggccg

SEQ ID NO: 296306 - RNA, 22 nt, Human
uuccuggccaagcagaguggaa

SEQ ID NO: 296307 - RNA, 22 nt, Human
aggacaagcuaaaggacuuccu

SEQ ID NO: 296308 - RNA, 22 nt, Human
ugucccagcacuuugggagucu

SEQ ID NO: 296309 - RNA, 22 nt, Human
uauuuaacuggaaacacaauga

SEQ ID NO: 296310 - RNA, 22 nt, Human
aaaagguuuugaguacaaauau

SEQ ID NO: 296311 - RNA, 22 nt, Human
ucagcuuucucuucuaucgaua

SEQ ID NO: 296312 - RNA, 21 nt, Human
ucagguggcagaguguuuaug

SEQ ID NO: 296313 - RNA, 22 nt, Human
ggcaggugagagcucuuugaaa

SEQ ID NO: 296314 - RNA, 22 nt, Human
guuucucacuuaccaacacaug

SEQ ID NO: 296315 - RNA, 22 nt, Human
accuucugaccaguuaucuuga

SEQ ID NO: 296316 - RNA, 23 nt, Human
agcuccuguaagguggucgucac

SEQ ID NO: 296317 - RNA, 22 nt, Human
ucuguggcugguaauugcaugu

SEQ ID NO: 296318 - RNA, 22 nt, Human
cuccuucugaggcucuggguuc

SEQ ID NO: 296319 - RNA, 22 nt, Human
aauuguaagugcugaguuaagg

SEQ ID NO: 296320 - RNA, 22 nt, Human
ucuagaaacaugacauugaucu

SEQ ID NO: 296321 - RNA, 22 nt, Human
agcucccaauugacuugaacua

SEQ ID NO: 296322 - RNA, 22 nt, Human
augaaggacaacaggggagcag

SEQ ID NO: 296323 - RNA, 22 nt, Human
cuggauccuucucuguguauuu

SEQ ID NO: 296324 - RNA, 22 nt, Human
acuucauuguaauauuauagca

SEQ ID NO: 296325 - RNA, 22 nt, Human
uggcucucaauggcuguacuau

SEQ ID NO: 296326 - RNA, 22 nt, Human
ugaaagcacucacuucugcucu

SEQ ID NO: 296327 - RNA, 22 nt, Human
uccugugucaauuccucauucu

SEQ ID NO: 296328 - RNA, 22 nt, Human
aaaucuuucccuuuacuaucca

SEQ ID NO: 296329 - RNA, 22 nt, Human
aagaauaaguagaugggagaag

SEQ ID NO: 296330 - RNA, 23 nt, Human
gguccacccgagccugcagcuuc

SEQ ID NO: 296331 - RNA, 22 nt, Human
cucccuggaggcccagaccugg

SEQ ID NO: 296332 - RNA, 22 nt, Human
uauguuuaguauccauuuucag

SEQ ID NO: 296333 - RNA, 18 nt, Human
cagaugagaugcaaucuc

SEQ ID NO: 296334 - RNA, 22 nt, Human
uuguguguagacucagccauug

SEQ ID NO: 296335 - RNA, 22 nt, Human
uagggauguggugagaacugag

SEQ ID NO: 296336 - RNA, 22 nt, Human
acuacauuuccugaccccugug

SEQ ID NO: 296337 - RNA, 22 nt, Human
uuuccaagacuccaguucuccc

SEQ ID NO: 296338 - RNA, 22 nt, Human
ucaugcaguuucuuaucugcca

SEQ ID NO: 296339 - RNA, 22 nt, Human
gguguugggcucacugguccuu

SEQ ID NO: 296340 - RNA, 21 nt, Human
agguacuaaugaaaagugauu

SEQ ID NO: 296341 - RNA, 22 nt, Human
ucccaaaguauuagcauuucaa

SEQ ID NO: 296342 - RNA, 23 nt, Human
uucagaagaaaugaguacaggag

SEQ ID NO: 296343 - RNA, 22 nt, Human
aggcaggugagucaaaacagac

SEQ ID NO: 296344 - RNA, 22 nt, Human
uggcuggaggguuagugagaua

SEQ ID NO: 296345 - RNA, 22 nt, Human
guuuauuagaguuuucugucug

SEQ ID NO: 296346 - RNA, 23 nt, Human
auauuagggagauuagcccucua

SEQ ID NO: 296347 - RNA, 22 nt, Human
cuuguccccagcagguugguuu

SEQ ID NO: 296348 - RNA, 22 nt, Human
uugcuauuuccugaaauaagca

SEQ ID NO: 296349 - RNA, 20 nt, Human
auuucaguguuugcaauuuc

SEQ ID NO: 296350 - RNA, 22 nt, Human
uaguuauauccagucuuuaaaa

SEQ ID NO: 296351 - RNA, 18 nt, Human
agaagccugccucaaugc

SEQ ID NO: 296352 - RNA, 22 nt, Human
gugcaggguagcgacggcagga

SEQ ID NO: 296353 - RNA, 22 nt, Human
agggauggaagcucgucugcaa

SEQ ID NO: 296354 - RNA, 22 nt, Human
agugugaguuacaaagugugaa

SEQ ID NO: 296355 - RNA, 22 nt, Human
acaugugugacaacagagguga

SEQ ID NO: 296356 - RNA, 22 nt, Human
uagaaaauagggccuguggagc

SEQ ID NO: 296357 - RNA, 22 nt, Human
agaaucuaaguacacagacaga

SEQ ID NO: 296358 - RNA, 22 nt, Human
uggcuguagaacaguggauauu

SEQ ID NO: 296359 - RNA, 19 nt, Human
ugacagagagcaggguggu

SEQ ID NO: 296360 - RNA, 22 nt, Human
ggaucuuuaaguucuuuuccau

SEQ ID NO: 296361 - RNA, 22 nt, Human
aagucuaaccuauuccgguguu

SEQ ID NO: 296362 - RNA, 22 nt, Human
cccaggcagucuggcucuaaag

SEQ ID NO: 296363 - RNA, 17 nt, Human
uguagcuucuccuucuc

SEQ ID NO: 296364 - RNA, 22 nt, Human
gauuuuacaugucauaucuauu

SEQ ID NO: 296365 - RNA, 22 nt, Human
ccagguguguacagaacagcac

SEQ ID NO: 296366 - RNA, 22 nt, Human
aagggacccuggaucaaaugga

SEQ ID NO: 296367 - RNA, 22 nt, Human
uaacuucuggaaaugcaucugc

SEQ ID NO: 296368 - RNA, 22 nt, Human
uagggaugagccaguggguagu

SEQ ID NO: 296369 - RNA, 19 nt, Human
agaggccucagcagcuggc

SEQ ID NO: 296370 - RNA, 22 nt, Human
agucaguugcaguuuauggaug

SEQ ID NO: 296371 - RNA, 22 nt, Human
auauaauucucagguuugacua

SEQ ID NO: 296372 - RNA, 22 nt, Human
ccagagagauugcuucuaaaga

SEQ ID NO: 296373 - RNA, 19 nt, Human
uuccugugcugcugugucc

SEQ ID NO: 296374 - RNA, 17 nt, Human
ucuggaugucauggaag

SEQ ID NO: 296375 - RNA, 22 nt, Human
aaauccuaaaaguuugacuuaa

SEQ ID NO: 296376 - RNA, 22 nt, Human
aggaggaaaaaggccacagcaa

SEQ ID NO: 296377 - RNA, 22 nt, Human
uguaaauaaugcauguaaauca

SEQ ID NO: 296378 - RNA, 21 nt, Human
uaucaagauguuaugguugaa

SEQ ID NO: 296379 - RNA, 20 nt, Human
uuucuugucggcuguugcug

SEQ ID NO: 296380 - RNA, 22 nt, Human
agagggcauaaaauagagcacg

SEQ ID NO: 296381 - RNA, 22 nt, Human
uauuugaaggcauacauuuuga

SEQ ID NO: 296382 - RNA, 22 nt, Human
acaguucugcaagauauuuuuu

SEQ ID NO: 296383 - RNA, 22 nt, Human
agggauguugucaaggaugugg

SEQ ID NO: 296384 - RNA, 22 nt, Human
gauguuaagaaggaauugaagu

SEQ ID NO: 296385 - RNA, 22 nt, Human
uuucucugugccauuuccauaa

SEQ ID NO: 296386 - RNA, 22 nt, Human
ccagagaggccaaggucguggu

SEQ ID NO: 296387 - RNA, 22 nt, Human
caggugguacuuaaagucagaa

SEQ ID NO: 296388 - RNA, 17 nt, Human
cauccgugagcucggca

SEQ ID NO: 296389 - RNA, 22 nt, Human
uaggugguagagccuggcuugc

SEQ ID NO: 296390 - RNA, 22 nt, Human
guguccucuuauugcucuuggc

SEQ ID NO: 296391 - RNA, 20 nt, Human
ugcaaacauuacuugggugu

SEQ ID NO: 296392 - RNA, 22 nt, Human
aauuuguuacacagcaauauaa

SEQ ID NO: 296393 - RNA, 22 nt, Human
ugucucaggcccaagccaguaa

SEQ ID NO: 296394 - RNA, 22 nt, Human
gcucagaggagcaucauaagga

SEQ ID NO: 296395 - RNA, 22 nt, Human
uccauugugauuauauacaaaa

SEQ ID NO: 296396 - RNA, 22 nt, Human
ucagaaaagagaaaaucuuaua

SEQ ID NO: 296397 - RNA, 22 nt, Human
ccauggcagccuggccuggcuu

SEQ ID NO: 296398 - RNA, 22 nt, Human
uaaauguuaugcccaucaucca

SEQ ID NO: 296399 - RNA, 23 nt, Human
uuucucauccagagagucagucc

SEQ ID NO: 296400 - RNA, 22 nt, Human
aguccuuuuguuuugagaugag

SEQ ID NO: 296401 - RNA, 22 nt, Human
cuguccuggugcuggggauccc

SEQ ID NO: 296402 - RNA, 22 nt, Human
ucuguuuauucaauuucuauau

SEQ ID NO: 296403 - RNA, 20 nt, Human
caugguggaggagcagggcc

SEQ ID NO: 296404 - RNA, 22 nt, Human
gguguucaaaugaacacaugca

SEQ ID NO: 296405 - RNA, 22 nt, Human
ucuguucagaauuguaacacuc

SEQ ID NO: 296406 - RNA, 22 nt, Human
uuaguuaguggggcugucaguc

SEQ ID NO: 296407 - RNA, 22 nt, Human
agacagacggcuuuauacacag

SEQ ID NO: 296408 - RNA, 20 nt, Human
ucuccuggugacaguaccca

SEQ ID NO: 296409 - RNA, 23 nt, Human
cuguggcugaguccuguuggagu

SEQ ID NO: 296410 - RNA, 22 nt, Human
ucagguguuagaagaaauuuca

SEQ ID NO: 296411 - RNA, 22 nt, Human
aaacaaauuucaagcugugaca

SEQ ID NO: 296412 - RNA, 22 nt, Human
uacacaaucuguuuuuccauuu

SEQ ID NO: 296413 - RNA, 22 nt, Human
cucuucaauagauuguugaggg

SEQ ID NO: 296414 - RNA, 19 nt, Human
uguacaaggauuaugcagg

SEQ ID NO: 296415 - RNA, 22 nt, Human
ggcuuuauuaacucauccguaa

SEQ ID NO: 296416 - RNA, 22 nt, Human
ccucucccgggugccgcugggc

SEQ ID NO: 296417 - RNA, 22 nt, Human
ugcucccacacuacucggaggc

SEQ ID NO: 296418 - RNA, 22 nt, Human
gccagcaguccugcugugugcc

SEQ ID NO: 296419 - RNA, 22 nt, Human
cagauucuccaggggcugcaga

SEQ ID NO: 296420 - RNA, 22 nt, Human
cugaggcuggggaagggaagug

SEQ ID NO: 296421 - RNA, 22 nt, Human
aagaaauggaagauccauggug

SEQ ID NO: 296422 - RNA, 20 nt, Human
gggagaagggcugaugagag

SEQ ID NO: 296423 - RNA, 21 nt, Human
uuccuggcggcagaaacguga

SEQ ID NO: 296424 - RNA, 22 nt, Human
uuauucugcacuuuuaaaauau

SEQ ID NO: 296425 - RNA, 21 nt, Human
caugugucuuguguuacugcu

SEQ ID NO: 296426 - RNA, 22 nt, Human
ccuggcagcauugguagagauu

SEQ ID NO: 296427 - RNA, 22 nt, Human
aggacaguguggaagagggugc

SEQ ID NO: 296428 - RNA, 22 nt, Human
augaggcacguguuacuggccu

SEQ ID NO: 296429 - RNA, 22 nt, Human
agaggugggagccuggucacau

SEQ ID NO: 296430 - RNA, 22 nt, Human
ugaggggccgcccaagcacuuc

SEQ ID NO: 296431 - RNA, 22 nt, Human
auacuucuagaaauacuaugca

SEQ ID NO: 296432 - RNA, 23 nt, Human
aaggccagaauuucaauggugcc

SEQ ID NO: 296433 - RNA, 23 nt, Human
ccauaaucaggguuguggggucc

SEQ ID NO: 296434 - RNA, 22 nt, Human
guauuaggugguggaauuguag

SEQ ID NO: 296435 - RNA, 22 nt, Human
uauacacauuuuuaccuauagu

SEQ ID NO: 296436 - RNA, 22 nt, Human
gguucaguggaauguguugacc

SEQ ID NO: 296437 - RNA, 22 nt, Human
ccugagagugcgugccuccuua

SEQ ID NO: 296438 - RNA, 22 nt, Human
guccacagagggcugggcaggc

SEQ ID NO: 296439 - RNA, 22 nt, Human
gcugcucucagagcucaugcug

SEQ ID NO: 296440 - RNA, 22 nt, Human
acacaaugcauauuuuuccaga

SEQ ID NO: 296441 - RNA, 22 nt, Human
agcaggugaucgcgugugcucc

SEQ ID NO: 296442 - RNA, 22 nt, Human
uguuacaagucuugagguacuu

SEQ ID NO: 296443 - RNA, 22 nt, Human
ugggcaggaugcguugauucuu

SEQ ID NO: 296444 - RNA, 22 nt, Human
gcccagggugaagugcaguugu

SEQ ID NO: 296445 - RNA, 22 nt, Human
uucuuucugaauacaguugagu

SEQ ID NO: 296446 - RNA, 22 nt, Human
acaacaggguaaggcaggccau

SEQ ID NO: 296447 - RNA, 22 nt, Human
uucuucuugucugcccucacau

SEQ ID NO: 296448 - RNA, 22 nt, Human
gggcucucaaggcagggcccca

SEQ ID NO: 296449 - RNA, 22 nt, Human
aauggcacuuuauaaauguuaa

SEQ ID NO: 296450 - RNA, 22 nt, Human
cagugcaggcuuguggccgcag

SEQ ID NO: 296451 - RNA, 22 nt, Human
ugaaagauaaguuauuauguac

SEQ ID NO: 296452 - RNA, 22 nt, Human
uuauuaagugcguacuguaugc

SEQ ID NO: 296453 - RNA, 23 nt, Human
auuuuacaggucaguuccuugaa

SEQ ID NO: 296454 - RNA, 22 nt, Human
aggccagggccagauuagccac

SEQ ID NO: 296455 - RNA, 22 nt, Human
uauguauucucagauuuacuaa

SEQ ID NO: 296456 - RNA, 22 nt, Human
ggucucagagguuucugcucag

SEQ ID NO: 296457 - RNA, 22 nt, Human
uggcagugugggaggaagguac

SEQ ID NO: 296458 - RNA, 22 nt, Human
caggcacaaauuucuagauaag

SEQ ID NO: 296459 - RNA, 22 nt, Human
caguccugaggaagagcugcug

SEQ ID NO: 296460 - RNA, 22 nt, Human
gcagcuuucuaagcuuuauugc

SEQ ID NO: 296461 - RNA, 22 nt, Human
uugcuguaaguaucuuucuacc

SEQ ID NO: 296462 - RNA, 22 nt, Human
ucuggcagaagugcugucagua

SEQ ID NO: 296463 - RNA, 22 nt, Human
cuggauguaacgaagguuucac

SEQ ID NO: 296464 - RNA, 22 nt, Human
gucuucaacaauaacuaccacu

SEQ ID NO: 296465 - RNA, 22 nt, Human
ucucagaagugaucaggauguu

SEQ ID NO: 296466 - RNA, 22 nt, Human
gagcagugccaaagaauuugcg

SEQ ID NO: 296467 - RNA, 22 nt, Human
accuguuuguguccauuaguga

SEQ ID NO: 296468 - RNA, 22 nt, Human
aauugcuuuaguuaccauagug

SEQ ID NO: 296469 - RNA, 22 nt, Human
caggucuccauuuugaugaguu

SEQ ID NO: 296470 - RNA, 22 nt, Human
aagugugaauuuuagagucagg

SEQ ID NO: 296471 - RNA, 23 nt, Human
cauaaaauauuaguaugguagca

SEQ ID NO: 296472 - RNA, 21 nt, Human
caagccagaccaauagcagcc

SEQ ID NO: 296473 - RNA, 22 nt, Human
acuugaaacaucuuuaaaugua

SEQ ID NO: 296474 - RNA, 22 nt, Human
gagguucacuuccugaaauagc

SEQ ID NO: 296475 - RNA, 22 nt, Human
acaaauuuauugaagggcauau

SEQ ID NO: 296476 - RNA, 22 nt, Human
caucagugcccuuggggaugcc

SEQ ID NO: 296477 - RNA, 22 nt, Human
uggaggaaguugcuggaaguca

SEQ ID NO: 296478 - RNA, 22 nt, Human
aaaagucugcucucauuucaga

SEQ ID NO: 296479 - RNA, 22 nt, Human
acagagagggagugauaaaucc

SEQ ID NO: 296480 - RNA, 22 nt, Human
gcucugagugaucagcugggaa

SEQ ID NO: 296481 - RNA, 22 nt, Human
agggacagucuacuguucacug

SEQ ID NO: 296482 - RNA, 20 nt, Human
agcaccucccauaugcuaga

SEQ ID NO: 296483 - RNA, 22 nt, Human
agggggcccuugcaggugagcg

SEQ ID NO: 296484 - RNA, 22 nt, Human
aagucucuuuggguacuuuauu

SEQ ID NO: 296485 - RNA, 22 nt, Human
gcucccuccaugaggcagaccg

SEQ ID NO: 296486 - RNA, 22 nt, Human
auccaaaauuuacuguagcauu

SEQ ID NO: 296487 - RNA, 22 nt, Human
gcacugcaucuacuggcaagua

SEQ ID NO: 296488 - RNA, 22 nt, Human
cuuucuucaucaagugccacgu

SEQ ID NO: 296489 - RNA, 22 nt, Human
ugcuugaacaaggauaaauuug

SEQ ID NO: 296490 - RNA, 22 nt, Human
cuggggggcuacugacagagga

SEQ ID NO: 296491 - RNA, 22 nt, Human
ccagcuuuugcacuggacuggg

SEQ ID NO: 296492 - RNA, 22 nt, Human
cauaauaucuccgauuacuugc

SEQ ID NO: 296493 - RNA, 22 nt, Human
gacugucuuguuucuaagauga

SEQ ID NO: 296494 - RNA, 18 nt, Human
uuccuucugauguauaug

SEQ ID NO: 296495 - RNA, 23 nt, Human
uguuuuucauucacaugggcugu

SEQ ID NO: 296496 - RNA, 22 nt, Human
uggcuggagagggucccaugag

SEQ ID NO: 296497 - RNA, 22 nt, Human
uccaugcagaggagcugguggc

SEQ ID NO: 296498 - RNA, 22 nt, Human
uuccaggccgggcaggaaacac

SEQ ID NO: 296499 - RNA, 22 nt, Human
ugggacacagaaaaggcagguu

SEQ ID NO: 296500 - RNA, 22 nt, Human
gacuuccuaagauucaggaaug

SEQ ID NO: 296501 - RNA, 22 nt, Human
cugcaucuguuagauuaucacc

SEQ ID NO: 296502 - RNA, 22 nt, Human
aagucguggcaggcuugcacga

SEQ ID NO: 296503 - RNA, 22 nt, Human
auuccuucuaaaacgcugcccu

SEQ ID NO: 296504 - RNA, 22 nt, Human
gauuuaaaguagaccuuuguuu

SEQ ID NO: 296505 - RNA, 22 nt, Human
gauggaaugaauggcagauaca

SEQ ID NO: 296506 - RNA, 22 nt, Human
uccugcagagucccacugauuu

SEQ ID NO: 296507 - RNA, 22 nt, Human
cauggaauuuucuaggcauaaa

SEQ ID NO: 296508 - RNA, 22 nt, Human
cagaguggugcaagggcagugu

SEQ ID NO: 296509 - RNA, 22 nt, Human
uucuuguauguaugcaaaauca

SEQ ID NO: 296510 - RNA, 22 nt, Human
uccugugaguagauaguauugu

SEQ ID NO: 296511 - RNA, 22 nt, Human
uuuaagagcuaguaugucauuu

SEQ ID NO: 296512 - RNA, 22 nt, Human
cauggcucacaggaugggcuag

SEQ ID NO: 296513 - RNA, 22 nt, Human
uuccuguguguugguggcagaa

SEQ ID NO: 296514 - RNA, 20 nt, Human
gagggcucguggauggauaa

SEQ ID NO: 296515 - RNA, 22 nt, Human
cuguccuguggugacagguaca

SEQ ID NO: 296516 - RNA, 20 nt, Human
ggcaggaccccaguggcauc

SEQ ID NO: 296517 - RNA, 19 nt, Human
aaaugugaugguacaauuc

SEQ ID NO: 296518 - RNA, 19 nt, Human
ccuguucaugacucugucc

SEQ ID NO: 296519 - RNA, 22 nt, Human
cagaaaggacagagugagggug

SEQ ID NO: 296520 - RNA, 22 nt, Human
ucuguggcaugguaucuggagg

SEQ ID NO: 296521 - RNA, 22 nt, Human
ucuccacagucccaccucgcuu

SEQ ID NO: 296522 - RNA, 22 nt, Human
agggaugguggaggaauuucaa

SEQ ID NO: 296523 - RNA, 22 nt, Human
uucuucuaaaugugcuuauuaa

SEQ ID NO: 296524 - RNA, 22 nt, Human
uauggcuucugggccaaauuua

SEQ ID NO: 296525 - RNA, 22 nt, Human
uguccauggagaagcucagggc

SEQ ID NO: 296526 - RNA, 22 nt, Human
acccaggguuugagcucugcag

SEQ ID NO: 296527 - RNA, 22 nt, Human
acagguggcauaggcaguuuga

SEQ ID NO: 296528 - RNA, 22 nt, Human
agcccuagagaaccagccugug

SEQ ID NO: 296529 - RNA, 22 nt, Human
aacacaaagaagcugcaggauc

SEQ ID NO: 296530 - RNA, 22 nt, Human
agagcacagccaccauuuacaa

SEQ ID NO: 296531 - RNA, 22 nt, Human
uggcugugucccuguccagagu

SEQ ID NO: 296532 - RNA, 22 nt, Human
gcacuuuguggauuguauuucc

SEQ ID NO: 296533 - RNA, 22 nt, Human
gcagcuuuguaaaguaugaagc

SEQ ID NO: 296534 - RNA, 22 nt, Human
auuuaauuuacauuugacagag

SEQ ID NO: 296535 - RNA, 22 nt, Human
uaucagcaacucagagcagucu

SEQ ID NO: 296536 - RNA, 22 nt, Human
caggaggcaguggguguugucu

SEQ ID NO: 296537 - RNA, 22 nt, Human
ugagguggccgaggagcaggac

SEQ ID NO: 296538 - RNA, 22 nt, Human
ugcaggugguuuggacacugcu

SEQ ID NO: 296539 - RNA, 22 nt, Human
ugcagggccuuguugaugugcu

SEQ ID NO: 296540 - RNA, 22 nt, Human
guguccugguuccuuguggcug

SEQ ID NO: 296541 - RNA, 22 nt, Human
acuguccuggagcucacacucu

SEQ ID NO: 296542 - RNA, 18 nt, Human
cuccuccacagccccugc

SEQ ID NO: 296543 - RNA, 22 nt, Human
uuuaaaauuuagaccucuccac

SEQ ID NO: 296544 - RNA, 22 nt, Human
ugccucaguuucaucugcagaa

SEQ ID NO: 296545 - RNA, 22 nt, Human
ucuccuggcucaccaggcugga

SEQ ID NO: 296546 - RNA, 22 nt, Human
cauuuguucaaccauucucgcu

SEQ ID NO: 296547 - RNA, 22 nt, Human
cagguuggucggcaaguacaca

SEQ ID NO: 296548 - RNA, 22 nt, Human
gagaggcuggguuggagaucga

SEQ ID NO: 296549 - RNA, 22 nt, Human
gaaaacacuuugaucugaaagu

SEQ ID NO: 296550 - RNA, 22 nt, Human
uuuaucuauuguauuguugaug

SEQ ID NO: 296551 - RNA, 22 nt, Human
uagcaaagaaccugauacccca

SEQ ID NO: 296552 - RNA, 22 nt, Human
aauugcuugaugacuaguaauu

SEQ ID NO: 296553 - RNA, 22 nt, Human
ucuuauugucuagauugagaug

SEQ ID NO: 296554 - RNA, 21 nt, Human
cucaaaauucuuucuguugga

SEQ ID NO: 296555 - RNA, 22 nt, Human
guggcacaaggcuuacacagca

SEQ ID NO: 296556 - RNA, 22 nt, Human
gggagcugagcuggaagagaau

SEQ ID NO: 296557 - RNA, 22 nt, Human
uccugcagaccucagucagguc

SEQ ID NO: 296558 - RNA, 22 nt, Human
ugcacuuuaaaaaauggugaug

SEQ ID NO: 296559 - RNA, 22 nt, Human
gagaggcuggcagugccagguu

SEQ ID NO: 296560 - RNA, 22 nt, Human
agaggcaaaaaucuauggcaac

SEQ ID NO: 296561 - RNA, 22 nt, Human
ucagagaggauuuuaauaagug

SEQ ID NO: 296562 - RNA, 22 nt, Human
ggcuguggcagcuggaaguggu

SEQ ID NO: 296563 - RNA, 22 nt, Human
ggaggucaaauggagggcuggg

SEQ ID NO: 296564 - RNA, 22 nt, Human
uauggcuucuuuugcaacuacu

SEQ ID NO: 296565 - RNA, 21 nt, Human
agcagacacuugugaccuucc

SEQ ID NO: 296566 - RNA, 22 nt, Human
cagcuugaaauauuaggagaug

SEQ ID NO: 296567 - RNA, 22 nt, Human
guagggacuguucucaccugag

SEQ ID NO: 296568 - RNA, 22 nt, Human
aaggaaagauucucucucuaga

SEQ ID NO: 296569 - RNA, 22 nt, Human
ccuggcagguagcauugaggag

SEQ ID NO: 296570 - RNA, 21 nt, Human
accaaaaccuauacuuucugu

SEQ ID NO: 296571 - RNA, 22 nt, Human
uaaggagguugguggguuggau

SEQ ID NO: 296572 - RNA, 22 nt, Human
uuuauuauccaguguugucaug

SEQ ID NO: 296573 - RNA, 22 nt, Human
uuccagugaugggcaauuuggu

SEQ ID NO: 296574 - RNA, 22 nt, Human
ucaguucuaacaguuuagaaca

SEQ ID NO: 296575 - RNA, 22 nt, Human
ggaccuggcaauuugcaucucu

SEQ ID NO: 296576 - RNA, 22 nt, Human
gcagucccauaucuuuaacaua

SEQ ID NO: 296577 - RNA, 22 nt, Human
uuugcucaguucucuguauuuu

SEQ ID NO: 296578 - RNA, 19 nt, Human
uauucuguuaaccuuuguc

SEQ ID NO: 296579 - RNA, 22 nt, Human
agucacaguuccuacccaguaa

SEQ ID NO: 296580 - RNA, 22 nt, Human
ugacagaggagcuggaaugauu

SEQ ID NO: 296581 - RNA, 22 nt, Human
guucuuuaaguggagaaggaaa

SEQ ID NO: 296582 - RNA, 22 nt, Human
uucuguuugugaacuggcugag

SEQ ID NO: 296583 - RNA, 22 nt, Human
uuaacauacaucaugaacaaug

SEQ ID NO: 296584 - RNA, 22 nt, Human
agaagaaaugaggccguucugc

SEQ ID NO: 296585 - RNA, 22 nt, Human
ccugacaggcggaggcugcagu

SEQ ID NO: 296586 - RNA, 22 nt, Human
agaaauuaugcaguaguuuuau

SEQ ID NO: 296587 - RNA, 22 nt, Human
ucagugucuagggacaguaauc

SEQ ID NO: 296588 - RNA, 22 nt, Human
acaaagauguuuaaagcauuua

SEQ ID NO: 296589 - RNA, 22 nt, Human
ugcuggaggggaugccuucacu

SEQ ID NO: 296590 - RNA, 22 nt, Human
acccagcaugacaccugcacau

SEQ ID NO: 296591 - RNA, 18 nt, Human
uagcaaagauguggauug

SEQ ID NO: 296592 - RNA, 22 nt, Human
acagguggaggcuuuaggaggu

SEQ ID NO: 296593 - RNA, 22 nt, Human
auguuucuaguuguaugucacu

SEQ ID NO: 296594 - RNA, 22 nt, Human
agcuccugugugaagccucccu

SEQ ID NO: 296595 - RNA, 22 nt, Human
uggcuuggcuaagaucuaagcu

SEQ ID NO: 296596 - RNA, 20 nt, Human
uacaauauucccacuuugcu

SEQ ID NO: 296597 - RNA, 22 nt, Human
ucaugaaucguggaaugauuua

SEQ ID NO: 296598 - RNA, 22 nt, Human
aaacacugaagaccuaucuggu

SEQ ID NO: 296599 - RNA, 22 nt, Human
acacauuuucuaacagggauca

SEQ ID NO: 296600 - RNA, 22 nt, Human
auguccagaguguccuggaaag

SEQ ID NO: 296601 - RNA, 22 nt, Human
ugggcuccagcaccugugcucu

SEQ ID NO: 296602 - RNA, 23 nt, Human
ccaggcucuuucaccugcuauuc

SEQ ID NO: 296603 - RNA, 22 nt, Human
guuuagaauggcaaaauuaagu

SEQ ID NO: 296604 - RNA, 22 nt, Human
cccugcagcauucucuaacugg

SEQ ID NO: 296605 - RNA, 22 nt, Human
aggacaaaggaccagaucugga

SEQ ID NO: 296606 - RNA, 22 nt, Human
aaaagagucuuaggcagucaua

SEQ ID NO: 296607 - RNA, 22 nt, Human
ucaauauucuucuuuaguagga

SEQ ID NO: 296608 - RNA, 23 nt, Human
agcuuugugaaagcagacauggg

SEQ ID NO: 296609 - RNA, 21 nt, Human
ugacagguauuuaucuggaaa

SEQ ID NO: 296610 - RNA, 22 nt, Human
aggaauguggcaaucuucaagu

SEQ ID NO: 296611 - RNA, 22 nt, Human
aaauggauggaauugacauuua

SEQ ID NO: 296612 - RNA, 22 nt, Human
uucuuuuuaaaguguguaugca

SEQ ID NO: 296613 - RNA, 22 nt, Human
aagagagggacuuauuaaaguc

SEQ ID NO: 296614 - RNA, 22 nt, Human
cagugggauugggauuggaacc

SEQ ID NO: 296615 - RNA, 22 nt, Human
aauaauguugacgauagucuua

SEQ ID NO: 296616 - RNA, 22 nt, Human
gagggaccccaggcuggcccuu

SEQ ID NO: 296617 - RNA, 21 nt, Human
uaugugucuguggaaaacuag

SEQ ID NO: 296618 - RNA, 22 nt, Human
cacugucacguucugaaacugu

SEQ ID NO: 296619 - RNA, 22 nt, Human
aaaguggucugcaucccuucug

SEQ ID NO: 296620 - RNA, 22 nt, Human
auucugggugacuacgugauca

SEQ ID NO: 296621 - RNA, 22 nt, Human
gggaggaaaugugcagcgaauu

SEQ ID NO: 296622 - RNA, 22 nt, Human
cccuagggcuaagcaggacugc

SEQ ID NO: 296623 - RNA, 22 nt, Human
ugguaagaacccaucagagaag

SEQ ID NO: 296624 - RNA, 17 nt, Human
gagccacccugugcgag

SEQ ID NO: 296625 - RNA, 22 nt, Human
aaccugcaguuuuuauucugag

SEQ ID NO: 296626 - RNA, 21 nt, Human
uaucaaggcacuuuuuaaaga

SEQ ID NO: 296627 - RNA, 22 nt, Human
aucuuacagcagcaaggaagua

SEQ ID NO: 296628 - RNA, 22 nt, Human
acaguuuaugguguuuuauaua

SEQ ID NO: 296629 - RNA, 22 nt, Human
gcagguguuuuaagacauugaa

SEQ ID NO: 296630 - RNA, 22 nt, Human
uucuggguaguaugguuaguuu

SEQ ID NO: 296631 - RNA, 14 nt, Human
aggaauguccuagg

SEQ ID NO: 296632 - RNA, 22 nt, Human
uucauucugggcucuaaggaac

SEQ ID NO: 296633 - RNA, 22 nt, Human
uggaggaaguggcuggccagaa

SEQ ID NO: 296634 - RNA, 22 nt, Human
uuccuggcaccaccacuucuag

SEQ ID NO: 296635 - RNA, 22 nt, Human
gucuggaaggaggagauggagc

SEQ ID NO: 296636 - RNA, 22 nt, Human
ucagacagggagucagaaaaua

SEQ ID NO: 296637 - RNA, 21 nt, Human
ccuguucacagaucuguaacu

SEQ ID NO: 296638 - RNA, 22 nt, Human
aagacaggaaaagcuccaggcc

SEQ ID NO: 296639 - RNA, 22 nt, Human
uuccucaguuagugccugaggc

SEQ ID NO: 296640 - RNA, 22 nt, Human
aaaguauuuuugacaggcauua

SEQ ID NO: 296641 - RNA, 22 nt, Human
aguuaaauguguuagccagggu

SEQ ID NO: 296642 - RNA, 22 nt, Human
cuuuaauucagauuugaaggga

SEQ ID NO: 296643 - RNA, 22 nt, Human
uuacauucuuggaaucuuguuu

SEQ ID NO: 296644 - RNA, 22 nt, Human
gcuuuuucaaaugaaagcuggu

SEQ ID NO: 296645 - RNA, 22 nt, Human
gucuuacccacagcaucuagaa

SEQ ID NO: 296646 - RNA, 22 nt, Human
uccaggcagcccuuccugacuc

SEQ ID NO: 296647 - RNA, 22 nt, Human
uacugucuauacacuugauuac

SEQ ID NO: 296648 - RNA, 22 nt, Human
acaguaaaaagccuuagaauuu

SEQ ID NO: 296649 - RNA, 22 nt, Human
gagggaaagguuaauacaugau

SEQ ID NO: 296650 - RNA, 22 nt, Human
aucucuguaauuacaugauauu

SEQ ID NO: 296651 - RNA, 22 nt, Human
ggcaaacaggagaguaaagaga

SEQ ID NO: 296652 - RNA, 22 nt, Human
uagaaacauauaggauggcagg

SEQ ID NO: 296653 - RNA, 22 nt, Human
accuacauacggaaauauuuac

SEQ ID NO: 296654 - RNA, 22 nt, Human
uacauguguucuguuucaaguu

SEQ ID NO: 296655 - RNA, 22 nt, Human
agcaguguucaaugauacacug

SEQ ID NO: 296656 - RNA, 21 nt, Human
acuuuaauauacaugaggagg

SEQ ID NO: 296657 - RNA, 22 nt, Human
aggucagcuagacagcucucug

SEQ ID NO: 296658 - RNA, 22 nt, Human
gaggugucugaguggggaccug

SEQ ID NO: 296659 - RNA, 22 nt, Human
ggucucuguugccuccaucaag

SEQ ID NO: 296660 - RNA, 22 nt, Human
aggcagggucuugcuauguugc

SEQ ID NO: 296661 - RNA, 22 nt, Human
accaggcacuccugaggucuga

SEQ ID NO: 296662 - RNA, 22 nt, Human
ggcuuggaccagucacaguggu

SEQ ID NO: 296663 - RNA, 22 nt, Human
aacaaauuaguugcaagacugg

SEQ ID NO: 296664 - RNA, 22 nt, Human
caaugauuuuuccauugcagga

SEQ ID NO: 296665 - RNA, 20 nt, Human
aagauucauuguaauuaggg

SEQ ID NO: 296666 - RNA, 22 nt, Human
ucugaaauauugguaauacuuu

SEQ ID NO: 296667 - RNA, 22 nt, Human
ccugcaagacuauuuaguucca

SEQ ID NO: 296668 - RNA, 22 nt, Human
aaaauuauagaucuagugccug

SEQ ID NO: 296669 - RNA, 20 nt, Human
uuucaaaggcaccuaugaag

SEQ ID NO: 296670 - RNA, 19 nt, Human
uggcagggagugauauuag

SEQ ID NO: 296671 - RNA, 22 nt, Human
cccuaggguuuggccagagccc

SEQ ID NO: 296672 - RNA, 22 nt, Human
ucagagcauucgggugacaaau

SEQ ID NO: 296673 - RNA, 22 nt, Human
ccuggagaggcgcugcagagga

SEQ ID NO: 296674 - RNA, 22 nt, Human
ccagagagggcgccaccuggag

SEQ ID NO: 296675 - RNA, 22 nt, Human
gaugugaggacucauguggagg

SEQ ID NO: 296676 - RNA, 23 nt, Human
ugagcaucacaggagaaccaggc

SEQ ID NO: 296677 - RNA, 22 nt, Human
cauccugagaggucucucuacc

SEQ ID NO: 296678 - RNA, 22 nt, Human
aaauauuauugcuuaaggggag

SEQ ID NO: 296679 - RNA, 22 nt, Human
uacauaauuaaucuuuaaguuc

SEQ ID NO: 296680 - RNA, 22 nt, Human
gccuguuuuccugcugugguug

SEQ ID NO: 296681 - RNA, 22 nt, Human
guauacagauacuuagacgugc

SEQ ID NO: 296682 - RNA, 22 nt, Human
aggcagguagaaggaucuuuau

SEQ ID NO: 296683 - RNA, 22 nt, Human
acugccuggccuggccucacug

SEQ ID NO: 296684 - RNA, 20 nt, Human
augauuuugcacuaacuuca

SEQ ID NO: 296685 - RNA, 22 nt, Human
cagggcucaccacugggauccu

SEQ ID NO: 296686 - RNA, 22 nt, Human
auguaguugaagugcuauaaag

SEQ ID NO: 296687 - RNA, 22 nt, Human
ucaguaaauaacucagaugcuc

SEQ ID NO: 296688 - RNA, 22 nt, Human
agaaucagugcuggcuauuagc

SEQ ID NO: 296689 - RNA, 22 nt, Human
gagcugcagcggcugacgcaac

SEQ ID NO: 296690 - RNA, 22 nt, Human
gucacuuuacacuccuacuaaa

SEQ ID NO: 296691 - RNA, 22 nt, Human
gaauacauuggaaaucagaaua

SEQ ID NO: 296692 - RNA, 22 nt, Human
ugcagguggccaucuucguucu

SEQ ID NO: 296693 - RNA, 22 nt, Human
uccugcaggccuguucccagua

SEQ ID NO: 296694 - RNA, 22 nt, Human
uucugugucuucuuguucugug

SEQ ID NO: 296695 - RNA, 22 nt, Human
gaauguuacuuugauuuugucc

SEQ ID NO: 296696 - RNA, 22 nt, Human
augcacaagguagauuauuauu

SEQ ID NO: 296697 - RNA, 22 nt, Human
agguuucaugggagacaacuca

SEQ ID NO: 296698 - RNA, 22 nt, Human
cugcaucaguggauaugauggu

SEQ ID NO: 296699 - RNA, 22 nt, Human
aaacugacaaucucaguccuau

SEQ ID NO: 296700 - RNA, 22 nt, Human
ucauuucagaugcauuuagaau

SEQ ID NO: 296701 - RNA, 22 nt, Human
aaucaucuccgaaaaaagagua

SEQ ID NO: 296702 - RNA, 22 nt, Human
gggaucuuguuuaauauuguuu

SEQ ID NO: 296703 - RNA, 22 nt, Human
uccaggcuagccugguagagaa

SEQ ID NO: 296704 - RNA, 20 nt, Human
gcauccagacacccagcugc

SEQ ID NO: 296705 - RNA, 22 nt, Human
caggccuuugcagggagagaga

SEQ ID NO: 296706 - RNA, 20 nt, Human
uauaaauucagagcuuuggu

SEQ ID NO: 296707 - RNA, 22 nt, Human
gagugagggcagcaggggcugc

SEQ ID NO: 296708 - RNA, 22 nt, Human
aacuuucagaauccuaugcauu

SEQ ID NO: 296709 - RNA, 20 nt, Human
accccagccccucuaucuga

SEQ ID NO: 296710 - RNA, 22 nt, Human
uuuacaguauaguaggacucau

SEQ ID NO: 296711 - RNA, 22 nt, Human
aagcugcaugaaguugaguaga

SEQ ID NO: 296712 - RNA, 22 nt, Human
gggagaagaaugugucaauugu

SEQ ID NO: 296713 - RNA, 22 nt, Human
uauuucugauugcucaugaggc

SEQ ID NO: 296714 - RNA, 22 nt, Human
agagggcugccucagucagcua

SEQ ID NO: 296715 - RNA, 22 nt, Human
agaaaugaauauguagugguua

SEQ ID NO: 296716 - RNA, 22 nt, Human
aaacaugagcauuucuguuuaa

SEQ ID NO: 296717 - RNA, 22 nt, Human
aagggcaggcagagaucauaua

SEQ ID NO: 296718 - RNA, 22 nt, Human
gauguguccuaguacggguggg

SEQ ID NO: 296719 - RNA, 20 nt, Human
uggaccugucucuuuaggga

SEQ ID NO: 296720 - RNA, 22 nt, Human
ucuggccugaaaguccaugcuu

SEQ ID NO: 296721 - RNA, 22 nt, Human
aaggugaacugguaaugacaga

SEQ ID NO: 296722 - RNA, 22 nt, Human
caauguaucaaccagaaaguuc

SEQ ID NO: 296723 - RNA, 22 nt, Human
gagcuuuacuucugacuggugc

SEQ ID NO: 296724 - RNA, 22 nt, Human
uaucucuagcgcacagaagaaa

SEQ ID NO: 296725 - RNA, 22 nt, Human
gggcccuggauuuaagcaugga

SEQ ID NO: 296726 - RNA, 22 nt, Human
ccagccacugggccacugccag

SEQ ID NO: 296727 - RNA, 22 nt, Human
acaugccaugaagguauuuuug

SEQ ID NO: 296728 - RNA, 22 nt, Human
uuucuuuugaauaguguguggu

SEQ ID NO: 296729 - RNA, 22 nt, Human
agggccagucguguauuacugu

SEQ ID NO: 296730 - RNA, 22 nt, Human
gggccaugagagguucaucaac

SEQ ID NO: 296731 - RNA, 22 nt, Human
ccugugacaaacccgccuauuc

SEQ ID NO: 296732 - RNA, 22 nt, Human
uccuggauuuaacccuggcucu

SEQ ID NO: 296733 - RNA, 22 nt, Human
ccaggcucacagcaucccagga

SEQ ID NO: 296734 - RNA, 22 nt, Human
ugcuggcuggaucagagauugg

SEQ ID NO: 296735 - RNA, 20 nt, Human
uucuggcaaacagaguucuu

SEQ ID NO: 296736 - RNA, 22 nt, Human
gggcuuggccccagaagagcua

SEQ ID NO: 296737 - RNA, 22 nt, Human
ccuguucauuuuuugacucugc

SEQ ID NO: 296738 - RNA, 22 nt, Human
auaaauaucacuguugucccuc

SEQ ID NO: 296739 - RNA, 22 nt, Human
aauaauagcagaguuuacaauc

SEQ ID NO: 296740 - RNA, 22 nt, Human
ucagaguuggccuuucuguauu

SEQ ID NO: 296741 - RNA, 22 nt, Human
ucuuucccaguagcucucccag

SEQ ID NO: 296742 - RNA, 22 nt, Human
uggcaucuccgacagucuugau

SEQ ID NO: 296743 - RNA, 22 nt, Human
guuggcagagagaagccuagca

SEQ ID NO: 296744 - RNA, 22 nt, Human
ccugccucccagagguccucua

SEQ ID NO: 296745 - RNA, 22 nt, Human
uuuaaagaaauuccucaucuuu

SEQ ID NO: 296746 - RNA, 22 nt, Human
uggacauguaaaggcucaaggu

SEQ ID NO: 296747 - RNA, 22 nt, Human
ggcacugggugagggucacugg

SEQ ID NO: 296748 - RNA, 22 nt, Human
auuugcaaagucguaucuguga

SEQ ID NO: 296749 - RNA, 22 nt, Human
cuguccuguagcuccaucaguc

SEQ ID NO: 296750 - RNA, 22 nt, Human
aagucucucauggcugacagca

SEQ ID NO: 296751 - RNA, 22 nt, Human
ucuuuauugcuacugguuuguc

SEQ ID NO: 296752 - RNA, 22 nt, Human
cacugaaacagguauugcuggu

SEQ ID NO: 296753 - RNA, 22 nt, Human
aucuggcuuaccuagggugccu

SEQ ID NO: 296754 - RNA, 17 nt, Human
auuucacuuagcaugag

SEQ ID NO: 296755 - RNA, 18 nt, Human
gccaggcaggguggggaa

SEQ ID NO: 296756 - RNA, 22 nt, Human
aaucucuucccaguaaaaaugg

SEQ ID NO: 296757 - RNA, 22 nt, Human
ccucaugcugcaucucugaggu

SEQ ID NO: 296758 - RNA, 22 nt, Human
ggguggagaggcuaaguccagu

SEQ ID NO: 296759 - RNA, 21 nt, Human
ccagagagagggaaguggguu

SEQ ID NO: 296760 - RNA, 22 nt, Human
uauuucuguuuauuuguacauc

SEQ ID NO: 296761 - RNA, 22 nt, Human
cugugucccacacgagguguau

SEQ ID NO: 296762 - RNA, 22 nt, Human
acaggcagagaacucagccaga

SEQ ID NO: 296763 - RNA, 22 nt, Human
aaauacagaguugcuuaaaagc

SEQ ID NO: 296764 - RNA, 22 nt, Human
caggaucuguuaaguuguucca

SEQ ID NO: 296765 - RNA, 22 nt, Human
ucuccuggucaccucagaaguc

SEQ ID NO: 296766 - RNA, 22 nt, Human
ugcaaacaguuaagaugcaggc

SEQ ID NO: 296767 - RNA, 22 nt, Human
uuucacaucaugggauggaagc

SEQ ID NO: 296768 - RNA, 22 nt, Human
gcuccuggucuggagcuucaag

SEQ ID NO: 296769 - RNA, 22 nt, Human
cagggaugugaugagcugagcc

SEQ ID NO: 296770 - RNA, 22 nt, Human
cuguuucuccacacucuuccca

SEQ ID NO: 296771 - RNA, 22 nt, Human
acauuuccuaacguauacacug

SEQ ID NO: 296772 - RNA, 22 nt, Human
aaaaaccucaauuacuuuugca

SEQ ID NO: 296773 - RNA, 22 nt, Human
auacacauguuauuguggaagc

SEQ ID NO: 296774 - RNA, 22 nt, Human
uucauagguuugcugugaacau

SEQ ID NO: 296775 - RNA, 22 nt, Human
aguaggcauuuaauaaacauga

SEQ ID NO: 296776 - RNA, 23 nt, Human
ucagugucuaguuguggaauuga

SEQ ID NO: 296777 - RNA, 22 nt, Human
caggcuugaagcuucagaguau

SEQ ID NO: 296778 - RNA, 23 nt, Human
agucucaagcuggagaauuaccu

SEQ ID NO: 296779 - RNA, 22 nt, Human
cuggagggagauucaaaggagg

SEQ ID NO: 296780 - RNA, 22 nt, Human
uuggcucugaaacccaagcucu

SEQ ID NO: 296781 - RNA, 22 nt, Human
ccugugccagccccuucugcug

SEQ ID NO: 296782 - RNA, 22 nt, Human
ucuguuuagaugcuuuaucugu

SEQ ID NO: 296783 - RNA, 22 nt, Human
ugauucuauggaaggcauaagg

SEQ ID NO: 296784 - RNA, 22 nt, Human
auauaaagagcuuaguauagug

SEQ ID NO: 296785 - RNA, 22 nt, Human
uugaaucucuugaaucucuguu

SEQ ID NO: 296786 - RNA, 22 nt, Human
cacacagugggaaaaccugaag

SEQ ID NO: 296787 - RNA, 22 nt, Human
aaauaaguaguuuaguguugug

SEQ ID NO: 296788 - RNA, 22 nt, Human
auuucucacucacaguccaugu

SEQ ID NO: 296789 - RNA, 22 nt, Human
uguguccuucugggagucccag

SEQ ID NO: 296790 - RNA, 22 nt, Human
cagggcagccaggccccguggg

SEQ ID NO: 296791 - RNA, 22 nt, Human
agaaaagugcucuagugagagc

SEQ ID NO: 296792 - RNA, 22 nt, Human
agugugagggguucuuugauau

SEQ ID NO: 296793 - RNA, 22 nt, Human
uggccaggcuggucuggaacgc

SEQ ID NO: 296794 - RNA, 22 nt, Human
aaaaaauuccauucugugccuu

SEQ ID NO: 296795 - RNA, 22 nt, Human
aagauuauggcagauaacaauu

SEQ ID NO: 296796 - RNA, 22 nt, Human
ggagagggggcucccugcuugg

SEQ ID NO: 296797 - RNA, 22 nt, Human
ucuggcucucauacucgccagu

SEQ ID NO: 296798 - RNA, 19 nt, Human
cacacccaugcuugccaag

SEQ ID NO: 296799 - RNA, 22 nt, Human
cacuuuaugggaagcaaaaauu

SEQ ID NO: 296800 - RNA, 22 nt, Human
ccuggcucuguccucgcgcaaa

SEQ ID NO: 296801 - RNA, 22 nt, Human
auuuagguagcugucuaagugu

SEQ ID NO: 296802 - RNA, 22 nt, Human
ugcaaacaauuuccuauaaagu

SEQ ID NO: 296803 - RNA, 22 nt, Human
aaaucagugcucauuugaaagg

SEQ ID NO: 296804 - RNA, 22 nt, Human
gcacaauaauuuuuuuaagagg

SEQ ID NO: 296805 - RNA, 22 nt, Human
auguuaaaaaccaguacaguug

SEQ ID NO: 296806 - RNA, 22 nt, Human
gcuguucacggaggaggauggg

SEQ ID NO: 296807 - RNA, 22 nt, Human
cuugagaaucuucucugaagag

SEQ ID NO: 296808 - RNA, 22 nt, Human
gaaaaucugcuuauauuauuuu

SEQ ID NO: 296809 - RNA, 22 nt, Human
cagagggacaguaugaugaaag

SEQ ID NO: 296810 - RNA, 22 nt, Human
uugggaaguuuaaugacagacu

SEQ ID NO: 296811 - RNA, 22 nt, Human
ggcuuugggcccucaagucucc

SEQ ID NO: 296812 - RNA, 22 nt, Human
ucaaaggcgguccaggaauaaa

SEQ ID NO: 296813 - RNA, 22 nt, Human
uggaucucggcaaugcgggacu

SEQ ID NO: 296814 - RNA, 22 nt, Human
uugacaaguggagauauuuaag

SEQ ID NO: 296815 - RNA, 22 nt, Human
uucugucaaaugccaguagaga

SEQ ID NO: 296816 - RNA, 22 nt, Human
gcuggaggcuggagugcagugg

SEQ ID NO: 296817 - RNA, 22 nt, Human
acugagcaggguuccgcaugga

SEQ ID NO: 296818 - RNA, 22 nt, Human
uccaggaaugugugugggcuag

SEQ ID NO: 296819 - RNA, 22 nt, Human
ugucugucuguccuucucauua

SEQ ID NO: 296820 - RNA, 22 nt, Human
agcauuuucugagaguauagau

SEQ ID NO: 296821 - RNA, 23 nt, Human
uucugucuugcugucagcuuucu

SEQ ID NO: 296822 - RNA, 22 nt, Human
aaaguagcuuaguugauauuuc

SEQ ID NO: 296823 - RNA, 19 nt, Human
ugccuggcaccagcuccac

SEQ ID NO: 296824 - RNA, 22 nt, Human
gcagacagaagcuaaguagaca

SEQ ID NO: 296825 - RNA, 22 nt, Human
caugggggucuggacaacaggc

SEQ ID NO: 296826 - RNA, 22 nt, Human
uguuggaauuaggauacagagg

SEQ ID NO: 296827 - RNA, 22 nt, Human
ccgcgagguggagguugcagug

SEQ ID NO: 296828 - RNA, 22 nt, Human
ccaagaggggaagggccgcagc

SEQ ID NO: 296829 - RNA, 22 nt, Human
ggagaggguguggaaaguuauc

SEQ ID NO: 296830 - RNA, 22 nt, Human
cagagggagcccuccaggagca

SEQ ID NO: 296831 - RNA, 22 nt, Human
ggagggaaccuuggcuggauug

SEQ ID NO: 296832 - RNA, 22 nt, Human
gaaagagaaccugggccuagau

SEQ ID NO: 296833 - RNA, 22 nt, Human
agaguggagagaaacaacucug

SEQ ID NO: 296834 - RNA, 22 nt, Human
gccagaggggcucgaaggcgcg

SEQ ID NO: 296835 - RNA, 22 nt, Human
gcggcccgagcaggacgggugg

SEQ ID NO: 296836 - RNA, 20 nt, Human
uccuccuugcagagcccaga

SEQ ID NO: 296837 - RNA, 17 nt, Human
gagguaggaagugaguc

SEQ ID NO: 296838 - RNA, 22 nt, Human
aggagcggauguguccugccag

SEQ ID NO: 296839 - RNA, 22 nt, Human
agggaugcaguaaaaacuguag

SEQ ID NO: 296840 - RNA, 22 nt, Human
gcggcccggguccccagcagca

SEQ ID NO: 296841 - RNA, 22 nt, Human
cgaggaggaaacgcggagaacu

SEQ ID NO: 296842 - RNA, 22 nt, Human
aagggugguguaggagaucaaa

SEQ ID NO: 296843 - RNA, 22 nt, Human
ggaggugacuggaucaugggca

SEQ ID NO: 296844 - RNA, 22 nt, Human
ugaguggacgugaggcugagua

SEQ ID NO: 296845 - RNA, 22 nt, Human
gaggaggcuuccgggaggcacg

SEQ ID NO: 296846 - RNA, 22 nt, Human
aagagagaacucccuucgccag

SEQ ID NO: 296847 - RNA, 22 nt, Human
caggggacacuccugcuugggc

SEQ ID NO: 296848 - RNA, 22 nt, Human
agaaagcacccugcacuuucug

SEQ ID NO: 296849 - RNA, 22 nt, Human
uggcccagcucagggugggcgg

SEQ ID NO: 296850 - RNA, 22 nt, Human
agacagcgaggacagaggggug

SEQ ID NO: 296851 - RNA, 19 nt, Human
cccagaggaaugccuggaa

SEQ ID NO: 296852 - RNA, 22 nt, Human
cuccagagagaaaggaggccgc

SEQ ID NO: 296853 - RNA, 21 nt, Human
cagaggggcuagccuggcugc

SEQ ID NO: 296854 - RNA, 22 nt, Human
auggaggaugugcagcaugggc

SEQ ID NO: 296855 - RNA, 22 nt, Human
cacagagagcuacgugcagcgu

SEQ ID NO: 296856 - RNA, 22 nt, Human
ggagaggguagggguccugccc

SEQ ID NO: 296857 - RNA, 22 nt, Human
aggagggagcuuaagccaggca

SEQ ID NO: 296858 - RNA, 22 nt, Human
cacagaggaugcccaagcgauc

SEQ ID NO: 296859 - RNA, 22 nt, Human
ggaaggguuuaagcaggagagu

SEQ ID NO: 296860 - RNA, 22 nt, Human
uggcuggggccugaauccugca

SEQ ID NO: 296861 - RNA, 22 nt, Human
uccuucccaggugucgccgccu

SEQ ID NO: 296862 - RNA, 22 nt, Human
uagcaggaggcaguuccucgcu

SEQ ID NO: 296863 - RNA, 22 nt, Human
agagcgagucuggggcucggau

SEQ ID NO: 296864 - RNA, 22 nt, Human
ccagagagggcgccaccuggag

SEQ ID NO: 296865 - RNA, 21 nt, Human
ucagagggcccuggaggcuca

SEQ ID NO: 296866 - RNA, 22 nt, Human
gccagagggauuccuggugugu

SEQ ID NO: 296867 - RNA, 22 nt, Human
ggagguggagcuggaaguucca

SEQ ID NO: 296868 - RNA, 23 nt, Human
agguggagcugugcagccggggc

SEQ ID NO: 296869 - RNA, 22 nt, Human
agagaugcuguggguagaggca

SEQ ID NO: 296870 - RNA, 22 nt, Human
caggaggaaaguuccacucaac

SEQ ID NO: 296871 - RNA, 22 nt, Human
ccagcaggagacuagcaacaua

SEQ ID NO: 296872 - RNA, 23 nt, Human
ggaagcucacguaguccugcacu

SEQ ID NO: 296873 - RNA, 22 nt, Human
ggaggaggggugacugaaugcu

SEQ ID NO: 296874 - RNA, 22 nt, Human
ggagaggggaacuuguugcuug

SEQ ID NO: 296875 - RNA, 20 nt, Human
acagaugaggaugcggaggc

SEQ ID NO: 296876 - RNA, 22 nt, Human
uaaagcaaugaaaguuuugcag

SEQ ID NO: 296877 - RNA, 22 nt, Human
guagcccaccuggggagggcga

SEQ ID NO: 296878 - RNA, 22 nt, Human
cccagaggcugaguugggagca

SEQ ID NO: 296879 - RNA, 22 nt, Human
uggaaagaggaagugcccagca

SEQ ID NO: 296880 - RNA, 22 nt, Human
gagcuccugaaacguuccugcc

SEQ ID NO: 296881 - RNA, 22 nt, Human
uaggcagggauuaggguugauu

SEQ ID NO: 296882 - RNA, 22 nt, Human
aggugggacccguggggugcga

SEQ ID NO: 296883 - RNA, 22 nt, Human
ggagggaguuucauuccugccc

SEQ ID NO: 296884 - RNA, 22 nt, Human
gagaggaagccuucuguacuug

SEQ ID NO: 296885 - RNA, 22 nt, Human
gagagaagggggauaugagccu

SEQ ID NO: 296886 - RNA, 22 nt, Human
ccagagaggccuuggcaagaca

SEQ ID NO: 296887 - RNA, 21 nt, Human
agggaaaaggcugagugaggg

SEQ ID NO: 296888 - RNA, 22 nt, Human
gaggagaggcuggacgcgguga

SEQ ID NO: 296889 - RNA, 22 nt, Human
agaacagaggccuuauguuuca

SEQ ID NO: 296890 - RNA, 23 nt, Human
ugaaagcaaugggucuauaguau

SEQ ID NO: 296891 - RNA, 22 nt, Human
uggcuuccagaacugagcaaca

SEQ ID NO: 296892 - RNA, 22 nt, Human
gcccagaguuugaagauacagu

SEQ ID NO: 296893 - RNA, 22 nt, Human
acagagggucugggcacaggac

SEQ ID NO: 296894 - RNA, 22 nt, Human
gggaggaaggcuugggugagua

SEQ ID NO: 296895 - RNA, 22 nt, Human
cgccccagccaguugagcggcg

SEQ ID NO: 296896 - RNA, 22 nt, Human
uggaaggggccaggcgcggagu

SEQ ID NO: 296897 - RNA, 22 nt, Human
agaggagguccuuuucugaugu

SEQ ID NO: 296898 - RNA, 22 nt, Human
ucuaggaguugauaaaagggcu

SEQ ID NO: 296899 - RNA, 22 nt, Human
agguggagaagagaugggcagu

SEQ ID NO: 296900 - RNA, 22 nt, Human
uuccagagaguuauuccccugg

SEQ ID NO: 296901 - RNA, 22 nt, Human
ucucuccuccacaccgggugcu

SEQ ID NO: 296902 - RNA, 22 nt, Human
acacuccagggagggagggaau

SEQ ID NO: 296903 - RNA, 22 nt, Human
cuaagaaggaggaaaagugcca

SEQ ID NO: 296904 - RNA, 22 nt, Human
ccaagaggggcagagggcugca

SEQ ID NO: 296905 - RNA, 22 nt, Human
ggggaggaagcuggaacacggg

SEQ ID NO: 296906 - RNA, 22 nt, Human
agaggaaguaaucaggaccugc

SEQ ID NO: 296907 - RNA, 22 nt, Human
ugaggaggugggcacacagagu

SEQ ID NO: 296908 - RNA, 22 nt, Human
aaaagagaaaguggcaggcuuu

SEQ ID NO: 296909 - RNA, 22 nt, Human
aggaagagcuggaccagaggac

SEQ ID NO: 296910 - RNA, 22 nt, Human
uccuuucugucuuuacucugga

SEQ ID NO: 296911 - RNA, 22 nt, Hepatitis E virus
caccgcccggucagccgucugg

SEQ ID NO: 296912 - RNA, 22 nt, Hepatitis E virus
cgcagcggcgguuccggcggug

SEQ ID NO: 296913 - RNA, 22 nt, Hepatitis E virus
agagauuguggcgcucugggcc

SEQ ID NO: 296914 - RNA, 22 nt, Hepatitis E virus
cgcagcggcgguuccggcggug

SEQ ID NO: 296915 - RNA, 22 nt, Hepatitis E virus
gaccuugguuaauguagcgacc

SEQ ID NO: 296916 - RNA, 23 nt, Hepatitis E virus
ccagacggcugaccgggcggugg

SEQ ID NO: 296917 - RNA, 22 nt, Hepatitis E virus
caccgccggaaccgccgcugcg

SEQ ID NO: 296918 - RNA, 23 nt, Hepatitis E virus
ucgcuacauuaaccaaggucaca

SEQ ID NO: 296919 - RNA, 22 nt, Hepatitis E virus
ugaccuugguccagucgagcga

SEQ ID NO: 296920 - RNA, 22 nt, Human
cccagugucaccaacaggacac

SEQ ID NO: 296921 - RNA, 22 nt, Human
ggcucugggccuccaaggucug

SEQ ID NO: 296922 - RNA, 22 nt, Human
aaauccuaauaaugcacuagug

SEQ ID NO: 296923 - RNA, 18 nt, Human
acagggaugggguaagug

SEQ ID NO: 296924 - RNA, 22 nt, Human
gcagcuuucuacuuccuacagc

SEQ ID NO: 296925 - RNA, 22 nt, Human
aggcagguguuaacccucugag

SEQ ID NO: 296926 - RNA, 22 nt, Human
aagggcucugcugucucucccc

SEQ ID NO: 296927 - RNA, 22 nt, Human
gcucuggccagacccucagugg

SEQ ID NO: 296928 - RNA, 22 nt, Human
ugguccugcccacgcccaucug

SEQ ID NO: 296929 - RNA, 22 nt, Human
uaguuuacuguucacuuugccc

SEQ ID NO: 296930 - RNA, 22 nt, Human
aagucacagaguuggaagucag

SEQ ID NO: 296931 - RNA, 22 nt, Human
uacauguguucuguuucaaguu

SEQ ID NO: 296932 - RNA, 22 nt, Human
uuguuucaggaugguuuguuac

SEQ ID NO: 296933 - RNA, 20 nt, Human
gcauguguauggaaggggga

SEQ ID NO: 296934 - RNA, 22 nt, Human
gcagguguuuuaagacauugaa

SEQ ID NO: 296935 - RNA, 22 nt, Human
ugguggggauucccucccuggc

SEQ ID NO: 296936 - RNA, 18 nt, Human
gcuuuauuucuuggggaa

SEQ ID NO: 296937 - RNA, 22 nt, Human
ggucucuguugccuccaucaag

SEQ ID NO: 296938 - RNA, 22 nt, Human
aagggcaggugggcauuucugg

SEQ ID NO: 296939 - RNA, 22 nt, Human
acuuccuugucaggugcaucau

SEQ ID NO: 296940 - RNA, 22 nt, Human
uaugugucccuugguguagcaa

SEQ ID NO: 296941 - RNA, 22 nt, Human
aagggcagggaguuugugucua

SEQ ID NO: 296942 - RNA, 22 nt, Human
ugugugcuaauguaugcucuaa

SEQ ID NO: 296943 - RNA, 22 nt, Human
acuggguguauuagugguguuu

SEQ ID NO: 296944 - RNA, 22 nt, Human
agcugccagcaaguuucaaaca

SEQ ID NO: 296945 - RNA, 22 nt, Human
ucugcuucuccuacuucauggg

SEQ ID NO: 296946 - RNA, 22 nt, Human
cucagccaugggguggaucagc

SEQ ID NO: 296947 - RNA, 22 nt, Human
cccaggaguaagugacauuguu

SEQ ID NO: 296948 - RNA, 22 nt, Human
uuucugaauaacucuaugauau

SEQ ID NO: 296949 - RNA, 22 nt, Human
ugagcaucuuuuuacagguuua

SEQ ID NO: 296950 - RNA, 22 nt, Human
acauguguaagaugugauauau

SEQ ID NO: 296951 - RNA, 22 nt, Human
uucuucuucauuucugacgaug

SEQ ID NO: 296952 - RNA, 22 nt, Human
gcagggaccuugcccacccucc

SEQ ID NO: 296953 - RNA, 19 nt, Human
uccagaugauauggauuac

SEQ ID NO: 296954 - RNA, 18 nt, Human
uuuauauggauagagacc

SEQ ID NO: 296955 - RNA, 22 nt, Human
gauugcugugcgccccaggugu

SEQ ID NO: 296956 - RNA, 22 nt, Human
aaaauacuguggaguguugaaa

SEQ ID NO: 296957 - RNA, 22 nt, Human
uuucaguuuaugucuugaauua

SEQ ID NO: 296958 - RNA, 20 nt, Human
acuguucaagggccuggugg

SEQ ID NO: 296959 - RNA, 22 nt, Human
cagacagggcccugugauggua

SEQ ID NO: 296960 - RNA, 22 nt, Human
agaggugacauaggagaggcuc

SEQ ID NO: 296961 - RNA, 22 nt, Human
ccuggguggcugccugccuuuc

SEQ ID NO: 296962 - RNA, 22 nt, Human
ggcagggaguggagacucccua

SEQ ID NO: 296963 - RNA, 22 nt, Human
auguucuuccaaaucuguaaca

SEQ ID NO: 296964 - RNA, 22 nt, Human
acucuacuguaguaugggcacu

SEQ ID NO: 296965 - RNA, 22 nt, Human
ucugaagauggaggaacuuaga

SEQ ID NO: 296966 - RNA, 21 nt, Human
aagugguuuagguuaccgggg

SEQ ID NO: 296967 - RNA, 21 nt, Human
uacagaaugcgcuucagucug

SEQ ID NO: 296968 - RNA, 22 nt, Human
aucuguaaaugcaaauguagcu

SEQ ID NO: 296969 - RNA, 22 nt, Human
ucaggugggucuacaauuaguu

SEQ ID NO: 296970 - RNA, 22 nt, Human
uaauuucuggagggagaaagag

SEQ ID NO: 296971 - RNA, 22 nt, Human
agagaggcgaguuaccugugcu

SEQ ID NO: 296972 - RNA, 22 nt, Human
uuccuucuuguaaugaucugcc

SEQ ID NO: 296973 - RNA, 22 nt, Human
aaacaugaauagauauuaaaca

SEQ ID NO: 296974 - RNA, 22 nt, Human
ucugggauuuuauagacaugcu

SEQ ID NO: 296975 - RNA, 22 nt, Human
uucuauugacauucacuguaac

SEQ ID NO: 296976 - RNA, 22 nt, Human
ugcuuccugaggccgucuucuc

SEQ ID NO: 296977 - RNA, 22 nt, Human
ucaggugggcguuccggugcgg

SEQ ID NO: 296978 - RNA, 22 nt, Human
guuuacuguuuucugauaagug

SEQ ID NO: 296979 - RNA, 22 nt, Human
aaagcugcuaugaacauucuau

SEQ ID NO: 296980 - RNA, 22 nt, Human
aguuugaauugaaaugcagaug

SEQ ID NO: 296981 - RNA, 22 nt, Human
aaguuuuccuguguccaagaug

SEQ ID NO: 296982 - RNA, 22 nt, Human
auuuaagacugacuucaccagu

SEQ ID NO: 296983 - RNA, 21 nt, Human
agacaugugaacuaaagguga

SEQ ID NO: 296984 - RNA, 22 nt, Human
aauugcuucauuaacauuuagg

SEQ ID NO: 296985 - RNA, 19 nt, Human
agaaauagccuuccuuguc

SEQ ID NO: 296986 - RNA, 22 nt, Human
ugucugaugauagugucucucc

SEQ ID NO: 296987 - RNA, 22 nt, Human
gccgugcgugcgcaggugcugu

SEQ ID NO: 296988 - RNA, 22 nt, Human
acagguggcauaggcaguuuga

SEQ ID NO: 296989 - RNA, 22 nt, Human
acagguguugacucacaggccc

SEQ ID NO: 296990 - RNA, 22 nt, Human
gucaccucucaucacaugcuac

SEQ ID NO: 296991 - RNA, 22 nt, Human
ggcuuuauuugcagccauuguu

SEQ ID NO: 296992 - RNA, 22 nt, Human
uggcaaaguuuaucaggaauau

SEQ ID NO: 296993 - RNA, 22 nt, Human
ucucccucuuugucugcuuugg

SEQ ID NO: 296994 - RNA, 22 nt, Human
uuagggacaaauuugcagaacc

SEQ ID NO: 296995 - RNA, 22 nt, Human
ugcuagggauauaguggcgagu

SEQ ID NO: 296996 - RNA, 22 nt, Human
uagaaacagcauauauuagccc

SEQ ID NO: 296997 - RNA, 21 nt, Human
ucuggguguaaaucuuauuug

SEQ ID NO: 296998 - RNA, 22 nt, Human
aacaaucaaguuucuaaaugac

SEQ ID NO: 296999 - RNA, 19 nt, Human
cuguugcuggggcucucuu

SEQ ID NO: 297000 - RNA, 22 nt, Human
uggcagguuuccuccucauagu

SEQ ID NO: 297001 - RNA, 22 nt, Human
acaauauuguacccagaaguuu

SEQ ID NO: 297002 - RNA, 22 nt, Human
agcugcaagaagaggucccuga

SEQ ID NO: 297003 - RNA, 22 nt, Human
uucuucaaaacaacacuggccu

SEQ ID NO: 297004 - RNA, 22 nt, Human
ucagggcauccauugccuguug

SEQ ID NO: 297005 - RNA, 22 nt, Human
uguaauuaaacugaagacagaa

SEQ ID NO: 297006 - RNA, 22 nt, Human
gcagguggugggggagccguuc

SEQ ID NO: 297007 - RNA, 22 nt, Human
ucuuauugucuagauugagaug

SEQ ID NO: 297008 - RNA, 22 nt, Human
auugcuugaauuaccauguaau

SEQ ID NO: 297009 - RNA, 22 nt, Human
ccugcagguugcagaggcggaa

SEQ ID NO: 297010 - RNA, 22 nt, Human
uaugcacacauguaugcaugug

SEQ ID NO: 297011 - RNA, 22 nt, Human
auauuaggcaaggagauuauuu

SEQ ID NO: 297012 - RNA, 22 nt, Human
agcaggugucggcgagggucuu

SEQ ID NO: 297013 - RNA, 22 nt, Human
cuuucuuuguccaccaacaaug

SEQ ID NO: 297014 - RNA, 22 nt, Human
gagaugguugcaauaguuuaaa

SEQ ID NO: 297015 - RNA, 23 nt, Human
gggaccugguaggaggugauugg

SEQ ID NO: 297016 - RNA, 22 nt, Human
gcugggaagugcaagaucaagg

SEQ ID NO: 297017 - RNA, 22 nt, Human
cugcagggaacugaggcccaga

SEQ ID NO: 297018 - RNA, 22 nt, Human
gcuguucagaugcgauucagga

SEQ ID NO: 297019 - RNA, 19 nt, Human
ccuguucaugacucugucc

SEQ ID NO: 297020 - RNA, 20 nt, Human
acuuuacugagcuguaauuc

SEQ ID NO: 297021 - RNA, 22 nt, Human
uuugcucaguucucuguauuuu

SEQ ID NO: 297022 - RNA, 22 nt, Human
gcaaaucaccaccuagcuggau

SEQ ID NO: 297023 - RNA, 18 nt, Human
uggcagguagacucaggu

SEQ ID NO: 297024 - RNA, 22 nt, Human
aauuuccagaccccauccacag

SEQ ID NO: 297025 - RNA, 22 nt, Human
agcagggcucugccaugggccc

SEQ ID NO: 297026 - RNA, 22 nt, Human
uguauacauuuaacuagauaga

SEQ ID NO: 297027 - RNA, 22 nt, Human
ucagguguauugaugucuguga

SEQ ID NO: 297028 - RNA, 22 nt, Human
gacauuagacuaauguagcauu

SEQ ID NO: 297029 - RNA, 22 nt, Human
ucagcuuucucucgccaucagg

SEQ ID NO: 297030 - RNA, 20 nt, Human
aagauucauuguaauuaggg

SEQ ID NO: 297031 - RNA, 22 nt, Human
aagggcuccaagagguagcugg

SEQ ID NO: 297032 - RNA, 22 nt, Human
uggcaaaggcgcucacaugccu

SEQ ID NO: 297033 - RNA, 18 nt, Human
ggacaucaucaggugcuu

SEQ ID NO: 297034 - RNA, 22 nt, Human
caguuucuuuccauuguuaccu

SEQ ID NO: 297035 - RNA, 22 nt, Human
uacagagacuuuauggcacaaa

SEQ ID NO: 297036 - RNA, 22 nt, Human
gcugguccacucccuggaggcu

SEQ ID NO: 297037 - RNA, 22 nt, Human
uugcagggucccagaggccugg

SEQ ID NO: 297038 - RNA, 22 nt, Human
ccuggaggggaccaggaccagg

SEQ ID NO: 297039 - RNA, 22 nt, Human
gguggggcccaggcaucugaug

SEQ ID NO: 297040 - RNA, 22 nt, Human
cagcuugaaauauuaggagaug

SEQ ID NO: 297041 - RNA, 22 nt, Human
cuucuuccugcugcagccucca

SEQ ID NO: 297042 - RNA, 22 nt, Human
uugcugggcucuucaacacaca

SEQ ID NO: 297043 - RNA, 22 nt, Human
uccuggcugccgucguccugcg

SEQ ID NO: 297044 - RNA, 22 nt, Human
uugcagggaaacaguuuaggaa

SEQ ID NO: 297045 - RNA, 22 nt, Human
gagcuuuaagggauaaaaugau

SEQ ID NO: 297046 - RNA, 22 nt, Human
ucauguguccuaguucauauaa

SEQ ID NO: 297047 - RNA, 22 nt, Human
uggaggaaucagggcuuaggcu

SEQ ID NO: 297048 - RNA, 22 nt, Human
ugcaggugagugcaggggcuca

SEQ ID NO: 297049 - RNA, 22 nt, Human
uaggugucaggccuccuccagc

SEQ ID NO: 297050 - RNA, 22 nt, Human
acaauguguuuuuauacauuug

SEQ ID NO: 297051 - RNA, 22 nt, Human
ggcaggcagauggcugcaccaa

SEQ ID NO: 297052 - RNA, 22 nt, Human
uacccaggggcugagcagaggu

SEQ ID NO: 297053 - RNA, 22 nt, Human
augcauugucugguuucauuuu

SEQ ID NO: 297054 - RNA, 22 nt, Human
aggcagguguugggagacacca

SEQ ID NO: 297055 - RNA, 22 nt, Human
aacaguaaagacagaauuuauc

SEQ ID NO: 297056 - RNA, 20 nt, Human
gcagggcaucuuggccccca

SEQ ID NO: 297057 - RNA, 22 nt, Human
caaggcauuguguaagcacuug

SEQ ID NO: 297058 - RNA, 17 nt, Human
acaggccugcuugcacu

SEQ ID NO: 297059 - RNA, 22 nt, Human
aauuguaagugcugaguuaagg

SEQ ID NO: 297060 - RNA, 22 nt, Human
aguuauaugugaaaacacguau

SEQ ID NO: 297061 - RNA, 22 nt, Human
acuuaaaaacagauccagcagg

SEQ ID NO: 297062 - RNA, 22 nt, Human
ccuguucaagguauuaauuauc

SEQ ID NO: 297063 - RNA, 22 nt, Human
agcagguggaaaauucuuauca

SEQ ID NO: 297064 - RNA, 22 nt, Human
aucuuucagggccauuuguauu

SEQ ID NO: 297065 - RNA, 22 nt, Human
ucagacaggcuucuuucucccu

SEQ ID NO: 297066 - RNA, 22 nt, Human
cacauaauaaauguuccugaug

SEQ ID NO: 297067 - RNA, 22 nt, Human
ucgggcucgcucuccuagcgga

SEQ ID NO: 297068 - RNA, 22 nt, Human
aguguccucuauuaugacuuua

SEQ ID NO: 297069 - RNA, 22 nt, Human
ugcuuuauguuaucagaagggu

SEQ ID NO: 297070 - RNA, 22 nt, Human
auaaacagaguaguugcuacug

SEQ ID NO: 297071 - RNA, 22 nt, Human
gacaugugagcaagcgugcggc

SEQ ID NO: 297072 - RNA, 22 nt, Human
caugcagcaggaucucauuccc

SEQ ID NO: 297073 - RNA, 23 nt, Human
aagugguuuugaacccggacccu

SEQ ID NO: 297074 - RNA, 22 nt, Human
aagggcuccacuugaaucacac

SEQ ID NO: 297075 - RNA, 22 nt, Human
uccuuccugcaggccaaguccu

SEQ ID NO: 297076 - RNA, 22 nt, Human
aaagcagaacugagagagcugg

SEQ ID NO: 297077 - RNA, 15 nt, Human
uugcuuuaagacaug

SEQ ID NO: 297078 - RNA, 17 nt, Human
cacaggugugguuugag

SEQ ID NO: 297079 - RNA, 21 nt, Human
agaaaaacacgauauaagccc

SEQ ID NO: 297080 - RNA, 22 nt, Human
gcaggcagagagggguuuccag

SEQ ID NO: 297081 - RNA, 22 nt, Human
gaggcaggcacuguuaucagca

SEQ ID NO: 297082 - RNA, 22 nt, Human
uguuucuuuguagauauucuuu

SEQ ID NO: 297083 - RNA, 22 nt, Human
auuugcuggugaauguauagcu

SEQ ID NO: 297084 - RNA, 22 nt, Human
gaggugucuggccuuuguagga

SEQ ID NO: 297085 - RNA, 22 nt, Human
aacaucuacuaagugccaggca

SEQ ID NO: 297086 - RNA, 22 nt, Human
acacauauucauauguacuuac

SEQ ID NO: 297087 - RNA, 22 nt, Human
aggcugagcuggcccuugaaau

SEQ ID NO: 297088 - RNA, 22 nt, Human
ucugcgcccugucgccugcucc

SEQ ID NO: 297089 - RNA, 21 nt, Human
agccugcaauguagguaccgg

SEQ ID NO: 297090 - RNA, 22 nt, Human
gcagcuuuagaaacaagggcug

SEQ ID NO: 297091 - RNA, 22 nt, Human
cagagacuggagugcaguggcg

SEQ ID NO: 297092 - RNA, 22 nt, Human
uggaaugagcuggcuaauaacc

SEQ ID NO: 297093 - RNA, 22 nt, Human
cucuggaauuaaggaagccugu

SEQ ID NO: 297094 - RNA, 22 nt, Human
ucagaaauguaagcugaugacu

SEQ ID NO: 297095 - RNA, 21 nt, Human
uauacaugugugcauacgugu

SEQ ID NO: 297096 - RNA, 22 nt, Human
uuacaagauaaccugaugcugu

SEQ ID NO: 297097 - RNA, 22 nt, Human
acuuggcaaguaucuauaaagu

SEQ ID NO: 297098 - RNA, 22 nt, Human
aauguuuuguaugccucugagc

SEQ ID NO: 297099 - RNA, 22 nt, Human
gcauguguuagagugugcaugc

SEQ ID NO: 297100 - RNA, 22 nt, Human
uuugcagugucagcuucugugu

SEQ ID NO: 297101 - RNA, 22 nt, Human
caguauuuauggcuugaguauu

SEQ ID NO: 297102 - RNA, 22 nt, Human
ucuugauuacaaauaacaucau

SEQ ID NO: 297103 - RNA, 22 nt, Human
gcugggucuggcugugagccgg

SEQ ID NO: 297104 - RNA, 22 nt, Human
guguguccaaggcacggaugac

SEQ ID NO: 297105 - RNA, 22 nt, Human
auuucccaugugaaucaauugg

SEQ ID NO: 297106 - RNA, 22 nt, Human
ucagagagguuaaauaucuugu

SEQ ID NO: 297107 - RNA, 19 nt, Human
ugcagccacgugagagacu

SEQ ID NO: 297108 - RNA, 22 nt, Human
ucuuauugugaugaugaagaac

SEQ ID NO: 297109 - RNA, 22 nt, Human
acaagcaugggcuuugacauca

SEQ ID NO: 297110 - RNA, 22 nt, Human
guuagggagggugcauaugugu

SEQ ID NO: 297111 - RNA, 22 nt, Human
gauuuauuuuuaaucagcaggg

SEQ ID NO: 297112 - RNA, 22 nt, Human
gcacccaguuugucucaggguu

SEQ ID NO: 297113 - RNA, 22 nt, Human
acuguccucgaaguaccugugc

SEQ ID NO: 297114 - RNA, 22 nt, Human
uacccagcaaucccuagagguu

SEQ ID NO: 297115 - RNA, 22 nt, Human
cuucuucaauagcaagcgcaua

SEQ ID NO: 297116 - RNA, 22 nt, Human
aguaccaugcuuccugacuggu

SEQ ID NO: 297117 - RNA, 18 nt, Human
acugaagaugcaagaccu

SEQ ID NO: 297118 - RNA, 22 nt, Human
auucuucaaagagugucaaagu

SEQ ID NO: 297119 - RNA, 22 nt, Human
aaagcugcugugaaugguuugg

SEQ ID NO: 297120 - RNA, 22 nt, Human
ugcuuuauuuuaaauaugccau

SEQ ID NO: 297121 - RNA, 22 nt, Human
cugggugaauuugaaggaaagg

SEQ ID NO: 297122 - RNA, 22 nt, Human
uguguccugcagacagacucag

SEQ ID NO: 297123 - RNA, 22 nt, Human
aguugaauaauuagacauaucu

SEQ ID NO: 297124 - RNA, 22 nt, Human
uuucacaacugcuuauuugaga

SEQ ID NO: 297125 - RNA, 22 nt, Human
cuuucacagcacaagccugccu

SEQ ID NO: 297126 - RNA, 22 nt, Human
aagggcagcuuaaauugguagc

SEQ ID NO: 297127 - RNA, 22 nt, Human
cagcuugugcaaagguccuggg

SEQ ID NO: 297128 - RNA, 22 nt, Human
cuucuuucccaggcauguuuua

SEQ ID NO: 297129 - RNA, 22 nt, Human
uucccaguuagucauuuuuaca

SEQ ID NO: 297130 - RNA, 22 nt, Human
uuugacucuugucucuuguuag

SEQ ID NO: 297131 - RNA, 22 nt, Human
gcuggagguagggagguccugu

SEQ ID NO: 297132 - RNA, 22 nt, Human
guucuucaggccauccucccag

SEQ ID NO: 297133 - RNA, 22 nt, Human
gaucugaaucaauagaauaacu

SEQ ID NO: 297134 - RNA, 22 nt, Human
accugcaguggccacuccuaau

SEQ ID NO: 297135 - RNA, 21 nt, Human
ccuguucacagaucuguaacu

SEQ ID NO: 297136 - RNA, 22 nt, Human
acaacauuauacauagaaagcu

SEQ ID NO: 297137 - RNA, 22 nt, Human
ccaugugucuccccuggaagua

SEQ ID NO: 297138 - RNA, 22 nt, Human
gcaggugguggggcuaugaucu

SEQ ID NO: 297139 - RNA, 22 nt, Human
auuuauugagagggaggggaau

SEQ ID NO: 297140 - RNA, 22 nt, Human
gcuuggaaguaggauugggaga

SEQ ID NO: 297141 - RNA, 20 nt, Human
auuucaguguuugcaauuuc

SEQ ID NO: 297142 - RNA, 22 nt, Human
cauaaguuggguaauauaauga

SEQ ID NO: 297143 - RNA, 22 nt, Human
uccaguggcaccuuggcccuca

SEQ ID NO: 297144 - RNA, 22 nt, Human
ugcuggguuaccuaagccuaaa

SEQ ID NO: 297145 - RNA, 22 nt, Human
uauugcuggaaaauggugugau

SEQ ID NO: 297146 - RNA, 22 nt, Human
uguccucaucuuuuccagaaau

SEQ ID NO: 297147 - RNA, 22 nt, Human
ucuuuauugcuacugguuuguc

SEQ ID NO: 297148 - RNA, 22 nt, Human
ugcuguggcaguuuauguauag

SEQ ID NO: 297149 - RNA, 21 nt, Human
ugacagguauuuaucuggaaa

SEQ ID NO: 297150 - RNA, 22 nt, Human
gacccugccaugagugacaggg

SEQ ID NO: 297151 - RNA, 22 nt, Human
cauuuauugaguggccacagug

SEQ ID NO: 297152 - RNA, 22 nt, Human
gaugaggucauguuuuacauau

SEQ ID NO: 297153 - RNA, 22 nt, Human
agaggcaugcacagaugugcug

SEQ ID NO: 297154 - RNA, 22 nt, Human
uguggggcugugguguucuucu

SEQ ID NO: 297155 - RNA, 22 nt, Human
ucaaagagcuauucaguugugg

SEQ ID NO: 297156 - RNA, 22 nt, Human
guccuucaagaguccccuacug

SEQ ID NO: 297157 - RNA, 22 nt, Human
auacuaaaguauagaacuuagu

SEQ ID NO: 297158 - RNA, 20 nt, Human
ccuguucacugcgcaguuuc

SEQ ID NO: 297159 - RNA, 22 nt, Human
uugcugaucugaaacguuacug

SEQ ID NO: 297160 - RNA, 22 nt, Human
cuccucagcugggaggaguccc

SEQ ID NO: 297161 - RNA, 22 nt, Human
uggcagguagucagaggcgaca

SEQ ID NO: 297162 - RNA, 22 nt, Human
aagguggugcuucugcuccucu

SEQ ID NO: 297163 - RNA, 22 nt, Human
gaaggcugcgaggggagugccg

SEQ ID NO: 297164 - RNA, 22 nt, Human
aauguuuucucugugaacacau

SEQ ID NO: 297165 - RNA, 22 nt, Human
uggcaauguuagcaaagcauuu

SEQ ID NO: 297166 - RNA, 22 nt, Human
aacacaaagaagcugcaggauc

SEQ ID NO: 297167 - RNA, 22 nt, Human
guucuucagaggggaaagaacc

SEQ ID NO: 297168 - RNA, 22 nt, Human
gcagggaccucacuacccccag

SEQ ID NO: 297169 - RNA, 22 nt, Human
ucuggguguagggccuggcaac

SEQ ID NO: 297170 - RNA, 22 nt, Human
aagggcucuguugccauuucag

SEQ ID NO: 297171 - RNA, 21 nt, Human
uuucuggguggcugcauagug

SEQ ID NO: 297172 - RNA, 22 nt, Human
cuugaaucuucugaguauuugc

SEQ ID NO: 297173 - RNA, 22 nt, Human
uugcuuuaccugugguauauuu

SEQ ID NO: 297174 - RNA, 22 nt, Human
auaugcauuuaccuggcauaua

SEQ ID NO: 297175 - RNA, 22 nt, Human
agcagcauuaugauauaucuua

SEQ ID NO: 297176 - RNA, 22 nt, Human
agucuucacucuucacuacuau

SEQ ID NO: 297177 - RNA, 22 nt, Human
uaccucaaguuccaggaaagcg

SEQ ID NO: 297178 - RNA, 22 nt, Human
aaauguuucuacuugugagcau

SEQ ID NO: 297179 - RNA, 22 nt, Human
ggcuuuauuaagcaggguaagu

SEQ ID NO: 297180 - RNA, 22 nt, Human
auguucuuguucaaaugucagu

SEQ ID NO: 297181 - RNA, 21 nt, Human
uuauugagacauuuguggaaa

SEQ ID NO: 297182 - RNA, 22 nt, Human
uguuuagcauaaagauuuucca

SEQ ID NO: 297183 - RNA, 22 nt, Human
gcagguguucucagaggaggcu

SEQ ID NO: 297184 - RNA, 21 nt, Human
cagaggcaggcucugugugug

SEQ ID NO: 297185 - RNA, 22 nt, Human
acaaggcuguuggucacaaacc

SEQ ID NO: 297186 - RNA, 22 nt, Human
uucaugaaaguguaucuugugg

SEQ ID NO: 297187 - RNA, 22 nt, Human
uuuacauguaauguuauacaaa

SEQ ID NO: 297188 - RNA, 22 nt, Human
auuuggaaacaauuauauucuu

SEQ ID NO: 297189 - RNA, 22 nt, Human
cuucauuaaugucuauaaguuu

SEQ ID NO: 297190 - RNA, 22 nt, Human
ucugggugcuacaaacaguauu

SEQ ID NO: 297191 - RNA, 22 nt, Human
ggaugaggaaaccacagugucc

SEQ ID NO: 297192 - RNA, 22 nt, Human
agcuuuauuugucauucacggc

SEQ ID NO: 297193 - RNA, 23 nt, Human
ccaggccucucagagggugugcc

SEQ ID NO: 297194 - RNA, 23 nt, Human
ugguggcagaaguagcagaugac

SEQ ID NO: 297195 - RNA, 22 nt, Human
cacaugugugcugaggacugug

SEQ ID NO: 297196 - RNA, 17 nt, Human
gagccacccugugcgag

SEQ ID NO: 297197 - RNA, 22 nt, Human
ucagcuuuccugcagcuaaggg

SEQ ID NO: 297198 - RNA, 22 nt, Human
acagcaugucuaguuaaauacu

SEQ ID NO: 297199 - RNA, 23 nt, Human
uuuugacaggaggaagguguuga

SEQ ID NO: 297200 - RNA, 22 nt, Human
uggcaaaggaaccuauuuuaaa

SEQ ID NO: 297201 - RNA, 22 nt, Human
ugaccauuugaucuacauucca

SEQ ID NO: 297202 - RNA, 22 nt, Human
uguguccuuaugaaaauacugu

SEQ ID NO: 297203 - RNA, 22 nt, Human
gggaccuggucuagcacugagc

SEQ ID NO: 297204 - RNA, 22 nt, Human
cccaguuucaacuuuccagugg

SEQ ID NO: 297205 - RNA, 22 nt, Human
uaggcuaggcugaagguuuugg

SEQ ID NO: 297206 - RNA, 22 nt, Human
agagcugaauuuggguggugga

SEQ ID NO: 297207 - RNA, 22 nt, Human
ccuuccuugagaagcaauuccu

SEQ ID NO: 297208 - RNA, 22 nt, Human
cuucacauguuggaguccuuug

SEQ ID NO: 297209 - RNA, 22 nt, Human
gaauuguaaguaccagcaugcu

SEQ ID NO: 297210 - RNA, 22 nt, Human
uucuucuugaaacuuuagguug

SEQ ID NO: 297211 - RNA, 22 nt, Human
auuucaguagaaaaucuugauu

SEQ ID NO: 297212 - RNA, 22 nt, Human
ggaagagaauuucucucuuuuu

SEQ ID NO: 297213 - RNA, 22 nt, Human
cagggcaggaugcugugauuau

SEQ ID NO: 297214 - RNA, 22 nt, Human
uguccucacaugguggggagag

SEQ ID NO: 297215 - RNA, 22 nt, Human
aaauuguugaucuacaguaagg

SEQ ID NO: 297216 - RNA, 22 nt, Human
uccugcagugugucuccugcac

SEQ ID NO: 297217 - RNA, 22 nt, Human
caugaguucaucugcuucucuu

SEQ ID NO: 297218 - RNA, 22 nt, Human
acaugauuuuuaaagagauaau

SEQ ID NO: 297219 - RNA, 22 nt, Human
uccaugaggcagggaggcuggc

SEQ ID NO: 297220 - RNA, 22 nt, Human
caaaugcagauucaggaguucu

SEQ ID NO: 297221 - RNA, 22 nt, Human
uauugcuggggugggccauguu

SEQ ID NO: 297222 - RNA, 23 nt, Human
uuauugaggguguagauuggugu

SEQ ID NO: 297223 - RNA, 22 nt, Human
uugcuuuaacuaguaaaugggg

SEQ ID NO: 297224 - RNA, 22 nt, Human
uaggugucuguccugggcugug

SEQ ID NO: 297225 - RNA, 22 nt, Human
ccaggugugauuuggcaguguc

SEQ ID NO: 297226 - RNA, 22 nt, Human
uccagaauacucugaaaucauu

SEQ ID NO: 297227 - RNA, 22 nt, Human
uugcagggcaaauggucagaua

SEQ ID NO: 297228 - RNA, 22 nt, Human
ugacagaccacugcaacucugu

SEQ ID NO: 297229 - RNA, 22 nt, Human
gcaggugucaguccccaaggug

SEQ ID NO: 297230 - RNA, 22 nt, Human
cuuaaagaugucaaggcuguuu

SEQ ID NO: 297231 - RNA, 22 nt, Human
gggacaugaagcaucggaggca

SEQ ID NO: 297232 - RNA, 22 nt, Human
ggcuuuauuuugcaugaaugcu

SEQ ID NO: 297233 - RNA, 22 nt, Human
uuugcuuugacugucagcaagu

SEQ ID NO: 297234 - RNA, 22 nt, Human
acuuuugaagaauuaugcaaaa

SEQ ID NO: 297235 - RNA, 22 nt, Human
uucaaaauuguucuaagcucug

SEQ ID NO: 297236 - RNA, 22 nt, Human
ucagcuuuuaaaaacaagaagu

SEQ ID NO: 297237 - RNA, 18 nt, Human
gccugcaggcacgggggu

SEQ ID NO: 297238 - RNA, 21 nt, Human
ucagcuuugcaacugcacauc

SEQ ID NO: 297239 - RNA, 22 nt, Human
ugacauguauguuguuggcaug

SEQ ID NO: 297240 - RNA, 22 nt, Human
cagacagggaccucgcuccaga

SEQ ID NO: 297241 - RNA, 22 nt, Human
agguggaaauggcuuuccuagg

SEQ ID NO: 297242 - RNA, 22 nt, Human
auguguccaaggccacaauagc

SEQ ID NO: 297243 - RNA, 22 nt, Human
ucccaguggugggugcacauuu

SEQ ID NO: 297244 - RNA, 22 nt, Human
uuugucaucccuuuugaaacug

SEQ ID NO: 297245 - RNA, 22 nt, Human
uuccagagaaaagguuuauuuc

SEQ ID NO: 297246 - RNA, 17 nt, Human
ucagcaaagacaaagga

SEQ ID NO: 297247 - RNA, 22 nt, Human
ccuggaggcucugggagggcag

SEQ ID NO: 297248 - RNA, 21 nt, Human
auacauucuauuaagcauuua

SEQ ID NO: 297249 - RNA, 22 nt, Human
uagacauuuucucaacaucucu

SEQ ID NO: 297250 - RNA, 22 nt, Human
cccagcuucugagggggccuug

SEQ ID NO: 297251 - RNA, 22 nt, Human
ccagggcagcagaauuggggca

SEQ ID NO: 297252 - RNA, 18 nt, Human
auggucucauacugggag

SEQ ID NO: 297253 - RNA, 22 nt, Human
cauuuauuggcauguaguaggu

SEQ ID NO: 297254 - RNA, 22 nt, Human
augugucuuugagacucugcua

SEQ ID NO: 297255 - RNA, 22 nt, Human
uugcagcuucuaccacuguuuc

SEQ ID NO: 297256 - RNA, 22 nt, Human
gaggugucaggguagucaugau

SEQ ID NO: 297257 - RNA, 22 nt, Human
uguacauagaaaggauacagcu

SEQ ID NO: 297258 - RNA, 22 nt, Human
gcaggcaguuugcuuuucccuc

SEQ ID NO: 297259 - RNA, 22 nt, Human
uuuuaccugaaccacacaguau

SEQ ID NO: 297260 - RNA, 22 nt, Human
agcagggcagcuuuuuucagaa

SEQ ID NO: 297261 - RNA, 21 nt, Human
gggugggaggacacagcaggc

SEQ ID NO: 297262 - RNA, 22 nt, Human
accaggcacuccugaggucuga

SEQ ID NO: 297263 - RNA, 22 nt, Human
ugcaaaaauugcuggaaucuuu

SEQ ID NO: 297264 - RNA, 22 nt, Human
ggacauuuuucuuccuacaaug

SEQ ID NO: 297265 - RNA, 22 nt, Human
cuuuaugguaaguauagaugac

SEQ ID NO: 297266 - RNA, 22 nt, Human
ggcagguggccaagugucuaag

SEQ ID NO: 297267 - RNA, 22 nt, Human
gucacuuuacacuccuacuaaa

SEQ ID NO: 297268 - RNA, 22 nt, Human
uacagauauagagauuuauaga

SEQ ID NO: 297269 - RNA, 22 nt, Human
cagcuauuuucucauuaaggau

SEQ ID NO: 297270 - RNA, 22 nt, Human
uaggugucuugucacuaccguu

SEQ ID NO: 297271 - RNA, 23 nt, Human
ugcugcccacucuuccagcccuc

SEQ ID NO: 297272 - RNA, 14 nt, Human
gcaggcagaucacu

SEQ ID NO: 297273 - RNA, 22 nt, Human
uguaaaguuacuuuugaaagga

SEQ ID NO: 297274 - RNA, 22 nt, Human
acaggcagauuaaggguaggca

SEQ ID NO: 297275 - RNA, 22 nt, Human
ucuggguggcuucagaggccac

SEQ ID NO: 297276 - RNA, 22 nt, Human
cucuucaaaagucuaauccuua

SEQ ID NO: 297277 - RNA, 22 nt, Human
cacaugugcaaauacugaggcu

SEQ ID NO: 297278 - RNA, 22 nt, Human
uccugcugccauuucaagugcu

SEQ ID NO: 297279 - RNA, 22 nt, Human
cuauuucaaggcccagauauga

SEQ ID NO: 297280 - RNA, 22 nt, Human
aguacauauaguaauuuagcca

SEQ ID NO: 297281 - RNA, 22 nt, Human
ucuguccucuuugaagcugcuc

SEQ ID NO: 297282 - RNA, 22 nt, Human
cagagcauuuggaagccacgug

SEQ ID NO: 297283 - RNA, 22 nt, Human
agugugagaugauugaggagca

SEQ ID NO: 297284 - RNA, 22 nt, Human
aggcagguagaaggaucuuuau

SEQ ID NO: 297285 - RNA, 22 nt, Human
auguucuuucagccagugcauc

SEQ ID NO: 297286 - RNA, 22 nt, Human
auuauuagauucuuaauuguaa

SEQ ID NO: 297287 - RNA, 22 nt, Human
aaauacuagaauucagaguuga

SEQ ID NO: 297288 - RNA, 22 nt, Human
ccagcuuuuccucucauugcuu

SEQ ID NO: 297289 - RNA, 22 nt, Human
gaaacaugucugacaauuuacc

SEQ ID NO: 297290 - RNA, 22 nt, Human
aucaaguuuucuuaguugacug

SEQ ID NO: 297291 - RNA, 22 nt, Human
auguccuugagacccuccucgg

SEQ ID NO: 297292 - RNA, 22 nt, Human
agcuuuaugaggagaccuuagu

SEQ ID NO: 297293 - RNA, 22 nt, Human
aucagagauuguaguaugugca

SEQ ID NO: 297294 - RNA, 22 nt, Human
ggcaggcaguguggugugaaac

SEQ ID NO: 297295 - RNA, 22 nt, Human
agcuuuguggcuuugcaagacu

SEQ ID NO: 297296 - RNA, 22 nt, Human
gaaacccaaacuaagacaguag

SEQ ID NO: 297297 - RNA, 22 nt, Human
ccagagaggggaagggcuugcc

SEQ ID NO: 297298 - RNA, 22 nt, Human
uaaugucaaggugauagauuug

SEQ ID NO: 297299 - RNA, 22 nt, Human
aauacaaucaaauucacuagca

SEQ ID NO: 297300 - RNA, 22 nt, Human
ugcuggaguucgacauugcaaa

SEQ ID NO: 297301 - RNA, 22 nt, Human
ggcaggugccuucugugcuagc

SEQ ID NO: 297302 - RNA, 22 nt, Human
gggugggagaaaugaguaucua

SEQ ID NO: 297303 - RNA, 23 nt, Human
uccaggcacgcauuucuucuagc

SEQ ID NO: 297304 - RNA, 22 nt, Human
gggagcuggagcuggaagacuc

SEQ ID NO: 297305 - RNA, 22 nt, Human
ucagguguggucaccacagggu

SEQ ID NO: 297306 - RNA, 22 nt, Human
agauuuaaauuugcuacaauuc

SEQ ID NO: 297307 - RNA, 22 nt, Human
aaauuucuaagcagccacuucc

SEQ ID NO: 297308 - RNA, 22 nt, Human
uucucuuugacauuauucaggu

SEQ ID NO: 297309 - RNA, 22 nt, Human
cacugagcugauagaauuccag

SEQ ID NO: 297310 - RNA, 22 nt, Human
uauguguccuguuaccggcagc

SEQ ID NO: 297311 - RNA, 22 nt, Human
gacccagaaggagugcccuaga

SEQ ID NO: 297312 - RNA, 23 nt, Human
accaugaugggagugcaaauaag

SEQ ID NO: 297313 - RNA, 22 nt, Human
guacccagaggcaugaucccag

SEQ ID NO: 297314 - RNA, 22 nt, Human
uuugacucaagccuuucuuuag

SEQ ID NO: 297315 - RNA, 22 nt, Human
ucuguucagcugccucagggua

SEQ ID NO: 297316 - RNA, 22 nt, Human
uccaggcauaaugcccaguggu

SEQ ID NO: 297317 - RNA, 22 nt, Human
agcagggcuccauuucacugcc

SEQ ID NO: 297318 - RNA, 22 nt, Human
gggcugaccccaccccucacuc

SEQ ID NO: 297319 - RNA, 22 nt, Human
aaggugucauccaggauggugg

SEQ ID NO: 297320 - RNA, 22 nt, Human
gagcugaagcgcuacagcaucc

SEQ ID NO: 297321 - RNA, 22 nt, Human
acauuguaguuguucugcagca

SEQ ID NO: 297322 - RNA, 22 nt, Human
cuacugaguccuucagcugcca

SEQ ID NO: 297323 - RNA, 22 nt, Human
gagacaggccaggugguacuua

SEQ ID NO: 297324 - RNA, 22 nt, Human
agcugccauggccugaauuuac

SEQ ID NO: 297325 - RNA, 22 nt, Human
ccagggcaggagaaagacucac

SEQ ID NO: 297326 - RNA, 22 nt, Human
ugcugcauuugcaguccuuuaa

SEQ ID NO: 297327 - RNA, 22 nt, Human
gcagcuuugucacggagugucg

SEQ ID NO: 297328 - RNA, 19 nt, Human
cccagcuugaccaccugcu

SEQ ID NO: 297329 - RNA, 22 nt, Human
ugagagaguaauugagugguaa

SEQ ID NO: 297330 - RNA, 22 nt, Human
ccagguggcccugcccuacucu

SEQ ID NO: 297331 - RNA, 22 nt, Human
caugaaaaugucaaguucugcu

SEQ ID NO: 297332 - RNA, 22 nt, Human
cagcuuuaggacucauaauaaa

SEQ ID NO: 297333 - RNA, 22 nt, Human
aauugcuuacuguuuuucaccu

SEQ ID NO: 297334 - RNA, 22 nt, Human
auuuacugagcagcuaccaugu

SEQ ID NO: 297335 - RNA, 22 nt, Human
uccuucucugguuuuuacugua

SEQ ID NO: 297336 - RNA, 22 nt, Human
gaucugaagauaugaaauauuu

SEQ ID NO: 297337 - RNA, 22 nt, Human
ucuguucagacacuuuacaugu

SEQ ID NO: 297338 - RNA, 19 nt, Human
ucuuauugagcagcugagg

SEQ ID NO: 297339 - RNA, 22 nt, Human
cauuguaagcuguugaauccuc

SEQ ID NO: 297340 - RNA, 22 nt, Human
cacaaaugguuguagacauuaa

SEQ ID NO: 297341 - RNA, 23 nt, Human
acuauaaaguuguucugauuuac

SEQ ID NO: 297342 - RNA, 22 nt, Human
ggagcugaggacacuacauuuu

SEQ ID NO: 297343 - RNA, 22 nt, Human
uaguauaauuguucuggaauca

SEQ ID NO: 297344 - RNA, 21 nt, Human
caugugucuuguguuacugcu

SEQ ID NO: 297345 - RNA, 22 nt, Human
caggugucaaaauacuaagugg

SEQ ID NO: 297346 - RNA, 22 nt, Human
ucuauugcagauggaugcccuc

SEQ ID NO: 297347 - RNA, 22 nt, Human
auguuucagauacagaucaaau

SEQ ID NO: 297348 - RNA, 22 nt, Human
aaauguuuugcucccauguggu

SEQ ID NO: 297349 - RNA, 22 nt, Human
uucagagauggaaggcagaaug

SEQ ID NO: 297350 - RNA, 22 nt, Human
auuuugaugcuaucuaaugaau

SEQ ID NO: 297351 - RNA, 22 nt, Human
cacaggugcuccucggggagcu

SEQ ID NO: 297352 - RNA, 22 nt, Human
uucauucuugggaucagagagu

SEQ ID NO: 297353 - RNA, 22 nt, Human
gccugcaggcuguaguuuguga

SEQ ID NO: 297354 - RNA, 22 nt, Human
cuugaauccaaaugggagauga

SEQ ID NO: 297355 - RNA, 22 nt, Human
gacagguggguaccuuuaugga

SEQ ID NO: 297356 - RNA, 22 nt, Human
guuucuuagguaaauucuuuga

SEQ ID NO: 297357 - RNA, 23 nt, Human
ugcaggugugcagagggcucuug

SEQ ID NO: 297358 - RNA, 22 nt, Human
uggcagguggagacagcagagc

SEQ ID NO: 297359 - RNA, 22 nt, Human
ucagggcacguuucugcaaugc

SEQ ID NO: 297360 - RNA, 22 nt, Human
cauguugaauggccuugauuuu

SEQ ID NO: 297361 - RNA, 22 nt, Human
ggcagguggcacugcugcuccc

SEQ ID NO: 297362 - RNA, 22 nt, Human
gccucuagggcuguugggaauu

SEQ ID NO: 297363 - RNA, 22 nt, Human
auuugaauggcuuaacacaacg

SEQ ID NO: 297364 - RNA, 22 nt, Human
agagggcugcugcacagugcuc

SEQ ID NO: 297365 - RNA, 22 nt, Human
aauugcuuuaguuaccauagug

SEQ ID NO: 297366 - RNA, 22 nt, Human
gaggaggaaaggaguugaaaug

SEQ ID NO: 297367 - RNA, 22 nt, Human
cagggcucagaagacagaccuc

SEQ ID NO: 297368 - RNA, 22 nt, Human
uuuccagauuaagauaccacuu

SEQ ID NO: 297369 - RNA, 22 nt, Human
gcaugugugagaccuuuuagca

SEQ ID NO: 297370 - RNA, 22 nt, Human
ucuagggugugcggcagggcua

SEQ ID NO: 297371 - RNA, 22 nt, Human
ugacagguucguuagucauguu

SEQ ID NO: 297372 - RNA, 22 nt, Human
aauucauauggauaugcuagua

SEQ ID NO: 297373 - RNA, 22 nt, Human
ucuuuauuucugaaucccccau

SEQ ID NO: 297374 - RNA, 22 nt, Human
uguacauacauagauauacaca

SEQ ID NO: 297375 - RNA, 18 nt, Human
uuggaggauguccaugaa

SEQ ID NO: 297376 - RNA, 22 nt, Human
ucugugccaucagucuccagag

SEQ ID NO: 297377 - RNA, 22 nt, Human
ccuuccuuuuacugucuccgga

SEQ ID NO: 297378 - RNA, 22 nt, Human
cauugaaaaacguugacugagu

SEQ ID NO: 297379 - RNA, 20 nt, Human
guauuagguguuccucuuuc

SEQ ID NO: 297380 - RNA, 22 nt, Human
auuagagguacaaaccuucacu

SEQ ID NO: 297381 - RNA, 22 nt, Human
ggcucccaggagggccuggagg

SEQ ID NO: 297382 - RNA, 22 nt, Human
ucagggcaccaaaaaagaugcc

SEQ ID NO: 297383 - RNA, 22 nt, Human
auuuaauuuacauuugacagag

SEQ ID NO: 297384 - RNA, 22 nt, Human
gcagggcagcucacugugguuc

SEQ ID NO: 297385 - RNA, 22 nt, Human
ucccaggcuaggccucugcguu

SEQ ID NO: 297386 - RNA, 22 nt, Human
gaacuuggaacuggggcuacug

SEQ ID NO: 297387 - RNA, 22 nt, Human
guuauuagaagugaaggauugu

SEQ ID NO: 297388 - RNA, 22 nt, Human
uugcuucaguagcucuuuaaag

SEQ ID NO: 297389 - RNA, 22 nt, Human
acagguguugaaugaugucaca

SEQ ID NO: 297390 - RNA, 22 nt, Human
gaugaaaaucuugagaugucga

SEQ ID NO: 297391 - RNA, 22 nt, Human
uggaggaauaacagcaaccuua

SEQ ID NO: 297392 - RNA, 22 nt, Human
ugcuggagugcaguggcuuaac

SEQ ID NO: 297393 - RNA, 22 nt, Human
ucugaagagucuugcaagaaag

SEQ ID NO: 297394 - RNA, 22 nt, Human
aaaaugaugcuguaauuuggca

SEQ ID NO: 297395 - RNA, 22 nt, Human
ucuuccucuucugcugagaagu

SEQ ID NO: 297396 - RNA, 22 nt, Human
ugaaacacugcgauaaaauccu

SEQ ID NO: 297397 - RNA, 22 nt, Human
gcaugugugucacuuuccugcc

SEQ ID NO: 297398 - RNA, 22 nt, Human
aguguccuccucugggagccag

SEQ ID NO: 297399 - RNA, 22 nt, Human
aacaugugucuggcuagauugu

SEQ ID NO: 297400 - RNA, 22 nt, Human
uggucuggggaccgaggguuac

SEQ ID NO: 297401 - RNA, 22 nt, Human
cuguguccuuuaaaaaagacac

SEQ ID NO: 297402 - RNA, 23 nt, Human
aaggugucauugaugggauucua

SEQ ID NO: 297403 - RNA, 21 nt, Human
gggugggguuccagccuuuuc

SEQ ID NO: 297404 - RNA, 22 nt, Human
acagucuacuugagcuuguaua

SEQ ID NO: 297405 - RNA, 22 nt, Human
accaggcagcaccaaagccggu

SEQ ID NO: 297406 - RNA, 22 nt, Human
cccaugagguggagguugcagu

SEQ ID NO: 297407 - RNA, 21 nt, Human
uccaaaucccauucuguaguc

SEQ ID NO: 297408 - RNA, 22 nt, Human
uagacaggguggcuuagaaaca

SEQ ID NO: 297409 - RNA, 22 nt, Human
cauguaaagcauccuucuaggg

SEQ ID NO: 297410 - RNA, 22 nt, Human
gaaggcaucacagaggcugugg

SEQ ID NO: 297411 - RNA, 22 nt, Human
ccuggagggacccuggcccugu

SEQ ID NO: 297412 - RNA, 22 nt, Human
gggggcucugacucccucagcu

SEQ ID NO: 297413 - RNA, 22 nt, Human
uggucugguuauuucuuaauga

SEQ ID NO: 297414 - RNA, 22 nt, Human
agggcuccugaggcccuucugg

SEQ ID NO: 297415 - RNA, 22 nt, Human
agcucugacauugauucucagc

SEQ ID NO: 297416 - RNA, 22 nt, Human
ugcuggagagccuuggccaagg

SEQ ID NO: 297417 - RNA, 18 nt, Human
cucagagaugcccuuauu

SEQ ID NO: 297418 - RNA, 22 nt, Human
uauuuaguuaucuuucauaaaa

SEQ ID NO: 297419 - RNA, 22 nt, Human
caaauguauaaauguacuuucu

SEQ ID NO: 297420 - RNA, 22 nt, Human
gccaggcauuauuccgaucccu

SEQ ID NO: 297421 - RNA, 23 nt, Human
uaggugucuaguguccacuaugu

SEQ ID NO: 297422 - RNA, 22 nt, Human
uguuccugaaugccuggcuggc

SEQ ID NO: 297423 - RNA, 22 nt, Human
cacaucagggcugcuugggggu

SEQ ID NO: 297424 - RNA, 22 nt, Human
aaagcugcuuuaaacaucuaug

SEQ ID NO: 297425 - RNA, 22 nt, Human
auuccuucuauucucugugggu

SEQ ID NO: 297426 - RNA, 22 nt, Human
gggaccuggacaugugugugcu

SEQ ID NO: 297427 - RNA, 22 nt, Human
ucaugugucugcugcagcuguu

SEQ ID NO: 297428 - RNA, 22 nt, Human
uuucagauggagguuuaggaca

SEQ ID NO: 297429 - RNA, 22 nt, Human
aaaagucugcuuucuauuauca

SEQ ID NO: 297430 - RNA, 22 nt, Human
ugaaagcacaaguucuaacagg

SEQ ID NO: 297431 - RNA, 22 nt, Human
uguccuuuaugaaaugguguuu

SEQ ID NO: 297432 - RNA, 22 nt, Human
gauguacuugccuuaucuaucc

SEQ ID NO: 297433 - RNA, 22 nt, Human
ucuuccuucuuugaugacaagg

SEQ ID NO: 297434 - RNA, 22 nt, Human
auucuucacuguuucagaauga

SEQ ID NO: 297435 - RNA, 22 nt, Human
uauugcugacugucuucugagu

SEQ ID NO: 297436 - RNA, 22 nt, Human
uccugcagaucaaagccuuuga

SEQ ID NO: 297437 - RNA, 22 nt, Human
cgcagguguucaguaaauguau

SEQ ID NO: 297438 - RNA, 22 nt, Human
aucauucuauuguugagcugcc

SEQ ID NO: 297439 - RNA, 22 nt, Human
uuugacucugggugcuuuuucg

SEQ ID NO: 297440 - RNA, 22 nt, Human
gguuucaacuaaaucaagaagg

SEQ ID NO: 297441 - RNA, 22 nt, Human
uucaacuaauguuuauuuuaug

SEQ ID NO: 297442 - RNA, 22 nt, Human
ugucagaggcucagggucucag

SEQ ID NO: 297443 - RNA, 22 nt, Human
uauacauguuuuacauaaguga

SEQ ID NO: 297444 - RNA, 22 nt, Human
cacaggugccaucucuucaugg

SEQ ID NO: 297445 - RNA, 21 nt, Human
uuccagagauuguuucaccug

SEQ ID NO: 297446 - RNA, 22 nt, Human
uuguuucauggggauguuuauu

SEQ ID NO: 297447 - RNA, 22 nt, Human
ggauggcagacagugaguggcu

SEQ ID NO: 297448 - RNA, 22 nt, Human
gacugccagaaugugaggccug

SEQ ID NO: 297449 - RNA, 22 nt, Human
aggcagggcucauuucuuaggc

SEQ ID NO: 297450 - RNA, 22 nt, Human
uggaauguugauaaacauaggc

SEQ ID NO: 297451 - RNA, 22 nt, Human
uugcugauucuguauuuaaggu

SEQ ID NO: 297452 - RNA, 22 nt, Human
ggaacaggaaaggagggaugcu

SEQ ID NO: 297453 - RNA, 22 nt, Human
gcaaguacaaacgcaucggcug

SEQ ID NO: 297454 - RNA, 22 nt, Human
uuguaaauaguaguaagaugcc

SEQ ID NO: 297455 - RNA, 22 nt, Human
uuuccuuccagguuccuaaggc

SEQ ID NO: 297456 - RNA, 22 nt, Human
cacaggccugucucuuucuaac

SEQ ID NO: 297457 - RNA, 22 nt, Human
auuaauuuuucugacagccaca

SEQ ID NO: 297458 - RNA, 22 nt, Human
gaacuugggagaagggagugug

SEQ ID NO: 297459 - RNA, 22 nt, Human
ccagcuuuccaggguugacugg

SEQ ID NO: 297460 - RNA, 22 nt, Human
ugcuuaaaauaguucauuuuug

SEQ ID NO: 297461 - RNA, 22 nt, Human
uuucagaaagcugaacauauga

SEQ ID NO: 297462 - RNA, 22 nt, Human
gaaagcagcuaagucuuaugau

SEQ ID NO: 297463 - RNA, 22 nt, Human
cacaugugcaguuacaugaauu

SEQ ID NO: 297464 - RNA, 21 nt, Human
gccugcagaccccaccaggcu

SEQ ID NO: 297465 - RNA, 21 nt, Human
uagggcaggcauuggaagaga

SEQ ID NO: 297466 - RNA, 22 nt, Human
ugcagugguugagagcccagac

SEQ ID NO: 297467 - RNA, 22 nt, Human
cuuaaauucuuaaugcccucau

SEQ ID NO: 297468 - RNA, 22 nt, Human
gaggugucuguuaggaauaggc

SEQ ID NO: 297469 - RNA, 22 nt, Human
acauguguuuuccuacuuauga

SEQ ID NO: 297470 - RNA, 21 nt, Human
agcaacucugacuagaugagg

SEQ ID NO: 297471 - RNA, 22 nt, Human
ucugggaaugaauaagaccugu

SEQ ID NO: 297472 - RNA, 22 nt, Human
cuuauugaaagccccugugccu

SEQ ID NO: 297473 - RNA, 22 nt, Human
gcagggcagagggagaaucucu

SEQ ID NO: 297474 - RNA, 22 nt, Human
aacauauaaacucuuaaguuca

SEQ ID NO: 297475 - RNA, 22 nt, Human
auuuuacuuugugaauauugac

SEQ ID NO: 297476 - RNA, 22 nt, Human
agacaaguucugugggucaccu

SEQ ID NO: 297477 - RNA, 22 nt, Human
uuugcugacuggaugcaguugg

SEQ ID NO: 297478 - RNA, 22 nt, Human
cagggcucccaaauaucucuuc

SEQ ID NO: 297479 - RNA, 19 nt, Human
ucccaggaagcaaauguca

SEQ ID NO: 297480 - RNA, 22 nt, Human
cuuuacuucucaaaauaaagca

SEQ ID NO: 297481 - RNA, 22 nt, Human
gguuauauaauucagugcuuuc

SEQ ID NO: 297482 - RNA, 22 nt, Human
gacagacagagaaugggcuuga

SEQ ID NO: 297483 - RNA, 22 nt, Human
aagggcaggcacccacccucac

SEQ ID NO: 297484 - RNA, 22 nt, Human
cccaggcagugugugcaugcgu

SEQ ID NO: 297485 - RNA, 22 nt, Human
aaacagcuggucucaaauguuc

SEQ ID NO: 297486 - RNA, 20 nt, Human
ucauguguguccuacagaga

SEQ ID NO: 297487 - RNA, 22 nt, Human
cauuuguaguaucuguuuauau

SEQ ID NO: 297488 - RNA, 19 nt, Human
auacagauguauccaugau

SEQ ID NO: 297489 - RNA, 22 nt, Human
cacuuuauuauaaauuugagag

SEQ ID NO: 297490 - RNA, 22 nt, Human
agacagugcaagaagagcaggc

SEQ ID NO: 297491 - RNA, 22 nt, Human
uaugugucccugcuacucaaca

SEQ ID NO: 297492 - RNA, 22 nt, Human
acagugugaugggccugccuga

SEQ ID NO: 297493 - RNA, 22 nt, Human
ggagcaguuguugagcaagcca

SEQ ID NO: 297494 - RNA, 22 nt, Human
uccaggaggguuuucugccuuc

SEQ ID NO: 297495 - RNA, 22 nt, Human
cagaagcagaacacuagauuua

SEQ ID NO: 297496 - RNA, 21 nt, Human
aaauuucugcaagccucaacu

SEQ ID NO: 297497 - RNA, 22 nt, Human
uugaaucuggguacuuguaaua

SEQ ID NO: 297498 - RNA, 21 nt, Human
ucucuccucaagcucgacccc

SEQ ID NO: 297499 - RNA, 21 nt, Human
auuucagagcacacaaguaaa

SEQ ID NO: 297500 - RNA, 22 nt, Human
ugggcagggucucuguuaucag

SEQ ID NO: 297501 - RNA, 22 nt, Human
aaagcuaugaggcaugcauuuc

SEQ ID NO: 297502 - RNA, 22 nt, Human
uccugcagccaagggucaucga

SEQ ID NO: 297503 - RNA, 22 nt, Human
ccacugaggcaggcaguaucua

SEQ ID NO: 297504 - RNA, 22 nt, Human
ugaaugauuugggugcauucag

SEQ ID NO: 297505 - RNA, 22 nt, Human
uuuguacauauauaaaaucugu

SEQ ID NO: 297506 - RNA, 22 nt, Human
cccuuccugggugucccggagu

SEQ ID NO: 297507 - RNA, 22 nt, Human
gacagacagggguucuccugga

SEQ ID NO: 297508 - RNA, 22 nt, Human
auguccagggcacacagcagug

SEQ ID NO: 297509 - RNA, 22 nt, Human
uguugcugacaagagaggagca

SEQ ID NO: 297510 - RNA, 22 nt, Human
ugagauguaagguaugcuuacu

SEQ ID NO: 297511 - RNA, 22 nt, Human
acaggccugagauuuugcauuu

SEQ ID NO: 297512 - RNA, 22 nt, Human
aucuuucuccauauacaucuuu

SEQ ID NO: 297513 - RNA, 17 nt, Human
accaggcaacacgccca

SEQ ID NO: 297514 - RNA, 22 nt, Human
uccaagcucucuaugccaugau

SEQ ID NO: 297515 - RNA, 22 nt, Human
uagggaugaagaugguauuucu

SEQ ID NO: 297516 - RNA, 22 nt, Human
cuguccuccagacgacaguccc

SEQ ID NO: 297517 - RNA, 22 nt, Human
uuuccuucaucaucugagagcu

SEQ ID NO: 297518 - RNA, 22 nt, Human
auuuauuaugggauuuggcaca

SEQ ID NO: 297519 - RNA, 22 nt, Human
agcagggcuucugugccugugc

SEQ ID NO: 297520 - RNA, 22 nt, Human
cuuagggaaucuuagagcugga

SEQ ID NO: 297521 - RNA, 22 nt, Human
acuguauuuggauauaagaucu

SEQ ID NO: 297522 - RNA, 22 nt, Human
agagcaauggcauccagcugau

SEQ ID NO: 297523 - RNA, 22 nt, Human
uuccauacgacugaggucucgg

SEQ ID NO: 297524 - RNA, 22 nt, Human
cuugcuggaaacucucucugcc

SEQ ID NO: 297525 - RNA, 22 nt, Human
uuugcugauauuuugcugauac

SEQ ID NO: 297526 - RNA, 22 nt, Human
acagagagaaacaaucagcagc

SEQ ID NO: 297527 - RNA, 22 nt, Human
ucuggcuggcagugauggugug

SEQ ID NO: 297528 - RNA, 22 nt, Human
uauuucccagggagcaacaagc

SEQ ID NO: 297529 - RNA, 21 nt, Human
auacacauacacauaaaugug

SEQ ID NO: 297530 - RNA, 22 nt, Human
uauuuccaccuauuauuuucug

SEQ ID NO: 297531 - RNA, 22 nt, Human
aaaacauucugugaacucucaa

SEQ ID NO: 297532 - RNA, 22 nt, Human
caaauguauucucacuucaggg

SEQ ID NO: 297533 - RNA, 22 nt, Human
uggcagggccugcucaucaucc

SEQ ID NO: 297534 - RNA, 22 nt, Human
cugcgugucucugucucauggc

SEQ ID NO: 297535 - RNA, 22 nt, Human
acuuguucauugaguacauaug

SEQ ID NO: 297536 - RNA, 22 nt, Human
ucagggcagccuaaggcaccuc

SEQ ID NO: 297537 - RNA, 22 nt, Human
uggagcagcucuagcgggcgcc

SEQ ID NO: 297538 - RNA, 22 nt, Human
ugcacacacucugcauauacuu

SEQ ID NO: 297539 - RNA, 22 nt, Human
cuguccuuacugcuucuggcuu

SEQ ID NO: 297540 - RNA, 22 nt, Human
acucuuauaguauugguuauua

SEQ ID NO: 297541 - RNA, 22 nt, Human
cagcaugaugcucacacaaaac

SEQ ID NO: 297542 - RNA, 22 nt, Human
uuauuaggaacucaggauuuuu

SEQ ID NO: 297543 - RNA, 22 nt, Human
ggagcugaguucuucagccggg

SEQ ID NO: 297544 - RNA, 20 nt, Human
ccagguggugccuggagagg

SEQ ID NO: 297545 - RNA, 19 nt, Human
uccaggaggcugccauuga

SEQ ID NO: 297546 - RNA, 22 nt, Human
aagggcaggagaagacggauau

SEQ ID NO: 297547 - RNA, 22 nt, Human
gagggaccccaggcuggcccuu

SEQ ID NO: 297548 - RNA, 22 nt, Human
ucugggugucacuccugccugc

SEQ ID NO: 297549 - RNA, 22 nt, Human
uccugcagcucugagaagcauc

SEQ ID NO: 297550 - RNA, 22 nt, Human
aacaggcaggagaauucugccu

SEQ ID NO: 297551 - RNA, 22 nt, Human
ugggcuccaauuuguccuuuca

SEQ ID NO: 297552 - RNA, 22 nt, Human
ugcuggagcaacauuauugugc

SEQ ID NO: 297553 - RNA, 20 nt, Human
ugcaggugggcccuucuggg

SEQ ID NO: 297554 - RNA, 22 nt, Human
cuggaagcuuguuugccagucu

SEQ ID NO: 297555 - RNA, 22 nt, Human
auacaacuuuaucuguaaugag

SEQ ID NO: 297556 - RNA, 22 nt, Human
auucugggcgccuauggcugca

SEQ ID NO: 297557 - RNA, 22 nt, Human
uggcuggagagggucccaugag

SEQ ID NO: 297558 - RNA, 22 nt, Human
acccagcuaacccuacccugga

SEQ ID NO: 297559 - RNA, 22 nt, Human
uucacaaaacacuauuuucugg

SEQ ID NO: 297560 - RNA, 22 nt, Human
uuuaacauguucaagaaacaua

SEQ ID NO: 297561 - RNA, 22 nt, Human
uguuucaugauugcugucauuu

SEQ ID NO: 297562 - RNA, 22 nt, Human
gucucuaucauagcugaacccu

SEQ ID NO: 297563 - RNA, 22 nt, Human
cugcagggaccacaagcagguu

SEQ ID NO: 297564 - RNA, 22 nt, Human
aaaagcagaccacgcuuugugg

SEQ ID NO: 297565 - RNA, 20 nt, Human
aguuuauuccaggagaacug

SEQ ID NO: 297566 - RNA, 22 nt, Human
ggcuuuauguuuuucauguggu

SEQ ID NO: 297567 - RNA, 22 nt, Human
caaauaguaugagcaaugauuc

SEQ ID NO: 297568 - RNA, 22 nt, Human
cuucuucauguauugauagucu

SEQ ID NO: 297569 - RNA, 22 nt, Human
ugacuuccagcaacuuccucca

SEQ ID NO: 297570 - RNA, 22 nt, Human
gcucucuuuuuccagugguggu

SEQ ID NO: 297571 - RNA, 22 nt, Human
uucuaaaauaaguuuaucuggu

SEQ ID NO: 297572 - RNA, 22 nt, Human
agggaccugcucacugccuggc

SEQ ID NO: 297573 - RNA, 22 nt, Human
gggucccuggaauuacuugaca

SEQ ID NO: 297574 - RNA, 22 nt, Human
ccuguucagagcuaagcaucau

SEQ ID NO: 297575 - RNA, 22 nt, Human
agcagguguauauaaggcugag

SEQ ID NO: 297576 - RNA, 22 nt, Human
cagaguguuucuuugggugggu

SEQ ID NO: 297577 - RNA, 19 nt, Human
aaaagucuauucaauuaca

SEQ ID NO: 297578 - RNA, 22 nt, Human
aagauuuauuagaugcuuaccu

SEQ ID NO: 297579 - RNA, 21 nt, Human
ugacagcauagagcagggagg

SEQ ID NO: 297580 - RNA, 22 nt, Human
ugcuggagucucuugacccugg

SEQ ID NO: 297581 - RNA, 22 nt, Human
uauguguccuaagcaaucaucc

SEQ ID NO: 297582 - RNA, 22 nt, Human
ggcaggcaucaucaguugauca

SEQ ID NO: 297583 - RNA, 19 nt, Human
cuccucagucccagagguc

SEQ ID NO: 297584 - RNA, 18 nt, Human
aaauuagauggaccugug

SEQ ID NO: 297585 - RNA, 22 nt, Human
uccuuucugucuuuacucugga

SEQ ID NO: 297586 - RNA, 22 nt, Human
uagggcucugagaguucagccu

SEQ ID NO: 297587 - RNA, 22 nt, Human
ccuggagguggagguugcagug

SEQ ID NO: 297588 - RNA, 22 nt, Human
gccaggcauuuauugauugaau

SEQ ID NO: 297589 - RNA, 22 nt, Human
uggaccugcuggaugggcaggu

SEQ ID NO: 297590 - RNA, 22 nt, Human
uuuaucugagcugauagauagu

SEQ ID NO: 297591 - RNA, 22 nt, Human
agcagggcagguaaggaucaga

SEQ ID NO: 297592 - RNA, 22 nt, Human
uucaacucuucaagaucacauc

SEQ ID NO: 297593 - RNA, 21 nt, Human
cuguccuggucuagaggcaca

SEQ ID NO: 297594 - RNA, 23 nt, Human
agcugcaagacucccugucugag

SEQ ID NO: 297595 - RNA, 22 nt, Human
uaguuuuacuugcgaugauaau

SEQ ID NO: 297596 - RNA, 22 nt, Human
gcaguucuacuuauccauagac

SEQ ID NO: 297597 - RNA, 22 nt, Human
agucaaagaugaccgaguuccu

SEQ ID NO: 297598 - RNA, 22 nt, Human
aacuuuaucggaacagguacuc

SEQ ID NO: 297599 - RNA, 22 nt, Human
acaggugggcuuaagagucggc

SEQ ID NO: 297600 - RNA, 21 nt, Human
ucugggugcuaguguuugcuu

SEQ ID NO: 297601 - RNA, 22 nt, Human
auuugcaugcuucuauugugaa

SEQ ID NO: 297602 - RNA, 22 nt, Human
caguguggagggagagagccug

SEQ ID NO: 297603 - RNA, 22 nt, Human
ggguguagacacauguucaucu

SEQ ID NO: 297604 - RNA, 22 nt, Human
ugacugaaauggcgacagugaa

SEQ ID NO: 297605 - RNA, 22 nt, Human
uuugacucuuaaguggcucaau

SEQ ID NO: 297606 - RNA, 22 nt, Human
caggaaagaaaugagaacacca

SEQ ID NO: 297607 - RNA, 22 nt, Human
acauguguacuuuuaaggaugu

SEQ ID NO: 297608 - RNA, 22 nt, Human
ucuguggauuuuaguguucaug

SEQ ID NO: 297609 - RNA, 22 nt, Human
cucagagauauagucccugcuu

SEQ ID NO: 297610 - RNA, 22 nt, Human
cagcuuuuuagaaucuagggca

SEQ ID NO: 297611 - RNA, 22 nt, Human
gguguccuacugcuugguugcu

SEQ ID NO: 297612 - RNA, 22 nt, Human
acagagagggagugauaaaucc

SEQ ID NO: 297613 - RNA, 22 nt, Human
ugcuuuauucaggguuuacccc

SEQ ID NO: 297614 - RNA, 22 nt, Human
uauuccagugugaucuuuguag

SEQ ID NO: 297615 - RNA, 23 nt, Human
guaggaauuuucacuuccucuug

SEQ ID NO: 297616 - RNA, 22 nt, Human
augauugcagcccuacagcugu

SEQ ID NO: 297617 - RNA, 22 nt, Human
caaaaacugcaauuacuuuuac

SEQ ID NO: 297618 - RNA, 22 nt, Human
auugcuuuguacaugccuagca

SEQ ID NO: 297619 - RNA, 22 nt, Human
guguccugccacccugggcuuu

SEQ ID NO: 297620 - RNA, 20 nt, Human
uccaggcagcucagaguguc

SEQ ID NO: 297621 - RNA, 20 nt, Human
uccuucugaggugaggagga

SEQ ID NO: 297622 - RNA, 22 nt, Human
agacagacauucuagagccacc

SEQ ID NO: 297623 - RNA, 22 nt, Human
aaggugguaggcuauaucagua

SEQ ID NO: 297624 - RNA, 18 nt, Human
uuuuaauuucaggggugg

SEQ ID NO: 297625 - RNA, 22 nt, Human
ggguuucaugguucucacaaug

SEQ ID NO: 297626 - RNA, 22 nt, Human
acauuuaaguuaaaaccucagu

SEQ ID NO: 297627 - RNA, 22 nt, Human
cauuuguauagugcuuagacca

SEQ ID NO: 297628 - RNA, 22 nt, Human
aaauuucuugaggcucucuagc

SEQ ID NO: 297629 - RNA, 19 nt, Human
gagggcucauuugaacaau

SEQ ID NO: 297630 - RNA, 21 nt, Human
uuacaaagcaagugcuguguc

SEQ ID NO: 297631 - RNA, 22 nt, Human
gagcacccuuugcacaucaguc

SEQ ID NO: 297632 - RNA, 18 nt, Human
aggcaggugcuggaaguc

SEQ ID NO: 297633 - RNA, 22 nt, Human
guccagugacaaguagcuggcc

SEQ ID NO: 297634 - RNA, 21 nt, Human
cagcuucuucugugaccuggu

SEQ ID NO: 297635 - RNA, 22 nt, Human
augcuuuuccaggagaaauaua

SEQ ID NO: 297636 - RNA, 22 nt, Human
cucuuaaagaauguuccagcug

SEQ ID NO: 297637 - RNA, 22 nt, Human
guccugguccugccuccccaug

SEQ ID NO: 297638 - RNA, 22 nt, Human
guuaucaugcuucaucaucacu

SEQ ID NO: 297639 - RNA, 22 nt, Human
aaauaaguaguuuaguguugug

SEQ ID NO: 297640 - RNA, 22 nt, Human
aaacacauuagcccuguggaaa

SEQ ID NO: 297641 - RNA, 22 nt, Human
augcacauaggccaaaucauuu

SEQ ID NO: 297642 - RNA, 21 nt, Human
uuuagggaccaggucauaggc

SEQ ID NO: 297643 - RNA, 22 nt, Human
uucugugauugacauguggcuu

SEQ ID NO: 297644 - RNA, 22 nt, Human
uggcagguuggccuuugguuca

SEQ ID NO: 297645 - RNA, 20 nt, Human
uauuuacaacuuagagccuc

SEQ ID NO: 297646 - RNA, 22 nt, Human
uacauaauaaggggcauggugu

SEQ ID NO: 297647 - RNA, 22 nt, Human
auuguuaugaaaauaagauguu

SEQ ID NO: 297648 - RNA, 22 nt, Human
auuuccuguugcuuuugccacu

SEQ ID NO: 297649 - RNA, 22 nt, Human
uucauguauuuaucauguaaau

SEQ ID NO: 297650 - RNA, 22 nt, Human
guccuggugcuggucauugucg

SEQ ID NO: 297651 - RNA, 22 nt, Human
uuccucagagggcgcuggggaa

SEQ ID NO: 297652 - RNA, 22 nt, Human
agccagagcagggaauuggaca

SEQ ID NO: 297653 - RNA, 22 nt, Human
uccaaauucuagggccuugguu

SEQ ID NO: 297654 - RNA, 18 nt, Human
aucuuuccauagcauguu

SEQ ID NO: 297655 - RNA, 22 nt, Human
acuucaugcagaagagagcugu

SEQ ID NO: 297656 - RNA, 22 nt, Human
cagguaguccacagugagggag

SEQ ID NO: 297657 - RNA, 22 nt, Human
accauccugaaaccuucaugcu

SEQ ID NO: 297658 - RNA, 22 nt, Human
uccugcaggggcugaggaacca

SEQ ID NO: 297659 - RNA, 22 nt, Human
cuuuaguuauuuagacuacagu

SEQ ID NO: 297660 - RNA, 22 nt, Human
uucagauguggcuuugucaggc

SEQ ID NO: 297661 - RNA, 20 nt, Human
uuucugugagaaacacuguu

SEQ ID NO: 297662 - RNA, 22 nt, Human
ugguuccaagauggcugccaca

SEQ ID NO: 297663 - RNA, 22 nt, Human
uuucuucuugauuuaaacaggg

SEQ ID NO: 297664 - RNA, 22 nt, Human
ggggaccugggcuucaaggguu

SEQ ID NO: 297665 - RNA, 18 nt, Human
cuuuaugugcagagcuuu

SEQ ID NO: 297666 - RNA, 22 nt, Human
ucuucacaggagccugccugcc

SEQ ID NO: 297667 - RNA, 22 nt, Human
gcagguguggguggcugccagg

SEQ ID NO: 297668 - RNA, 22 nt, Human
aggaccuguguuuuccuugaau

SEQ ID NO: 297669 - RNA, 22 nt, Human
uuacauguuuacggauacacuu

SEQ ID NO: 297670 - RNA, 22 nt, Human
cccugcagugugaccucaccua

SEQ ID NO: 297671 - RNA, 22 nt, Human
ugcuuuauggauuuguguccug

SEQ ID NO: 297672 - RNA, 22 nt, Human
ucaggagcuugguagugugauu

SEQ ID NO: 297673 - RNA, 22 nt, Human
aagauuauuuaagacaggaacc

SEQ ID NO: 297674 - RNA, 22 nt, Human
gcaaaaaaugcuuguugcuuag

SEQ ID NO: 297675 - RNA, 22 nt, Human
gaggugucauuuaguuaaucag

SEQ ID NO: 297676 - RNA, 22 nt, Human
aaagcagguugcaauuacagug

SEQ ID NO: 297677 - RNA, 22 nt, Human
cuuuaguucuagaaagugaaac

SEQ ID NO: 297678 - RNA, 22 nt, Human
ugggaccucucuugagagagca

SEQ ID NO: 297679 - RNA, 22 nt, Human
cauuuaaagguuguggguaaaa

SEQ ID NO: 297680 - RNA, 22 nt, Human
uuaauuuuaaccuguuuguguc

SEQ ID NO: 297681 - RNA, 19 nt, Human
ccaggccugcgggcguugg

SEQ ID NO: 297682 - RNA, 22 nt, Human
aggugagguuugggagguguca

SEQ ID NO: 297683 - RNA, 22 nt, Human
ccagccuuacugcccuucagug

SEQ ID NO: 297684 - RNA, 22 nt, Human
ggcaggugaucuagagucaaua

SEQ ID NO: 297685 - RNA, 22 nt, Human
uaaggcauaaggccagaggcua

SEQ ID NO: 297686 - RNA, 22 nt, Human
ccaggccucccuuuuccagcca

SEQ ID NO: 297687 - RNA, 22 nt, Human
guuauugagacauagaguuaug

SEQ ID NO: 297688 - RNA, 21 nt, Human
cacuccacuuagaacaggguu

SEQ ID NO: 297689 - RNA, 22 nt, Human
gacagacaccugggggguugcu

SEQ ID NO: 297690 - RNA, 21 nt, Human
gcaaauguucaggaaaaaaga

SEQ ID NO: 297691 - RNA, 19 nt, Human
ugcuuccucaccaucuccc

SEQ ID NO: 297692 - RNA, 22 nt, Human
accauuuaaggaaaauguauca

SEQ ID NO: 297693 - RNA, 22 nt, Human
aagcaauauacugauaugauua

SEQ ID NO: 297694 - RNA, 22 nt, Human
gguccucaaucccaacaaggca

SEQ ID NO: 297695 - RNA, 22 nt, Human
ugcaggugcguuuucaagccuc

SEQ ID NO: 297696 - RNA, 22 nt, Human
gccugcagccagggaguucucu

SEQ ID NO: 297697 - RNA, 22 nt, Human
ugauguucuguauaucauauag

SEQ ID NO: 297698 - RNA, 16 nt, Human
cagcuuuaugucagug

SEQ ID NO: 297699 - RNA, 22 nt, Human
guucuucaucauuaacacucug

SEQ ID NO: 297700 - RNA, 22 nt, Human
augcacuacuuggcuuuacuga

SEQ ID NO: 297701 - RNA, 22 nt, Human
gacagacacagggccaugauug

SEQ ID NO: 297702 - RNA, 22 nt, Human
gaauacaugauacaugaacugc

SEQ ID NO: 297703 - RNA, 22 nt, Human
gcauucuuuuuaggagguuccu

SEQ ID NO: 297704 - RNA, 22 nt, Human
uucagcaagaccaccauguacc

SEQ ID NO: 297705 - RNA, 22 nt, Human
uuaacauacaucaugaacaaug

SEQ ID NO: 297706 - RNA, 22 nt, Human
caugaggucagggggagccggu

SEQ ID NO: 297707 - RNA, 22 nt, Human
gcaaauucuuaacuggacugug

SEQ ID NO: 297708 - RNA, 22 nt, Human
uggaccugggguggccuccucu

SEQ ID NO: 297709 - RNA, 22 nt, Human
uuaaauauuauguugucugcaa

SEQ ID NO: 297710 - RNA, 22 nt, Human
uguuuuaagagcgcacuuuaua

SEQ ID NO: 297711 - RNA, 22 nt, Human
uguggggcagcuagccggccug

SEQ ID NO: 297712 - RNA, 22 nt, Human
gccuggguccacugaucaugcu

SEQ ID NO: 297713 - RNA, 22 nt, Human
cuugaaguugcaaaacauuaau

SEQ ID NO: 297714 - RNA, 22 nt, Human
uugcacuccagcccgagcaaca

SEQ ID NO: 297715 - RNA, 22 nt, Human
aucauuucccuuuagaucacaa

SEQ ID NO: 297716 - RNA, 22 nt, Human
gaggcauaaguagaagagauug

SEQ ID NO: 297717 - RNA, 22 nt, Human
agcucccagaagccagagucgg

SEQ ID NO: 297718 - RNA, 17 nt, Human
ggaggcaacagacaggg

SEQ ID NO: 297719 - RNA, 22 nt, Human
cuuaaagaguauuuaauauaau

SEQ ID NO: 297720 - RNA, 22 nt, Human
agcugcaaaccaggccggcgcg

SEQ ID NO: 297721 - RNA, 22 nt, Human
acagauguacacucauauauaa

SEQ ID NO: 297722 - RNA, 22 nt, Human
aagaguuuaugauauaacaugu

SEQ ID NO: 297723 - RNA, 21 nt, Human
acagacagggccagugucccc

SEQ ID NO: 297724 - RNA, 22 nt, Human
aagaacuuccuaauauauuuuc

SEQ ID NO: 297725 - RNA, 22 nt, Human
gcugguccagggccucuguggg

SEQ ID NO: 297726 - RNA, 22 nt, Human
uggcaggugccuguaaucucag

SEQ ID NO: 297727 - RNA, 22 nt, Human
agugugaguuugguugagacuu

SEQ ID NO: 297728 - RNA, 22 nt, Human
auuucucaucaagugccaacuc

SEQ ID NO: 297729 - RNA, 22 nt, Human
uacaggugguaaaaauauuguu

SEQ ID NO: 297730 - RNA, 22 nt, Human
uaauaucuacuucauagaguuu

SEQ ID NO: 297731 - RNA, 22 nt, Human
ucugggugccacugucuguaca

SEQ ID NO: 297732 - RNA, 22 nt, Human
ccuggaggcagaaauaggacuu

SEQ ID NO: 297733 - RNA, 20 nt, Human
aggaggaagaaagcacacug

SEQ ID NO: 297734 - RNA, 22 nt, Human
aguuuccaaagcauguucacac

SEQ ID NO: 297735 - RNA, 22 nt, Human
uuuauacuccacucugcaagcg

SEQ ID NO: 297736 - RNA, 22 nt, Human
uuggaacauccaggacagauau

SEQ ID NO: 297737 - RNA, 19 nt, Human
cuucuucuuggcagccaag

SEQ ID NO: 297738 - RNA, 22 nt, Human
uugcauuccaguccccacugug

SEQ ID NO: 297739 - RNA, 22 nt, Human
uuucagaugugugucucugaag

SEQ ID NO: 297740 - RNA, 22 nt, Human
uuucaaauaccauaaaccuaau

SEQ ID NO: 297741 - RNA, 22 nt, Human
aggaggaaggcuucauuagguu

SEQ ID NO: 297742 - RNA, 22 nt, Human
gcaggugggggucggugcaucu

SEQ ID NO: 297743 - RNA, 22 nt, Human
ugcagggaauccagucuagggu

SEQ ID NO: 297744 - RNA, 22 nt, Human
uuuccaagagcuuauuucugaa

SEQ ID NO: 297745 - RNA, 22 nt, Human
ugcauugauagaaaaacaugga

SEQ ID NO: 297746 - RNA, 17 nt, Human
uccuggauccauggugg

SEQ ID NO: 297747 - RNA, 22 nt, Human
ccauguguucaauaagggaguu

SEQ ID NO: 297748 - RNA, 22 nt, Human
gcugccacauuuucaggacuaa

SEQ ID NO: 297749 - RNA, 22 nt, Human
cuaggguggauuugugcagagu

SEQ ID NO: 297750 - RNA, 22 nt, Human
uccgccaggacugagggcccau

SEQ ID NO: 297751 - RNA, 22 nt, Human
uauugcugaaaugcugaguuca

SEQ ID NO: 297752 - RNA, 17 nt, Human
cucuggaauuggugaag

SEQ ID NO: 297753 - RNA, 22 nt, Human
uucuuauagaagcaaccauugu

SEQ ID NO: 297754 - RNA, 22 nt, Human
cagcuuugccaaguaaggucuu

SEQ ID NO: 297755 - RNA, 22 nt, Human
uguuugcuuacuuguaugcugc

SEQ ID NO: 297756 - RNA, 22 nt, Human
ggcuuuauaggguagaggauca

SEQ ID NO: 297757 - RNA, 22 nt, Human
cuguccuguggugacagguaca

SEQ ID NO: 297758 - RNA, 22 nt, Human
auaugcaagcacauagaauacu

SEQ ID NO: 297759 - RNA, 22 nt, Human
ggcagugggaaauaagugagaa

SEQ ID NO: 297760 - RNA, 22 nt, Human
uuugcugaauaaaugugugacu

SEQ ID NO: 297761 - RNA, 22 nt, Human
uagguauaauauuuugaagaaa

SEQ ID NO: 297762 - RNA, 22 nt, Human
uggaugcugcugucagggaugg

SEQ ID NO: 297763 - RNA, 19 nt, Human
ugacagagagcaggguggu

SEQ ID NO: 297764 - RNA, 22 nt, Human
ccuggaucccgauggcugugag

SEQ ID NO: 297765 - RNA, 22 nt, Human
cagugagggcauucagugcugg

SEQ ID NO: 297766 - RNA, 23 nt, Human
uuaggcacuuaguagggccagag

SEQ ID NO: 297767 - RNA, 22 nt, Human
uuguaaaguucuuaggaagcuc

SEQ ID NO: 297768 - RNA, 22 nt, Human
ugcaggugguuuggacacugcu

SEQ ID NO: 297769 - RNA, 22 nt, Human
gacaugugucugcaaguugauc

SEQ ID NO: 297770 - RNA, 22 nt, Human
ugcagguggacacgggagacgg

SEQ ID NO: 297771 - RNA, 20 nt, Human
aaugaggucccacugaggag

SEQ ID NO: 297772 - RNA, 22 nt, Human
gggucuccauguuaacaucacu

SEQ ID NO: 297773 - RNA, 22 nt, Human
ucuucaaagaauuuuaguaauu

SEQ ID NO: 297774 - RNA, 17 nt, Human
agacagguuauaguuga

SEQ ID NO: 297775 - RNA, 22 nt, Human
uuauucagauuggcuacaggau

SEQ ID NO: 297776 - RNA, 22 nt, Human
ugcagggauccuagcugaagag

SEQ ID NO: 297777 - RNA, 22 nt, Human
auauuagggucucuaaauucua

SEQ ID NO: 297778 - RNA, 22 nt, Human
gauguacuuuaaaauacuucag

SEQ ID NO: 297779 - RNA, 22 nt, Human
uuuccuucccuggaugagaagu

SEQ ID NO: 297780 - RNA, 22 nt, Human
ccacccagaccagggaucuggg

SEQ ID NO: 297781 - RNA, 20 nt, Human
ggcaggugcucgcuuggucu

SEQ ID NO: 297782 - RNA, 22 nt, Human
gcacccagaggucagcagugcu

SEQ ID NO: 297783 - RNA, 22 nt, Human
uuauacuaaaacgcauugaauu

SEQ ID NO: 297784 - RNA, 22 nt, Human
uuucucagcucagcaucugggu

SEQ ID NO: 297785 - RNA, 22 nt, Human
uuccagugacuaagcuucugcu

SEQ ID NO: 297786 - RNA, 22 nt, Human
auaaauugugcuuuugacaucu

SEQ ID NO: 297787 - RNA, 22 nt, Human
uccugcagaccucagucagguc

SEQ ID NO: 297788 - RNA, 22 nt, Human
uccagaccaugugagaggcgca

SEQ ID NO: 297789 - RNA, 22 nt, Human
cccugcagaucagugagaacuu

SEQ ID NO: 297790 - RNA, 22 nt, Human
caggccucuccuuagucuggca

SEQ ID NO: 297791 - RNA, 22 nt, Human
cauccagggcagccauggccug

SEQ ID NO: 297792 - RNA, 22 nt, Human
aagcuuuaugacuuggagacag

SEQ ID NO: 297793 - RNA, 20 nt, Human
cuggguggcaagcaaggggg

SEQ ID NO: 297794 - RNA, 22 nt, Human
cccugcagacgucuugaugccu

SEQ ID NO: 297795 - RNA, 22 nt, Human
acaguguagaauccuguacuua

SEQ ID NO: 297796 - RNA, 22 nt, Human
uguccucaggaccuggcacagu

SEQ ID NO: 297797 - RNA, 22 nt, Human
agagggcuuugauucucaguuc

SEQ ID NO: 297798 - RNA, 22 nt, Human
cagcaggugucuagcaaggguc

SEQ ID NO: 297799 - RNA, 22 nt, Human
gaggugucccugacccuuugca

SEQ ID NO: 297800 - RNA, 22 nt, Human
aguauucuggaauucuauguga

SEQ ID NO: 297801 - RNA, 22 nt, Human
acaguuaaauauuucuacuggg

SEQ ID NO: 297802 - RNA, 22 nt, Human
gucaaauauacuaagagguaaa

SEQ ID NO: 297803 - RNA, 22 nt, Human
cagggcagggccacacccccug

SEQ ID NO: 297804 - RNA, 22 nt, Human
ccugggugaaugauauucuaaa

SEQ ID NO: 297805 - RNA, 22 nt, Human
ugcuggguguuccgcacuugac

SEQ ID NO: 297806 - RNA, 21 nt, Human
uuucugaaggcaacaucuauc

SEQ ID NO: 297807 - RNA, 22 nt, Human
ucuggccccuggcaguccugga

SEQ ID NO: 297808 - RNA, 22 nt, Human
ucuagggaacaugggucaagcu

SEQ ID NO: 297809 - RNA, 22 nt, Human
acuguucaagcaaaugacauug

SEQ ID NO: 297810 - RNA, 22 nt, Human
cuucaguucuaaaguagaaugu

SEQ ID NO: 297811 - RNA, 22 nt, Human
uauuagguaaaggacuugcagg

SEQ ID NO: 297812 - RNA, 17 nt, Human
ccagagaguaguuagga

SEQ ID NO: 297813 - RNA, 22 nt, Human
caaaugauacuguuuuuagucu

SEQ ID NO: 297814 - RNA, 22 nt, Human
aauuaugagguagauaucacau

SEQ ID NO: 297815 - RNA, 22 nt, Human
uuuauauguauugacuuugaug

SEQ ID NO: 297816 - RNA, 22 nt, Human
cagaggcugccagccaugugca

SEQ ID NO: 297817 - RNA, 15 nt, Human
gcaggcaggucaccu

SEQ ID NO: 297818 - RNA, 22 nt, Human
ugucuuuauauauuuggaaaau

SEQ ID NO: 297819 - RNA, 22 nt, Human
cuggguguuggguacugaccgu

SEQ ID NO: 297820 - RNA, 22 nt, Human
uacuuucuuucccaagaggugg

SEQ ID NO: 297821 - RNA, 22 nt, Human
gacaggcuuccuaagugccaga

SEQ ID NO: 297822 - RNA, 22 nt, Human
uccugucugcucacagagcugg

SEQ ID NO: 297823 - RNA, 22 nt, Human
uguggggccaaagcccagccac

SEQ ID NO: 297824 - RNA, 22 nt, Human
uccugcaggccagaggggugag

SEQ ID NO: 297825 - RNA, 22 nt, Human
gcaggcagagaaggaacauuua

SEQ ID NO: 297826 - RNA, 22 nt, Human
aaggcauaggacaaaucaguga

SEQ ID NO: 297827 - RNA, 22 nt, Human
uccaggagguagugcuuaauuu

SEQ ID NO: 297828 - RNA, 17 nt, Human
ccuuccucaucuccuuc

SEQ ID NO: 297829 - RNA, 22 nt, Human
cguguccuuuuagcuucagguc

SEQ ID NO: 297830 - RNA, 22 nt, Human
cugaaugagggauucugagggc

SEQ ID NO: 297831 - RNA, 22 nt, Human
uuacauguaaucuaaaauaauu

SEQ ID NO: 297832 - RNA, 22 nt, Human
aacauucuauuuugcuaaaaca

SEQ ID NO: 297833 - RNA, 18 nt, Human
uacuuuauucccccucca

SEQ ID NO: 297834 - RNA, 22 nt, Human
gcaggugggggagaaguuguga

SEQ ID NO: 297835 - RNA, 22 nt, Human
uccucuggcucuuucccuagga

SEQ ID NO: 297836 - RNA, 22 nt, Human
uuccuucuaauuuuacaccuga

SEQ ID NO: 297837 - RNA, 22 nt, Human
cuccaggcucguccaagaucga

SEQ ID NO: 297838 - RNA, 22 nt, Human
cuguccugugcauugucagaug

SEQ ID NO: 297839 - RNA, 22 nt, Human
aggugggguucagucucagccg

SEQ ID NO: 297840 - RNA, 22 nt, Human
guagggacccacagucuauauu

SEQ ID NO: 297841 - RNA, 22 nt, Human
agcagggcucuguggagggugg

SEQ ID NO: 297842 - RNA, 22 nt, Human
cuggauguuuugcuaaggacuc

SEQ ID NO: 297843 - RNA, 22 nt, Human
uuuuaauugcaauuaugguccc

SEQ ID NO: 297844 - RNA, 22 nt, Human
gcagacagccagacugcacugg

SEQ ID NO: 297845 - RNA, 22 nt, Human
ccaggugucaugcgugugaccc

SEQ ID NO: 297846 - RNA, 22 nt, Human
ucacaugaguauuauuuuccaa

SEQ ID NO: 297847 - RNA, 22 nt, Human
acagacagaggcuccaugagga

SEQ ID NO: 297848 - RNA, 22 nt, Human
uagaaacaucagcuaaccaaaa

SEQ ID NO: 297849 - RNA, 22 nt, Human
uccuggguaaacacugaccuuu

SEQ ID NO: 297850 - RNA, 22 nt, Human
cuagccugggauuugaacuuau

SEQ ID NO: 297851 - RNA, 22 nt, Human
acaggcagagaacucagccaga

SEQ ID NO: 297852 - RNA, 22 nt, Human
uuucuuauacuauauugucauc

SEQ ID NO: 297853 - RNA, 22 nt, Human
gcagguguccugggcuggcagu

SEQ ID NO: 297854 - RNA, 22 nt, Human
aagggcagaaagggacgcuuug

SEQ ID NO: 297855 - RNA, 19 nt, Human
uggaccugugcccauggcu

SEQ ID NO: 297856 - RNA, 22 nt, Human
guggaggaagggauucagacca

SEQ ID NO: 297857 - RNA, 22 nt, Human
uguguccucauguggcagagag

SEQ ID NO: 297858 - RNA, 22 nt, Human
cuuuucaugccagcccaucaca

SEQ ID NO: 297859 - RNA, 22 nt, Human
auuugcaaagucguaucuguga

SEQ ID NO: 297860 - RNA, 22 nt, Human
cuucagagugcagaagauuggg

SEQ ID NO: 297861 - RNA, 22 nt, Human
gguguccuuugggggcuccgag

SEQ ID NO: 297862 - RNA, 22 nt, Human
uaacuugguuggugggcaggag

SEQ ID NO: 297863 - RNA, 22 nt, Human
uuccuucuggaagcuucagggg

SEQ ID NO: 297864 - RNA, 22 nt, Human
uuuguagauucauugaacuuuu

SEQ ID NO: 297865 - RNA, 22 nt, Human
ugcuuaaaaugaugauuauuuu

SEQ ID NO: 297866 - RNA, 22 nt, Human
uucuucuucuggcugcaccugg

SEQ ID NO: 297867 - RNA, 20 nt, Human
caugugucaguucucaccca

SEQ ID NO: 297868 - RNA, 22 nt, Human
aggugggggcuguguccuugac

SEQ ID NO: 297869 - RNA, 22 nt, Human
uuggaggaagcucaugggggau

SEQ ID NO: 297870 - RNA, 22 nt, Human
ugaauccagagcuauuucgucc

SEQ ID NO: 297871 - RNA, 22 nt, Human
uacugcaugguggaguggagcu

SEQ ID NO: 297872 - RNA, 22 nt, Human
ucagggcaaugucccucagaag

SEQ ID NO: 297873 - RNA, 20 nt, Human
gaggccucagccucagcucc

SEQ ID NO: 297874 - RNA, 22 nt, Human
gacagacaggugugguaggcac

SEQ ID NO: 297875 - RNA, 22 nt, Human
aauggcuggguuucauuuugua

SEQ ID NO: 297876 - RNA, 22 nt, Human
gagggcucuacucaccacccug

SEQ ID NO: 297877 - RNA, 22 nt, Human
ucucuucuuguguuuuccugcc

SEQ ID NO: 297878 - RNA, 22 nt, Human
aggacaguccgggguccuccac

SEQ ID NO: 297879 - RNA, 22 nt, Human
gggcagguacuggguggugagc

SEQ ID NO: 297880 - RNA, 22 nt, Human
ugcuuaaacccugaucaugugu

SEQ ID NO: 297881 - RNA, 22 nt, Human
uuucuucagccacuccaaacug

SEQ ID NO: 297882 - RNA, 22 nt, Human
auuucagaugaccaaauggaaa

SEQ ID NO: 297883 - RNA, 22 nt, Human
ugucuucaucuccaugcacaga

SEQ ID NO: 297884 - RNA, 22 nt, Human
agugugaguaauucagggaggg

SEQ ID NO: 297885 - RNA, 22 nt, Human
gcaccugcuggggcugaugaga

SEQ ID NO: 297886 - RNA, 22 nt, Human
acauuguuugagaauacagaug

SEQ ID NO: 297887 - RNA, 22 nt, Human
auguaccucugcauuccugccu

SEQ ID NO: 297888 - RNA, 19 nt, Human
uccaggcauccuucaggcu

SEQ ID NO: 297889 - RNA, 22 nt, Human
ucagagaguuacacaaauuguu

SEQ ID NO: 297890 - RNA, 22 nt, Human
ugcaggugauucugaugcaguu

SEQ ID NO: 297891 - RNA, 22 nt, Human
ccaggugucuguggccagcccu

SEQ ID NO: 297892 - RNA, 22 nt, Human
agggcacccucucugcaguacc

SEQ ID NO: 297893 - RNA, 22 nt, Human
uuugcaaauauguguuucuauu

SEQ ID NO: 297894 - RNA, 22 nt, Human
uggagcaggaaacaucuagagg

SEQ ID NO: 297895 - RNA, 19 nt, Human
aggaaggaaccugagucug

SEQ ID NO: 297896 - RNA, 22 nt, Human
cagguggcuuauuagggucagu

SEQ ID NO: 297897 - RNA, 22 nt, Human
aaugggcuuuggccaguaggag

SEQ ID NO: 297898 - RNA, 22 nt, Human
uguagaaagcucuucugaaauc

SEQ ID NO: 297899 - RNA, 22 nt, Human
cagaggcucagauggcccuggc

SEQ ID NO: 297900 - RNA, 22 nt, Human
cagcuuuagagaaaacauauuu

SEQ ID NO: 297901 - RNA, 22 nt, Human
uugcaggguacauucuuagaau

SEQ ID NO: 297902 - RNA, 22 nt, Human
aucuuccuucacuuucucccac

SEQ ID NO: 297903 - RNA, 22 nt, Human
cuucucccgaagccgguucugc

SEQ ID NO: 297904 - RNA, 22 nt, Human
uaucauuuaacagaaucauugc

SEQ ID NO: 297905 - RNA, 22 nt, Human
ggguggggccaggcaauuugca

SEQ ID NO: 297906 - RNA, 22 nt, Human
aaagcucuuauagcagagugug

SEQ ID NO: 297907 - RNA, 22 nt, Human
gcaggugggagccgcugccuga

SEQ ID NO: 297908 - RNA, 22 nt, Human
agcagggcuugccgcuuguccu

SEQ ID NO: 297909 - RNA, 22 nt, Human
uacugcauaacuggcauguggg

SEQ ID NO: 297910 - RNA, 22 nt, Human
ggggaccuuuccauuucugaga

SEQ ID NO: 297911 - RNA, 22 nt, Human
uucuucagagaguagaagcaag

SEQ ID NO: 297912 - RNA, 22 nt, Human
ugcugggugguugcuccucccg

SEQ ID NO: 297913 - RNA, 23 nt, Human
ucaggugugcggacugcugaguc

SEQ ID NO: 297914 - RNA, 22 nt, Human
ugggaccugcucuuggaaugag

SEQ ID NO: 297915 - RNA, 22 nt, Human
cagaagucacccucagaauaac

SEQ ID NO: 297916 - RNA, 22 nt, Human
ugggccaguccagccccaggga

SEQ ID NO: 297917 - RNA, 22 nt, Human
cagaggcauacucccagucuug

SEQ ID NO: 297918 - RNA, 22 nt, Human
ucauuuguugaacuuuagugcg

SEQ ID NO: 297919 - RNA, 22 nt, Human
aacauacauauuucagugucca

SEQ ID NO: 297920 - RNA, 19 nt, Human
ccagagagcuagguacaga

SEQ ID NO: 297921 - RNA, 20 nt, Human
ccagcauguacacaugugga

SEQ ID NO: 297922 - RNA, 22 nt, Human
ggcuacuagacuuugauacuag

SEQ ID NO: 297923 - RNA, 22 nt, Human
uuucaaauagaaucuuuccaaa

SEQ ID NO: 297924 - RNA, 22 nt, Human
gcuuuacugagaugacacaggg

SEQ ID NO: 297925 - RNA, 20 nt, Human
uucuuaaagaccucacuuug

SEQ ID NO: 297926 - RNA, 22 nt, Human
aaagcagauucugaugcaguag

SEQ ID NO: 297927 - RNA, 22 nt, Human
uuuacagucugucuagcaaugu

SEQ ID NO: 297928 - RNA, 22 nt, Human
uccugaggcacaauccuagaau

SEQ ID NO: 297929 - RNA, 22 nt, Human
gaugaggucuacauuguuaaaa

SEQ ID NO: 297930 - RNA, 22 nt, Human
uguucagagacagaaauucuaa

SEQ ID NO: 297931 - RNA, 22 nt, Human
aggaggaauugacacagaagcc

SEQ ID NO: 297932 - RNA, 22 nt, Human
gggaacuucagaaagucgcugc

SEQ ID NO: 297933 - RNA, 22 nt, Human
cuuugcugagcugguuguucaa

SEQ ID NO: 297934 - RNA, 22 nt, Human
cauuuccacucugggagucaga

SEQ ID NO: 297935 - RNA, 22 nt, Human
agcugcaaguguugccuccuac

SEQ ID NO: 297936 - RNA, 22 nt, Human
uuccugggcucuggcuggccua

SEQ ID NO: 297937 - RNA, 22 nt, Human
gggaccuggcaccuuugcucug

SEQ ID NO: 297938 - RNA, 22 nt, Human
cagguugaaaguggaggagcua

SEQ ID NO: 297939 - RNA, 22 nt, Human
acuuagauaacaaaccuguggu

SEQ ID NO: 297940 - RNA, 22 nt, Human
acaacauucuuaaauacacuga

SEQ ID NO: 297941 - RNA, 22 nt, Human
ggcagguguggaguguuauuuu

SEQ ID NO: 297942 - RNA, 22 nt, Human
uuuaagaaguuauguuauaaau

SEQ ID NO: 297943 - RNA, 22 nt, Human
cuugaaucuggcuuugccacuu

SEQ ID NO: 297944 - RNA, 22 nt, Human
uaugugucuuuaucuggcucuu

SEQ ID NO: 297945 - RNA, 22 nt, Human
uucuucuuucccccugugguac

SEQ ID NO: 297946 - RNA, 22 nt, Human
uccugcagccacugcaggcaga

SEQ ID NO: 297947 - RNA, 22 nt, Human
ccagguguccccgucacugcag

SEQ ID NO: 297948 - RNA, 22 nt, Human
caaaugauaccuauuacuaggc

SEQ ID NO: 297949 - RNA, 22 nt, Human
ccauguguugagauuccagccu

SEQ ID NO: 297950 - RNA, 22 nt, Human
uauuccagguauucuucaagag

SEQ ID NO: 297951 - RNA, 20 nt, Human
aaguuuucuccaaauacagu

SEQ ID NO: 297952 - RNA, 15 nt, Human
gcauguguaauaggc

SEQ ID NO: 297953 - RNA, 22 nt, Human
uuauuagggugguuuauguucu

SEQ ID NO: 297954 - RNA, 22 nt, Human
agguggggaguauauguaauug

SEQ ID NO: 297955 - RNA, 22 nt, Human
uuaauuuucucaucugugaaau

SEQ ID NO: 297956 - RNA, 22 nt, Human
uggaccugaagaauaggaagua

SEQ ID NO: 297957 - RNA, 22 nt, Human
uuguuucaaauauuucagaaua

SEQ ID NO: 297958 - RNA, 22 nt, Human
caauuucucuuuauaucucaca

SEQ ID NO: 297959 - RNA, 22 nt, Human
gaagggagaagguugggugacg

SEQ ID NO: 297960 - RNA, 22 nt, Human
uugaaauacugcauuguucagu

SEQ ID NO: 297961 - RNA, 22 nt, Human
acacuuuaugucuagaucuggg

SEQ ID NO: 297962 - RNA, 22 nt, Human
aggcuuuaaguggccuacagcu

SEQ ID NO: 297963 - RNA, 22 nt, Human
guuucacagucugcagaauuuu

SEQ ID NO: 297964 - RNA, 22 nt, Human
uauuuauuggacaguguugcug

SEQ ID NO: 297965 - RNA, 22 nt, Human
ggcaggcauggggucugccauu

SEQ ID NO: 297966 - RNA, 22 nt, Human
cuacauaaauauuuaugugucu

SEQ ID NO: 297967 - RNA, 22 nt, Human
gagggcagugaauuuugaagcu

SEQ ID NO: 297968 - RNA, 22 nt, Human
uccaggcaugucccaagccgga

SEQ ID NO: 297969 - RNA, 22 nt, Human
uucaucaauguguuuaauaaug

SEQ ID NO: 297970 - RNA, 22 nt, Human
cauguuuuguguacagaauauu

SEQ ID NO: 297971 - RNA, 22 nt, Human
uucugcaucugaauuuaaguac

SEQ ID NO: 297972 - RNA, 22 nt, Human
ucaggugggcaguggguugagc

SEQ ID NO: 297973 - RNA, 22 nt, Human
agccggccauguggucuugugc

SEQ ID NO: 297974 - RNA, 22 nt, Human
auugcuggcccagaugcuuuag

SEQ ID NO: 297975 - RNA, 22 nt, Human
agcccuaacucccaguaucuug

SEQ ID NO: 297976 - RNA, 21 nt, Human
ugacccuucuagcagaacaca

SEQ ID NO: 297977 - RNA, 20 nt, Human
acaugcaguggucauuucag

SEQ ID NO: 297978 - RNA, 22 nt, Human
ggcaggugacggggaugaguau

SEQ ID NO: 297979 - RNA, 22 nt, Human
ggcaggugcugggagcaucuca

SEQ ID NO: 297980 - RNA, 22 nt, Human
uuuccauguuaucuugcagacu

SEQ ID NO: 297981 - RNA, 22 nt, Human
ugaaaucaauugcaauguuuau

SEQ ID NO: 297982 - RNA, 22 nt, Human
guuauugagguggagucucacu

SEQ ID NO: 297983 - RNA, 22 nt, Human
acaccauacucauguugguucc

SEQ ID NO: 297984 - RNA, 22 nt, Human
cuuucucaaugccggaaggcac

SEQ ID NO: 297985 - RNA, 22 nt, Human
agacagacuuugaucuggaugu

SEQ ID NO: 297986 - RNA, 22 nt, Human
acagguguaauuugcccgaggu

SEQ ID NO: 297987 - RNA, 22 nt, Human
acauuucucuugaugucucuau

SEQ ID NO: 297988 - RNA, 22 nt, Human
ccaggccuggccaggggaugcc

SEQ ID NO: 297989 - RNA, 22 nt, Human
cauuuauucauuugcuagggcu

SEQ ID NO: 297990 - RNA, 22 nt, Human
ucuauuuuauacucaaaucuuc

SEQ ID NO: 297991 - RNA, 22 nt, Human
caggugucagcagcacuguacu

SEQ ID NO: 297992 - RNA, 22 nt, Human
auguaauaggguaacauaacau

SEQ ID NO: 297993 - RNA, 22 nt, Human
uucuucaugcuguugcugcuug

SEQ ID NO: 297994 - RNA, 22 nt, Human
gucugcccuuccucuccacgau

SEQ ID NO: 297995 - RNA, 22 nt, Human
uauauuuaaauccagguugaaa

SEQ ID NO: 297996 - RNA, 22 nt, Human
uucagcaaacacgaugcuuguu

SEQ ID NO: 297997 - RNA, 22 nt, Human
uccuucuuucccccuagucauu

SEQ ID NO: 297998 - RNA, 22 nt, Human
gaggcuggcagaaaagcacagg

SEQ ID NO: 297999 - RNA, 20 nt, Human
auuuggcaugaaguauugau

SEQ ID NO: 298000 - RNA, 20 nt, Human
agguggcucuuccugggcuu

SEQ ID NO: 298001 - RNA, 22 nt, Human
agcugcaaccuuagcuauaggc

SEQ ID NO: 298002 - RNA, 21 nt, Human
ccuucuccacagggucuccgg

SEQ ID NO: 298003 - RNA, 20 nt, Human
uuugacucaggccuuuagcc

SEQ ID NO: 298004 - RNA, 22 nt, Human
gauuuauugucccuguccugcu

SEQ ID NO: 298005 - RNA, 22 nt, Human
aaauccuaagcagaggaauuua

SEQ ID NO: 298006 - RNA, 22 nt, Human
aagacaggaacauagcaaaucc

SEQ ID NO: 298007 - RNA, 22 nt, Human
ucuucacagaugcauauacuuc

SEQ ID NO: 298008 - RNA, 22 nt, Human
gugcaggggccuccccuugcug

SEQ ID NO: 298009 - RNA, 22 nt, Human
aagcuuuaagugucagucagcc

SEQ ID NO: 298010 - RNA, 22 nt, Human
uauuuccaggccccacucuaga

SEQ ID NO: 298011 - RNA, 22 nt, Human
gacagggaaacauugaaguguc

SEQ ID NO: 298012 - RNA, 22 nt, Human
gcacccagggacuuggcuggcc

SEQ ID NO: 298013 - RNA, 22 nt, Human
ugggugcucugcuucccugcac

SEQ ID NO: 298014 - RNA, 22 nt, Human
ucuggguggcagugauggcgug

SEQ ID NO: 298015 - RNA, 22 nt, Human
ucuguucaguuguaccuucccc

SEQ ID NO: 298016 - RNA, 22 nt, Human
ggaggauuugucaucugaagau

SEQ ID NO: 298017 - RNA, 22 nt, Human
aacagacauauuuuuaauaugc

SEQ ID NO: 298018 - RNA, 22 nt, Human
aaauaugaaugauaagaguuau

SEQ ID NO: 298019 - RNA, 22 nt, Human
gagggcaggggucuugcacggu

SEQ ID NO: 298020 - RNA, 22 nt, Human
aacagacaacuccuguggcuca

SEQ ID NO: 298021 - RNA, 22 nt, Human
cauuggaaugcauuugaagaga

SEQ ID NO: 298022 - RNA, 22 nt, Human
ucagcuuuugucagaaauugua

SEQ ID NO: 298023 - RNA, 22 nt, Human
ugguccuguguucuuccugccu

SEQ ID NO: 298024 - RNA, 22 nt, Human
uuccagaaaucuuucagcucaa

SEQ ID NO: 298025 - RNA, 22 nt, Human
uuaguuuauaauucauuucugu

SEQ ID NO: 298026 - RNA, 22 nt, Human
aucauucuagcuguuguguuga

SEQ ID NO: 298027 - RNA, 22 nt, Human
ggcuccacccugcuuccagaag

SEQ ID NO: 298028 - RNA, 22 nt, Human
agaguggcagcaagucagguag

SEQ ID NO: 298029 - RNA, 22 nt, Human
acagcuuuugaaaaauuacugg

SEQ ID NO: 298030 - RNA, 22 nt, Human
uuugacucccaaacugugauuu

SEQ ID NO: 298031 - RNA, 22 nt, Human
cagaucaagcuguauggucaga

SEQ ID NO: 298032 - RNA, 22 nt, Human
uuuccuuccauguugggcaaaa

SEQ ID NO: 298033 - RNA, 22 nt, Human
cuucuucccagcuucccucacc

SEQ ID NO: 298034 - RNA, 22 nt, Human
uggagcugccuggcaccuacag

SEQ ID NO: 298035 - RNA, 21 nt, Human
cuggaggcagguggugccagg

SEQ ID NO: 298036 - RNA, 20 nt, Human
uugauucaagggcugaugga

SEQ ID NO: 298037 - RNA, 22 nt, Human
aggaggaacucagaaagaaggu

SEQ ID NO: 298038 - RNA, 18 nt, Human
gcucuggcucaccuccag

SEQ ID NO: 298039 - RNA, 22 nt, Human
agcagggcugugcuccuuccga

SEQ ID NO: 298040 - RNA, 22 nt, Human
cuuucuuucgaagacgugauua

SEQ ID NO: 298041 - RNA, 22 nt, Human
auuuauuauugugguuacuucu

SEQ ID NO: 298042 - RNA, 21 nt, Human
gcugggucagcagguccucug

SEQ ID NO: 298043 - RNA, 22 nt, Human
gugagcaggauuucauggugua

SEQ ID NO: 298044 - RNA, 22 nt, Human
gguggggcucagcaaucugugu

SEQ ID NO: 298045 - RNA, 22 nt, Human
uggcaggugccaugggcucaga

SEQ ID NO: 298046 - RNA, 22 nt, Human
agcugcaaagaugauuuguugu

SEQ ID NO: 298047 - RNA, 22 nt, Human
aacaaacaaacauuuugucauc

SEQ ID NO: 298048 - RNA, 22 nt, Human
cuucagaauccagaaucagaau

SEQ ID NO: 298049 - RNA, 22 nt, Human
cagaacagacuuaacagggcug

SEQ ID NO: 298050 - RNA, 22 nt, Human
ucugggaacugagcuccccuag

SEQ ID NO: 298051 - RNA, 22 nt, Human
uagggaccuuagaauuguaugu

SEQ ID NO: 298052 - RNA, 22 nt, Human
uauuuccauguuagaacuaagu

SEQ ID NO: 298053 - RNA, 22 nt, Human
aaggaugaacauuaauacauca

SEQ ID NO: 298054 - RNA, 22 nt, Human
ugcugggucagugagagcaggg

SEQ ID NO: 298055 - RNA, 22 nt, Human
guguguccucaguaguggcaug

SEQ ID NO: 298056 - RNA, 22 nt, Human
gaugguccuccugcugccucuc

SEQ ID NO: 298057 - RNA, 22 nt, Human
uuccaggauagcuuucaggaau

SEQ ID NO: 298058 - RNA, 22 nt, Human
ugacauguuagggaaaugugau

SEQ ID NO: 298059 - RNA, 22 nt, Human
aguuauuucaguaacauaauag

SEQ ID NO: 298060 - RNA, 22 nt, Human
aaacauuugcaacucgguuugg

SEQ ID NO: 298061 - RNA, 22 nt, Human
auucagcaaacauuuauugugu

SEQ ID NO: 298062 - RNA, 22 nt, Human
cauuuguaucugggcugcugug

SEQ ID NO: 298063 - RNA, 22 nt, Human
auugcuuucuuuggggaacugu

SEQ ID NO: 298064 - RNA, 19 nt, Human
agugugagacuccaucuca

SEQ ID NO: 298065 - RNA, 22 nt, Human
ccugccuucuaaagcgcccgcc

SEQ ID NO: 298066 - RNA, 22 nt, Human
ccuggagggcgccgcacagucc

SEQ ID NO: 298067 - RNA, 22 nt, Human
uccaugaguuugaggaaaagag

SEQ ID NO: 298068 - RNA, 22 nt, Human
gcaugugucuccccaguggagg

SEQ ID NO: 298069 - RNA, 22 nt, Human
gacagacauuuccugauccaau

SEQ ID NO: 298070 - RNA, 21 nt, Human
uuuaauuugcauguaugacgc

SEQ ID NO: 298071 - RNA, 21 nt, Human
agcaggugaaccuccaguaca

SEQ ID NO: 298072 - RNA, 22 nt, Human
guuuauuaacugucaagugauu

SEQ ID NO: 298073 - RNA, 22 nt, Human
agagagcauggcacagaggggu

SEQ ID NO: 298074 - RNA, 22 nt, Human
uaccugcagcgggaauccauua

SEQ ID NO: 298075 - RNA, 22 nt, Human
accugcagccacuucucuccuu

SEQ ID NO: 298076 - RNA, 22 nt, Human
gacagacaugggacuucauacu

SEQ ID NO: 298077 - RNA, 22 nt, Human
uuucuuuguuguuaucacauca

SEQ ID NO: 298078 - RNA, 22 nt, Human
cuggaggagagucugaaugaca

SEQ ID NO: 298079 - RNA, 22 nt, Human
uuggcuuuuaugcagcuuaggu

SEQ ID NO: 298080 - RNA, 22 nt, Human
ugcaggugcagcgauacuguga

SEQ ID NO: 298081 - RNA, 22 nt, Human
uuguuuacaaguuacucagucu

SEQ ID NO: 298082 - RNA, 23 nt, Human
ugcuguggauggcagguccuugc

SEQ ID NO: 298083 - RNA, 22 nt, Human
agaauuguucuguagcuuggcu

SEQ ID NO: 298084 - RNA, 21 nt, Human
uaaaucucuguauucuucagu

SEQ ID NO: 298085 - RNA, 22 nt, Human
acuucuucuucagcugggggau

SEQ ID NO: 298086 - RNA, 22 nt, Human
aguucucaagacaauuaccugu

SEQ ID NO: 298087 - RNA, 22 nt, Human
agaguacugccucaguuaugaa

SEQ ID NO: 298088 - RNA, 22 nt, Human
ugucuuuagaaagaagcagaca

SEQ ID NO: 298089 - RNA, 22 nt, Human
aggcagguuuacucuuauuugg

SEQ ID NO: 298090 - RNA, 22 nt, Human
gagacugcauagauggccacaa

SEQ ID NO: 298091 - RNA, 22 nt, Human
auucugauaucuuauucuagcu

SEQ ID NO: 298092 - RNA, 22 nt, Human
uucucuuuucaccaguugcuaa

SEQ ID NO: 298093 - RNA, 22 nt, Human
ucaggugugaacuauuuggaaa

SEQ ID NO: 298094 - RNA, 22 nt, Human
uaauaacaauuguaggacauga

SEQ ID NO: 298095 - RNA, 21 nt, Human
ugcuuuaugggaaaaauguca

SEQ ID NO: 298096 - RNA, 19 nt, Human
guugaaaguaggugagggu

SEQ ID NO: 298097 - RNA, 22 nt, Human
cuggcuuucauuucaagcacgu

SEQ ID NO: 298098 - RNA, 22 nt, Human
cuaaaauuaucaagauaauucc

SEQ ID NO: 298099 - RNA, 22 nt, Human
cauuuugugcuagacacuaugg

SEQ ID NO: 298100 - RNA, 22 nt, Human
cagacaggguccuguccgucac

SEQ ID NO: 298101 - RNA, 22 nt, Human
guaaaauagaauaacguggcua

SEQ ID NO: 298102 - RNA, 22 nt, Human
gcagggcagcugaagcuaggug

SEQ ID NO: 298103 - RNA, 22 nt, Human
aguccagugucaaggugccauu

SEQ ID NO: 298104 - RNA, 22 nt, Human
aaauggaauguguuuauaauuc

SEQ ID NO: 298105 - RNA, 22 nt, Human
aaguuucaugauguaauuauug

SEQ ID NO: 298106 - RNA, 22 nt, Human
aaucuucacagagaaaauuagg

SEQ ID NO: 298107 - RNA, 20 nt, Human
cccaguguccagccuugcca

SEQ ID NO: 298108 - RNA, 22 nt, Human
gguggggcuaggaccucaggau

SEQ ID NO: 298109 - RNA, 22 nt, Human
gcaucuaauccaguccagcauc

SEQ ID NO: 298110 - RNA, 22 nt, Human
cuguuuucuagggcugagguga

SEQ ID NO: 298111 - RNA, 20 nt, Human
guaaaauauggucuuugggu

SEQ ID NO: 298112 - RNA, 22 nt, Human
agcuuguuaaggaugcauauua

SEQ ID NO: 298113 - RNA, 22 nt, Human
cuggauggucccaugagcagcu

SEQ ID NO: 298114 - RNA, 22 nt, Human
gcucucuugguggcuguccugg

SEQ ID NO: 298115 - RNA, 23 nt, Human
ggacaugucucuggguauuuuga

SEQ ID NO: 298116 - RNA, 22 nt, Human
caguucuuauuuggccaguguc

SEQ ID NO: 298117 - RNA, 22 nt, Human
uacaaagucagaauaacaggug

SEQ ID NO: 298118 - RNA, 22 nt, Human
aaggcuuuugggaauuuucaac

SEQ ID NO: 298119 - RNA, 22 nt, Human
aauaauuagugggacagagaac

SEQ ID NO: 298120 - RNA, 22 nt, Human
uguccugggaaaucccuuaggc

SEQ ID NO: 298121 - RNA, 22 nt, Human
cucuggaagugauggcagguca

SEQ ID NO: 298122 - RNA, 22 nt, Human
cagacaggguuuuggucuuugg

SEQ ID NO: 298123 - RNA, 22 nt, Human
acugaugaagaguaccacuguu

SEQ ID NO: 298124 - RNA, 22 nt, Human
aaauccuaaaaguuugacuuaa

SEQ ID NO: 298125 - RNA, 19 nt, Human
aaggugguuugucucugua

SEQ ID NO: 298126 - RNA, 22 nt, Human
uucuguuuuagaaauaaguagu

SEQ ID NO: 298127 - RNA, 22 nt, Human
auucuucacauaagugcuguac

SEQ ID NO: 298128 - RNA, 22 nt, Human
uuccuucuucauuguguuacag

SEQ ID NO: 298129 - RNA, 22 nt, Human
gguguccuucguccgcuggcau

SEQ ID NO: 298130 - RNA, 22 nt, Human
uuuccauguuggugaaaugagg

SEQ ID NO: 298131 - RNA, 22 nt, Human
ugaaagcuguacaugugguaca

SEQ ID NO: 298132 - RNA, 22 nt, Human
uuuacagucaccaaacuuugcu

SEQ ID NO: 298133 - RNA, 22 nt, Human
agcuuuauggugccucacuuga

SEQ ID NO: 298134 - RNA, 22 nt, Human
acacaaauuguaggauaauugc

SEQ ID NO: 298135 - RNA, 22 nt, Human
guguguccuugggccucugcag

SEQ ID NO: 298136 - RNA, 22 nt, Human
aagugguuauuuugaucuagaa

SEQ ID NO: 298137 - RNA, 22 nt, Human
auauuucaugggguuccauacu

SEQ ID NO: 298138 - RNA, 22 nt, Human
aggagugggggcgagaaguuaa

SEQ ID NO: 298139 - RNA, 22 nt, Human
ccagugcauaaucaauacagcc

SEQ ID NO: 298140 - RNA, 22 nt, Human
cacccaggcagguggcugagaa

SEQ ID NO: 298141 - RNA, 22 nt, Human
uuauugacugaucagagaggga

SEQ ID NO: 298142 - RNA, 22 nt, Human
uagcuuuaccauagaagaguau

SEQ ID NO: 298143 - RNA, 22 nt, Human
uucuucuuuaucucaguauccu

SEQ ID NO: 298144 - RNA, 21 nt, Human
aagaguggcugaggaggugau

SEQ ID NO: 298145 - RNA, 22 nt, Human
aauuucagaccauuugcaauua

SEQ ID NO: 298146 - RNA, 22 nt, Human
aaggugucucucugcuucuugg

SEQ ID NO: 298147 - RNA, 22 nt, Human
ucuucuucccaucccucaaaug

SEQ ID NO: 298148 - RNA, 22 nt, Human
cgcaggugaaagaggcugggca

SEQ ID NO: 298149 - RNA, 21 nt, Human
uucuucaaagaagaaggcaca

SEQ ID NO: 298150 - RNA, 22 nt, Human
aaacaucaauugcaucucccaa

SEQ ID NO: 298151 - RNA, 22 nt, Human
gcaggcagagguggaggagaca

SEQ ID NO: 298152 - RNA, 22 nt, Human
ccagagagucgaugggggacac

SEQ ID NO: 298153 - RNA, 22 nt, Human
cuauuagacacaauuagugauu

SEQ ID NO: 298154 - RNA, 22 nt, Human
ugguggcagcugagugucaggu

SEQ ID NO: 298155 - RNA, 22 nt, Human
ucugaacagaaaagaugcacaa

SEQ ID NO: 298156 - RNA, 22 nt, Human
gggcagguuauuggaguaggga

SEQ ID NO: 298157 - RNA, 22 nt, Human
gcaggcagaucaccugucagga

SEQ ID NO: 298158 - RNA, 20 nt, Human
uuuuccagaaaguaucauug

SEQ ID NO: 298159 - RNA, 22 nt, Human
cuucucccuggcuucugcacac

SEQ ID NO: 298160 - RNA, 22 nt, Human
ugcugccaucucaacugcccuu

SEQ ID NO: 298161 - RNA, 22 nt, Human
ugcaggugccucuugagcuugu

SEQ ID NO: 298162 - RNA, 22 nt, Human
uccaggcacgaggcccugugca

SEQ ID NO: 298163 - RNA, 22 nt, Human
ggagcugagaguagucccuuuu

SEQ ID NO: 298164 - RNA, 21 nt, Human
cacaggugggucagugaggcc

SEQ ID NO: 298165 - RNA, 22 nt, Human
caguguuuaaucauugugaauu

SEQ ID NO: 298166 - RNA, 22 nt, Human
ugaaucauggauaaauagcuua

SEQ ID NO: 298167 - RNA, 20 nt, Human
auguccucagccacugcccu

SEQ ID NO: 298168 - RNA, 22 nt, Human
uugaaguuguaguucagugaag

SEQ ID NO: 298169 - RNA, 22 nt, Human
cagagcauuaaaaccagcucug

SEQ ID NO: 298170 - RNA, 22 nt, Human
gaauuugaaaagugaugggaau

SEQ ID NO: 298171 - RNA, 22 nt, Human
auuugcuuuaagguauaaaagg

SEQ ID NO: 298172 - RNA, 22 nt, Human
gacuuuauuacuaacccuguga

SEQ ID NO: 298173 - RNA, 22 nt, Human
aacaugauuuaguauaaugcag

SEQ ID NO: 298174 - RNA, 22 nt, Human
ucuucagagugaaagucuguga

SEQ ID NO: 298175 - RNA, 22 nt, Human
caugcagccugugaacaguguc

SEQ ID NO: 298176 - RNA, 22 nt, Human
uucuuuucuuggcaggaguaga

SEQ ID NO: 298177 - RNA, 22 nt, Human
uuuauugucuucguggugccua

SEQ ID NO: 298178 - RNA, 22 nt, Human
acagaaauugggcaaauggaag

SEQ ID NO: 298179 - RNA, 22 nt, Human
acagacaguaaauaguguggcu

SEQ ID NO: 298180 - RNA, 22 nt, Human
gggaccuggggacuccuuguuc

SEQ ID NO: 298181 - RNA, 22 nt, Human
ccagagaggccuuggcaagaca

SEQ ID NO: 298182 - RNA, 22 nt, Human
uggguggagaaguggaccugcu

SEQ ID NO: 298183 - RNA, 22 nt, Human
uccaggcauaagccuugagugu

SEQ ID NO: 298184 - RNA, 22 nt, Human
ggucuggcaggugaggacucag

SEQ ID NO: 298185 - RNA, 22 nt, Human
agaggcucugccgccucaggua

SEQ ID NO: 298186 - RNA, 22 nt, Human
gggcaggucugggucagccuga

SEQ ID NO: 298187 - RNA, 22 nt, Human
auaugcauguacgugugcacaa

SEQ ID NO: 298188 - RNA, 22 nt, Human
gacccaggguggucaccugaaa

SEQ ID NO: 298189 - RNA, 22 nt, Human
agcccuaaauuaucuuuauuuu

SEQ ID NO: 298190 - RNA, 22 nt, Human
caggcauaucuacauuauccaa

SEQ ID NO: 298191 - RNA, 22 nt, Human
cuguccucuguccucagcagga

SEQ ID NO: 298192 - RNA, 22 nt, Human
agauuugcggcuuuacuuugca

SEQ ID NO: 298193 - RNA, 22 nt, Human
gagaggagguggcuaugacagc

SEQ ID NO: 298194 - RNA, 22 nt, Human
ggaggcagaauagagugugggu

SEQ ID NO: 298195 - RNA, 16 nt, Human
aaggaaugucauucug

SEQ ID NO: 298196 - RNA, 22 nt, Human
accaggcagucaccguccagga

SEQ ID NO: 298197 - RNA, 22 nt, Human
uguccuuuguucccugucucug

SEQ ID NO: 298198 - RNA, 22 nt, Human
aaagugguuuuucagacuuuga

SEQ ID NO: 298199 - RNA, 22 nt, Human
uccaggcaguuuuccagguugu

SEQ ID NO: 298200 - RNA, 22 nt, Human
acuguucauuuguccuguaucu

SEQ ID NO: 298201 - RNA, 22 nt, Human
gugggugugagugacggcgucc

SEQ ID NO: 298202 - RNA, 22 nt, Human
uguggggcucccuggcagccug

SEQ ID NO: 298203 - RNA, 22 nt, Human
cagagaaaaaauccugcucuca

SEQ ID NO: 298204 - RNA, 22 nt, Human
ucagcuuucuauguugcuaaac

SEQ ID NO: 298205 - RNA, 21 nt, Human
gggaggaagcugcuucucucu

SEQ ID NO: 298206 - RNA, 21 nt, Human
agcugcaaaaacauacaguuc

SEQ ID NO: 298207 - RNA, 22 nt, Human
cuccaugaauuugagcuuugug

SEQ ID NO: 298208 - RNA, 22 nt, Human
agacagacaaaauuccugccug

SEQ ID NO: 298209 - RNA, 22 nt, Human
uccuggguucauguccuggugc

SEQ ID NO: 298210 - RNA, 20 nt, Human
gccugcagagaaggucagag

SEQ ID NO: 298211 - RNA, 19 nt, Human
gcgaggaagucacuguggu

SEQ ID NO: 298212 - RNA, 22 nt, Human
ugcucauuggcgaucugaggga

SEQ ID NO: 298213 - RNA, 22 nt, Human
ggcuccagguuuaaggguaugu

SEQ ID NO: 298214 - RNA, 23 nt, Human
uccaugagaugugggcuucuagu

SEQ ID NO: 298215 - RNA, 22 nt, Human
uuucuugagcccaggaggugga

SEQ ID NO: 298216 - RNA, 22 nt, Human
ccuugcucucccaagcccgcag

SEQ ID NO: 298217 - RNA, 22 nt, Human
auuguauaacagcauguauuuu

SEQ ID NO: 298218 - RNA, 22 nt, Human
ucacugggagaugugggaaggg

SEQ ID NO: 298219 - RNA, 22 nt, Human
gaggugguucagguagagccca

SEQ ID NO: 298220 - RNA, 22 nt, Human
uuccucaacaacuucccuacag

SEQ ID NO: 298221 - RNA, 22 nt, Human
cugggaaauggcuucgagcuca

SEQ ID NO: 298222 - RNA, 22 nt, Human
ugcagggcacggugcgcguggg

SEQ ID NO: 298223 - RNA, 22 nt, Human
uuauugaguuuacagcuuuaga

SEQ ID NO: 298224 - RNA, 22 nt, Human
uuccuucuuugugguagaaagu

SEQ ID NO: 298225 - RNA, 22 nt, Human
uuuccuucucagggagcuucaa

SEQ ID NO: 298226 - RNA, 22 nt, Human
uauguacuacacuagaacauuu

SEQ ID NO: 298227 - RNA, 22 nt, Human
ucacaauuuggauacagcuaug

SEQ ID NO: 298228 - RNA, 22 nt, Human
uuucucauuuagaguggcaggg

SEQ ID NO: 298229 - RNA, 22 nt, Human
caauuucuuguuaauucucagg

SEQ ID NO: 298230 - RNA, 22 nt, Human
uuucugauauacuguagaaucc

SEQ ID NO: 298231 - RNA, 22 nt, Human
ucccacaggagccugaguccca

SEQ ID NO: 298232 - RNA, 17 nt, Human
acagcagggaaguguug

SEQ ID NO: 298233 - RNA, 22 nt, Human
gagagcugggcuuugggugaag

SEQ ID NO: 298234 - RNA, 22 nt, Human
ugcuuuauuggaaccucauccu

SEQ ID NO: 298235 - RNA, 22 nt, Human
ugcugaggagguggcugugcuu

SEQ ID NO: 298236 - RNA, 22 nt, Human
aaauacagauuccagggucuua

SEQ ID NO: 298237 - RNA, 19 nt, Human
gcaugcagaguaagaaggu

SEQ ID NO: 298238 - RNA, 22 nt, Human
uagggacacugcucaugaguuc

SEQ ID NO: 298239 - RNA, 22 nt, Human
ucuggcccaucuucugccacca

SEQ ID NO: 298240 - RNA, 22 nt, Human
auuuccugggucucacuccaga

SEQ ID NO: 298241 - RNA, 22 nt, Human
uugcuuuauuuggcaugccacu

SEQ ID NO: 298242 - RNA, 22 nt, Human
acauguaaaaauuaagguaaga

SEQ ID NO: 298243 - RNA, 22 nt, Human
guguccaucucuguaugcugcu

SEQ ID NO: 298244 - RNA, 22 nt, Human
cacagaaaaaggcuugaaaauc

SEQ ID NO: 298245 - RNA, 22 nt, Human
agccagagacugugucuguaau

SEQ ID NO: 298246 - RNA, 19 nt, Human
ugguggaggugcaccugac

SEQ ID NO: 298247 - RNA, 22 nt, Human
cgacccuacagacagugcugag

SEQ ID NO: 298248 - RNA, 22 nt, Human
gcagacaggggcuuaggaaagg

SEQ ID NO: 298249 - RNA, 22 nt, Human
ucuuccucaugaauucucguau

SEQ ID NO: 298250 - RNA, 22 nt, Human
aucacaaaggcugcuucaugau

SEQ ID NO: 298251 - RNA, 22 nt, Human
uucuccaacacaagcaugaugu

SEQ ID NO: 298252 - RNA, 22 nt, Human
cagacaggagacuggaucaugg

SEQ ID NO: 298253 - RNA, 22 nt, Human
uucuuguauauaaaaaucauuu

SEQ ID NO: 298254 - RNA, 22 nt, Human
gagggcuccucacauucucuau

SEQ ID NO: 298255 - RNA, 21 nt, Human
ugacugaggcuucuucacaca

SEQ ID NO: 298256 - RNA, 22 nt, Human
aucuuucuauuucuaaaaacua

SEQ ID NO: 298257 - RNA, 15 nt, Human
gcaggcagaucaccg

SEQ ID NO: 298258 - RNA, 22 nt, Human
uacuaaauaguuuaauuccuca

SEQ ID NO: 298259 - RNA, 22 nt, Human
auuuccauacacccauuucuga

SEQ ID NO: 298260 - RNA, 23 nt, Human
aguccuuuuuauaaaauugagga

SEQ ID NO: 298261 - RNA, 22 nt, Human
cauggaauuuucuaggcauaaa

SEQ ID NO: 298262 - RNA, 22 nt, Human
agucccagcuucccccaugcag

SEQ ID NO: 298263 - RNA, 22 nt, Human
aagagcauggaauggagaucca

SEQ ID NO: 298264 - RNA, 17 nt, Human
acaggcagaucaccuga

SEQ ID NO: 298265 - RNA, 22 nt, Human
uuucagaaagcaucaucaaagu

SEQ ID NO: 298266 - RNA, 17 nt, Human
uucugggucccagggcc

SEQ ID NO: 298267 - RNA, 22 nt, Human
aauucuuguuguuaguauauuu

SEQ ID NO: 298268 - RNA, 22 nt, Human
gggacagacccaugggccaggu

SEQ ID NO: 298269 - RNA, 22 nt, Human
cuuuauuagauguagacuuucu

SEQ ID NO: 298270 - RNA, 22 nt, Human
agaaauguggaucguuuuaaaa

SEQ ID NO: 298271 - RNA, 18 nt, Human
ucuuccaacacugacacc

SEQ ID NO: 298272 - RNA, 22 nt, Human
acuuuguuuggcuauuagaguc

SEQ ID NO: 298273 - RNA, 22 nt, Human
ugaaaaacuuuaauccauaaag

SEQ ID NO: 298274 - RNA, 22 nt, Human
cucagagaaccuaagcggagga

SEQ ID NO: 298275 - RNA, 22 nt, Human
uucucuuagcuguaaagucaau

SEQ ID NO: 298276 - RNA, 22 nt, Human
agggaccucuucuugcagcuga

SEQ ID NO: 298277 - RNA, 22 nt, Human
ggcagguggacgugcuaaagcu

SEQ ID NO: 298278 - RNA, 22 nt, Human
uuuguaaaggccugaauuucag

SEQ ID NO: 298279 - RNA, 22 nt, Human
gauuguaaaacagaucauuauc

SEQ ID NO: 298280 - RNA, 22 nt, Human
acagguggggaggcugagguuc

SEQ ID NO: 298281 - RNA, 22 nt, Human
uacagacauucaauuuugaccc

SEQ ID NO: 298282 - RNA, 22 nt, Human
ccaggugugcucugcaguggau

SEQ ID NO: 298283 - RNA, 22 nt, Human
ggcuuuauuucacuguaccaua

SEQ ID NO: 298284 - RNA, 22 nt, Human
agcagggcuggauuuggcaaga

SEQ ID NO: 298285 - RNA, 22 nt, Human
gcagcuuuaaacauuggaaaua

SEQ ID NO: 298286 - RNA, 22 nt, Human
augaaauggugguuuuccauuu

SEQ ID NO: 298287 - RNA, 17 nt, Human
uguuuucauucauugcu

SEQ ID NO: 298288 - RNA, 22 nt, Human
uucuucaaagaugucuguugga

SEQ ID NO: 298289 - RNA, 22 nt, Human
ugcagggaugcuagagguaaga

SEQ ID NO: 298290 - RNA, 22 nt, Human
gaaguacaguuuuaucuagcca

SEQ ID NO: 298291 - RNA, 22 nt, Human
cuggguguucaggagcugggcu

SEQ ID NO: 298292 - RNA, 22 nt, Human
accugccagaauccaagccaca

SEQ ID NO: 298293 - RNA, 22 nt, Human
gcugggugucacggggcucgug

SEQ ID NO: 298294 - RNA, 22 nt, Human
ccuugguccaacccugcacagc

SEQ ID NO: 298295 - RNA, 22 nt, Human
guccuucuuuucaucccugguu

SEQ ID NO: 298296 - RNA, 22 nt, Human
uuauuuaaugugaucugaagag

SEQ ID NO: 298297 - RNA, 22 nt, Human
cucccaagcugugcugaacugu

SEQ ID NO: 298298 - RNA, 22 nt, Human
ugucagagcaaggccaggccag

SEQ ID NO: 298299 - RNA, 19 nt, Human
aauagauuaauuauccucu

SEQ ID NO: 298300 - RNA, 22 nt, Human
augugucuaauuccaggagcac

SEQ ID NO: 298301 - RNA, 22 nt, Human
cuugcuggugucgugccuucac

SEQ ID NO: 298302 - RNA, 22 nt, Human
agcugcaauucuggacauaguc

SEQ ID NO: 298303 - RNA, 22 nt, Human
ugcagggaggccccgcagcccu

SEQ ID NO: 298304 - RNA, 22 nt, Human
auucuucacauggauaggaucu

SEQ ID NO: 298305 - RNA, 22 nt, Human
uguagaaauuaguaagaucaac

SEQ ID NO: 298306 - RNA, 22 nt, Human
uacaggugcucuacagacagga

SEQ ID NO: 298307 - RNA, 21 nt, Human
agcugcaagagcaacaucuuu

SEQ ID NO: 298308 - RNA, 22 nt, Human
gaauguuugacuaaagguagcu

SEQ ID NO: 298309 - RNA, 21 nt, Human
ucuuccuccacagcgugccac

SEQ ID NO: 298310 - RNA, 19 nt, Human
gcgaggaagucacuguggc

SEQ ID NO: 298311 - RNA, 20 nt, Human
cuucuucagccuaugcuuca

SEQ ID NO: 298312 - RNA, 22 nt, Human
agcuggucuuaaauguguccag

SEQ ID NO: 298313 - RNA, 22 nt, Human
uauuccuaagucccaacuacau

SEQ ID NO: 298314 - RNA, 22 nt, Human
uccaggcauguggccaguacuc

SEQ ID NO: 298315 - RNA, 22 nt, Human
ccauucuuucagugucucaugu

SEQ ID NO: 298316 - RNA, 22 nt, Human
uuaaauuauuucuagugaggug

SEQ ID NO: 298317 - RNA, 22 nt, Human
ugauuuuauugaaacuucacuu

SEQ ID NO: 298318 - RNA, 22 nt, Human
aacuuucaggcaaugaauauuu

SEQ ID NO: 298319 - RNA, 22 nt, Human
aaacagcuaauggccaggaaua

SEQ ID NO: 298320 - RNA, 22 nt, Human
uuucuguaaggacuuaaugcaa

SEQ ID NO: 298321 - RNA, 22 nt, Human
aauuagggagagguagcuaggu

SEQ ID NO: 298322 - RNA, 22 nt, Human
gcaggugucuucauggaacucu

SEQ ID NO: 298323 - RNA, 22 nt, Human
uaaguuuucuggaauaacuugg

SEQ ID NO: 298324 - RNA, 18 nt, Human
ucugagguggacgaggag

SEQ ID NO: 298325 - RNA, 22 nt, Human
gagcaguggugguguguuagag

SEQ ID NO: 298326 - RNA, 22 nt, Human
ugcaggugaaaauuaugaggau

SEQ ID NO: 298327 - RNA, 22 nt, Human
uuggaggauaaggauauugauu

SEQ ID NO: 298328 - RNA, 22 nt, Human
auugcugguagucagugucccu

SEQ ID NO: 298329 - RNA, 22 nt, Human
agucccuucucaaagugugcgg

SEQ ID NO: 298330 - RNA, 22 nt, Human
aucagagacaaaaccagcacuu

SEQ ID NO: 298331 - RNA, 22 nt, Human
acauguaagacuagcuuaaagu

SEQ ID NO: 298332 - RNA, 22 nt, Human
ugcugccaagcccgugcuccug

SEQ ID NO: 298333 - RNA, 22 nt, Human
agcuggcaguaugacuggugac

SEQ ID NO: 298334 - RNA, 22 nt, Human
uacacacaugcauuugccuuau

SEQ ID NO: 298335 - RNA, 22 nt, Human
uggacaugagcugagugggugu

SEQ ID NO: 298336 - RNA, 22 nt, Human
uccuucuccuccuugagugaca

SEQ ID NO: 298337 - RNA, 22 nt, Human
ggcuuggaaauugcaggacaca

SEQ ID NO: 298338 - RNA, 22 nt, Human
aguccugucaccucuacuuucg

SEQ ID NO: 298339 - RNA, 22 nt, Human
cuugaagaaauggagacaggau

SEQ ID NO: 298340 - RNA, 22 nt, Human
ucagugugaguaccaugcucag

SEQ ID NO: 298341 - RNA, 22 nt, Human
cucagagagggcaccagggcca

SEQ ID NO: 298342 - RNA, 22 nt, Human
uaggccauucuuggagcuuacu

SEQ ID NO: 298343 - RNA, 22 nt, Human
uuccaggaagcaguuagcagcc

SEQ ID NO: 298344 - RNA, 22 nt, Human
ucauuguagggcauuuagagag

SEQ ID NO: 298345 - RNA, 22 nt, Human
auauauuugagaauauucauga

SEQ ID NO: 298346 - RNA, 22 nt, Human
uugcugggugcuauuaugaaca

SEQ ID NO: 298347 - RNA, 22 nt, Human
gggcugacaguuuccccugaaa

SEQ ID NO: 298348 - RNA, 22 nt, Human
ccagagagaaauggauuugagu

SEQ ID NO: 298349 - RNA, 22 nt, Human
augagguuuuacugccauuuuc

SEQ ID NO: 298350 - RNA, 22 nt, Human
uuuagauaaugcucaagcaauu

SEQ ID NO: 298351 - RNA, 19 nt, Human
aaggugucccaacugcguu

SEQ ID NO: 298352 - RNA, 22 nt, Human
cccagcuugcccaggacugagg

SEQ ID NO: 298353 - RNA, 22 nt, Human
acuuccagugucugcugcuagc

SEQ ID NO: 298354 - RNA, 22 nt, Human
cagguacauucguagacccauu

SEQ ID NO: 298355 - RNA, 22 nt, Human
uuucaaaguugggaauuguaau

SEQ ID NO: 298356 - RNA, 22 nt, Human
aaauacagaguugcuuaaaagc

SEQ ID NO: 298357 - RNA, 22 nt, Human
uuugcacuagcauuuguccaug

SEQ ID NO: 298358 - RNA, 22 nt, Human
auacaugugugugcauacaugu

SEQ ID NO: 298359 - RNA, 22 nt, Human
uccagcaugaaggggcuuuuau

SEQ ID NO: 298360 - RNA, 22 nt, Human
cuuauuagugucugucugaguu

SEQ ID NO: 298361 - RNA, 22 nt, Human
agcagguguaucggucaccuac

SEQ ID NO: 298362 - RNA, 22 nt, Human
agacagacaugcuaguuuucuu

SEQ ID NO: 298363 - RNA, 21 nt, Human
ggcaggugggucucuguugcu

SEQ ID NO: 298364 - RNA, 22 nt, Human
agaugaaagauuuuuauagaga

SEQ ID NO: 298365 - RNA, 22 nt, Human
cagcuuugcaggcuggucagug

SEQ ID NO: 298366 - RNA, 22 nt, Human
cacaggcugcccgcagcuggga

SEQ ID NO: 298367 - RNA, 22 nt, Human
ucuuaaagagcgcaauuugagg

SEQ ID NO: 298368 - RNA, 22 nt, Human
caaaguccuagaacagugcuug

SEQ ID NO: 298369 - RNA, 22 nt, Human
ccagcauggcaccugagaugag

SEQ ID NO: 298370 - RNA, 22 nt, Human
aauuagggaaaacauuugcuuu

SEQ ID NO: 298371 - RNA, 22 nt, Human
guucuauuccccuuaucuguga

SEQ ID NO: 298372 - RNA, 22 nt, Human
acauguguacauauauaugugc

SEQ ID NO: 298373 - RNA, 22 nt, Human
uagcuuuaaaaaucaucaaagc

SEQ ID NO: 298374 - RNA, 22 nt, Human
aauauaugugguauugaccagc

SEQ ID NO: 298375 - RNA, 22 nt, Human
acagacaguaugguggggcuga

SEQ ID NO: 298376 - RNA, 22 nt, Human
gcuguucacggaggaggauggg

SEQ ID NO: 298377 - RNA, 22 nt, Human
uuauuacacugaaagaauugcg

SEQ ID NO: 298378 - RNA, 22 nt, Human
auuuaugauuagccuauuguug

SEQ ID NO: 298379 - RNA, 20 nt, Human
ucagauuuuucuaacuuuga

SEQ ID NO: 298380 - RNA, 22 nt, Human
aaauuauaggugccaccuugga

SEQ ID NO: 298381 - RNA, 22 nt, Human
uuuccagagggugcucagggcg

SEQ ID NO: 298382 - RNA, 22 nt, Human
uucuauugggcagcauugcuuc

SEQ ID NO: 298383 - RNA, 22 nt, Human
ccugcagggugcugccacagau

SEQ ID NO: 298384 - RNA, 22 nt, Human
cacccagcuuuugcauccuccg

SEQ ID NO: 298385 - RNA, 22 nt, Human
aaaagcagaucuccaaagucua

SEQ ID NO: 298386 - RNA, 22 nt, Human
cuauuagguuggugcaaaagua

SEQ ID NO: 298387 - RNA, 22 nt, Human
uagaaauaaaucugcagcuggg

SEQ ID NO: 298388 - RNA, 18 nt, Human
agcagguggauuuauugg

SEQ ID NO: 298389 - RNA, 22 nt, Human
ugugcauguauugauuuguacc

SEQ ID NO: 298390 - RNA, 22 nt, Human
agaauaauacugaaaugcugaa

SEQ ID NO: 298391 - RNA, 22 nt, Human
aagauaaacucuugauuucuga

SEQ ID NO: 298392 - RNA, 22 nt, Human
uggaggaaaauuacuggggucu

SEQ ID NO: 298393 - RNA, 23 nt, Human
acagaaaucauuuguaagguacc

SEQ ID NO: 298394 - RNA, 22 nt, Human
uuugacuccagagcccauuuuu

SEQ ID NO: 298395 - RNA, 22 nt, Human
caauuucucgaacucuaaucca

SEQ ID NO: 298396 - RNA, 22 nt, Human
aagugccccaggcuguuaacau

SEQ ID NO: 298397 - RNA, 22 nt, Human
uguuuucauuugauguaacaaa

SEQ ID NO: 298398 - RNA, 22 nt, Human
uauugguagauggagagagaca

SEQ ID NO: 298399 - RNA, 22 nt, Human
aguguccuggcaaggguuucag

SEQ ID NO: 298400 - RNA, 22 nt, Human
agauuucucuuucccuggcuga

SEQ ID NO: 298401 - RNA, 22 nt, Human
uuaaauuccagccucauaauag

SEQ ID NO: 298402 - RNA, 22 nt, Human
uuuaucuguuccucuuggaggc

SEQ ID NO: 298403 - RNA, 22 nt, Human
acagggcauuuccucuaugugu

SEQ ID NO: 298404 - RNA, 22 nt, Human
caggguggaagcuguagagugg

SEQ ID NO: 298405 - RNA, 22 nt, Human
ggcagaccucuccagccccaca

SEQ ID NO: 298406 - RNA, 22 nt, Human
uuguguccuaagcaccagaugg

SEQ ID NO: 298407 - RNA, 19 nt, Human
cacaucagcagggcugugg

SEQ ID NO: 298408 - RNA, 22 nt, Human
gggcaggugaccucuuguccug

SEQ ID NO: 298409 - RNA, 20 nt, Human
gagggcucguggauggauaa

SEQ ID NO: 298410 - RNA, 22 nt, Human
agagacaggguuuugucguguu

SEQ ID NO: 298411 - RNA, 22 nt, Human
gcagggcacagacagugccaag

SEQ ID NO: 298412 - RNA, 22 nt, Human
uucauucugggcucuaaggaac

SEQ ID NO: 298413 - RNA, 22 nt, Human
acagaaaugauguuuggcaaua

SEQ ID NO: 298414 - RNA, 22 nt, Human
ugcaguggaaagacucagacuu

SEQ ID NO: 298415 - RNA, 22 nt, Human
uuuguuuucaaugugucauuca

SEQ ID NO: 298416 - RNA, 22 nt, Human
gucauauacacugcauguaauc

SEQ ID NO: 298417 - RNA, 22 nt, Human
ucuucagacuccaaauguuuua

SEQ ID NO: 298418 - RNA, 22 nt, Human
uguguccucuuaccucugaccc

SEQ ID NO: 298419 - RNA, 22 nt, Human
ugggaagaguuagagacagcug

SEQ ID NO: 298420 - RNA, 22 nt, Human
ucagggcaaaagggaaaccauu

SEQ ID NO: 298421 - RNA, 22 nt, Human
uuuuuauaacucuuuugugaca

SEQ ID NO: 298422 - RNA, 22 nt, Human
cuagggaccucagcuccuggag

SEQ ID NO: 298423 - RNA, 22 nt, Human
cccaggcagcccuucugacgca

SEQ ID NO: 298424 - RNA, 22 nt, Human
ugucagagcaaugagguucagc

SEQ ID NO: 298425 - RNA, 22 nt, Human
uagggcucagagaaguggggcc

SEQ ID NO: 298426 - RNA, 22 nt, Human
aaugauuuggcaaaggaaucca

SEQ ID NO: 298427 - RNA, 22 nt, Human
augugcaaauccaaugugaaug

SEQ ID NO: 298428 - RNA, 22 nt, Human
auucauuuagguauucacuuac

SEQ ID NO: 298429 - RNA, 22 nt, Human
uuguuuuuaaacaugugacuga

SEQ ID NO: 298430 - RNA, 22 nt, Human
cucagcaacccuagaacauuug

SEQ ID NO: 298431 - RNA, 22 nt, Human
uucugugcccauuuuaaaaugg

SEQ ID NO: 298432 - RNA, 22 nt, Human
auugaaaauauaauucuaggag

SEQ ID NO: 298433 - RNA, 22 nt, Human
gacaggguccaaaggcagggga

SEQ ID NO: 298434 - RNA, 22 nt, Human
accaggcagcugggggugaugu

SEQ ID NO: 298435 - RNA, 17 nt, Human
cagacaggcugucaccc

SEQ ID NO: 298436 - RNA, 22 nt, Human
cacaugugggaaauggugcuua

SEQ ID NO: 298437 - RNA, 22 nt, Human
gauguguccuaguacggguggg

SEQ ID NO: 298438 - RNA, 22 nt, Human
cauuagggccaccauaacaaaa

SEQ ID NO: 298439 - RNA, 22 nt, Human
uuuagggaauagaagaucugaa

SEQ ID NO: 298440 - RNA, 22 nt, Human
uuaugcaaaggggccucuuccu

SEQ ID NO: 298441 - RNA, 22 nt, Human
auuuacuggaaaaacuaugagc

SEQ ID NO: 298442 - RNA, 22 nt, Human
uuuccucugucaugacagcuga

SEQ ID NO: 298443 - RNA, 22 nt, Human
gcaaauauucaagacuuuucca

SEQ ID NO: 298444 - RNA, 22 nt, Human
agcagggcagugcuucagcucu

SEQ ID NO: 298445 - RNA, 22 nt, Human
cccaggcagaauuaguguuuca

SEQ ID NO: 298446 - RNA, 22 nt, Human
uuuauuauccaguguugucaug

SEQ ID NO: 298447 - RNA, 22 nt, Human
gccaggcagcaggaagccagug

SEQ ID NO: 298448 - RNA, 22 nt, Human
ugcaggugguccuuccucugcu

SEQ ID NO: 298449 - RNA, 22 nt, Human
uacauaauuaaucuuuaaguuc

SEQ ID NO: 298450 - RNA, 22 nt, Human
ggaacuugaaaaucaagguggu

SEQ ID NO: 298451 - RNA, 22 nt, Human
agucucagcaagcauggcuagu

SEQ ID NO: 298452 - RNA, 22 nt, Human
cauaauuuuuuuaagucagaac

SEQ ID NO: 298453 - RNA, 22 nt, Human
gaggugucaugagggccugcuc

SEQ ID NO: 298454 - RNA, 22 nt, Human
auucuucauuguugauucaugu

SEQ ID NO: 298455 - RNA, 22 nt, Human
guguuuuaucagacaaaguaua

SEQ ID NO: 298456 - RNA, 22 nt, Human
acagcuuuucaauucugcugag

SEQ ID NO: 298457 - RNA, 22 nt, Human
uuuguucaugccuauauucuca

SEQ ID NO: 298458 - RNA, 22 nt, Human
ucuguucagaagaggugaaagu

SEQ ID NO: 298459 - RNA, 22 nt, Human
auguguuuguaccuuuaaauau

SEQ ID NO: 298460 - RNA, 22 nt, Human
ccuguucaccauggucacgugc

SEQ ID NO: 298461 - RNA, 22 nt, Human
agguuuaugccuuggagcuggg

SEQ ID NO: 298462 - RNA, 22 nt, Human
cuuguucaguccugacuuccug

SEQ ID NO: 298463 - RNA, 22 nt, Human
ccagggcauguccaagacuuag

SEQ ID NO: 298464 - RNA, 22 nt, Human
uauaucauggagauuaacauuc

SEQ ID NO: 298465 - RNA, 22 nt, Human
ccagguguguacagaacagcac

SEQ ID NO: 298466 - RNA, 22 nt, Human
cuucguuuuuaguagcaauguu

SEQ ID NO: 298467 - RNA, 22 nt, Human
ucugggaacacacgucacuuca

SEQ ID NO: 298468 - RNA, 21 nt, Human
acuguucauuugaugaacugg

SEQ ID NO: 298469 - RNA, 22 nt, Human
gcuguucacagacucugcucug

SEQ ID NO: 298470 - RNA, 22 nt, Human
uaggugguagagccuggcuugc

SEQ ID NO: 298471 - RNA, 22 nt, Human
uuucaugagauuccuccacauc

SEQ ID NO: 298472 - RNA, 22 nt, Human
acacuaaugagaaaggaauuaa

SEQ ID NO: 298473 - RNA, 22 nt, Human
uuauuagguuauucucuguacu

SEQ ID NO: 298474 - RNA, 22 nt, Human
caggugucggucaggcgguuuu

SEQ ID NO: 298475 - RNA, 22 nt, Human
cacauaauugaacgugaugagu

SEQ ID NO: 298476 - RNA, 22 nt, Human
accaggcagagcugggccuuaa

SEQ ID NO: 298477 - RNA, 22 nt, Human
gaggugucaucaggcagcucug

SEQ ID NO: 298478 - RNA, 22 nt, Human
ccagcuuuuagugggcuuauua

SEQ ID NO: 298479 - RNA, 22 nt, Human
aggacaugugccuccagggcag

SEQ ID NO: 298480 - RNA, 22 nt, Human
cucuucuuauggccguggcuga

SEQ ID NO: 298481 - RNA, 22 nt, Human
gcagcuuucuaagcuuuauugc

SEQ ID NO: 298482 - RNA, 18 nt, Human
ucuggagggaagcuuuga

SEQ ID NO: 298483 - RNA, 22 nt, Human
caguguuucugaguuccagcuc

SEQ ID NO: 298484 - RNA, 22 nt, Human
aaguauaagcuauucuucauga

SEQ ID NO: 298485 - RNA, 22 nt, Human
uugacacaguuuucucauuaag

SEQ ID NO: 298486 - RNA, 22 nt, Human
ucuucaaauccuacagugucug

SEQ ID NO: 298487 - RNA, 22 nt, Human
uagggcaguuauaacauuagug

SEQ ID NO: 298488 - RNA, 22 nt, Human
cuuuaagacucugcucuuggug

SEQ ID NO: 298489 - RNA, 22 nt, Human
acaggacaggcugggcuagacu

SEQ ID NO: 298490 - RNA, 22 nt, Human
acuuucuucuacuacuuggaga

SEQ ID NO: 298491 - RNA, 22 nt, Human
auuuauuaccucggaguuucug

SEQ ID NO: 298492 - RNA, 21 nt, Human
aguuugaugcaauuucugaga

SEQ ID NO: 298493 - RNA, 22 nt, Human
uauugcugccauuuuccaaugu

SEQ ID NO: 298494 - RNA, 22 nt, Human
uauuuccaaaagccuauuauga

SEQ ID NO: 298495 - RNA, 22 nt, Human
ucuguucaagacugaggugaca

SEQ ID NO: 298496 - RNA, 22 nt, Human
caggugguuccauguuucauga

SEQ ID NO: 298497 - RNA, 22 nt, Human
ccuguucaugaaacugcuuucc

SEQ ID NO: 298498 - RNA, 22 nt, Human
cccaugagauucugaauuuggc

SEQ ID NO: 298499 - RNA, 22 nt, Human
cuacauaaauuuaucacagacu

SEQ ID NO: 298500 - RNA, 22 nt, Human
acacuaauuaagcugcuuuacu

SEQ ID NO: 298501 - RNA, 22 nt, Human
aacauucugguucuaaaaaccu

SEQ ID NO: 298502 - RNA, 22 nt, Human
auauuugucaauucacuguuca

SEQ ID NO: 298503 - RNA, 22 nt, Human
cuuuauuccuacaagauuuucu

SEQ ID NO: 298504 - RNA, 22 nt, Human
caauuucuggaacuaauucuga

SEQ ID NO: 298505 - RNA, 22 nt, Human
agggcuccaaggaaguguagcu

SEQ ID NO: 298506 - RNA, 22 nt, Human
aaugugucccuuauuucacagg

SEQ ID NO: 298507 - RNA, 18 nt, Human
gacaggugggugagacca

SEQ ID NO: 298508 - RNA, 22 nt, Human
ucucuucauagugacacccauc

SEQ ID NO: 298509 - RNA, 22 nt, Human
gaugaaaaaagacgagcauaua

SEQ ID NO: 298510 - RNA, 23 nt, Human
gaggcagcuccugcagugcccug

SEQ ID NO: 298511 - RNA, 22 nt, Human
gcuguucaagacuaggaaauuu

SEQ ID NO: 298512 - RNA, 22 nt, Human
cagacaggcaggugcugcuuug

SEQ ID NO: 298513 - RNA, 22 nt, Human
ggugggugcagggggcuucuua

SEQ ID NO: 298514 - RNA, 22 nt, Human
ucauguguuaaacuccaagaua

SEQ ID NO: 298515 - RNA, 22 nt, Human
uuucauugagacuauagacauc

SEQ ID NO: 298516 - RNA, 22 nt, Human
caaaugcuacuaauaggcaagu

SEQ ID NO: 298517 - RNA, 22 nt, Human
uuuccucacacagaagaucuug

SEQ ID NO: 298518 - RNA, 22 nt, Human
aagggcaggaaaagauggaugu

SEQ ID NO: 298519 - RNA, 22 nt, Human
aagcugcaaaaaauuucugucu

SEQ ID NO: 298520 - RNA, 22 nt, Human
acccaggguagaaccucagagc

SEQ ID NO: 298521 - RNA, 22 nt, Human
acauguguaaaaguggauaaaa

SEQ ID NO: 298522 - RNA, 19 nt, Human
gaacuuggccaggcacagu

SEQ ID NO: 298523 - RNA, 19 nt, Human
ucugaagaauuagagagca

SEQ ID NO: 298524 - RNA, 22 nt, Human
ucauucuugaucacuaguuagu

SEQ ID NO: 298525 - RNA, 22 nt, Human
cccaggcagugcugaucccuca

SEQ ID NO: 298526 - RNA, 22 nt, Human
ucucucuucaacccuuaacuag

SEQ ID NO: 298527 - RNA, 22 nt, Human
gugaaaauaaggcugguucuug

SEQ ID NO: 298528 - RNA, 22 nt, Human
cccagugugccccuccugcagc

SEQ ID NO: 298529 - RNA, 22 nt, Human
ucuucaauuagauuuaccaauu

SEQ ID NO: 298530 - RNA, 22 nt, Human
cauuuguagcuauuuacuguau

SEQ ID NO: 298531 - RNA, 22 nt, Human
gaggugucuagaucuaccagua

SEQ ID NO: 298532 - RNA, 22 nt, Human
uaauucagggccagaaucccca

SEQ ID NO: 298533 - RNA, 22 nt, Human
ggagcugaguggguuuauugau

SEQ ID NO: 298534 - RNA, 22 nt, Human
ugcuuucuuuagcuccugaguc

SEQ ID NO: 298535 - RNA, 22 nt, Human
ugcauuuuuaacaaggcuaauu

SEQ ID NO: 298536 - RNA, 22 nt, Human
ucagguggagaccuccuuggcc

SEQ ID NO: 298537 - RNA, 22 nt, Human
uuucuggguuuaugucacagcu

SEQ ID NO: 298538 - RNA, 22 nt, Human
cuuaaaaucuggcaguuagcua

SEQ ID NO: 298539 - RNA, 22 nt, Human
agccagaggaacuugaugacug

SEQ ID NO: 298540 - RNA, 22 nt, Human
ggcaggugugagcuguaaagga

SEQ ID NO: 298541 - RNA, 22 nt, Human
ucuugcacuucaugaauauguu

SEQ ID NO: 298542 - RNA, 22 nt, Human
uuaccuaaaauagcucaauuua

SEQ ID NO: 298543 - RNA, 22 nt, Human
aacaugauggggaagaacaaga

SEQ ID NO: 298544 - RNA, 21 nt, Human
ugaucauuuguguaaaggaga

SEQ ID NO: 298545 - RNA, 22 nt, Human
uuaguucuugggugaacuuuug

SEQ ID NO: 298546 - RNA, 22 nt, Human
cagaaaauaaaguuucuacgca

SEQ ID NO: 298547 - RNA, 22 nt, Human
uucagugucaauuuuuaaauau

SEQ ID NO: 298548 - RNA, 22 nt, Human
ccaucagauuagcaaaauccag

SEQ ID NO: 298549 - RNA, 22 nt, Human
uucacaauaggagcaugcaaau

SEQ ID NO: 298550 - RNA, 22 nt, Human
ggaacuugcaaccucuggucac

SEQ ID NO: 298551 - RNA, 22 nt, Human
ggggcagggagguuaucgccga

SEQ ID NO: 298552 - RNA, 22 nt, Human
uuugcaaagaaauuauugcugu

SEQ ID NO: 298553 - RNA, 22 nt, Human
uuucaaaccuacuuguauguuu

SEQ ID NO: 298554 - RNA, 22 nt, Human
ggcaggcaccagcucagcaaua

SEQ ID NO: 298555 - RNA, 22 nt, Human
acauuuuuauucaucaaagcag

SEQ ID NO: 298556 - RNA, 22 nt, Human
aguaaaauuucugcugaggaga

SEQ ID NO: 298557 - RNA, 22 nt, Human
aaugaucuacucucauuaucuc

SEQ ID NO: 298558 - RNA, 21 nt, Human
uaauaauuccacuacagagua

SEQ ID NO: 298559 - RNA, 22 nt, Human
aagguuaaauagguauuuucca

SEQ ID NO: 298560 - RNA, 22 nt, Human
gcagguggaagcagcagacuca

SEQ ID NO: 298561 - RNA, 22 nt, Human
acauccagaucucagcauggcu

SEQ ID NO: 298562 - RNA, 22 nt, Human
aggacaugaagaaagggcaagg

SEQ ID NO: 298563 - RNA, 22 nt, Human
auuuaaugucgagcuauuguag

SEQ ID NO: 298564 - RNA, 22 nt, Human
gaggcugggaaguccaagacca

SEQ ID NO: 298565 - RNA, 22 nt, Human
ccuuccucauccauuucucuug

SEQ ID NO: 298566 - RNA, 22 nt, Human
gcaguguuaggaauaaaaauga

SEQ ID NO: 298567 - RNA, 22 nt, Human
acagcauggauaacaaggcacu

SEQ ID NO: 298568 - RNA, 22 nt, Human
uuaguugauguucuggagguag

SEQ ID NO: 298569 - RNA, 22 nt, Human
ucaaauaaugccauucaucauc

SEQ ID NO: 298570 - RNA, 22 nt, Human
gcguccagggaaggcccagcug

SEQ ID NO: 298571 - RNA, 22 nt, Human
aaggugguaauagugcaggauu

SEQ ID NO: 298572 - RNA, 22 nt, Human
acucacuuuccauucaagcacc

SEQ ID NO: 298573 - RNA, 22 nt, Human
cuuuccaaugucacuaugaauc

SEQ ID NO: 298574 - RNA, 22 nt, Human
uuaaauuuuagaaacagacucu

SEQ ID NO: 298575 - RNA, 22 nt, Human
uuuauuagauuaucaaagaggu

SEQ ID NO: 298576 - RNA, 22 nt, Human
ggcuuuuguuucagcucugcua

SEQ ID NO: 298577 - RNA, 22 nt, Human
aagaaagggagaaggauggugu

SEQ ID NO: 298578 - RNA, 22 nt, Human
gcuggcuggcgggugcguccuc

SEQ ID NO: 298579 - RNA, 22 nt, Human
cuuaagcaaaauauucuuucac

SEQ ID NO: 298580 - RNA, 22 nt, Human
uuagcuucuuacauuucauccu

SEQ ID NO: 298581 - RNA, 22 nt, Human
ugaugguuuuauuaauaggacc

SEQ ID NO: 298582 - RNA, 22 nt, Human
ucugaagaacugucuagagaac

SEQ ID NO: 298583 - RNA, 20 nt, Human
gcuguucacauuauuaguag

SEQ ID NO: 298584 - RNA, 21 nt, Human
cucugcccagggccuccugcc

SEQ ID NO: 298585 - RNA, 22 nt, Human
cagugaggugcccagccugccc

SEQ ID NO: 298586 - RNA, 22 nt, Human
gauucuuacuucuaagcaagcu

SEQ ID NO: 298587 - RNA, 21 nt, Human
agcagguguaaaggaggaaau

SEQ ID NO: 298588 - RNA, 22 nt, Human
aauugcuucccaagggaggucu

SEQ ID NO: 298589 - RNA, 22 nt, Human
auuucagauucagaaauguagg

SEQ ID NO: 298590 - RNA, 22 nt, Human
gaggcugguaggaaaggaaaca

SEQ ID NO: 298591 - RNA, 22 nt, Human
uguuccugguuccugcaugaug

SEQ ID NO: 298592 - RNA, 22 nt, Human
gggcaaguccggugcccagagc

SEQ ID NO: 298593 - RNA, 22 nt, Human
aaacaugcauucaagaaaaucu

SEQ ID NO: 298594 - RNA, 22 nt, Human
ugggugugccauauuccauuuc

SEQ ID NO: 298595 - RNA, 22 nt, Human
guggaggaaaagaaguugggug

SEQ ID NO: 298596 - RNA, 22 nt, Human
uagggcagccuuauagcuccca

SEQ ID NO: 298597 - RNA, 22 nt, Human
cagcuucuggcguggagccuga

SEQ ID NO: 298598 - RNA, 22 nt, Human
gcagcuuuggagguggaacucu

SEQ ID NO: 298599 - RNA, 22 nt, Human
cuguccugaaguuuucaugaga

SEQ ID NO: 298600 - RNA, 18 nt, Human
ugagaggcuauuuuuugc

SEQ ID NO: 298601 - RNA, 22 nt, Human
gaggccagaaugagcugaaugc

SEQ ID NO: 298602 - RNA, 22 nt, Human
ucuaaagaagaggguucugcgg

SEQ ID NO: 298603 - RNA, 22 nt, Human
gacaucugaggcccucagagcc

SEQ ID NO: 298604 - RNA, 22 nt, Human
gccaggcagacaggucaucagg

SEQ ID NO: 298605 - RNA, 22 nt, Human
ugcagggcacacgcacgggugu

SEQ ID NO: 298606 - RNA, 22 nt, Human
uaaacauuuguuauucuuguuu

SEQ ID NO: 298607 - RNA, 22 nt, Human
uuccugggaggcuguguacuug

SEQ ID NO: 298608 - RNA, 22 nt, Human
cuugcacacauguacaugugua

SEQ ID NO: 298609 - RNA, 22 nt, Human
cugggguggauggguccaaguu

SEQ ID NO: 298610 - RNA, 22 nt, Human
cagggcucccucuggcucccag

SEQ ID NO: 298611 - RNA, 22 nt, Human
uuucuauugaucuaauaaacau

SEQ ID NO: 298612 - RNA, 22 nt, Human
ccaggugugauuucaucugagg

SEQ ID NO: 298613 - RNA, 20 nt, Human
uccaugaguuagagacuaua

SEQ ID NO: 298614 - RNA, 22 nt, Human
cuguuuucccuggaguucagca

SEQ ID NO: 298615 - RNA, 22 nt, Human
uuucccaguucccugcucuaua

SEQ ID NO: 298616 - RNA, 22 nt, Human
cccagcuugucugauucagccu

SEQ ID NO: 298617 - RNA, 22 nt, Human
ucucacagugcaggucugucuc

SEQ ID NO: 298618 - RNA, 22 nt, Human
aacuuucuuggaugucucaaca

SEQ ID NO: 298619 - RNA, 22 nt, Human
cuuugcaaacugucacacuuuc

SEQ ID NO: 298620 - RNA, 22 nt, Human
uagcugaugaauaauuauucuu

SEQ ID NO: 298621 - RNA, 22 nt, Human
guauuaggaaauaugaagaaag

SEQ ID NO: 298622 - RNA, 22 nt, Human
acuggaggggaaaaugguagua

SEQ ID NO: 298623 - RNA, 19 nt, Human
ccauuguaaagaaaaaugu

SEQ ID NO: 298624 - RNA, 22 nt, Human
uacuuuauucaggaaggcuggu

SEQ ID NO: 298625 - RNA, 22 nt, Human
gaauguaagugggcagaagaca

SEQ ID NO: 298626 - RNA, 22 nt, Human
ucuggguggugucuuccaagac

SEQ ID NO: 298627 - RNA, 15 nt, Human
uuggaggauguagua

SEQ ID NO: 298628 - RNA, 22 nt, Human
ugagaaaagguugagaugauaa

SEQ ID NO: 298629 - RNA, 22 nt, Human
aggaccuguaccucagcaucua

SEQ ID NO: 298630 - RNA, 22 nt, Human
cugugggagcacaugacagaua

SEQ ID NO: 298631 - RNA, 22 nt, Human
ccaggccugcaucugcugcgca

SEQ ID NO: 298632 - RNA, 22 nt, Human
cucuggccuggggccugcuccc

SEQ ID NO: 298633 - RNA, 22 nt, Human
uaguccuugcugggcacagagu

SEQ ID NO: 298634 - RNA, 22 nt, Human
cagggcaggaauuugacauugc

SEQ ID NO: 298635 - RNA, 17 nt, Human
ggcuggaggggacccgg

SEQ ID NO: 298636 - RNA, 22 nt, Human
caaauaguuuuucauguauuau

SEQ ID NO: 298637 - RNA, 22 nt, Human
uccuggauuaauagggagcugu

SEQ ID NO: 298638 - RNA, 22 nt, Human
agcccggcuuccccgguugcua

SEQ ID NO: 298639 - RNA, 22 nt, Human
ucagcugcucaaauuuauguca

SEQ ID NO: 298640 - RNA, 22 nt, Human
aagagagggacuuauuaaaguc

SEQ ID NO: 298641 - RNA, 22 nt, Human
ccaggccuucugaggacacucu

SEQ ID NO: 298642 - RNA, 22 nt, Human
uuuuucauugcagccucucucc

SEQ ID NO: 298643 - RNA, 22 nt, Human
aaaaucuaaguagcgaguaagg

SEQ ID NO: 298644 - RNA, 22 nt, Human
cccagcuugcgggcggcaggag

SEQ ID NO: 298645 - RNA, 22 nt, Human
ccagccacugggccacugccag

SEQ ID NO: 298646 - RNA, 22 nt, Human
uuuccaagacuccaguucuccc

SEQ ID NO: 298647 - RNA, 22 nt, Human
gucuggccugccagcucuggug

SEQ ID NO: 298648 - RNA, 22 nt, Human
ugcuuuauaaccauuucugugg

SEQ ID NO: 298649 - RNA, 22 nt, Human
agucaaagaagaugguuccaaa

SEQ ID NO: 298650 - RNA, 19 nt, Human
uguguccuagcagccaguc

SEQ ID NO: 298651 - RNA, 22 nt, Human
agggaagaaucacugggauguu

SEQ ID NO: 298652 - RNA, 22 nt, Human
cuuccuuccuuccccgaaaugc

SEQ ID NO: 298653 - RNA, 22 nt, Human
uaaauuuacccaaggaacaugu

SEQ ID NO: 298654 - RNA, 22 nt, Human
ucugggaauuuauuggcacuuu

SEQ ID NO: 298655 - RNA, 19 nt, Human
agacaaguuuccagaagcc

SEQ ID NO: 298656 - RNA, 22 nt, Human
uguacuauuaagaggccuaaau

SEQ ID NO: 298657 - RNA, 22 nt, Human
gacagacaggaggccaccugcu

SEQ ID NO: 298658 - RNA, 22 nt, Human
cugcaucaguggauaugauggu

SEQ ID NO: 298659 - RNA, 22 nt, Human
uuuugcuugagugcacaaaaug

SEQ ID NO: 298660 - RNA, 22 nt, Human
ggaaguuguaugaucggggaau

SEQ ID NO: 298661 - RNA, 20 nt, Human
uagggcucauuaugaucucc

SEQ ID NO: 298662 - RNA, 22 nt, Human
ucuucuccaguucauccuacca

SEQ ID NO: 298663 - RNA, 22 nt, Human
ugggaaagacucaggacaggag

SEQ ID NO: 298664 - RNA, 22 nt, Human
aagauuauggcagauaacaauu

SEQ ID NO: 298665 - RNA, 22 nt, Human
augaaaacggaccagagcuauu

SEQ ID NO: 298666 - RNA, 22 nt, Human
augauauuugcaaugugcuugc

SEQ ID NO: 298667 - RNA, 22 nt, Human
gaaggggaguggcuagugugug

SEQ ID NO: 298668 - RNA, 22 nt, Human
gcagagugaagggagaggugug

SEQ ID NO: 298669 - RNA, 23 nt, Human
ugcugggguaguuuguggcacag

SEQ ID NO: 298670 - RNA, 22 nt, Human
gcaguguuguuaaaagauuaga

SEQ ID NO: 298671 - RNA, 19 nt, Human
ugcucuggagccagcucuc

SEQ ID NO: 298672 - RNA, 22 nt, Human
cagacaggguggguuucugggc

SEQ ID NO: 298673 - RNA, 22 nt, Human
uggucuggaacuccuggcuuca

SEQ ID NO: 298674 - RNA, 22 nt, Human
aaagcagaggugauaugacuua

SEQ ID NO: 298675 - RNA, 22 nt, Human
acagcagguuauuguuauggca

SEQ ID NO: 298676 - RNA, 21 nt, Human
ggcuuuaugcucacccagccu

SEQ ID NO: 298677 - RNA, 22 nt, Human
ggucaaagugaggagucagguu

SEQ ID NO: 298678 - RNA, 22 nt, Human
auguauuucuauguagugaaga

SEQ ID NO: 298679 - RNA, 22 nt, Human
uucuuuucaagaggggcaagga

SEQ ID NO: 298680 - RNA, 22 nt, Human
uauucauaguaaacaaaagugg

SEQ ID NO: 298681 - RNA, 22 nt, Human
ggcuuucuaugaacucaaaggc

SEQ ID NO: 298682 - RNA, 22 nt, Human
auauuaggugcucaauacaugc

SEQ ID NO: 298683 - RNA, 22 nt, Human
uuauuccauucaguucaacaag

SEQ ID NO: 298684 - RNA, 22 nt, Human
gcaggcagguggcaucuuguga

SEQ ID NO: 298685 - RNA, 22 nt, Human
agggaauucacuggaacgcccu

SEQ ID NO: 298686 - RNA, 22 nt, Human
cgaggcagggaagcugcaaaag

SEQ ID NO: 298687 - RNA, 21 nt, Human
aguguccuugaucuugccuug

SEQ ID NO: 298688 - RNA, 22 nt, Human
uggaggaaguggacaguugugu

SEQ ID NO: 298689 - RNA, 22 nt, Human
aauguugagcuugaaaguaggu

SEQ ID NO: 298690 - RNA, 22 nt, Human
ccuugguuuccaggaugaggcu

SEQ ID NO: 298691 - RNA, 22 nt, Human
cccaggcagggacgugcucugg

SEQ ID NO: 298692 - RNA, 22 nt, Human
ucagagaguuggaaagaauuaa

SEQ ID NO: 298693 - RNA, 22 nt, Human
gcagggcagcuuagucccuguc

SEQ ID NO: 298694 - RNA, 22 nt, Human
agggcuccuaugaugcucugcc

SEQ ID NO: 298695 - RNA, 22 nt, Human
ugcagggcuacaggacuacaac

SEQ ID NO: 298696 - RNA, 18 nt, Human
ugcuggguaacuguaugg

SEQ ID NO: 298697 - RNA, 22 nt, Human
uuccuucuuuuacaccauaaau

SEQ ID NO: 298698 - RNA, 22 nt, Human
uguggcagaggaggcagcgucc

SEQ ID NO: 298699 - RNA, 22 nt, Human
auggaagacagauaaggcagaa

SEQ ID NO: 298700 - RNA, 22 nt, Human
uuguccuggagguuaauagagu

SEQ ID NO: 298701 - RNA, 22 nt, Human
gaagggaaggaaagaaccagca

SEQ ID NO: 298702 - RNA, 22 nt, Human
gcagagaccccgcagugaggcc

SEQ ID NO: 298703 - RNA, 22 nt, Human
uguuugaacugaauaacauagu

SEQ ID NO: 298704 - RNA, 22 nt, Human
ggucaaagggugagauggcagg

SEQ ID NO: 298705 - RNA, 20 nt, Human
uacagacaugacaauaaugg

SEQ ID NO: 298706 - RNA, 18 nt, Human
ucagagagcagcuuuauu

SEQ ID NO: 298707 - RNA, 20 nt, Human
cugaagaguggccugaucug

SEQ ID NO: 298708 - RNA, 22 nt, Human
gacauaauaaucugaccuagau

SEQ ID NO: 298709 - RNA, 22 nt, Human
ucagggcauacucuucaagguc

SEQ ID NO: 298710 - RNA, 22 nt, Human
uauucugugugauauguaaaug

SEQ ID NO: 298711 - RNA, 19 nt, Human
aauacaguguuauagaauu

SEQ ID NO: 298712 - RNA, 17 nt, Human
gggcagggacuccuggg

SEQ ID NO: 298713 - RNA, 20 nt, Human
ugugccuggcuuuguccuga

SEQ ID NO: 298714 - RNA, 22 nt, Human
ugaaggagaauuaauaggcauu

SEQ ID NO: 298715 - RNA, 22 nt, Human
ccagcuuuggaguguuguugcu

SEQ ID NO: 298716 - RNA, 22 nt, Human
gagacaggauuuaaccaaagcu

SEQ ID NO: 298717 - RNA, 22 nt, Human
ccugggugaaauaguccucaag

SEQ ID NO: 298718 - RNA, 22 nt, Human
uagggcagccacccaggcugcu

SEQ ID NO: 298719 - RNA, 22 nt, Human
uuuuucauauuccccucucugg

SEQ ID NO: 298720 - RNA, 22 nt, Human
agaaguuguagguuugcauauu

SEQ ID NO: 298721 - RNA, 22 nt, Human
gguccuuugccaucucuccacc

SEQ ID NO: 298722 - RNA, 22 nt, Human
gcaggugucuucagcaggauga

SEQ ID NO: 298723 - RNA, 22 nt, Human
agugucugccuauuuuucaagc

SEQ ID NO: 298724 - RNA, 22 nt, Human
guuuauuauacaacaaaagcua

SEQ ID NO: 298725 - RNA, 22 nt, Human
aggaccuguagggccugcaucc

SEQ ID NO: 298726 - RNA, 22 nt, Human
gcuggagguuucaccugaguuu

SEQ ID NO: 298727 - RNA, 22 nt, Human
cccaggacucuucacugcagcc

SEQ ID NO: 298728 - RNA, 21 nt, Human
guuauugaccuccaggcuggc

SEQ ID NO: 298729 - RNA, 22 nt, Human
aaugcuaaaacacagauuuuug

SEQ ID NO: 298730 - RNA, 22 nt, Human
caguuaaaagguaugcuaccaa

SEQ ID NO: 298731 - RNA, 22 nt, Human
guguguccaaggccacaauagc

SEQ ID NO: 298732 - RNA, 22 nt, Human
ucagcuuuuuggauugcccaag

SEQ ID NO: 298733 - RNA, 22 nt, Human
guaaacaugcuguguacucagc

SEQ ID NO: 298734 - RNA, 22 nt, Human
ucugggaaguccucugucaugc

SEQ ID NO: 298735 - RNA, 22 nt, Human
cucugcccucgcacaucugcca

SEQ ID NO: 298736 - RNA, 23 nt, Human
uguccuuuuugaggccuccuccu

SEQ ID NO: 298737 - RNA, 22 nt, Human
auuuacagugugccuacuauau

SEQ ID NO: 298738 - RNA, 20 nt, Human
ugcagguguuggagaaggua

SEQ ID NO: 298739 - RNA, 22 nt, Human
guguccugagugaggccuggcc

SEQ ID NO: 298740 - RNA, 22 nt, Human
aguauacaguaaugacauaucu

SEQ ID NO: 298741 - RNA, 22 nt, Human
cugcaucacagcaggaggcaca

SEQ ID NO: 298742 - RNA, 22 nt, Human
gggagcauuucccuguguugaa

SEQ ID NO: 298743 - RNA, 22 nt, Human
cacuguauuauuaggaaugaca

SEQ ID NO: 298744 - RNA, 22 nt, Human
aagauuuagggccaguuuacau

SEQ ID NO: 298745 - RNA, 22 nt, Human
uguuuacuuaaauguuuucaua

SEQ ID NO: 298746 - RNA, 22 nt, Human
uuggaggauggaguuagcaucu

SEQ ID NO: 298747 - RNA, 22 nt, Human
cagggcuccccagagagccucu

SEQ ID NO: 298748 - RNA, 20 nt, Human
ggggcagguuuuuauggcua

SEQ ID NO: 298749 - RNA, 14 nt, Human
gcaggcagaccacc

SEQ ID NO: 298750 - RNA, 22 nt, Human
cuuuaguucuaaugcauugaaa

SEQ ID NO: 298751 - RNA, 22 nt, Human
cacaggugugugccuuaucaaa

SEQ ID NO: 298752 - RNA, 22 nt, Human
gaauacauuggaaaucagaaua

SEQ ID NO: 298753 - RNA, 22 nt, Human
ccagacagcaguuaaaggacau

SEQ ID NO: 298754 - RNA, 22 nt, Human
cccugcagagggaugggggcag

SEQ ID NO: 298755 - RNA, 22 nt, Human
gggucuggcaugcugagaugga

SEQ ID NO: 298756 - RNA, 22 nt, Human
caugaaaauaacauuguuguga

SEQ ID NO: 298757 - RNA, 22 nt, Human
uugcuuuaaugagauuuugcca

SEQ ID NO: 298758 - RNA, 22 nt, Human
ccaggccucaccugcccaccua

SEQ ID NO: 298759 - RNA, 22 nt, Human
ucucuuaauaaguaaauacuga

SEQ ID NO: 298760 - RNA, 22 nt, Human
ugcagggcaucuuugaagugug

SEQ ID NO: 298761 - RNA, 22 nt, Human
gagagaaaugugcaguuugggc

SEQ ID NO: 298762 - RNA, 23 nt, Human
ugcuggcuuuuaucuggucccua

SEQ ID NO: 298763 - RNA, 22 nt, Human
uggcagggagccaccggucaug

SEQ ID NO: 298764 - RNA, 22 nt, Human
auguguccacaggugugagaga

SEQ ID NO: 298765 - RNA, 22 nt, Human
caaauacuggguaaguuaauuu

SEQ ID NO: 298766 - RNA, 22 nt, Human
aauguuguuuuucugcaugucu

SEQ ID NO: 298767 - RNA, 23 nt, Human
aaauucaguccuucaacucugag

SEQ ID NO: 298768 - RNA, 22 nt, Human
uucaguaaaacacugcaauguc

SEQ ID NO: 298769 - RNA, 22 nt, Human
aaguuugcauagauuaagcauu

SEQ ID NO: 298770 - RNA, 22 nt, Human
agcagggcugcggccccaccac

SEQ ID NO: 298771 - RNA, 22 nt, Human
uauugguaggacucagcugaga

SEQ ID NO: 298772 - RNA, 22 nt, Human
gaacuguaguuaauacuacaca

SEQ ID NO: 298773 - RNA, 20 nt, Human
ugggugagaguguuugcucu

SEQ ID NO: 298774 - RNA, 23 nt, Human
uugcuugagcccaggaaguggag

SEQ ID NO: 298775 - RNA, 22 nt, Human
cuccuucugaggcucuggguuc

SEQ ID NO: 298776 - RNA, 22 nt, Human
uaguuucagcuccuucauccug

SEQ ID NO: 298777 - RNA, 22 nt, Human
guucuucagucacaucacagaa

SEQ ID NO: 298778 - RNA, 22 nt, Human
ccagggcaauaggaacacuuuu

SEQ ID NO: 298779 - RNA, 22 nt, Human
gggguguggacggcugugccag

SEQ ID NO: 298780 - RNA, 22 nt, Human
uuguguccuauaugcauguucu

SEQ ID NO: 298781 - RNA, 22 nt, Human
acacuuuagaaaaaagaauggu

SEQ ID NO: 298782 - RNA, 22 nt, Human
aguggcagagcaggugcuggaa

SEQ ID NO: 298783 - RNA, 23 nt, Human
cgcccagccucagugaccugggc

SEQ ID NO: 298784 - RNA, 23 nt, Human
aaacuugcuauggcugaaaucau

SEQ ID NO: 298785 - RNA, 22 nt, Human
aguuauaaucugcuacugauau

SEQ ID NO: 298786 - RNA, 22 nt, Human
ugguauuacuucuagacacaag

SEQ ID NO: 298787 - RNA, 22 nt, Human
cagaugaaguaggugacgagca

SEQ ID NO: 298788 - RNA, 22 nt, Human
uaggugucuggacaacuuugua

SEQ ID NO: 298789 - RNA, 22 nt, Human
ucagacagggcuucucaaacuu

SEQ ID NO: 298790 - RNA, 22 nt, Human
uuucuuuuccaauaucccuacu

SEQ ID NO: 298791 - RNA, 23 nt, Human
ccaaagucgaagucuaguccaga

SEQ ID NO: 298792 - RNA, 22 nt, Human
gcagggcagugugucugugggg

SEQ ID NO: 298793 - RNA, 22 nt, Human
guaggcagugguuggaagagaa

SEQ ID NO: 298794 - RNA, 22 nt, Human
uuuauauauggcuggucuggau

SEQ ID NO: 298795 - RNA, 22 nt, Human
caauacuuccuuguuagaggca

SEQ ID NO: 298796 - RNA, 22 nt, Human
ugguggggucaucgucagaugc

SEQ ID NO: 298797 - RNA, 22 nt, Human
auacacauauguguguauaugu

SEQ ID NO: 298798 - RNA, 22 nt, Human
uguacauagaucuugaaaauua

SEQ ID NO: 298799 - RNA, 22 nt, Human
ucccuucuggcagcagugugag

SEQ ID NO: 298800 - RNA, 22 nt, Human
ugaaagaagccucccuuuggag

SEQ ID NO: 298801 - RNA, 19 nt, Human
gcaucagagcagaaggggu

SEQ ID NO: 298802 - RNA, 20 nt, Human
ggcaggugcuguccccuccu

SEQ ID NO: 298803 - RNA, 22 nt, Human
caugcagcggcguuugguuuaa

SEQ ID NO: 298804 - RNA, 22 nt, Human
uuggaggaugucggcauauuua

SEQ ID NO: 298805 - RNA, 22 nt, Human
acauucuuaacaguuaaaaacu

SEQ ID NO: 298806 - RNA, 22 nt, Human
gcaggugugcugaauuacguga

SEQ ID NO: 298807 - RNA, 21 nt, Human
acauguaagagaguuucaaga

SEQ ID NO: 298808 - RNA, 22 nt, Human
aguguccuugauuccuguuguu

SEQ ID NO: 298809 - RNA, 22 nt, Human
ucccaggcuggcaggcagcagu

SEQ ID NO: 298810 - RNA, 22 nt, Human
gcuuccaaaucuguucaaaaug

SEQ ID NO: 298811 - RNA, 22 nt, Human
uauuuaaaauagugcuccagca

SEQ ID NO: 298812 - RNA, 22 nt, Human
aacaaccaaaaagaugaaugua

SEQ ID NO: 298813 - RNA, 22 nt, Human
agggugugcuguugggucuuuc

SEQ ID NO: 298814 - RNA, 22 nt, Human
ucaucaguuuagaaaaaauaug

SEQ ID NO: 298815 - RNA, 19 nt, Human
aguguccuagucauuugcc

SEQ ID NO: 298816 - RNA, 22 nt, Human
aggaccugcuaaugugccaagu

SEQ ID NO: 298817 - RNA, 22 nt, Human
gaacuugguauuccuuuuaaca

SEQ ID NO: 298818 - RNA, 22 nt, Human
uuucuucagagagagcuuuccc

SEQ ID NO: 298819 - RNA, 22 nt, Human
gcuuuauuuugugagggauuac

SEQ ID NO: 298820 - RNA, 23 nt, Human
gagugcagaauagacaugcagug

SEQ ID NO: 298821 - RNA, 22 nt, Human
auguguccuuguucccauucca

SEQ ID NO: 298822 - RNA, 22 nt, Human
auaguuuacaaaaaugaugcau

SEQ ID NO: 298823 - RNA, 22 nt, Human
uuccuaaucacgaacauuauuu

SEQ ID NO: 298824 - RNA, 22 nt, Human
aagaucagcucccgagucugag

SEQ ID NO: 298825 - RNA, 22 nt, Human
ucuggcuguuuuagaugagcuc

SEQ ID NO: 298826 - RNA, 22 nt, Human
aaccugcauguuucuaaaagca

SEQ ID NO: 298827 - RNA, 22 nt, Human
auuuacugcuugacacauuggu

SEQ ID NO: 298828 - RNA, 22 nt, Human
agacagugauggacaggcagac

SEQ ID NO: 298829 - RNA, 22 nt, Human
uccugcagguggaugauucucu

SEQ ID NO: 298830 - RNA, 22 nt, Human
aaggugucacuguuucuggccu

SEQ ID NO: 298831 - RNA, 22 nt, Human
auuuccauuaucaugacaaauu

SEQ ID NO: 298832 - RNA, 22 nt, Human
agugaggggauucaggcaaggu

SEQ ID NO: 298833 - RNA, 22 nt, Human
uacagguggaucacuaguauag

SEQ ID NO: 298834 - RNA, 22 nt, Human
ucuuagauguuagcucugugug

SEQ ID NO: 298835 - RNA, 22 nt, Human
ugauagagcacuaaguagugua

SEQ ID NO: 298836 - RNA, 22 nt, Human
uauuucagcccuacuacuuggc

SEQ ID NO: 298837 - RNA, 22 nt, Human
cuguguccucccgcugcaccca

SEQ ID NO: 298838 - RNA, 22 nt, Human
ucaggagcugcacugggcccac

SEQ ID NO: 298839 - RNA, 22 nt, Human
uagggcaguuucauguuaucuu

SEQ ID NO: 298840 - RNA, 22 nt, Human
ugacugaaggacuagauugauu

SEQ ID NO: 298841 - RNA, 22 nt, Human
ucagguggcugguugcuggcua

SEQ ID NO: 298842 - RNA, 22 nt, Human
ggcugaguugagaggauuacuu

SEQ ID NO: 298843 - RNA, 22 nt, Human
ugcuuuauucccuucugaugug

SEQ ID NO: 298844 - RNA, 22 nt, Human
gauugcugaagaaagugaguga

SEQ ID NO: 298845 - RNA, 22 nt, Human
guggcacaaggcuuacacagca

SEQ ID NO: 298846 - RNA, 22 nt, Human
cacagguggcuccaaguuagag

SEQ ID NO: 298847 - RNA, 22 nt, Human
ucuucuuccucauuuauacaua

SEQ ID NO: 298848 - RNA, 22 nt, Human
gagguggucgaggagggguacc

SEQ ID NO: 298849 - RNA, 22 nt, Human
ccagcuuuauagcuucaaagga

SEQ ID NO: 298850 - RNA, 22 nt, Human
aguguccucaucuguaaaauga

SEQ ID NO: 298851 - RNA, 22 nt, Human
cagaagcaaguagugauucuuu

SEQ ID NO: 298852 - RNA, 22 nt, Human
uuauuguagcacuuuggcagug

SEQ ID NO: 298853 - RNA, 22 nt, Human
cccaggcacacugaagugacau

SEQ ID NO: 298854 - RNA, 22 nt, Human
ugggcuccggcggccucaggcu

SEQ ID NO: 298855 - RNA, 22 nt, Human
uaacauguuaagaaauuagaua

SEQ ID NO: 298856 - RNA, 22 nt, Human
cauuuauucucagauccuuguc

SEQ ID NO: 298857 - RNA, 22 nt, Human
uggcaaagaugaagcauuucgu

SEQ ID NO: 298858 - RNA, 22 nt, Human
ugcuuuauuuauaaaauagcaa

SEQ ID NO: 298859 - RNA, 22 nt, Human
uaagauguuuugguuugauaag

SEQ ID NO: 298860 - RNA, 22 nt, Human
ggcaggcacuguguuuuguguu

SEQ ID NO: 298861 - RNA, 22 nt, Human
gacagguggggaaacuaaggua

SEQ ID NO: 298862 - RNA, 22 nt, Human
ucaucaguguccuuaucacuua

SEQ ID NO: 298863 - RNA, 22 nt, Human
agugaggggcagcugagugggc

SEQ ID NO: 298864 - RNA, 19 nt, Human
uuagguauuauugcuuucc

SEQ ID NO: 298865 - RNA, 22 nt, Human
guaugcaucgacucaagucuga

SEQ ID NO: 298866 - RNA, 22 nt, Human
uucuggguggccaguauuuaga

SEQ ID NO: 298867 - RNA, 21 nt, Human
uuguguccuucuaaagggcca

SEQ ID NO: 298868 - RNA, 22 nt, Human
gucuauauauugcuugaauaau

SEQ ID NO: 298869 - RNA, 17 nt, Human
ucuggaugucauggaag

SEQ ID NO: 298870 - RNA, 22 nt, Human
accaggcacucuuguggcagug

SEQ ID NO: 298871 - RNA, 22 nt, Human
gguggcagagaggagguaguuu

SEQ ID NO: 298872 - RNA, 22 nt, Human
gcccaggcuggagugcaguagc

SEQ ID NO: 298873 - RNA, 22 nt, Human
acaguguuuuagaaaagcuuga

SEQ ID NO: 298874 - RNA, 22 nt, Human
ugacaggugcugggggcagugu

SEQ ID NO: 298875 - RNA, 21 nt, Human
ucuucccucaggauguccugc

SEQ ID NO: 298876 - RNA, 22 nt, Human
uggcaaagugacuccuuggggc

SEQ ID NO: 298877 - RNA, 22 nt, Human
acauacagaccugcagggcagc

SEQ ID NO: 298878 - RNA, 22 nt, Human
aaagcugcuuugguuucuggaa

SEQ ID NO: 298879 - RNA, 22 nt, Human
agaagcuauaacaacaauuaua

SEQ ID NO: 298880 - RNA, 22 nt, Human
uucuucagucccacuagccaca

SEQ ID NO: 298881 - RNA, 22 nt, Human
ucuggcucugacacuacuguua

SEQ ID NO: 298882 - RNA, 22 nt, Human
accuuauuuugaaauagauugu

SEQ ID NO: 298883 - RNA, 17 nt, Human
ggcaguggaggaagaga

SEQ ID NO: 298884 - RNA, 22 nt, Human
ccagguguaagacaugguccua

SEQ ID NO: 298885 - RNA, 22 nt, Human
gcagggcagggcaagaacuggg

SEQ ID NO: 298886 - RNA, 22 nt, Human
ggucuggauaauuccaguaccu

SEQ ID NO: 298887 - RNA, 22 nt, Human
gccaggcagauaugugagcuua

SEQ ID NO: 298888 - RNA, 22 nt, Human
gaugagcauuguuucauguguu

SEQ ID NO: 298889 - RNA, 22 nt, Human
cccagugucugggccugcaggg

SEQ ID NO: 298890 - RNA, 22 nt, Human
cagggagcuggugccagccgac

SEQ ID NO: 298891 - RNA, 22 nt, Human
ccugggucccagccaggcuuug

SEQ ID NO: 298892 - RNA, 19 nt, Human
uuucuuuuccccucagcac

SEQ ID NO: 298893 - RNA, 22 nt, Human
aacaugugagcagguuuuuuau

SEQ ID NO: 298894 - RNA, 22 nt, Human
ucagggacagggugcugcugcg

SEQ ID NO: 298895 - RNA, 22 nt, Human
uucaugugauaaaugugugacu

SEQ ID NO: 298896 - RNA, 22 nt, Human
ccuucucccucugagaggaacc

SEQ ID NO: 298897 - RNA, 22 nt, Human
ccaggugucugucucuuuuuca

SEQ ID NO: 298898 - RNA, 19 nt, Human
uaggaauguagaauccuag

SEQ ID NO: 298899 - RNA, 22 nt, Human
cuucuucaaccugaaaguuuca

SEQ ID NO: 298900 - RNA, 23 nt, Human
ucagagagcuguugagagcugcc

SEQ ID NO: 298901 - RNA, 22 nt, Human
guguccugggucucugauucuu

SEQ ID NO: 298902 - RNA, 22 nt, Human
acauuguauaaugauuaucaca

SEQ ID NO: 298903 - RNA, 22 nt, Human
guucacaagaguuacagacaga

SEQ ID NO: 298904 - RNA, 16 nt, Human
uccaggcauaucugag

SEQ ID NO: 298905 - RNA, 22 nt, Human
cagcaugaugagugcaguuugg

SEQ ID NO: 298906 - RNA, 22 nt, Human
cuuaggaacgcucugccuagug

SEQ ID NO: 298907 - RNA, 22 nt, Human
guuagggaucaggaacaagagc

SEQ ID NO: 298908 - RNA, 22 nt, Human
auucuucagcaggggacacuau

SEQ ID NO: 298909 - RNA, 22 nt, Human
caugugucuuuauggagccaca

SEQ ID NO: 298910 - RNA, 22 nt, Human
gcauacagagaggauguggcau

SEQ ID NO: 298911 - RNA, 22 nt, Human
agacagaccauggcuauucaga

SEQ ID NO: 298912 - RNA, 22 nt, Human
cuguccucaucugccccaaggg

SEQ ID NO: 298913 - RNA, 22 nt, Human
ccagagaggcaaaacuccuucc

SEQ ID NO: 298914 - RNA, 22 nt, Human
acuuuguuuucaugaaacagcu

SEQ ID NO: 298915 - RNA, 22 nt, Human
cugcccucgggcccucccauag

SEQ ID NO: 298916 - RNA, 22 nt, Human
uggaggaaaaaaccaggcagag

SEQ ID NO: 298917 - RNA, 22 nt, Human
aauauccacacugugucccugc

SEQ ID NO: 298918 - RNA, 22 nt, Human
aggaggaauacaauccagcagc

SEQ ID NO: 298919 - RNA, 21 nt, Human
ccugggugggaccccucuucc

SEQ ID NO: 298920 - RNA, 22 nt, Human
uccuucuguagucccugucccu

SEQ ID NO: 298921 - RNA, 22 nt, Human
accuugaugccuuuccaagaug

SEQ ID NO: 298922 - RNA, 22 nt, Human
cuccgcagcgggccaauccgga

SEQ ID NO: 298923 - RNA, 19 nt, Human
ggcauccacgaaugcagag

SEQ ID NO: 298924 - RNA, 22 nt, Human
cuguccucaacccauccuucuc

SEQ ID NO: 298925 - RNA, 22 nt, Human
guacaauaacuagucuuauagu

SEQ ID NO: 298926 - RNA, 22 nt, Human
auuucuggauuuuggaugcugc

SEQ ID NO: 298927 - RNA, 22 nt, Human
ucugaagauuaccagcuaaaug

SEQ ID NO: 298928 - RNA, 22 nt, Human
uccucagaaaccccugugaggu

SEQ ID NO: 298929 - RNA, 20 nt, Human
gccugcagguuggaugggau

SEQ ID NO: 298930 - RNA, 22 nt, Human
cacaucagguagaccuacagag

SEQ ID NO: 298931 - RNA, 22 nt, Human
agauguuuuggagacacuaacc

SEQ ID NO: 298932 - RNA, 22 nt, Human
uuucacauaucaacucuauccu

SEQ ID NO: 298933 - RNA, 22 nt, Human
cuguccagucuuuagcaagcug

SEQ ID NO: 298934 - RNA, 22 nt, Human
guccaugacugugacucacaug

SEQ ID NO: 298935 - RNA, 22 nt, Human
ucuggagggcccacauccacaa

SEQ ID NO: 298936 - RNA, 22 nt, Human
uccaggcaugguguaauuuugc

SEQ ID NO: 298937 - RNA, 22 nt, Human
gacauaaaauggaauucuguug

SEQ ID NO: 298938 - RNA, 22 nt, Human
uaguaguaauuguuaucuuauu

SEQ ID NO: 298939 - RNA, 22 nt, Human
uauuuauucauucagcaagcau

SEQ ID NO: 298940 - RNA, 22 nt, Human
cagagcaucgcgcagagagccu

SEQ ID NO: 298941 - RNA, 22 nt, Human
agacagacguagugugagagua

SEQ ID NO: 298942 - RNA, 22 nt, Human
ucugggaacagccuggcugugu

SEQ ID NO: 298943 - RNA, 22 nt, Human
ucuguucauguugggcuuuucc

SEQ ID NO: 298944 - RNA, 21 nt, Human
uuucuucacuuugccccaugu

SEQ ID NO: 298945 - RNA, 22 nt, Human
uguggggccucgugcuagcugg

SEQ ID NO: 298946 - RNA, 19 nt, Human
agugcagggagcacccuca

SEQ ID NO: 298947 - RNA, 22 nt, Human
aagacauugucauuuuauaauu

SEQ ID NO: 298948 - RNA, 20 nt, Human
uugauucccucuaaacucgc

SEQ ID NO: 298949 - RNA, 20 nt, Human
ccaggccugggccugcucua

SEQ ID NO: 298950 - RNA, 22 nt, Human
cauacuuuugcccugacauucu

SEQ ID NO: 298951 - RNA, 22 nt, Human
uuugacucauuaaagucuccgu

SEQ ID NO: 298952 - RNA, 22 nt, Human
augcuacuauccuucugcuuaa

SEQ ID NO: 298953 - RNA, 22 nt, Human
uuuccagguauuaauacuguau

SEQ ID NO: 298954 - RNA, 22 nt, Human
aagcuuucagagcagaauguga

SEQ ID NO: 298955 - RNA, 22 nt, Human
ucugucccugagagcucaggag

SEQ ID NO: 298956 - RNA, 22 nt, Human
ccagcuuuaucaagucugagcu

SEQ ID NO: 298957 - RNA, 19 nt, Human
uccugcugugugaagggga

SEQ ID NO: 298958 - RNA, 22 nt, Human
ucauuuguucucauucucuacu

SEQ ID NO: 298959 - RNA, 22 nt, Human
uucugggugccaccuaagacau

SEQ ID NO: 298960 - RNA, 22 nt, Human
uuugcaauuugugcugcaaaug

SEQ ID NO: 298961 - RNA, 22 nt, Human
acuucuaugcacagagcuugga

SEQ ID NO: 298962 - RNA, 22 nt, Human
ugaaacauuugaugaucuuugg

SEQ ID NO: 298963 - RNA, 22 nt, Human
cucccaagauaaauaaggcagu

SEQ ID NO: 298964 - RNA, 22 nt, Human
cagguggugccuccaggcuggu

SEQ ID NO: 298965 - RNA, 22 nt, Human
uucucuuaucuggcauuauugg

SEQ ID NO: 298966 - RNA, 22 nt, Human
uuuacuugauauggagcugagg

SEQ ID NO: 298967 - RNA, 22 nt, Human
uugcuuauagagaguuucauac

SEQ ID NO: 298968 - RNA, 22 nt, Human
auuuccaguccuaaugaucugg

SEQ ID NO: 298969 - RNA, 22 nt, Human
uaucuaaaggauuuaauuuagu

SEQ ID NO: 298970 - RNA, 22 nt, Human
uuucaaagcaacugaaaaggaa

SEQ ID NO: 298971 - RNA, 22 nt, Human
aguguguccagaaaucuguauu

SEQ ID NO: 298972 - RNA, 22 nt, Human
ugcuggagcccaggcggccuuu

SEQ ID NO: 298973 - RNA, 22 nt, Human
gacagaaggcaucuagggcacg

SEQ ID NO: 298974 - RNA, 22 nt, Human
gugagcagcucaggguggucuc

SEQ ID NO: 298975 - RNA, 22 nt, Human
ggaggcaggaaagacagguuca

SEQ ID NO: 298976 - RNA, 22 nt, Human
aucauucugauggucaaugcua

SEQ ID NO: 298977 - RNA, 22 nt, Human
uuagcuuuucacuugcauuauc

SEQ ID NO: 298978 - RNA, 22 nt, Human
ugcuugaacccaggaaguggag

SEQ ID NO: 298979 - RNA, 22 nt, Human
ccaggugugucuggccccgaag

SEQ ID NO: 298980 - RNA, 22 nt, Human
ucaggugucuaucuaaccuggu

SEQ ID NO: 298981 - RNA, 22 nt, Human
ggcaggcagaggcugagacagg

SEQ ID NO: 298982 - RNA, 22 nt, Human
ccugcagaaaggguccccagga

SEQ ID NO: 298983 - RNA, 21 nt, Human
aguugcugcugcugcagguga

SEQ ID NO: 298984 - RNA, 22 nt, Human
auuguauuagcacaauacaauu

SEQ ID NO: 298985 - RNA, 22 nt, Human
uagaaacauguucuguucuguu

SEQ ID NO: 298986 - RNA, 22 nt, Human
uccugcagcugauaaauacagu

SEQ ID NO: 298987 - RNA, 22 nt, Human
gaguccuuuucucuguccacug

SEQ ID NO: 298988 - RNA, 19 nt, Human
aaaguuuuauucucauuug

SEQ ID NO: 298989 - RNA, 22 nt, Human
ucagguguguggcucuggacca

SEQ ID NO: 298990 - RNA, 22 nt, Human
gguguccucacuauagcaaguc

SEQ ID NO: 298991 - RNA, 22 nt, Human
aacauuguuuucccuauaucca

SEQ ID NO: 298992 - RNA, 19 nt, Human
uauugguaugugugaggca

SEQ ID NO: 298993 - RNA, 22 nt, Human
gaucuucucuuuaguagaaaca

SEQ ID NO: 298994 - RNA, 22 nt, Human
uuguccugcaaccucacauggc

SEQ ID NO: 298995 - RNA, 23 nt, Human
ugagcaucacaggagaaccaggc

SEQ ID NO: 298996 - RNA, 20 nt, Human
uuucacaucugucccuuuaa

SEQ ID NO: 298997 - RNA, 22 nt, Human
gcauguuuugcaacaagugacc

SEQ ID NO: 298998 - RNA, 22 nt, Human
acucauugaaacuuaagaucua

SEQ ID NO: 298999 - RNA, 22 nt, Human
aauugcuuuacaagccguuuaa

SEQ ID NO: 299000 - RNA, 22 nt, Human
agguggucuuaaacugcucugg

SEQ ID NO: 299001 - RNA, 22 nt, Human
uucucuuuugugaugugagaug

SEQ ID NO: 299002 - RNA, 22 nt, Human
agauacaaaagauaagauuuag

SEQ ID NO: 299003 - RNA, 22 nt, Human
auuccuucuuugagaauaagca

SEQ ID NO: 299004 - RNA, 22 nt, Human
ucugcaugaugaacaaaugagc

SEQ ID NO: 299005 - RNA, 20 nt, Human
uuucacagucccuguuuccu

SEQ ID NO: 299006 - RNA, 22 nt, Human
gcagacagggcuacagagguac

SEQ ID NO: 299007 - RNA, 22 nt, Human
agugucuguugaguuucaaaag

SEQ ID NO: 299008 - RNA, 22 nt, Human
cucuucuuuaguccagaccauc

SEQ ID NO: 299009 - RNA, 22 nt, Human
ccuguucauuuguauuugucuu

SEQ ID NO: 299010 - RNA, 22 nt, Human
uccaggcagggcagccaucaag

SEQ ID NO: 299011 - RNA, 22 nt, Human
uuugacucaagcccucauguua

SEQ ID NO: 299012 - RNA, 22 nt, Human
uuauacauguuuauaagguuga

SEQ ID NO: 299013 - RNA, 22 nt, Human
ccagguggugaaagugggcccu

SEQ ID NO: 299014 - RNA, 22 nt, Human
uguccucacacguagggaguaa

SEQ ID NO: 299015 - RNA, 22 nt, Human
caggauggucagaugcauuguc

SEQ ID NO: 299016 - RNA, 22 nt, Human
gggcaaagugguggaggcaguu

SEQ ID NO: 299017 - RNA, 22 nt, Human
uaguuaggaauagcagcgacuc

SEQ ID NO: 299018 - RNA, 16 nt, Human
ucuuaguuguguggua

SEQ ID NO: 299019 - RNA, 22 nt, Human
ccagguggacggcgaguacagg

SEQ ID NO: 299020 - RNA, 22 nt, Human
ccugcaguuuguugugaccccg

SEQ ID NO: 299021 - RNA, 22 nt, Human
aaaggcuaugagauagaagaua

SEQ ID NO: 299022 - RNA, 22 nt, Human
uaguuauauccagucuuuaaaa

SEQ ID NO: 299023 - RNA, 22 nt, Human
aagguggucuuacugaugguau

SEQ ID NO: 299024 - RNA, 19 nt, Human
gauuuaaacguggcucuau

SEQ ID NO: 299025 - RNA, 22 nt, Human
uauuuccaagcugaauccaaug

SEQ ID NO: 299026 - RNA, 22 nt, Human
cuguacaaguccuucaucaggg

SEQ ID NO: 299027 - RNA, 22 nt, Human
auugggaugccggcugauaaga

SEQ ID NO: 299028 - RNA, 22 nt, Human
ugccuggaaggcccaugggaag

SEQ ID NO: 299029 - RNA, 22 nt, Human
acacauuucucuuuuuguaagu

SEQ ID NO: 299030 - RNA, 22 nt, Human
uauugcugccucguccaggcug

SEQ ID NO: 299031 - RNA, 22 nt, Human
ccagcuuucugggugguuucug

SEQ ID NO: 299032 - RNA, 22 nt, Human
agcauguucaucuucuguuggu

SEQ ID NO: 299033 - RNA, 19 nt, Human
ccagguggaacugagguag

SEQ ID NO: 299034 - RNA, 22 nt, Human
uaauuuuacuuccugagcaccu

SEQ ID NO: 299035 - RNA, 22 nt, Human
agggucaacauuucauugauuc

SEQ ID NO: 299036 - RNA, 22 nt, Human
uggaaugaauuuggcuuccucc

SEQ ID NO: 299037 - RNA, 20 nt, Human
ucuggcucuuugcuccuccc

SEQ ID NO: 299038 - RNA, 22 nt, Human
uugggaaguuuaaugacagacu

SEQ ID NO: 299039 - RNA, 22 nt, Human
uguugauuaguguuuagacuua

SEQ ID NO: 299040 - RNA, 22 nt, Human
aagggcucugugcuugucccau

SEQ ID NO: 299041 - RNA, 22 nt, Human
cuuccagagauccaugaauacc

SEQ ID NO: 299042 - RNA, 22 nt, Human
uuucacaucagagguagauuag

SEQ ID NO: 299043 - RNA, 22 nt, Human
auguccucggcucugugcugcu

SEQ ID NO: 299044 - RNA, 22 nt, Human
agcagggcuuuggcuggcuuuc

SEQ ID NO: 299045 - RNA, 22 nt, Human
uucuuguaauuuggagaaauga

SEQ ID NO: 299046 - RNA, 22 nt, Human
aaaguggugggcgaacucauca

SEQ ID NO: 299047 - RNA, 22 nt, Human
ccagagagagaggucaauggca

SEQ ID NO: 299048 - RNA, 22 nt, Human
cccugcagaccaaugccauaga

SEQ ID NO: 299049 - RNA, 19 nt, Human
acagcagguguggggauaa

SEQ ID NO: 299050 - RNA, 22 nt, Human
ucuguucaguugauuagacaga

SEQ ID NO: 299051 - RNA, 14 nt, Human
gcaggcagaucauu

SEQ ID NO: 299052 - RNA, 22 nt, Human
caguuucugagcccugucauuu

SEQ ID NO: 299053 - RNA, 20 nt, Human
cugcaggguuagaggcucca

SEQ ID NO: 299054 - RNA, 22 nt, Human
uuuacuuucucaaguauauagg

SEQ ID NO: 299055 - RNA, 22 nt, Human
acuggaggauuccuggaaggcg

SEQ ID NO: 299056 - RNA, 22 nt, Human
caguucuuaauaccaugugguu

SEQ ID NO: 299057 - RNA, 22 nt, Human
agucauaugacccuucacaaac

SEQ ID NO: 299058 - RNA, 22 nt, Human
gggugggacucuuuggccugag

SEQ ID NO: 299059 - RNA, 22 nt, Human
cgcagggccgcgagcgggacca

SEQ ID NO: 299060 - RNA, 22 nt, Human
ugcuagggauacaguggugaau

SEQ ID NO: 299061 - RNA, 22 nt, Human
gcagagaguugggcugcgccag

SEQ ID NO: 299062 - RNA, 22 nt, Human
aauuucuccaagaaugcuuaga

SEQ ID NO: 299063 - RNA, 22 nt, Human
cgcaggugccggcagauggggu

SEQ ID NO: 299064 - RNA, 22 nt, Human
auuucugugcaguaaaugguga

SEQ ID NO: 299065 - RNA, 22 nt, Human
agggaagaagcugguaguaggu

SEQ ID NO: 299066 - RNA, 22 nt, Human
uggaaaaacugagacuuagaca

SEQ ID NO: 299067 - RNA, 22 nt, Human
agggcucccgcgguguccggga

SEQ ID NO: 299068 - RNA, 22 nt, Human
ugggaccugaagcagguuggca

SEQ ID NO: 299069 - RNA, 22 nt, Human
agucacauggacucaggaugac

SEQ ID NO: 299070 - RNA, 17 nt, Human
uuucagauucacuuucu

SEQ ID NO: 299071 - RNA, 22 nt, Human
agcuggagaauaggaauuagug

SEQ ID NO: 299072 - RNA, 22 nt, Human
gaucugaaauagcuacugcaga

SEQ ID NO: 299073 - RNA, 21 nt, Human
uaugugucuguggaaaacuag

SEQ ID NO: 299074 - RNA, 22 nt, Human
uggagcagcuaagccucugaga

SEQ ID NO: 299075 - RNA, 22 nt, Human
gugaccauaauagauuaugagu

SEQ ID NO: 299076 - RNA, 22 nt, Human
cagggcuccccgcaccgcagcc

SEQ ID NO: 299077 - RNA, 22 nt, Human
cuuccuucaauauaauuuuuac

SEQ ID NO: 299078 - RNA, 22 nt, Human
cagcuuguuaccgagggagggu

SEQ ID NO: 299079 - RNA, 22 nt, Human
aaaucucaggccucuauuuacu

SEQ ID NO: 299080 - RNA, 22 nt, Human
cagggcucaggcucugggauuc

SEQ ID NO: 299081 - RNA, 22 nt, Human
cuuccucugccucccgugcuca

SEQ ID NO: 299082 - RNA, 22 nt, Human
ugcagguggcuccagggacugc

SEQ ID NO: 299083 - RNA, 22 nt, Human
agcugcaagauaaaagugaugu

SEQ ID NO: 299084 - RNA, 22 nt, Human
aguaaaaauugaggugcaaaau

SEQ ID NO: 299085 - RNA, 22 nt, Human
ucuggcccuauggcauguaccu

SEQ ID NO: 299086 - RNA, 22 nt, Human
gcagguguggaguggggugagc

SEQ ID NO: 299087 - RNA, 22 nt, Human
uuccagagcaguuuucagauca

SEQ ID NO: 299088 - RNA, 22 nt, Human
acauaucuuucccucuccugaa

SEQ ID NO: 299089 - RNA, 22 nt, Human
cauuagggacugaggaauaagg

SEQ ID NO: 299090 - RNA, 22 nt, Human
acagggcagaaauguugcaucu

SEQ ID NO: 299091 - RNA, 22 nt, Human
cuauugcuuuugugugcuccca

SEQ ID NO: 299092 - RNA, 22 nt, Human
uuauuguuuacuaguuugcaga

SEQ ID NO: 299093 - RNA, 22 nt, Human
caaauucacaugauugcuucug

SEQ ID NO: 299094 - RNA, 22 nt, Human
ccucaugcugcaucucugaggu

SEQ ID NO: 299095 - RNA, 22 nt, Human
ucuucaaacugaaaauuuagaa

SEQ ID NO: 299096 - RNA, 19 nt, Human
uagcugauagcuacuuuau

SEQ ID NO: 299097 - RNA, 22 nt, Human
ugcguacuguuuauacaugugu

SEQ ID NO: 299098 - RNA, 22 nt, Human
ugcuggguagaaguauuagucu

SEQ ID NO: 299099 - RNA, 22 nt, Human
uuucaaacauaucuucauuacu

SEQ ID NO: 299100 - RNA, 22 nt, Human
ucauuucuguugugcaucacug

SEQ ID NO: 299101 - RNA, 22 nt, Human
ucaggaaagccuagaagagaac

SEQ ID NO: 299102 - RNA, 22 nt, Human
aaucuucacagaaaaaugucug

SEQ ID NO: 299103 - RNA, 20 nt, Human
acaaaauagguacuggguag

SEQ ID NO: 299104 - RNA, 22 nt, Human
uccaggcagcccuuccugacuc

SEQ ID NO: 299105 - RNA, 22 nt, Human
aagucacauucugagguauugg

SEQ ID NO: 299106 - RNA, 22 nt, Human
gcaccugcuggaaucagucugu

SEQ ID NO: 299107 - RNA, 22 nt, Human
uauugcuggugcuguucugaau

SEQ ID NO: 299108 - RNA, 22 nt, Human
agaaacucauccuggagaugac

SEQ ID NO: 299109 - RNA, 22 nt, Human
cagaugaacuaggcugcacuug

SEQ ID NO: 299110 - RNA, 20 nt, Human
uuccuggggaaugauagaag

SEQ ID NO: 299111 - RNA, 22 nt, Human
cauuuccacuucugaaaacugg

SEQ ID NO: 299112 - RNA, 21 nt, Human
uuucucaguugugugagcagc

SEQ ID NO: 299113 - RNA, 19 nt, Human
ucccaguggggagaggugu

SEQ ID NO: 299114 - RNA, 22 nt, Human
gacccaggguauccagagcugc

SEQ ID NO: 299115 - RNA, 22 nt, Human
aaccccgcucaggcugggugag

SEQ ID NO: 299116 - RNA, 19 nt, Human
uucuaccuuacuguaggcu

SEQ ID NO: 299117 - RNA, 22 nt, Human
uucuucaguuugguaaauguaa

SEQ ID NO: 299118 - RNA, 22 nt, Human
gcaucuaaauaaacgugggagu

SEQ ID NO: 299119 - RNA, 22 nt, Human
ggcauccaguucugaucaacaa

SEQ ID NO: 299120 - RNA, 22 nt, Human
uggcagguuaugcgggccacau

SEQ ID NO: 299121 - RNA, 22 nt, Human
uugcuuuagggcaaauauuuca

SEQ ID NO: 299122 - RNA, 22 nt, Human
acaugauucuugauaggcauug

SEQ ID NO: 299123 - RNA, 22 nt, Human
uuccggaagguucucuagaauu

SEQ ID NO: 299124 - RNA, 22 nt, Human
uuuacucuugcuacacaacugu

SEQ ID NO: 299125 - RNA, 22 nt, Human
cuuucuuauaccugucagggcc

SEQ ID NO: 299126 - RNA, 22 nt, Human
ucacaaauauuuuaacaguagg

SEQ ID NO: 299127 - RNA, 18 nt, Human
agacagacagguuugugc

SEQ ID NO: 299128 - RNA, 17 nt, Human
cagugaggccuuuccuc

SEQ ID NO: 299129 - RNA, 22 nt, Human
cugggucugggccuccuggagu

SEQ ID NO: 299130 - RNA, 22 nt, Human
gcagggcagaaggugcugagga

SEQ ID NO: 299131 - RNA, 22 nt, Human
gccugcagccucaagggcugag

SEQ ID NO: 299132 - RNA, 22 nt, Human
uaaguucaagucuuggauauaa

SEQ ID NO: 299133 - RNA, 22 nt, Human
uauuccuauggccacugcuacu

SEQ ID NO: 299134 - RNA, 22 nt, Human
ggaucuucagccagcaggugcc

SEQ ID NO: 299135 - RNA, 22 nt, Human
aggcugcagaacagucaggugc

SEQ ID NO: 299136 - RNA, 22 nt, Human
ugcagggaaugcuugcagcaug

SEQ ID NO: 299137 - RNA, 22 nt, Human
aaauccuaaggagaauaugauu

SEQ ID NO: 299138 - RNA, 22 nt, Human
ugguuuaccccuguccuauauc

SEQ ID NO: 299139 - RNA, 22 nt, Human
ucugggugggcccgagaaaucu

SEQ ID NO: 299140 - RNA, 22 nt, Human
gacagguggguucucguaucug

SEQ ID NO: 299141 - RNA, 20 nt, Human
ucuaaaguacaguuugugug

SEQ ID NO: 299142 - RNA, 22 nt, Human
uuugacucuagucauagaagug

SEQ ID NO: 299143 - RNA, 22 nt, Human
cagggcagugaagaacacacgu

SEQ ID NO: 299144 - RNA, 21 nt, Human
aguaguuuagcacaggguuug

SEQ ID NO: 299145 - RNA, 22 nt, Human
gcagguguggauuugcauccag

SEQ ID NO: 299146 - RNA, 22 nt, Human
uuucuucauucaccuucacccc

SEQ ID NO: 299147 - RNA, 23 nt, Human
cuguccugccauccacagcggcc

SEQ ID NO: 299148 - RNA, 22 nt, Human
gucacuguauccagguuccagc

SEQ ID NO: 299149 - RNA, 22 nt, Human
ggacaggugacugcccagagug

SEQ ID NO: 299150 - RNA, 22 nt, Human
uggcuggagcgcccuccucugc

SEQ ID NO: 299151 - RNA, 22 nt, Human
ugcuggaggccagaagucugag

SEQ ID NO: 299152 - RNA, 22 nt, Human
ucaggugucugccucuuugagu

SEQ ID NO: 299153 - RNA, 18 nt, Human
ucauuuguuuugcaugaa

SEQ ID NO: 299154 - RNA, 22 nt, Human
uuuacauugcauuagguauuau

SEQ ID NO: 299155 - RNA, 22 nt, Human
auguccuuuguaucccuaggca

SEQ ID NO: 299156 - RNA, 22 nt, Human
aggcaggggagcuggaagggua

SEQ ID NO: 299157 - RNA, 22 nt, Human
ugaccugcagucaagaggggaa

SEQ ID NO: 299158 - RNA, 22 nt, Human
cuggaaugccucccugucagag

SEQ ID NO: 299159 - RNA, 22 nt, Human
ucauuguauuaaaauauugguu

SEQ ID NO: 299160 - RNA, 22 nt, Human
ggcucccacccauagggcgagu

SEQ ID NO: 299161 - RNA, 22 nt, Human
uuuacagagaauguacauaaag

SEQ ID NO: 299162 - RNA, 22 nt, Human
acuguacugaaaaguaagcaag

SEQ ID NO: 299163 - RNA, 22 nt, Human
uaagaaacaugauacuuuuccu

SEQ ID NO: 299164 - RNA, 22 nt, Human
uacaaaaaauugauacugacga

SEQ ID NO: 299165 - RNA, 22 nt, Human
uacagauaacugaaugcagacu

SEQ ID NO: 299166 - RNA, 22 nt, Human
ucaaggagcccacagucuaaug

SEQ ID NO: 299167 - RNA, 22 nt, Human
uugcugggcaugucuuaauucu

SEQ ID NO: 299168 - RNA, 22 nt, Human
uaaaaugccagaccaguucacg

SEQ ID NO: 299169 - RNA, 22 nt, Human
uccuggcugaguucccaagucg

SEQ ID NO: 299170 - RNA, 22 nt, Human
acacuuuacucuuacaccauug

SEQ ID NO: 299171 - RNA, 22 nt, Human
uucuucaguguagcaacuguau

SEQ ID NO: 299172 - RNA, 22 nt, Human
ucugcccuggggucagccucca

SEQ ID NO: 299173 - RNA, 22 nt, Human
ugaacauugucacauuccuagc

SEQ ID NO: 299174 - RNA, 22 nt, Human
guauacauagaugaugaacaag

SEQ ID NO: 299175 - RNA, 22 nt, Human
ggcaggugcccagagagcacga

SEQ ID NO: 299176 - RNA, 22 nt, Human
auacaacuuuacaugcaauucc

SEQ ID NO: 299177 - RNA, 22 nt, Human
aaguguauauaugacuuauaaa

SEQ ID NO: 299178 - RNA, 22 nt, Human
ugagcauuggaucaaaugacuu

SEQ ID NO: 299179 - RNA, 22 nt, Human
ccuguucacccuccaugcacag

SEQ ID NO: 299180 - RNA, 22 nt, Human
ccaugagcuuccuauauagggu

SEQ ID NO: 299181 - RNA, 22 nt, Human
cauuagggucucucagcugaau

SEQ ID NO: 299182 - RNA, 22 nt, Human
uggcaggucaugaguggccacc

SEQ ID NO: 299183 - RNA, 22 nt, Human
guuugcaaauuguguuaaagcu

SEQ ID NO: 299184 - RNA, 22 nt, Human
gggugggaucuguggagccuca

SEQ ID NO: 299185 - RNA, 22 nt, Human
uucugugaaucuuuuuucccac

SEQ ID NO: 299186 - RNA, 22 nt, Human
uuaacauuguccuuagcagauu

SEQ ID NO: 299187 - RNA, 22 nt, Human
uuuuauugucuguauugccuau

SEQ ID NO: 299188 - RNA, 20 nt, Human
aggcucagcugagcucuugg

SEQ ID NO: 299189 - RNA, 22 nt, Human
cucuuaguaaugccaugaagca

SEQ ID NO: 299190 - RNA, 22 nt, Human
aaaccaucagauaauucauacu

SEQ ID NO: 299191 - RNA, 22 nt, Human
cccugcagaaccacagacaaac

SEQ ID NO: 299192 - RNA, 22 nt, Human
cuauaauuaugcucaaaaugua

SEQ ID NO: 299193 - RNA, 22 nt, Human
gccugcagugagugcagaaggu

SEQ ID NO: 299194 - RNA, 22 nt, Human
auuauuagugauguuguuacug

SEQ ID NO: 299195 - RNA, 22 nt, Human
uguaaauugaaggaaauuugug

SEQ ID NO: 299196 - RNA, 20 nt, Human
uuuauuggccuuucaggaac

SEQ ID NO: 299197 - RNA, 22 nt, Human
uuuggacuuagccugcagaauu

SEQ ID NO: 299198 - RNA, 22 nt, Human
uucauucuuugaaucugaggua

SEQ ID NO: 299199 - RNA, 22 nt, Human
ucagcuuugccaccagcuguaa

SEQ ID NO: 299200 - RNA, 22 nt, Human
ccucuaggauguggcuggagga

SEQ ID NO: 299201 - RNA, 22 nt, Human
gcacccaggcuugggcagcaac

SEQ ID NO: 299202 - RNA, 22 nt, Human
uucugggucacccuucugcuca

SEQ ID NO: 299203 - RNA, 22 nt, Human
ucuggaggcaacuaaccuaguu

SEQ ID NO: 299204 - RNA, 22 nt, Human
uccaggcaaaaggaacugcuug

SEQ ID NO: 299205 - RNA, 22 nt, Human
aaaauuuugcccuauccuucau

SEQ ID NO: 299206 - RNA, 22 nt, Human
uuguauuuauauugaauagcuu

SEQ ID NO: 299207 - RNA, 22 nt, Human
uuuauguuugacaaugaucugg

SEQ ID NO: 299208 - RNA, 22 nt, Human
acacacagguaaaggagccugg

SEQ ID NO: 299209 - RNA, 23 nt, Human
acuugauuauuguugauagauuc

SEQ ID NO: 299210 - RNA, 22 nt, Human
cagcaaagguagaagcacagga

SEQ ID NO: 299211 - RNA, 22 nt, Human
caguaaaagauggaaauagaau

SEQ ID NO: 299212 - RNA, 22 nt, Human
cuuucauuugauaagaaugcca

SEQ ID NO: 299213 - RNA, 22 nt, Human
gccugcagauauauaggauggu

SEQ ID NO: 299214 - RNA, 22 nt, Human
cuguguccugucuccuaaggug

SEQ ID NO: 299215 - RNA, 22 nt, Human
uuagggaaggcugcugucagcu

SEQ ID NO: 299216 - RNA, 22 nt, Human
caggauggcagagaaaagggug

SEQ ID NO: 299217 - RNA, 22 nt, Human
uugcugaugguauuaugcuagu

SEQ ID NO: 299218 - RNA, 22 nt, Human
ccagggcagcgccccuccacgc

SEQ ID NO: 299219 - RNA, 22 nt, Human
guagcuauuuaugauacucaug

SEQ ID NO: 299220 - RNA, 22 nt, Human
uauugaggaucuccugcuaauu

SEQ ID NO: 299221 - RNA, 22 nt, Human
auauaaguuaguggucauguuu

SEQ ID NO: 299222 - RNA, 22 nt, Human
uuauuagguuuacauaaagguu

SEQ ID NO: 299223 - RNA, 22 nt, Human
ugcagggcaguggagguugagu

SEQ ID NO: 299224 - RNA, 22 nt, Human
gcuggagguggugagaaaaggu

SEQ ID NO: 299225 - RNA, 22 nt, Human
uuccagugaaacaugaggugug

SEQ ID NO: 299226 - RNA, 22 nt, Human
cacccagcagcacuuaagacua

SEQ ID NO: 299227 - RNA, 22 nt, Human
uccuggguggcucugcccggcu

SEQ ID NO: 299228 - RNA, 22 nt, Human
uccugcagcugcagaccugggg

SEQ ID NO: 299229 - RNA, 22 nt, Human
cucuuaaaaacuugauauauuu

SEQ ID NO: 299230 - RNA, 22 nt, Human
aagggagacaguugugugagga

SEQ ID NO: 299231 - RNA, 17 nt, Human
ucuguucaagugagagg

SEQ ID NO: 299232 - RNA, 22 nt, Human
uggaaauguauuugggcaugcc

SEQ ID NO: 299233 - RNA, 22 nt, Human
ugaaugaugcaguauaaugaua

SEQ ID NO: 299234 - RNA, 22 nt, Human
ugcagggcuccuggcuccaauc

SEQ ID NO: 299235 - RNA, 22 nt, Human
ggguguggcugcgugccaauaa

SEQ ID NO: 299236 - RNA, 22 nt, Human
aacuauguuaauaaguuucauu

SEQ ID NO: 299237 - RNA, 22 nt, Human
aguccuuugggaaaaaugacua

SEQ ID NO: 299238 - RNA, 22 nt, Human
ugcugccaauuucuggucuuga

SEQ ID NO: 299239 - RNA, 22 nt, Human
uuaguucucaugaauuuuaagu

SEQ ID NO: 299240 - RNA, 21 nt, Human
ugucugauguauuuuuugccu

SEQ ID NO: 299241 - RNA, 22 nt, Human
ucagacagucaucagagcuugu

SEQ ID NO: 299242 - RNA, 22 nt, Human
auucagcaguuccugcuucagu

SEQ ID NO: 299243 - RNA, 22 nt, Human
cuguacuaauugcuuuacaugu

SEQ ID NO: 299244 - RNA, 22 nt, Human
uccaggcauuggagagauaaug

SEQ ID NO: 299245 - RNA, 22 nt, Human
cuggcucuaucuccaaggcugg

SEQ ID NO: 299246 - RNA, 22 nt, Human
ucuuagcacagcuauauaaguu

SEQ ID NO: 299247 - RNA, 21 nt, Human
cuggcucuguugucacccggc

SEQ ID NO: 299248 - RNA, 22 nt, Human
acauauauuacuaguaaagaca

SEQ ID NO: 299249 - RNA, 22 nt, Human
cuaugaaaugucagauucugca

SEQ ID NO: 299250 - RNA, 22 nt, Human
agaaauguugaauacacaaaau

SEQ ID NO: 299251 - RNA, 22 nt, Human
uucauuccuucccuaagcaacu

SEQ ID NO: 299252 - RNA, 22 nt, Human
uuugacucauugauuuucucug

SEQ ID NO: 299253 - RNA, 22 nt, Human
uuucauuggcucccugaugaau

SEQ ID NO: 299254 - RNA, 21 nt, Human
uggccaaaaccauauuauuaa

SEQ ID NO: 299255 - RNA, 22 nt, Human
aagggcucgguagcaguccuga

SEQ ID NO: 299256 - RNA, 22 nt, Human
caguuuauagcucuagcagcuu

SEQ ID NO: 299257 - RNA, 22 nt, Human
uaaagcugaaaugauuaugaca

SEQ ID NO: 299258 - RNA, 22 nt, Human
ccuucuucaccaguuuaccuga

SEQ ID NO: 299259 - RNA, 22 nt, Human
uuguucaugguuguaaguuuga

SEQ ID NO: 299260 - RNA, 22 nt, Human
aguaaaauuguauuggaaaaca

SEQ ID NO: 299261 - RNA, 22 nt, Human
gcagacagacugcagugauuuu

SEQ ID NO: 299262 - RNA, 22 nt, Human
gacaugugcugucucuuaaauu

SEQ ID NO: 299263 - RNA, 22 nt, Human
uggcaaaggaaaugauuuaaga

SEQ ID NO: 299264 - RNA, 22 nt, Human
auuuauugaacacugacuaugu

SEQ ID NO: 299265 - RNA, 22 nt, Human
cguccucagaggccauccgaaa

SEQ ID NO: 299266 - RNA, 19 nt, Human
ugacagguuuuauguguuu

SEQ ID NO: 299267 - RNA, 22 nt, Human
uccuggcucugcugccuccuag

SEQ ID NO: 299268 - RNA, 18 nt, Human
uggcaggggcaguacgcc

SEQ ID NO: 299269 - RNA, 22 nt, Human
uccuuccugcucuaacauucag

SEQ ID NO: 299270 - RNA, 22 nt, Human
aaguguuuggggaucauuuuaa

SEQ ID NO: 299271 - RNA, 22 nt, Human
aaaugucuguaggggcugcagg

SEQ ID NO: 299272 - RNA, 22 nt, Human
ggcuuuaucaaaugagacccug

SEQ ID NO: 299273 - RNA, 22 nt, Human
ucuuucuuuaucaccugauaug

SEQ ID NO: 299274 - RNA, 22 nt, Human
uucuuuucuuuaggcauugugu

SEQ ID NO: 299275 - RNA, 22 nt, Human
auugcagauucuucucagggag

SEQ ID NO: 299276 - RNA, 22 nt, Human
uucuuuuggacucaaagagaac

SEQ ID NO: 299277 - RNA, 22 nt, Human
agguggcuucuggccaggugug

SEQ ID NO: 299278 - RNA, 22 nt, Human
cuuugcaaacgauuaccacaug

SEQ ID NO: 299279 - RNA, 22 nt, Human
acagauuugacugguaccuggc

SEQ ID NO: 299280 - RNA, 22 nt, Human
cagcuuuccagagaccugcccc

SEQ ID NO: 299281 - RNA, 22 nt, Human
cauguuaaaauauacauucuga

SEQ ID NO: 299282 - RNA, 22 nt, Human
cagagaaagaagcccauucauu

SEQ ID NO: 299283 - RNA, 18 nt, Human
uagggcucuagggaguga

SEQ ID NO: 299284 - RNA, 22 nt, Human
uguuauugucgcugcacuggga

SEQ ID NO: 299285 - RNA, 18 nt, Human
ucagagagaauaguaauu

SEQ ID NO: 299286 - RNA, 22 nt, Human
ucaagagaaggggaaauagacu

SEQ ID NO: 299287 - RNA, 23 nt, Human
uuuauauuccuaaugucuugagc

SEQ ID NO: 299288 - RNA, 22 nt, Human
ucagguguagguuguucaguuu

SEQ ID NO: 299289 - RNA, 21 nt, Human
gauuugcagaaacuagacagg

SEQ ID NO: 299290 - RNA, 21 nt, Human
auucagaguaauucaucuuua

SEQ ID NO: 299291 - RNA, 22 nt, Human
uuugaaucugauauggcagcau

SEQ ID NO: 299292 - RNA, 22 nt, Human
uggguccuuuuuggacuucuuc

SEQ ID NO: 299293 - RNA, 22 nt, Human
gcuggaggcaguucagacacca

SEQ ID NO: 299294 - RNA, 22 nt, Human
auugcuggaugagcucuuggau

SEQ ID NO: 299295 - RNA, 22 nt, Human
acaaauaugguacucggagaaa

SEQ ID NO: 299296 - RNA, 22 nt, Human
uaaauuaugucacaugacucug

SEQ ID NO: 299297 - RNA, 22 nt, Human
agacgagggcccccaggacagc

SEQ ID NO: 299298 - RNA, 22 nt, Human
cgcgguggcggccuccagcgcc

SEQ ID NO: 299299 - RNA, 22 nt, Human
uccaggcaugucugaguccuuc

SEQ ID NO: 299300 - RNA, 21 nt, Human
uguuuuccaccuugaggcaag

SEQ ID NO: 299301 - RNA, 22 nt, Human
aagggcuccauccuuauaaaug

SEQ ID NO: 299302 - RNA, 22 nt, Human
ggugggaguggaacguggaaga

SEQ ID NO: 299303 - RNA, 22 nt, Human
uaaauuauguuccauguccuuu

SEQ ID NO: 299304 - RNA, 22 nt, Human
ucaauaauggcaggauaaauuu

SEQ ID NO: 299305 - RNA, 22 nt, Human
agcugcaagucuguguggggag

SEQ ID NO: 299306 - RNA, 22 nt, Human
gggcagggguagcauuccaagu

SEQ ID NO: 299307 - RNA, 21 nt, Human
auggugagauacugggugugg

SEQ ID NO: 299308 - RNA, 22 nt, Human
ggguggcacugauaaugagacg

SEQ ID NO: 299309 - RNA, 22 nt, Human
ucuucaaaugcuaguaauauca

SEQ ID NO: 299310 - RNA, 17 nt, Human
uccaugagacaugaaga

SEQ ID NO: 299311 - RNA, 23 nt, Human
uucuuucaagaaguucacagugc

SEQ ID NO: 299312 - RNA, 22 nt, Human
auguuucaugacugagcaaaau

SEQ ID NO: 299313 - RNA, 22 nt, Human
auuucauagauuguaaaucccu

SEQ ID NO: 299314 - RNA, 22 nt, Human
gguucaguggaauguguugacc

SEQ ID NO: 299315 - RNA, 22 nt, Human
ucagcuuucucagaggccuaac

SEQ ID NO: 299316 - RNA, 22 nt, Human
uggaccugagccuggcccugcc

SEQ ID NO: 299317 - RNA, 22 nt, Human
auuugcuuucagguauaaaagg

SEQ ID NO: 299318 - RNA, 22 nt, Human
acaaauauuuacugaauccacu

SEQ ID NO: 299319 - RNA, 19 nt, Human
ggaacuuggccuuuaccca

SEQ ID NO: 299320 - RNA, 22 nt, Human
uugggugguggggagaguucag

SEQ ID NO: 299321 - RNA, 22 nt, Human
uccucagagcauagcgcugucu

SEQ ID NO: 299322 - RNA, 22 nt, Human
gacagacacaauugauccauga

SEQ ID NO: 299323 - RNA, 22 nt, Human
uccugcagagccgcccucaggu

SEQ ID NO: 299324 - RNA, 22 nt, Human
aaucucuuuggcucaaggaucc

SEQ ID NO: 299325 - RNA, 22 nt, Human
ucacaaauagcuauauuaagga

SEQ ID NO: 299326 - RNA, 19 nt, Human
auucagcauucugcacuuc

SEQ ID NO: 299327 - RNA, 22 nt, Human
acacugaauguuuaagaacuug

SEQ ID NO: 299328 - RNA, 22 nt, Human
uuuucauuguuacuaugagcua

SEQ ID NO: 299329 - RNA, 23 nt, Human
acuuuauugaccccaggucaguu

SEQ ID NO: 299330 - RNA, 16 nt, Human
uggcagguuuuuaucu

SEQ ID NO: 299331 - RNA, 22 nt, Human
gacaggugaaacagcaagguaa

SEQ ID NO: 299332 - RNA, 22 nt, Human
guaggcagggcuguggggagaa

SEQ ID NO: 299333 - RNA, 22 nt, Human
cuucuucaagagaaugggagac

SEQ ID NO: 299334 - RNA, 22 nt, Human
aggccuccuggcuccaggccuu

SEQ ID NO: 299335 - RNA, 22 nt, Human
cuuuacugaagugaagaccugg

SEQ ID NO: 299336 - RNA, 22 nt, Human
ccagguguuacacgaguguuaa

SEQ ID NO: 299337 - RNA, 22 nt, Human
auguccucaaaacugauugcag

SEQ ID NO: 299338 - RNA, 22 nt, Human
gggcaggugcccagggccagag

SEQ ID NO: 299339 - RNA, 22 nt, Human
gggcagguguugucaaucuaau

SEQ ID NO: 299340 - RNA, 22 nt, Human
gaccuggaggauccucuucuug

SEQ ID NO: 299341 - RNA, 22 nt, Human
aauguaaaguugggcacaaaug

SEQ ID NO: 299342 - RNA, 22 nt, Human
uaucacaucaauguuuuaaaau

SEQ ID NO: 299343 - RNA, 22 nt, Human
cucccagguuccgacgccucuu

SEQ ID NO: 299344 - RNA, 22 nt, Human
gggacccugggaggcuggcgca

SEQ ID NO: 299345 - RNA, 22 nt, Human
auuagggaaacugacuugucuc

SEQ ID NO: 299346 - RNA, 22 nt, Human
uagggcucgggcacaggacagg

SEQ ID NO: 299347 - RNA, 22 nt, Human
cagauuuagaguggggcuugga

SEQ ID NO: 299348 - RNA, 21 nt, Human
uacuacagucucuuuaucagu

SEQ ID NO: 299349 - RNA, 22 nt, Human
gccaggcagccacccucugcga

SEQ ID NO: 299350 - RNA, 22 nt, Human
uucagcacuguuauggauuugc

SEQ ID NO: 299351 - RNA, 22 nt, Human
ucuuucuucuuucauaguguga

SEQ ID NO: 299352 - RNA, 22 nt, Human
uauugcugcuauugucaguuca

SEQ ID NO: 299353 - RNA, 22 nt, Human
aagaguggagcuggaaaguggg

SEQ ID NO: 299354 - RNA, 22 nt, Human
uuccuucuagagcuuguuuagg

SEQ ID NO: 299355 - RNA, 22 nt, Human
uugaaaaaauugguagaggaug

SEQ ID NO: 299356 - RNA, 22 nt, Human
uuaaauuagucaagcuucucug

SEQ ID NO: 299357 - RNA, 22 nt, Human
acuguucaucucuuagaaagua

SEQ ID NO: 299358 - RNA, 22 nt, Human
cauuaggguaauugaacacuua

SEQ ID NO: 299359 - RNA, 22 nt, Human
agcuggaggggccagcaggugu

SEQ ID NO: 299360 - RNA, 21 nt, Human
acagauuuuauaucucugcug

SEQ ID NO: 299361 - RNA, 22 nt, Human
uggguggauuaggauaggguau

SEQ ID NO: 299362 - RNA, 22 nt, Human
agguggggugagcugcagacua

SEQ ID NO: 299363 - RNA, 22 nt, Human
cucuuaaagcuuccaguuucaa

SEQ ID NO: 299364 - RNA, 22 nt, Human
aggguggcaccacauaucauag

SEQ ID NO: 299365 - RNA, 20 nt, Human
uaggugucuuugccagcuuu

SEQ ID NO: 299366 - RNA, 22 nt, Human
cugggugacagagugagauggu

SEQ ID NO: 299367 - RNA, 22 nt, Human
augcagcuucaggauuaugaug

SEQ ID NO: 299368 - RNA, 22 nt, Human
auuucaguguuuuaagaguuca

SEQ ID NO: 299369 - RNA, 22 nt, Human
auguccagaguguccuggaaag

SEQ ID NO: 299370 - RNA, 22 nt, Human
cacagcuucccaaaguggaccu

SEQ ID NO: 299371 - RNA, 22 nt, Human
gaaggcuguuucugguagugau

SEQ ID NO: 299372 - RNA, 16 nt, Human
caggugucagucaccu

SEQ ID NO: 299373 - RNA, 22 nt, Human
agcaggugucacuuucacucca

SEQ ID NO: 299374 - RNA, 22 nt, Human
ugcaggugcuacaagaacucac

SEQ ID NO: 299375 - RNA, 22 nt, Human
auccaugaagguacuucucagg

SEQ ID NO: 299376 - RNA, 22 nt, Human
gccugcagaacugugaggcaau

SEQ ID NO: 299377 - RNA, 18 nt, Human
ccagcaugccagaggcug

SEQ ID NO: 299378 - RNA, 22 nt, Human
cagcuuuauugagguauaauug

SEQ ID NO: 299379 - RNA, 22 nt, Human
gugcaaaagucauugugguuuu

SEQ ID NO: 299380 - RNA, 22 nt, Human
ggcuacuagguaccauuuagaa

SEQ ID NO: 299381 - RNA, 22 nt, Human
acagguguagaaaacagauuau

SEQ ID NO: 299382 - RNA, 22 nt, Human
ccacaagaugcaaacucuaaca

SEQ ID NO: 299383 - RNA, 22 nt, Human
uuuaauuuucugggcccagcag

SEQ ID NO: 299384 - RNA, 22 nt, Human
uuugacucuucuagcaagugug

SEQ ID NO: 299385 - RNA, 22 nt, Human
uggcagguagaguucugagaug

SEQ ID NO: 299386 - RNA, 22 nt, Human
ucugggaacucugucauuuccc

SEQ ID NO: 299387 - RNA, 22 nt, Human
ggggcaggagcccuucuucagc

SEQ ID NO: 299388 - RNA, 22 nt, Human
auugcuggcaucagugacaaua

SEQ ID NO: 299389 - RNA, 19 nt, Human
uggcucuguuucucuggag

SEQ ID NO: 299390 - RNA, 22 nt, Human
auuaauuuccaggcacugugcu

SEQ ID NO: 299391 - RNA, 22 nt, Human
auaaugaggauuugcauauuag

SEQ ID NO: 299392 - RNA, 22 nt, Human
uuguguccuaacaucuaguuaa

SEQ ID NO: 299393 - RNA, 22 nt, Human
uugcagcugcaguaaauguuca

SEQ ID NO: 299394 - RNA, 22 nt, Human
aauuuagauugauaaacaugga

SEQ ID NO: 299395 - RNA, 22 nt, Human
aaacuucagugaaugacuuaug

SEQ ID NO: 299396 - RNA, 20 nt, Human
ccugucuccucuuaccuggc

SEQ ID NO: 299397 - RNA, 22 nt, Human
cagggcuagugacaccccaguc

SEQ ID NO: 299398 - RNA, 22 nt, Human
acagcuuugggcaaugcuauga

SEQ ID NO: 299399 - RNA, 22 nt, Human
ucuguucauuugccucggcucu

SEQ ID NO: 299400 - RNA, 21 nt, Human
ugacagguuuaggauuaaaau

SEQ ID NO: 299401 - RNA, 23 nt, Human
aaauaggaguaucuggaucauga

SEQ ID NO: 299402 - RNA, 22 nt, Human
ugacagacuuuacuucuccuau

SEQ ID NO: 299403 - RNA, 22 nt, Human
aguucgagaucugcugaugaga

SEQ ID NO: 299404 - RNA, 22 nt, Human
uagaaacauucaguugcagucc

SEQ ID NO: 299405 - RNA, 22 nt, Human
cuggaggaggaagucuacaaug

SEQ ID NO: 299406 - RNA, 22 nt, Human
auucagcaaugagcuuggauuu

SEQ ID NO: 299407 - RNA, 22 nt, Human
uacaguaccagaaaugcuaaga

SEQ ID NO: 299408 - RNA, 22 nt, Human
ccagcuuucauaucaugaggua

SEQ ID NO: 299409 - RNA, 22 nt, Human
ucagggcaagauugguuaauaa

SEQ ID NO: 299410 - RNA, 22 nt, Human
cuguccuggagggcauaggacg

SEQ ID NO: 299411 - RNA, 22 nt, Human
aaaagcagguacucagcuuggg

SEQ ID NO: 299412 - RNA, 22 nt, Human
gagcuuuaagggcacuggucuu

SEQ ID NO: 299413 - RNA, 22 nt, Human
agggcuacugccugccuucagg

SEQ ID NO: 299414 - RNA, 22 nt, Human
uaagaaacuaaugcaauaagag

SEQ ID NO: 299415 - RNA, 22 nt, Human
ccuguucaagggaugauugacc

SEQ ID NO: 299416 - RNA, 22 nt, Human
cccagugucauucuaagggagg

SEQ ID NO: 299417 - RNA, 22 nt, Human
gcagcuuuaaucugaauaagua

SEQ ID NO: 299418 - RNA, 22 nt, Human
aggagaggcucuaacucugugu

SEQ ID NO: 299419 - RNA, 22 nt, Human
caauauauaaugaguacuuucc

SEQ ID NO: 299420 - RNA, 22 nt, Human
ggagggagcauccccuugcuga

SEQ ID NO: 299421 - RNA, 22 nt, Human
uuccuucuggaggcuccagggg

SEQ ID NO: 299422 - RNA, 22 nt, Human
agcaggugaucgcgugugcucc

SEQ ID NO: 299423 - RNA, 22 nt, Human
ccagguguucuuugucccuguu

SEQ ID NO: 299424 - RNA, 20 nt, Human
uugaagagucagguagggcc

SEQ ID NO: 299425 - RNA, 23 nt, Human
ucuguucaaggcuuucuccuuga

SEQ ID NO: 299426 - RNA, 22 nt, Human
aacauuuaugguagucauugca

SEQ ID NO: 299427 - RNA, 22 nt, Human
gaguaguugcugcagagaauac

SEQ ID NO: 299428 - RNA, 22 nt, Human
aagaauuaucugaaagcugugu

SEQ ID NO: 299429 - RNA, 23 nt, Human
uggcaaagcauucuuauaacagu

SEQ ID NO: 299430 - RNA, 22 nt, Human
ggacagacaaaaauaguaagca

SEQ ID NO: 299431 - RNA, 22 nt, Human
auuuccauguccaaaaauuagu

SEQ ID NO: 299432 - RNA, 22 nt, Human
uuuaauugcauuuaaagaugga

SEQ ID NO: 299433 - RNA, 21 nt, Human
gcugccaccgcgugcuccagg

SEQ ID NO: 299434 - RNA, 22 nt, Human
ggaccugcauuuuaacaagauc

SEQ ID NO: 299435 - RNA, 22 nt, Human
auguguccuuauaagaagaaga

SEQ ID NO: 299436 - RNA, 22 nt, Human
uccugggucugggugucugagg

SEQ ID NO: 299437 - RNA, 22 nt, Human
uccagacccaugacccugggga

SEQ ID NO: 299438 - RNA, 22 nt, Human
gaauccaggguuguuugagcua

SEQ ID NO: 299439 - RNA, 22 nt, Human
acagagagcugugauugaguua

SEQ ID NO: 299440 - RNA, 22 nt, Human
uuuuugaaggcugaugugauua

SEQ ID NO: 299441 - RNA, 22 nt, Human
acaugaaguggucagaucaaac

SEQ ID NO: 299442 - RNA, 22 nt, Human
gcuucuaucccuccacugcacu

SEQ ID NO: 299443 - RNA, 22 nt, Human
uauaaauuauuaggcugcuaaa

SEQ ID NO: 299444 - RNA, 22 nt, Human
agagggugcuggagagacauug

SEQ ID NO: 299445 - RNA, 22 nt, Human
acacuuuaagcauuucacacug

SEQ ID NO: 299446 - RNA, 22 nt, Human
gaucauuugcaggaaacauuaa

SEQ ID NO: 299447 - RNA, 22 nt, Human
aacuuaaacccacucauguaga

SEQ ID NO: 299448 - RNA, 22 nt, Human
ucuuccuugccuugcuucauca

SEQ ID NO: 299449 - RNA, 22 nt, Human
uuuucauuuuuguagaugcaag

SEQ ID NO: 299450 - RNA, 22 nt, Human
guuucauacagauuauucaugg

SEQ ID NO: 299451 - RNA, 22 nt, Human
cgcaggugaacuguucugcagu

SEQ ID NO: 299452 - RNA, 22 nt, Human
ugcagguggauucaauguggga

SEQ ID NO: 299453 - RNA, 22 nt, Human
ugcuggaggaguuuacuguggc

SEQ ID NO: 299454 - RNA, 22 nt, Human
uugauacaggcucuauuucauc

SEQ ID NO: 299455 - RNA, 22 nt, Human
acuugguugaugucauaagguu

SEQ ID NO: 299456 - RNA, 22 nt, Human
uccaugagagguaacuuuacaa

SEQ ID NO: 299457 - RNA, 22 nt, Human
ugucucaucucuuaaccccacu

SEQ ID NO: 299458 - RNA, 22 nt, Human
gcagguggauauugcuacuuga

SEQ ID NO: 299459 - RNA, 22 nt, Human
acaggccuuggcaggcauguga

SEQ ID NO: 299460 - RNA, 22 nt, Human
caugugucaaaugauguagcug

SEQ ID NO: 299461 - RNA, 22 nt, Human
uggcaaggccacaggugcaguu

SEQ ID NO: 299462 - RNA, 23 nt, Human
cccagagcacagccuccagaugc

SEQ ID NO: 299463 - RNA, 22 nt, Human
uuagcuuucaugaaccuggucg

SEQ ID NO: 299464 - RNA, 22 nt, Human
cagggccagagagggcuggcug

SEQ ID NO: 299465 - RNA, 22 nt, Human
cccugcagggaggauucugaag

SEQ ID NO: 299466 - RNA, 22 nt, Human
uugcuuuaucuaagcauggcca

SEQ ID NO: 299467 - RNA, 20 nt, Human
agcuucuucugucuaauuuu

SEQ ID NO: 299468 - RNA, 22 nt, Human
ucaaaggcauugccaauaagua

SEQ ID NO: 299469 - RNA, 22 nt, Human
agguggggcccaccaauuugca

SEQ ID NO: 299470 - RNA, 22 nt, Human
aguggcagggcuggcugcugca

SEQ ID NO: 299471 - RNA, 22 nt, Human
agacaugucaccaauucuuacu

SEQ ID NO: 299472 - RNA, 22 nt, Human
cuaaucaucuuucucuuaaagc

SEQ ID NO: 299473 - RNA, 23 nt, Human
uuugaaguugacugccuuccaga

SEQ ID NO: 299474 - RNA, 22 nt, Human
ccagugugauuguugcaagaau

SEQ ID NO: 299475 - RNA, 22 nt, Human
gacaggugugaugauuuaggcu

SEQ ID NO: 299476 - RNA, 22 nt, Human
uuccaugccucuauuuagaauu

SEQ ID NO: 299477 - RNA, 22 nt, Human
agccuauuccaggaugagcuca

SEQ ID NO: 299478 - RNA, 22 nt, Human
cagggcagccaggccccguggg

SEQ ID NO: 299479 - RNA, 22 nt, Human
uccauucuaugcuuacauuuau

SEQ ID NO: 299480 - RNA, 22 nt, Human
ccagguggaggugugagguccu

SEQ ID NO: 299481 - RNA, 22 nt, Human
ggcaggcaagucugcucuguga

SEQ ID NO: 299482 - RNA, 22 nt, Human
aaacauuguaauuuuagcaugg

SEQ ID NO: 299483 - RNA, 21 nt, Human
uucauaaaccauucucaugca

SEQ ID NO: 299484 - RNA, 22 nt, Human
uguuuucuuccuaauugcucau

SEQ ID NO: 299485 - RNA, 22 nt, Human
gccaggcacugcucuaagcccu

SEQ ID NO: 299486 - RNA, 22 nt, Human
agcagguggauuuagacgggag

SEQ ID NO: 299487 - RNA, 23 nt, Human
uccuccuuuugcuugugcuuccc

SEQ ID NO: 299488 - RNA, 22 nt, Human
uagggcucagaguccaguuucu

SEQ ID NO: 299489 - RNA, 22 nt, Human
cuggguccugcucucccuaaga

SEQ ID NO: 299490 - RNA, 19 nt, Human
uuugcugguucaggaaaga

SEQ ID NO: 299491 - RNA, 22 nt, Human
aguuuucuguucuacaauuuga

SEQ ID NO: 299492 - RNA, 22 nt, Human
ucagcauguucuuaggucacag

SEQ ID NO: 299493 - RNA, 22 nt, Human
aacuuucagaauccuaugcauu

SEQ ID NO: 299494 - RNA, 22 nt, Human
auugaaaaaugacuauugcuua

SEQ ID NO: 299495 - RNA, 22 nt, Human
guuuuauaggcuguugcuauau

SEQ ID NO: 299496 - RNA, 22 nt, Human
ggagaggggcaaguuuaucuag

SEQ ID NO: 299497 - RNA, 22 nt, Human
uucauucuugucuuuguauagu

SEQ ID NO: 299498 - RNA, 22 nt, Human
uugcagcuuagugauguuaucu

SEQ ID NO: 299499 - RNA, 22 nt, Human
ugcagggcuaagucagagccug

SEQ ID NO: 299500 - RNA, 22 nt, Human
ucuucaaaaaauauccaucagu

SEQ ID NO: 299501 - RNA, 22 nt, Human
ugacagacacaccuuaggaaag

SEQ ID NO: 299502 - RNA, 22 nt, Human
gaggcauaaaucacaguguuca

SEQ ID NO: 299503 - RNA, 22 nt, Human
uuacuuuugcaccaaacuaaua

SEQ ID NO: 299504 - RNA, 22 nt, Human
uugauacauuuuuaggauaaac

SEQ ID NO: 299505 - RNA, 22 nt, Human
ugucugggauguaauuccugcc

SEQ ID NO: 299506 - RNA, 22 nt, Human
agcagguggucuguugcugcug

SEQ ID NO: 299507 - RNA, 22 nt, Human
acagguggggcacuuggagccu

SEQ ID NO: 299508 - RNA, 20 nt, Human
uuuacauuuugaaacaguga

SEQ ID NO: 299509 - RNA, 19 nt, Human
ugcauaaauuauauacuuu

SEQ ID NO: 299510 - RNA, 23 nt, Human
gccaggcacaugguggacacgca

SEQ ID NO: 299511 - RNA, 22 nt, Human
uguccuggggcgacuuggggcc

SEQ ID NO: 299512 - RNA, 22 nt, Human
aaacaccagucccaguauacac

SEQ ID NO: 299513 - RNA, 19 nt, Human
accugcaguaauaauuccu

SEQ ID NO: 299514 - RNA, 22 nt, Human
agcaggugggcaugaaagcuga

SEQ ID NO: 299515 - RNA, 18 nt, Human
ccuggaggucuucggggu

SEQ ID NO: 299516 - RNA, 22 nt, Human
auacagggacauccaguuuuuc

SEQ ID NO: 299517 - RNA, 22 nt, Human
gagcugcacuggggguggaaug

SEQ ID NO: 299518 - RNA, 22 nt, Human
uccugucuaaagaccugcaggc

SEQ ID NO: 299519 - RNA, 22 nt, Human
aauacaguaauuuugaugaguu

SEQ ID NO: 299520 - RNA, 22 nt, Human
uuccaugcaagaaguauggcuc

SEQ ID NO: 299521 - RNA, 22 nt, Human
caaagucauggggaugcagguc

SEQ ID NO: 299522 - RNA, 22 nt, Human
gucauuccuuauguugauucag

SEQ ID NO: 299523 - RNA, 22 nt, Human
agagcggggauaguuaauauuc

SEQ ID NO: 299524 - RNA, 22 nt, Human
uuccuuccauagcaaaacaugc

SEQ ID NO: 299525 - RNA, 22 nt, Human
uauuaggguuuugaagguuugu

SEQ ID NO: 299526 - RNA, 22 nt, Human
uuccuucuuccagaggcugccc

SEQ ID NO: 299527 - RNA, 22 nt, Human
cugcaaaaguaauuggggcuuu

SEQ ID NO: 299528 - RNA, 22 nt, Human
uuuuauagcugaauaguauucc

SEQ ID NO: 299529 - RNA, 22 nt, Human
cugucccuucauuauucacuac

SEQ ID NO: 299530 - RNA, 22 nt, Human
aacacagcuaauuucugucaau

SEQ ID NO: 299531 - RNA, 22 nt, Human
gaggugucguagauuauucuca

SEQ ID NO: 299532 - RNA, 22 nt, Human
ugucuucagcaaaugccuuucu

SEQ ID NO: 299533 - RNA, 19 nt, Human
uuugugaagaaaaugaugc

SEQ ID NO: 299534 - RNA, 20 nt, Human
cagagaccaggccagguguc

SEQ ID NO: 299535 - RNA, 22 nt, Human
auuucucaguuccuacuguuua

SEQ ID NO: 299536 - RNA, 22 nt, Human
gagagggauacugaguuuuggu

SEQ ID NO: 299537 - RNA, 22 nt, Human
gaauuucuggacccuuugagaa

SEQ ID NO: 299538 - RNA, 22 nt, Human
uacagagaguacagcauccaca

SEQ ID NO: 299539 - RNA, 22 nt, Human
agaaaguuuugugcuauauaug

SEQ ID NO: 299540 - RNA, 22 nt, Human
gccaaaucacagggccaaaagc

SEQ ID NO: 299541 - RNA, 22 nt, Human
uauaauuuggggaaaguggugu

SEQ ID NO: 299542 - RNA, 17 nt, Human
auccuucuguucuuucu

SEQ ID NO: 299543 - RNA, 21 nt, Human
uggcagggguaguaguacagc

SEQ ID NO: 299544 - RNA, 22 nt, Human
ugcacuuuaaaaaauggugaug

SEQ ID NO: 299545 - RNA, 22 nt, Human
ggagaggggaacuuguugcuug

SEQ ID NO: 299546 - RNA, 21 nt, Human
acuguucaucuguucagaagc

SEQ ID NO: 299547 - RNA, 22 nt, Human
uguccuuuacugauugcuucug

SEQ ID NO: 299548 - RNA, 22 nt, Human
uuuugcuguuauaugcuauuau

SEQ ID NO: 299549 - RNA, 22 nt, Human
aucuacccacugaacacaauau

SEQ ID NO: 299550 - RNA, 22 nt, Human
cagcaccuguuagcauuaaaua

SEQ ID NO: 299551 - RNA, 19 nt, Human
uagaaagaugauggguggg

SEQ ID NO: 299552 - RNA, 22 nt, Human
aggacagugguguucuggagug

SEQ ID NO: 299553 - RNA, 22 nt, Human
agcagggccugagugaccuaac

SEQ ID NO: 299554 - RNA, 22 nt, Human
uggcaaaguaucugucccagcu

SEQ ID NO: 299555 - RNA, 22 nt, Human
ggguggggcccaggaaaucuau

SEQ ID NO: 299556 - RNA, 22 nt, Human
uguguccucaugagguuugcag

SEQ ID NO: 299557 - RNA, 22 nt, Human
uuucuacauucaaaaacuacca

SEQ ID NO: 299558 - RNA, 22 nt, Human
gcaugcaguaaaauucagcaac

SEQ ID NO: 299559 - RNA, 22 nt, Human
uuauuccauagaagucaaggaa

SEQ ID NO: 299560 - RNA, 23 nt, Human
uccugcagauaagcugguugaca

SEQ ID NO: 299561 - RNA, 22 nt, Human
aauuuccagaucagaugacuca

SEQ ID NO: 299562 - RNA, 20 nt, Human
uuucaguuaucuugaccuuc

SEQ ID NO: 299563 - RNA, 22 nt, Human
ugcagggccuuguugaugugcu

SEQ ID NO: 299564 - RNA, 22 nt, Human
guuuuauaggugaaauauuacu

SEQ ID NO: 299565 - RNA, 22 nt, Human
cuggcacucauaggccaguuca

SEQ ID NO: 299566 - RNA, 22 nt, Human
cccaggcauuuucaacuuuagu

SEQ ID NO: 299567 - RNA, 22 nt, Human
aaacaugagcauuucuguuuaa

SEQ ID NO: 299568 - RNA, 22 nt, Human
ugcagggaaaguguuggcagca

SEQ ID NO: 299569 - RNA, 22 nt, Human
ugguguggggauaagcacucug

SEQ ID NO: 299570 - RNA, 22 nt, Human
uuccaugaaggagacugagaag

SEQ ID NO: 299571 - RNA, 22 nt, Human
ugggccaggcaugugaucagca

SEQ ID NO: 299572 - RNA, 22 nt, Human
uacauguggguuaaaaacacuc

SEQ ID NO: 299573 - RNA, 22 nt, Human
auugaaaaauucacaauucugg

SEQ ID NO: 299574 - RNA, 22 nt, Human
acaugugugacaacagagguga

SEQ ID NO: 299575 - RNA, 22 nt, Human
agcaggugggaucaagcuggca

SEQ ID NO: 299576 - RNA, 22 nt, Human
ccagcuuuugcacuggacuggg

SEQ ID NO: 299577 - RNA, 22 nt, Human
acaaauguggacauggauaaug

SEQ ID NO: 299578 - RNA, 22 nt, Human
gagggcagaaaauuaugcggug

SEQ ID NO: 299579 - RNA, 22 nt, Human
gauccugugguuuuccugugca

SEQ ID NO: 299580 - RNA, 22 nt, Human
guguguccaggcgggagucaag

SEQ ID NO: 299581 - RNA, 22 nt, Human
uucaaacaguguagaauauaug

SEQ ID NO: 299582 - RNA, 22 nt, Human
cauguuaaugaauuuuugcagu

SEQ ID NO: 299583 - RNA, 22 nt, Human
ucgcuugaacccaggaagugga

SEQ ID NO: 299584 - RNA, 23 nt, Human
uuucaacuccugccauuauuucu

SEQ ID NO: 299585 - RNA, 22 nt, Human
augaaacaguguguauagcaaa

SEQ ID NO: 299586 - RNA, 22 nt, Human
uagguggugggauaugagcauc

SEQ ID NO: 299587 - RNA, 22 nt, Human
uuuccuuugcccaauacauguc

SEQ ID NO: 299588 - RNA, 22 nt, Human
uuuaaauuauaguuaaugucug

SEQ ID NO: 299589 - RNA, 22 nt, Human
ccugggugcccggcccuucucu

SEQ ID NO: 299590 - RNA, 21 nt, Human
agcaggugcuguuggaggaaa

SEQ ID NO: 299591 - RNA, 22 nt, Human
gagggaaaauaaaauugcagua

SEQ ID NO: 299592 - RNA, 22 nt, Human
cagagccuuccuagcagacucu

SEQ ID NO: 299593 - RNA, 19 nt, Human
ucucaauucuccccacugc

SEQ ID NO: 299594 - RNA, 22 nt, Human
uggaauguaaacucugugaggg

SEQ ID NO: 299595 - RNA, 22 nt, Human
ugucuuuaaaauuaaacacauc

SEQ ID NO: 299596 - RNA, 20 nt, Human
cuucuucaguaguuuguucu

SEQ ID NO: 299597 - RNA, 21 nt, Human
auuuucauuuccaggggagga

SEQ ID NO: 299598 - RNA, 22 nt, Human
ucuuuucuccagaccugggauc

SEQ ID NO: 299599 - RNA, 22 nt, Human
cuuaauuuaaaauaguucaggc

SEQ ID NO: 299600 - RNA, 22 nt, Human
uuaaauauuuucagcaggguca

SEQ ID NO: 299601 - RNA, 22 nt, Human
acauguguguauacguauuuau

SEQ ID NO: 299602 - RNA, 21 nt, Human
uugcuuauggcacugcuuugc

SEQ ID NO: 299603 - RNA, 22 nt, Human
uauuugaagggagaaagugcca

SEQ ID NO: 299604 - RNA, 22 nt, Human
auguaaaagauuauuuuccugu

SEQ ID NO: 299605 - RNA, 22 nt, Human
ccugucacgaugacugcacucu

SEQ ID NO: 299606 - RNA, 22 nt, Human
gccucaagacauuuuuaauugc

SEQ ID NO: 299607 - RNA, 22 nt, Human
ugagcagagucgcuccagagug

SEQ ID NO: 299608 - RNA, 22 nt, Human
aaucuucauuuugacaagauuc

SEQ ID NO: 299609 - RNA, 22 nt, Human
uggcaagggauuguggagaacu

SEQ ID NO: 299610 - RNA, 22 nt, Human
ugucccucugaggcuucccugg

SEQ ID NO: 299611 - RNA, 18 nt, Human
gacccagcagaugggcuu

SEQ ID NO: 299612 - RNA, 22 nt, Human
aguuuacacuuuugauucuuau

SEQ ID NO: 299613 - RNA, 21 nt, Human
agcuuacauuaccauuguugc

SEQ ID NO: 299614 - RNA, 22 nt, Human
uuuccuuccaaaugcccgggag

SEQ ID NO: 299615 - RNA, 22 nt, Human
ucaggaaagaagaugcucagug

SEQ ID NO: 299616 - RNA, 22 nt, Human
uuggauuacaugaaaugcagaa

SEQ ID NO: 299617 - RNA, 22 nt, Human
uggcaaagaccgcaauuacuuu

SEQ ID NO: 299618 - RNA, 18 nt, Human
uggaggaaucacaauggc

SEQ ID NO: 299619 - RNA, 22 nt, Human
agacagacacaugguaacagau

SEQ ID NO: 299620 - RNA, 23 nt, Human
uugauuucaaaugcagagaacac

SEQ ID NO: 299621 - RNA, 22 nt, Human
ucagguggcuucggggaguggc

SEQ ID NO: 299622 - RNA, 22 nt, Human
gauguguccccagaggauugaa

SEQ ID NO: 299623 - RNA, 22 nt, Human
uuucucauagucaugccucuua

SEQ ID NO: 299624 - RNA, 22 nt, Human
agcugcaacuguccuugccuug

SEQ ID NO: 299625 - RNA, 22 nt, Human
uuacauuuugggguaaggauaa

SEQ ID NO: 299626 - RNA, 22 nt, Human
aggagcugauaaaaggggguca

SEQ ID NO: 299627 - RNA, 22 nt, Human
agcaggugacccaagcaggcug

SEQ ID NO: 299628 - RNA, 22 nt, Human
uguuaauauacuaaaauccacu

SEQ ID NO: 299629 - RNA, 22 nt, Human
uacccagcccaugccuaccuca

SEQ ID NO: 299630 - RNA, 22 nt, Human
ucugggaaaugcuguuccuugu

SEQ ID NO: 299631 - RNA, 22 nt, Human
ucuuuauuuuaugcuugugcaa

SEQ ID NO: 299632 - RNA, 22 nt, Human
auuucuguugcuuauaaauuac

SEQ ID NO: 299633 - RNA, 22 nt, Human
ucauuuguggaagugauugugg

SEQ ID NO: 299634 - RNA, 22 nt, Human
uaaaaaacauuacucuguccug

SEQ ID NO: 299635 - RNA, 22 nt, Human
ugcaggugugugcaagggaggg

SEQ ID NO: 299636 - RNA, 19 nt, Human
gguccucagcagagcaugc

SEQ ID NO: 299637 - RNA, 22 nt, Human
gauuguaauucuacuuuccgcu

SEQ ID NO: 299638 - RNA, 22 nt, Human
gggucuggagggcagcccuucu

SEQ ID NO: 299639 - RNA, 22 nt, Human
aucuguucuucaaaauauuaca

SEQ ID NO: 299640 - RNA, 22 nt, Human
uggaugucauaguuggauauac

SEQ ID NO: 299641 - RNA, 22 nt, Human
guuauauauaguauuucucuga

SEQ ID NO: 299642 - RNA, 22 nt, Human
ggcaggugguaaggauuucaua

SEQ ID NO: 299643 - RNA, 22 nt, Human
uuccuucuuccuuuaguaacca

SEQ ID NO: 299644 - RNA, 22 nt, Human
uuuucaguuccaucucugcucu

SEQ ID NO: 299645 - RNA, 22 nt, Human
aauaauuauuugagagcagacc

SEQ ID NO: 299646 - RNA, 22 nt, Human
auccaugauuaguaggauaaag

SEQ ID NO: 299647 - RNA, 22 nt, Human
ucuaugaaaagucuauucauuc

SEQ ID NO: 299648 - RNA, 21 nt, Human
acagugugcuucucucccucc

SEQ ID NO: 299649 - RNA, 19 nt, Human
uggcagggagugauauuag

SEQ ID NO: 299650 - RNA, 22 nt, Human
aucuagauuagguauaagagcu

SEQ ID NO: 299651 - RNA, 22 nt, Human
ugcugagggagggguuuuccag

SEQ ID NO: 299652 - RNA, 22 nt, Human
uucuacaauaugaauaaugaag

SEQ ID NO: 299653 - RNA, 20 nt, Human
cccaggcagagcuagcggca

SEQ ID NO: 299654 - RNA, 22 nt, Human
ucaggugggaguagaaugcuag

SEQ ID NO: 299655 - RNA, 22 nt, Human
uuccuuucccuugcuucugugc

SEQ ID NO: 299656 - RNA, 22 nt, Human
cuucucaaaguugugaaucagg

SEQ ID NO: 299657 - RNA, 22 nt, Human
uaaugucuaugggccagauaau

SEQ ID NO: 299658 - RNA, 22 nt, Human
uuuauucugugcuacaugaaga

SEQ ID NO: 299659 - RNA, 22 nt, Human
uuauuccauuauuucacuuagg

SEQ ID NO: 299660 - RNA, 22 nt, Human
uccuggauuuaacccuggcucu

SEQ ID NO: 299661 - RNA, 22 nt, Human
ggcaggugcuaagagagguaaa

SEQ ID NO: 299662 - RNA, 22 nt, Human
ccacaggcugcugcaggucccg

SEQ ID NO: 299663 - RNA, 22 nt, Human
cuuucauucuuagauauuagug

SEQ ID NO: 299664 - RNA, 22 nt, Human
uuucauaauacuguacaugaaa

SEQ ID NO: 299665 - RNA, 22 nt, Human
ugacccuuagugaacauuagaa

SEQ ID NO: 299666 - RNA, 22 nt, Human
uggguacuccuauuaguucagu

SEQ ID NO: 299667 - RNA, 22 nt, Human
gauugcugccagcguguccgug

SEQ ID NO: 299668 - RNA, 20 nt, Human
guauuacaggcuuagaacca

SEQ ID NO: 299669 - RNA, 20 nt, Human
agacccucuggacugggccc

SEQ ID NO: 299670 - RNA, 22 nt, Human
aggggauggagcuggaaggcag

SEQ ID NO: 299671 - RNA, 22 nt, Human
gguuucaaauuaaagucuuaag

SEQ ID NO: 299672 - RNA, 22 nt, Human
uugcagggcaucuaugucuggu

SEQ ID NO: 299673 - RNA, 22 nt, Human
ucccagaagugaaauuucuaga

SEQ ID NO: 299674 - RNA, 22 nt, Human
ucaggcaggaagggaggacuug

SEQ ID NO: 299675 - RNA, 22 nt, Human
aguguccucaggcuuuguuccu

SEQ ID NO: 299676 - RNA, 22 nt, Human
auuauuagacuuauaugguagu

SEQ ID NO: 299677 - RNA, 22 nt, Human
ugucccugccugcccacucugu

SEQ ID NO: 299678 - RNA, 22 nt, Human
ggcaggcaaugaggaugggaag

SEQ ID NO: 299679 - RNA, 22 nt, Human
acagguggucuuugcuccuuuu

SEQ ID NO: 299680 - RNA, 22 nt, Human
acccagccuacaaagcucaccu

SEQ ID NO: 299681 - RNA, 22 nt, Human
cuuuauggaaucaaagacugga

SEQ ID NO: 299682 - RNA, 22 nt, Human
uggcagggugccaguugcgagu

SEQ ID NO: 299683 - RNA, 22 nt, Human
ccugggugacagagugagaccu

SEQ ID NO: 299684 - RNA, 22 nt, Human
uucugggugcaacucuguucug

SEQ ID NO: 299685 - RNA, 22 nt, Human
auuuggaaaugcaucucuugag

SEQ ID NO: 299686 - RNA, 22 nt, Human
uaaauucugaucaaguuccuuc

SEQ ID NO: 299687 - RNA, 23 nt, Human
uuguccugccgaucucugagaau

SEQ ID NO: 299688 - RNA, 19 nt, Human
uuccugggguuccauugug

SEQ ID NO: 299689 - RNA, 22 nt, Human
uuccuugguagagagaauauuu

SEQ ID NO: 299690 - RNA, 21 nt, Human
auauuguagguaaagugcagg

SEQ ID NO: 299691 - RNA, 21 nt, Human
ucauguguaacuuuugaccac

SEQ ID NO: 299692 - RNA, 22 nt, Human
auugcugaacuuauaaaugaau

SEQ ID NO: 299693 - RNA, 22 nt, Human
ucagacaggccucuccagccuc

SEQ ID NO: 299694 - RNA, 22 nt, Human
cuuaauuuuuguaguagaugga

SEQ ID NO: 299695 - RNA, 22 nt, Human
auuaguaaaacauuguauaugu

SEQ ID NO: 299696 - RNA, 22 nt, Human
uaauuccaaguugagacaugca

SEQ ID NO: 299697 - RNA, 20 nt, Human
aucuucuuggccagcuugcu

SEQ ID NO: 299698 - RNA, 22 nt, Human
gaaucauuuauuuuugacagca

SEQ ID NO: 299699 - RNA, 22 nt, Human
uccuuccuggggucucugcugc

SEQ ID NO: 299700 - RNA, 22 nt, Human
ucaugaauauugaaugcuucau

SEQ ID NO: 299701 - RNA, 22 nt, Human
ggcuagggaucuagaccaggac

SEQ ID NO: 299702 - RNA, 22 nt, Human
uagcuuuuaguacuuaauggcu

SEQ ID NO: 299703 - RNA, 22 nt, Human
cuuugcuuuacucccacugugu

SEQ ID NO: 299704 - RNA, 22 nt, Human
uuuucauuguaaaucaggaaac

SEQ ID NO: 299705 - RNA, 22 nt, Human
ccagacaggggcuguuccugcu

SEQ ID NO: 299706 - RNA, 21 nt, Human
acagagcauaaugguguggca

SEQ ID NO: 299707 - RNA, 22 nt, Human
aucauucuaguccuuauggucu

SEQ ID NO: 299708 - RNA, 19 nt, Human
uguccucacagagcauaac

SEQ ID NO: 299709 - RNA, 22 nt, Human
uuuauuggauggauggauggau

SEQ ID NO: 299710 - RNA, 22 nt, Human
ugacauguaagauggaaaagcg

SEQ ID NO: 299711 - RNA, 22 nt, Human
gggaccuggcgagggucacaca

SEQ ID NO: 299712 - RNA, 22 nt, Human
gauuguaauuuucaagagguaa

SEQ ID NO: 299713 - RNA, 22 nt, Human
cagggcagagccaggauuucaa

SEQ ID NO: 299714 - RNA, 19 nt, Human
agacacacuuacguggaau

SEQ ID NO: 299715 - RNA, 22 nt, Human
agaggaauaaauuucuguagug

SEQ ID NO: 299716 - RNA, 22 nt, Human
auaaaauuugcuacuguuaaau

SEQ ID NO: 299717 - RNA, 22 nt, Human
ucuuccaagguugcacacuauc

SEQ ID NO: 299718 - RNA, 22 nt, Human
cuggauguaaagggugaagaaa

SEQ ID NO: 299719 - RNA, 22 nt, Human
cauuugaauuguucugugggaa

SEQ ID NO: 299720 - RNA, 22 nt, Human
acagggcagugucuugaaaaau

SEQ ID NO: 299721 - RNA, 22 nt, Human
aacauaauguggccaaagucac

SEQ ID NO: 299722 - RNA, 22 nt, Human
cuggaugugguaaugacuuuga

SEQ ID NO: 299723 - RNA, 21 nt, Human
gcaaguacuaucaucauuauc

SEQ ID NO: 299724 - RNA, 22 nt, Human
acaggcagguccugucccagcu

SEQ ID NO: 299725 - RNA, 22 nt, Human
cacccagcauuggcuaagagag

SEQ ID NO: 299726 - RNA, 22 nt, Human
uguuuugcuucucuguuuccca

SEQ ID NO: 299727 - RNA, 20 nt, Human
uuucaguugguuaauggcau

SEQ ID NO: 299728 - RNA, 22 nt, Human
uuugacucuugcuuugguggcu

SEQ ID NO: 299729 - RNA, 22 nt, Human
acuuuguucuaauaguaucucu

SEQ ID NO: 299730 - RNA, 17 nt, Human
aggccucccuccaggcc

SEQ ID NO: 299731 - RNA, 22 nt, Human
uuguaagaauaugaauacaaau

SEQ ID NO: 299732 - RNA, 22 nt, Human
acgugcaggaucugguuggcga

SEQ ID NO: 299733 - RNA, 22 nt, Human
aauguauuccucaugcaagagu

SEQ ID NO: 299734 - RNA, 22 nt, Human
guuuucuggcaguuauuccuua

SEQ ID NO: 299735 - RNA, 22 nt, Human
uauuggauagcuugugcagaau

SEQ ID NO: 299736 - RNA, 22 nt, Human
aaucuucuacuugacaguucuc

SEQ ID NO: 299737 - RNA, 22 nt, Human
ucucucuugucaccccaucugc

SEQ ID NO: 299738 - RNA, 22 nt, Human
ggaugaggaagauuacugagaa

SEQ ID NO: 299739 - RNA, 22 nt, Human
agaggaauaugggugcacuaga

SEQ ID NO: 299740 - RNA, 22 nt, Human
gagguguccuagaaguauucag

SEQ ID NO: 299741 - RNA, 22 nt, Human
auuauaugugggauagaauuua

SEQ ID NO: 299742 - RNA, 22 nt, Human
uuuuccagauuggacuuagucc

SEQ ID NO: 299743 - RNA, 22 nt, Human
gagggcagagacagugauucac

SEQ ID NO: 299744 - RNA, 22 nt, Human
uuugcugaccccauucugaguc

SEQ ID NO: 299745 - RNA, 21 nt, Human
auuuucauuaauucagugugg

SEQ ID NO: 299746 - RNA, 23 nt, Human
aaacaugcagcacaugaaugcua

SEQ ID NO: 299747 - RNA, 22 nt, Human
ugggcagggaucucuuuugcaa

SEQ ID NO: 299748 - RNA, 22 nt, Human
gggugggguguaucggauccua

SEQ ID NO: 299749 - RNA, 22 nt, Human
ggacauuugcaccuaccucagc

SEQ ID NO: 299750 - RNA, 22 nt, Human
uuuaauuuuccucuuccuggag

SEQ ID NO: 299751 - RNA, 22 nt, Human
agcugcaaguaagcuugcuccu

SEQ ID NO: 299752 - RNA, 22 nt, Human
uuaauuuuuauguauagugugu

SEQ ID NO: 299753 - RNA, 22 nt, Human
uacauguaauuuucauaguaag

SEQ ID NO: 299754 - RNA, 22 nt, Human
auagauuauuugcucauuacuu

SEQ ID NO: 299755 - RNA, 22 nt, Human
uuggaauucaaguuguagcuua

SEQ ID NO: 299756 - RNA, 22 nt, Human
uucuaaaaccaauucugcuucu

SEQ ID NO: 299757 - RNA, 22 nt, Human
uauuaggguaaauuugacaugc

SEQ ID NO: 299758 - RNA, 22 nt, Human
acagcaggauuuggcgauguug

SEQ ID NO: 299759 - RNA, 22 nt, Human
gggcagguggcaaagccagagg

SEQ ID NO: 299760 - RNA, 21 nt, Human
ccagcuuucccaagucccuuu

SEQ ID NO: 299761 - RNA, 19 nt, Human
acaaaugauguugcacuga

SEQ ID NO: 299762 - RNA, 22 nt, Human
guugcacaguuccucaagcagg

SEQ ID NO: 299763 - RNA, 17 nt, Human
aguguuuccuuaucauu

SEQ ID NO: 299764 - RNA, 22 nt, Human
cucuucuuggcccccaugaggg

SEQ ID NO: 299765 - RNA, 22 nt, Human
gugagcauauauguaaucguuu

SEQ ID NO: 299766 - RNA, 22 nt, Human
auucuucauaccuacugagguu

SEQ ID NO: 299767 - RNA, 22 nt, Human
auuuauuaugggauuuggcuca

SEQ ID NO: 299768 - RNA, 22 nt, Human
ucauuguauacuuuauuuauga

SEQ ID NO: 299769 - RNA, 22 nt, Human
uugaauucauuucucauugagu

SEQ ID NO: 299770 - RNA, 22 nt, Human
uuccugcuuccuggccucacaa

SEQ ID NO: 299771 - RNA, 22 nt, Human
ggaaggaaguaaaugaugcuau

SEQ ID NO: 299772 - RNA, 21 nt, Human
uccuuccuugagguccuuucc

SEQ ID NO: 299773 - RNA, 22 nt, Human
guguguccacacauacauacau

SEQ ID NO: 299774 - RNA, 22 nt, Human
cagagcauaauugacaugaggu

SEQ ID NO: 299775 - RNA, 22 nt, Human
caggugucuaauucucaccccc

SEQ ID NO: 299776 - RNA, 22 nt, Human
uuauuccaguaaucucuguaau

SEQ ID NO: 299777 - RNA, 20 nt, Human
uggcagguggccucaguucc

SEQ ID NO: 299778 - RNA, 22 nt, Human
uuuaauugauucacagucugua

SEQ ID NO: 299779 - RNA, 23 nt, Human
cacacccaucacuaagagcuccu

SEQ ID NO: 299780 - RNA, 23 nt, Human
uggagcugggcucagacccuggg

SEQ ID NO: 299781 - RNA, 22 nt, Human
aauauucaaguuauucuuucuu

SEQ ID NO: 299782 - RNA, 17 nt, Human
uuauuuuuugggcugag

SEQ ID NO: 299783 - RNA, 22 nt, Human
cagaagagaugaaauaguauua

SEQ ID NO: 299784 - RNA, 22 nt, Human
acagguguguucccggaaagcc

SEQ ID NO: 299785 - RNA, 22 nt, Human
caugaguuuuuuaguucaugca

SEQ ID NO: 299786 - RNA, 22 nt, Human
ggcaggugggaacccuccccac

SEQ ID NO: 299787 - RNA, 22 nt, Human
aaauuucaguuaccuuuacguu

SEQ ID NO: 299788 - RNA, 22 nt, Human
uuucaaagucaauaucauuacc

SEQ ID NO: 299789 - RNA, 22 nt, Human
ccagggcacuuaggcccagccc

SEQ ID NO: 299790 - RNA, 22 nt, Human
aaugaggucauuaaugguggga

SEQ ID NO: 299791 - RNA, 22 nt, Human
uugcaggggaaggagcagagcu

SEQ ID NO: 299792 - RNA, 22 nt, Human
guuauacauauguguuaacaaa

SEQ ID NO: 299793 - RNA, 22 nt, Human
cauuuguaggaugcuucuuguu

SEQ ID NO: 299794 - RNA, 22 nt, Human
gagguguccucagccaacucug

SEQ ID NO: 299795 - RNA, 22 nt, Human
uuuuccuucugauacuccauuu

SEQ ID NO: 299796 - RNA, 22 nt, Human
cucuucuugcuagacugagugc

SEQ ID NO: 299797 - RNA, 16 nt, Human
gcaggcagaucacaug

SEQ ID NO: 299798 - RNA, 22 nt, Human
cagcuguccuuccuggugggcg

SEQ ID NO: 299799 - RNA, 22 nt, Human
uuccagauuucuacacaagacc

SEQ ID NO: 299800 - RNA, 18 nt, Human
ugaccugcgcuucacggu

SEQ ID NO: 299801 - RNA, 22 nt, Human
uuauugaguaucugcuuggugu

SEQ ID NO: 299802 - RNA, 22 nt, Human
uccuccuuguucuuuugccuac

SEQ ID NO: 299803 - RNA, 19 nt, Human
agaaucaggucaggugaca

SEQ ID NO: 299804 - RNA, 22 nt, Human
uuuccuucuuagcgguguucuu

SEQ ID NO: 299805 - RNA, 22 nt, Human
ggcuuuaugcagggauagaaau

SEQ ID NO: 299806 - RNA, 22 nt, Human
auuauuguacuuucaauaaggu

SEQ ID NO: 299807 - RNA, 22 nt, Human
cuguugcucccagggagagggu

SEQ ID NO: 299808 - RNA, 22 nt, Human
aacauuguuuugcacaacucuu

SEQ ID NO: 299809 - RNA, 22 nt, Human
acagagagguaaaauauauagu

SEQ ID NO: 299810 - RNA, 22 nt, Human
gggcuccaccuagggacacugg

SEQ ID NO: 299811 - RNA, 22 nt, Human
guagggacaauauguuauuaga

SEQ ID NO: 299812 - RNA, 22 nt, Human
uucccuuccucacucuacuugu

SEQ ID NO: 299813 - RNA, 22 nt, Human
auugcuaggaacagguugcacc

SEQ ID NO: 299814 - RNA, 22 nt, Human
uggcaaagauuaccacaucuac

SEQ ID NO: 299815 - RNA, 17 nt, Human
uggucuggaagaacuga

SEQ ID NO: 299816 - RNA, 22 nt, Human
augauguugauaaauuacuuua

SEQ ID NO: 299817 - RNA, 22 nt, Human
cccaggcacaccccgaacggaa

SEQ ID NO: 299818 - RNA, 22 nt, Human
aggacaguguggaagagggugc

SEQ ID NO: 299819 - RNA, 22 nt, Human
uuucagauuaucucaacuuugg

SEQ ID NO: 299820 - RNA, 22 nt, Human
uaaugucuccaggguugaccua

SEQ ID NO: 299821 - RNA, 22 nt, Human
uuuuauugggaguccucuacug

SEQ ID NO: 299822 - RNA, 22 nt, Human
uacccagcuccucagaagacca

SEQ ID NO: 299823 - RNA, 22 nt, Human
ucuggaugauaugugaacuuga

SEQ ID NO: 299824 - RNA, 22 nt, Human
ucugcccucauugcugccugga

SEQ ID NO: 299825 - RNA, 22 nt, Human
ugcuggguggacuuggcucuca

SEQ ID NO: 299826 - RNA, 22 nt, Human
gagggcucacugagaaagcagu

SEQ ID NO: 299827 - RNA, 22 nt, Human
uugcuuuacaaaaauugauggu

SEQ ID NO: 299828 - RNA, 22 nt, Human
gguagggcaaaguagggcaccu

SEQ ID NO: 299829 - RNA, 22 nt, Human
uccaggcacagaguuggucagu

SEQ ID NO: 299830 - RNA, 22 nt, Human
uaaaguuuggcagacaauaaca

SEQ ID NO: 299831 - RNA, 22 nt, Human
uuugauuuacuggauauucuca

SEQ ID NO: 299832 - RNA, 22 nt, Human
gacugaaggucucagcauguga

SEQ ID NO: 299833 - RNA, 22 nt, Human
ggucccagcugcucaagaggcu

SEQ ID NO: 299834 - RNA, 22 nt, Human
ucaauuuauguggcuauucauu

SEQ ID NO: 299835 - RNA, 22 nt, Human
uuuucagaggccuaagagguuu

SEQ ID NO: 299836 - RNA, 22 nt, Human
uucuucuuaauguccugggaac

SEQ ID NO: 299837 - RNA, 22 nt, Human
acuacaguacuauaucuauagg

SEQ ID NO: 299838 - RNA, 22 nt, Human
auuugcuggugaaauagugaca

SEQ ID NO: 299839 - RNA, 22 nt, Human
ucauuuguaccauuuuuuaaga

SEQ ID NO: 299840 - RNA, 22 nt, Human
uuuugcugggguggcuagcuua

SEQ ID NO: 299841 - RNA, 22 nt, Human
agcagggcucacauuaguggau

SEQ ID NO: 299842 - RNA, 22 nt, Human
ggacuccucuagaaguugaggc

SEQ ID NO: 299843 - RNA, 22 nt, Human
aaauuauucucauguguuucuu

SEQ ID NO: 299844 - RNA, 22 nt, Human
uggagcugguaaacagugacau

SEQ ID NO: 299845 - RNA, 22 nt, Human
ugucuucaucucagacacaguu

SEQ ID NO: 299846 - RNA, 22 nt, Human
agggcuccgggcaggcgaugga

SEQ ID NO: 299847 - RNA, 22 nt, Human
cuucucccugggggcucuuuau

SEQ ID NO: 299848 - RNA, 22 nt, Human
cagauucucacuguauucaggu

SEQ ID NO: 299849 - RNA, 22 nt, Human
ggagcugagacccaguggcuga

SEQ ID NO: 299850 - RNA, 22 nt, Human
uagacaggaaacauuaggaugg

SEQ ID NO: 299851 - RNA, 22 nt, Human
ucuccauuuuauagauaaugaa

SEQ ID NO: 299852 - RNA, 22 nt, Human
cuuuaagagaucaccaaucaca

SEQ ID NO: 299853 - RNA, 22 nt, Human
aauuagggaaaauuuacuugua

SEQ ID NO: 299854 - RNA, 22 nt, Human
cacaauuuguuuuaucaguauu

SEQ ID NO: 299855 - RNA, 22 nt, Human
ccuucuccugccuuggguucau

SEQ ID NO: 299856 - RNA, 22 nt, Human
auuucuguggcuucauucuccu

SEQ ID NO: 299857 - RNA, 22 nt, Human
uuuccaugaucguuauagaacu

SEQ ID NO: 299858 - RNA, 22 nt, Human
ugacaggucauauaagcuugca

SEQ ID NO: 299859 - RNA, 22 nt, Human
cccaugagaccugguuuaaggc

SEQ ID NO: 299860 - RNA, 22 nt, Human
uugcugauucaugauuugagaa

SEQ ID NO: 299861 - RNA, 22 nt, Human
uuauucugcacuuuuaaaauau

SEQ ID NO: 299862 - RNA, 22 nt, Human
uugaaaacuuucuagaccaaga

SEQ ID NO: 299863 - RNA, 22 nt, Human
cagacagguugcaaaacuucaa

SEQ ID NO: 299864 - RNA, 18 nt, Human
ugaggcagucagugaugg

SEQ ID NO: 299865 - RNA, 23 nt, Human
uggcaaggaaugggauggagacu

SEQ ID NO: 299866 - RNA, 22 nt, Human
ugaguacucggagugcuuugga

SEQ ID NO: 299867 - RNA, 22 nt, Human
ccagggcagggaccacgugucu

SEQ ID NO: 299868 - RNA, 22 nt, Human
uagaaacagaaaacuguaauag

SEQ ID NO: 299869 - RNA, 21 nt, Human
cagacccucuagaggccaccu

SEQ ID NO: 299870 - RNA, 22 nt, Human
acaaaugugucuaauugugccu

SEQ ID NO: 299871 - RNA, 22 nt, Human
aagcugcagaugugccugugga

SEQ ID NO: 299872 - RNA, 22 nt, Human
uccucccuguaccauuccucug

SEQ ID NO: 299873 - RNA, 22 nt, Human
uguguuuugaacucaucuacug

SEQ ID NO: 299874 - RNA, 19 nt, Human
uggaggaaguauauuucau

SEQ ID NO: 299875 - RNA, 22 nt, Human
ggacaugugcaacuucuuugga

SEQ ID NO: 299876 - RNA, 22 nt, Human
aaggugguugcaauuaccauaa

SEQ ID NO: 299877 - RNA, 22 nt, Human
aauggaauaccuagguggccca

SEQ ID NO: 299878 - RNA, 22 nt, Human
auuguaaauagugccacaauaa

SEQ ID NO: 299879 - RNA, 22 nt, Human
cucuggaauugaccugggaggg

SEQ ID NO: 299880 - RNA, 16 nt, Human
gcagguggaucaccug

SEQ ID NO: 299881 - RNA, 21 nt, Human
agggaaaaggcugagugaggg

SEQ ID NO: 299882 - RNA, 22 nt, Human
agggcucugagcuggaccaccu

SEQ ID NO: 299883 - RNA, 22 nt, Human
gcaguguuuacauauuagaaac

SEQ ID NO: 299884 - RNA, 22 nt, Human
gccuggagggauagaaugcaag

SEQ ID NO: 299885 - RNA, 16 nt, Human
ucagggcagaauggca

SEQ ID NO: 299886 - RNA, 23 nt, Human
uggaccugaaccagugccucugu

SEQ ID NO: 299887 - RNA, 22 nt, Human
cuggauccuucucuguguauuu

SEQ ID NO: 299888 - RNA, 22 nt, Human
auguccaguuucuacacacaua

SEQ ID NO: 299889 - RNA, 22 nt, Human
uccuucugaaaaaugcacacga

SEQ ID NO: 299890 - RNA, 22 nt, Human
uggaaauggaucugaugagucu

SEQ ID NO: 299891 - RNA, 22 nt, Human
ugaagcuuuccuguggucagga

SEQ ID NO: 299892 - RNA, 22 nt, Human
acacauaagccuaaucaucucc

SEQ ID NO: 299893 - RNA, 22 nt, Human
acauuguaaauaccuuuaucac

SEQ ID NO: 299894 - RNA, 22 nt, Human
cacuggaauucaagauacugag

SEQ ID NO: 299895 - RNA, 22 nt, Human
uccuccuuguuuuccuguuuac

SEQ ID NO: 299896 - RNA, 22 nt, Human
cagaggcagacccuccagggcg

SEQ ID NO: 299897 - RNA, 22 nt, Human
cucuuuccucagccacagucua

SEQ ID NO: 299898 - RNA, 22 nt, Human
gugggugucaguaucuuuaacg

SEQ ID NO: 299899 - RNA, 22 nt, Human
uggaccugcguaggugcugggc

SEQ ID NO: 299900 - RNA, 22 nt, Human
uuuaaaaaacuagucugagucu

SEQ ID NO: 299901 - RNA, 21 nt, Human
ugggaccuauuucaacuggau

SEQ ID NO: 299902 - RNA, 22 nt, Human
acaauacuauuuucaguauccu

SEQ ID NO: 299903 - RNA, 22 nt, Human
caccugcaaggagcuuucauuu

SEQ ID NO: 299904 - RNA, 22 nt, Human
cagugaggcucugcugagcggu

SEQ ID NO: 299905 - RNA, 22 nt, Human
auuauuauuguugauguuaggg

SEQ ID NO: 299906 - RNA, 22 nt, Human
cagcaugacagucugcagcaga

SEQ ID NO: 299907 - RNA, 19 nt, Human
aaagcagaggagcaucuga

SEQ ID NO: 299908 - RNA, 22 nt, Human
acauguguggacaugaaucuac

SEQ ID NO: 299909 - RNA, 22 nt, Human
uaugugucaaaccauucaucug

SEQ ID NO: 299910 - RNA, 22 nt, Human
uucagagaagcaaaggcagauu

SEQ ID NO: 299911 - RNA, 22 nt, Human
acagauuuuauuauucagguau

SEQ ID NO: 299912 - RNA, 22 nt, Human
aguauugugacucaaguauucu

SEQ ID NO: 299913 - RNA, 22 nt, Human
ucagagagcagaacuuuuuuac

SEQ ID NO: 299914 - RNA, 22 nt, Human
uugcagcuucgagucuaucugu

SEQ ID NO: 299915 - RNA, 22 nt, Human
uauuugaagauucuucugaugu

SEQ ID NO: 299916 - RNA, 20 nt, Human
uugagcuuuuaguacagaca

SEQ ID NO: 299917 - RNA, 20 nt, Human
gagcaguggaguuuccaggg

SEQ ID NO: 299918 - RNA, 22 nt, Human
cuucuucacacuggucugaagc

SEQ ID NO: 299919 - RNA, 22 nt, Human
gcuggaggaucacuugagccca

SEQ ID NO: 299920 - RNA, 18 nt, Human
uuucacagauucaugacu

SEQ ID NO: 299921 - RNA, 22 nt, Human
cuuccugcccacuuccugcugg

SEQ ID NO: 299922 - RNA, 22 nt, Human
uucauaaugagguccuagaggc

SEQ ID NO: 299923 - RNA, 20 nt, Human
uuucuguaaggcauuaaucu

SEQ ID NO: 299924 - RNA, 17 nt, Human
ccaggugggaggugggg

SEQ ID NO: 299925 - RNA, 22 nt, Human
uacauguggaguuuucuaguca

SEQ ID NO: 299926 - RNA, 22 nt, Human
aaauuucuguuguuuugagcca

SEQ ID NO: 299927 - RNA, 22 nt, Human
gguuucaaaguggacaguuagu

SEQ ID NO: 299928 - RNA, 22 nt, Human
uugugcaauuuaaaaucuuccu

SEQ ID NO: 299929 - RNA, 22 nt, Human
agagugauucuaguuagggaau

SEQ ID NO: 299930 - RNA, 22 nt, Human
ugcagggcagauaugacuguag

SEQ ID NO: 299931 - RNA, 18 nt, Human
uggcagggaggaaauaua

SEQ ID NO: 299932 - RNA, 22 nt, Human
guuuacaugcagaaaaucaaug

SEQ ID NO: 299933 - RNA, 22 nt, Human
cagugagggcccccuuccaggu

SEQ ID NO: 299934 - RNA, 22 nt, Human
ugcagggacaggcucuggggau

SEQ ID NO: 299935 - RNA, 22 nt, Human
uuccuucuggagcccggggagc

SEQ ID NO: 299936 - RNA, 20 nt, Human
cauuugaaucuccauucugc

SEQ ID NO: 299937 - RNA, 22 nt, Human
ccagagagcuacaaggcauaaa

SEQ ID NO: 299938 - RNA, 22 nt, Human
gcuguucauagaaauggucuca

SEQ ID NO: 299939 - RNA, 22 nt, Human
gaaugaauuuuggauggugaag

SEQ ID NO: 299940 - RNA, 19 nt, Human
uagguguccgccggaggug

SEQ ID NO: 299941 - RNA, 22 nt, Human
cauuugaaugagauugcuguaa

SEQ ID NO: 299942 - RNA, 22 nt, Human
uguugcuguaugaauaggaagg

SEQ ID NO: 299943 - RNA, 20 nt, Human
gcaggcagggaaugggggug

SEQ ID NO: 299944 - RNA, 22 nt, Human
cuaaaugucauggaguuguaga

SEQ ID NO: 299945 - RNA, 22 nt, Human
ucaggaaagaguaauguauaca

SEQ ID NO: 299946 - RNA, 22 nt, Human
uguuaggguccugugcaggggc

SEQ ID NO: 299947 - RNA, 22 nt, Human
aaagauuuaagaauaauuugug

SEQ ID NO: 299948 - RNA, 14 nt, Human
gcagguggaucacc

SEQ ID NO: 299949 - RNA, 22 nt, Human
auuuauuaagcaucugcuaugu

SEQ ID NO: 299950 - RNA, 22 nt, Human
auguuucaaauauauagaguug

SEQ ID NO: 299951 - RNA, 22 nt, Human
uguuucugucuguuuucuacau

SEQ ID NO: 299952 - RNA, 22 nt, Human
ucagcuuucucaaagaagcugg

SEQ ID NO: 299953 - RNA, 22 nt, Human
aagccggcugggccgaggcugc

SEQ ID NO: 299954 - RNA, 22 nt, Human
caugaggugauaaagcugggau

SEQ ID NO: 299955 - RNA, 22 nt, Human
ucagggaccccucugaguggag

SEQ ID NO: 299956 - RNA, 22 nt, Human
ugagaaugaaucuuuugcuuuc

SEQ ID NO: 299957 - RNA, 22 nt, Human
ugaacaacugcaaaaaucucca

SEQ ID NO: 299958 - RNA, 22 nt, Human
cagggcauaagaugaggcugua

SEQ ID NO: 299959 - RNA, 22 nt, Human
auuucuguauccugcugucaga

SEQ ID NO: 299960 - RNA, 22 nt, Human
aagcugcagguugaauccaggu

SEQ ID NO: 299961 - RNA, 22 nt, Human
agauggucaaggauacuguuca

SEQ ID NO: 299962 - RNA, 22 nt, Human
acuugaauuauauuucuagaga

SEQ ID NO: 299963 - RNA, 22 nt, Human
uaggugucuaacaauaagugua

SEQ ID NO: 299964 - RNA, 22 nt, Human
ccaggcaggcgauggugcagug

SEQ ID NO: 299965 - RNA, 19 nt, Human
uggcagguagugagcaguc

SEQ ID NO: 299966 - RNA, 22 nt, Human
uccugcaggccuguucccagua

SEQ ID NO: 299967 - RNA, 23 nt, Human
cuguccuguaguucacguuggcc

SEQ ID NO: 299968 - RNA, 22 nt, Human
uuccaggaacagaugaagguug

SEQ ID NO: 299969 - RNA, 22 nt, Human
ucagagagaaauaguuuuugac

SEQ ID NO: 299970 - RNA, 22 nt, Human
ucuucacauggaacaugaagcu

SEQ ID NO: 299971 - RNA, 22 nt, Human
uuuacagaucuguugauuuguu

SEQ ID NO: 299972 - RNA, 22 nt, Human
uuucuguaaguggcaaauaaug

SEQ ID NO: 299973 - RNA, 22 nt, Human
auugaguaccuccagauucaua

SEQ ID NO: 299974 - RNA, 22 nt, Human
cuccauugaacauccucucaga

SEQ ID NO: 299975 - RNA, 23 nt, Human
ccagugauugccuggaaggaggu

SEQ ID NO: 299976 - RNA, 22 nt, Human
cugggcugcaguuccugguccu

SEQ ID NO: 299977 - RNA, 22 nt, Human
ggcaggcagccuccauccacag

SEQ ID NO: 299978 - RNA, 22 nt, Human
gaugagguaagaauguaacacc

SEQ ID NO: 299979 - RNA, 22 nt, Human
cuggaggagcauggacuggagu

SEQ ID NO: 299980 - RNA, 22 nt, Human
uggaaagucucuuuugacugua

SEQ ID NO: 299981 - RNA, 19 nt, Human
ugggcagguucaguaaugg

SEQ ID NO: 299982 - RNA, 22 nt, Human
ggguaggaugguagaagggacc

SEQ ID NO: 299983 - RNA, 22 nt, Human
aaauauagugacacuuauaguc

SEQ ID NO: 299984 - RNA, 19 nt, Human
cugcagggaugugcagagu

SEQ ID NO: 299985 - RNA, 22 nt, Human
ucuguucagguuucagagaacu

SEQ ID NO: 299986 - RNA, 16 nt, Human
auuuccagauuaugca

SEQ ID NO: 299987 - RNA, 22 nt, Human
ccagcuuuuggggugacaauuu

SEQ ID NO: 299988 - RNA, 22 nt, Human
uaacaauaguguuugcuaguca

SEQ ID NO: 299989 - RNA, 22 nt, Human
uuucuucauagaccuugucuug

SEQ ID NO: 299990 - RNA, 22 nt, Human
cuauuacauuucuggacauuca

SEQ ID NO: 299991 - RNA, 22 nt, Human
cuuguauuaggaagaaugcuuu

SEQ ID NO: 299992 - RNA, 19 nt, Human
gcugggugggguccacagc

SEQ ID NO: 299993 - RNA, 22 nt, Human
ugcuuuauucgacaucugguag

SEQ ID NO: 299994 - RNA, 17 nt, Human
aaggaaugucagaaguu

SEQ ID NO: 299995 - RNA, 22 nt, Human
gguaaaaugcagauucuuagcc

SEQ ID NO: 299996 - RNA, 18 nt, Human
auugcuuuuguaccaacc

SEQ ID NO: 299997 - RNA, 22 nt, Human
agaauucugacaauagaauugg

SEQ ID NO: 299998 - RNA, 22 nt, Human
cauuuaagagaaauauuuaguu

SEQ ID NO: 299999 - RNA, 22 nt, Human
uuuaaauuuguguuuagagggu

SEQ ID NO: 300000 - RNA, 22 nt, Human
auacuuuggucacuauuauugg

SEQ ID NO: 300001 - RNA, 22 nt, Human
uuuuauugucaaugaagacaga

SEQ ID NO: 300002 - RNA, 22 nt, Human
ugccuugcacauaauauacauu

SEQ ID NO: 300003 - RNA, 22 nt, Human
gguguccucaugauuuucuaga

SEQ ID NO: 300004 - RNA, 22 nt, Human
cuggaggaauaaucuccuaccc

SEQ ID NO: 300005 - RNA, 22 nt, Human
gacuuuaugaagagaugaccaa

SEQ ID NO: 300006 - RNA, 22 nt, Human
ccagggcaugggaagaacugaa

SEQ ID NO: 300007 - RNA, 22 nt, Human
cacgcauguggaucagaugaag

SEQ ID NO: 300008 - RNA, 22 nt, Human
cucuuccucucaugcggucaua

SEQ ID NO: 300009 - RNA, 22 nt, Human
uucuucagacuacugaugauug

SEQ ID NO: 300010 - RNA, 22 nt, Human
cuuuuucuucuaggugugccug

SEQ ID NO: 300011 - RNA, 22 nt, Human
acagggcaccugagguaggaag

SEQ ID NO: 300012 - RNA, 22 nt, Human
ggaccugccagaacucaggcua

SEQ ID NO: 300013 - RNA, 22 nt, Human
uuucugaagggcagcagacucu

SEQ ID NO: 300014 - RNA, 22 nt, Human
auuaauuuuaccuuuguaaaca

SEQ ID NO: 300015 - RNA, 22 nt, Human
cuggaggccacuguacagauug

SEQ ID NO: 300016 - RNA, 22 nt, Human
ucagagagccucaggcacugcc

SEQ ID NO: 300017 - RNA, 22 nt, Human
ggcaggugcucugugggccugg

SEQ ID NO: 300018 - RNA, 22 nt, Human
uggagcagggcaucacugugcg

SEQ ID NO: 300019 - RNA, 22 nt, Human
aaagcugcccagcugccuguuu

SEQ ID NO: 300020 - RNA, 22 nt, Human
aaagcaugauuagauagaugau

SEQ ID NO: 300021 - RNA, 22 nt, Human
uguccuuuguguaucuauagua

SEQ ID NO: 300022 - RNA, 22 nt, Human
guacacauauauuaaaaauugu

SEQ ID NO: 300023 - RNA, 22 nt, Human
ucaggaaauggcuucaugguuu

SEQ ID NO: 300024 - RNA, 22 nt, Human
ugcugaggcagaugucugugac

SEQ ID NO: 300025 - RNA, 22 nt, Human
uaaguucauaagcuuauucuua

SEQ ID NO: 300026 - RNA, 22 nt, Human
uucaaauuaccacauuugcuua

SEQ ID NO: 300027 - RNA, 22 nt, Human
ggaugucuuuacuuugggauuu

SEQ ID NO: 300028 - RNA, 22 nt, Human
uugaaauaucaaguuauuagug

SEQ ID NO: 300029 - RNA, 22 nt, Human
uacccaggaggaaacugaggcu

SEQ ID NO: 300030 - RNA, 22 nt, Human
auuaaauuaaguggcuaauuua

SEQ ID NO: 300031 - RNA, 22 nt, Human
uacaugugcacgugugacuuug

SEQ ID NO: 300032 - RNA, 19 nt, Human
uccugcagguggcuugcag

SEQ ID NO: 300033 - RNA, 22 nt, Human
auuuccaugaaguuuaguuaua

SEQ ID NO: 300034 - RNA, 22 nt, Human
acagguggaggcuuuaggaggu

SEQ ID NO: 300035 - RNA, 22 nt, Human
cagacaggaaguucagaagaaa

SEQ ID NO: 300036 - RNA, 22 nt, Human
agguaaaauagauaguauuucu

SEQ ID NO: 300037 - RNA, 23 nt, Human
caggugguagagaaaaauccaga

SEQ ID NO: 300038 - RNA, 20 nt, Human
uacaauauucccacuuugcu

SEQ ID NO: 300039 - RNA, 22 nt, Human
ccagcuuuucagaaucugccug

SEQ ID NO: 300040 - RNA, 22 nt, Human
uuauugcucuauuauggccuaa

SEQ ID NO: 300041 - RNA, 22 nt, Human
ucagagaggauuuuaauaagug

SEQ ID NO: 300042 - RNA, 22 nt, Human
ucuaggguccacagggucagcc

SEQ ID NO: 300043 - RNA, 17 nt, Human
acagggcagaaacagcu

SEQ ID NO: 300044 - RNA, 22 nt, Human
uuucuauaugaggagcuaaagu

SEQ ID NO: 300045 - RNA, 22 nt, Human
agucugcuuccuggagaacuca

SEQ ID NO: 300046 - RNA, 17 nt, Human
aguggcaggcagauggg

SEQ ID NO: 300047 - RNA, 22 nt, Human
ugcuggaggggaugccuucacu

SEQ ID NO: 300048 - RNA, 22 nt, Human
agcuuuaucuucaccugggaau

SEQ ID NO: 300049 - RNA, 22 nt, Human
uucagagagaaaccagugggaa

SEQ ID NO: 300050 - RNA, 22 nt, Human
acagcaggaagcuggagggaaa

SEQ ID NO: 300051 - RNA, 22 nt, Human
auguuauuaaaguacagauucu

SEQ ID NO: 300052 - RNA, 22 nt, Human
gagcagugacuggagcaugaga

SEQ ID NO: 300053 - RNA, 22 nt, Human
uuaguuuucccaucuuuauggu

SEQ ID NO: 300054 - RNA, 19 nt, Human
auggaaaaugccagacuga

SEQ ID NO: 300055 - RNA, 22 nt, Human
uuaguuaguggggcugucaguc

SEQ ID NO: 300056 - RNA, 22 nt, Human
guccagagauggacgagcagau

SEQ ID NO: 300057 - RNA, 22 nt, Human
cuggcccauggugagcucuggg

SEQ ID NO: 300058 - RNA, 22 nt, Human
cccugcagagagugcuuuugug

SEQ ID NO: 300059 - RNA, 22 nt, Human
guucuucagcauuagaagucau

SEQ ID NO: 300060 - RNA, 22 nt, Human
auguguccauuaucaguucugg

SEQ ID NO: 300061 - RNA, 22 nt, Human
ucaaucacguguuccauguucu

SEQ ID NO: 300062 - RNA, 22 nt, Human
gcugauagacugaauguuggga

SEQ ID NO: 300063 - RNA, 23 nt, Human
agguggucuuguggaugcugcaa

SEQ ID NO: 300064 - RNA, 22 nt, Human
uguuuauucauggcuaaugaaa

SEQ ID NO: 300065 - RNA, 22 nt, Human
auauaauacaaccugcuaagug

SEQ ID NO: 300066 - RNA, 22 nt, Human
gccaggcagcugggagggugcc

SEQ ID NO: 300067 - RNA, 22 nt, Human
uuccaggagacuuccagaaaua

SEQ ID NO: 300068 - RNA, 22 nt, Human
uaucaauacauguuaucagugu

SEQ ID NO: 300069 - RNA, 22 nt, Human
acacuuggagcaacacuuaugg

SEQ ID NO: 300070 - RNA, 22 nt, Human
ccaaagucagugcucagucguc

SEQ ID NO: 300071 - RNA, 22 nt, Human
aauuaguaaccuaauuccaucu

SEQ ID NO: 300072 - RNA, 22 nt, Human
auaauauaauccuacuucccau

SEQ ID NO: 300073 - RNA, 18 nt, Human
caggaauggaugggauuu

SEQ ID NO: 300074 - RNA, 22 nt, Human
uuuacuuguucugcugaauucu

SEQ ID NO: 300075 - RNA, 22 nt, Human
agugugagauuaaaccgaauca

SEQ ID NO: 300076 - RNA, 22 nt, Human
gacaggcuucaugauggcagga

SEQ ID NO: 300077 - RNA, 22 nt, Human
uaaauucagugaguaauuucug

SEQ ID NO: 300078 - RNA, 22 nt, Human
gggcagguguuuccaaggugag

SEQ ID NO: 300079 - RNA, 22 nt, Human
uugugucccuggagcuucugug

SEQ ID NO: 300080 - RNA, 22 nt, Human
uacauaaugagcuaguuaaguu

SEQ ID NO: 300081 - RNA, 22 nt, Human
cuuccuucuguaagaccaguug

SEQ ID NO: 300082 - RNA, 22 nt, Human
guugcugggagcagggauccug

SEQ ID NO: 300083 - RNA, 22 nt, Human
agaggcaugaucuuauaauuua

SEQ ID NO: 300084 - RNA, 22 nt, Human
uucuucuucaagugcugcauuc

SEQ ID NO: 300085 - RNA, 22 nt, Human
uacauagugaacauuuacagag

SEQ ID NO: 300086 - RNA, 22 nt, Human
agugugaguaauugagucuguc

SEQ ID NO: 300087 - RNA, 22 nt, Human
uugcuggggugugaaaucugau

SEQ ID NO: 300088 - RNA, 22 nt, Human
gauccugugcauggggugaugg

SEQ ID NO: 300089 - RNA, 21 nt, Human
uagcuuuaauauucccacauu

SEQ ID NO: 300090 - RNA, 22 nt, Human
uccuggguagagaccugaugaa

SEQ ID NO: 300091 - RNA, 22 nt, Human
gguguccugucagcuagaguga

SEQ ID NO: 300092 - RNA, 22 nt, Human
uucuucaaacaaaaguggcaug

SEQ ID NO: 300093 - RNA, 22 nt, Human
ucuucagacccuuagcugugau

SEQ ID NO: 300094 - RNA, 22 nt, Human
ugcuuuauaucucucuucuuag

SEQ ID NO: 300095 - RNA, 18 nt, Human
ggcggguguuuuauucac

SEQ ID NO: 300096 - RNA, 22 nt, Human
cccagcucugcagaccugcccu

SEQ ID NO: 300097 - RNA, 22 nt, Human
uaaauuauggcuggcagagcag

SEQ ID NO: 300098 - RNA, 22 nt, Human
uuugaaguaccugguucugacu

SEQ ID NO: 300099 - RNA, 22 nt, Human
ucucuuucuauaugugagucuu

SEQ ID NO: 300100 - RNA, 22 nt, Human
uuauugaaauggaagcuauaac

SEQ ID NO: 300101 - RNA, 22 nt, Human
ccugcagggaaucgaggcagaa

SEQ ID NO: 300102 - RNA, 22 nt, Human
aagaaaagauguuugguuuuca

SEQ ID NO: 300103 - RNA, 22 nt, Human
guguccuuaugcauaccagagu

SEQ ID NO: 300104 - RNA, 23 nt, Human
aucauucuccaaucuggagcagg

SEQ ID NO: 300105 - RNA, 22 nt, Human
gcuuccuuccuuacauuggugg

SEQ ID NO: 300106 - RNA, 22 nt, Human
uuuauuguguugaaacugaauu

SEQ ID NO: 300107 - RNA, 22 nt, Human
ucauuucaaugauacuacuaag

SEQ ID NO: 300108 - RNA, 18 nt, Human
ccagguggugacagagau

SEQ ID NO: 300109 - RNA, 22 nt, Human
caggauggccccggggcugugc

SEQ ID NO: 300110 - RNA, 22 nt, Human
cuauuaggcuuccauuucaugc

SEQ ID NO: 300111 - RNA, 22 nt, Human
uucucagugaaguuuagaacau

SEQ ID NO: 300112 - RNA, 22 nt, Human
acaugcauaggagaagucuuua

SEQ ID NO: 300113 - RNA, 22 nt, Human
uauguacacacacaugcaugua

SEQ ID NO: 300114 - RNA, 22 nt, Human
uucuuaacuggaaaaugucaga

SEQ ID NO: 300115 - RNA, 22 nt, Human
auuguuaaacugaagcauuacu

SEQ ID NO: 300116 - RNA, 22 nt, Human
cauuaaaauaucucaugguguu

SEQ ID NO: 300117 - RNA, 22 nt, Human
uggacauguaaaggcucaaggu

SEQ ID NO: 300118 - RNA, 22 nt, Human
uaaauuguuuucuagaaguugu

SEQ ID NO: 300119 - RNA, 22 nt, Human
ucugaagacauaugauauggug

SEQ ID NO: 300120 - RNA, 22 nt, Human
uuuauuuauccuucuggauugc

SEQ ID NO: 300121 - RNA, 22 nt, Human
ucuuccugaaacccuguuccag

SEQ ID NO: 300122 - RNA, 22 nt, Human
ucagguggcuuggagggggacg

SEQ ID NO: 300123 - RNA, 22 nt, Human
cugaaauucugccucugcacaa

SEQ ID NO: 300124 - RNA, 22 nt, Human
ccagagaccagaacauggggau

SEQ ID NO: 300125 - RNA, 22 nt, Human
ucauguguguuucauguaugga

SEQ ID NO: 300126 - RNA, 22 nt, Human
uccuuuaugugaguuguuuccc

SEQ ID NO: 300127 - RNA, 23 nt, Human
ggagaggggugugggcaucuuua

SEQ ID NO: 300128 - RNA, 22 nt, Human
aaauuaguacauugcaaagucc

SEQ ID NO: 300129 - RNA, 22 nt, Human
aauuaugauuggucuaaaccag

SEQ ID NO: 300130 - RNA, 20 nt, Human
cuucuucauuaacccuacug

SEQ ID NO: 300131 - RNA, 22 nt, Human
caggacagugcagguccauccu

SEQ ID NO: 300132 - RNA, 20 nt, Human
cuuuaguuauuaacagcacu

SEQ ID NO: 300133 - RNA, 22 nt, Human
auuaaauguuccuuaaauuaua

SEQ ID NO: 300134 - RNA, 22 nt, Human
uacuagaaauuaccuucucacu

SEQ ID NO: 300135 - RNA, 22 nt, Human
uauugguaucugagacagaguu

SEQ ID NO: 300136 - RNA, 22 nt, Human
ccaggccugugcaaggagggag

SEQ ID NO: 300137 - RNA, 22 nt, Human
uguguuauugccacugaagacc

SEQ ID NO: 300138 - RNA, 22 nt, Human
aauugcuuuucaaggguacagc

SEQ ID NO: 300139 - RNA, 22 nt, Human
uccaggcaucccccaggacaga

SEQ ID NO: 300140 - RNA, 22 nt, Human
ucuggcucauacaagccugcaa

SEQ ID NO: 300141 - RNA, 22 nt, Human
uuguaaaugaccuuuucuaauu

SEQ ID NO: 300142 - RNA, 22 nt, Human
ugagcagaacacgggauccaug

SEQ ID NO: 300143 - RNA, 22 nt, Human
uacccagcuucaagucaggacu

SEQ ID NO: 300144 - RNA, 20 nt, Human
aagggcagagggaacagacu

SEQ ID NO: 300145 - RNA, 20 nt, Human
ucccaggcuccacccuagac

SEQ ID NO: 300146 - RNA, 22 nt, Human
auuucacaaagaacagaugcag

SEQ ID NO: 300147 - RNA, 22 nt, Human
gguaggaguauuuugcagcagu

SEQ ID NO: 300148 - RNA, 22 nt, Human
cugcagggugacguugcccacc

SEQ ID NO: 300149 - RNA, 19 nt, Human
uccugaaaacuucuggaau

SEQ ID NO: 300150 - RNA, 22 nt, Human
auucagcagccauggcuucuga

SEQ ID NO: 300151 - RNA, 22 nt, Human
gcagguggucacucauccccag

SEQ ID NO: 300152 - RNA, 22 nt, Human
aaauuuaaggaggugcucacuu

SEQ ID NO: 300153 - RNA, 21 nt, Human
uccugcagggcagcagagugg

SEQ ID NO: 300154 - RNA, 22 nt, Human
acagcuuuuaugggaccagcca

SEQ ID NO: 300155 - RNA, 20 nt, Human
cucuuaaauguaaaguaggc

SEQ ID NO: 300156 - RNA, 22 nt, Human
uccaggcaggguuaaggguccu

SEQ ID NO: 300157 - RNA, 22 nt, Human
uguguccugcaggugcugccug

SEQ ID NO: 300158 - RNA, 22 nt, Human
gugagacacgugugugaccugg

SEQ ID NO: 300159 - RNA, 20 nt, Human
cugaacacagaauaagcaca

SEQ ID NO: 300160 - RNA, 22 nt, Human
aguuugaaaguauugacagaag

SEQ ID NO: 300161 - RNA, 19 nt, Human
ggcaggugugcuuaugcuu

SEQ ID NO: 300162 - RNA, 22 nt, Human
uguccuggagacacaagguggu

SEQ ID NO: 300163 - RNA, 19 nt, Human
uccuccuuacuuccucuug

SEQ ID NO: 300164 - RNA, 22 nt, Human
ucauuguauucagaacugaaga

SEQ ID NO: 300165 - RNA, 22 nt, Human
aagcugcaugaaguugaguaga

SEQ ID NO: 300166 - RNA, 22 nt, Human
agacacugaaucagagggacau

SEQ ID NO: 300167 - RNA, 22 nt, Human
guuaaauucgaugauggauaaa

SEQ ID NO: 300168 - RNA, 22 nt, Human
uagggacaaagagcugaggccu

SEQ ID NO: 300169 - RNA, 22 nt, Human
uccagauggauuuaagaccuaa

SEQ ID NO: 300170 - RNA, 22 nt, Human
gccaggcaggugucggagcccu

SEQ ID NO: 300171 - RNA, 22 nt, Human
uuaaacauuuauggaggcagca

SEQ ID NO: 300172 - RNA, 22 nt, Human
ugacauguccugagaagauggc

SEQ ID NO: 300173 - RNA, 22 nt, Human
ugucuggggaacugugcaucca

SEQ ID NO: 300174 - RNA, 22 nt, Human
ggagagggggcucccugcuugg

SEQ ID NO: 300175 - RNA, 22 nt, Human
aucagagauggcuccagugcuc

SEQ ID NO: 300176 - RNA, 22 nt, Human
guuaauuugcagcuuucgagcu

SEQ ID NO: 300177 - RNA, 22 nt, Human
gcugccacgaucucugcuguag

SEQ ID NO: 300178 - RNA, 22 nt, Human
auuucucagcacuuccuaucuc

SEQ ID NO: 300179 - RNA, 22 nt, Human
cagcuucuucaguccuggagcu

SEQ ID NO: 300180 - RNA, 22 nt, Human
uggacauguccggccagacaau

SEQ ID NO: 300181 - RNA, 22 nt, Human
aaaucucaauuugaauuguagc

SEQ ID NO: 300182 - RNA, 22 nt, Human
ucauuugugugagugauuugac

SEQ ID NO: 300183 - RNA, 23 nt, Human
cacagguguuucaucuucucagu

SEQ ID NO: 300184 - RNA, 22 nt, Human
ucugagguggacgauggagccu

SEQ ID NO: 300185 - RNA, 22 nt, Human
aaauuauuaugccccucuauaa

SEQ ID NO: 300186 - RNA, 22 nt, Human
ccagagagguagcuuacccucu

SEQ ID NO: 300187 - RNA, 22 nt, Human
gaauuguauugauuuuucagag

SEQ ID NO: 300188 - RNA, 22 nt, Human
uuguauuuggguaguauagaga

SEQ ID NO: 300189 - RNA, 22 nt, Human
uacaugugauaaauugauuaaa

SEQ ID NO: 300190 - RNA, 22 nt, Human
gcaaauacauguugagcaccua

SEQ ID NO: 300191 - RNA, 22 nt, Human
agcagggcuuugucucugugaa

SEQ ID NO: 300192 - RNA, 22 nt, Human
acagggcagagggcaguuggua

SEQ ID NO: 300193 - RNA, 22 nt, Human
gggcuggaggagauccagaggc

SEQ ID NO: 300194 - RNA, 22 nt, Human
uguauacaugucugugugcaca

SEQ ID NO: 300195 - RNA, 20 nt, Human
aacuuguucuaccuguuuca

SEQ ID NO: 300196 - RNA, 22 nt, Human
cuuaauuuaagccuagaaugca

SEQ ID NO: 300197 - RNA, 22 nt, Human
cagggcucccugcagccucugu

SEQ ID NO: 300198 - RNA, 16 nt, Human
cuacccagugagaagg

SEQ ID NO: 300199 - RNA, 22 nt, Human
gucuucuuuaaccuacuaaagc

SEQ ID NO: 300200 - RNA, 22 nt, Human
guaaucucagcuacuugggagg

SEQ ID NO: 300201 - RNA, 22 nt, Human
agcugcaaguccaaaggaauua

SEQ ID NO: 300202 - RNA, 22 nt, Human
aaaagucucucugaguaaaagu

SEQ ID NO: 300203 - RNA, 22 nt, Human
auuuacauuuauuugagaaggu

SEQ ID NO: 300204 - RNA, 23 nt, Human
agucuucauuguauuuccagacc

SEQ ID NO: 300205 - RNA, 22 nt, Human
ggacaggugugaggcuggcaca

SEQ ID NO: 300206 - RNA, 22 nt, Human
ucaggcaggcucagaggaaaac

SEQ ID NO: 300207 - RNA, 22 nt, Human
auuucacaucuaucucagauuu

SEQ ID NO: 300208 - RNA, 22 nt, Human
uauugguaugguaagaauugaa

SEQ ID NO: 300209 - RNA, 22 nt, Human
augagacuaccuguaauguggc

SEQ ID NO: 300210 - RNA, 22 nt, Human
gcagcuuuguaaaguaugaagc

SEQ ID NO: 300211 - RNA, 22 nt, Human
cagacugaguggauuaaacaau

SEQ ID NO: 300212 - RNA, 22 nt, Human
acauuuuaauaugcuuagugug

SEQ ID NO: 300213 - RNA, 22 nt, Human
uuccagugaugggcaauuuggu

SEQ ID NO: 300214 - RNA, 22 nt, Human
gcagggaccagggccagaucca

SEQ ID NO: 300215 - RNA, 22 nt, Human
guuuuauaugucucugcugaca

SEQ ID NO: 300216 - RNA, 22 nt, Human
ucauucuuuaccaaguugucac

SEQ ID NO: 300217 - RNA, 22 nt, Human
ucagacagagaaguacaaugag

SEQ ID NO: 300218 - RNA, 22 nt, Human
aggcucccaagcacugacccca

SEQ ID NO: 300219 - RNA, 22 nt, Human
uuugucauaucacacaauuuug

SEQ ID NO: 300220 - RNA, 21 nt, Human
cagugagguccccagccuagg

SEQ ID NO: 300221 - RNA, 22 nt, Human
agugacuggugugaaguuaaau

SEQ ID NO: 300222 - RNA, 22 nt, Human
acaggugugagaacaugccuug

SEQ ID NO: 300223 - RNA, 22 nt, Human
guguccugguuccuuguggcug

SEQ ID NO: 300224 - RNA, 22 nt, Human
cuuccugcuccccugccaauuc

SEQ ID NO: 300225 - RNA, 22 nt, Human
uggcaggggaggugcuugcuua

SEQ ID NO: 300226 - RNA, 22 nt, Human
cuguccugucugcuuuuaauuu

SEQ ID NO: 300227 - RNA, 22 nt, Human
ucagcuuuccuugcuuuagauu

SEQ ID NO: 300228 - RNA, 22 nt, Human
acagugugugcuuucccuuacg

SEQ ID NO: 300229 - RNA, 22 nt, Human
uguccaggucagcagcagggac

SEQ ID NO: 300230 - RNA, 22 nt, Human
uagggcaggggaggaaucugaa

SEQ ID NO: 300231 - RNA, 22 nt, Human
uuugggaauaauugcacagauu

SEQ ID NO: 300232 - RNA, 22 nt, Human
ugcuguaauacuuaagguuaag

SEQ ID NO: 300233 - RNA, 22 nt, Human
cuuuuucugauguuccaugauu

SEQ ID NO: 300234 - RNA, 22 nt, Human
gcagacaggauuggguuaauag

SEQ ID NO: 300235 - RNA, 22 nt, Human
aggcaggcccucuggaaaggua

SEQ ID NO: 300236 - RNA, 22 nt, Human
uagcuuuaauaagcugcugaau

SEQ ID NO: 300237 - RNA, 22 nt, Human
uucuggguaacaaggcaagaau

SEQ ID NO: 300238 - RNA, 22 nt, Human
uuaaaauagccagugccccucu

SEQ ID NO: 300239 - RNA, 22 nt, Human
gagggcucuaccaaguaacucu

SEQ ID NO: 300240 - RNA, 22 nt, Human
ggaggggucucuagcgaggaga

SEQ ID NO: 300241 - RNA, 23 nt, Human
gagggcucugagugcuugggcca

SEQ ID NO: 300242 - RNA, 22 nt, Human
ggaaggaagugcagacuuuaaa

SEQ ID NO: 300243 - RNA, 20 nt, Human
ugcagggcugccucccagcu

SEQ ID NO: 300244 - RNA, 22 nt, Human
ucugaaaugcaaauuugacuga

SEQ ID NO: 300245 - RNA, 22 nt, Human
aaggcauacauauuguuauagg

SEQ ID NO: 300246 - RNA, 22 nt, Human
uggaggaaguugcuggaaguca

SEQ ID NO: 300247 - RNA, 22 nt, Human
acagccagguaaaggcauggca

SEQ ID NO: 300248 - RNA, 22 nt, Human
ugcaggugcugauaccuacucc

SEQ ID NO: 300249 - RNA, 23 nt, Human
uuuuaauuuggacauaagaagau

SEQ ID NO: 300250 - RNA, 22 nt, Human
guauuagggccaaaggcaggaa

SEQ ID NO: 300251 - RNA, 20 nt, Human
aggaggaaaaaaugacgagc

SEQ ID NO: 300252 - RNA, 22 nt, Human
uccugcagcugaagcucaugug

SEQ ID NO: 300253 - RNA, 22 nt, Human
agcagguggacagaggaagaaa

SEQ ID NO: 300254 - RNA, 22 nt, Human
gagcuuuaggagaaggagguca

SEQ ID NO: 300255 - RNA, 22 nt, Human
guguguccuguuuuaaaauagu

SEQ ID NO: 300256 - RNA, 17 nt, Human
uccuuucuuuaccuguu

SEQ ID NO: 300257 - RNA, 22 nt, Human
auuccuucuaaaacgcugcccu

SEQ ID NO: 300258 - RNA, 22 nt, Human
cucuuaaauaacaucauugcuu

SEQ ID NO: 300259 - RNA, 22 nt, Human
uucaaauacauucuuugccacu

SEQ ID NO: 300260 - RNA, 21 nt, Human
uuuuauugaugaauggccacu

SEQ ID NO: 300261 - RNA, 22 nt, Human
gcaguggcaugaugugggcuca

SEQ ID NO: 300262 - RNA, 22 nt, Human
agcagggccuggcacuccuggg

SEQ ID NO: 300263 - RNA, 22 nt, Human
uggaauguaaaccucagguggg

SEQ ID NO: 300264 - RNA, 22 nt, Human
acaauacaggcuucuggacuua

SEQ ID NO: 300265 - RNA, 22 nt, Human
uguguccuuucuaaugcccaga

SEQ ID NO: 300266 - RNA, 22 nt, Human
auugugcaaauauuaucuguag

SEQ ID NO: 300267 - RNA, 22 nt, Human
uguuucaggaccuaucuuuuag

SEQ ID NO: 300268 - RNA, 22 nt, Human
guguccucuuauugcucuuggc

SEQ ID NO: 300269 - RNA, 22 nt, Human
uacuucaaccuucucuauuaga

SEQ ID NO: 300270 - RNA, 22 nt, Human
augcuuuauuauuuugcaggga

SEQ ID NO: 300271 - RNA, 22 nt, Human
uccagcauuuuucaauagaauu

SEQ ID NO: 300272 - RNA, 19 nt, Human
gcugggugaggucguugga

SEQ ID NO: 300273 - RNA, 22 nt, Human
cagggcaguuuuacuucucucu

SEQ ID NO: 300274 - RNA, 22 nt, Human
gaagucuucauucucucugaga

SEQ ID NO: 300275 - RNA, 22 nt, Human
cuccuccuaaaugauucuuccu

SEQ ID NO: 300276 - RNA, 22 nt, Human
cuacauaaucuggauuugucug

SEQ ID NO: 300277 - RNA, 22 nt, Human
acucugcuguuuacucucuaua

SEQ ID NO: 300278 - RNA, 15 nt, Human
uccaggcauucauuc

SEQ ID NO: 300279 - RNA, 22 nt, Human
uguguccuacugaggagcuccu

SEQ ID NO: 300280 - RNA, 17 nt, Human
uauacacagacagacug

SEQ ID NO: 300281 - RNA, 22 nt, Human
aagagcuggauggaaucuggga

SEQ ID NO: 300282 - RNA, 22 nt, Human
ugucaacacaccuaucucaauu

SEQ ID NO: 300283 - RNA, 22 nt, Human
aaagaguucuaugaucuuucca

SEQ ID NO: 300284 - RNA, 22 nt, Human
uuauuuuaccuuccucugagcu

SEQ ID NO: 300285 - RNA, 21 nt, Human
gccugcaguuuugaagcccuu

SEQ ID NO: 300286 - RNA, 22 nt, Human
cuaugaaaggauuuggaguugu

SEQ ID NO: 300287 - RNA, 22 nt, Human
gguguccuacagggccgcaggc

SEQ ID NO: 300288 - RNA, 22 nt, Human
auucuucacaccuguuccuguu

SEQ ID NO: 300289 - RNA, 22 nt, Human
ucucuuaauuuuggaauagugu

SEQ ID NO: 300290 - RNA, 19 nt, Human
cucuuaaauugucucuugc

SEQ ID NO: 300291 - RNA, 22 nt, Human
agagggcaugcuugguggccug

SEQ ID NO: 300292 - RNA, 22 nt, Human
cugaaugaaaucaaggacugag

SEQ ID NO: 300293 - RNA, 22 nt, Human
ggggugugaguagagcugggga

SEQ ID NO: 300294 - RNA, 22 nt, Human
cccugcagcuuuugcauaguca

SEQ ID NO: 300295 - RNA, 22 nt, Human
acagaggguguggaggaagacg

SEQ ID NO: 300296 - RNA, 22 nt, Human
uuauucuuuucuccagaauccc

SEQ ID NO: 300297 - RNA, 22 nt, Human
gggaggaaggcuugggugagua

SEQ ID NO: 300298 - RNA, 22 nt, Human
aaauacaaaaauuagccaggca

SEQ ID NO: 300299 - RNA, 22 nt, Human
uaugacaagguggaguaugagu

SEQ ID NO: 300300 - RNA, 22 nt, Human
uuucuucucacccaggacagag

SEQ ID NO: 300301 - RNA, 22 nt, Human
gaguccuuuguuccuugccaca

SEQ ID NO: 300302 - RNA, 22 nt, Human
uacagguaaaauuaucagaaac

SEQ ID NO: 300303 - RNA, 22 nt, Human
ucagguguuagaagaaauuuca

SEQ ID NO: 300304 - RNA, 22 nt, Human
augagguuuugauuggcacagg

SEQ ID NO: 300305 - RNA, 22 nt, Human
caggcagcugcgacaagagagc

SEQ ID NO: 300306 - RNA, 22 nt, Human
uaacuuuaguguaugagguaag

SEQ ID NO: 300307 - RNA, 21 nt, Human
gguguccugagggauagguag

SEQ ID NO: 300308 - RNA, 22 nt, Human
cugcagggagaggggacagccu

SEQ ID NO: 300309 - RNA, 22 nt, Human
ccagcuuuucuuaucauuauaa

SEQ ID NO: 300310 - RNA, 22 nt, Human
uggguagaguggagggauaaga

SEQ ID NO: 300311 - RNA, 19 nt, Human
uugaaauuguuugauaugg

SEQ ID NO: 300312 - RNA, 22 nt, Human
cacuggaauauggcguugaacc

SEQ ID NO: 300313 - RNA, 22 nt, Human
aaaauaacuucuacuauuugca

SEQ ID NO: 300314 - RNA, 22 nt, Human
aggcucaguauagcuggcaagu

SEQ ID NO: 300315 - RNA, 22 nt, Human
gucuucuuuucagucugcuugu

SEQ ID NO: 300316 - RNA, 22 nt, Human
ugagggaguuggguguauagga

SEQ ID NO: 300317 - RNA, 22 nt, Human
cagggcucgcucuugcccuucg

SEQ ID NO: 300318 - RNA, 22 nt, Human
auuauucuuaugucaucauggc

SEQ ID NO: 300319 - RNA, 17 nt, Human
gaauuucuuggucaaaa

SEQ ID NO: 300320 - RNA, 22 nt, Human
ugguggagccuaggcuaagucu

SEQ ID NO: 300321 - RNA, 22 nt, Human
uuucaguuguccuguuaauagc

SEQ ID NO: 300322 - RNA, 22 nt, Human
gcauguguuauuucucuguggg

SEQ ID NO: 300323 - RNA, 22 nt, Human
guuuaagaggguuucauuccca

SEQ ID NO: 300324 - RNA, 22 nt, Human
aguguccuuguuauuacugcuc

SEQ ID NO: 300325 - RNA, 22 nt, Human
uugcugggucagaagccaggag

SEQ ID NO: 300326 - RNA, 22 nt, Human
gaggggaugcagagaggcuuau

SEQ ID NO: 300327 - RNA, 23 nt, Human
uuuuauugauauguagcuguugu

SEQ ID NO: 300328 - RNA, 22 nt, Human
uguaauauuguagugacaguac

SEQ ID NO: 300329 - RNA, 22 nt, Human
ggcaggaggugaguggcgggug

SEQ ID NO: 300330 - RNA, 22 nt, Human
aagugguuugauucaguuuaug

SEQ ID NO: 300331 - RNA, 22 nt, Human
uuugacuccuguguuucuggaa

SEQ ID NO: 300332 - RNA, 22 nt, Human
uggcagaaagaaccaugugcaa

SEQ ID NO: 300333 - RNA, 18 nt, Human
gaggauggaaggagaugc

SEQ ID NO: 300334 - RNA, 22 nt, Human
aguugacauccagagacauucu

SEQ ID NO: 300335 - RNA, 22 nt, Human
auuagauacacagauuuccacu

SEQ ID NO: 300336 - RNA, 22 nt, Human
ccauuguaguaucuguuuuagu

SEQ ID NO: 300337 - RNA, 22 nt, Human
uaaaugucuguuaacaugaaug

SEQ ID NO: 300338 - RNA, 22 nt, Human
guuuucugauuagcaaaucuga

SEQ ID NO: 300339 - RNA, 22 nt, Human
aguauacauauauuagccuucg

SEQ ID NO: 300340 - RNA, 22 nt, Human
acagguggcacugcuguuacuc

SEQ ID NO: 300341 - RNA, 22 nt, Human
uccaggagaggccugaccaggu

SEQ ID NO: 300342 - RNA, 22 nt, Human
gggaccugccauugcucacagg

SEQ ID NO: 300343 - RNA, 22 nt, Human
auccuucuaagagggacguaug

SEQ ID NO: 300344 - RNA, 20 nt, Human
gauguguccucagcaguggu

SEQ ID NO: 300345 - RNA, 22 nt, Human
ccagguggaaggucugugcucu

SEQ ID NO: 300346 - RNA, 21 nt, Human
guuuucaugauagagucugua

SEQ ID NO: 300347 - RNA, 22 nt, Human
ggauuucuuccuuccucagaag

SEQ ID NO: 300348 - RNA, 19 nt, Human
caggaaugagguaauggcu

SEQ ID NO: 300349 - RNA, 22 nt, Human
agaaagcacucugucuuuuacc

SEQ ID NO: 300350 - RNA, 22 nt, Human
ugcuggagaucauuaauguuca

SEQ ID NO: 300351 - RNA, 22 nt, Human
guuauuaguaagacucgcacau

SEQ ID NO: 300352 - RNA, 22 nt, Human
gaugugucuccauacaccaccc

SEQ ID NO: 300353 - RNA, 22 nt, Human
cagggcuccaugcagggacucc

SEQ ID NO: 300354 - RNA, 21 nt, Human
uuuaaagaauaggaagggagg

SEQ ID NO: 300355 - RNA, 22 nt, Human
agcaugaaaacaugaaacagca

SEQ ID NO: 300356 - RNA, 22 nt, Human
uuucauugucaauaaacuguau

SEQ ID NO: 300357 - RNA, 22 nt, Human
guuagguagaaguuuacuuuga

SEQ ID NO: 300358 - RNA, 22 nt, Human
auauuagguuggugcaaaagua

SEQ ID NO: 300359 - RNA, 22 nt, Human
uauugcugaggauugaggcuug

SEQ ID NO: 300360 - RNA, 22 nt, Human
uucauguaguguaaugucuuca

SEQ ID NO: 300361 - RNA, 22 nt, Human
acacuuuacagaauguuuugau

SEQ ID NO: 300362 - RNA, 22 nt, Human
cuauuagguaugcagccuauuu

SEQ ID NO: 300363 - RNA, 22 nt, Human
agacagacuguguuugaauccu

SEQ ID NO: 300364 - RNA, 22 nt, Human
acaugacaccucuggcugggug

SEQ ID NO: 300365 - RNA, 22 nt, Human
ugcagggagcucuggggugcag

SEQ ID NO: 300366 - RNA, 22 nt, Human
gccaggcaaauuaaggaaugca

SEQ ID NO: 300367 - RNA, 22 nt, Human
ugggcaggagagaagcuaaaga

SEQ ID NO: 300368 - RNA, 22 nt, Human
guuuuuaucuaauagcaguuau

SEQ ID NO: 300369 - RNA, 23 nt, Human
ucuguacaauugagaagagaaca

SEQ ID NO: 300370 - RNA, 22 nt, Human
ucagggcaagucucagaagguu

SEQ ID NO: 300371 - RNA, 22 nt, Human
cuguguccauuuaucauuguca

SEQ ID NO: 300372 - RNA, 22 nt, Human
uggccucaaucuguccuccagc

SEQ ID NO: 300373 - RNA, 22 nt, Human
uugcuaauaaaguuuuuaugug

SEQ ID NO: 300374 - RNA, 21 nt, Human
caugugucauuggagagcaau

SEQ ID NO: 300375 - RNA, 22 nt, Human
cauuuguaguuaaaaaugucuc

SEQ ID NO: 300376 - RNA, 22 nt, Human
uaguuuacucaucuauaaaaug

SEQ ID NO: 300377 - RNA, 22 nt, Human
ucuuaaaccacaaaauucagag

SEQ ID NO: 300378 - RNA, 22 nt, Human
uugcuugacuuuguguaccugu

SEQ ID NO: 300379 - RNA, 22 nt, Human
uauuucagcaagaagaaugugg

SEQ ID NO: 300380 - RNA, 22 nt, Human
ccaggugugucaccauugccca

SEQ ID NO: 300381 - RNA, 22 nt, Human
uuugugcagauguauauuugug

SEQ ID NO: 300382 - RNA, 20 nt, Human
cugcagggugagugggcgau

SEQ ID NO: 300383 - RNA, 22 nt, Human
cuuaauuucaaacugcuaguga

SEQ ID NO: 300384 - RNA, 22 nt, Human
accaggcagcacuuuccuugca

SEQ ID NO: 300385 - RNA, 22 nt, Human
ggucuggaauaagguccaggaa

SEQ ID NO: 300386 - RNA, 22 nt, Human
cacagguguguccuggucuugu

SEQ ID NO: 300387 - RNA, 22 nt, Human
aggcagggcugggauuagacuc

SEQ ID NO: 300388 - RNA, 22 nt, Human
uccuggguccugggaagcccug

SEQ ID NO: 300389 - RNA, 20 nt, Human
gcagggcaagggauaugaaa

SEQ ID NO: 300390 - RNA, 22 nt, Human
aguggggccgcgguccugcccu

SEQ ID NO: 300391 - RNA, 22 nt, Human
ccuucuccccucugcagggugu

SEQ ID NO: 300392 - RNA, 22 nt, Human
ugcugccagggcucugcccaca

SEQ ID NO: 300393 - RNA, 22 nt, Human
ugaccuuucuuugagauuccug

SEQ ID NO: 300394 - RNA, 21 nt, Human
uauuuauuaauuuguaaggcu

SEQ ID NO: 300395 - RNA, 22 nt, Human
uuugacuccuuugugaaaagag

SEQ ID NO: 300396 - RNA, 22 nt, Human
agagggugaaugagauagaaaa

SEQ ID NO: 300397 - RNA, 18 nt, Human
ucagcuuuugaaaaccaa

SEQ ID NO: 300398 - RNA, 22 nt, Human
cuuugcaauagaggcacacaug

SEQ ID NO: 300399 - RNA, 21 nt, Human
aguguccuuuuacugugaaua

SEQ ID NO: 300400 - RNA, 22 nt, Human
uugcuuuauuccuagcccuugu

SEQ ID NO: 300401 - RNA, 22 nt, Human
cauauuugguauaacuuaagca

SEQ ID NO: 300402 - RNA, 22 nt, Human
gccaggcgggucucaaacuccu

SEQ ID NO: 300403 - RNA, 22 nt, Human
uuuaugagcaaugcugagggga

SEQ ID NO: 300404 - RNA, 22 nt, Human
aguugcugauucugucugugau

SEQ ID NO: 300405 - RNA, 22 nt, Human
ggugcaggagcggggugcucgg

SEQ ID NO: 300406 - RNA, 21 nt, Human
uggaggaauaaagcacagaag

SEQ ID NO: 300407 - RNA, 22 nt, Human
ucagaagccaccuuuuguuggg

SEQ ID NO: 300408 - RNA, 22 nt, Human
agcugaaucucaggcauccuuu

SEQ ID NO: 300409 - RNA, 22 nt, Human
gcaugcagggagggucuggcug

SEQ ID NO: 300410 - RNA, 22 nt, Human
aagcuuuaaggaauuuuaugga

SEQ ID NO: 300411 - RNA, 22 nt, Human
aaggugguuguaggcuggucug

SEQ ID NO: 300412 - RNA, 22 nt, Human
ugacauguauguauuuguuuau

SEQ ID NO: 300413 - RNA, 22 nt, Human
uagcuuuaggaugguucucuug

SEQ ID NO: 300414 - RNA, 22 nt, Human
uauuccagguuucuuguuguau

SEQ ID NO: 300415 - RNA, 22 nt, Human
agacagguguuuuacaacuucg

SEQ ID NO: 300416 - RNA, 17 nt, Human
uaggugguugcuggucu

SEQ ID NO: 300417 - RNA, 22 nt, Human
ugaucuccugaccuuguaaucc

SEQ ID NO: 300418 - RNA, 20 nt, Human
gggugugugcagggccuggu

SEQ ID NO: 300419 - RNA, 22 nt, Human
gggugugucuuuugcuccugga

SEQ ID NO: 300420 - RNA, 21 nt, Human
uucuucaggccaaugcucauu

SEQ ID NO: 300421 - RNA, 22 nt, Human
aaagcugcaagcuccugaggaa

SEQ ID NO: 300422 - RNA, 22 nt, Human
ugcauguguuugccacagugag

SEQ ID NO: 300423 - RNA, 23 nt, Human
cagaccuuucuguaucaguuauc

SEQ ID NO: 300424 - RNA, 22 nt, Human
acauguaaaagauaaauuaaca

SEQ ID NO: 300425 - RNA, 22 nt, Human
aggaggugcuguuuguccugga

SEQ ID NO: 300426 - RNA, 22 nt, Human
gaauuuaaggaccaagcauuuu

SEQ ID NO: 300427 - RNA, 22 nt, Human
ggcaaaguuuucaucucauaac

SEQ ID NO: 300428 - RNA, 22 nt, Human
ccagcuuuagguugccugccag

SEQ ID NO: 300429 - RNA, 22 nt, Human
gugcaggguagcgacggcagga

SEQ ID NO: 300430 - RNA, 20 nt, Human
ucagacagucgcaguucugg

SEQ ID NO: 300431 - RNA, 22 nt, Human
cccaggcagccugcagggaagg

SEQ ID NO: 300432 - RNA, 22 nt, Human
cagggacccuacuagcucacac

SEQ ID NO: 300433 - RNA, 22 nt, Human
ugugaaaagggcuuuguacaaa

SEQ ID NO: 300434 - RNA, 22 nt, Human
gcaguggcuaagcucgcaugca

SEQ ID NO: 300435 - RNA, 22 nt, Human
ucuguaguagguuguaguucuu

SEQ ID NO: 300436 - RNA, 20 nt, Human
ucaggcaguggggaaaggca

SEQ ID NO: 300437 - RNA, 22 nt, Human
gaugugucauuuggucaucugc

SEQ ID NO: 300438 - RNA, 22 nt, Human
aagacaggaaaagcuccaggcc

SEQ ID NO: 300439 - RNA, 22 nt, Human
gauugcugggucccacucccag

SEQ ID NO: 300440 - RNA, 22 nt, Human
aggcaggugagucaaaacagac

SEQ ID NO: 300441 - RNA, 22 nt, Human
ggaugggaacuugguagggcau

SEQ ID NO: 300442 - RNA, 22 nt, Human
uuccuaauggcaaaacauguuu

SEQ ID NO: 300443 - RNA, 22 nt, Human
auuuucaucauggguuuaacau

SEQ ID NO: 300444 - RNA, 22 nt, Human
ugcuuagacgucaaguacagcc

SEQ ID NO: 300445 - RNA, 22 nt, Human
gaugcgggcccgcuccacugcc

SEQ ID NO: 300446 - RNA, 22 nt, Human
ccuucuucuguguggcccaaga

SEQ ID NO: 300447 - RNA, 17 nt, Human
ggcaggugcggggccgc

SEQ ID NO: 300448 - RNA, 22 nt, Human
caugugguucaaguacuccaca

SEQ ID NO: 300449 - RNA, 22 nt, Human
ugggacucacucuuuuggccag

SEQ ID NO: 300450 - RNA, 22 nt, Human
gagcugcagcggcugacgcaac

SEQ ID NO: 300451 - RNA, 22 nt, Human
aaauuugauaagccauuguuac

SEQ ID NO: 300452 - RNA, 22 nt, Human
uguuuccuucugucucuuugga

SEQ ID NO: 300453 - RNA, 22 nt, Human
ggcaggugcuugucgaaggccu

SEQ ID NO: 300454 - RNA, 22 nt, Human
cuuuauguccaccagacugcaa

SEQ ID NO: 300455 - RNA, 22 nt, Human
ugacagguuguguagguggcca

SEQ ID NO: 300456 - RNA, 22 nt, Human
ggggugggcgugcagggacacc

SEQ ID NO: 300457 - RNA, 22 nt, Human
aaauauaguaaaugcauaguuc

SEQ ID NO: 300458 - RNA, 22 nt, Human
auuuucaucgcuagguuggccu

SEQ ID NO: 300459 - RNA, 22 nt, Human
aguccaguguguucuggcagca

SEQ ID NO: 300460 - RNA, 22 nt, Human
uagguguccucguccaaagauu

SEQ ID NO: 300461 - RNA, 22 nt, Human
uguguccuccagggagauguaa

SEQ ID NO: 300462 - RNA, 23 nt, Human
uucuggguugcugugcuuggaau

SEQ ID NO: 300463 - RNA, 22 nt, Human
ucaggaaaguguucucagagga

SEQ ID NO: 300464 - RNA, 20 nt, Human
cugcaaaaugacauuaggaa

SEQ ID NO: 300465 - RNA, 19 nt, Human
cacacccaugcuugccaag

SEQ ID NO: 300466 - RNA, 22 nt, Human
auaguuugugaaacacagcagu

SEQ ID NO: 300467 - RNA, 22 nt, Human
aaggcuuucagcuaacuugauu

SEQ ID NO: 300468 - RNA, 22 nt, Human
cacccaggacaggccagaugug

SEQ ID NO: 300469 - RNA, 22 nt, Human
agcaggugccagguguacccgc

SEQ ID NO: 300470 - RNA, 22 nt, Human
cccagcuugcaaauggguugcu

SEQ ID NO: 300471 - RNA, 22 nt, Human
auugcugaaaugaaaggauaug

SEQ ID NO: 300472 - RNA, 22 nt, Human
aaggcauagucuuuaaguucug

SEQ ID NO: 300473 - RNA, 22 nt, Human
ugcuggagaugaaagggcccug

SEQ ID NO: 300474 - RNA, 22 nt, Human
augaaacacacacgcgcauacu

SEQ ID NO: 300475 - RNA, 17 nt, Human
aauugcuuguacuccca

SEQ ID NO: 300476 - RNA, 22 nt, Human
uacagauauuguacaguuauag

SEQ ID NO: 300477 - RNA, 22 nt, Human
aucuguaaagauaaucauaugu

SEQ ID NO: 300478 - RNA, 22 nt, Human
agaagaggggugucccuguggc

SEQ ID NO: 300479 - RNA, 22 nt, Human
uaaugucagcauaguuuauuuu

SEQ ID NO: 300480 - RNA, 22 nt, Human
gacccagcuaaccaggugggga

SEQ ID NO: 300481 - RNA, 22 nt, Human
gcuggccucaucacugacuucu

SEQ ID NO: 300482 - RNA, 22 nt, Human
ugagggagucaugauuaaggaa

SEQ ID NO: 300483 - RNA, 22 nt, Human
agaagaaaugaggccguucugc

SEQ ID NO: 300484 - RNA, 22 nt, Human
uaugccuggaaccuuucucuuu

SEQ ID NO: 300485 - RNA, 22 nt, Human
auuuaagauugcguauucaugu

SEQ ID NO: 300486 - RNA, 22 nt, Human
agaaggaagccaggagggugca

SEQ ID NO: 300487 - RNA, 22 nt, Human
guuuuacacaccuaugaaagac

SEQ ID NO: 300488 - RNA, 22 nt, Human
agauggucuuuugaguaaugaa

SEQ ID NO: 300489 - RNA, 22 nt, Human
uaauuuuaacugugcuguuugg

SEQ ID NO: 300490 - RNA, 22 nt, Human
aagggcucugggcuacgcacug

SEQ ID NO: 300491 - RNA, 22 nt, Human
ccaugugucgggccugcagugg

SEQ ID NO: 300492 - RNA, 22 nt, Human
agacaggcuuugcuguauauca

SEQ ID NO: 300493 - RNA, 18 nt, Human
cuucucccaucuuggcca

SEQ ID NO: 300494 - RNA, 22 nt, Human
gguuucaacuucaaccucucca

SEQ ID NO: 300495 - RNA, 22 nt, Human
aaagagggacaggcgcagacac

SEQ ID NO: 300496 - RNA, 22 nt, Human
uccucuccauauuuucugauuu

SEQ ID NO: 300497 - RNA, 22 nt, Human
auuuauugaagcuuauuacguu

SEQ ID NO: 300498 - RNA, 22 nt, Human
uuuaagacuuagauuuauuggg

SEQ ID NO: 300499 - RNA, 22 nt, Human
auuuccaugaauucccacucau

SEQ ID NO: 300500 - RNA, 18 nt, Human
cauaauuuucuuucuuua

SEQ ID NO: 300501 - RNA, 22 nt, Human
guucuucagauuccauuucagu

SEQ ID NO: 300502 - RNA, 22 nt, Human
uuauuaggaaaaggucagaugu

SEQ ID NO: 300503 - RNA, 22 nt, Human
caaauucucuuacuguuugaca

SEQ ID NO: 300504 - RNA, 22 nt, Human
guuucuuucuauugacugaaca

SEQ ID NO: 300505 - RNA, 22 nt, Human
ucagggcaucucuuaaguggug

SEQ ID NO: 300506 - RNA, 22 nt, Human
ggauuaagaccugucaguacac

SEQ ID NO: 300507 - RNA, 22 nt, Human
caaauguaaauucuuuugaagc

SEQ ID NO: 300508 - RNA, 22 nt, Human
cuguguccaauggccuuagcag

SEQ ID NO: 300509 - RNA, 22 nt, Human
ugacauguaguuagaaaauagg

SEQ ID NO: 300510 - RNA, 22 nt, Human
aacccagccguguagcugccgc

SEQ ID NO: 300511 - RNA, 22 nt, Human
uguuccuguuuaaugugcucau

SEQ ID NO: 300512 - RNA, 22 nt, Human
cuguccugggggugguccuugc

SEQ ID NO: 300513 - RNA, 22 nt, Human
ugaugagggagauuugagccca

SEQ ID NO: 300514 - RNA, 22 nt, Human
uggcaaauauuuuguuuuguaa

SEQ ID NO: 300515 - RNA, 22 nt, Human
aauuguaacuacauugagaaca

SEQ ID NO: 300516 - RNA, 22 nt, Human
uguccuuuucuuuagugcagcu

SEQ ID NO: 300517 - RNA, 22 nt, Human
uuuauugacuucagugagucuu

SEQ ID NO: 300518 - RNA, 21 nt, Human
gaaaagcaagggaguagaaca

SEQ ID NO: 300519 - RNA, 21 nt, Human
cuguccaguaauuccuggcac

SEQ ID NO: 300520 - RNA, 22 nt, Human
auuucuuuucaagagggugcuu

SEQ ID NO: 300521 - RNA, 22 nt, Human
cagcuuuaccaauauuuggaaa

SEQ ID NO: 300522 - RNA, 20 nt, Human
agggugugggccuuagccau

SEQ ID NO: 300523 - RNA, 20 nt, Human
uuugcgaggccaaggcgggc

SEQ ID NO: 300524 - RNA, 22 nt, Human
ucugugcaggaagucauuauga

SEQ ID NO: 300525 - RNA, 22 nt, Human
uacaguaagaugaaauagcaau

SEQ ID NO: 300526 - RNA, 22 nt, Human
uuguuuuaucuuucuacagacu

SEQ ID NO: 300527 - RNA, 22 nt, Human
guuagggaagcgcuguguucuu

SEQ ID NO: 300528 - RNA, 19 nt, Human
ccugggucugcagcauuca

SEQ ID NO: 300529 - RNA, 22 nt, Human
agacagacuugaaaauguucuu

SEQ ID NO: 300530 - RNA, 22 nt, Human
aguguccugugucccagacugu

SEQ ID NO: 300531 - RNA, 19 nt, Human
guucaaacacugauucagc

SEQ ID NO: 300532 - RNA, 20 nt, Human
gagggcaggcacccauuuca

SEQ ID NO: 300533 - RNA, 22 nt, Human
ucaaauaccagcuuuuccagaa

SEQ ID NO: 300534 - RNA, 22 nt, Human
ugcuuuaucugugagaaccuga

SEQ ID NO: 300535 - RNA, 22 nt, Human
ucucuucuauuugagacuauuu

SEQ ID NO: 300536 - RNA, 22 nt, Human
uuuguuuacaaaaauaagcagu

SEQ ID NO: 300537 - RNA, 22 nt, Human
gaugugucccuuucaacucaga

SEQ ID NO: 300538 - RNA, 22 nt, Human
ccuacaggaaauuguaucaaaa

SEQ ID NO: 300539 - RNA, 22 nt, Human
gggugggguucaggaaucuuca

SEQ ID NO: 300540 - RNA, 22 nt, Human
agguggagaagagaugggcagu

SEQ ID NO: 300541 - RNA, 22 nt, Human
gcagguguggagaguggucggg

SEQ ID NO: 300542 - RNA, 22 nt, Human
ucuuccucccuacagagcucag

SEQ ID NO: 300543 - RNA, 22 nt, Human
gcacaauuauuuaugcaguaug

SEQ ID NO: 300544 - RNA, 22 nt, Human
gagaaacaacacuugaugccuu

SEQ ID NO: 300545 - RNA, 22 nt, Human
caaagucagccagcuaguaggu

SEQ ID NO: 300546 - RNA, 17 nt, Human
cccguucucuucgcugg

SEQ ID NO: 300547 - RNA, 22 nt, Human
agggacccauagagagaccagu

SEQ ID NO: 300548 - RNA, 22 nt, Human
gauugcuguucccagggggcug

SEQ ID NO: 300549 - RNA, 22 nt, Human
ugggcagggagcuggaaccaca

SEQ ID NO: 300550 - RNA, 22 nt, Human
uuuucaguaaugucuacauaau

SEQ ID NO: 300551 - RNA, 22 nt, Human
guuuaagaaaauucauguuguu

SEQ ID NO: 300552 - RNA, 23 nt, Human
acagggcauugcuggccucgagg

SEQ ID NO: 300553 - RNA, 22 nt, Human
aaucuuucccuauuaaaugugg

SEQ ID NO: 300554 - RNA, 22 nt, Human
aauuugcaugaugagaacaaua

SEQ ID NO: 300555 - RNA, 22 nt, Human
ccaaguacagauuccuccacug

SEQ ID NO: 300556 - RNA, 22 nt, Human
uagaagcaguaauagaaauagg

SEQ ID NO: 300557 - RNA, 22 nt, Human
gccagggaaacugcagaccagc

SEQ ID NO: 300558 - RNA, 22 nt, Human
uuccaugacugaagcaggggcg

SEQ ID NO: 300559 - RNA, 22 nt, Human
gggacauggcuaggauuccaau

SEQ ID NO: 300560 - RNA, 22 nt, Human
acagauuuuaaaugacacuccc

SEQ ID NO: 300561 - RNA, 21 nt, Human
gggcaggucucugaugucaac

SEQ ID NO: 300562 - RNA, 22 nt, Human
ugcaggugguccauuugggaac

SEQ ID NO: 300563 - RNA, 20 nt, Human
cccagagccauagccagaca

SEQ ID NO: 300564 - RNA, 22 nt, Human
ccuuuucuggccaccaagcgcu

SEQ ID NO: 300565 - RNA, 22 nt, Human
aagggcagaauagagaagaugg

SEQ ID NO: 300566 - RNA, 22 nt, Human
uuucacaugguacugccuguuu

SEQ ID NO: 300567 - RNA, 22 nt, Human
auccagaacaccuguaucacca

SEQ ID NO: 300568 - RNA, 19 nt, Human
ugggaaaguaacauacaaa

SEQ ID NO: 300569 - RNA, 21 nt, Human
agacagacugccugacccacg

SEQ ID NO: 300570 - RNA, 22 nt, Human
uugaaugaggaagagcacuggc

SEQ ID NO: 300571 - RNA, 22 nt, Human
cuguuauuucugccaggugagu

SEQ ID NO: 300572 - RNA, 22 nt, Human
uggacaugaccucgagcgagau

SEQ ID NO: 300573 - RNA, 20 nt, Human
uccugcaguuccuaggaggg

SEQ ID NO: 300574 - RNA, 23 nt, Human
aaauuauugcucuucaauugccu

SEQ ID NO: 300575 - RNA, 22 nt, Human
uaauuucuaauucauuuucagu

SEQ ID NO: 300576 - RNA, 22 nt, Human
gaaggcaucacagaggcuguga

SEQ ID NO: 300577 - RNA, 22 nt, Human
ugcagggaagcaaggguggcuc

SEQ ID NO: 300578 - RNA, 22 nt, Human
agagcaucuaacacauaagccu

SEQ ID NO: 300579 - RNA, 22 nt, Human
ugguggggccagacuucagcuc

SEQ ID NO: 300580 - RNA, 22 nt, Human
cuguccuggccgcccuugugag

SEQ ID NO: 300581 - RNA, 22 nt, Human
uaguauagauugaagcagauca

SEQ ID NO: 300582 - RNA, 22 nt, Human
cuagggacagaaagaggguaga

SEQ ID NO: 300583 - RNA, 22 nt, Human
gucuggaaggaggagauggagc

SEQ ID NO: 300584 - RNA, 22 nt, Human
agcucccagaaggcccugcgcc

SEQ ID NO: 300585 - RNA, 22 nt, Human
aaaagcaguuuauagucaguug

SEQ ID NO: 300586 - RNA, 22 nt, Human
aggaggaagggaagacaaguaa

SEQ ID NO: 300587 - RNA, 22 nt, Human
cugugucccacacgagguguau

SEQ ID NO: 300588 - RNA, 22 nt, Human
auccucaguguuucugacaucu

SEQ ID NO: 300589 - RNA, 22 nt, Human
cuguugcugagguucaaggguc

SEQ ID NO: 300590 - RNA, 22 nt, Human
aauaucagcacuuuugugguau

SEQ ID NO: 300591 - RNA, 22 nt, Human
cuaaaauuaccuaccaguuuag

SEQ ID NO: 300592 - RNA, 22 nt, Human
uucacauuucauaccacagcuu

SEQ ID NO: 300593 - RNA, 22 nt, Human
gcauguguucuugaaaggccac

SEQ ID NO: 300594 - RNA, 22 nt, Human
gccaggcaauguguuagaagcg

SEQ ID NO: 300595 - RNA, 22 nt, Human
ucugucuucaucagcaugugau

SEQ ID NO: 300596 - RNA, 22 nt, Human
cagaagaguagcugaacaaguu

SEQ ID NO: 300597 - RNA, 22 nt, Human
uuuaaagaaauuccucaucuuu

SEQ ID NO: 300598 - RNA, 22 nt, Human
accuaaauucuggcugauuagg

SEQ ID NO: 300599 - RNA, 22 nt, Human
uguguccuucugggagucccag

SEQ ID NO: 300600 - RNA, 22 nt, Human
cacaauguauauguauaucaaa

SEQ ID NO: 300601 - RNA, 22 nt, Human
aaaauccucuaauucuagaaua

SEQ ID NO: 300602 - RNA, 22 nt, Human
agaagcuaggcuagacaaguga

SEQ ID NO: 300603 - RNA, 22 nt, Human
ucagagagcuggugggcagagg

SEQ ID NO: 300604 - RNA, 18 nt, Human
ucagguguuuucuguaua

SEQ ID NO: 300605 - RNA, 22 nt, Human
uaccaugucuucaauaagucua

SEQ ID NO: 300606 - RNA, 21 nt, Human
uuugcugaagauuuuaggcug

SEQ ID NO: 300607 - RNA, 19 nt, Human
gcuaggguugguggcgugc

SEQ ID NO: 300608 - RNA, 21 nt, Human
ugcauaaagaaauacaaauac

SEQ ID NO: 300609 - RNA, 22 nt, Human
agaugggugccuucuuucuuua

SEQ ID NO: 300610 - RNA, 22 nt, Human
uguguccucagggaagcagaga

SEQ ID NO: 300611 - RNA, 22 nt, Human
ggaccuggcaauuugcaucucu

SEQ ID NO: 300612 - RNA, 22 nt, Human
ggucuggauuuuaucuacugua

SEQ ID NO: 300613 - RNA, 22 nt, Human
agagguugggucugaggugaga

SEQ ID NO: 300614 - RNA, 23 nt, Human
uuggcaaagccuaugaaguccuc

SEQ ID NO: 300615 - RNA, 22 nt, Human
acuugguuguuuuaacuuggca

SEQ ID NO: 300616 - RNA, 22 nt, Human
uguucuucuagauugccuuuua

SEQ ID NO: 300617 - RNA, 22 nt, Human
cucccaguguuguuuucugaug

SEQ ID NO: 300618 - RNA, 22 nt, Human
gcugggucagaaucucccugug

SEQ ID NO: 300619 - RNA, 22 nt, Human
uuaugggagcaauuggggaggu

SEQ ID NO: 300620 - RNA, 22 nt, Human
gggcagguggccucuuguacua

SEQ ID NO: 300621 - RNA, 22 nt, Human
agcugcaaagaucugucaguca

SEQ ID NO: 300622 - RNA, 22 nt, Human
ugaucauuaucaaacuggucau

SEQ ID NO: 300623 - RNA, 22 nt, Human
uccucagaagaaccccuagauu

SEQ ID NO: 300624 - RNA, 22 nt, Human
gaacaucaugaagaaaacauau

SEQ ID NO: 300625 - RNA, 22 nt, Human
cucuggccgcagcucagcucug

SEQ ID NO: 300626 - RNA, 21 nt, Human
ucugaugguagaugagaugug

SEQ ID NO: 300627 - RNA, 22 nt, Human
ggcaguggguuccccaaggcac

SEQ ID NO: 300628 - RNA, 22 nt, Human
uauuccuauuucuaaacauaug

SEQ ID NO: 300629 - RNA, 22 nt, Human
uugcuuuauguguaugacuuga

SEQ ID NO: 300630 - RNA, 22 nt, Human
uauuugaaaguguacaaaaacu

SEQ ID NO: 300631 - RNA, 22 nt, Human
ucuucccuaaucaccaucuuca

SEQ ID NO: 300632 - RNA, 22 nt, Human
uggacaugucuucuccaagaaa

SEQ ID NO: 300633 - RNA, 22 nt, Human
guuucaaauagguuucagcaaa

SEQ ID NO: 300634 - RNA, 22 nt, Human
gcuuucuugguucugcaggggc

SEQ ID NO: 300635 - RNA, 22 nt, Human
gucauuccuauccauuugauac

SEQ ID NO: 300636 - RNA, 22 nt, Human
uuccuucucuguggggaaggca

SEQ ID NO: 300637 - RNA, 22 nt, Human
cacaccagagguuaccugcaaa

SEQ ID NO: 300638 - RNA, 22 nt, Human
gcagguggaucaccacgucagg

SEQ ID NO: 300639 - RNA, 22 nt, Human
aagugguuuuaagagguuccuu

SEQ ID NO: 300640 - RNA, 22 nt, Human
guaguucugcagugucaccuga

SEQ ID NO: 300641 - RNA, 22 nt, Human
ucuguucaucucaugggagaau

SEQ ID NO: 300642 - RNA, 22 nt, Human
caggcauaaucucaucuuguuu

SEQ ID NO: 300643 - RNA, 22 nt, Human
uuauuuaaaauguagguuggga

SEQ ID NO: 300644 - RNA, 20 nt, Human
ugcugagguugacaugccca

SEQ ID NO: 300645 - RNA, 17 nt, Human
aaguccagaguugagca

SEQ ID NO: 300646 - RNA, 22 nt, Human
caggauggagggagggcuguua

SEQ ID NO: 300647 - RNA, 22 nt, Human
cggcagggcuccaugcauuucu

SEQ ID NO: 300648 - RNA, 22 nt, Human
ucugaaagaagggcagucuuuu

SEQ ID NO: 300649 - RNA, 22 nt, Human
agcuuuauuaacucuccaggug

SEQ ID NO: 300650 - RNA, 22 nt, Human
uuuacaguuaagaaauguuacc

SEQ ID NO: 300651 - RNA, 22 nt, Human
gaguccuuuugugccacaggga

SEQ ID NO: 300652 - RNA, 22 nt, Human
ucagggcauggcugcacuuggc

SEQ ID NO: 300653 - RNA, 22 nt, Human
uauaaaugcacuuuugaaauau

SEQ ID NO: 300654 - RNA, 22 nt, Human
guauuagguuggugcaaaagua

SEQ ID NO: 300655 - RNA, 22 nt, Human
auauaguuggguuucauucuac

SEQ ID NO: 300656 - RNA, 20 nt, Human
cuguggaauuuuaccaugcg

SEQ ID NO: 300657 - RNA, 22 nt, Human
aguaaaauuaauggaucagaag

SEQ ID NO: 300658 - RNA, 22 nt, Human
uguccucacaggaaugaacuuu

SEQ ID NO: 300659 - RNA, 22 nt, Human
aaggugucaaacuagaagaugu

SEQ ID NO: 300660 - RNA, 22 nt, Human
agcucccaggcagucaugagga

SEQ ID NO: 300661 - RNA, 22 nt, Human
ggaugucuggucuauuucaagu

SEQ ID NO: 300662 - RNA, 22 nt, Human
gaugugucuggcuccccugcaa

SEQ ID NO: 300663 - RNA, 22 nt, Human
uagggcagaguccaggaugggc

SEQ ID NO: 300664 - RNA, 22 nt, Human
agcagguggugggccagauuug

SEQ ID NO: 300665 - RNA, 22 nt, Human
uccauugugauuauauacaaaa

SEQ ID NO: 300666 - RNA, 22 nt, Human
cacuuuauaaaauuggugugag

SEQ ID NO: 300667 - RNA, 22 nt, Human
ucagugugaggucuuccacccg

SEQ ID NO: 300668 - RNA, 22 nt, Human
uuuauugaguaucuacuaugug

SEQ ID NO: 300669 - RNA, 22 nt, Human
ccagagacgucggucagggcgc

SEQ ID NO: 300670 - RNA, 22 nt, Human
auacuuucugaccaauuaauug

SEQ ID NO: 300671 - RNA, 22 nt, Human
uuacacaacaucuguauuauua

SEQ ID NO: 300672 - RNA, 22 nt, Human
ccaaguacucucaccaaagcuu

SEQ ID NO: 300673 - RNA, 22 nt, Human
aucuuucaaucaggaaaaaucu

SEQ ID NO: 300674 - RNA, 22 nt, Human
agacaaauggaguaugagcaac

SEQ ID NO: 300675 - RNA, 22 nt, Human
aaagaaaccuaucagccacaug

SEQ ID NO: 300676 - RNA, 22 nt, Human
cagacaggaauucuggcguggu

SEQ ID NO: 300677 - RNA, 22 nt, Human
uucauucugcaguucucagcuc

SEQ ID NO: 300678 - RNA, 22 nt, Human
aggcagggugaugauaaugauu

SEQ ID NO: 300679 - RNA, 22 nt, Human
cuuaaauuuucaucuacaagaa

SEQ ID NO: 300680 - RNA, 22 nt, Human
ugguaugaccguggugcaagca

SEQ ID NO: 300681 - RNA, 22 nt, Human
uuuaguagaaugauacagggca

SEQ ID NO: 300682 - RNA, 23 nt, Human
agaggcaggaguggcuugcccgg

SEQ ID NO: 300683 - RNA, 22 nt, Human
uauuauugcaaguauauaaagu

SEQ ID NO: 300684 - RNA, 22 nt, Human
gcagggcaguaagagcuagagu

SEQ ID NO: 300685 - RNA, 22 nt, Human
uucauucuuauuugugaucugg

SEQ ID NO: 300686 - RNA, 22 nt, Human
gcacuuuaaauguucacggaaa

SEQ ID NO: 300687 - RNA, 22 nt, Human
uuucucagucacaugaaccaau

SEQ ID NO: 300688 - RNA, 22 nt, Human
uauaauuuaucaugucacaguu

SEQ ID NO: 300689 - RNA, 19 nt, Human
aagcauggugccucaccuc

SEQ ID NO: 300690 - RNA, 22 nt, Human
uuaagacaguguauuuguuuuc

SEQ ID NO: 300691 - RNA, 22 nt, Human
accaggcaaaaccacaggagca

SEQ ID NO: 300692 - RNA, 17 nt, Human
cagcuuuaugcuacugu

SEQ ID NO: 300693 - RNA, 18 nt, Human
acauuucuccuucugacc

SEQ ID NO: 300694 - RNA, 22 nt, Human
gaugagguuuuugaaaugugga

SEQ ID NO: 300695 - RNA, 22 nt, Human
cagagcugcuucccaguuugug

SEQ ID NO: 300696 - RNA, 22 nt, Human
uagggcagauucgguggaguuu

SEQ ID NO: 300697 - RNA, 22 nt, Human
augaaugggucauuauuugauc

SEQ ID NO: 300698 - RNA, 22 nt, Human
ugaggccagugacauauauuaa

SEQ ID NO: 300699 - RNA, 22 nt, Human
uuucuucacaggguauugggug

SEQ ID NO: 300700 - RNA, 20 nt, Human
agauuauuccuaagauuucu

SEQ ID NO: 300701 - RNA, 22 nt, Human
caguauuuguucccuaucaaug

SEQ ID NO: 300702 - RNA, 22 nt, Human
cauguguccuagcuauucuccu

SEQ ID NO: 300703 - RNA, 19 nt, Human
ccucaucuuggugugugca

SEQ ID NO: 300704 - RNA, 22 nt, Human
uuuuagcacuaagugauaugcu

SEQ ID NO: 300705 - RNA, 22 nt, Human
uuucacauucagauauagacuu

SEQ ID NO: 300706 - RNA, 22 nt, Human
acagguggagugguuagcaggc

SEQ ID NO: 300707 - RNA, 22 nt, Human
ucauuauuuuggacuggagugu

SEQ ID NO: 300708 - RNA, 22 nt, Human
cucuccaggacuuuggcccaau

SEQ ID NO: 300709 - RNA, 22 nt, Human
ugcuggcuuuuugguccuugcu

SEQ ID NO: 300710 - RNA, 22 nt, Human
uuuuucaucugauugauaacuc

SEQ ID NO: 300711 - RNA, 22 nt, Human
gacccaggcccaaggcugccag

SEQ ID NO: 300712 - RNA, 22 nt, Human
auugcugggaauauuuagccca

SEQ ID NO: 300713 - RNA, 22 nt, Human
uccaugcagaguccaggccuca

SEQ ID NO: 300714 - RNA, 22 nt, Human
ccugggucuccuccugcuggcu

SEQ ID NO: 300715 - RNA, 22 nt, Human
agccauccucccaccucagccu

SEQ ID NO: 300716 - RNA, 22 nt, Human
gcuguucagggcacucaugggc

SEQ ID NO: 300717 - RNA, 18 nt, Human
uucuggguguuauguuua

SEQ ID NO: 300718 - RNA, 22 nt, Human
caugaaggaauaauuguuuaga

SEQ ID NO: 300719 - RNA, 22 nt, Human
aagagcaucgguggagccccca

SEQ ID NO: 300720 - RNA, 22 nt, Human
uuauuuaaaagugguaagauuc

SEQ ID NO: 300721 - RNA, 22 nt, Human
cacaauuuccuugcuucacuuu

SEQ ID NO: 300722 - RNA, 22 nt, Human
uuguugcucuuguugccacaug

SEQ ID NO: 300723 - RNA, 22 nt, Human
auuuauugagacuuaacaaccc

SEQ ID NO: 300724 - RNA, 22 nt, Human
uccaugaggaccaaauucguag

SEQ ID NO: 300725 - RNA, 22 nt, Human
agcugcaggauuauggaaugga

SEQ ID NO: 300726 - RNA, 22 nt, Human
cuuucacacacauacauuugga

SEQ ID NO: 300727 - RNA, 20 nt, Human
uuuauugagcacguacugug

SEQ ID NO: 300728 - RNA, 22 nt, Human
uucugggacaucuggacaguuu

SEQ ID NO: 300729 - RNA, 22 nt, Human
aaaguggucaccuucucauuuc

SEQ ID NO: 300730 - RNA, 22 nt, Human
aggcaggucuguaucuagucuc

SEQ ID NO: 300731 - RNA, 22 nt, Human
ucauguguugcacugaggaccu

SEQ ID NO: 300732 - RNA, 22 nt, Human
gacacuuuaggauuuaaaaguc

SEQ ID NO: 300733 - RNA, 22 nt, Human
gcugggcuugguuucccugcuu

SEQ ID NO: 300734 - RNA, 22 nt, Human
cagagcagugaggaguugugua

SEQ ID NO: 300735 - RNA, 22 nt, Human
cuugcaugcauuugaagaucau

SEQ ID NO: 300736 - RNA, 22 nt, Human
gggcaggugauuuuggcuccau

SEQ ID NO: 300737 - RNA, 22 nt, Human
auuuccauuuucagccauuacu

SEQ ID NO: 300738 - RNA, 22 nt, Human
gggucugggcaggcgcuuccuc

SEQ ID NO: 300739 - RNA, 23 nt, Human
acagugugguggacaaggagcag

SEQ ID NO: 300740 - RNA, 22 nt, Human
ugacauguauaucuuacgcuau

SEQ ID NO: 300741 - RNA, 22 nt, Human
gccugcagggccugggccuacc

SEQ ID NO: 300742 - RNA, 22 nt, Human
acaacaggguaaggcaggccau

SEQ ID NO: 300743 - RNA, 22 nt, Human
aaaaaugcugugguagcugugu

SEQ ID NO: 300744 - RNA, 22 nt, Human
uacuuuaucagcgucaaaggua

SEQ ID NO: 300745 - RNA, 22 nt, Human
ucucaagcuaguguuuauagua

SEQ ID NO: 300746 - RNA, 22 nt, Human
ucagagaguccuggucauuugc

SEQ ID NO: 300747 - RNA, 22 nt, Human
agggacccugaugacugaggag

SEQ ID NO: 300748 - RNA, 22 nt, Human
auucuucaucacuaccuuguga

SEQ ID NO: 300749 - RNA, 22 nt, Human
ggcaggcacauuugggggccgu

SEQ ID NO: 300750 - RNA, 22 nt, Human
auuaaauuagcaaacugugaaa

SEQ ID NO: 300751 - RNA, 22 nt, Human
uacacacagaggccaugggauu

SEQ ID NO: 300752 - RNA, 22 nt, Human
uucuaccuacccucugcauaca

SEQ ID NO: 300753 - RNA, 21 nt, Human
uguguaauauguauaagaaua

SEQ ID NO: 300754 - RNA, 18 nt, Human
agacccucuaagggcagu

SEQ ID NO: 300755 - RNA, 22 nt, Human
uuugaacuucuccauucugaug

SEQ ID NO: 300756 - RNA, 22 nt, Human
gagcaguaggagaacccugagc

SEQ ID NO: 300757 - RNA, 22 nt, Human
ucuuccuucgcccuugcuguuu

SEQ ID NO: 300758 - RNA, 22 nt, Human
cuggauccaacagaguuggguu

SEQ ID NO: 300759 - RNA, 18 nt, Human
uuuuacucauagcaggcc

SEQ ID NO: 300760 - RNA, 22 nt, Human
ugcuuuauucagucucugccau

SEQ ID NO: 300761 - RNA, 22 nt, Human
uucuggguuuacaucugacuuc

SEQ ID NO: 300762 - RNA, 22 nt, Human
ugccuacauuccuugcuuaugg

SEQ ID NO: 300763 - RNA, 22 nt, Human
uuuguguuuguacaaugcacua

SEQ ID NO: 300764 - RNA, 22 nt, Human
agcaguccaacugagguggcau

SEQ ID NO: 300765 - RNA, 20 nt, Human
auguccagugacuggaccau

SEQ ID NO: 300766 - RNA, 22 nt, Human
uacaaaugaguuguaugaacca

SEQ ID NO: 300767 - RNA, 22 nt, Human
agcuucuugggcuuuacacaaa

SEQ ID NO: 300768 - RNA, 22 nt, Human
aaagcugcccuacacggaagca

SEQ ID NO: 300769 - RNA, 22 nt, Human
uguacuuaugagauccuagucg

SEQ ID NO: 300770 - RNA, 22 nt, Human
ugggcuccuugggagcaaguga

SEQ ID NO: 300771 - RNA, 22 nt, Human
ucuaggguguauaaggaagccu

SEQ ID NO: 300772 - RNA, 22 nt, Human
uuauuucauugauuucuaagac

SEQ ID NO: 300773 - RNA, 22 nt, Human
gccugcagggugaugggcugcc

SEQ ID NO: 300774 - RNA, 22 nt, Human
aaaugcuacauacacaucaggg

SEQ ID NO: 300775 - RNA, 22 nt, Human
gauuuuauauggcauacugugg

SEQ ID NO: 300776 - RNA, 22 nt, Human
ccagggcagugggagaaggugc

SEQ ID NO: 300777 - RNA, 21 nt, Human
uggacauuauggagagaguag

SEQ ID NO: 300778 - RNA, 22 nt, Human
ccagugugguagguccacaggu

SEQ ID NO: 300779 - RNA, 22 nt, Human
agcugcaacaucugcuuguccc

SEQ ID NO: 300780 - RNA, 22 nt, Human
cguggggcggguggacacuugc

SEQ ID NO: 300781 - RNA, 22 nt, Human
uggcagugggaagcuggaaguc

SEQ ID NO: 300782 - RNA, 22 nt, Human
uuggaggaugcaaugagggagu

SEQ ID NO: 300783 - RNA, 22 nt, Human
acagguguagcaggagcaucaa

SEQ ID NO: 300784 - RNA, 21 nt, Human
uuucacaaaaguaugugacaa

SEQ ID NO: 300785 - RNA, 23 nt, Human
uguuuuucauucacaugggcugu

SEQ ID NO: 300786 - RNA, 20 nt, Human
ugcagguguguccaagcacu

SEQ ID NO: 300787 - RNA, 22 nt, Human
ugggcagguuguuauuugacau

SEQ ID NO: 300788 - RNA, 22 nt, Human
ugcuuuauagacaaggaaguag

SEQ ID NO: 300789 - RNA, 22 nt, Human
uugcuuuagaaucugcuucugg

SEQ ID NO: 300790 - RNA, 22 nt, Human
cacaaugugguuugucaucuuu

SEQ ID NO: 300791 - RNA, 22 nt, Human
uaggugguugucugcuuuccua

SEQ ID NO: 300792 - RNA, 22 nt, Human
cuuuccuccacucccuaggcuu

SEQ ID NO: 300793 - RNA, 22 nt, Human
cagaagaggacuggguagcuca

SEQ ID NO: 300794 - RNA, 22 nt, Human
ugacaugugucuccuuccgucu

SEQ ID NO: 300795 - RNA, 22 nt, Human
uuucaaauggagucgugaaaug

SEQ ID NO: 300796 - RNA, 22 nt, Human
cauuuucagcacccaucugaaa

SEQ ID NO: 300797 - RNA, 22 nt, Human
caaaucuauauguugauauucu

SEQ ID NO: 300798 - RNA, 22 nt, Human
ugggaagauggagugacaggca

SEQ ID NO: 300799 - RNA, 22 nt, Human
gccaggguucgaauccguaugg

SEQ ID NO: 300800 - RNA, 22 nt, Human
uccaguaugacugauguccuuc

SEQ ID NO: 300801 - RNA, 22 nt, Human
gacagcaggaugugaggggaug

SEQ ID NO: 300802 - RNA, 22 nt, Human
aguugacucucaagauccuguu

SEQ ID NO: 300803 - RNA, 17 nt, Human
gcauccaguaacaugcc

SEQ ID NO: 300804 - RNA, 22 nt, Human
uaauacagaaguguauuaaaau

SEQ ID NO: 300805 - RNA, 22 nt, Human
aaguccuuggagaauagaaagg

SEQ ID NO: 300806 - RNA, 22 nt, Human
cauguuaauaugcauugaguac

SEQ ID NO: 300807 - RNA, 22 nt, Human
cuuaaauuggaugaguuaaguu

SEQ ID NO: 300808 - RNA, 22 nt, Human
cugcugcccuagacccaguccu

SEQ ID NO: 300809 - RNA, 20 nt, Human
cccugcagccaugggagugg

SEQ ID NO: 300810 - RNA, 22 nt, Human
ugcuggcuggagugccucugga

SEQ ID NO: 300811 - RNA, 22 nt, Human
uugauuccuugaaauauccuug

SEQ ID NO: 300812 - RNA, 22 nt, Human
aauguucagaggacaauauaaa

SEQ ID NO: 300813 - RNA, 23 nt, Human
aaugauuucaugaugauagcagc

SEQ ID NO: 300814 - RNA, 22 nt, Human
acaggugguagaguggaaagag

SEQ ID NO: 300815 - RNA, 22 nt, Human
ugggcuccagcaccugugcucu

SEQ ID NO: 300816 - RNA, 22 nt, Human
cuggcuguaacauuuugccaua

SEQ ID NO: 300817 - RNA, 22 nt, Human
acagguggacacagcagcaguc

SEQ ID NO: 300818 - RNA, 22 nt, Human
cuguuauuuagaacauggaauc

SEQ ID NO: 300819 - RNA, 22 nt, Human
uuccaggaagauucaacaaaag

SEQ ID NO: 300820 - RNA, 22 nt, Human
cagagccucagaauccugugga

SEQ ID NO: 300821 - RNA, 22 nt, Human
agguggggaaaccagcgauccc

SEQ ID NO: 300822 - RNA, 22 nt, Human
ggucccaggaaucuguguucua

SEQ ID NO: 300823 - RNA, 23 nt, Human
auguauuuaaauuucagugauga

SEQ ID NO: 300824 - RNA, 22 nt, Human
uuguuauaaagacuaaauaugu

SEQ ID NO: 300825 - RNA, 22 nt, Human
gauuuuucaguauaaaauauau

SEQ ID NO: 300826 - RNA, 22 nt, Human
gucugcccagaagacauccccu

SEQ ID NO: 300827 - RNA, 22 nt, Human
uaucaucuuguugucaugcagc

SEQ ID NO: 300828 - RNA, 22 nt, Human
acacauaagaaacuacaaagag

SEQ ID NO: 300829 - RNA, 22 nt, Human
ugauucuauggaaggcauaagg

SEQ ID NO: 300830 - RNA, 22 nt, Human
agugauuugggugucagaaagu

SEQ ID NO: 300831 - RNA, 22 nt, Human
gugagauuugaguggggauaca

SEQ ID NO: 300832 - RNA, 21 nt, Human
aaggcuggagaugcaggucug

SEQ ID NO: 300833 - RNA, 22 nt, Human
uacauguuuacuccaagucagg

SEQ ID NO: 300834 - RNA, 22 nt, Human
agagggaucacccuguuucugg

SEQ ID NO: 300835 - RNA, 22 nt, Human
acagcaggcaugaaugacacug

SEQ ID NO: 300836 - RNA, 22 nt, Human
guaaaauucuagcaucugaaag

SEQ ID NO: 300837 - RNA, 22 nt, Human
gaggugucugaguggggaccug

SEQ ID NO: 300838 - RNA, 22 nt, Human
gguguccugggcaggcagcuga

SEQ ID NO: 300839 - RNA, 19 nt, Human
gacaggacgaagggaaguu

SEQ ID NO: 300840 - RNA, 22 nt, Human
aagcagacaucccauacuuuug

SEQ ID NO: 300841 - RNA, 22 nt, Human
ggcaaagagacaugcaucgggg

SEQ ID NO: 300842 - RNA, 21 nt, Human
uccuucucuaugauugucuga

SEQ ID NO: 300843 - RNA, 22 nt, Human
agaugguuuugucuuuaugauu

SEQ ID NO: 300844 - RNA, 21 nt, Human
gggcuuuuuauuuagcacugu

SEQ ID NO: 300845 - RNA, 22 nt, Human
ggguaccaagcugcuugggggc

SEQ ID NO: 300846 - RNA, 22 nt, Human
uggcucugagucugcccuuggc

SEQ ID NO: 300847 - RNA, 22 nt, Human
uucuggauaugggagagggagc

SEQ ID NO: 300848 - RNA, 22 nt, Human
aaaaaccuuucauugcaaaugu

SEQ ID NO: 300849 - RNA, 22 nt, Human
cuguaaaacacuguaguaucug

SEQ ID NO: 300850 - RNA, 22 nt, Human
cuuuauguucaguacaaugcuu

SEQ ID NO: 300851 - RNA, 22 nt, Human
uuucaaagaccauuaacuauca

SEQ ID NO: 300852 - RNA, 22 nt, Human
uaauuuuaugacaguguauuuu

SEQ ID NO: 300853 - RNA, 22 nt, Human
ucaggugucuugugggauuuua

SEQ ID NO: 300854 - RNA, 22 nt, Human
uauuuuaaagugaagggucuug

SEQ ID NO: 300855 - RNA, 22 nt, Human
caacuuuagcaauguuaguaua

SEQ ID NO: 300856 - RNA, 22 nt, Human
ggagcugaaggggugggcucag

SEQ ID NO: 300857 - RNA, 22 nt, Human
uauuucagggagaauaaauuug

SEQ ID NO: 300858 - RNA, 22 nt, Human
cagggcagaacauauagauagu

SEQ ID NO: 300859 - RNA, 22 nt, Human
cuggauguccagguagaaguuu

SEQ ID NO: 300860 - RNA, 22 nt, Human
cugacagaugcugcuggcagua

SEQ ID NO: 300861 - RNA, 22 nt, Human
uuguauuggcaaagaacuugag

SEQ ID NO: 300862 - RNA, 22 nt, Human
gcagacagaagcuaaguagaca

SEQ ID NO: 300863 - RNA, 22 nt, Human
auuuccuguaggggcuugcgaa

SEQ ID NO: 300864 - RNA, 22 nt, Human
ucuuuuaagccucuggcauagg

SEQ ID NO: 300865 - RNA, 22 nt, Human
ucuguugacuccuagcagccau

SEQ ID NO: 300866 - RNA, 22 nt, Human
auuauuaggacuacugggguug

SEQ ID NO: 300867 - RNA, 22 nt, Human
auucuucauacagacaaguccu

SEQ ID NO: 300868 - RNA, 22 nt, Human
gcagcuuucugggacagaaagg

SEQ ID NO: 300869 - RNA, 22 nt, Human
agucucuuuaaucacagugucu

SEQ ID NO: 300870 - RNA, 19 nt, Human
guagggacagugguucuga

SEQ ID NO: 300871 - RNA, 22 nt, Human
uagaacacuugaccacugcucc

SEQ ID NO: 300872 - RNA, 22 nt, Human
gcuggaggcuggagugcagugg

SEQ ID NO: 300873 - RNA, 22 nt, Human
cagggcucgcucgcucgcucgc

SEQ ID NO: 300874 - RNA, 22 nt, Human
guacccaggcacgccuugcuga

SEQ ID NO: 300875 - RNA, 22 nt, Human
gcagacaggcccaguggaggga

SEQ ID NO: 300876 - RNA, 22 nt, Human
cagggcucgcugccagcuucag

SEQ ID NO: 300877 - RNA, 22 nt, Human
uacaguauggaaaauguauagu

SEQ ID NO: 300878 - RNA, 22 nt, Human
aaaauccuuagccgagugaggu

SEQ ID NO: 300879 - RNA, 22 nt, Human
cacaggcuuccaguccccagcu

SEQ ID NO: 300880 - RNA, 22 nt, Human
ggcucugccucugacccucugg

SEQ ID NO: 300881 - RNA, 22 nt, Human
uguccugggccggcgacugguc

SEQ ID NO: 300882 - RNA, 22 nt, Human
uaauugcuuuauccuguuagaa

SEQ ID NO: 300883 - RNA, 22 nt, Human
agcagggccaacaguaaacacc

SEQ ID NO: 300884 - RNA, 22 nt, Human
auuucucaguguacauuauguu

SEQ ID NO: 300885 - RNA, 22 nt, Human
ggcuuuauuauguggccaugug

SEQ ID NO: 300886 - RNA, 22 nt, Human
uuuuauguaauccuuacugucg

SEQ ID NO: 300887 - RNA, 22 nt, Human
guagggacuuguuuuacuagua

SEQ ID NO: 300888 - RNA, 22 nt, Human
gaagcuucguggcucuucaaau

SEQ ID NO: 300889 - RNA, 22 nt, Human
agggaccugucaaugacaguua

SEQ ID NO: 300890 - RNA, 22 nt, Human
auuacaguaacagcuacaaugc

SEQ ID NO: 300891 - RNA, 22 nt, Human
gcccggcagucacacacccagg

SEQ ID NO: 300892 - RNA, 22 nt, Human
ucucuucacaugcuugcuccaa

SEQ ID NO: 300893 - RNA, 22 nt, Human
uccugcagacauuuacaccuuu

SEQ ID NO: 300894 - RNA, 22 nt, Human
aggguggccaccaaguauguca

SEQ ID NO: 300895 - RNA, 22 nt, Human
aggaccugacauuguguuuucu

SEQ ID NO: 300896 - RNA, 22 nt, Human
cugaggaagacagcagcugugu

SEQ ID NO: 300897 - RNA, 22 nt, Human
ccagagaguaaacauuuuccgg

SEQ ID NO: 300898 - RNA, 20 nt, Human
uggaccugucucuuuaggga

SEQ ID NO: 300899 - RNA, 22 nt, Human
agccagagaguguuggagaugu

SEQ ID NO: 300900 - RNA, 22 nt, Human
gcaggcaggcuuccuugaacug

SEQ ID NO: 300901 - RNA, 22 nt, Human
caggcauggugagaacucagcc

SEQ ID NO: 300902 - RNA, 22 nt, Human
agacagguagcaggacagauau

SEQ ID NO: 300903 - RNA, 22 nt, Human
ucaaaggcgguccaggaauaaa

SEQ ID NO: 300904 - RNA, 22 nt, Human
cuguccugguacuuugagguuc

SEQ ID NO: 300905 - RNA, 22 nt, Human
ccauguguugauucucugcaga

SEQ ID NO: 300906 - RNA, 22 nt, Human
cagggcucaggaaaucagacgu

SEQ ID NO: 300907 - RNA, 22 nt, Human
gccaggcagcagcgaggauggu

SEQ ID NO: 300908 - RNA, 23 nt, Human
ugacagaccuucccagacaguca

SEQ ID NO: 300909 - RNA, 22 nt, Human
agagccaggugcugcuguuuga

SEQ ID NO: 300910 - RNA, 22 nt, Human
cagagagcaugggaggcccgag

SEQ ID NO: 300911 - RNA, 22 nt, Human
aaacaucaccauuuuaccuaau

SEQ ID NO: 300912 - RNA, 22 nt, Human
acuuagauuuccuuacugggug

SEQ ID NO: 300913 - RNA, 20 nt, Human
ugaucaugugaaagucaugu

SEQ ID NO: 300914 - RNA, 22 nt, Human
cagguggucaggcaaggacacg

SEQ ID NO: 300915 - RNA, 22 nt, Human
ucuucauuuuacaggcagaccu

SEQ ID NO: 300916 - RNA, 22 nt, Human
uccagcauauauagagaaugag

SEQ ID NO: 300917 - RNA, 17 nt, Human
uaaguuauagcagaaga

SEQ ID NO: 300918 - RNA, 22 nt, Human
guuagggagucagguggcucuu

SEQ ID NO: 300919 - RNA, 22 nt, Human
uuuugagauggagucuugcucu

SEQ ID NO: 300920 - RNA, 22 nt, Human
ugauuuccuaggucuggagaag

SEQ ID NO: 300921 - RNA, 22 nt, Human
acagguguaaaacccaggaugg

SEQ ID NO: 300922 - RNA, 22 nt, Human
auguucuacagauggaaagggg

SEQ ID NO: 300923 - RNA, 22 nt, Human
uauuucuaagagauaucuguac

SEQ ID NO: 300924 - RNA, 22 nt, Human
guccaggucuggacccugagcc

SEQ ID NO: 300925 - RNA, 22 nt, Human
agaggccggccgagcccauggg

SEQ ID NO: 300926 - RNA, 22 nt, Human
uauuugagcgaagcaguguuuu

SEQ ID NO: 300927 - RNA, 18 nt, Human
cagagcagagguggagcg

SEQ ID NO: 300928 - RNA, 22 nt, Human
aaaguggucugcaucccuucug

SEQ ID NO: 300929 - RNA, 22 nt, Human
cugugucccccucagccaggug

SEQ ID NO: 300930 - RNA, 17 nt, Human
uccaggcagcaacugag

SEQ ID NO: 300931 - RNA, 22 nt, Human
auuuguagugaagugaaaauaa

SEQ ID NO: 300932 - RNA, 22 nt, Human
gugcaaaaguaauugugguuuu

SEQ ID NO: 300933 - RNA, 22 nt, Human
uuugacucagcaaauucacagg

SEQ ID NO: 300934 - RNA, 22 nt, Human
cuucugugcuucacaguugcca

SEQ ID NO: 300935 - RNA, 22 nt, Human
ucauuacaguguuuauaugucu

SEQ ID NO: 300936 - RNA, 22 nt, Human
auuguaacauguucagaucacu

SEQ ID NO: 300937 - RNA, 22 nt, Human
aggaccuggaucacagagaucu

SEQ ID NO: 300938 - RNA, 22 nt, Human
ggcuuggaccagucacaguggu

SEQ ID NO: 300939 - RNA, 22 nt, Human
ugacccauggucugaucauagg

SEQ ID NO: 300940 - RNA, 20 nt, Human
uauuuguauuugggaaaguu

SEQ ID NO: 300941 - RNA, 22 nt, Human
guuauugacauguauuaagcac

SEQ ID NO: 300942 - RNA, 22 nt, Human
uuucuagggcucuugucuucug

SEQ ID NO: 300943 - RNA, 22 nt, Human
cuuagggagaaugccucugcag

SEQ ID NO: 300944 - RNA, 22 nt, Human
aagggcucccaacucaucuuuu

SEQ ID NO: 300945 - RNA, 22 nt, Human
uucuuaacucaaauauauaucc

SEQ ID NO: 300946 - RNA, 22 nt, Human
agguuuauguuuggugcaggag

SEQ ID NO: 300947 - RNA, 22 nt, Human
ucuggaggcaggcugccaggau

SEQ ID NO: 300948 - RNA, 22 nt, Human
gggaccugcgccacucacuguc

SEQ ID NO: 300949 - RNA, 22 nt, Human
agcagguguuggcugggccauc

SEQ ID NO: 300950 - RNA, 22 nt, Human
accucaaggaaaaucuagacag

SEQ ID NO: 300951 - RNA, 22 nt, Human
uaagaaacccaggaauuucuua

SEQ ID NO: 300952 - RNA, 22 nt, Human
uuugagguuagcuagcagauca

SEQ ID NO: 300953 - RNA, 22 nt, Human
cccugcagccggccagcucauu

SEQ ID NO: 300954 - RNA, 22 nt, Human
uucaacuauuaugaauaaaauu

SEQ ID NO: 300955 - RNA, 22 nt, Human
aaacacaccuuuggaacuguga

SEQ ID NO: 300956 - RNA, 22 nt, Human
uugcuuuaucucuuaugccuca

SEQ ID NO: 300957 - RNA, 22 nt, Human
uuuucagugggcaaugauguga

SEQ ID NO: 300958 - RNA, 22 nt, Human
cauguguccacccuugaacaca

SEQ ID NO: 300959 - RNA, 22 nt, Human
cucuucuugucucugguuagaa

SEQ ID NO: 300960 - RNA, 22 nt, Human
ucucucagggggaaggcugaag

SEQ ID NO: 300961 - RNA, 22 nt, Human
uaugaaaagguggccaauguag

SEQ ID NO: 300962 - RNA, 22 nt, Human
uagggcaggugaagaaaagcua

SEQ ID NO: 300963 - RNA, 22 nt, Human
uuucaaagucaagaaggauacu

SEQ ID NO: 300964 - RNA, 22 nt, Human
auacaaagacaaaucucaaucu

SEQ ID NO: 300965 - RNA, 21 nt, Human
aggcucccagaaaugggcauc

SEQ ID NO: 300966 - RNA, 22 nt, Human
acagagagaauuggguuuacag

SEQ ID NO: 300967 - RNA, 22 nt, Human
uucuggguaguaugguuaguuu

SEQ ID NO: 300968 - RNA, 22 nt, Human
aggcaggugggagugauuccuu

SEQ ID NO: 300969 - RNA, 22 nt, Human
auucuuaauugccaugcuguau

SEQ ID NO: 300970 - RNA, 22 nt, Human
cucuggaagaauacacuuagaa

SEQ ID NO: 300971 - RNA, 22 nt, Human
uuccagaagccuccauauuacu

SEQ ID NO: 300972 - RNA, 22 nt, Human
guauauaugugugaacauguau

SEQ ID NO: 300973 - RNA, 22 nt, Human
guuauugacucucuuguggcuu

SEQ ID NO: 300974 - RNA, 22 nt, Human
uagcuuuagugaaaaauaucag

SEQ ID NO: 300975 - RNA, 22 nt, Human
aguuuacaugacguguauuuca

SEQ ID NO: 300976 - RNA, 22 nt, Human
ugccuggauucgguuguuguca

SEQ ID NO: 300977 - RNA, 22 nt, Human
ucuggaugggaugaggcaacaa

SEQ ID NO: 300978 - RNA, 22 nt, Human
gguggggcccuggcacugguau

SEQ ID NO: 300979 - RNA, 22 nt, Human
agagggaaaaacucaugucauu

SEQ ID NO: 300980 - RNA, 22 nt, Human
gcagggcaaugaucccgagagg

SEQ ID NO: 300981 - RNA, 22 nt, Human
ucacaaaugaggaaaucgagca

SEQ ID NO: 300982 - RNA, 22 nt, Human
cuuauaaaguccaucugaacaa

SEQ ID NO: 300983 - RNA, 22 nt, Human
aaagcagagguugcagugagcu

SEQ ID NO: 300984 - RNA, 22 nt, Human
ggucuggccuccgggcaggugg

SEQ ID NO: 300985 - RNA, 22 nt, Human
uccaggcauguugggaagauga

SEQ ID NO: 300986 - RNA, 22 nt, Human
cugcuuuagacaacugcuggga

SEQ ID NO: 300987 - RNA, 22 nt, Human
gcaggugguuaaggucccaugu

SEQ ID NO: 300988 - RNA, 22 nt, Human
uuuacagucucuauagucaaaa

SEQ ID NO: 300989 - RNA, 22 nt, Human
auucuucaccugagucagucua

SEQ ID NO: 300990 - RNA, 22 nt, Human
ugauuucuuccuugucauuaga

SEQ ID NO: 300991 - RNA, 22 nt, Human
uccaugagcuagggauucauca

SEQ ID NO: 300992 - RNA, 18 nt, Human
uguaaacacuuucauucu

SEQ ID NO: 300993 - RNA, 22 nt, Human
uugcuguaguguucugauguca

SEQ ID NO: 300994 - RNA, 22 nt, Human
guagggacuguucucaccugag

SEQ ID NO: 300995 - RNA, 22 nt, Human
uuaagucaauaucaaucucagc

SEQ ID NO: 300996 - RNA, 22 nt, Human
aaugauugcaaacauugagaac

SEQ ID NO: 300997 - RNA, 21 nt, Human
cacaugugaauuacugaacug

SEQ ID NO: 300998 - RNA, 22 nt, Human
uccucagaauggauggcagggg

SEQ ID NO: 300999 - RNA, 22 nt, Human
cuguguccuuuuaguugcugug

SEQ ID NO: 301000 - RNA, 22 nt, Human
gcaggcagccacgauucccuug

SEQ ID NO: 301001 - RNA, 22 nt, Human
aaggcuuuuaacuacuguuuua

SEQ ID NO: 301002 - RNA, 22 nt, Human
uucauauaaauggaaucagaau

SEQ ID NO: 301003 - RNA, 22 nt, Human
ucagguguggaccgaggucaga

SEQ ID NO: 301004 - RNA, 22 nt, Human
uuguacaaaggauuuggaagag

SEQ ID NO: 301005 - RNA, 22 nt, Human
uuauugcuuuggaaaacacuca

SEQ ID NO: 301006 - RNA, 22 nt, Human
auuucucaucuuugugaauggu

SEQ ID NO: 301007 - RNA, 22 nt, Human
uucagagacagcaaccaggaca

SEQ ID NO: 301008 - RNA, 22 nt, Human
uuucagaaaacuuaucaucagu

SEQ ID NO: 301009 - RNA, 22 nt, Human
gggaacuugccccagaggaauu

SEQ ID NO: 301010 - RNA, 22 nt, Human
auucucuuuguauaacaucuug

SEQ ID NO: 301011 - RNA, 22 nt, Human
auugcugggaggauguguguuc

SEQ ID NO: 301012 - RNA, 22 nt, Human
ugguccugagaauccuguccuc

SEQ ID NO: 301013 - RNA, 22 nt, Human
cugggugaguauaggaaaggga

SEQ ID NO: 301014 - RNA, 21 nt, Human
ggguguggaaauuacauccug

SEQ ID NO: 301015 - RNA, 22 nt, Human
acagguggccccgagggagugg

SEQ ID NO: 301016 - RNA, 22 nt, Human
acaaauuuauugaagggcauau

SEQ ID NO: 301017 - RNA, 22 nt, Human
cuccagugcacccagaggauuu

SEQ ID NO: 301018 - RNA, 22 nt, Human
cccagugucucuugugccuuuc

SEQ ID NO: 301019 - RNA, 22 nt, Human
ugcccacauggugccauggcca

SEQ ID NO: 301020 - RNA, 22 nt, Human
uaauuucuucaucucugcagcu

SEQ ID NO: 301021 - RNA, 22 nt, Human
ucaggaaagaguuagaugauua

SEQ ID NO: 301022 - RNA, 22 nt, Human
ucagagagguuggugauaagaa

SEQ ID NO: 301023 - RNA, 22 nt, Human
cauccaggcaccacaaccagcu

SEQ ID NO: 301024 - RNA, 22 nt, Human
acagggcagguggcuacugguc

SEQ ID NO: 301025 - RNA, 22 nt, Human
uuucuuuugcccuguggguuag

SEQ ID NO: 301026 - RNA, 22 nt, Human
aguggcagagcugugucuugaa

SEQ ID NO: 301027 - RNA, 22 nt, Human
uuuuauugguaaugauaaaagu

SEQ ID NO: 301028 - RNA, 22 nt, Human
uguaaaaccaaaucaaucuagu

SEQ ID NO: 301029 - RNA, 22 nt, Human
uguguccuaugaaagaggguua

SEQ ID NO: 301030 - RNA, 22 nt, Human
uaauuucaccguugcuagaaau

SEQ ID NO: 301031 - RNA, 22 nt, Human
guacauuuacugaugaaaagua

SEQ ID NO: 301032 - RNA, 21 nt, Human
uucaauacuauuucaauaguc

SEQ ID NO: 301033 - RNA, 22 nt, Human
cauuauugccagccauacugaa

SEQ ID NO: 301034 - RNA, 22 nt, Human
ugcuuuauugcaucaguguggg

SEQ ID NO: 301035 - RNA, 22 nt, Human
cucuggaagaugaccuggguaa

SEQ ID NO: 301036 - RNA, 22 nt, Human
guucucucugcuuccaagaugg

SEQ ID NO: 301037 - RNA, 22 nt, Human
agaaaauuagauuuuacugugu

SEQ ID NO: 301038 - RNA, 22 nt, Human
gcaaggauguacugcaauagga

SEQ ID NO: 301039 - RNA, 22 nt, Human
uucauacaguggcugcacucca

SEQ ID NO: 301040 - RNA, 22 nt, Human
auugcuuuucagacaaugaggc

SEQ ID NO: 301041 - RNA, 22 nt, Human
gggcucucgauuagacccuggg

SEQ ID NO: 301042 - RNA, 22 nt, Human
uccaugagggacacuggaugcu

SEQ ID NO: 301043 - RNA, 22 nt, Human
uaugcacauucacacaaaaaug

SEQ ID NO: 301044 - RNA, 16 nt, Human
uuauugaggccaagga

SEQ ID NO: 301045 - RNA, 22 nt, Human
aaauuucaagcaaaguagcuau

SEQ ID NO: 301046 - RNA, 22 nt, Human
cacuuagucucaccaguucagu

SEQ ID NO: 301047 - RNA, 22 nt, Human
ucagggcaaagggcagaguuug

SEQ ID NO: 301048 - RNA, 22 nt, Human
cuggaggacagaggccaugucu

SEQ ID NO: 301049 - RNA, 22 nt, Human
augggugugaaaauggucaucu

SEQ ID NO: 301050 - RNA, 22 nt, Human
aauugcuuaugccaggugagag

SEQ ID NO: 301051 - RNA, 22 nt, Human
ggacagacagugugagugaggc

SEQ ID NO: 301052 - RNA, 22 nt, Human
acugccaaugguaguuugaugg

SEQ ID NO: 301053 - RNA, 22 nt, Human
uacagacagacuucccacccuc

SEQ ID NO: 301054 - RNA, 22 nt, Human
uaagaaacauuuuuaugacagu

SEQ ID NO: 301055 - RNA, 22 nt, Human
gguguccuugcuccuucagcuu

SEQ ID NO: 301056 - RNA, 21 nt, Human
acagcaagccuucacaugagu

SEQ ID NO: 301057 - RNA, 22 nt, Human
aacaguaaaaaucauuuaguug

SEQ ID NO: 301058 - RNA, 22 nt, Human
augaaaaguucgaucuagaagg

SEQ ID NO: 301059 - RNA, 22 nt, Human
uaucuaaauggaauauuccaga

SEQ ID NO: 301060 - RNA, 23 nt, Human
ucagagaggcccccugcagagau

SEQ ID NO: 301061 - RNA, 22 nt, Human
acugaagaacgcaucagugguu

SEQ ID NO: 301062 - RNA, 22 nt, Human
gcaggcagagucaauuugaucc

SEQ ID NO: 301063 - RNA, 22 nt, Human
ugucaaaaugacuuuacuacag

SEQ ID NO: 301064 - RNA, 22 nt, Human
uguuugcuaggguugguauuua

SEQ ID NO: 301065 - RNA, 22 nt, Human
acuguucacagauuagucgaug

SEQ ID NO: 301066 - RNA, 22 nt, Human
uucagaauauuuguuuuacaug

SEQ ID NO: 301067 - RNA, 22 nt, Human
cuguaaauaugaagaauauaug

SEQ ID NO: 301068 - RNA, 22 nt, Human
uggaaugaaaaguacuucagaa

SEQ ID NO: 301069 - RNA, 22 nt, Human
agacaaaugguaauuaugucua

SEQ ID NO: 301070 - RNA, 22 nt, Human
ccagggcaaaugagaucauagc

SEQ ID NO: 301071 - RNA, 22 nt, Human
acauacauauguuuaaaugcau

SEQ ID NO: 301072 - RNA, 22 nt, Human
uccugaaauucugguugucacu

SEQ ID NO: 301073 - RNA, 22 nt, Human
gggcagguacaagaugcuucuu

SEQ ID NO: 301074 - RNA, 22 nt, Human
ccagguguaggacaccaaggga

SEQ ID NO: 301075 - RNA, 20 nt, Human
uauuugaaauggccaagugu

SEQ ID NO: 301076 - RNA, 19 nt, Human
ccuggaggugaagguucuc

SEQ ID NO: 301077 - RNA, 22 nt, Human
uccaugguuucagucuggcugg

SEQ ID NO: 301078 - RNA, 21 nt, Human
uguaaguuucaucugaauugg

SEQ ID NO: 301079 - RNA, 22 nt, Human
ugugauauuugaguauugucaa

SEQ ID NO: 301080 - RNA, 22 nt, Human
aaggcuuuaugugaccaaaaga

SEQ ID NO: 301081 - RNA, 22 nt, Human
ucauugccauggcauuugcaga

SEQ ID NO: 301082 - RNA, 22 nt, Human
agcaggugacagggcuguggug

SEQ ID NO: 301083 - RNA, 22 nt, Human
uucacuuaacaucauaucauga

SEQ ID NO: 301084 - RNA, 22 nt, Human
ugcaggugcugugucaagagag

SEQ ID NO: 301085 - RNA, 22 nt, Human
uguccugggucccugcuagaag

SEQ ID NO: 301086 - RNA, 22 nt, Human
cagcauuuucuuaauguaggug

SEQ ID NO: 301087 - RNA, 18 nt, Human
agcaggugcuguuucuuu

SEQ ID NO: 301088 - RNA, 22 nt, Human
agcugcaagauuucuuuuguau

SEQ ID NO: 301089 - RNA, 20 nt, Human
cucuggaagaguuuaaaugg

SEQ ID NO: 301090 - RNA, 22 nt, Human
uccagaccuagggcaccccagu

SEQ ID NO: 301091 - RNA, 19 nt, Human
ugccuggacaaaugugggg

SEQ ID NO: 301092 - RNA, 22 nt, Human
uauaaaacagaaagcacuaccu

SEQ ID NO: 301093 - RNA, 20 nt, Human
uuccuguauacaaagaguuc

SEQ ID NO: 301094 - RNA, 22 nt, Human
gagguggugguggaggcauagc

SEQ ID NO: 301095 - RNA, 22 nt, Human
gaugugucuauucaacaugaaa

SEQ ID NO: 301096 - RNA, 22 nt, Human
uuccucagcacaaagccaagau

SEQ ID NO: 301097 - RNA, 22 nt, Human
ggcuuuauauuguuugagcaga

SEQ ID NO: 301098 - RNA, 22 nt, Human
uuuuucugagaauaugagagga

SEQ ID NO: 301099 - RNA, 22 nt, Human
cugauagacaaucaccauggga

SEQ ID NO: 301100 - RNA, 22 nt, Human
agagcauccaucggccaggacc

SEQ ID NO: 301101 - RNA, 22 nt, Human
agggcuccaggggcugggugac

SEQ ID NO: 301102 - RNA, 22 nt, Human
ucucccucauuccugcuuccau

SEQ ID NO: 301103 - RNA, 22 nt, Human
cagcaggauuugaaaggaagag

SEQ ID NO: 301104 - RNA, 20 nt, Human
ucauuacagugcuaagaugu

SEQ ID NO: 301105 - RNA, 22 nt, Human
cugcaaaagucauugugguuuu

SEQ ID NO: 301106 - RNA, 22 nt, Human
cugaaggcuaaaauggacugaa

SEQ ID NO: 301107 - RNA, 22 nt, Human
acagcuuuuuacuaauagauug

SEQ ID NO: 301108 - RNA, 22 nt, Human
augauuucuauauaaacuuaaa

SEQ ID NO: 301109 - RNA, 22 nt, Human
guuacucuugagaggcugaggu

SEQ ID NO: 301110 - RNA, 22 nt, Human
gugugucccuuggaaccucagc

SEQ ID NO: 301111 - RNA, 22 nt, Human
gcauuuaaauuugaacuucaga

SEQ ID NO: 301112 - RNA, 23 nt, Human
aaugggugcaacuauccaugaca

SEQ ID NO: 301113 - RNA, 22 nt, Human
cccaaggccuucaagccagcuc

SEQ ID NO: 301114 - RNA, 22 nt, Human
ugcugggucccuugagagcuca

SEQ ID NO: 301115 - RNA, 22 nt, Human
ucauuuaauugguuuugcucgu

SEQ ID NO: 301116 - RNA, 18 nt, Human
ugcuuggagcauuuacca

SEQ ID NO: 301117 - RNA, 22 nt, Human
caaauucagaaaauugguagag

SEQ ID NO: 301118 - RNA, 22 nt, Human
ucugggaagcugguccuguucu

SEQ ID NO: 301119 - RNA, 22 nt, Human
ugggcuccucgucacucgcugu

SEQ ID NO: 301120 - RNA, 22 nt, Human
acuuugcagggcuugauaucca

SEQ ID NO: 301121 - RNA, 22 nt, Human
ugggcaggaugcguugauucuu

SEQ ID NO: 301122 - RNA, 22 nt, Human
cuggauguccuuccccugaagc

SEQ ID NO: 301123 - RNA, 22 nt, Human
aucaagaauugggagcuauuga

SEQ ID NO: 301124 - RNA, 22 nt, Human
cccagugucuccaacaucagau

SEQ ID NO: 301125 - RNA, 22 nt, Human
aguuuauuuuugauaagucuug

SEQ ID NO: 301126 - RNA, 22 nt, Human
cagggcagcuuccuuuguuagg

SEQ ID NO: 301127 - RNA, 21 nt, Human
uggcaggcagcuggaagcuug

SEQ ID NO: 301128 - RNA, 22 nt, Human
cauuugaaccuggauguucuua

SEQ ID NO: 301129 - RNA, 22 nt, Human
uuucuagucucgaucucuuaau

SEQ ID NO: 301130 - RNA, 20 nt, Human
caugguggaggagcagggcc

SEQ ID NO: 301131 - RNA, 21 nt, Human
uauuugcugccaucuuugagg

SEQ ID NO: 301132 - RNA, 21 nt, Human
aggaggaacccguggcugggc

SEQ ID NO: 301133 - RNA, 22 nt, Human
uuucuacagcuggugcaacuuu

SEQ ID NO: 301134 - RNA, 22 nt, Human
ugcauaaagugccauaguauua

SEQ ID NO: 301135 - RNA, 22 nt, Human
uauguuauuuucauacaacaga

SEQ ID NO: 301136 - RNA, 22 nt, Human
gucuucaacaauaacuaccacu

SEQ ID NO: 301137 - RNA, 22 nt, Human
ccagagagaaaauggagggcca

SEQ ID NO: 301138 - RNA, 22 nt, Human
cuucuucagcacaauauugaug

SEQ ID NO: 301139 - RNA, 22 nt, Human
guuuauaaggcccaauauuucu

SEQ ID NO: 301140 - RNA, 22 nt, Human
cuaauacacccuauugcuuguu

SEQ ID NO: 301141 - RNA, 22 nt, Human
uucacuuauagggauguuauug

SEQ ID NO: 301142 - RNA, 22 nt, Human
augcuauacauaugacaucaca

SEQ ID NO: 301143 - RNA, 22 nt, Human
acaugcauacacguacauaccu

SEQ ID NO: 301144 - RNA, 22 nt, Human
uugcuuuaggauuuaaguggca

SEQ ID NO: 301145 - RNA, 22 nt, Human
uccuggguuaauuaugauucac

SEQ ID NO: 301146 - RNA, 22 nt, Human
auuaauauacacuguuagcaug

SEQ ID NO: 301147 - RNA, 22 nt, Human
uucugaaagccaauucauugaa

SEQ ID NO: 301148 - RNA, 22 nt, Human
agcagggcuguguagguaauga

SEQ ID NO: 301149 - RNA, 20 nt, Human
auccaugagagucuggauuc

SEQ ID NO: 301150 - RNA, 22 nt, Human
ucaggugugggcagagaaacca

SEQ ID NO: 301151 - RNA, 22 nt, Human
cagugggacaugggcacugggc

SEQ ID NO: 301152 - RNA, 22 nt, Human
cccaggcacagauuaucccaau

SEQ ID NO: 301153 - RNA, 21 nt, Human
aauuagggugccucuuauaau

SEQ ID NO: 301154 - RNA, 22 nt, Human
uauuuaaaaagaggccagcugg

SEQ ID NO: 301155 - RNA, 22 nt, Human
agaugaagaugccacuaagacc

SEQ ID NO: 301156 - RNA, 22 nt, Human
cugcguguuugcacccugucug

SEQ ID NO: 301157 - RNA, 22 nt, Human
gggaggaaaugugcagcgaauu

SEQ ID NO: 301158 - RNA, 22 nt, Human
uuucccagagguaugaauaagu

SEQ ID NO: 301159 - RNA, 22 nt, Human
cuauugcuaucauucugguggu

SEQ ID NO: 301160 - RNA, 22 nt, Human
uguccucaaggagcuucagucu

SEQ ID NO: 301161 - RNA, 22 nt, Human
auauauuuugcggucacguggc

SEQ ID NO: 301162 - RNA, 22 nt, Human
aagacaauuugauacuaguugc

SEQ ID NO: 301163 - RNA, 19 nt, Human
ccaggccuggcgucuccgc

SEQ ID NO: 301164 - RNA, 22 nt, Human
cccaggcagcggggucuccuug

SEQ ID NO: 301165 - RNA, 22 nt, Human
auuaaagaaacccagcauguga

SEQ ID NO: 301166 - RNA, 19 nt, Human
uguacauauagagcucagu

SEQ ID NO: 301167 - RNA, 20 nt, Human
acagaugaggaaaaugaagu

SEQ ID NO: 301168 - RNA, 22 nt, Human
guuuacuguuaaccaacgaaug

SEQ ID NO: 301169 - RNA, 22 nt, Human
ucagguguuucuggagaaguaa

SEQ ID NO: 301170 - RNA, 22 nt, Human
cgcagguguguuuucaggacua

SEQ ID NO: 301171 - RNA, 22 nt, Human
ccacagagcauuagauuucaga

SEQ ID NO: 301172 - RNA, 22 nt, Human
gcaggugguggcgcgcgcccug

SEQ ID NO: 301173 - RNA, 22 nt, Human
ucuggguggcugccaaucugcc

SEQ ID NO: 301174 - RNA, 22 nt, Human
uguuuuucaaauauugcucugu

SEQ ID NO: 301175 - RNA, 22 nt, Human
ccucuuccagcuguugcuucca

SEQ ID NO: 301176 - RNA, 22 nt, Human
aauugcuugaugacuaguaauu

SEQ ID NO: 301177 - RNA, 22 nt, Human
gcaggcagucaucuuucauauu

SEQ ID NO: 301178 - RNA, 22 nt, Human
acaguacauaauccugagucug

SEQ ID NO: 301179 - RNA, 22 nt, Human
aggcaggucacaugcuuggcga

SEQ ID NO: 301180 - RNA, 22 nt, Human
uuauugagcaacucuggggcuc

SEQ ID NO: 301181 - RNA, 22 nt, Human
auacacauguguaugugcaugc

SEQ ID NO: 301182 - RNA, 22 nt, Human
gccaggcagagccccgugcagc

SEQ ID NO: 301183 - RNA, 22 nt, Human
auucuucacaaauauauagaag

SEQ ID NO: 301184 - RNA, 22 nt, Human
ucaggugguccuaagugccauc

SEQ ID NO: 301185 - RNA, 22 nt, Human
cuuaacauccugcauuuuucuu

SEQ ID NO: 301186 - RNA, 22 nt, Human
agaugguugucgcaaaugaaug

SEQ ID NO: 301187 - RNA, 22 nt, Human
aauauugagaaccagcauguuu

SEQ ID NO: 301188 - RNA, 22 nt, Human
ugcagggccuucuagaccaugg

SEQ ID NO: 301189 - RNA, 19 nt, Human
gcagacagguccagagagg

SEQ ID NO: 301190 - RNA, 22 nt, Human
uuuccucuuugugacacagcug

SEQ ID NO: 301191 - RNA, 23 nt, Human
agggcuccuuguugauuagcauu

SEQ ID NO: 301192 - RNA, 15 nt, Human
agacagacaguggga

SEQ ID NO: 301193 - RNA, 22 nt, Human
aauguuuuauagcucaagcaau

SEQ ID NO: 301194 - RNA, 22 nt, Human
guucuucacauuucauugagga

SEQ ID NO: 301195 - RNA, 23 nt, Human
gcugugcacgagccacugccugu

SEQ ID NO: 301196 - RNA, 22 nt, Human
agcuuuaugcuuccuacaagcu

SEQ ID NO: 301197 - RNA, 22 nt, Human
aaaugcuagggagaaacucucc

SEQ ID NO: 301198 - RNA, 22 nt, Human
uguauacaggauuacucauagc

SEQ ID NO: 301199 - RNA, 22 nt, Human
ccucugcccuuuuccuguauca

SEQ ID NO: 301200 - RNA, 22 nt, Human
ccagguggacuugauuugaaua

SEQ ID NO: 301201 - RNA, 20 nt, Human
uggucuggagccagugagga

SEQ ID NO: 301202 - RNA, 18 nt, Human
gcagcuuuugauucaccc

SEQ ID NO: 301203 - RNA, 22 nt, Human
aaucaagaaaaugaggauucuu

SEQ ID NO: 301204 - RNA, 22 nt, Human
aagcugcagacccccugucuca

SEQ ID NO: 301205 - RNA, 19 nt, Human
cacuuuauuucuguuuugu

SEQ ID NO: 301206 - RNA, 22 nt, Human
uacauguuauuucacuauuggu

SEQ ID NO: 301207 - RNA, 22 nt, Human
aaugugaaaccgcacagaauaa

SEQ ID NO: 301208 - RNA, 22 nt, Human
cuccuucuccucgggaggccag

SEQ ID NO: 301209 - RNA, 21 nt, Human
gacaggugauucagagcaggg

SEQ ID NO: 301210 - RNA, 22 nt, Human
gccugcagggcccuuguggguc

SEQ ID NO: 301211 - RNA, 22 nt, Human
ucagggcaucaucaugaauaua

SEQ ID NO: 301212 - RNA, 22 nt, Human
gcaguggccacauggaggagga

SEQ ID NO: 301213 - RNA, 22 nt, Human
agcagggcuuugcagacuuggg

SEQ ID NO: 301214 - RNA, 22 nt, Human
aaagcagggaugaggcuagagg

SEQ ID NO: 301215 - RNA, 22 nt, Human
aguugacauccauaacaggaag

SEQ ID NO: 301216 - RNA, 22 nt, Human
uucaaacaaaacuguucccaua

SEQ ID NO: 301217 - RNA, 22 nt, Human
guacuacaguuucucauuaaau

SEQ ID NO: 301218 - RNA, 22 nt, Human
cuccagauguauacuuuccaag

SEQ ID NO: 301219 - RNA, 22 nt, Human
gagcagugccaaagaauuugcg

SEQ ID NO: 301220 - RNA, 22 nt, Human
acugcacuucacccugggugac

SEQ ID NO: 301221 - RNA, 22 nt, Human
uagaaacauauguuugagacau

SEQ ID NO: 301222 - RNA, 22 nt, Human
uguguccugguguuaauuuuau

SEQ ID NO: 301223 - RNA, 22 nt, Human
acacugaauaauugagaguuga

SEQ ID NO: 301224 - RNA, 22 nt, Human
aaggugguuugauuaucccacu

SEQ ID NO: 301225 - RNA, 22 nt, Human
gcuucuauuauuuggagcugag

SEQ ID NO: 301226 - RNA, 17 nt, Human
uuuagaauacaauguuu

SEQ ID NO: 301227 - RNA, 22 nt, Human
ccagggcaucacauccaguguu

SEQ ID NO: 301228 - RNA, 22 nt, Human
aucagagaccggucaagucaug

SEQ ID NO: 301229 - RNA, 22 nt, Human
ucagcuuugcaaguuagaaaau

SEQ ID NO: 301230 - RNA, 22 nt, Human
uccacagaauguaagauccaca

SEQ ID NO: 301231 - RNA, 22 nt, Human
guaacauaguuugugcuucauc

SEQ ID NO: 301232 - RNA, 22 nt, Human
uuuacagaaugucaauuucuau

SEQ ID NO: 301233 - RNA, 22 nt, Human
ucugggugacccugggcaaggc

SEQ ID NO: 301234 - RNA, 22 nt, Human
cccugcagccuugcaugccuuc

SEQ ID NO: 301235 - RNA, 22 nt, Human
gguguccucggauucagggcag

SEQ ID NO: 301236 - RNA, 22 nt, Human
cagaguggcgacccccucagcu

SEQ ID NO: 301237 - RNA, 22 nt, Human
aaugugucagcuugucgaucuu

SEQ ID NO: 301238 - RNA, 22 nt, Human
ccagggcagccaacccagaugc

SEQ ID NO: 301239 - RNA, 22 nt, Human
gagccaccuucaacucaggaau

SEQ ID NO: 301240 - RNA, 22 nt, Human
ccauuguaaagaguauacuuug

SEQ ID NO: 301241 - RNA, 22 nt, Human
aguaaaaucaccaucucuuugu

SEQ ID NO: 301242 - RNA, 22 nt, Human
ugaaaaaccucaguccgcuuua

SEQ ID NO: 301243 - RNA, 22 nt, Human
cauuuauucaugaucuguagcu

SEQ ID NO: 301244 - RNA, 22 nt, Human
uuuucauuuacauuagggaaga

SEQ ID NO: 301245 - RNA, 20 nt, Human
cuguccugaucuuuucagaa

SEQ ID NO: 301246 - RNA, 22 nt, Human
guuucauucggcagcucauaag

SEQ ID NO: 301247 - RNA, 18 nt, Human
ucccuucucccuugccuc

SEQ ID NO: 301248 - RNA, 21 nt, Human
uaucaagauguuaugguugaa

SEQ ID NO: 301249 - RNA, 22 nt, Human
cccaggcaguagaaagaagagg

SEQ ID NO: 301250 - RNA, 22 nt, Human
uagaaucuaguucauucauuug

SEQ ID NO: 301251 - RNA, 22 nt, Human
aauugcuuguuuucggucauaa

SEQ ID NO: 301252 - RNA, 14 nt, Human
gcagguggaucacu

SEQ ID NO: 301253 - RNA, 22 nt, Human
ggaugagguagaugaacaaggg

SEQ ID NO: 301254 - RNA, 22 nt, Human
acacaaguucuaaagauugcgc

SEQ ID NO: 301255 - RNA, 22 nt, Human
aaauguacgggaguagaauuag

SEQ ID NO: 301256 - RNA, 22 nt, Human
cucuucaauagauuguugaggg

SEQ ID NO: 301257 - RNA, 22 nt, Human
auccugaaaacuuacgaagugg

SEQ ID NO: 301258 - RNA, 22 nt, Human
aaauguaagucuuuguuucuua

SEQ ID NO: 301259 - RNA, 22 nt, Human
uuuaaagagaaugugaaggagu

SEQ ID NO: 301260 - RNA, 22 nt, Human
aagugguuugagcacagugcug

SEQ ID NO: 301261 - RNA, 22 nt, Human
ugcagguguagaguugggcucc

SEQ ID NO: 301262 - RNA, 22 nt, Human
agggacuugaugucagggagau

SEQ ID NO: 301263 - RNA, 22 nt, Human
aaagacagacggaaaccugagg

SEQ ID NO: 301264 - RNA, 22 nt, Human
auucaaauuaaguuaauucagc

SEQ ID NO: 301265 - RNA, 22 nt, Human
aauuagggaaguauuuaguagu

SEQ ID NO: 301266 - RNA, 22 nt, Human
aaggugguucgcugguacccag

SEQ ID NO: 301267 - RNA, 22 nt, Human
cagcagagcugugugggaaggg

SEQ ID NO: 301268 - RNA, 22 nt, Human
acagcuuuguuuucccugcuga

SEQ ID NO: 301269 - RNA, 22 nt, Human
aauucaugaguagaaucuauau

SEQ ID NO: 301270 - RNA, 22 nt, Human
aguggcagaucucuggucugga

SEQ ID NO: 301271 - RNA, 22 nt, Human
ccagggcacguugggacaguac

SEQ ID NO: 301272 - RNA, 22 nt, Human
aaaauuauggaguaucccaaag

SEQ ID NO: 301273 - RNA, 22 nt, Human
cucagagaaaaggagcaagggu

SEQ ID NO: 301274 - RNA, 22 nt, Human
uugcaacaucugaacauuuauc

SEQ ID NO: 301275 - RNA, 22 nt, Human
aagcugcagcacagagaggugg

SEQ ID NO: 301276 - RNA, 22 nt, Human
cugagggucaacuugauuguau

SEQ ID NO: 301277 - RNA, 22 nt, Human
uuaugauuugccacagauuggu

SEQ ID NO: 301278 - RNA, 22 nt, Human
ccugggucuugguucaugcucu

SEQ ID NO: 301279 - RNA, 22 nt, Human
uauugcugccaggacccuaucc

SEQ ID NO: 301280 - RNA, 22 nt, Human
ugaggaauggcuuaauguggga

SEQ ID NO: 301281 - RNA, 22 nt, Human
cgcaccacugaauuccagccug

SEQ ID NO: 301282 - RNA, 22 nt, Human
gccaaaucuugcacacucuugu

SEQ ID NO: 301283 - RNA, 22 nt, Human
uagggacccucccugcucuaac

SEQ ID NO: 301284 - RNA, 22 nt, Human
ugcagggcccuugggguugaac

SEQ ID NO: 301285 - RNA, 22 nt, Human
uuggagauaucacaccuucaca

SEQ ID NO: 301286 - RNA, 22 nt, Human
uaauuucaauagcuugcauaau

SEQ ID NO: 301287 - RNA, 22 nt, Human
agaagggccagcuggacaccug

SEQ ID NO: 301288 - RNA, 22 nt, Human
ugagaugaauaacuccugcuaa

SEQ ID NO: 301289 - RNA, 22 nt, Human
uucucauggugucuuuauacau

SEQ ID NO: 301290 - RNA, 22 nt, Human
ugucuuuagagucacaaaacca

SEQ ID NO: 301291 - RNA, 22 nt, Human
cagcaugagaaaaugaaucaga

SEQ ID NO: 301292 - RNA, 19 nt, Human
acagggcagcaauaggaua

SEQ ID NO: 301293 - RNA, 22 nt, Human
cuggcucugagcccaccuccag

SEQ ID NO: 301294 - RNA, 22 nt, Human
uauugcugaugcugaagggaag

SEQ ID NO: 301295 - RNA, 22 nt, Human
uuguguccucuaaucucaccac

SEQ ID NO: 301296 - RNA, 22 nt, Human
acaaaauuguguuaaacuuuau

SEQ ID NO: 301297 - RNA, 22 nt, Human
gcagagcacccugcagugguau

SEQ ID NO: 301298 - RNA, 22 nt, Human
agaugaaaauacgugacuuuaa

SEQ ID NO: 301299 - RNA, 22 nt, Human
uuccaggagccacacaggggcg

SEQ ID NO: 301300 - RNA, 22 nt, Human
ccuagaugggauggcggccggg

SEQ ID NO: 301301 - RNA, 22 nt, Human
aaauggaucuguggaauacauu

SEQ ID NO: 301302 - RNA, 20 nt, Human
uccugcagucgcuagcgccc

SEQ ID NO: 301303 - RNA, 22 nt, Human
cccaggcacucuuggucauuuu

SEQ ID NO: 301304 - RNA, 22 nt, Human
uuauuauagauuaugcaagauu

SEQ ID NO: 301305 - RNA, 22 nt, Human
gccaggcacaguucuaggugcu

SEQ ID NO: 301306 - RNA, 22 nt, Human
caguagacacauuaauauggaa

SEQ ID NO: 301307 - RNA, 21 nt, Human
aaagugguaaggauuauuuug

SEQ ID NO: 301308 - RNA, 22 nt, Human
uauaauuuuagaagagauggaa

SEQ ID NO: 301309 - RNA, 22 nt, Human
acaagaaagguaggauucaggu

SEQ ID NO: 301310 - RNA, 22 nt, Human
uggcaggguuggccaccuuacc

SEQ ID NO: 301311 - RNA, 22 nt, Human
ugaaugauacagaauuauguag

SEQ ID NO: 301312 - RNA, 22 nt, Human
ugucccuggagcuucugucccc

SEQ ID NO: 301313 - RNA, 19 nt, Human
uggugcuggccucccaugg

SEQ ID NO: 301314 - RNA, 20 nt, Human
uuuaucugugggaguggaga

SEQ ID NO: 301315 - RNA, 15 nt, Human
cuccaugauuuugca

SEQ ID NO: 301316 - RNA, 22 nt, Human
uacauguuugguaaaugauggc

SEQ ID NO: 301317 - RNA, 22 nt, Human
gaauugcuaaccaauucaaaau

SEQ ID NO: 301318 - RNA, 22 nt, Human
gauccuguuagaucccauuaga

SEQ ID NO: 301319 - RNA, 22 nt, Human
auuaagggccaauccuccagcc

SEQ ID NO: 301320 - RNA, 22 nt, Human
ugcaggugugguuccucagcca

SEQ ID NO: 301321 - RNA, 22 nt, Human
caacuuuaugauugguuuguca

SEQ ID NO: 301322 - RNA, 22 nt, Human
cuugggaaugcuaacagaugac

SEQ ID NO: 301323 - RNA, 22 nt, Human
cugcaggggccucgagcacagg

SEQ ID NO: 301324 - RNA, 22 nt, Human
acagcaggcaugaagaaauguu

SEQ ID NO: 301325 - RNA, 16 nt, Human
ccuggaggucacuuca

SEQ ID NO: 301326 - RNA, 22 nt, Human
ugguggcaauucaaagacagca

SEQ ID NO: 301327 - RNA, 22 nt, Human
ucuuccuugcuccuugucacuu

SEQ ID NO: 301328 - RNA, 22 nt, Human
uucuuaaaacuuauggacaggu

SEQ ID NO: 301329 - RNA, 22 nt, Human
cuuccuuccacaccuucagaau

SEQ ID NO: 301330 - RNA, 22 nt, Human
auugcuuuugagcuagaauuuu

SEQ ID NO: 301331 - RNA, 22 nt, Human
cugcauuagucaugcuuugcag

SEQ ID NO: 301332 - RNA, 22 nt, Human
ucuuauugguaaugauggcauu

SEQ ID NO: 301333 - RNA, 22 nt, Human
accaggcaacugugaaugggcu

SEQ ID NO: 301334 - RNA, 22 nt, Human
agacauauuggcuugcuuuaau

SEQ ID NO: 301335 - RNA, 22 nt, Human
uuuaucuggacugugauauaaa

SEQ ID NO: 301336 - RNA, 22 nt, Human
ggcuuuugcuguguuuuccaga

SEQ ID NO: 301337 - RNA, 22 nt, Human
uacuacaagggcccuaaaaggu

SEQ ID NO: 301338 - RNA, 22 nt, Human
ccagagagaguacugggcucug

SEQ ID NO: 301339 - RNA, 22 nt, Human
ccuguucauuuuuugacucugc

SEQ ID NO: 301340 - RNA, 22 nt, Human
uucuuuuacauuaagauuucag

SEQ ID NO: 301341 - RNA, 21 nt, Human
uucuggguuguuaaucugaac

SEQ ID NO: 301342 - RNA, 22 nt, Human
ucuccucccaggcucuuccagg

SEQ ID NO: 301343 - RNA, 22 nt, Human
gccagguggcugagcagcugca

SEQ ID NO: 301344 - RNA, 22 nt, Human
uaaaggcuucugcagggacuga

SEQ ID NO: 301345 - RNA, 22 nt, Human
uucuucaauuuuccauauacug

SEQ ID NO: 301346 - RNA, 22 nt, Human
gccaggcagcuagcaaccccug

SEQ ID NO: 301347 - RNA, 22 nt, Human
uaagaacuucggacauguuauc

SEQ ID NO: 301348 - RNA, 22 nt, Human
auaaauaucacuguugucccuc

SEQ ID NO: 301349 - RNA, 22 nt, Human
aggcaggugcuuaugacuugcu

SEQ ID NO: 301350 - RNA, 16 nt, Human
uuuuauugugacagcc

SEQ ID NO: 301351 - RNA, 21 nt, Human
gcaugugugggacuggauccu

SEQ ID NO: 301352 - RNA, 22 nt, Human
aaggugucggcagagccgcuuc

SEQ ID NO: 301353 - RNA, 22 nt, Human
aggcuagaggcuucuggcuuca

SEQ ID NO: 301354 - RNA, 22 nt, Human
auaucaguaucuauguauuugu

SEQ ID NO: 301355 - RNA, 22 nt, Human
acauguaacauauauguagcau

SEQ ID NO: 301356 - RNA, 22 nt, Human
uuucacuagaacguucuuguuu

SEQ ID NO: 301357 - RNA, 22 nt, Human
gacagacacuguguccucacuu

SEQ ID NO: 301358 - RNA, 22 nt, Human
cuuuaguuuaagaacaugauga

SEQ ID NO: 301359 - RNA, 18 nt, Human
cccagcuuagcgccccuc

SEQ ID NO: 301360 - RNA, 22 nt, Human
ccaugcauauaauagugccugg

SEQ ID NO: 301361 - RNA, 23 nt, Human
cagcuuucagggcuuuagggaag

SEQ ID NO: 301362 - RNA, 22 nt, Human
gaugaugaggccaugaggcagg

SEQ ID NO: 301363 - RNA, 19 nt, Human
ggcauccagaacuaccagu

SEQ ID NO: 301364 - RNA, 22 nt, Human
caaaugauagagccgauuauca

SEQ ID NO: 301365 - RNA, 22 nt, Human
cuguuauuuuccucugaacucu

SEQ ID NO: 301366 - RNA, 20 nt, Human
uugcugggaccuuuuucaac

SEQ ID NO: 301367 - RNA, 22 nt, Human
uugcuaauuuaacuaccuuguu

SEQ ID NO: 301368 - RNA, 22 nt, Human
cuguccugaggcagguggccug

SEQ ID NO: 301369 - RNA, 22 nt, Human
auauucuuccaaaacaucauuu

SEQ ID NO: 301370 - RNA, 22 nt, Human
gucaggccaauacucuccagca

SEQ ID NO: 301371 - RNA, 22 nt, Human
ugcagggccgcuggaggucaug

SEQ ID NO: 301372 - RNA, 22 nt, Human
ugccaaauugcccuauaaauga

SEQ ID NO: 301373 - RNA, 22 nt, Human
ucagguggccaaaugggagcgc

SEQ ID NO: 301374 - RNA, 22 nt, Human
cuuuaguuugugauacgaagau

SEQ ID NO: 301375 - RNA, 22 nt, Human
caaauacuaaacauaagauuuu

SEQ ID NO: 301376 - RNA, 15 nt, Human
gcagguggaucacuu

SEQ ID NO: 301377 - RNA, 22 nt, Human
gggugacauuaggaagauagac

SEQ ID NO: 301378 - RNA, 22 nt, Human
cccugcagagccagcccugacc

SEQ ID NO: 301379 - RNA, 17 nt, Human
ggcaggugacagacacc

SEQ ID NO: 301380 - RNA, 22 nt, Human
agcagggcuggggcacgagcca

SEQ ID NO: 301381 - RNA, 22 nt, Human
caguucuuuguggggaguucuc

SEQ ID NO: 301382 - RNA, 22 nt, Human
caguguggcugagacagaggcu

SEQ ID NO: 301383 - RNA, 22 nt, Human
ccagguggcuucugcccgaugu

SEQ ID NO: 301384 - RNA, 22 nt, Human
agauauuuguaucuugcuauug

SEQ ID NO: 301385 - RNA, 22 nt, Human
cuguccuguacuuugaggcccu

SEQ ID NO: 301386 - RNA, 22 nt, Human
uuuuagacuuguauguaaagcc

SEQ ID NO: 301387 - RNA, 23 nt, Human
uugggaaauaguuaagacaugag

SEQ ID NO: 301388 - RNA, 22 nt, Human
uuccugggauuauugucaagca

SEQ ID NO: 301389 - RNA, 22 nt, Human
uauuccaguccuauccucuuuu

SEQ ID NO: 301390 - RNA, 22 nt, Human
gcagagaggauauuauugucca

SEQ ID NO: 301391 - RNA, 22 nt, Human
agacagacauagaaauuaguaa

SEQ ID NO: 301392 - RNA, 22 nt, Human
uuaggaaaaucaugagagauga

SEQ ID NO: 301393 - RNA, 22 nt, Human
acacagcaacuugcaguaugga

SEQ ID NO: 301394 - RNA, 22 nt, Human
aacauuucagcaaauaagaaca

SEQ ID NO: 301395 - RNA, 22 nt, Human
guguguccucauaagauggagg

SEQ ID NO: 301396 - RNA, 22 nt, Human
agcagggcaguuaaaggguccu

SEQ ID NO: 301397 - RNA, 22 nt, Human
cauuuauugguuaggccagcag

SEQ ID NO: 301398 - RNA, 22 nt, Human
acaauaguaagguauauuguca

SEQ ID NO: 301399 - RNA, 22 nt, Human
auuuacagaagcauguaauagc

SEQ ID NO: 301400 - RNA, 22 nt, Human
cuguccugaguucuuggagguc

SEQ ID NO: 301401 - RNA, 22 nt, Human
agauugaagacugguggagcug

SEQ ID NO: 301402 - RNA, 22 nt, Human
cagagggacaguaugaugaaag

SEQ ID NO: 301403 - RNA, 22 nt, Human
guggaaugaauagauuugcauu

SEQ ID NO: 301404 - RNA, 22 nt, Human
auuugcuucugugaaaucaagu

SEQ ID NO: 301405 - RNA, 22 nt, Human
gggagcuguaagggacagguag

SEQ ID NO: 301406 - RNA, 22 nt, Human
uacaugugcuauuuguuuugua

SEQ ID NO: 301407 - RNA, 22 nt, Human
ugucaauauguaauaacugaau

SEQ ID NO: 301408 - RNA, 22 nt, Human
uucauguaauuccauaagguaa

SEQ ID NO: 301409 - RNA, 22 nt, Human
ggaugucugucauuaugcuuuc

SEQ ID NO: 301410 - RNA, 22 nt, Human
aaaagcagagacucuggagcua

SEQ ID NO: 301411 - RNA, 22 nt, Human
uucuuccucacacucucaccca

SEQ ID NO: 301412 - RNA, 22 nt, Human
uagggcucugcucaucaguugu

SEQ ID NO: 301413 - RNA, 22 nt, Human
uacccagggcuuuucugaugca

SEQ ID NO: 301414 - RNA, 22 nt, Human
aguugcagacgcagagauguug

SEQ ID NO: 301415 - RNA, 22 nt, Human
ccagaugagaccacacugcugg

SEQ ID NO: 301416 - RNA, 22 nt, Human
ggcucccugccuguccucaguc

SEQ ID NO: 301417 - RNA, 22 nt, Human
agugugagggguucuuugauau

SEQ ID NO: 301418 - RNA, 22 nt, Human
cuucucucccuggcacucagac

SEQ ID NO: 301419 - RNA, 22 nt, Human
uggacaacauagugagaccuca

SEQ ID NO: 301420 - RNA, 22 nt, Human
gacagacaggagcucacaggca

SEQ ID NO: 301421 - RNA, 22 nt, Human
uuugguauugcacacugucuuc

SEQ ID NO: 301422 - RNA, 22 nt, Human
guauucauauuaaacauaucaa

SEQ ID NO: 301423 - RNA, 22 nt, Human
uugauuucuuacucuuccaagg

SEQ ID NO: 301424 - RNA, 22 nt, Human
caugugucuaaucuacuaauau

SEQ ID NO: 301425 - RNA, 22 nt, Human
uuugcuuucuguugaacagagu

SEQ ID NO: 301426 - RNA, 22 nt, Human
cagggagcuuucccaggacccu

SEQ ID NO: 301427 - RNA, 22 nt, Human
acaggugucuaaggcagacagc

SEQ ID NO: 301428 - RNA, 22 nt, Human
caugaaugcuggguucauguaa

SEQ ID NO: 301429 - RNA, 22 nt, Human
cuuccucccggcccaugcucug

SEQ ID NO: 301430 - RNA, 22 nt, Human
auacaaauuuauagaugcauuu

SEQ ID NO: 301431 - RNA, 22 nt, Human
aagauuuaccacuuuauucaag

SEQ ID NO: 301432 - RNA, 22 nt, Human
cuuuauuguccuucuuaggugg

SEQ ID NO: 301433 - RNA, 22 nt, Human
auuugcauaauagugauuugua

SEQ ID NO: 301434 - RNA, 15 nt, Human
gggcaggucuggggc

SEQ ID NO: 301435 - RNA, 22 nt, Human
guggaauguccuugaucauaag

SEQ ID NO: 301436 - RNA, 22 nt, Human
uuacuucuuacaaaagaaauau

SEQ ID NO: 301437 - RNA, 22 nt, Human
acccagcuguuucccgugucau

SEQ ID NO: 301438 - RNA, 20 nt, Human
gggugggagagucugagggu

SEQ ID NO: 301439 - RNA, 22 nt, Human
ugcaggugccaucgcugcucau

SEQ ID NO: 301440 - RNA, 22 nt, Human
cauguacaaaaggcaaaugccu

SEQ ID NO: 301441 - RNA, 22 nt, Human
gggacaugccccucagugggug

SEQ ID NO: 301442 - RNA, 22 nt, Human
agggcuccgggccaccggccug

SEQ ID NO: 301443 - RNA, 22 nt, Human
ccuguucaaugcccuggcuuca

SEQ ID NO: 301444 - RNA, 16 nt, Human
gcagguggggcgcgca

SEQ ID NO: 301445 - RNA, 22 nt, Human
cuuccagguccuucuugagaag

SEQ ID NO: 301446 - RNA, 22 nt, Human
uccaugagacagauacuguaag

SEQ ID NO: 301447 - RNA, 22 nt, Human
auuuauuggaugcuuacuuggg

SEQ ID NO: 301448 - RNA, 22 nt, Human
auccaugaucaauuuauuacua

SEQ ID NO: 301449 - RNA, 22 nt, Human
cauaauuucuguaucagcacca

SEQ ID NO: 301450 - RNA, 22 nt, Human
ugcacccucaucagucaaaugg

SEQ ID NO: 301451 - RNA, 22 nt, Human
gcaugcaggauagguugagcuc

SEQ ID NO: 301452 - RNA, 18 nt, Human
gggcucacacaggucauc

SEQ ID NO: 301453 - RNA, 22 nt, Human
ugucuucaguaaaauacacuau

SEQ ID NO: 301454 - RNA, 22 nt, Human
cuggcugggagcgagcugcuca

SEQ ID NO: 301455 - RNA, 22 nt, Human
uuuauuagugcuuguaucacug

SEQ ID NO: 301456 - RNA, 22 nt, Human
uauuuaauuagugauuguagag

SEQ ID NO: 301457 - RNA, 22 nt, Human
gccugcagacguguuuuccuca

SEQ ID NO: 301458 - RNA, 22 nt, Human
gcuguucacaucuggaccauuu

SEQ ID NO: 301459 - RNA, 22 nt, Human
ucccugaaacauaauagaugcc

SEQ ID NO: 301460 - RNA, 22 nt, Human
aaagcucuuuuccaaguauuga

SEQ ID NO: 301461 - RNA, 22 nt, Human
auacauacauguaugcacauac

SEQ ID NO: 301462 - RNA, 23 nt, Human
uccuuugucuuugcauagauggu

SEQ ID NO: 301463 - RNA, 22 nt, Human
uagggcagcugcaucaggcacu

SEQ ID NO: 301464 - RNA, 21 nt, Human
uggcagguucaaaggccuauc

SEQ ID NO: 301465 - RNA, 22 nt, Human
gagcaggucuuucauggugcau

SEQ ID NO: 301466 - RNA, 22 nt, Human
uuucaugaggggcaaaaucuca

SEQ ID NO: 301467 - RNA, 22 nt, Human
cagcuuuggcccagucgggagg

SEQ ID NO: 301468 - RNA, 22 nt, Human
accugcagguguuuccacacuu

SEQ ID NO: 301469 - RNA, 22 nt, Human
cuauugaggacauaaggacucu

SEQ ID NO: 301470 - RNA, 22 nt, Human
aaagauucgagcgauguauaaa

SEQ ID NO: 301471 - RNA, 22 nt, Human
ucuguucaugucuuuuuaagug

SEQ ID NO: 301472 - RNA, 22 nt, Human
gcagcuuuguggagaggcccau

SEQ ID NO: 301473 - RNA, 22 nt, Human
uacuaucucuucuaacuucaga

SEQ ID NO: 301474 - RNA, 22 nt, Human
auagauacuggguauggagaug

SEQ ID NO: 301475 - RNA, 22 nt, Human
ucuggcuccugaguccaugcuc

SEQ ID NO: 301476 - RNA, 22 nt, Human
gggcaggggucaguggccccaa

SEQ ID NO: 301477 - RNA, 22 nt, Human
ucagggcauucaagaggccugg

SEQ ID NO: 301478 - RNA, 22 nt, Human
uuuagggacaagggucuggggu

SEQ ID NO: 301479 - RNA, 22 nt, Human
gagccucguggcggccacugcg

SEQ ID NO: 301480 - RNA, 22 nt, Human
cguccuuugaauugaggucuuu

SEQ ID NO: 301481 - RNA, 22 nt, Human
ggcagggcaggaaagucaggaa

SEQ ID NO: 301482 - RNA, 22 nt, Human
gcagcuuucugcaaugucaucc

SEQ ID NO: 301483 - RNA, 22 nt, Human
gcccagcuuuucacuuccacac

SEQ ID NO: 301484 - RNA, 22 nt, Human
uucuucuugucugcccucacau

SEQ ID NO: 301485 - RNA, 22 nt, Human
aaugugucauuucccacaggug

SEQ ID NO: 301486 - RNA, 22 nt, Human
uccuggguagccuguccaagau

SEQ ID NO: 301487 - RNA, 22 nt, Human
aauuucagaacccaaauuagcg

SEQ ID NO: 301488 - RNA, 22 nt, Human
gaggcuccccaugaggccccag

SEQ ID NO: 301489 - RNA, 22 nt, Human
ugcagggccaugguggcggcug

SEQ ID NO: 301490 - RNA, 22 nt, Human
ugauguccucaugucaagcucc

SEQ ID NO: 301491 - RNA, 22 nt, Human
gauuuucugagccuucaaauuu

SEQ ID NO: 301492 - RNA, 23 nt, Human
guguguccauucgcacucuuagg

SEQ ID NO: 301493 - RNA, 22 nt, Human
aaacaucauaggcaugcaugau

SEQ ID NO: 301494 - RNA, 22 nt, Human
cuucuauucacuggucacaguu

SEQ ID NO: 301495 - RNA, 22 nt, Human
aaaagucugcucucauuucaga

SEQ ID NO: 301496 - RNA, 23 nt, Human
ugggaccuguuugcccacagaug

SEQ ID NO: 301497 - RNA, 22 nt, Human
ugcauacacaagcauacaugua

SEQ ID NO: 301498 - RNA, 22 nt, Human
cacagcauaaugaaauauacuu

SEQ ID NO: 301499 - RNA, 22 nt, Human
uugcuuuaaaauggcuaagucu

SEQ ID NO: 301500 - RNA, 21 nt, Human
aaaaagcuggggcaugcaugc

SEQ ID NO: 301501 - RNA, 22 nt, Human
acagaauugaaaguauaaucug

SEQ ID NO: 301502 - RNA, 22 nt, Human
cuggaggaauaauggcaucuug

SEQ ID NO: 301503 - RNA, 22 nt, Human
uucuucaacaaggacacuguua

SEQ ID NO: 301504 - RNA, 22 nt, Human
aagagcaucuauuucacagugg

SEQ ID NO: 301505 - RNA, 22 nt, Human
uaaagcuguuagaguaguaaga

SEQ ID NO: 301506 - RNA, 22 nt, Human
uaggugucugcucuuauuuaac

SEQ ID NO: 301507 - RNA, 22 nt, Human
ggguugaggcggaugucggcgg

SEQ ID NO: 301508 - RNA, 22 nt, Human
gucugcccggccuuccuccacc

SEQ ID NO: 301509 - RNA, 22 nt, Human
ugcuccagugagcuggccaucc

SEQ ID NO: 301510 - RNA, 22 nt, Human
cuucuuucuuuugaucacaggu

SEQ ID NO: 301511 - RNA, 22 nt, Human
ugacaugugcucaucuuggcua

SEQ ID NO: 301512 - RNA, 22 nt, Human
uugcuuuagguauagaauccau

SEQ ID NO: 301513 - RNA, 22 nt, Human
cagcugcaggaacaaaaaugug

SEQ ID NO: 301514 - RNA, 22 nt, Human
uuuaucuguuguaccugcauug

SEQ ID NO: 301515 - RNA, 22 nt, Human
aagaugcagcuuuacaauaagg

SEQ ID NO: 301516 - RNA, 22 nt, Human
cuguugcuaaguagugcaggua

SEQ ID NO: 301517 - RNA, 22 nt, Human
uauccuguuuugcacaauuaua

SEQ ID NO: 301518 - RNA, 22 nt, Human
aagaaaggauauaugggaggua

SEQ ID NO: 301519 - RNA, 22 nt, Human
ugacaguuaagguauacauuca

SEQ ID NO: 301520 - RNA, 22 nt, Human
uccaggaggugaggggaccaaa

SEQ ID NO: 301521 - RNA, 22 nt, Human
uccugcagccuugggcuggagc

SEQ ID NO: 301522 - RNA, 22 nt, Human
auaguguuacccuucuuaaagu

SEQ ID NO: 301523 - RNA, 22 nt, Human
aaggugucggguuagcucagcc

SEQ ID NO: 301524 - RNA, 22 nt, Human
ucugggaaccagugcggcuggg

SEQ ID NO: 301525 - RNA, 22 nt, Human
guaaaauugcaauuacuuuugc

SEQ ID NO: 301526 - RNA, 22 nt, Human
uacaugugaucagaaagugaaa

SEQ ID NO: 301527 - RNA, 18 nt, Human
uccucucuuuccccaggg

SEQ ID NO: 301528 - RNA, 22 nt, Human
gguguccuuguugaacgaaaau

SEQ ID NO: 301529 - RNA, 22 nt, Human
caggcagcugcuggguucagcc

SEQ ID NO: 301530 - RNA, 18 nt, Human
uggcagguccagcugugg

SEQ ID NO: 301531 - RNA, 22 nt, Human
ucagacagcuugggauaacuga

SEQ ID NO: 301532 - RNA, 22 nt, Human
uuugacauuggcuuauucuguu

SEQ ID NO: 301533 - RNA, 18 nt, Human
uuccuucugauguauaug

SEQ ID NO: 301534 - RNA, 23 nt, Human
gggcagguuuuuauaggcuucag

SEQ ID NO: 301535 - RNA, 22 nt, Human
gcauguguggaggagaugugcu

SEQ ID NO: 301536 - RNA, 22 nt, Human
aguccuuuuguuuugagaugag

SEQ ID NO: 301537 - RNA, 22 nt, Human
cauuuguacagaacagcuuuau

SEQ ID NO: 301538 - RNA, 22 nt, Human
aaauucaguuuuaauaaucacu

SEQ ID NO: 301539 - RNA, 22 nt, Human
cuuuucauuguuuguacaugca

SEQ ID NO: 301540 - RNA, 22 nt, Human
uuguccugugauuucagggccu

SEQ ID NO: 301541 - RNA, 22 nt, Human
cacccagcacagagggaggcga

SEQ ID NO: 301542 - RNA, 22 nt, Human
uuucugcagcagacucagugug

SEQ ID NO: 301543 - RNA, 22 nt, Human
ccagguggugccucuguucgca

SEQ ID NO: 301544 - RNA, 22 nt, Human
aacauuuacaaauccuucugca

SEQ ID NO: 301545 - RNA, 22 nt, Human
gacaguuuuuaauccuuucaug

SEQ ID NO: 301546 - RNA, 22 nt, Human
uuaaagaugcagcuuuagagaa

SEQ ID NO: 301547 - RNA, 22 nt, Human
cccaggcaggagugugguggcu

SEQ ID NO: 301548 - RNA, 22 nt, Human
uucuucaaauagcagggaguca

SEQ ID NO: 301549 - RNA, 22 nt, Human
uaugaaacauucauacaaauaa

SEQ ID NO: 301550 - RNA, 22 nt, Human
acaggcaggcgggacagcccga

SEQ ID NO: 301551 - RNA, 23 nt, Human
ccacuagcaccuguucaacuucu

SEQ ID NO: 301552 - RNA, 22 nt, Human
aaugauuggcacuagauacaca

SEQ ID NO: 301553 - RNA, 22 nt, Human
ugcuacuacuugucaacgguca

SEQ ID NO: 301554 - RNA, 22 nt, Human
ggcagggcccugauuccugggg

SEQ ID NO: 301555 - RNA, 22 nt, Human
cagggcagggauguugcggcag

SEQ ID NO: 301556 - RNA, 22 nt, Human
guuagaauaaaaggucagagag

SEQ ID NO: 301557 - RNA, 22 nt, Human
gcagggcaaauguggaaaggag

SEQ ID NO: 301558 - RNA, 22 nt, Human
cuacccagcaccuaggcugccu

SEQ ID NO: 301559 - RNA, 22 nt, Human
aaugaucuggcucaggauauca

SEQ ID NO: 301560 - RNA, 22 nt, Human
cucuggaauguuuacaugcccu

SEQ ID NO: 301561 - RNA, 22 nt, Human
agacaucauguuacagauuaag

SEQ ID NO: 301562 - RNA, 22 nt, Human
aggcaaagaggauauuuugggg

SEQ ID NO: 301563 - RNA, 22 nt, Human
uuguacaaguauuaugugaaca

SEQ ID NO: 301564 - RNA, 21 nt, Human
uccuggcuuuaugcuaccucu

SEQ ID NO: 301565 - RNA, 23 nt, Human
agcuucauugaccuccgcagggg

SEQ ID NO: 301566 - RNA, 22 nt, Human
ucuucaaguuccaaagugcagg

SEQ ID NO: 301567 - RNA, 22 nt, Human
ccugggugaugugcugcccucg

SEQ ID NO: 301568 - RNA, 22 nt, Human
uuugacaaaggaaaaaugcaca

SEQ ID NO: 301569 - RNA, 22 nt, Human
uaagacugugagcucagagacu

SEQ ID NO: 301570 - RNA, 22 nt, Human
agauggucugguuauuuuuagu

SEQ ID NO: 301571 - RNA, 22 nt, Human
aaucucuugggaggaaugaauu

SEQ ID NO: 301572 - RNA, 22 nt, Human
gagcagugagugaauguugccu

SEQ ID NO: 301573 - RNA, 22 nt, Human
ucagucuucccuccagugcaac

SEQ ID NO: 301574 - RNA, 22 nt, Human
auuuccuucggacaguuugggu

SEQ ID NO: 301575 - RNA, 22 nt, Human
auuuuacuacuccaauuaauga

SEQ ID NO: 301576 - RNA, 21 nt, Human
ugcuggguuugcccaucaggc

SEQ ID NO: 301577 - RNA, 22 nt, Human
uggaauguuuccccagccugca

SEQ ID NO: 301578 - RNA, 22 nt, Human
agcugcaauacccuucuuccuu

SEQ ID NO: 301579 - RNA, 19 nt, Human
caugugucaauacuguacc

SEQ ID NO: 301580 - RNA, 22 nt, Human
ggucugcccacuacucuccauu

SEQ ID NO: 301581 - RNA, 20 nt, Human
agacaaaaugacuucaugca

SEQ ID NO: 301582 - RNA, 22 nt, Human
cugggucuggcuacugcuuccu

SEQ ID NO: 301583 - RNA, 22 nt, Human
auucagcauucauuaugcgcca

SEQ ID NO: 301584 - RNA, 17 nt, Human
gcaagggaugggagauu

SEQ ID NO: 301585 - RNA, 22 nt, Human
ggacagaggguugacagaguau

SEQ ID NO: 301586 - RNA, 22 nt, Human
ucuguccuguuuccuccugaca

SEQ ID NO: 301587 - RNA, 22 nt, Human
ggcaggcagaaaaauagaauau

SEQ ID NO: 301588 - RNA, 22 nt, Human
ugggccaggggccucuucugau

SEQ ID NO: 301589 - RNA, 17 nt, Human
gugaagagucauugaau

SEQ ID NO: 301590 - RNA, 22 nt, Human
ugcagguggcagcggggcacca

SEQ ID NO: 301591 - RNA, 22 nt, Human
uaauguaaacacagagacagaa

SEQ ID NO: 301592 - RNA, 22 nt, Human
gugcaguggcagauccuagcuc

SEQ ID NO: 301593 - RNA, 20 nt, Human
auuugcaucugaauaacuua

SEQ ID NO: 301594 - RNA, 22 nt, Human
accuuuauaugaaagaugacau

SEQ ID NO: 301595 - RNA, 22 nt, Human
auaugauuccacuauuguaugg

SEQ ID NO: 301596 - RNA, 22 nt, Human
uuauucagucugucuagggagu

SEQ ID NO: 301597 - RNA, 20 nt, Human
aaacauucauguacaaguga

SEQ ID NO: 301598 - RNA, 22 nt, Human
ggcugccacgucgaggguccaa

SEQ ID NO: 301599 - RNA, 22 nt, Human
uugcuuuacauguucugguaaa

SEQ ID NO: 301600 - RNA, 22 nt, Human
guacacauuaugcuucucuaaa

SEQ ID NO: 301601 - RNA, 22 nt, Human
gagcaguggucugaucuucuaa

SEQ ID NO: 301602 - RNA, 22 nt, Human
uccuaguucucugccagucgcu

SEQ ID NO: 301603 - RNA, 18 nt, Human
uguggcugguccacacug

SEQ ID NO: 301604 - RNA, 22 nt, Human
uaaaagcucuucuguugaguua

SEQ ID NO: 301605 - RNA, 22 nt, Human
agguguccaggaagaugcuggc

SEQ ID NO: 301606 - RNA, 22 nt, Human
agacaucaaugaucagagguag

SEQ ID NO: 301607 - RNA, 23 nt, Human
uggcaggugguuagauguuuugu

SEQ ID NO: 301608 - RNA, 22 nt, Human
ggggugugucugacaaugguau

SEQ ID NO: 301609 - RNA, 22 nt, Human
aaaugcuaacaaggaaugcugc

SEQ ID NO: 301610 - RNA, 22 nt, Human
ugcaggugucucugucuagcgu

SEQ ID NO: 301611 - RNA, 22 nt, Human
cacaugaguccugccagguaug

SEQ ID NO: 301612 - RNA, 22 nt, Human
ggagcugaggaauagcuuugau

SEQ ID NO: 301613 - RNA, 22 nt, Human
auacaacagaaaaugauuauuc

SEQ ID NO: 301614 - RNA, 22 nt, Human
uagggcucacugagaugaauau

SEQ ID NO: 301615 - RNA, 22 nt, Human
aaguccaugaucaagauguggc

SEQ ID NO: 301616 - RNA, 22 nt, Human
cacccagggcugugccugccca

SEQ ID NO: 301617 - RNA, 22 nt, Human
cuguccuccggccaccuacagu

SEQ ID NO: 301618 - RNA, 22 nt, Human
ugugaaaagcaggcuacuuucu

SEQ ID NO: 301619 - RNA, 22 nt, Human
guuuacauauuuuaauugguga

SEQ ID NO: 301620 - RNA, 22 nt, Human
auuuguuccacacauauuuacu

SEQ ID NO: 301621 - RNA, 22 nt, Human
agaaaugucaggaaagaagucc

SEQ ID NO: 301622 - RNA, 22 nt, Human
caggcagcugacugucagauau

SEQ ID NO: 301623 - RNA, 22 nt, Human
guuggcuaugagagcuuuagug

SEQ ID NO: 301624 - RNA, 22 nt, Human
uugggcagggaaaggacaggca

SEQ ID NO: 301625 - RNA, 22 nt, Human
uggcaggugcacuuuugguuuc

SEQ ID NO: 301626 - RNA, 22 nt, Human
cauguaaagaauuucacacaag

SEQ ID NO: 301627 - RNA, 22 nt, Human
cccagugugaugagguugcuaa

SEQ ID NO: 301628 - RNA, 22 nt, Human
ccagagaguaucauggagagua

SEQ ID NO: 301629 - RNA, 22 nt, Human
agggaccucauguaaguggauu

SEQ ID NO: 301630 - RNA, 22 nt, Human
uuauuugcccauguuuagcaga

SEQ ID NO: 301631 - RNA, 22 nt, Human
ucgagcucuggagccaaggaug

SEQ ID NO: 301632 - RNA, 22 nt, Human
uuccagauguuuaaguucugcu

SEQ ID NO: 301633 - RNA, 21 nt, Human
aagaaguuuggauuuuguccu

SEQ ID NO: 301634 - RNA, 21 nt, Human
acaggcucacgauccauuucu

SEQ ID NO: 301635 - RNA, 22 nt, Human
ucccaggccauaaaacucagag

SEQ ID NO: 301636 - RNA, 22 nt, Human
agugcuccuauggaucaguugu

SEQ ID NO: 301637 - RNA, 22 nt, Human
aggagguggcaacugucgacag

SEQ ID NO: 301638 - RNA, 22 nt, Human
acagguggcuuccauuuucuaa

SEQ ID NO: 301639 - RNA, 21 nt, Human
aagaugauauuuuaucuguag

SEQ ID NO: 301640 - RNA, 22 nt, Human
uucccucucacuuaaagcuugg

SEQ ID NO: 301641 - RNA, 22 nt, Human
gagcugaauugcugccauuugc

SEQ ID NO: 301642 - RNA, 21 nt, Human
agguggggcugcaccucugcu

SEQ ID NO: 301643 - RNA, 22 nt, Human
cccugcaguccuuucuuggcuc

SEQ ID NO: 301644 - RNA, 22 nt, Human
ugcaggugucugggggcaacag

SEQ ID NO: 301645 - RNA, 22 nt, Human
cuucucccaaguaugcaguuug

SEQ ID NO: 301646 - RNA, 22 nt, Human
aaauccuaccaagaaauucccu

SEQ ID NO: 301647 - RNA, 22 nt, Human
ugcagggcuauaacuccauucu

SEQ ID NO: 301648 - RNA, 22 nt, Human
uuuagccaacuauaugacuagu

SEQ ID NO: 301649 - RNA, 22 nt, Human
ucauuuguucaucugcucuucu

SEQ ID NO: 301650 - RNA, 22 nt, Human
uaccugcaaaguuccuuuugcc

SEQ ID NO: 301651 - RNA, 22 nt, Human
cccaggcacauccacucuguga

SEQ ID NO: 301652 - RNA, 22 nt, Human
auugagcuguuuuguaggauaa

SEQ ID NO: 301653 - RNA, 22 nt, Human
uucauguaggcugcaaugcaca

SEQ ID NO: 301654 - RNA, 22 nt, Human
uaaaaugaucucucauguucuu

SEQ ID NO: 301655 - RNA, 23 nt, Human
ugcuggguaucagaaucacugag

SEQ ID NO: 301656 - RNA, 22 nt, Human
uucugggugacucacgcucccc

SEQ ID NO: 301657 - RNA, 22 nt, Human
agaagcuuccuacauuguucuu

SEQ ID NO: 301658 - RNA, 22 nt, Human
guuccuuccuaucccgagagcc

SEQ ID NO: 301659 - RNA, 22 nt, Human
gggcagguuggcaucccgggca

SEQ ID NO: 301660 - RNA, 22 nt, Human
uuaaaguguuaacugaagcuua

SEQ ID NO: 301661 - RNA, 22 nt, Human
aggcaguguauugcuagcggcu

SEQ ID NO: 301662 - RNA, 22 nt, Human
uuguacaaauaggaaccucuga

SEQ ID NO: 301663 - RNA, 22 nt, Human
uauuucagucacuucuucucug

SEQ ID NO: 301664 - RNA, 22 nt, Human
cuuuaauuaggaaguauaauga

SEQ ID NO: 301665 - RNA, 22 nt, Human
auuugguuacucaguugucuga

SEQ ID NO: 301666 - RNA, 22 nt, Human
uuccuccuacgcuuaucacuuu

SEQ ID NO: 301667 - RNA, 22 nt, Human
uucagagagaccaaguggcgug

SEQ ID NO: 301668 - RNA, 22 nt, Human
auuaguaguaguuagcagccuc

SEQ ID NO: 301669 - RNA, 22 nt, Human
gagcuuuaccuuagguucuguu

SEQ ID NO: 301670 - RNA, 22 nt, Human
gcaggacaggcguugguccagu

SEQ ID NO: 301671 - RNA, 22 nt, Human
ggcaggcaacggaccacuaguc

SEQ ID NO: 301672 - RNA, 21 nt, Human
cauuagggcagaagcaggaag

SEQ ID NO: 301673 - RNA, 22 nt, Human
agcugcaaaggcacacuugggc

SEQ ID NO: 301674 - RNA, 22 nt, Human
uuauccaagcagaagcugcaca

SEQ ID NO: 301675 - RNA, 21 nt, Human
agaaaauggcguuuuagauuu

SEQ ID NO: 301676 - RNA, 22 nt, Human
gaauuuccucuaaaccccugag

SEQ ID NO: 301677 - RNA, 22 nt, Human
acagggcaugugcaagagacau

SEQ ID NO: 301678 - RNA, 22 nt, Human
auucucaguucacuaguuucuu

SEQ ID NO: 301679 - RNA, 22 nt, Human
uaguucuagccagugaaaugua

SEQ ID NO: 301680 - RNA, 22 nt, Human
auuuccauagagcgucucacag

SEQ ID NO: 301681 - RNA, 22 nt, Human
cagguuuagguggacgugcagg

SEQ ID NO: 301682 - RNA, 22 nt, Human
caggugguuugauaggauaacu

SEQ ID NO: 301683 - RNA, 22 nt, Human
cauucuuacacaauauuuuaau

SEQ ID NO: 301684 - RNA, 22 nt, Human
uagcuuuagaaauauucucaga

SEQ ID NO: 301685 - RNA, 22 nt, Human
cuguccuguggaccugaggacg

SEQ ID NO: 301686 - RNA, 22 nt, Human
ggcuuuaugcacagcagauggu

SEQ ID NO: 301687 - RNA, 21 nt, Human
accucaagcaacaaccaaggu

SEQ ID NO: 301688 - RNA, 22 nt, Human
aaggccaucuacuuacggaauu

SEQ ID NO: 301689 - RNA, 21 nt, Human
ggugacacguggccccgcucu

SEQ ID NO: 301690 - RNA, 22 nt, Human
ucagacagaaagaugaguaugg

SEQ ID NO: 301691 - RNA, 22 nt, Human
uuccugggugguccugguagag

SEQ ID NO: 301692 - RNA, 22 nt, Human
gugugucccuacaacagcuuca

SEQ ID NO: 301693 - RNA, 22 nt, Human
uggagcugacucacaccagcua

SEQ ID NO: 301694 - RNA, 22 nt, Human
uuuucauugagcaccugaguaa

SEQ ID NO: 301695 - RNA, 22 nt, Human
ggcagguguuuuuauauuaaag

SEQ ID NO: 301696 - RNA, 22 nt, Human
accauuugacucucuaaggaua

SEQ ID NO: 301697 - RNA, 22 nt, Human
uuccaugaaauguguuaugcuu

SEQ ID NO: 301698 - RNA, 19 nt, Human
cuguuauugucagagcucc

SEQ ID NO: 301699 - RNA, 22 nt, Human
acuuagauuccugguaccuccg

SEQ ID NO: 301700 - RNA, 22 nt, Human
uuccuucucagcccucgaggau

SEQ ID NO: 301701 - RNA, 17 nt, Human
ccagguggaaucgugga

SEQ ID NO: 301702 - RNA, 22 nt, Human
aagugcuguuucugaugaaugc

SEQ ID NO: 301703 - RNA, 22 nt, Human
auguaacacccacuuuuauagc

SEQ ID NO: 301704 - RNA, 22 nt, Human
cauguccuucucauugccucau

SEQ ID NO: 301705 - RNA, 22 nt, Human
ccaggccucuggcugcuuaguc

SEQ ID NO: 301706 - RNA, 22 nt, Human
gugcauuugugcaugcacaugu

SEQ ID NO: 301707 - RNA, 22 nt, Human
ugucugggagggacagggcuac

SEQ ID NO: 301708 - RNA, 22 nt, Human
uugucuggucaaaucacuugua

SEQ ID NO: 301709 - RNA, 22 nt, Human
cuguggaaaauuuguauguaau

SEQ ID NO: 301710 - RNA, 16 nt, Human
agcagguguauagugu

SEQ ID NO: 301711 - RNA, 22 nt, Human
uuucuucaauugcuaacaagga

SEQ ID NO: 301712 - RNA, 22 nt, Human
auucacaaaaugauauagauac

SEQ ID NO: 301713 - RNA, 22 nt, Human
uuuauugcuggccaccuguagc

SEQ ID NO: 301714 - RNA, 22 nt, Human
agcagggcaaagucaggcuaac

SEQ ID NO: 301715 - RNA, 22 nt, Human
auugaaucugcacuaguauuuu

SEQ ID NO: 301716 - RNA, 22 nt, Human
acagcaugagaguagcaaaagg

SEQ ID NO: 301717 - RNA, 18 nt, Human
uuaguauaacugccugug

SEQ ID NO: 301718 - RNA, 22 nt, Human
caauguuuuuccuuccuuaaua

SEQ ID NO: 301719 - RNA, 22 nt, Human
uuucaguguaucuuccaaaagc

SEQ ID NO: 301720 - RNA, 22 nt, Human
auaugagaauuggaaaauauca

SEQ ID NO: 301721 - RNA, 22 nt, Human
uuauuccagcuaagaguccugg

SEQ ID NO: 301722 - RNA, 21 nt, Human
agguggucugcagcagcugaa

SEQ ID NO: 301723 - RNA, 22 nt, Human
gaauguaaaauugccuacaaga

SEQ ID NO: 301724 - RNA, 22 nt, Human
ucagggcacauucugcaguggc

SEQ ID NO: 301725 - RNA, 22 nt, Human
acccagccacagcauugaggga

SEQ ID NO: 301726 - RNA, 19 nt, Human
ucuguucacauuguuucgc

SEQ ID NO: 301727 - RNA, 22 nt, Human
aagguggugaguacaguuaggu

SEQ ID NO: 301728 - RNA, 22 nt, Human
cggcaggguugguuuucucuga

SEQ ID NO: 301729 - RNA, 22 nt, Human
aggaccugacuggcuccugcuu

SEQ ID NO: 301730 - RNA, 20 nt, Human
ccuuuauuauuuguaugaug

SEQ ID NO: 301731 - RNA, 22 nt, Human
gagggcucugucuggaagggaa

SEQ ID NO: 301732 - RNA, 22 nt, Human
cuguucauggaaaaauaguugg

SEQ ID NO: 301733 - RNA, 19 nt, Human
uuugaauccagcugguaac

SEQ ID NO: 301734 - RNA, 17 nt, Human
uguccauuugccuggag

SEQ ID NO: 301735 - RNA, 22 nt, Human
guuuuauaauugcuucauaaga

SEQ ID NO: 301736 - RNA, 22 nt, Human
gcagguggcagaggugggaucu

SEQ ID NO: 301737 - RNA, 22 nt, Human
auccacagucuuagccaucaaa

SEQ ID NO: 301738 - RNA, 22 nt, Human
gcaggcaggaaggacuaaguaa

SEQ ID NO: 301739 - RNA, 22 nt, Human
aucuuuauuuauugagcacuua

SEQ ID NO: 301740 - RNA, 22 nt, Human
auuaucuauguagaaugauuuu

SEQ ID NO: 301741 - RNA, 22 nt, Human
uuuagcuucaguucuagcuucu

SEQ ID NO: 301742 - RNA, 22 nt, Human
ccaaggcaggggaucaaaguuu

SEQ ID NO: 301743 - RNA, 22 nt, Human
agggacuauuuacccaucucac

SEQ ID NO: 301744 - RNA, 22 nt, Human
cccagggaagggcuaccugagg

SEQ ID NO: 301745 - RNA, 22 nt, Human
acugaaugaggggugaucuggg

SEQ ID NO: 301746 - RNA, 22 nt, Human
acagacuggagugagagaaaua

SEQ ID NO: 301747 - RNA, 22 nt, Human
uccaugagcuagcuuuccaaag

SEQ ID NO: 301748 - RNA, 22 nt, Human
gcagggacaacugugcaccuga

SEQ ID NO: 301749 - RNA, 22 nt, Human
cauuugaaauaguucauucuug

SEQ ID NO: 301750 - RNA, 20 nt, Human
cacaggcuuacaguuuagau

SEQ ID NO: 301751 - RNA, 22 nt, Human
gguguccuugcagaaggcggcg

SEQ ID NO: 301752 - RNA, 20 nt, Human
ucccaaggaugccugggugu

SEQ ID NO: 301753 - RNA, 22 nt, Human
aucuuucaguuucauaccaauu

SEQ ID NO: 301754 - RNA, 17 nt, Human
ucuucucuuccagucuu

SEQ ID NO: 301755 - RNA, 22 nt, Human
uuauucuuuaaacauauauguu

SEQ ID NO: 301756 - RNA, 19 nt, Human
ugcagggcugcgccugggg

SEQ ID NO: 301757 - RNA, 22 nt, Human
agcucccauuaucuucugaaac

SEQ ID NO: 301758 - RNA, 22 nt, Human
agacaucagcuugugugcaggg

SEQ ID NO: 301759 - RNA, 22 nt, Human
guccaugauucuguguaguaga

SEQ ID NO: 301760 - RNA, 22 nt, Human
aauuugauuuucuuaaaccaua

SEQ ID NO: 301761 - RNA, 22 nt, Human
ggcagggaagcuggcaucacgg

SEQ ID NO: 301762 - RNA, 23 nt, Human
gggcuccagucucugcucaguug

SEQ ID NO: 301763 - RNA, 22 nt, Human
gugagggcagaacccccaggcc

SEQ ID NO: 301764 - RNA, 22 nt, Human
ucauuguuucugcuuuucauga

SEQ ID NO: 301765 - RNA, 18 nt, Human
ggugagggagcuggaagc

SEQ ID NO: 301766 - RNA, 22 nt, Human
cacaugaugguggaagccauag

SEQ ID NO: 301767 - RNA, 22 nt, Human
ccagggcauguaacuaauggug

SEQ ID NO: 301768 - RNA, 22 nt, Human
acauuuaaugauccuacuguga

SEQ ID NO: 301769 - RNA, 20 nt, Human
ucagagagagggugccacuu

SEQ ID NO: 301770 - RNA, 22 nt, Human
uuagcuuuagagccauuacugg

SEQ ID NO: 301771 - RNA, 22 nt, Human
ugacauguggcuuugacccagg

SEQ ID NO: 301772 - RNA, 21 nt, Human
aaucauacaaaacaugucagg

SEQ ID NO: 301773 - RNA, 22 nt, Human
acugugagugauuuccuucugg

SEQ ID NO: 301774 - RNA, 22 nt, Human
acacauauauacauauuugugc

SEQ ID NO: 301775 - RNA, 22 nt, Human
ugaaagcuuguuggaaauguag

SEQ ID NO: 301776 - RNA, 22 nt, Human
aaggugguuugcagacagaaua

SEQ ID NO: 301777 - RNA, 22 nt, Human
agccauccuacuaccucagcau

SEQ ID NO: 301778 - RNA, 22 nt, Human
guucuguacuccaagcucuucc

SEQ ID NO: 301779 - RNA, 22 nt, Human
gagggcuccauuccccgugccc

SEQ ID NO: 301780 - RNA, 22 nt, Human
ucugggcccuaaaccagcucua

SEQ ID NO: 301781 - RNA, 22 nt, Human
gagccuccuccuggugugccga

SEQ ID NO: 301782 - RNA, 22 nt, Human
acuguucauuuggauuucucug

SEQ ID NO: 301783 - RNA, 21 nt, Human
augucaaaugcuuuauuuuau

SEQ ID NO: 301784 - RNA, 22 nt, Human
uuauuguaggccuauuguagaa

SEQ ID NO: 301785 - RNA, 22 nt, Human
ugggaccugcccuggccccauc

SEQ ID NO: 301786 - RNA, 22 nt, Human
aaaauccugcugacucgagaug

SEQ ID NO: 301787 - RNA, 22 nt, Human
aacagacagaaaaaugugaucu

SEQ ID NO: 301788 - RNA, 22 nt, Human
ucacuuuggauuauguaauuuc

SEQ ID NO: 301789 - RNA, 22 nt, Human
ucccaaggugcucggcaacagg

SEQ ID NO: 301790 - RNA, 22 nt, Human
cuauuagguaugugguugcuau

SEQ ID NO: 301791 - RNA, 22 nt, Human
cugggugaguugaugaaggaga

SEQ ID NO: 301792 - RNA, 22 nt, Human
acagguggaaacaugguguugg

SEQ ID NO: 301793 - RNA, 22 nt, Human
cccaggcagccccagaagcuug

SEQ ID NO: 301794 - RNA, 22 nt, Human
ugcuggcugcagugcugucaaa

SEQ ID NO: 301795 - RNA, 22 nt, Human
ucagucuuugcuuaugacaaua

SEQ ID NO: 301796 - RNA, 22 nt, Human
auugcuuuuagugaaauuauau

SEQ ID NO: 301797 - RNA, 22 nt, Human
gggcaggugccagcucccuguc

SEQ ID NO: 301798 - RNA, 22 nt, Human
gugcaaaaguaacugugguuuu

SEQ ID NO: 301799 - RNA, 22 nt, Human
uggaaugucauaccauaaaaga

SEQ ID NO: 301800 - RNA, 22 nt, Human
uugcacuaggaaaaggcagcca

SEQ ID NO: 301801 - RNA, 22 nt, Human
ggucucugaacuuccacugcgc

SEQ ID NO: 301802 - RNA, 22 nt, Human
ugcaggugucuccagggcaggu

SEQ ID NO: 301803 - RNA, 22 nt, Human
cagagcaugaauaaaaguuaca

SEQ ID NO: 301804 - RNA, 22 nt, Human
gcuggaggaggaagugugaggg

SEQ ID NO: 301805 - RNA, 22 nt, Human
auuauaaaccuuugaggguggg

SEQ ID NO: 301806 - RNA, 22 nt, Human
uacagacaaagagcaugcggua

SEQ ID NO: 301807 - RNA, 22 nt, Human
ucuucuccagugcuucugcaca

SEQ ID NO: 301808 - RNA, 22 nt, Human
caccugccugcaggggcuccac

SEQ ID NO: 301809 - RNA, 22 nt, Human
aaucauaauuguauacauucau

SEQ ID NO: 301810 - RNA, 22 nt, Human
ugggcaggugcuauuuuccaug

SEQ ID NO: 301811 - RNA, 22 nt, Human
aaaguucauugaugacugaggu

SEQ ID NO: 301812 - RNA, 22 nt, Human
acuugccuguuacauuucuagu

SEQ ID NO: 301813 - RNA, 21 nt, Human
acucaggagacuaacuauguc

SEQ ID NO: 301814 - RNA, 23 nt, Human
uuccagaguccacaucugccacc

SEQ ID NO: 301815 - RNA, 22 nt, Human
uugaucaaaucagcuacugagg

SEQ ID NO: 301816 - RNA, 22 nt, Human
gauuuuauuagcccaaacuuug

SEQ ID NO: 301817 - RNA, 22 nt, Human
gaauugcuaauccaagugacug

SEQ ID NO: 301818 - RNA, 20 nt, Human
agguauaagaaaugugauuu

SEQ ID NO: 301819 - RNA, 18 nt, Human
uuggcuuugagaacuggu

SEQ ID NO: 301820 - RNA, 22 nt, Human
ucagacaggcuggacagcuugc

SEQ ID NO: 301821 - RNA, 21 nt, Human
uuuucuggaguaugucuccuc

SEQ ID NO: 301822 - RNA, 22 nt, Human
uuucaguucaguuuauuauauc

SEQ ID NO: 301823 - RNA, 22 nt, Human
uccucagauauaaaugagggug

SEQ ID NO: 301824 - RNA, 20 nt, Human
gagucacagaagaagcugaa

SEQ ID NO: 301825 - RNA, 22 nt, Human
auggaggaugugcagcaugggc

SEQ ID NO: 301826 - RNA, 22 nt, Human
caggcauagaagggcaagaaua

SEQ ID NO: 301827 - RNA, 22 nt, Human
cugcagggaugugaggcccguu

SEQ ID NO: 301828 - RNA, 22 nt, Human
uauugauaaggauggcugcaau

SEQ ID NO: 301829 - RNA, 22 nt, Human
uugcagggaaaucagugaggau

SEQ ID NO: 301830 - RNA, 22 nt, Human
uauuucagacacugaucuugca

SEQ ID NO: 301831 - RNA, 22 nt, Human
gggacaugaggccauagugauu

SEQ ID NO: 301832 - RNA, 22 nt, Human
agacuucuuugugagcauuuuc

SEQ ID NO: 301833 - RNA, 22 nt, Human
ugcauggacucaucagacaaga

SEQ ID NO: 301834 - RNA, 22 nt, Human
guucuucaucauuuuagauagg

SEQ ID NO: 301835 - RNA, 22 nt, Human
uuuucauuagaaugacugagaa

SEQ ID NO: 301836 - RNA, 23 nt, Human
aggcagguuugggcucuucuugu

SEQ ID NO: 301837 - RNA, 22 nt, Human
aaaaaguauuggccaugguuga

SEQ ID NO: 301838 - RNA, 22 nt, Human
gccaggcauguccucugcagaa

SEQ ID NO: 301839 - RNA, 22 nt, Human
gugcaaaaauaauugugguuuu

SEQ ID NO: 301840 - RNA, 22 nt, Human
uuccaugccuagaacaggauuc

SEQ ID NO: 301841 - RNA, 22 nt, Human
gaagcacauggcuauagcuauu

SEQ ID NO: 301842 - RNA, 22 nt, Human
uuggaggaggcauuggaggauu

SEQ ID NO: 301843 - RNA, 22 nt, Human
cccaggcaucccauuaaggagc

SEQ ID NO: 301844 - RNA, 22 nt, Human
ggcagguggaaguuggcagagc

SEQ ID NO: 301845 - RNA, 22 nt, Human
ugacauguccaggugguccugu

SEQ ID NO: 301846 - RNA, 22 nt, Human
gcauuauuaauagcugcaugag

SEQ ID NO: 301847 - RNA, 22 nt, Human
uuugacucaguggacguacuag

SEQ ID NO: 301848 - RNA, 22 nt, Human
cuuguugcugaauucaggauuc

SEQ ID NO: 301849 - RNA, 22 nt, Human
ugcauacacaugugcacauacg

SEQ ID NO: 301850 - RNA, 22 nt, Human
uucuuugcccuuaaugaaauaa

SEQ ID NO: 301851 - RNA, 22 nt, Human
cagagggcucggcggccgcucc

SEQ ID NO: 301852 - RNA, 22 nt, Human
ucuggagaggaggauguggaca

SEQ ID NO: 301853 - RNA, 22 nt, Human
auguguccucuggcagguuuag

SEQ ID NO: 301854 - RNA, 22 nt, Human
uggcaaagacugcaaggacuuu

SEQ ID NO: 301855 - RNA, 19 nt, Human
agcugcaaaagguggaacu

SEQ ID NO: 301856 - RNA, 22 nt, Human
uuugacucuugcccaguuuggc

SEQ ID NO: 301857 - RNA, 22 nt, Human
aaagugguucuuacauccgugg

SEQ ID NO: 301858 - RNA, 22 nt, Human
cugaggcucaagggcagguggg

SEQ ID NO: 301859 - RNA, 21 nt, Human
uggaccuguccuucucgcugu

SEQ ID NO: 301860 - RNA, 22 nt, Human
uuugcuuaaaguucuuucuggu

SEQ ID NO: 301861 - RNA, 22 nt, Human
gcaggcaggagcccaacugccu

SEQ ID NO: 301862 - RNA, 22 nt, Human
cuuagggaauugggaggaugcc

SEQ ID NO: 301863 - RNA, 20 nt, Human
ugcuuuaugcuauacuuugu

SEQ ID NO: 301864 - RNA, 22 nt, Human
agaaauguauucuguauguuuu

SEQ ID NO: 301865 - RNA, 22 nt, Human
gagggcucaacuacuacuaggc

SEQ ID NO: 301866 - RNA, 22 nt, Human
gcaguccaaaguggcucucacc

SEQ ID NO: 301867 - RNA, 22 nt, Human
auucagagcacuggguagaauu

SEQ ID NO: 301868 - RNA, 22 nt, Human
caguguggugugcacagcuuag

SEQ ID NO: 301869 - RNA, 22 nt, Human
cagggacccgcacagguagcau

SEQ ID NO: 301870 - RNA, 22 nt, Human
gucuucaauagagccucaauuu

SEQ ID NO: 301871 - RNA, 22 nt, Human
uguggggcugucaggcaacugg

SEQ ID NO: 301872 - RNA, 22 nt, Human
cuccagugagcgcggggcaugg

SEQ ID NO: 301873 - RNA, 22 nt, Human
agcuugauuucucugcagugug

SEQ ID NO: 301874 - RNA, 22 nt, Human
cuguguccuccccaucacuucu

SEQ ID NO: 301875 - RNA, 22 nt, Human
gucugcccucacgccagcuggg

SEQ ID NO: 301876 - RNA, 22 nt, Human
agggcgacaauggagagcguuu

SEQ ID NO: 301877 - RNA, 22 nt, Human
uuuccuaggagauugaucacau

SEQ ID NO: 301878 - RNA, 22 nt, Human
ugggugagccacaggaguuguc

SEQ ID NO: 301879 - RNA, 22 nt, Human
uguggcagcugcugcaggagcu

SEQ ID NO: 301880 - RNA, 22 nt, Human
ucuauaaauuaugcagucucag

SEQ ID NO: 301881 - RNA, 22 nt, Human
gcauguguaugguaggaauauu

SEQ ID NO: 301882 - RNA, 23 nt, Human
uuucaaauuacucugcagaugac

SEQ ID NO: 301883 - RNA, 22 nt, Human
uccugcagagacagaggccuca

SEQ ID NO: 301884 - RNA, 22 nt, Human
auucugggucugggugugauca

SEQ ID NO: 301885 - RNA, 22 nt, Human
uuugucuuggccucaguuuucu

SEQ ID NO: 301886 - RNA, 22 nt, Human
aaagcagagaucauggcuugua

SEQ ID NO: 301887 - RNA, 22 nt, Human
ccagguguagcacugcucacag

SEQ ID NO: 301888 - RNA, 22 nt, Human
caggacugauguuccuccagcc

SEQ ID NO: 301889 - RNA, 22 nt, Human
acagcaggcacacaaggauaga

SEQ ID NO: 301890 - RNA, 22 nt, Human
gacuuuaucuuguccuuccugc

SEQ ID NO: 301891 - RNA, 22 nt, Human
gcagggcucaacaggacacccc

SEQ ID NO: 301892 - RNA, 22 nt, Human
ccuugcucaucccccagugccu

SEQ ID NO: 301893 - RNA, 22 nt, Human
ggagcugaaccccaucgugcug

SEQ ID NO: 301894 - RNA, 22 nt, Human
agccuggaauuaaggaaaugca

SEQ ID NO: 301895 - RNA, 22 nt, Human
cuugucuugcacacgguugcca

SEQ ID NO: 301896 - RNA, 22 nt, Human
acauguaaaaggaacaugcaug

SEQ ID NO: 301897 - RNA, 22 nt, Human
gggaccugggccagaggacagu

SEQ ID NO: 301898 - RNA, 22 nt, Human
agcagguggccuccugucuguc

SEQ ID NO: 301899 - RNA, 22 nt, Human
ucacaggcuugugaacauugca

SEQ ID NO: 301900 - RNA, 22 nt, Human
aaguccaguuucauuugagguc

SEQ ID NO: 301901 - RNA, 22 nt, Human
agagcacggccaccauuuacaa

SEQ ID NO: 301902 - RNA, 22 nt, Human
uccaggcaaaaaccaacuacag

SEQ ID NO: 301903 - RNA, 22 nt, Human
uacaaaguagaaauucaguaaa

SEQ ID NO: 301904 - RNA, 22 nt, Human
uaucuauuauguucuauguguc

SEQ ID NO: 301905 - RNA, 22 nt, Human
gugcuggcaccccucuccaguu

SEQ ID NO: 301906 - RNA, 22 nt, Human
uagacaggagucaggcuagaau

SEQ ID NO: 301907 - RNA, 22 nt, Human
uuuccagggcucuguagaagaa

SEQ ID NO: 301908 - RNA, 22 nt, Human
uggcagggccugaaucuuauac

SEQ ID NO: 301909 - RNA, 22 nt, Human
uuuuauuaucuuugaaugggac

SEQ ID NO: 301910 - RNA, 22 nt, Human
gaaugaaucuguaagugacaag

SEQ ID NO: 301911 - RNA, 22 nt, Human
ggcaggugcaccugagccaucu

SEQ ID NO: 301912 - RNA, 22 nt, Human
uauuccaguucaccuuuucauc

SEQ ID NO: 301913 - RNA, 22 nt, Human
ucagagaggcaauacuguuuaa

SEQ ID NO: 301914 - RNA, 22 nt, Human
uuuccauguguacuggccagaa

SEQ ID NO: 301915 - RNA, 22 nt, Human
acuugguggcgaacgaggguca

SEQ ID NO: 301916 - RNA, 22 nt, Human
gaggaggaaguucucuguaggc

SEQ ID NO: 301917 - RNA, 22 nt, Human
uucacaauagcuggcaucaucu

SEQ ID NO: 301918 - RNA, 22 nt, Human
uauuccagaugaaaucauucag

SEQ ID NO: 301919 - RNA, 22 nt, Human
aagguggugaucaucuugaagg

SEQ ID NO: 301920 - RNA, 16 nt, Human
ucaggugugacuuuuu

SEQ ID NO: 301921 - RNA, 22 nt, Human
auaugagagaggaaagauuuua

SEQ ID NO: 301922 - RNA, 22 nt, Human
acaagaauuuacauguagugga

SEQ ID NO: 301923 - RNA, 22 nt, Human
agacaugugguauaaucagggg

SEQ ID NO: 301924 - RNA, 22 nt, Human
gcuggguggaucggaggcucug

SEQ ID NO: 301925 - RNA, 22 nt, Human
aguguccuagcaagccgguccu

SEQ ID NO: 301926 - RNA, 21 nt, Human
ccagagagagggaaguggguu

SEQ ID NO: 301927 - RNA, 22 nt, Human
gccaggcauucuagaaguagug

SEQ ID NO: 301928 - RNA, 22 nt, Human
ccaggugugagcauucugucuu

SEQ ID NO: 301929 - RNA, 20 nt, Human
uugaagaggauauaucgcuc

SEQ ID NO: 301930 - RNA, 22 nt, Human
ugcuuuauuaagagagaaauuu

SEQ ID NO: 301931 - RNA, 22 nt, Human
agaaaauauucauugagaggcu

SEQ ID NO: 301932 - RNA, 22 nt, Human
ccaaaugugccuguuucaacaa

SEQ ID NO: 301933 - RNA, 22 nt, Human
auugcuuuuaagcaccaccuaa

SEQ ID NO: 301934 - RNA, 22 nt, Human
aggaaucagaauucuuagaauu

SEQ ID NO: 301935 - RNA, 22 nt, Human
ucagggcagaauccaaagaauu

SEQ ID NO: 301936 - RNA, 22 nt, Human
uucuucaaugugcccuguuuuc

SEQ ID NO: 301937 - RNA, 22 nt, Human
gcacccaggccggcgacugcag

SEQ ID NO: 301938 - RNA, 22 nt, Human
uacaaaguaauguauaauaucg

SEQ ID NO: 301939 - RNA, 22 nt, Human
uacuuuuagccuauuugauucu

SEQ ID NO: 301940 - RNA, 22 nt, Human
uuuccuaagguagugauaauuu

SEQ ID NO: 301941 - RNA, 22 nt, Human
ucagacagaaggacuauuugaa

SEQ ID NO: 301942 - RNA, 23 nt, Human
uuuuccagaaucgacucuguaga

SEQ ID NO: 301943 - RNA, 22 nt, Human
uuacaguuuaguccaagccaga

SEQ ID NO: 301944 - RNA, 22 nt, Human
gcaugugucuuuauagcagcau

SEQ ID NO: 301945 - RNA, 23 nt, Human
auucuucauuaucuucuagaaaa

SEQ ID NO: 301946 - RNA, 22 nt, Human
ugcagguguaaauuuucaagag

SEQ ID NO: 301947 - RNA, 22 nt, Human
ccauguguaaauuagauaacuc

SEQ ID NO: 301948 - RNA, 22 nt, Human
ccuggguccuggcagccuccug

SEQ ID NO: 301949 - RNA, 22 nt, Human
gauggaaugaauggcagauaca

SEQ ID NO: 301950 - RNA, 22 nt, Human
uuaagauagaacccaguagucu

SEQ ID NO: 301951 - RNA, 22 nt, Human
ucuuuccuagaggcugaugagu

SEQ ID NO: 301952 - RNA, 22 nt, Human
aggcagguuggggaaaagcacu

SEQ ID NO: 301953 - RNA, 19 nt, Human
ucagggcaguccggucccc

SEQ ID NO: 301954 - RNA, 22 nt, Human
acuugguuggucucacccuguu

SEQ ID NO: 301955 - RNA, 22 nt, Human
guggauuacaagacaguugaga

SEQ ID NO: 301956 - RNA, 22 nt, Human
uaguuaggaaaguccagggagc

SEQ ID NO: 301957 - RNA, 22 nt, Human
ucagguguguuguauuuuacca

SEQ ID NO: 301958 - RNA, 22 nt, Human
acuguucacccagcacuagcag

SEQ ID NO: 301959 - RNA, 22 nt, Human
aagcaauagcaacaacuuuaca

SEQ ID NO: 301960 - RNA, 22 nt, Human
ggguggaagccagagaggucau

SEQ ID NO: 301961 - RNA, 22 nt, Human
ugaauagacuggggcugugaag

SEQ ID NO: 301962 - RNA, 22 nt, Human
aaggugucacugggacaggaaa

SEQ ID NO: 301963 - RNA, 22 nt, Human
cagaugaaggccugaaugucua

SEQ ID NO: 301964 - RNA, 22 nt, Human
uguuucaaagaaagaaaauaua

SEQ ID NO: 301965 - RNA, 22 nt, Human
gacuacucaaacuuucucuaua

SEQ ID NO: 301966 - RNA, 22 nt, Human
ucguccugugcaccugccugca

SEQ ID NO: 301967 - RNA, 22 nt, Human
uaaagcuguucagugcagaaag

SEQ ID NO: 301968 - RNA, 22 nt, Human
ucagaugagugcuuucagcugc

SEQ ID NO: 301969 - RNA, 22 nt, Human
cugaggcugggcauggggucca

SEQ ID NO: 301970 - RNA, 22 nt, Human
uaaauguauaggcacuaaaccu

SEQ ID NO: 301971 - RNA, 22 nt, Human
aucugaagggaaguggaaggca

SEQ ID NO: 301972 - RNA, 22 nt, Human
uauuugcaacauaaaacucuga

SEQ ID NO: 301973 - RNA, 22 nt, Human
uaauuauuugaagacauuagag

SEQ ID NO: 301974 - RNA, 22 nt, Human
gguuuauuaaugugaacuguau

SEQ ID NO: 301975 - RNA, 20 nt, Human
ucagggcaugggacagcccc

SEQ ID NO: 301976 - RNA, 20 nt, Human
ucuuauugucuugaggaguu

SEQ ID NO: 301977 - RNA, 22 nt, Human
ucccagugagaugaaacaggua

SEQ ID NO: 301978 - RNA, 19 nt, Human
aaaugugaugguacaauuc

SEQ ID NO: 301979 - RNA, 23 nt, Human
uuuauuuauuuaggcugagggau

SEQ ID NO: 301980 - RNA, 22 nt, Human
accuuuauagcugauuaugaca

SEQ ID NO: 301981 - RNA, 22 nt, Human
ccuuccagaguucagucugccc

SEQ ID NO: 301982 - RNA, 22 nt, Human
gaggaugguaugaggcaagcaa

SEQ ID NO: 301983 - RNA, 22 nt, Human
agggccucuaccauccaagguu

SEQ ID NO: 301984 - RNA, 22 nt, Human
cuggaaauuggagaugauguuu

SEQ ID NO: 301985 - RNA, 20 nt, Human
uugcuuuaucagacaugaua

SEQ ID NO: 301986 - RNA, 22 nt, Human
uucuuuuccuacacagcgauuu

SEQ ID NO: 301987 - RNA, 22 nt, Human
agcagggcagugaucagaaagg

SEQ ID NO: 301988 - RNA, 22 nt, Human
ucugaagagaaugcugcugaac

SEQ ID NO: 301989 - RNA, 22 nt, Human
ggaccugcccuggcucagaugc

SEQ ID NO: 301990 - RNA, 21 nt, Human
uuccuggggacuuccguggga

SEQ ID NO: 301991 - RNA, 22 nt, Human
uguguccugugaucucuagggu

SEQ ID NO: 301992 - RNA, 21 nt, Human
ucagggcagugggagguuccu

SEQ ID NO: 301993 - RNA, 19 nt, Human
agugugaguaauuggaguu

SEQ ID NO: 301994 - RNA, 22 nt, Human
acuauuagcauaucaugaaugg

SEQ ID NO: 301995 - RNA, 22 nt, Human
cauuguuauagcauuacacacc

SEQ ID NO: 301996 - RNA, 22 nt, Human
ccagggcauccucacaucgcag

SEQ ID NO: 301997 - RNA, 22 nt, Human
ggagcugaggcugaggccucac

SEQ ID NO: 301998 - RNA, 22 nt, Human
cugaggcucccucgggucugcu

SEQ ID NO: 301999 - RNA, 23 nt, Human
gacagagugagaccuugucuuac

SEQ ID NO: 302000 - RNA, 22 nt, Human
ucuguucaugaaauaucuuuuu

SEQ ID NO: 302001 - RNA, 22 nt, Human
ucaagaaagggcuucaccagga

SEQ ID NO: 302002 - RNA, 19 nt, Human
cuuuucaucaacagccaau

SEQ ID NO: 302003 - RNA, 22 nt, Human
cacuugauggaagagcagaaga

SEQ ID NO: 302004 - RNA, 22 nt, Human
gcagcuuucuuuuugcaugucu

SEQ ID NO: 302005 - RNA, 22 nt, Human
uucaugugaauauauuugucuu

SEQ ID NO: 302006 - RNA, 22 nt, Human
cuuauauuuuaggaacagacaa

SEQ ID NO: 302007 - RNA, 22 nt, Human
uguccugggucaaauccugguc

SEQ ID NO: 302008 - RNA, 22 nt, Human
ugcagggccagacuggguugga

SEQ ID NO: 302009 - RNA, 21 nt, Human
uuuagggaggauauuuaacuu

SEQ ID NO: 302010 - RNA, 20 nt, Human
ggcaggcaggagguuuccag

SEQ ID NO: 302011 - RNA, 22 nt, Human
acagggcagcaacuuugugccu

SEQ ID NO: 302012 - RNA, 22 nt, Human
auuaaauuggacgcugggggaa

SEQ ID NO: 302013 - RNA, 22 nt, Human
uuucugcauauguauguaugga

SEQ ID NO: 302014 - RNA, 19 nt, Human
uuuagcuuacguuucauug

SEQ ID NO: 302015 - RNA, 21 nt, Human
agaauaaugguaucauuugcu

SEQ ID NO: 302016 - RNA, 22 nt, Human
aggcagguuacaaaaacuuuau

SEQ ID NO: 302017 - RNA, 22 nt, Human
uuauucuucuucucuugccagg

SEQ ID NO: 302018 - RNA, 22 nt, Human
gggcagguggcagggucucugg

SEQ ID NO: 302019 - RNA, 22 nt, Human
ggcagguguggugaccagagau

SEQ ID NO: 302020 - RNA, 22 nt, Human
aaauuagucgguuuaggaauuu

SEQ ID NO: 302021 - RNA, 22 nt, Human
ccagguggacaaggcuuucaca

SEQ ID NO: 302022 - RNA, 22 nt, Human
caggccuccacuccacgcagac

SEQ ID NO: 302023 - RNA, 23 nt, Human
ugcuggcuuccagcugcucccuc

SEQ ID NO: 302024 - RNA, 22 nt, Human
auuccaguuggguucuaauaca

SEQ ID NO: 302025 - RNA, 22 nt, Human
acuuucaugcucugagcacugg

SEQ ID NO: 302026 - RNA, 22 nt, Human
ggcuuggaaaugguaaugagcu

SEQ ID NO: 302027 - RNA, 22 nt, Human
uucuaaauuuuggaagaugcag

SEQ ID NO: 302028 - RNA, 22 nt, Human
aucugcuugaaugagcaacagg

SEQ ID NO: 302029 - RNA, 18 nt, Human
uuauuggugcugcuguuc

SEQ ID NO: 302030 - RNA, 22 nt, Human
uccaggcacuauauauacuuuu

SEQ ID NO: 302031 - RNA, 22 nt, Human
agggcuccuccccggccuccac

SEQ ID NO: 302032 - RNA, 22 nt, Human
uugacacagaucaauauucaac

SEQ ID NO: 302033 - RNA, 22 nt, Human
ugcuagugugugagauguucaa

SEQ ID NO: 302034 - RNA, 23 nt, Human
ugcaggugauuaauccaguuuca

SEQ ID NO: 302035 - RNA, 22 nt, Human
aauucuagcauugugaaaauau

SEQ ID NO: 302036 - RNA, 22 nt, Human
aggagcugugaaugggaggggu

SEQ ID NO: 302037 - RNA, 22 nt, Human
acuguccauucacucauauuca

SEQ ID NO: 302038 - RNA, 22 nt, Human
auuuuuaugacaaaccauccuc

SEQ ID NO: 302039 - RNA, 22 nt, Human
agggccucugacgcccccagcc

SEQ ID NO: 302040 - RNA, 22 nt, Human
uuuaaauguuuaaaacucguga

SEQ ID NO: 302041 - RNA, 19 nt, Human
auuucaagagguuuauugg

SEQ ID NO: 302042 - RNA, 22 nt, Human
ucuggaugcucugagcccaagg

SEQ ID NO: 302043 - RNA, 22 nt, Human
ugguccuggaagguccugaggg

SEQ ID NO: 302044 - RNA, 19 nt, Human
aucugccuguuaucacaua

SEQ ID NO: 302045 - RNA, 22 nt, Human
gggcaggugugcagagcuguug

SEQ ID NO: 302046 - RNA, 22 nt, Human
guggaggacaaaagaagccuuu

SEQ ID NO: 302047 - RNA, 22 nt, Human
agcaaucaccaccucuauauuu

SEQ ID NO: 302048 - RNA, 22 nt, Human
uuucauggcuaggacuagagug

SEQ ID NO: 302049 - RNA, 22 nt, Human
ggcaggugccaguuggcuuggg

SEQ ID NO: 302050 - RNA, 22 nt, Human
uguacauuuagagcucaauaga

SEQ ID NO: 302051 - RNA, 22 nt, Human
caggugguugagagcuguaggc

SEQ ID NO: 302052 - RNA, 22 nt, Human
gcagggcagaccuccagccuau

SEQ ID NO: 302053 - RNA, 20 nt, Human
aaaaucucccagaaacuuau

SEQ ID NO: 302054 - RNA, 22 nt, Human
ggcuuuauuaacucauccguaa

SEQ ID NO: 302055 - RNA, 22 nt, Human
cuguccuggugcuggggauccc

SEQ ID NO: 302056 - RNA, 22 nt, Human
acaguguguucugggaccucca

SEQ ID NO: 302057 - RNA, 22 nt, Human
ugguuaaguccagaaaggaagc

SEQ ID NO: 302058 - RNA, 22 nt, Human
uucugggagagaaagggccuug

SEQ ID NO: 302059 - RNA, 22 nt, Human
agaaauaugcugauuagaugaa

SEQ ID NO: 302060 - RNA, 22 nt, Human
ucaggaaacuacaguugaacua

SEQ ID NO: 302061 - RNA, 23 nt, Human
uauuagggccaggacuggcaaau

SEQ ID NO: 302062 - RNA, 22 nt, Human
uagcuuuaagacauggugaaug

SEQ ID NO: 302063 - RNA, 22 nt, Human
gcuguggucccucuguccucau

SEQ ID NO: 302064 - RNA, 22 nt, Human
ucagagaguuagugucuuagcu

SEQ ID NO: 302065 - RNA, 22 nt, Human
cugguccuaaagcccuacucca

SEQ ID NO: 302066 - RNA, 22 nt, Human
aaguguuuacuuaaagucaugg

SEQ ID NO: 302067 - RNA, 22 nt, Human
cuuucuucaucaagugccacgu

SEQ ID NO: 302068 - RNA, 19 nt, Human
ugguggaggccccauguuc

SEQ ID NO: 302069 - RNA, 22 nt, Human
ucuguucacugagcaauggcaa

SEQ ID NO: 302070 - RNA, 22 nt, Human
uggagcaggaagucuauggcug

SEQ ID NO: 302071 - RNA, 22 nt, Human
uuuagggaugucagaacaggga

SEQ ID NO: 302072 - RNA, 18 nt, Human
uuugcaaaggaaguaugg

SEQ ID NO: 302073 - RNA, 22 nt, Human
cugaaaauguuacacaggaaga

SEQ ID NO: 302074 - RNA, 18 nt, Human
ugcuuuaugcuuauauaa

SEQ ID NO: 302075 - RNA, 16 nt, Human
gcuggagggagggguu

SEQ ID NO: 302076 - RNA, 22 nt, Human
aagcuguucucuaaguuucaug

SEQ ID NO: 302077 - RNA, 22 nt, Human
agcuuuauauuuaaugaauucu

SEQ ID NO: 302078 - RNA, 22 nt, Human
aaucuucuuucuuaacaguaca

SEQ ID NO: 302079 - RNA, 22 nt, Human
uuugaaauuaagauauugucca

SEQ ID NO: 302080 - RNA, 22 nt, Human
agcuuguuagaaauguagacuc

SEQ ID NO: 302081 - RNA, 22 nt, Human
gggacagaaggaagugagcaca

SEQ ID NO: 302082 - RNA, 22 nt, Human
ugcaaaauaaugaacgauuuuu

SEQ ID NO: 302083 - RNA, 22 nt, Human
cagggcucccuugcaaggaggg

SEQ ID NO: 302084 - RNA, 19 nt, Human
agcugcagaccagaagugc

SEQ ID NO: 302085 - RNA, 22 nt, Human
uuuguacauccuaauucugagu

SEQ ID NO: 302086 - RNA, 22 nt, Human
uuauuggaaaagggcuguaauu

SEQ ID NO: 302087 - RNA, 22 nt, Human
ggauguugauugaauggccauu

SEQ ID NO: 302088 - RNA, 22 nt, Human
agucacccuccaacucuccacu

SEQ ID NO: 302089 - RNA, 22 nt, Human
cuauuauuauguuaacuggacu

SEQ ID NO: 302090 - RNA, 22 nt, Human
gaggcagcgggucaggaccgug

SEQ ID NO: 302091 - RNA, 23 nt, Human
ccacagagcugccaauuccugug

SEQ ID NO: 302092 - RNA, 22 nt, Human
uucuuaaagaggcaaaacacag

SEQ ID NO: 302093 - RNA, 21 nt, Human
gcauguguggugugcuccaca

SEQ ID NO: 302094 - RNA, 22 nt, Human
cucugaccauucccuugauuuu

SEQ ID NO: 302095 - RNA, 22 nt, Human
ugcaggugacaccacucuuccu

SEQ ID NO: 302096 - RNA, 22 nt, Human
ggagcugagcagcgauggcgga

SEQ ID NO: 302097 - RNA, 22 nt, Human
ccugggugucaugggcagcugg

SEQ ID NO: 302098 - RNA, 22 nt, Human
gcuggccuugaggugucuuuau

SEQ ID NO: 302099 - RNA, 22 nt, Human
augacagaggagugcaggugau

SEQ ID NO: 302100 - RNA, 22 nt, Human
ggcaggcacaguaauacauguu

SEQ ID NO: 302101 - RNA, 22 nt, Human
cuuccuccgaagaaguugcugg

SEQ ID NO: 302102 - RNA, 22 nt, Human
ucaggugucaagcagggagcug

SEQ ID NO: 302103 - RNA, 22 nt, Human
uuugcaaagugacuauuauaug

SEQ ID NO: 302104 - RNA, 22 nt, Human
auuugcuuaucuccacaguugu

SEQ ID NO: 302105 - RNA, 22 nt, Human
aauacauauggaauuccauguu

SEQ ID NO: 302106 - RNA, 22 nt, Human
ccagcuuucucagaggcuucua

SEQ ID NO: 302107 - RNA, 17 nt, Human
uucagaagcauuuuggc

SEQ ID NO: 302108 - RNA, 22 nt, Human
ugcagggauuauguagggguug

SEQ ID NO: 302109 - RNA, 22 nt, Human
uuauuagcugggcuucagggug

SEQ ID NO: 302110 - RNA, 22 nt, Human
ccaggugugguggcauacaccu

SEQ ID NO: 302111 - RNA, 22 nt, Human
gacauguugaagaauauuugga

SEQ ID NO: 302112 - RNA, 23 nt, Human
uuguccucuggaucgguuugguu

SEQ ID NO: 302113 - RNA, 22 nt, Human
uagaauaugauuaauuuucuua

SEQ ID NO: 302114 - RNA, 22 nt, Human
uuaagcauggaagugaaauaau

SEQ ID NO: 302115 - RNA, 22 nt, Human
ugccugggaucugugcccuuug

SEQ ID NO: 302116 - RNA, 22 nt, Human
agcagguguuuguaucauaagg

SEQ ID NO: 302117 - RNA, 21 nt, Human
aguugcauaggccagccaucc

SEQ ID NO: 302118 - RNA, 22 nt, Human
gagcuuuacuucugacuggugc

SEQ ID NO: 302119 - RNA, 22 nt, Human
cugcggugggcugggcuguccc

SEQ ID NO: 302120 - RNA, 22 nt, Human
uuccucagggaggcuagcagua

SEQ ID NO: 302121 - RNA, 22 nt, Human
uuucuucagccuucacaaccug

SEQ ID NO: 302122 - RNA, 18 nt, Human
ucuugccugcacccucuc

SEQ ID NO: 302123 - RNA, 22 nt, Human
gacaggcuuugagucccagaac

SEQ ID NO: 302124 - RNA, 22 nt, Human
uuuugagauggugucucgcucc

SEQ ID NO: 302125 - RNA, 22 nt, Human
cagaugagaguggccaggguuc

SEQ ID NO: 302126 - RNA, 22 nt, Human
ucuggagggggaugccucaucc

SEQ ID NO: 302127 - RNA, 22 nt, Human
gcaucuaaacuugcaucauugu

SEQ ID NO: 302128 - RNA, 22 nt, Human
uacaucuaucuagaugcucaga

SEQ ID NO: 302129 - RNA, 22 nt, Human
uuuaaaauuuagaccucuccac

SEQ ID NO: 302130 - RNA, 22 nt, Human
cuuuucaugagucuguuauggg

SEQ ID NO: 302131 - RNA, 22 nt, Human
gcaaggacucccugggucauuc

SEQ ID NO: 302132 - RNA, 22 nt, Human
gggacuuaaugcagagagggac

SEQ ID NO: 302133 - RNA, 22 nt, Human
ggcaggcaggucuucauggccc

SEQ ID NO: 302134 - RNA, 22 nt, Human
ugcuccuucccuucccagugag

SEQ ID NO: 302135 - RNA, 22 nt, Human
auuugcugagcucaaagaaaag

SEQ ID NO: 302136 - RNA, 22 nt, Human
aaccugcaguuuuuauucugag

SEQ ID NO: 302137 - RNA, 22 nt, Human
cagggcaguaccgcccucuggc

SEQ ID NO: 302138 - RNA, 22 nt, Human
ggcaggugcucaaaaauauuug

SEQ ID NO: 302139 - RNA, 22 nt, Human
aggcagggucuugcuauguugc

SEQ ID NO: 302140 - RNA, 22 nt, Human
uuuaaaaucagaugggaguugg

SEQ ID NO: 302141 - RNA, 22 nt, Human
gagagacagcacacaguguggg

SEQ ID NO: 302142 - RNA, 22 nt, Human
cuguguccauguucuaauuugg

SEQ ID NO: 302143 - RNA, 22 nt, Human
uuucacaaaugucuuuaacuug

SEQ ID NO: 302144 - RNA, 22 nt, Human
ccaggugggaggaaagcagaga

SEQ ID NO: 302145 - RNA, 22 nt, Human
agggcuccaggggaccaucagu

SEQ ID NO: 302146 - RNA, 21 nt, Human
guccagagagccggcuccuga

SEQ ID NO: 302147 - RNA, 22 nt, Human
aggcagggaccaguuguuuucu

SEQ ID NO: 302148 - RNA, 22 nt, Human
uauugcugacuuguucaguguu

SEQ ID NO: 302149 - RNA, 22 nt, Human
gcagggacgcagcacucuccgu

SEQ ID NO: 302150 - RNA, 22 nt, Human
ggguauuaaaaugaaggagaaa

SEQ ID NO: 302151 - RNA, 20 nt, Human
ggcaggaccccaguggcauc

SEQ ID NO: 302152 - RNA, 22 nt, Human
ugguuccacuaaccugagagcc

SEQ ID NO: 302153 - RNA, 22 nt, Human
cagaugaacucuauccuguggc

SEQ ID NO: 302154 - RNA, 22 nt, Human
ugaccugcguaggugguuucug

SEQ ID NO: 302155 - RNA, 22 nt, Human
aauuagggaggacaaagguaca

SEQ ID NO: 302156 - RNA, 22 nt, Human
uagcuuuaagaugagaugugga

SEQ ID NO: 302157 - RNA, 22 nt, Human
cucuggaaaauugugugggggu

SEQ ID NO: 302158 - RNA, 19 nt, Human
ucaaaggcuuuuaggagac

SEQ ID NO: 302159 - RNA, 22 nt, Human
aauuucagagguagagauucua

SEQ ID NO: 302160 - RNA, 22 nt, Human
agaagucauuuauguuagauga

SEQ ID NO: 302161 - RNA, 20 nt, Human
guguuucaugugauacaaug

SEQ ID NO: 302162 - RNA, 22 nt, Human
uaguauuuccuguaagcuauag

SEQ ID NO: 302163 - RNA, 22 nt, Human
uuugcuugacccuugugcugaa

SEQ ID NO: 302164 - RNA, 22 nt, Human
acuguacuuuagaaaguguagu

SEQ ID NO: 302165 - RNA, 17 nt, Human
aaugaaugaauucuuug

SEQ ID NO: 302166 - RNA, 22 nt, Human
gcauguguugguuuaugcaugu

SEQ ID NO: 302167 - RNA, 22 nt, Human
aaaugucagaagcuuuacuucu

SEQ ID NO: 302168 - RNA, 22 nt, Human
cucugaauggacacuccagugu

SEQ ID NO: 302169 - RNA, 21 nt, Human
uuugacuccucauuuuuauau

SEQ ID NO: 302170 - RNA, 22 nt, Human
cagggcucagggacugcagaaa

SEQ ID NO: 302171 - RNA, 22 nt, Human
ggcauccaaauaccaagaugua

SEQ ID NO: 302172 - RNA, 22 nt, Human
auacagauguugaauguuauau

SEQ ID NO: 302173 - RNA, 22 nt, Human
guucuucaguaaaauuaaaugu

SEQ ID NO: 302174 - RNA, 22 nt, Human
acuguucauauucuuagaaauu

SEQ ID NO: 302175 - RNA, 22 nt, Human
acacacaauuaguuuuaugcuu

SEQ ID NO: 302176 - RNA, 21 nt, Human
ccuucuccauuacaguaagcu

SEQ ID NO: 302177 - RNA, 22 nt, Human
aaagauuauggcauugaaauac

SEQ ID NO: 302178 - RNA, 22 nt, Human
gcugggucucucccugguccug

SEQ ID NO: 302179 - RNA, 22 nt, Human
uaaaacuuaacuauccagauua

SEQ ID NO: 302180 - RNA, 22 nt, Human
uauguauagagucuuuuaaauu

SEQ ID NO: 302181 - RNA, 22 nt, Human
caucuucagguucauggucaua

SEQ ID NO: 302182 - RNA, 22 nt, Human
cugcugccccugagcucagccu

SEQ ID NO: 302183 - RNA, 22 nt, Human
uuccucagcucagcgagagaga

SEQ ID NO: 302184 - RNA, 22 nt, Human
uuugaacugauaaucuucuguu

SEQ ID NO: 302185 - RNA, 22 nt, Human
ugcuggaauaauuucauguuaa

SEQ ID NO: 302186 - RNA, 22 nt, Human
gugaccaucagagaauaacaaa

SEQ ID NO: 302187 - RNA, 22 nt, Human
aaggcucccucuucucgagugu

SEQ ID NO: 302188 - RNA, 22 nt, Human
uuaguuguaaaauggaauuugu

SEQ ID NO: 302189 - RNA, 21 nt, Human
ucauuugugaucugauuucca

SEQ ID NO: 302190 - RNA, 22 nt, Human
gcaggcaguugcaguuuucuag

SEQ ID NO: 302191 - RNA, 22 nt, Human
ugcaggguauccuugucucugc

SEQ ID NO: 302192 - RNA, 22 nt, Human
agucacaguuccuacccaguaa

SEQ ID NO: 302193 - RNA, 22 nt, Human
uagggcucagcucuagcuccug

SEQ ID NO: 302194 - RNA, 22 nt, Human
agcagggccucuggcacugguc

SEQ ID NO: 302195 - RNA, 22 nt, Human
cgggcuccgggucuuugcaguc

SEQ ID NO: 302196 - RNA, 22 nt, Human
cagggcaguaacgggaacaucu

SEQ ID NO: 302197 - RNA, 21 nt, Human
aucauucuggaaaauucaagc

SEQ ID NO: 302198 - RNA, 22 nt, Human
acaggacauguaccaggugguc

SEQ ID NO: 302199 - RNA, 22 nt, Human
uccuucuuugacaaguggcaga

SEQ ID NO: 302200 - RNA, 17 nt, Human
gggcugacaguggccuc

SEQ ID NO: 302201 - RNA, 23 nt, Human
uggaauguuucuuguacugaaug

SEQ ID NO: 302202 - RNA, 22 nt, Human
ucuguucauaguaguguauaug

SEQ ID NO: 302203 - RNA, 22 nt, Human
uguuuacugcauucuauuugcu

SEQ ID NO: 302204 - RNA, 21 nt, Human
uggccaaacuggagcauuuga

SEQ ID NO: 302205 - RNA, 22 nt, Human
aauacaguagguaauaguucau

SEQ ID NO: 302206 - RNA, 21 nt, Human
uaaaggcuuuagaauggcaaa

SEQ ID NO: 302207 - RNA, 22 nt, Human
uucuuguauguaugcaaaauca

SEQ ID NO: 302208 - RNA, 22 nt, Human
cccaggcagagagcuggugagc

SEQ ID NO: 302209 - RNA, 22 nt, Human
aauagugaacaggaacaugcuu

SEQ ID NO: 302210 - RNA, 22 nt, Human
uuagugguaaggaugaaauuuc

SEQ ID NO: 302211 - RNA, 22 nt, Human
gcagggcaucccugagcgggug

SEQ ID NO: 302212 - RNA, 22 nt, Human
cauuuguaucauauguaucuua

SEQ ID NO: 302213 - RNA, 22 nt, Human
caacuuuaauuugggugucaga

SEQ ID NO: 302214 - RNA, 22 nt, Human
agacagguaaauagagaugcug

SEQ ID NO: 302215 - RNA, 22 nt, Human
ucuuuccucugagcuccuguag

SEQ ID NO: 302216 - RNA, 22 nt, Human
gggcucucaaggcagggcccca

SEQ ID NO: 302217 - RNA, 22 nt, Human
ucauuuauaaggaugcaauuaa

SEQ ID NO: 302218 - RNA, 22 nt, Human
cagcaugaauguguucguaggg

SEQ ID NO: 302219 - RNA, 22 nt, Human
uuuguaaauagcaguacucaug

SEQ ID NO: 302220 - RNA, 17 nt, Human
gcuccuucuaacuucca

SEQ ID NO: 302221 - RNA, 22 nt, Human
uguuuuaaagccauugccuuuc

SEQ ID NO: 302222 - RNA, 19 nt, Human
accaggcuuauggucagug

SEQ ID NO: 302223 - RNA, 18 nt, Human
uuucacaaccuccagagg

SEQ ID NO: 302224 - RNA, 22 nt, Human
acuguccuggagcucacacucu

SEQ ID NO: 302225 - RNA, 22 nt, Human
auaguuuuaaaaccucaggaag

SEQ ID NO: 302226 - RNA, 22 nt, Human
cuguggaaggccuguccugaaa

SEQ ID NO: 302227 - RNA, 22 nt, Human
auauauuuacucuccuguugca

SEQ ID NO: 302228 - RNA, 22 nt, Human
uacauguauguguacgugcaug

SEQ ID NO: 302229 - RNA, 22 nt, Human
cacgguggcccacaggugcaag

SEQ ID NO: 302230 - RNA, 22 nt, Human
acagucauuagauacaaugucu

SEQ ID NO: 302231 - RNA, 22 nt, Human
gcugccacucugagcuugcuuc

SEQ ID NO: 302232 - RNA, 22 nt, Human
ucuggccugaaaguccaugcuu

SEQ ID NO: 302233 - RNA, 22 nt, Human
gacuuuauuuuaacggagauuc

SEQ ID NO: 302234 - RNA, 22 nt, Human
gagggaccuuuacacagacauu

SEQ ID NO: 302235 - RNA, 22 nt, Human
cauucauuagaauagauaugua

SEQ ID NO: 302236 - RNA, 22 nt, Human
acaggugugcggaaagcuguga

SEQ ID NO: 302237 - RNA, 22 nt, Human
acauuaaacuugcuuggcugua

SEQ ID NO: 302238 - RNA, 22 nt, Human
ucaagagauugaauaauaacug

SEQ ID NO: 302239 - RNA, 22 nt, Human
auggcuggauaguugaagcucu

SEQ ID NO: 302240 - RNA, 22 nt, Human
cagacagggguaaccuuccuca

SEQ ID NO: 302241 - RNA, 21 nt, Human
ccuuuacaauuuugcauuccu

SEQ ID NO: 302242 - RNA, 22 nt, Human
augaguugaagcuacaagaggc

SEQ ID NO: 302243 - RNA, 22 nt, Human
auaacaugaccugugcuucaca

SEQ ID NO: 302244 - RNA, 22 nt, Human
guuucauuaccugacccaugag

SEQ ID NO: 302245 - RNA, 22 nt, Human
uuuuccagagcugucucuugca

SEQ ID NO: 302246 - RNA, 22 nt, Human
agacagacggcuuuauacacag

SEQ ID NO: 302247 - RNA, 22 nt, Human
cagcuuuaguaacccacugcuc

SEQ ID NO: 302248 - RNA, 22 nt, Human
uucagaaguagcuaagcaguca

SEQ ID NO: 302249 - RNA, 22 nt, Human
uccugggucucuuccuuaguuc

SEQ ID NO: 302250 - RNA, 22 nt, Human
gcagacagaugagggugcuggg

SEQ ID NO: 302251 - RNA, 22 nt, Human
agagagcaguggaucaccuagc

SEQ ID NO: 302252 - RNA, 22 nt, Human
cucuuccuacagucugcuaugc

SEQ ID NO: 302253 - RNA, 22 nt, Human
uaggugguuaugucagccuaga

SEQ ID NO: 302254 - RNA, 22 nt, Human
uccagaccauggauggcugcaa

SEQ ID NO: 302255 - RNA, 22 nt, Human
cagcuuugugcaaugcagucuc

SEQ ID NO: 302256 - RNA, 19 nt, Human
uuugcagugguuccuuugu

SEQ ID NO: 302257 - RNA, 22 nt, Human
cuuuauauauucccaggcugcc

SEQ ID NO: 302258 - RNA, 22 nt, Human
ucagguggaauuaauuaagaga

SEQ ID NO: 302259 - RNA, 22 nt, Human
cuguccugauggugccacuggu

SEQ ID NO: 302260 - RNA, 22 nt, Human
ucagggacgugagcucagaguc

SEQ ID NO: 302261 - RNA, 22 nt, Human
gcccagcuggcuuccagcacau

SEQ ID NO: 302262 - RNA, 22 nt, Human
augcauaauguauguauugacu

SEQ ID NO: 302263 - RNA, 22 nt, Human
ugggucuguagggcuguccaau

SEQ ID NO: 302264 - RNA, 22 nt, Human
ucacugugcucucuagauaggc

SEQ ID NO: 302265 - RNA, 22 nt, Human
gagacaggcagcuaguggguca

SEQ ID NO: 302266 - RNA, 22 nt, Human
ccaguguguuaguggauuuccc

SEQ ID NO: 302267 - RNA, 20 nt, Human
uccaggcagacagcuauggg

SEQ ID NO: 302268 - RNA, 22 nt, Human
gaggugguuuguggugacucau

SEQ ID NO: 302269 - RNA, 22 nt, Human
acagggcaaccucugggagacu

SEQ ID NO: 302270 - RNA, 22 nt, Human
aguguuugucccguuagaaaug

SEQ ID NO: 302271 - RNA, 22 nt, Human
gaaugagggagauguuggugca

SEQ ID NO: 302272 - RNA, 22 nt, Human
guugggguaccuugaggcuggg

SEQ ID NO: 302273 - RNA, 22 nt, Human
accucaagugauccacucaccu

SEQ ID NO: 302274 - RNA, 22 nt, Human
ccuguucacgguguguuguuag

SEQ ID NO: 302275 - RNA, 22 nt, Human
caggugguuguuuggauucuaa

SEQ ID NO: 302276 - RNA, 22 nt, Human
aagcugcacuacuugagggacc

SEQ ID NO: 302277 - RNA, 22 nt, Human
ggcaggcauugcaacauguaca

SEQ ID NO: 302278 - RNA, 22 nt, Human
agguguccaauccugguuggau

SEQ ID NO: 302279 - RNA, 22 nt, Human
caaaaaacacagaugucugugu

SEQ ID NO: 302280 - RNA, 22 nt, Human
gcugccagucuaaugggaaaca

SEQ ID NO: 302281 - RNA, 23 nt, Human
ugcagggcaaguuagagacccca

SEQ ID NO: 302282 - RNA, 22 nt, Human
aggaccugccaggugcaaagca

SEQ ID NO: 302283 - RNA, 23 nt, Human
guuccuucauguggucauugguu

SEQ ID NO: 302284 - RNA, 22 nt, Human
agcuuuaucccuugcccaucga

SEQ ID NO: 302285 - RNA, 22 nt, Human
guuucuuuugugaucaccaacc

SEQ ID NO: 302286 - RNA, 22 nt, Human
aaacuuucauguaucucuuuca

SEQ ID NO: 302287 - RNA, 22 nt, Human
gaaguuuauuucaaucuauuca

SEQ ID NO: 302288 - RNA, 17 nt, Human
ugauaguucauuuuaag

SEQ ID NO: 302289 - RNA, 21 nt, Human
uccugcaggaggccugagagg

SEQ ID NO: 302290 - RNA, 22 nt, Human
ccagguguggggaggacucaca

SEQ ID NO: 302291 - RNA, 22 nt, Human
aacaaugugaagugcuguucag

SEQ ID NO: 302292 - RNA, 22 nt, Human
aggaaacuguccccucauccua

SEQ ID NO: 302293 - RNA, 22 nt, Human
agucagguacuccgagggcaug

SEQ ID NO: 302294 - RNA, 22 nt, Human
accucaagaauguauaacacag

SEQ ID NO: 302295 - RNA, 22 nt, Human
uuccaugaagggcagccucuca

SEQ ID NO: 302296 - RNA, 19 nt, Human
auuuauuguaugauuccau

SEQ ID NO: 302297 - RNA, 22 nt, Human
acagggcagagaggcaggcuug

SEQ ID NO: 302298 - RNA, 17 nt, Human
ucuguucaugcauaccu

SEQ ID NO: 302299 - RNA, 22 nt, Human
cucuggccugcuuccucaggua

SEQ ID NO: 302300 - RNA, 22 nt, Human
gggcugacucugcacugagcca

SEQ ID NO: 302301 - RNA, 22 nt, Human
aacuugguuguuggcaauuugc

SEQ ID NO: 302302 - RNA, 20 nt, Human
uacagaaugcaauaaaaugg

SEQ ID NO: 302303 - RNA, 20 nt, Human
agcauuugaaauaugacuau

SEQ ID NO: 302304 - RNA, 22 nt, Human
ccaggugugccagcagggacug

SEQ ID NO: 302305 - RNA, 22 nt, Human
gccugcaguucugugcuaggca

SEQ ID NO: 302306 - RNA, 22 nt, Human
uugcuuuauuggguuuacugcc

SEQ ID NO: 302307 - RNA, 22 nt, Human
ggcagguggauuuucuacucua

SEQ ID NO: 302308 - RNA, 22 nt, Human
aguguccuugagguuccuagga

SEQ ID NO: 302309 - RNA, 22 nt, Human
uuagcuuucagccuuucucacc

SEQ ID NO: 302310 - RNA, 22 nt, Human
acuguucauccuuuuugaacaa

SEQ ID NO: 302311 - RNA, 20 nt, Human
cuugguggcucugggaagug

SEQ ID NO: 302312 - RNA, 22 nt, Human
guuucauuuacaucuguaggua

SEQ ID NO: 302313 - RNA, 22 nt, Human
uauuuguagaauggauuaaggg

SEQ ID NO: 302314 - RNA, 22 nt, Human
acagcuuuguguuaaugggaag

SEQ ID NO: 302315 - RNA, 22 nt, Human
uguccuuugggagggcacagcu

SEQ ID NO: 302316 - RNA, 22 nt, Human
cugcaggguuuuucaaggacaa

SEQ ID NO: 302317 - RNA, 22 nt, Human
gggcagguaggugaaauaauga

SEQ ID NO: 302318 - RNA, 19 nt, Human
ccaggccucuggggccugu

SEQ ID NO: 302319 - RNA, 22 nt, Human
auugcugaaaguauuuuaugac

SEQ ID NO: 302320 - RNA, 22 nt, Human
cagggcacggagaagucacccc

SEQ ID NO: 302321 - RNA, 22 nt, Human
cugggugauuccuguccaggca

SEQ ID NO: 302322 - RNA, 22 nt, Human
aaugugucuaugugguucacag

SEQ ID NO: 302323 - RNA, 22 nt, Human
ucagcacugaaauucuucacau

SEQ ID NO: 302324 - RNA, 22 nt, Human
gcccaggccggagagcagugcu

SEQ ID NO: 302325 - RNA, 22 nt, Human
gcaugcagucaaccaguaaggg

SEQ ID NO: 302326 - RNA, 22 nt, Human
acaguaaaucaacagaauaucu

SEQ ID NO: 302327 - RNA, 18 nt, Human
uccuaacuuagauacucc

SEQ ID NO: 302328 - RNA, 20 nt, Human
gacaggugcuaaagaggggc

SEQ ID NO: 302329 - RNA, 22 nt, Human
auuguauaagucuauuuacaau

SEQ ID NO: 302330 - RNA, 22 nt, Human
gacaugugagagcucgguuuuc

SEQ ID NO: 302331 - RNA, 22 nt, Human
gugggguagaucuuucucagga

SEQ ID NO: 302332 - RNA, 22 nt, Human
ggcuuucucacagcauggcagc

SEQ ID NO: 302333 - RNA, 22 nt, Human
gacucguucauaguuccaauuu

SEQ ID NO: 302334 - RNA, 22 nt, Human
uucuuuucccaauauuuugcug

SEQ ID NO: 302335 - RNA, 22 nt, Human
gcuggcugaguucugucgucug

SEQ ID NO: 302336 - RNA, 22 nt, Human
gugcaaaaggcauugugguuuu

SEQ ID NO: 302337 - RNA, 22 nt, Human
uuucauugucuacauaugacau

SEQ ID NO: 302338 - RNA, 22 nt, Human
gcagcuuuaaaggaggcucuga

SEQ ID NO: 302339 - RNA, 22 nt, Human
aaggugucauuguuuauggaga

SEQ ID NO: 302340 - RNA, 22 nt, Human
ccucccuuuuggugucugcaua

SEQ ID NO: 302341 - RNA, 17 nt, Human
ugacagacaucaugagc

SEQ ID NO: 302342 - RNA, 22 nt, Human
agcuuuaucacaauauuggcua

SEQ ID NO: 302343 - RNA, 22 nt, Human
ucuguucaucaucuggacacau

SEQ ID NO: 302344 - RNA, 22 nt, Human
gcuguucauuagaaauagaaug

SEQ ID NO: 302345 - RNA, 22 nt, Human
caguguuuguauagaauaugca

SEQ ID NO: 302346 - RNA, 22 nt, Human
uucagaaugugaccuuauuugg

SEQ ID NO: 302347 - RNA, 22 nt, Human
agguggggccaaaugcuacagu

SEQ ID NO: 302348 - RNA, 22 nt, Human
ugcaaaaaggcagacuggugau

SEQ ID NO: 302349 - RNA, 19 nt, Human
aauuagggagucgguuaag

SEQ ID NO: 302350 - RNA, 22 nt, Human
augagagguuucgucagaggaa

SEQ ID NO: 302351 - RNA, 22 nt, Human
ucaguucugcuagaaaaacagu

SEQ ID NO: 302352 - RNA, 22 nt, Human
caggugguuaugaggaagguga

SEQ ID NO: 302353 - RNA, 22 nt, Human
caauuucugggccucacacaag

SEQ ID NO: 302354 - RNA, 22 nt, Human
ugcaugaacacaugugcaugua

SEQ ID NO: 302355 - RNA, 22 nt, Human
cuucauuggcuuccauagaugc

SEQ ID NO: 302356 - RNA, 22 nt, Human
agaaagaggaugcagaucucau

SEQ ID NO: 302357 - RNA, 22 nt, Human
uuuauugagcacccguugugcg

SEQ ID NO: 302358 - RNA, 22 nt, Human
uuucuguagugugguauguagg

SEQ ID NO: 302359 - RNA, 22 nt, Human
caggcagggagcuggaaaggau

SEQ ID NO: 302360 - RNA, 22 nt, Human
acagguguggggcugugguacu

SEQ ID NO: 302361 - RNA, 22 nt, Human
gcugcgguggcuggcgauggga

SEQ ID NO: 302362 - RNA, 22 nt, Human
uggcagggaauacagauguuua

SEQ ID NO: 302363 - RNA, 22 nt, Human
gggaccugaggcccugcuccac

SEQ ID NO: 302364 - RNA, 22 nt, Human
cuuuccaaugcauuuccaaugu

SEQ ID NO: 302365 - RNA, 22 nt, Human
auacuuuuaauuccuucugagu

SEQ ID NO: 302366 - RNA, 22 nt, Human
uucaacuagauuuauacaauuc

SEQ ID NO: 302367 - RNA, 18 nt, Human
ucuguccuuccauucuuc

SEQ ID NO: 302368 - RNA, 18 nt, Human
uguuuauuuuucucuuac

SEQ ID NO: 302369 - RNA, 22 nt, Human
auguguccugcugugucacaca

SEQ ID NO: 302370 - RNA, 22 nt, Human
ucagggacugcagagggaagcu

SEQ ID NO: 302371 - RNA, 22 nt, Human
uccuguuuaucugugugacucg

SEQ ID NO: 302372 - RNA, 22 nt, Human
caugggggucuggacaacaggc

SEQ ID NO: 302373 - RNA, 22 nt, Human
accaugaugcauccuuaaggaa

SEQ ID NO: 302374 - RNA, 22 nt, Human
uuccuuucccucacagccucgg

SEQ ID NO: 302375 - RNA, 22 nt, Human
caggacauugauccauuggcac

SEQ ID NO: 302376 - RNA, 22 nt, Human
gcaggcaguuauuuaguagaau

SEQ ID NO: 302377 - RNA, 22 nt, Human
gucccauaaguagugcaacuug

SEQ ID NO: 302378 - RNA, 22 nt, Human
ucagggcagguuaacuugggug

SEQ ID NO: 302379 - RNA, 22 nt, Human
uacauaauugucuuuguccuca

SEQ ID NO: 302380 - RNA, 22 nt, Human
gcagggcacaaggacgcacagg

SEQ ID NO: 302381 - RNA, 22 nt, Human
ugcauguuaagaaaauauugag

SEQ ID NO: 302382 - RNA, 22 nt, Human
cagugagguggauggauggccu

SEQ ID NO: 302383 - RNA, 22 nt, Human
ggcaggugaccuggccucccag

SEQ ID NO: 302384 - RNA, 22 nt, Human
ucacugugaauguuaucaucuu

SEQ ID NO: 302385 - RNA, 22 nt, Human
uggcagggaguugcaggauuuc

SEQ ID NO: 302386 - RNA, 22 nt, Human
accacugcccauggugaaaacu

SEQ ID NO: 302387 - RNA, 22 nt, Human
ggggcucaguucggacagccug

SEQ ID NO: 302388 - RNA, 22 nt, Human
aaaauuauagaucuagugccug

SEQ ID NO: 302389 - RNA, 22 nt, Human
uugcaggguuaaaguaagguag

SEQ ID NO: 302390 - RNA, 22 nt, Human
ugagggagcacacacugaagug

SEQ ID NO: 302391 - RNA, 21 nt, Human
uugcugcccucccuuuccuca

SEQ ID NO: 302392 - RNA, 22 nt, Human
uuccuggggcgacuguaucuga

SEQ ID NO: 302393 - RNA, 22 nt, Human
uuggcaaaauuuaaagaaguga

SEQ ID NO: 302394 - RNA, 22 nt, Human
ugggccaggucugugucagcug

SEQ ID NO: 302395 - RNA, 22 nt, Human
aggcaguguucuucuaagggca

SEQ ID NO: 302396 - RNA, 22 nt, Human
uccugcaguuacaucccagcca

SEQ ID NO: 302397 - RNA, 22 nt, Human
caguuuauuuccaagaugacaa

SEQ ID NO: 302398 - RNA, 22 nt, Human
auguaaauuguacugacacacg

SEQ ID NO: 302399 - RNA, 22 nt, Human
uucuuacagaguuuacagagcc

SEQ ID NO: 302400 - RNA, 22 nt, Human
aauaauuuuagcucagaguugu

SEQ ID NO: 302401 - RNA, 23 nt, Human
ugcuggguaaauagcugaguaac

SEQ ID NO: 302402 - RNA, 22 nt, Human
cauuuguaauacugacuugcag

SEQ ID NO: 302403 - RNA, 20 nt, Human
uuugagaccagucugcccaa

SEQ ID NO: 302404 - RNA, 22 nt, Human
uuugacucuuagcccaggacuc

SEQ ID NO: 302405 - RNA, 22 nt, Human
aacuuuauuguuaggggcuaaa

SEQ ID NO: 302406 - RNA, 22 nt, Human
uuuucuuuaaucugguggggug

SEQ ID NO: 302407 - RNA, 22 nt, Human
ucaacaaauacuuaaagcagag

SEQ ID NO: 302408 - RNA, 22 nt, Human
uugcuuuacggcaaggccccag

SEQ ID NO: 302409 - RNA, 22 nt, Human
ggguggagaggcuaaguccagu

SEQ ID NO: 302410 - RNA, 22 nt, Human
uggcaggugaaguuguuaggga

SEQ ID NO: 302411 - RNA, 23 nt, Human
cuuuucauugccuuagcgcagag

SEQ ID NO: 302412 - RNA, 22 nt, Human
aauaucaacaguguccuucuaa

SEQ ID NO: 302413 - RNA, 22 nt, Human
uguguccucacuguaugcaagg

SEQ ID NO: 302414 - RNA, 22 nt, Human
acaaaugucuccucuuuuguua

SEQ ID NO: 302415 - RNA, 22 nt, Human
cauuuccagcuccugcaucaug

SEQ ID NO: 302416 - RNA, 22 nt, Human
uaguacuacguuuucuacuauc

SEQ ID NO: 302417 - RNA, 22 nt, Human
auccuucuccaaaacuggcucc

SEQ ID NO: 302418 - RNA, 22 nt, Human
uugcuuuaccauuugaucucua

SEQ ID NO: 302419 - RNA, 22 nt, Human
uguccuauuucucugugcauga

SEQ ID NO: 302420 - RNA, 22 nt, Human
cucuuagauauggagaauuacc

SEQ ID NO: 302421 - RNA, 22 nt, Human
uccaggcaaggauaauaaacau

SEQ ID NO: 302422 - RNA, 22 nt, Human
aauuaggggaggacguaucaua

SEQ ID NO: 302423 - RNA, 18 nt, Human
cuguccaguagacucugc

SEQ ID NO: 302424 - RNA, 22 nt, Human
uacaacauuguguugcuucaua

SEQ ID NO: 302425 - RNA, 22 nt, Human
agaugguccaugcacagauaug

SEQ ID NO: 302426 - RNA, 22 nt, Human
auucuucaucagagaugcacua

SEQ ID NO: 302427 - RNA, 22 nt, Human
ccagacccugcucuggggcucu

SEQ ID NO: 302428 - RNA, 22 nt, Human
aaagugguuucccaguucagua

SEQ ID NO: 302429 - RNA, 22 nt, Human
ugauugacuuuagaauagcacu

SEQ ID NO: 302430 - RNA, 22 nt, Human
uccuccuuguuuugucucugcu

SEQ ID NO: 302431 - RNA, 22 nt, Human
ugcuuuaucaaagcuauaguga

SEQ ID NO: 302432 - RNA, 22 nt, Human
auuuucaugacuaccuuaaaua

SEQ ID NO: 302433 - RNA, 22 nt, Human
uuucacauuuguuuuaagaagu

SEQ ID NO: 302434 - RNA, 23 nt, Human
caggacaugggaggaaguauggc

SEQ ID NO: 302435 - RNA, 22 nt, Human
cccugcaggcucagacuggagu

SEQ ID NO: 302436 - RNA, 22 nt, Human
agcccccucccuagugacugga

SEQ ID NO: 302437 - RNA, 18 nt, Human
gccaggcaggguggggaa

SEQ ID NO: 302438 - RNA, 22 nt, Human
aagggacccuggaucaaaugga

SEQ ID NO: 302439 - RNA, 22 nt, Human
acagauuuauugaagcugcugc

SEQ ID NO: 302440 - RNA, 19 nt, Human
guguccauggagcauggag

SEQ ID NO: 302441 - RNA, 23 nt, Human
uuuauccaacucuguaaucucuc

SEQ ID NO: 302442 - RNA, 22 nt, Human
agagauggagagcacuggggcu

SEQ ID NO: 302443 - RNA, 22 nt, Human
acagguguacaaugcaugacag

SEQ ID NO: 302444 - RNA, 22 nt, Human
gaagccucaacaucucugcguc

SEQ ID NO: 302445 - RNA, 22 nt, Human
gggugguggccagcagugggca

SEQ ID NO: 302446 - RNA, 22 nt, Human
gccaaaucuggauuuagcaaga

SEQ ID NO: 302447 - RNA, 22 nt, Human
guuaauuuaguagaguccagau

SEQ ID NO: 302448 - RNA, 20 nt, Human
ugcugggugggcagcuguaa

SEQ ID NO: 302449 - RNA, 22 nt, Human
uugagggucuggaucugcugcu

SEQ ID NO: 302450 - RNA, 22 nt, Human
aaagugguuuaugauauuccaa

SEQ ID NO: 302451 - RNA, 22 nt, Human
uugcugauuuccccuugagugu

SEQ ID NO: 302452 - RNA, 22 nt, Human
augcagcugugggcaagaaaug

SEQ ID NO: 302453 - RNA, 22 nt, Human
ugcaggugguacuucuuuuucu

SEQ ID NO: 302454 - RNA, 21 nt, Human
ucuuccugcuccacacucccc

SEQ ID NO: 302455 - RNA, 22 nt, Human
ugguuccaaucgcacuggcuca

SEQ ID NO: 302456 - RNA, 22 nt, Human
uuaugcaacaggugagcagaca

SEQ ID NO: 302457 - RNA, 22 nt, Human
uuuugcuuuuguaacacagugu

SEQ ID NO: 302458 - RNA, 22 nt, Human
cuucuucaucuguaaaacuugg

SEQ ID NO: 302459 - RNA, 22 nt, Human
ggcaggugugagaucgaggcca

SEQ ID NO: 302460 - RNA, 22 nt, Human
aauugcuugucuucuucccuac

SEQ ID NO: 302461 - RNA, 22 nt, Human
agugugucugaucacuugugag

SEQ ID NO: 302462 - RNA, 22 nt, Human
ggcaggcaggagcucugucucc

SEQ ID NO: 302463 - RNA, 22 nt, Human
ugcagggauuagaggccgggga

SEQ ID NO: 302464 - RNA, 22 nt, Human
ucauuauccuaguaucuugaau

SEQ ID NO: 302465 - RNA, 22 nt, Human
uuagggacagcucuguagguga

SEQ ID NO: 302466 - RNA, 22 nt, Human
aauaucaguauauuguaucagu

SEQ ID NO: 302467 - RNA, 23 nt, Human
auauuagggagauuagcccucua

SEQ ID NO: 302468 - RNA, 22 nt, Human
gaaugaauucagcacauggaau

SEQ ID NO: 302469 - RNA, 22 nt, Human
ccccaggcagggccuaacagag

SEQ ID NO: 302470 - RNA, 22 nt, Human
aaguguuuauuuauaacgaucu

SEQ ID NO: 302471 - RNA, 22 nt, Human
ucaggugggaccugcuaggaca

SEQ ID NO: 302472 - RNA, 22 nt, Human
cuucuuaaucccuuauauauuu

SEQ ID NO: 302473 - RNA, 22 nt, Human
gugguaucugucucccccacug

SEQ ID NO: 302474 - RNA, 22 nt, Human
uuuuauugcaauaaagugugua

SEQ ID NO: 302475 - RNA, 22 nt, Human
augcaugcagggaagacaguag

SEQ ID NO: 302476 - RNA, 22 nt, Human
ccuuuucuacaagcaaaugugc

SEQ ID NO: 302477 - RNA, 22 nt, Human
auuuccuugcaaguuucuguaa

SEQ ID NO: 302478 - RNA, 22 nt, Human
gguggcaguggucucugacaga

SEQ ID NO: 302479 - RNA, 22 nt, Human
ucagcuuucucuucuaucgaua

SEQ ID NO: 302480 - RNA, 22 nt, Human
cugugucccuugucccagagcc

SEQ ID NO: 302481 - RNA, 21 nt, Human
aaauacagaaacuuguuuuca

SEQ ID NO: 302482 - RNA, 22 nt, Human
guggauggagcuggaagccauu

SEQ ID NO: 302483 - RNA, 16 nt, Human
agcagggcgggaagga

SEQ ID NO: 302484 - RNA, 19 nt, Human
gcaggcagcugggguaucc

SEQ ID NO: 302485 - RNA, 22 nt, Human
aauucuugguccuaguguauaa

SEQ ID NO: 302486 - RNA, 22 nt, Human
guuucuuuuaaaauauguagac

SEQ ID NO: 302487 - RNA, 22 nt, Human
acuuggugaagucaggugauua

SEQ ID NO: 302488 - RNA, 22 nt, Human
aaauucagcagugaaaugcccc

SEQ ID NO: 302489 - RNA, 22 nt, Human
acaaaagugagugugucucaga

SEQ ID NO: 302490 - RNA, 21 nt, Human
aauuacagauggaauuacaga

SEQ ID NO: 302491 - RNA, 22 nt, Human
aagcagacagagaauggguuug

SEQ ID NO: 302492 - RNA, 22 nt, Human
aguagcacaauuuugucccuaa

SEQ ID NO: 302493 - RNA, 22 nt, Human
caagcuuguuucuccugggggu

SEQ ID NO: 302494 - RNA, 20 nt, Human
agcaggugacggggccugcu

SEQ ID NO: 302495 - RNA, 22 nt, Human
auaagcauguuagaauauuuga

SEQ ID NO: 302496 - RNA, 22 nt, Human
gcuaggaggaagaaugugaauu

SEQ ID NO: 302497 - RNA, 20 nt, Human
acaauauguagaugaauagc

SEQ ID NO: 302498 - RNA, 22 nt, Human
uuccuuccuccuccaguucugg

SEQ ID NO: 302499 - RNA, 22 nt, Human
caauauauaggaacaacuuagg

SEQ ID NO: 302500 - RNA, 22 nt, Human
ugcugagcgcauccggcggccg

SEQ ID NO: 302501 - RNA, 22 nt, Human
uuccuagggcagagccgcuggg

SEQ ID NO: 302502 - RNA, 22 nt, Human
auuucucacucacaguccaugu

SEQ ID NO: 302503 - RNA, 22 nt, Human
aggcaccuugagagcaggagcu

SEQ ID NO: 302504 - RNA, 22 nt, Human
gcaggugguccccguggagugg

SEQ ID NO: 302505 - RNA, 22 nt, Human
ggcuggcagugugagagaggga

SEQ ID NO: 302506 - RNA, 22 nt, Human
aaauauaauuucugccucaaua

SEQ ID NO: 302507 - RNA, 22 nt, Human
uuauugagcacauaguaugugg

SEQ ID NO: 302508 - RNA, 22 nt, Human
ggcaggcaucauguggucauua

SEQ ID NO: 302509 - RNA, 21 nt, Human
uuguaaagguuuagaagaaug

SEQ ID NO: 302510 - RNA, 19 nt, Human
cuuauuagagugagagcuu

SEQ ID NO: 302511 - RNA, 22 nt, Human
uguuauugagguuacuuauaag

SEQ ID NO: 302512 - RNA, 22 nt, Human
uuuaauuuuccugguaggccug

SEQ ID NO: 302513 - RNA, 22 nt, Human
auguccagaguaaagcacauuc

SEQ ID NO: 302514 - RNA, 19 nt, Human
aggcaggugcagagguccc

SEQ ID NO: 302515 - RNA, 22 nt, Human
aacaaagucguugccuagaaga

SEQ ID NO: 302516 - RNA, 22 nt, Human
cagcaugauuggugucugguga

SEQ ID NO: 302517 - RNA, 22 nt, Human
uugugucccuguaagacaaagc

SEQ ID NO: 302518 - RNA, 22 nt, Human
agacagacugguuugaauuggu

SEQ ID NO: 302519 - RNA, 22 nt, Human
uuuauugcccuguaguacagga

SEQ ID NO: 302520 - RNA, 22 nt, Human
agacaaagacagcaucucaggu

SEQ ID NO: 302521 - RNA, 22 nt, Human
acuugguugcaaaugaauuauu

SEQ ID NO: 302522 - RNA, 22 nt, Human
cagagagcuuagugugcugcau

SEQ ID NO: 302523 - RNA, 22 nt, Human
ucagacagggagucagaaaaua

SEQ ID NO: 302524 - RNA, 22 nt, Human
agaccuggauuccaauccuacc

SEQ ID NO: 302525 - RNA, 22 nt, Human
cuuguccccagcagguugguuu

SEQ ID NO: 302526 - RNA, 22 nt, Human
uguccuggaaaaauggagaguu

SEQ ID NO: 302527 - RNA, 22 nt, Human
aaagcugccaaggagaauacua

SEQ ID NO: 302528 - RNA, 22 nt, Human
gacaauaaaaugaucuuacagu

SEQ ID NO: 302529 - RNA, 22 nt, Human
guccaugauucugugacacccu

SEQ ID NO: 302530 - RNA, 22 nt, Human
cugggugucaggagacaugaug

SEQ ID NO: 302531 - RNA, 22 nt, Human
ccuggaggagcgcugaccagcu

SEQ ID NO: 302532 - RNA, 22 nt, Human
auguccagccaaccacuggauu

SEQ ID NO: 302533 - RNA, 22 nt, Human
aaauggauggaauugacauuua

SEQ ID NO: 302534 - RNA, 22 nt, Human
acuguucaaguuuuaugcugga

SEQ ID NO: 302535 - RNA, 17 nt, Human
cccaugagcccacuccc

SEQ ID NO: 302536 - RNA, 21 nt, Human
uagggcucuauuuuuauuuca

SEQ ID NO: 302537 - RNA, 22 nt, Human
acuuucauuuguaauaaacuuc

SEQ ID NO: 302538 - RNA, 22 nt, Human
acaguuugcccugacauucucc

SEQ ID NO: 302539 - RNA, 22 nt, Human
agaccugcagggccaggccugc

SEQ ID NO: 302540 - RNA, 22 nt, Human
guagcuuauuagggauaauagu

SEQ ID NO: 302541 - RNA, 22 nt, Human
aguguccuuucuguuccagcca

SEQ ID NO: 302542 - RNA, 22 nt, Human
ugggcaggggcccugcuuccgu

SEQ ID NO: 302543 - RNA, 22 nt, Human
uuuaagagcuaguaugucauuu

SEQ ID NO: 302544 - RNA, 22 nt, Human
cuguguccugcgucaagccaau

SEQ ID NO: 302545 - RNA, 22 nt, Human
acacaggacagggauguguuuu

SEQ ID NO: 302546 - RNA, 22 nt, Human
cagacagguagggacagaacau

SEQ ID NO: 302547 - RNA, 22 nt, Human
aaugaaauguagcuuauccaua

SEQ ID NO: 302548 - RNA, 16 nt, Human
gagggcagaggcggaa

SEQ ID NO: 302549 - RNA, 22 nt, Human
cagggcucacucggcuggcguc

SEQ ID NO: 302550 - RNA, 22 nt, Human
acuuucaugguaguuguauucu

SEQ ID NO: 302551 - RNA, 22 nt, Human
gcagguggagcaguagucuggu

SEQ ID NO: 302552 - RNA, 22 nt, Human
uuuagggaaauugaggguuaag

SEQ ID NO: 302553 - RNA, 19 nt, Human
uucauucuuucuacuuacc

SEQ ID NO: 302554 - RNA, 22 nt, Human
ugacauguguaaucagcuccgu

SEQ ID NO: 302555 - RNA, 22 nt, Human
cuuauuagaguuguguucuguu

SEQ ID NO: 302556 - RNA, 22 nt, Human
uguccuuuuccccaaauucacu

SEQ ID NO: 302557 - RNA, 22 nt, Human
uguuugcucugacuaucuugcg

SEQ ID NO: 302558 - RNA, 22 nt, Human
cugucucagcaggaagucauca

SEQ ID NO: 302559 - RNA, 22 nt, Human
caugcauguuuacuacagugac

SEQ ID NO: 302560 - RNA, 22 nt, Human
cacagguguuuguuauacucag

SEQ ID NO: 302561 - RNA, 22 nt, Human
cuuuauguacuguguauuugaa

SEQ ID NO: 302562 - RNA, 22 nt, Human
uuuguuagagugugggaggcug

SEQ ID NO: 302563 - RNA, 22 nt, Human
cggcaggugugcucacucugcc

SEQ ID NO: 302564 - RNA, 22 nt, Human
uauugagaacccucaggaggca

SEQ ID NO: 302565 - RNA, 18 nt, Human
agcaugagagaggcugug

SEQ ID NO: 302566 - RNA, 22 nt, Human
auuauuucucacucacauaaua

SEQ ID NO: 302567 - RNA, 22 nt, Human
ucccaggcaaaggcagcucauu

SEQ ID NO: 302568 - RNA, 22 nt, Human
uugauaaaaugauaucuucuuu

SEQ ID NO: 302569 - RNA, 22 nt, Human
uuaguuuucucaucuaucucac

SEQ ID NO: 302570 - RNA, 22 nt, Human
ccaaugauggugcccacgauga

SEQ ID NO: 302571 - RNA, 22 nt, Human
cuuacaaaggagaggagauagg

SEQ ID NO: 302572 - RNA, 22 nt, Human
gcaggugugaaugugaauuaag

SEQ ID NO: 302573 - RNA, 22 nt, Human
uuccucucaacaugccugccgg

SEQ ID NO: 302574 - RNA, 22 nt, Human
ugguccuggggaucugcaguga

SEQ ID NO: 302575 - RNA, 22 nt, Human
ggaugucuaggguuuaugugcc

SEQ ID NO: 302576 - RNA, 22 nt, Human
agcaggugguaggcagucagca

SEQ ID NO: 302577 - RNA, 22 nt, Human
ugcagggagggcccagcaaucu

SEQ ID NO: 302578 - RNA, 22 nt, Human
aaauguaguugaaaaguuaagg

SEQ ID NO: 302579 - RNA, 18 nt, Human
uggcaggaaaugcacuuu

SEQ ID NO: 302580 - RNA, 22 nt, Human
caucuaaauuugacuccaagga

SEQ ID NO: 302581 - RNA, 22 nt, Human
auaguuuucuaugcacuguuau

SEQ ID NO: 302582 - RNA, 22 nt, Human
auuucuguuugcuacuauaagu

SEQ ID NO: 302583 - RNA, 22 nt, Human
auccuucuaccuaggacuauuu

SEQ ID NO: 302584 - RNA, 22 nt, Human
cagugaggaguccagggcagag

SEQ ID NO: 302585 - RNA, 22 nt, Human
ucuggcuccacaccucacugca

SEQ ID NO: 302586 - RNA, 22 nt, Human
uuuauugacccaaagcgagagu

SEQ ID NO: 302587 - RNA, 22 nt, Human
uccugugucaauuccucauucu

SEQ ID NO: 302588 - RNA, 22 nt, Human
acccaggcugcuucucaguggc

SEQ ID NO: 302589 - RNA, 22 nt, Human
ccuuuguucauugccuucaguc

SEQ ID NO: 302590 - RNA, 22 nt, Human
gucuucuuguuuugaaggaaau

SEQ ID NO: 302591 - RNA, 21 nt, Human
agguacuaaugaaaagugauu

SEQ ID NO: 302592 - RNA, 22 nt, Human
caauguaucaaccagaaaguuc

SEQ ID NO: 302593 - RNA, 22 nt, Human
gaauguaauagucaguagaaca

SEQ ID NO: 302594 - RNA, 18 nt, Human
aaaaagugcucaggccua

SEQ ID NO: 302595 - RNA, 22 nt, Human
agaagggaacucagagaugauu

SEQ ID NO: 302596 - RNA, 21 nt, Human
ugggugggcagagucucuuca

SEQ ID NO: 302597 - RNA, 22 nt, Human
gcugcaaaccugccaccuggug

SEQ ID NO: 302598 - RNA, 17 nt, Human
aggcagguaagaguuau

SEQ ID NO: 302599 - RNA, 22 nt, Human
aauugcuuuugggggcaguuac

SEQ ID NO: 302600 - RNA, 22 nt, Human
caggccucuauggucagcugag

SEQ ID NO: 302601 - RNA, 22 nt, Human
uuuucauuguuccucgagcauu

SEQ ID NO: 302602 - RNA, 20 nt, Human
ccagagaguagguuagugau

SEQ ID NO: 302603 - RNA, 22 nt, Human
uggagcagaguucagcggggag

SEQ ID NO: 302604 - RNA, 22 nt, Human
aguuauuacucuuuaacauauu

SEQ ID NO: 302605 - RNA, 22 nt, Human
cuugcuucauuagugucuuagu

SEQ ID NO: 302606 - RNA, 22 nt, Human
ccuggaucuaaggaagcuggga

SEQ ID NO: 302607 - RNA, 22 nt, Human
auuuccugcaggggcugguggg

SEQ ID NO: 302608 - RNA, 21 nt, Human
acagacaguccagagaaaaga

SEQ ID NO: 302609 - RNA, 22 nt, Human
aggacauguaaauggagaggga

SEQ ID NO: 302610 - RNA, 20 nt, Human
ugcagggcucugcuucucuc

SEQ ID NO: 302611 - RNA, 21 nt, Human
agaagcuagucacuaaaucca

SEQ ID NO: 302612 - RNA, 22 nt, Human
auucuuauuuaaauagagucug

SEQ ID NO: 302613 - RNA, 22 nt, Human
uuuagaaguucacacauuuaaa

SEQ ID NO: 302614 - RNA, 22 nt, Human
uuccugaaugcuguugugcugu

SEQ ID NO: 302615 - RNA, 22 nt, Human
cuuguucaguugccucuccugc

SEQ ID NO: 302616 - RNA, 22 nt, Human
cccugcagaucuaggguccuuc

SEQ ID NO: 302617 - RNA, 22 nt, Human
auuugaaguaaguaaugaguau

SEQ ID NO: 302618 - RNA, 22 nt, Human
cugagaucuuuauacgaggcac

SEQ ID NO: 302619 - RNA, 22 nt, Human
gggagcugagcuggaagagaau

SEQ ID NO: 302620 - RNA, 22 nt, Human
uaugugucucaguugugauuga

SEQ ID NO: 302621 - RNA, 20 nt, Human
guauuaggagguaaauguaa

SEQ ID NO: 302622 - RNA, 22 nt, Human
uugaaagacuucuccugugaaa

SEQ ID NO: 302623 - RNA, 22 nt, Human
aagggcucccugccugaggugg

SEQ ID NO: 302624 - RNA, 22 nt, Human
aaggcuggcaauauauuuguua

SEQ ID NO: 302625 - RNA, 21 nt, Human
ugcaccuguucacugcaguuc

SEQ ID NO: 302626 - RNA, 22 nt, Human
uccaggcaaagugcugggcugc

SEQ ID NO: 302627 - RNA, 22 nt, Human
uugcuguaaguaucuuucuacc

SEQ ID NO: 302628 - RNA, 20 nt, Human
uuucaagucagcaauucuca

SEQ ID NO: 302629 - RNA, 22 nt, Human
cuggcacugaguggcuuaugac

SEQ ID NO: 302630 - RNA, 22 nt, Human
aaacaaacauagguuugaaagu

SEQ ID NO: 302631 - RNA, 19 nt, Human
gcagguggauguggucagc

SEQ ID NO: 302632 - RNA, 22 nt, Human
cuguccagaaagggggcaacaa

SEQ ID NO: 302633 - RNA, 22 nt, Human
aguuugaaauguuggcaauauu

SEQ ID NO: 302634 - RNA, 22 nt, Human
cagguggugccuccucccuucc

SEQ ID NO: 302635 - RNA, 22 nt, Human
gcuggguccaugguccucgggu

SEQ ID NO: 302636 - RNA, 22 nt, Human
uaugugucugucgugcauaaau

SEQ ID NO: 302637 - RNA, 22 nt, Human
ugacagacagcuucucauuuua

SEQ ID NO: 302638 - RNA, 22 nt, Human
ggggcaggagguguucucuuuu

SEQ ID NO: 302639 - RNA, 22 nt, Human
ucaaaaauguuuuauauuggua

SEQ ID NO: 302640 - RNA, 22 nt, Human
ugggugggagcacccugucugg

SEQ ID NO: 302641 - RNA, 22 nt, Human
ugugucaauuuucauuccuacu

SEQ ID NO: 302642 - RNA, 22 nt, Human
ugcuguguaaaaggugauugaa

SEQ ID NO: 302643 - RNA, 22 nt, Human
cagcacaguacaaggcacggau

SEQ ID NO: 302644 - RNA, 22 nt, Human
cgcaggugggcccuucauugau

SEQ ID NO: 302645 - RNA, 22 nt, Human
uuccaggauggcaauaaugaau

SEQ ID NO: 302646 - RNA, 19 nt, Human
cucagagaggggcagugcc

SEQ ID NO: 302647 - RNA, 22 nt, Human
cacaaauggccguguucaaaga

SEQ ID NO: 302648 - RNA, 22 nt, Human
acuuaaaaccagacagcgucau

SEQ ID NO: 302649 - RNA, 22 nt, Human
uuccaugacaccgagggaaguc

SEQ ID NO: 302650 - RNA, 22 nt, Human
acagacagauuuugucugaugu

SEQ ID NO: 302651 - RNA, 17 nt, Human
agacagaccucugcauc

SEQ ID NO: 302652 - RNA, 19 nt, Human
agguggucuaggcuggaga

SEQ ID NO: 302653 - RNA, 22 nt, Human
cucugcccucacuuggggccug

SEQ ID NO: 302654 - RNA, 22 nt, Human
gugcaaaagcaguugugguuuu

SEQ ID NO: 302655 - RNA, 22 nt, Human
ucauuucccuccuacaaagagg

SEQ ID NO: 302656 - RNA, 22 nt, Human
uuucauaauagugcaguuuguu

SEQ ID NO: 302657 - RNA, 22 nt, Human
uucuggaucugagggggaagau

SEQ ID NO: 302658 - RNA, 21 nt, Human
uccuccuucaaguccuggccu

SEQ ID NO: 302659 - RNA, 22 nt, Human
uggagcagugguccuggagaug

SEQ ID NO: 302660 - RNA, 22 nt, Human
cagaaauucccauuucagauuc

SEQ ID NO: 302661 - RNA, 20 nt, Human
auaaaauaacugccacaaga

SEQ ID NO: 302662 - RNA, 22 nt, Human
cacauguguauaugugaggggg

SEQ ID NO: 302663 - RNA, 22 nt, Human
ccuguucacugcacaguuuccg

SEQ ID NO: 302664 - RNA, 22 nt, Human
gaucuucuauguaaugaagugu

SEQ ID NO: 302665 - RNA, 23 nt, Human
uucaaaacuggaaaaucagaugc

SEQ ID NO: 302666 - RNA, 22 nt, Human
cugccguguuuuucauguuaaa

SEQ ID NO: 302667 - RNA, 22 nt, Human
ugcagggaaaacccaggaugcu

SEQ ID NO: 302668 - RNA, 22 nt, Human
ggaguugauuuuggauauauua

SEQ ID NO: 302669 - RNA, 22 nt, Human
cuguccugcccacccugcaggg

SEQ ID NO: 302670 - RNA, 22 nt, Human
caaugauugcuauuuacauaaa

SEQ ID NO: 302671 - RNA, 23 nt, Human
ugguggggucuuggagacagcac

SEQ ID NO: 302672 - RNA, 22 nt, Human
ggguuccuccaguuccuagagc

SEQ ID NO: 302673 - RNA, 23 nt, Human
auuucuaggggauuuucuggugc

SEQ ID NO: 302674 - RNA, 22 nt, Human
acuggacagaggaaauauggag

SEQ ID NO: 302675 - RNA, 22 nt, Human
aguauacaaauaaauguguaau

SEQ ID NO: 302676 - RNA, 22 nt, Human
cuguggaauugaugcuuagugu

SEQ ID NO: 302677 - RNA, 20 nt, Human
uguguccaucaucugggcac

SEQ ID NO: 302678 - RNA, 22 nt, Human
uugcuaggauucauucuauacu

SEQ ID NO: 302679 - RNA, 22 nt, Human
ugcuuuauguggcugauacuca

SEQ ID NO: 302680 - RNA, 22 nt, Human
uuccuggggggauagauuucac

SEQ ID NO: 302681 - RNA, 22 nt, Human
ccugggucuggucacuaaguca

SEQ ID NO: 302682 - RNA, 22 nt, Human
acuggaggccccucccagugaa

SEQ ID NO: 302683 - RNA, 22 nt, Human
gguguccuuguccuuugguacc

SEQ ID NO: 302684 - RNA, 22 nt, Human
ccauaaucuggcuuugagagag

SEQ ID NO: 302685 - RNA, 22 nt, Human
cuggagugacuuuguuccuuuu

SEQ ID NO: 302686 - RNA, 22 nt, Human
gggaaugugaaacaguaaggga

SEQ ID NO: 302687 - RNA, 22 nt, Human
gucuggaagaacuagggauguu

SEQ ID NO: 302688 - RNA, 22 nt, Human
ucccaaggccaggcaucuagaa

SEQ ID NO: 302689 - RNA, 22 nt, Human
cucuuccuuucccuugagggug

SEQ ID NO: 302690 - RNA, 18 nt, Human
ccauguguuccuuuuggg

SEQ ID NO: 302691 - RNA, 22 nt, Human
uuuauuggauauuuacaagaua

SEQ ID NO: 302692 - RNA, 22 nt, Human
uugugucccugcggcugaggag

SEQ ID NO: 302693 - RNA, 22 nt, Human
aagcuuuagagaugaguuccuu

SEQ ID NO: 302694 - RNA, 22 nt, Human
uuggaggauugcucucagccca

SEQ ID NO: 302695 - RNA, 20 nt, Human
cugaagagacuggaggggca

SEQ ID NO: 302696 - RNA, 22 nt, Human
uaguuuaccaaauugaucuucc

SEQ ID NO: 302697 - RNA, 22 nt, Human
uugcuuuacuuugccauucguu

SEQ ID NO: 302698 - RNA, 22 nt, Human
auguccagagccggccugcuga

SEQ ID NO: 302699 - RNA, 22 nt, Human
auuagauauuugcuguuggauu

SEQ ID NO: 302700 - RNA, 22 nt, Human
ugguggggcuuuccuucugcuu

SEQ ID NO: 302701 - RNA, 22 nt, Human
guuauaaaaugcacaguuguuu

SEQ ID NO: 302702 - RNA, 22 nt, Human
uuucauugagaauauaagauuu

SEQ ID NO: 302703 - RNA, 22 nt, Human
auuuucauggcuucugcucagu

SEQ ID NO: 302704 - RNA, 22 nt, Human
aggacuuagaacauuauguacu

SEQ ID NO: 302705 - RNA, 22 nt, Human
uguuuuccuccugguuucugcc

SEQ ID NO: 302706 - RNA, 22 nt, Human
cagcuuauucaguaagcacaua

SEQ ID NO: 302707 - RNA, 22 nt, Human
guuuuuacuaagguugcuaagu

SEQ ID NO: 302708 - RNA, 22 nt, Human
gucugcccugcugaucucaccc

SEQ ID NO: 302709 - RNA, 22 nt, Human
uuuaucugaggaaagcagacaa

SEQ ID NO: 302710 - RNA, 22 nt, Human
ucagcuuuuuacaugugaaaua

SEQ ID NO: 302711 - RNA, 22 nt, Human
gacagacacuauugguaugccu

SEQ ID NO: 302712 - RNA, 22 nt, Human
uuuccuaguucuaagaaaugua

SEQ ID NO: 302713 - RNA, 22 nt, Human
uuguguccaaggcuauggugau

SEQ ID NO: 302714 - RNA, 22 nt, Human
ucuggcucccagccugcucuca

SEQ ID NO: 302715 - RNA, 22 nt, Human
gggccaugagagguucaucaac

SEQ ID NO: 302716 - RNA, 17 nt, Human
gccugcaggcccgcaga

SEQ ID NO: 302717 - RNA, 22 nt, Human
cccagugugguugugaauucug

SEQ ID NO: 302718 - RNA, 22 nt, Human
auugcugacaccaaguaguagc

SEQ ID NO: 302719 - RNA, 22 nt, Human
uugaaucucuugaaucucuguu

SEQ ID NO: 302720 - RNA, 20 nt, Human
aacacagauaccaaagguug

SEQ ID NO: 302721 - RNA, 22 nt, Human
ucuuuauuuaagucuguuguaa

SEQ ID NO: 302722 - RNA, 22 nt, Human
gagggcaguagccucguacccu

SEQ ID NO: 302723 - RNA, 22 nt, Human
uugggacaucuggcauacaguu

SEQ ID NO: 302724 - RNA, 22 nt, Human
guuuacauguacucauuauacu

SEQ ID NO: 302725 - RNA, 22 nt, Human
gugaccauuugacauauccuug

SEQ ID NO: 302726 - RNA, 22 nt, Human
gcauagucaguaggauucucaa

SEQ ID NO: 302727 - RNA, 22 nt, Human
ggcugcaaaggaaaagugguga

SEQ ID NO: 302728 - RNA, 22 nt, Human
cccaggcagucuggcucuaaag

SEQ ID NO: 302729 - RNA, 22 nt, Human
gccugcagcaugcuaggucuug

SEQ ID NO: 302730 - RNA, 22 nt, Human
ucuguucaguugauguaguuuu

SEQ ID NO: 302731 - RNA, 22 nt, Human
uagguggugugcgaagagcgug

SEQ ID NO: 302732 - RNA, 22 nt, Human
gcuggaggauggacuggaagaa

SEQ ID NO: 302733 - RNA, 22 nt, Human
gcuguucaaaagccacaguuac

SEQ ID NO: 302734 - RNA, 22 nt, Human
ugcagggcccucauuccugucc

SEQ ID NO: 302735 - RNA, 19 nt, Human
uucauucucuuauuguugu

SEQ ID NO: 302736 - RNA, 22 nt, Human
cagcuuuauuaaugauugucuu

SEQ ID NO: 302737 - RNA, 22 nt, Human
ugacagacauggaagccagagu

SEQ ID NO: 302738 - RNA, 20 nt, Human
acccagcucugugcccuggg

SEQ ID NO: 302739 - RNA, 19 nt, Human
gcagagugggguggagggu

SEQ ID NO: 302740 - RNA, 22 nt, Human
uggcagguuucguuaaaaaugg

SEQ ID NO: 302741 - RNA, 22 nt, Human
gcuggaagaaugagugccucgu

SEQ ID NO: 302742 - RNA, 22 nt, Human
uuacauguucucauacacagag

SEQ ID NO: 302743 - RNA, 22 nt, Human
cagcuuguuuuauuuggggacc

SEQ ID NO: 302744 - RNA, 22 nt, Human
aguguccuuaguuagcuuuggg

SEQ ID NO: 302745 - RNA, 22 nt, Human
acagggcagagugaaaugcuau

SEQ ID NO: 302746 - RNA, 22 nt, Human
ugcugugggauauauguucaaa

SEQ ID NO: 302747 - RNA, 21 nt, Human
aaugcauuaacauaaagcuga

SEQ ID NO: 302748 - RNA, 22 nt, Human
uauugauaugcagaacugacuu

SEQ ID NO: 302749 - RNA, 22 nt, Human
cuagggacugggaccuuaguua

SEQ ID NO: 302750 - RNA, 22 nt, Human
uacaugugguagggagggcagu

SEQ ID NO: 302751 - RNA, 22 nt, Human
ccagggcaggggcuggaguuca

SEQ ID NO: 302752 - RNA, 22 nt, Human
gaggugucugcuguguucaaag

SEQ ID NO: 302753 - RNA, 23 nt, Human
uuuggacuugugacucuucuccu

SEQ ID NO: 302754 - RNA, 22 nt, Human
aaggugguuugcuaaucccaac

SEQ ID NO: 302755 - RNA, 19 nt, Human
gccugcagaaaaggcaggg

SEQ ID NO: 302756 - RNA, 22 nt, Human
auagcuuuuugucauagagucu

SEQ ID NO: 302757 - RNA, 22 nt, Human
aggcaaagcgauaccagagcua

SEQ ID NO: 302758 - RNA, 22 nt, Human
cagagaaagggugaauuccuuc

SEQ ID NO: 302759 - RNA, 22 nt, Human
acaugauuaaaagauuuuaaag

SEQ ID NO: 302760 - RNA, 22 nt, Human
gucugcccugagcucccagugc

SEQ ID NO: 302761 - RNA, 22 nt, Human
cgucacuucuuagucuauuuuc

SEQ ID NO: 302762 - RNA, 22 nt, Human
uuucaguuacugcuauaucauu

SEQ ID NO: 302763 - RNA, 22 nt, Human
gagggaaagguuaauacaugau

SEQ ID NO: 302764 - RNA, 22 nt, Human
gcuguucacauuuugggccaaa

SEQ ID NO: 302765 - RNA, 22 nt, Human
aaugcauauguaggcaagcagu

SEQ ID NO: 302766 - RNA, 22 nt, Human
cagggcucaccacugggauccu

SEQ ID NO: 302767 - RNA, 22 nt, Human
uaaaggcuuuuacaggagugca

SEQ ID NO: 302768 - RNA, 22 nt, Human
ccagagagggcgccaccuggag

SEQ ID NO: 302769 - RNA, 22 nt, Human
acaggugguaaaauggacuguc

SEQ ID NO: 302770 - RNA, 22 nt, Human
gguuucaaugagaagugcuugu

SEQ ID NO: 302771 - RNA, 22 nt, Human
ccugggugaaaucucuccugca

SEQ ID NO: 302772 - RNA, 22 nt, Human
uuucuucuugaguaaccagauu

SEQ ID NO: 302773 - RNA, 22 nt, Human
uccuucuggaggcucuaagggg

SEQ ID NO: 302774 - RNA, 22 nt, Human
ucuggagaacuugcaagaggau

SEQ ID NO: 302775 - RNA, 22 nt, Human
agggcccuagggaaugagacau

SEQ ID NO: 302776 - RNA, 22 nt, Human
acucuuauuuugaaguaauaau

SEQ ID NO: 302777 - RNA, 19 nt, Human
gcaggugugaauccguaga

SEQ ID NO: 302778 - RNA, 22 nt, Human
gaaucauuggaaccacauccaa

SEQ ID NO: 302779 - RNA, 22 nt, Human
uuugcagugauucuugcaguga

SEQ ID NO: 302780 - RNA, 22 nt, Human
ccaugagccaggcugaggaagc

SEQ ID NO: 302781 - RNA, 22 nt, Human
ccccugaagacaauggagaggu

SEQ ID NO: 302782 - RNA, 22 nt, Human
ugggaccuguuacauugaguua

SEQ ID NO: 302783 - RNA, 22 nt, Human
gccaggcaugggcuucugggcg

SEQ ID NO: 302784 - RNA, 20 nt, Human
uauugaguaccuacuguaua

SEQ ID NO: 302785 - RNA, 22 nt, Human
aauucuauaggcaagcuauuuu

SEQ ID NO: 302786 - RNA, 19 nt, Human
agggauauuuaaaaagcuc

SEQ ID NO: 302787 - RNA, 22 nt, Human
caggcagcccugcaccaagugu

SEQ ID NO: 302788 - RNA, 22 nt, Human
ucagcuuugaucucaggcaauc

SEQ ID NO: 302789 - RNA, 22 nt, Human
cuuccuucugaagcauagaagc

SEQ ID NO: 302790 - RNA, 23 nt, Human
cacaggcugcgcauaagcuucuc

SEQ ID NO: 302791 - RNA, 22 nt, Human
uuauuucauguaaaauuuaugu

SEQ ID NO: 302792 - RNA, 22 nt, Human
aggcaguggcugagaccagggg

SEQ ID NO: 302793 - RNA, 22 nt, Human
ucaugaaucguggaaugauuua

SEQ ID NO: 302794 - RNA, 22 nt, Human
ugcacuccaggcugggugacag

SEQ ID NO: 302795 - RNA, 22 nt, Human
uggcaaagaugguucucaccau

SEQ ID NO: 302796 - RNA, 22 nt, Human
agcagggcugcagugugucuuu

SEQ ID NO: 302797 - RNA, 19 nt, Human
ugguggcaaugucagcuaa

SEQ ID NO: 302798 - RNA, 22 nt, Human
ucagguguaucauggaguugaa

SEQ ID NO: 302799 - RNA, 22 nt, Human
ugcuuucauugugauaggaagc

SEQ ID NO: 302800 - RNA, 22 nt, Human
gaccucagugaauggucaugua

SEQ ID NO: 302801 - RNA, 22 nt, Human
agcuuuauagaaaggaucagug

SEQ ID NO: 302802 - RNA, 22 nt, Human
gccaggcaggccacgcuguguu

SEQ ID NO: 302803 - RNA, 22 nt, Human
cccugcagagaccacugaccuu

SEQ ID NO: 302804 - RNA, 22 nt, Human
guuuauuagaguuuucugucug

SEQ ID NO: 302805 - RNA, 22 nt, Human
gcaaggaccuuugagcgugcca

SEQ ID NO: 302806 - RNA, 22 nt, Human
cuggcccucggaguccagcugc

SEQ ID NO: 302807 - RNA, 22 nt, Human
uauuccaaaaucccaaacugcc

SEQ ID NO: 302808 - RNA, 22 nt, Human
aaugauuuccccuacacagaag

SEQ ID NO: 302809 - RNA, 22 nt, Human
cuggauuuaauuaacuguugcu

SEQ ID NO: 302810 - RNA, 22 nt, Human
auaaagauuucuuuuucucuac

SEQ ID NO: 302811 - RNA, 22 nt, Human
uggcagguggcacagccuggga

SEQ ID NO: 302812 - RNA, 20 nt, Human
gucugcccaggccaccacgg

SEQ ID NO: 302813 - RNA, 22 nt, Human
uuauugagagcuguuuuauggc

SEQ ID NO: 302814 - RNA, 20 nt, Human
cauauauaccuagaagugga

SEQ ID NO: 302815 - RNA, 22 nt, Human
aaggcauaccugaauguuugug

SEQ ID NO: 302816 - RNA, 22 nt, Human
cagcuuuaccuuuaggaguaac

SEQ ID NO: 302817 - RNA, 18 nt, Human
ucucugaauauuuuaugu

SEQ ID NO: 302818 - RNA, 22 nt, Human
uucauuccuucuguaccuugcc

SEQ ID NO: 302819 - RNA, 22 nt, Human
ugcagggccuugggucuuucuu

SEQ ID NO: 302820 - RNA, 22 nt, Human
aauucuauguucuugaguaaga

SEQ ID NO: 302821 - RNA, 22 nt, Human
ucaggcaggaucccagggaagg

SEQ ID NO: 302822 - RNA, 22 nt, Human
guuuauuggguauuguggagcc

SEQ ID NO: 302823 - RNA, 22 nt, Human
gguguccuuagaaagcagaccu

SEQ ID NO: 302824 - RNA, 22 nt, Human
auucagugugagguuuucaagu

SEQ ID NO: 302825 - RNA, 22 nt, Human
agaggcacaacagucccauugu

SEQ ID NO: 302826 - RNA, 22 nt, Human
uccuuucccuuuccauccuggc

SEQ ID NO: 302827 - RNA, 22 nt, Human
uguccuggagugcuugggggaa

SEQ ID NO: 302828 - RNA, 22 nt, Human
guuuucauuacugcugugauuu

SEQ ID NO: 302829 - RNA, 22 nt, Human
aaaauguaaagcuugaguguag

SEQ ID NO: 302830 - RNA, 19 nt, Human
gguguccuagagauaagag

SEQ ID NO: 302831 - RNA, 22 nt, Human
ugcuggagaccugcuugcacca

SEQ ID NO: 302832 - RNA, 22 nt, Human
gcacccagcccagggcgugaug

SEQ ID NO: 302833 - RNA, 22 nt, Human
aguuggagugaacaugagauug

SEQ ID NO: 302834 - RNA, 22 nt, Human
aguuguaagaggcacaaggaag

SEQ ID NO: 302835 - RNA, 22 nt, Human
auugcuggcagcuggaucugca

SEQ ID NO: 302836 - RNA, 22 nt, Human
uuuccuguugccaucaagaaug

SEQ ID NO: 302837 - RNA, 23 nt, Human
uaauucacauauacauugcuuca

SEQ ID NO: 302838 - RNA, 21 nt, Human
acagggcaugcagcuggcugu

SEQ ID NO: 302839 - RNA, 22 nt, Human
caugcaugccgggcugacagag

SEQ ID NO: 302840 - RNA, 22 nt, Human
ucaggugugugguggaaggcag

SEQ ID NO: 302841 - RNA, 22 nt, Human
guccugguuuucacagaccuuu

SEQ ID NO: 302842 - RNA, 22 nt, Human
cuggcuugcagcucaucauaaa

SEQ ID NO: 302843 - RNA, 22 nt, Human
agcaggugcauggcgagcgcgg

SEQ ID NO: 302844 - RNA, 22 nt, Human
aguccaugguucugacucaucu

SEQ ID NO: 302845 - RNA, 22 nt, Human
ggggaccuucccagagcaguug

SEQ ID NO: 302846 - RNA, 22 nt, Human
gaaucauuuagcucugcaugga

SEQ ID NO: 302847 - RNA, 22 nt, Human
gauaccagacagggagggagaa

SEQ ID NO: 302848 - RNA, 22 nt, Human
auuaaaauuccaagguaugcca

SEQ ID NO: 302849 - RNA, 23 nt, Human
uagggcagcugggagggacaugc

SEQ ID NO: 302850 - RNA, 22 nt, Human
aaagcuaccuuuguguucauag

SEQ ID NO: 302851 - RNA, 22 nt, Human
gguggggccagggcuccaaccu

SEQ ID NO: 302852 - RNA, 22 nt, Human
uaggugucagguauagaauuua

SEQ ID NO: 302853 - RNA, 22 nt, Human
ugacaggugauugugaacuaag

SEQ ID NO: 302854 - RNA, 22 nt, Human
aacuuucagcaaguaauucugg

SEQ ID NO: 302855 - RNA, 22 nt, Human
cugugucccagccaggauaaug

SEQ ID NO: 302856 - RNA, 22 nt, Human
uguguccuuuggaggaucagcg

SEQ ID NO: 302857 - RNA, 22 nt, Human
aaaacaguuuaggcaucacagu

SEQ ID NO: 302858 - RNA, 22 nt, Human
gccugcagaggugcugcuagcu

SEQ ID NO: 302859 - RNA, 18 nt, Human
guuaauuuugaaguucau

SEQ ID NO: 302860 - RNA, 22 nt, Human
auuauuaggugcucucugacaa

SEQ ID NO: 302861 - RNA, 22 nt, Human
uggaggcaggggauacagguca

SEQ ID NO: 302862 - RNA, 22 nt, Human
gcagguggauuaucagaagugc

SEQ ID NO: 302863 - RNA, 22 nt, Human
gguuucaacuuuugugaggaau

SEQ ID NO: 302864 - RNA, 18 nt, Human
gcugggguugagcucucc

SEQ ID NO: 302865 - RNA, 22 nt, Human
cagacccugggccacagaggag

SEQ ID NO: 302866 - RNA, 22 nt, Human
uaacauuugcugucuccuaugu

SEQ ID NO: 302867 - RNA, 22 nt, Human
agcauuuagucuuuauugcagc

SEQ ID NO: 302868 - RNA, 22 nt, Human
agaagggcuacacgggcucucc

SEQ ID NO: 302869 - RNA, 22 nt, Human
uuccuucugaagccuuuguguu

SEQ ID NO: 302870 - RNA, 22 nt, Human
ugggaccugcuccuggaaugag

SEQ ID NO: 302871 - RNA, 22 nt, Human
ggggaccuaggcucugucucuu

SEQ ID NO: 302872 - RNA, 21 nt, Human
guagggacagagaguugguga

SEQ ID NO: 302873 - RNA, 22 nt, Human
cccugcaggggaccugcagccu

SEQ ID NO: 302874 - RNA, 22 nt, Human
aggacauguuuguaucuuccuu

SEQ ID NO: 302875 - RNA, 22 nt, Human
gugguggaugucuguaaucuca

SEQ ID NO: 302876 - RNA, 22 nt, Human
acuuucuuaggcuguauaaaug

SEQ ID NO: 302877 - RNA, 22 nt, Human
ucccagggcacucacccucccu

SEQ ID NO: 302878 - RNA, 22 nt, Human
ggcaguggaggacccugugucu

SEQ ID NO: 302879 - RNA, 22 nt, Human
cuacauuaaauuggcuuacuua

SEQ ID NO: 302880 - RNA, 22 nt, Human
uuucaguuuuugcucgauguau

SEQ ID NO: 302881 - RNA, 22 nt, Human
ucauuuggaagccugagagugu

SEQ ID NO: 302882 - RNA, 22 nt, Human
gguuacauggaagaaauauaau

SEQ ID NO: 302883 - RNA, 22 nt, Human
ugaauagagcugcaguggacau

SEQ ID NO: 302884 - RNA, 21 nt, Human
agaauuaaauuggauuugugu

SEQ ID NO: 302885 - RNA, 22 nt, Human
cugccugcaugcugccauagcu

SEQ ID NO: 302886 - RNA, 22 nt, Human
auauaacauacauacagaaaag

SEQ ID NO: 302887 - RNA, 22 nt, Human
ucugggugagcugccucggguc

SEQ ID NO: 302888 - RNA, 22 nt, Human
auguccucuucugccucaggcc

SEQ ID NO: 302889 - RNA, 22 nt, Human
ucuucacaugaccuucaugucu

SEQ ID NO: 302890 - RNA, 22 nt, Human
agguauuauuagcaucucuauu

SEQ ID NO: 302891 - RNA, 22 nt, Human
aauguuuugcauuaguuuucua

SEQ ID NO: 302892 - RNA, 21 nt, Human
auaauguacaaaaacugucuu

SEQ ID NO: 302893 - RNA, 22 nt, Human
ucagguguucuccacucaguuu

SEQ ID NO: 302894 - RNA, 22 nt, Human
uuggaggacuaguuaagagacc

SEQ ID NO: 302895 - RNA, 22 nt, Human
uauuccaagcacagcaacccag

SEQ ID NO: 302896 - RNA, 22 nt, Human
auuauauaggacuugcccuucc

SEQ ID NO: 302897 - RNA, 20 nt, Human
gcauccagacacccagcugc

SEQ ID NO: 302898 - RNA, 22 nt, Human
aauugcuuguuucuuuaacuga

SEQ ID NO: 302899 - RNA, 22 nt, Human
cauuuguauguuccuccuuagg

SEQ ID NO: 302900 - RNA, 22 nt, Human
agugugagcccuggaguggugc

SEQ ID NO: 302901 - RNA, 22 nt, Human
gggaauguaaucauggaaugcu

SEQ ID NO: 302902 - RNA, 22 nt, Human
auuucuacaguacacaugcauu

SEQ ID NO: 302903 - RNA, 21 nt, Human
ucucuuucuggaagcuucccu

SEQ ID NO: 302904 - RNA, 22 nt, Human
uuucacauuuaggcgugaauug

SEQ ID NO: 302905 - RNA, 22 nt, Human
guuuauugauaaaagcuggaca

SEQ ID NO: 302906 - RNA, 22 nt, Human
acuugguugcuucugaaaugac

SEQ ID NO: 302907 - RNA, 22 nt, Human
uauagacaagcguaacaagaag

SEQ ID NO: 302908 - RNA, 22 nt, Human
cugggcugauuuagucacguuu

SEQ ID NO: 302909 - RNA, 22 nt, Human
aacuugguaccaccuucugaag

SEQ ID NO: 302910 - RNA, 22 nt, Human
auucugggugacuacgugauca

SEQ ID NO: 302911 - RNA, 22 nt, Human
uacaugugcuggguucuuggcc

SEQ ID NO: 302912 - RNA, 22 nt, Human
aguggcagguguuucguggugc

SEQ ID NO: 302913 - RNA, 22 nt, Human
auugcuggcugccaucuugccc

SEQ ID NO: 302914 - RNA, 22 nt, Human
acauguggaggaggcgagggua

SEQ ID NO: 302915 - RNA, 22 nt, Human
auacauauaugguacuuccugg

SEQ ID NO: 302916 - RNA, 22 nt, Human
uugcaggguugacacugccugc

SEQ ID NO: 302917 - RNA, 22 nt, Human
acccagcaugacaccugcacau

SEQ ID NO: 302918 - RNA, 22 nt, Human
ucuggcucuccagugcucuuag

SEQ ID NO: 302919 - RNA, 20 nt, Human
cagcuuuagaucuuugauua

SEQ ID NO: 302920 - RNA, 22 nt, Human
cuguggaaauaaacaaugcuaa

SEQ ID NO: 302921 - RNA, 22 nt, Human
aggcucagaggugagcaucugc

SEQ ID NO: 302922 - RNA, 18 nt, Human
guguccuggcugcggcgc

SEQ ID NO: 302923 - RNA, 22 nt, Human
uggcagguuaacuuacaacugu

SEQ ID NO: 302924 - RNA, 22 nt, Human
uaaguuuuaagcaaucugauaa

SEQ ID NO: 302925 - RNA, 22 nt, Human
aagggcucugugugccucccca

SEQ ID NO: 302926 - RNA, 22 nt, Human
gguuccaccuggcgagggguau

SEQ ID NO: 302927 - RNA, 22 nt, Human
cuguccugugucagccugaaau

SEQ ID NO: 302928 - RNA, 22 nt, Human
aguucuucauaaccuuacugug

SEQ ID NO: 302929 - RNA, 22 nt, Human
cagagcagggguuucccagguu

SEQ ID NO: 302930 - RNA, 22 nt, Human
uagcuuuaggcacguuugaauu

SEQ ID NO: 302931 - RNA, 22 nt, Human
aaauuucuggaagugucagagu

SEQ ID NO: 302932 - RNA, 23 nt, Human
gauugcuguaugcaggagcauuc

SEQ ID NO: 302933 - RNA, 22 nt, Human
aaggcauaugcauagaagacag

SEQ ID NO: 302934 - RNA, 22 nt, Human
uguguccuguccccuugcugcu

SEQ ID NO: 302935 - RNA, 22 nt, Human
guuuauuauucaacuucauguu

SEQ ID NO: 302936 - RNA, 22 nt, Human
aaauccuaaugacaaguuuagu

SEQ ID NO: 302937 - RNA, 22 nt, Human
cagcuucugucugauuagcaag

SEQ ID NO: 302938 - RNA, 18 nt, Human
gguccugggccuggcuca

SEQ ID NO: 302939 - RNA, 22 nt, Human
aucaagaacuuauuuuggaaau

SEQ ID NO: 302940 - RNA, 22 nt, Human
auucugggaacuuugucucuca

SEQ ID NO: 302941 - RNA, 22 nt, Human
uaauuucacugauaugaaguca

SEQ ID NO: 302942 - RNA, 22 nt, Human
uugaaucuauguauucagugua

SEQ ID NO: 302943 - RNA, 22 nt, Human
uccaggcauagaaggcacgcac

SEQ ID NO: 302944 - RNA, 22 nt, Human
ccuuuucuauguaccagcagug

SEQ ID NO: 302945 - RNA, 22 nt, Human
ccagccacagcuuccagcuccu

SEQ ID NO: 302946 - RNA, 22 nt, Human
gcagaagucagaccaucugaau

SEQ ID NO: 302947 - RNA, 22 nt, Human
uguccuggugcuucuugggauu

SEQ ID NO: 302948 - RNA, 22 nt, Human
agacccucuccaugcccacugc

SEQ ID NO: 302949 - RNA, 22 nt, Human
cagggcucaucugugugaccag

SEQ ID NO: 302950 - RNA, 22 nt, Human
ccaggccuagccccugagggua

SEQ ID NO: 302951 - RNA, 22 nt, Human
gacaggugagaugaggaacacc

SEQ ID NO: 302952 - RNA, 22 nt, Human
aguuguaauaacaauaccaaaa

SEQ ID NO: 302953 - RNA, 20 nt, Human
ccuucuccagcuuguucuug

SEQ ID NO: 302954 - RNA, 22 nt, Human
ucugggaagcugcgugccuguu

SEQ ID NO: 302955 - RNA, 22 nt, Human
gccuggguuccaugaucuccag

SEQ ID NO: 302956 - RNA, 23 nt, Human
cguguccuucagggagagugugg

SEQ ID NO: 302957 - RNA, 22 nt, Human
cacaggugcaagaaguugcagu

SEQ ID NO: 302958 - RNA, 22 nt, Human
aagcuuuaugaucucucagcua

SEQ ID NO: 302959 - RNA, 22 nt, Human
caauagugucugcuuguuucua

SEQ ID NO: 302960 - RNA, 22 nt, Human
uguguccuuucuuaagagugag

SEQ ID NO: 302961 - RNA, 22 nt, Human
uauauucaaugauuaguaucag

SEQ ID NO: 302962 - RNA, 22 nt, Human
auuaagugacuaaaguaaugcu

SEQ ID NO: 302963 - RNA, 22 nt, Human
cuggaguuagaguagacacuga

SEQ ID NO: 302964 - RNA, 22 nt, Human
ucuccgaucacagguuuucaau

SEQ ID NO: 302965 - RNA, 17 nt, Human
ugguggcuggagucagg

SEQ ID NO: 302966 - RNA, 22 nt, Human
uuuuauuaguggcuagaugggg

SEQ ID NO: 302967 - RNA, 22 nt, Human
gcagagaggaaugaagccaucc

SEQ ID NO: 302968 - RNA, 20 nt, Human
auguucuucauuuaauguuc

SEQ ID NO: 302969 - RNA, 22 nt, Human
guucuucaaagugacaacuaaa

SEQ ID NO: 302970 - RNA, 22 nt, Human
auuuucauuuugcagggugaga

SEQ ID NO: 302971 - RNA, 19 nt, Human
cuggaauguggcuggugca

SEQ ID NO: 302972 - RNA, 19 nt, Human
ucaaaacacaaaugguuga

SEQ ID NO: 302973 - RNA, 22 nt, Human
uagaaauggagaacagauuaau

SEQ ID NO: 302974 - RNA, 21 nt, Human
ucagaacuggugcagaugaau

SEQ ID NO: 302975 - RNA, 18 nt, Human
gcagguguggagaagggg

SEQ ID NO: 302976 - RNA, 22 nt, Human
gggugggaaggcuaagggauug

SEQ ID NO: 302977 - RNA, 22 nt, Human
agccagaguugaaugugagucu

SEQ ID NO: 302978 - RNA, 22 nt, Human
auguuauaguuauaaaaugagg

SEQ ID NO: 302979 - RNA, 22 nt, Human
auuuccaugaaggcagauuuua

SEQ ID NO: 302980 - RNA, 22 nt, Human
aagggcaggcagagaucauaua

SEQ ID NO: 302981 - RNA, 22 nt, Human
agacacuguguacagaaaaaga

SEQ ID NO: 302982 - RNA, 22 nt, Human
uaguuaacucuugguaauaggu

SEQ ID NO: 302983 - RNA, 22 nt, Human
ucugggugaugaaaugcacugu

SEQ ID NO: 302984 - RNA, 22 nt, Human
uccugcaggcuugaguccucag

SEQ ID NO: 302985 - RNA, 22 nt, Human
gagggcucugaaaggaggucac

SEQ ID NO: 302986 - RNA, 22 nt, Human
gcaugugucccucagucugugc

SEQ ID NO: 302987 - RNA, 22 nt, Human
cuggguguagauggaaguuugg

SEQ ID NO: 302988 - RNA, 22 nt, Human
uuuaauuugaaaugaguaaccc

SEQ ID NO: 302989 - RNA, 22 nt, Human
ucagacagauuuugacacuugc

SEQ ID NO: 302990 - RNA, 22 nt, Human
uuugcuuguucaagauuucugu

SEQ ID NO: 302991 - RNA, 22 nt, Human
ccaggugguucaggucaccaua

SEQ ID NO: 302992 - RNA, 22 nt, Human
gcugggucucuggguguaacaa

SEQ ID NO: 302993 - RNA, 22 nt, Human
uacuuuauuguaaaugcugaug

SEQ ID NO: 302994 - RNA, 22 nt, Human
ucugaagagcuuuggaaguaug

SEQ ID NO: 302995 - RNA, 22 nt, Human
uuucauaaccucaagcuacagu

SEQ ID NO: 302996 - RNA, 22 nt, Human
ugauucacagacuucacaaggc

SEQ ID NO: 302997 - RNA, 22 nt, Human
gacaggcugugauggccgggag

SEQ ID NO: 302998 - RNA, 22 nt, Human
ucuaaccuuugaaacugcuuuc

SEQ ID NO: 302999 - RNA, 22 nt, Human
uacaaaaguaauuacgguuuuu

SEQ ID NO: 303000 - RNA, 22 nt, Human
aggcagguuucccggcugucaa

SEQ ID NO: 303001 - RNA, 20 nt, Human
acugugaaugcugaauuagc

SEQ ID NO: 303002 - RNA, 22 nt, Human
uuuauugucuaugaacugcuug

SEQ ID NO: 303003 - RNA, 22 nt, Human
uuauuuuuaaaaguucacacag

SEQ ID NO: 303004 - RNA, 22 nt, Human
gaacuuggaccugguccuuugg

SEQ ID NO: 303005 - RNA, 22 nt, Human
auguuaaaugguuuauuauuaa

SEQ ID NO: 303006 - RNA, 20 nt, Human
aggagcugaauuagaggguu

SEQ ID NO: 303007 - RNA, 22 nt, Human
ugcagguggauaucucaucaga

SEQ ID NO: 303008 - RNA, 22 nt, Human
gcacccagccagcaucucagag

SEQ ID NO: 303009 - RNA, 22 nt, Human
cuccucaaggucucaggaauaa

SEQ ID NO: 303010 - RNA, 22 nt, Human
ugcaaaaacagccuugaggccu

SEQ ID NO: 303011 - RNA, 22 nt, Human
cuuagauacaguagaaagacuc

SEQ ID NO: 303012 - RNA, 22 nt, Human
ugaaugauguauaauauugaga

SEQ ID NO: 303013 - RNA, 22 nt, Human
uguccauggagaagcucagggc

SEQ ID NO: 303014 - RNA, 22 nt, Human
uggcaaggcugugggggcagag

SEQ ID NO: 303015 - RNA, 22 nt, Human
cuucccuuucuggugacuucuc

SEQ ID NO: 303016 - RNA, 22 nt, Human
guuuucaugucuauugggcaua

SEQ ID NO: 303017 - RNA, 22 nt, Human
gcagggcauagaggcacggagg

SEQ ID NO: 303018 - RNA, 22 nt, Human
cuugggugcuggaggcugccgc

SEQ ID NO: 303019 - RNA, 22 nt, Human
gcuuccucccugcugcucacua

SEQ ID NO: 303020 - RNA, 22 nt, Human
auuucaaggcuauuaauauaaa

SEQ ID NO: 303021 - RNA, 22 nt, Human
uggagcugagagccaggcuggc

SEQ ID NO: 303022 - RNA, 22 nt, Human
uaggugucuuucuguccuuguu

SEQ ID NO: 303023 - RNA, 22 nt, Human
aguggggccggugaggccgagg

SEQ ID NO: 303024 - RNA, 22 nt, Human
uuucugcauuguccucuugguu

SEQ ID NO: 303025 - RNA, 20 nt, Human
uuaagaaaagcacauccugc

SEQ ID NO: 303026 - RNA, 22 nt, Human
uauauguagucagucagaguaa

SEQ ID NO: 303027 - RNA, 22 nt, Human
agguggggcugggaaagauucc

SEQ ID NO: 303028 - RNA, 20 nt, Human
gauuacaaaaugaaaugcau

SEQ ID NO: 303029 - RNA, 22 nt, Human
ggaugucucccagcaccaaagu

SEQ ID NO: 303030 - RNA, 22 nt, Human
ccaggccuuccaguacgcagaa

SEQ ID NO: 303031 - RNA, 22 nt, Human
agugugaguuacaaagugugaa

SEQ ID NO: 303032 - RNA, 22 nt, Human
uuccuucuccagaacuucuagg

SEQ ID NO: 303033 - RNA, 22 nt, Human
gaauaucccgcuaugcaaagua

SEQ ID NO: 303034 - RNA, 22 nt, Human
uacaagucacuuccuuucuaaa

SEQ ID NO: 303035 - RNA, 22 nt, Human
uggcagguacccauuggcugua

SEQ ID NO: 303036 - RNA, 22 nt, Human
gacagacaaauguuuuuaacuu

SEQ ID NO: 303037 - RNA, 22 nt, Human
gguccuuugaaagggguguguc

SEQ ID NO: 303038 - RNA, 22 nt, Human
gauugcuggggcaggcuguagc

SEQ ID NO: 303039 - RNA, 22 nt, Human
aagaugauguuguguuuucacu

SEQ ID NO: 303040 - RNA, 22 nt, Human
uacauguauguguuaauaucug

SEQ ID NO: 303041 - RNA, 22 nt, Human
augauugaaaaugacauugcca

SEQ ID NO: 303042 - RNA, 22 nt, Human
guauuagguuggugcaaaauug

SEQ ID NO: 303043 - RNA, 22 nt, Human
ggacaggugcaaagggcacaug

SEQ ID NO: 303044 - RNA, 22 nt, Human
aggcaugacuuuggcugaagaa

SEQ ID NO: 303045 - RNA, 22 nt, Human
aggaccugagaguuggaaaucc

SEQ ID NO: 303046 - RNA, 23 nt, Human
uguguccuuaacuguauauacua

SEQ ID NO: 303047 - RNA, 22 nt, Human
acauuuauauaacucacuagga

SEQ ID NO: 303048 - RNA, 22 nt, Human
gguuucaacucagcuaguaagg

SEQ ID NO: 303049 - RNA, 22 nt, Human
uuuagggaagaagcccauggcc

SEQ ID NO: 303050 - RNA, 21 nt, Human
gcugcaaauucuaacaauuau

SEQ ID NO: 303051 - RNA, 22 nt, Human
acuuucauuugugaagacugua

SEQ ID NO: 303052 - RNA, 22 nt, Human
cauuguuaauugguaucuuaca

SEQ ID NO: 303053 - RNA, 22 nt, Human
gacagguguguguauauuaggg

SEQ ID NO: 303054 - RNA, 22 nt, Human
uuuauuuauaagccacuugcug

SEQ ID NO: 303055 - RNA, 21 nt, Human
ucuguucaaggaacuacggau

SEQ ID NO: 303056 - RNA, 22 nt, Human
uacagacauuuacuccacuccu

SEQ ID NO: 303057 - RNA, 22 nt, Human
ucaugaacaucucaaauaacca

SEQ ID NO: 303058 - RNA, 22 nt, Human
aauguugaggauaucagaaaau

SEQ ID NO: 303059 - RNA, 22 nt, Human
agcagguggccacgaggaggag

SEQ ID NO: 303060 - RNA, 22 nt, Human
uauacagucuuuugcuauauuc

SEQ ID NO: 303061 - RNA, 22 nt, Human
auaaacaguaaaugugagcagu

SEQ ID NO: 303062 - RNA, 22 nt, Human
cuuguugcuaacauaugcuucu

SEQ ID NO: 303063 - RNA, 22 nt, Human
caugcaggaggaaaaagcagcu

SEQ ID NO: 303064 - RNA, 22 nt, Human
aaaauuauucauggcuuuugga

SEQ ID NO: 303065 - RNA, 22 nt, Human
cuggaggcaguugccccaguca

SEQ ID NO: 303066 - RNA, 22 nt, Human
uuccaggaaaacaguuggaagu

SEQ ID NO: 303067 - RNA, 22 nt, Human
agccuuguuggucugaguuugg

SEQ ID NO: 303068 - RNA, 22 nt, Human
ggcugcaagacaagguugguuu

SEQ ID NO: 303069 - RNA, 22 nt, Human
uggaggaaguggcuggccagaa

SEQ ID NO: 303070 - RNA, 22 nt, Human
gccugcagcugcuuccacacac

SEQ ID NO: 303071 - RNA, 22 nt, Human
ucagggcacugucaccugauau

SEQ ID NO: 303072 - RNA, 19 nt, Human
cuguccugguuuggucccu

SEQ ID NO: 303073 - RNA, 22 nt, Human
cuuucuuugcagugagccagag

SEQ ID NO: 303074 - RNA, 22 nt, Human
caguguggugagauuccaggug

SEQ ID NO: 303075 - RNA, 22 nt, Human
cagcaugaaacaauugagccca

SEQ ID NO: 303076 - RNA, 22 nt, Human
gagcagugaugggaggacguca

SEQ ID NO: 303077 - RNA, 22 nt, Human
agcuggagcuucaagcagguaa

SEQ ID NO: 303078 - RNA, 22 nt, Human
ggagcugagguaacagugagug

SEQ ID NO: 303079 - RNA, 22 nt, Human
guauuacaaauaaauguuacug

SEQ ID NO: 303080 - RNA, 22 nt, Human
aaaugcuacacaggaauucuca

SEQ ID NO: 303081 - RNA, 22 nt, Human
uuucacauguggaaugccaggu

SEQ ID NO: 303082 - RNA, 22 nt, Human
uuguaaagcugauuagaaagcc

SEQ ID NO: 303083 - RNA, 22 nt, Human
uaauuauuaugacaacaauugc

SEQ ID NO: 303084 - RNA, 22 nt, Human
cuggaugucuuggggacuccug

SEQ ID NO: 303085 - RNA, 22 nt, Human
ccagguguggccacauggcugg

SEQ ID NO: 303086 - RNA, 19 nt, Human
caggugguaaucugagccu

SEQ ID NO: 303087 - RNA, 22 nt, Human
guccaguguguuuaucuuggau

SEQ ID NO: 303088 - RNA, 22 nt, Human
uauuuguauguguguacauaua

SEQ ID NO: 303089 - RNA, 22 nt, Human
uuuuauugucucccaguucugg

SEQ ID NO: 303090 - RNA, 22 nt, Human
uuuuccuuucaucaggacaaag

SEQ ID NO: 303091 - RNA, 22 nt, Human
ucagacagcuugcagggaggug

SEQ ID NO: 303092 - RNA, 22 nt, Human
uuuauaugugaagguuugcaga

SEQ ID NO: 303093 - RNA, 22 nt, Human
uccuggaucuacucucaauugg

SEQ ID NO: 303094 - RNA, 22 nt, Human
uuaacugugacaguuucucaga

SEQ ID NO: 303095 - RNA, 22 nt, Human
cuccagggaugagacagaguag

SEQ ID NO: 303096 - RNA, 22 nt, Human
auguuucaucaguaagguuuug

SEQ ID NO: 303097 - RNA, 22 nt, Human
gaaccauuguugaaaagaauag

SEQ ID NO: 303098 - RNA, 22 nt, Human
agcaggugaugugagucuggaa

SEQ ID NO: 303099 - RNA, 22 nt, Human
uuuccagagcaugucugcucag

SEQ ID NO: 303100 - RNA, 22 nt, Human
uuucuaggcacagugucuuccc

SEQ ID NO: 303101 - RNA, 22 nt, Human
uaccugcacagccagccaugug

SEQ ID NO: 303102 - RNA, 22 nt, Human
uuucuuuugaauaguguguggu

SEQ ID NO: 303103 - RNA, 22 nt, Human
uuccagaauugggagccuugag

SEQ ID NO: 303104 - RNA, 22 nt, Human
cccaguguuccuugaggggcug

SEQ ID NO: 303105 - RNA, 22 nt, Human
uuccaugagcucugaguucaca

SEQ ID NO: 303106 - RNA, 22 nt, Human
ccacccagcagaggaggcaaga

SEQ ID NO: 303107 - RNA, 20 nt, Human
uuacuugucucagcauggag

SEQ ID NO: 303108 - RNA, 22 nt, Human
acuuuauuuccuauugcaucca

SEQ ID NO: 303109 - RNA, 22 nt, Human
guucuuaagaccacaauaaaaa

SEQ ID NO: 303110 - RNA, 22 nt, Human
ccacccagccagaugcaggaag

SEQ ID NO: 303111 - RNA, 22 nt, Human
gucugcccuuggcucagccaua

SEQ ID NO: 303112 - RNA, 22 nt, Human
uacauguggagauaacugaagc

SEQ ID NO: 303113 - RNA, 22 nt, Human
cagcuucuccggccuggugcgg

SEQ ID NO: 303114 - RNA, 22 nt, Human
uggcagggucuugcuguguugc

SEQ ID NO: 303115 - RNA, 22 nt, Human
cagggcagggagcuuagaauga

SEQ ID NO: 303116 - RNA, 22 nt, Human
gagagcacggucuugggcaugg

SEQ ID NO: 303117 - RNA, 22 nt, Human
auucuucagaauaucuggcacu

SEQ ID NO: 303118 - RNA, 22 nt, Human
ugaauaaucuuggguauuaaua

SEQ ID NO: 303119 - RNA, 22 nt, Human
aacaugugucuugcauuucuug

SEQ ID NO: 303120 - RNA, 22 nt, Human
cugcagggcagaagggcauaga

SEQ ID NO: 303121 - RNA, 22 nt, Human
uuucacauuagauaugucauuu

SEQ ID NO: 303122 - RNA, 22 nt, Human
auuuggcaacauuaauugaauc

SEQ ID NO: 303123 - RNA, 22 nt, Human
ucuggaugaaagggcuauauau

SEQ ID NO: 303124 - RNA, 22 nt, Human
acuuccuuuugggaaacuguuu

SEQ ID NO: 303125 - RNA, 22 nt, Human
uuguacuaucaccaugucaugu

SEQ ID NO: 303126 - RNA, 22 nt, Human
aguuuguaaguucauuaugagu

SEQ ID NO: 303127 - RNA, 22 nt, Human
acauuuaaauaccuauguuucu

SEQ ID NO: 303128 - RNA, 22 nt, Human
ucuuuccaaggacucuguagca

SEQ ID NO: 303129 - RNA, 22 nt, Human
gcuggagggguaauaggauggg

SEQ ID NO: 303130 - RNA, 22 nt, Human
cugaggcuuggaggggucuggu

SEQ ID NO: 303131 - RNA, 22 nt, Human
auuguauaauuguauugccaaa

SEQ ID NO: 303132 - RNA, 23 nt, Human
agagcaucaugaugcuaagucug

SEQ ID NO: 303133 - RNA, 22 nt, Human
ucuggcucucauacucgccagu

SEQ ID NO: 303134 - RNA, 22 nt, Human
cagggcagaaggcacucuacuc

SEQ ID NO: 303135 - RNA, 22 nt, Human
uuuauuuaaagucguguguuaa

SEQ ID NO: 303136 - RNA, 22 nt, Human
ugcuggcugccagguucccugu

SEQ ID NO: 303137 - RNA, 22 nt, Human
cagaguggugcaagggcagugu

SEQ ID NO: 303138 - RNA, 22 nt, Human
gcaugcaggagagaaagacggc

SEQ ID NO: 303139 - RNA, 22 nt, Human
uuauauuguguaauaagugaag

SEQ ID NO: 303140 - RNA, 22 nt, Human
auauuccauugguuucccuucu

SEQ ID NO: 303141 - RNA, 22 nt, Human
auuucccuccagggaaagcuua

SEQ ID NO: 303142 - RNA, 22 nt, Human
caguggugaagagcaggggcuc

SEQ ID NO: 303143 - RNA, 22 nt, Human
aguccuuugcugaacugucaca

SEQ ID NO: 303144 - RNA, 18 nt, Human
uccugcagcuucuaugua

SEQ ID NO: 303145 - RNA, 22 nt, Human
ugggacacagaaaaggcagguu

SEQ ID NO: 303146 - RNA, 22 nt, Human
cacauaaucaccaaguccuuuc

SEQ ID NO: 303147 - RNA, 22 nt, Human
cuucagaggggacucaaaguca

SEQ ID NO: 303148 - RNA, 22 nt, Human
aagggcagccugacucacgguc

SEQ ID NO: 303149 - RNA, 22 nt, Human
uuauugagcaccuacuaugugu

SEQ ID NO: 303150 - RNA, 22 nt, Human
gggaggaaugcaacuuauuuag

SEQ ID NO: 303151 - RNA, 20 nt, Human
ccagcuuucccugcagcauc

SEQ ID NO: 303152 - RNA, 22 nt, Human
cagauuuaccuaacuccaaguu

SEQ ID NO: 303153 - RNA, 22 nt, Human
auuuauugguuugcauggugaa

SEQ ID NO: 303154 - RNA, 22 nt, Human
uguuucauuaguacugacaaua

SEQ ID NO: 303155 - RNA, 22 nt, Human
uacagcuaggcaaaaaugacau

SEQ ID NO: 303156 - RNA, 22 nt, Human
ucagggcacaggccuguggguu

SEQ ID NO: 303157 - RNA, 22 nt, Human
gagggcuccacacgggcccagc

SEQ ID NO: 303158 - RNA, 22 nt, Human
uuggaggaaauugcuuuugugg

SEQ ID NO: 303159 - RNA, 18 nt, Human
agcagguggcgucugcag

SEQ ID NO: 303160 - RNA, 22 nt, Human
uuugaaauaugaggcauuauga

SEQ ID NO: 303161 - RNA, 22 nt, Human
uauuugaaggcauacauuuuga

SEQ ID NO: 303162 - RNA, 22 nt, Human
cucuggaauggguguuucuaac

SEQ ID NO: 303163 - RNA, 22 nt, Human
cucugcccccagcuggugcuug

SEQ ID NO: 303164 - RNA, 22 nt, Human
ccagagagauugcuucuaaaga

SEQ ID NO: 303165 - RNA, 23 nt, Human
uccaggcaugagcucuggaugga

SEQ ID NO: 303166 - RNA, 22 nt, Human
agcagguguuagggauccaaug

SEQ ID NO: 303167 - RNA, 22 nt, Human
ucagggcauguauguuucuuua

SEQ ID NO: 303168 - RNA, 22 nt, Human
gagugcuugcauauuuauuguc

SEQ ID NO: 303169 - RNA, 22 nt, Human
ccugcucccgggacgcguucac

SEQ ID NO: 303170 - RNA, 22 nt, Human
aaaagguuuugaguacaaauau

SEQ ID NO: 303171 - RNA, 22 nt, Human
uuucuuucaauucuccuaaugc

SEQ ID NO: 303172 - RNA, 22 nt, Human
cuggauguaacgaagguuucac

SEQ ID NO: 303173 - RNA, 22 nt, Human
uguccuagaguacauuccacug

SEQ ID NO: 303174 - RNA, 22 nt, Human
aggcuuuaauuaucuacaggag

SEQ ID NO: 303175 - RNA, 22 nt, Human
auccugugcaaugacugcaucu

SEQ ID NO: 303176 - RNA, 22 nt, Human
uguuugcuauauccuacuucau

SEQ ID NO: 303177 - RNA, 22 nt, Human
uuuaaauucugucugccgcuua

SEQ ID NO: 303178 - RNA, 21 nt, Human
aucuggaaauucugccagaga

SEQ ID NO: 303179 - RNA, 22 nt, Human
uguccuuuuucuuaggaaauau

SEQ ID NO: 303180 - RNA, 22 nt, Human
auuucaguguugguuagcaagc

SEQ ID NO: 303181 - RNA, 22 nt, Human
ugaaagcagcaccaauaccauu

SEQ ID NO: 303182 - RNA, 22 nt, Human
guaggcagguggaggagugaag

SEQ ID NO: 303183 - RNA, 17 nt, Human
uacauguguaucugauu

SEQ ID NO: 303184 - RNA, 22 nt, Human
uuccaggacaagauguuucagg

SEQ ID NO: 303185 - RNA, 22 nt, Human
caggacagagcccagacugugu

SEQ ID NO: 303186 - RNA, 18 nt, Human
uuccaugauuccuuucac

SEQ ID NO: 303187 - RNA, 22 nt, Human
ugcagggcaguuuguuucggca

SEQ ID NO: 303188 - RNA, 22 nt, Human
ugcagggaaagggcacugggcu

SEQ ID NO: 303189 - RNA, 22 nt, Human
ucagacagugugaucagucucu

SEQ ID NO: 303190 - RNA, 22 nt, Human
accugcagcuaaagauguaggg

SEQ ID NO: 303191 - RNA, 22 nt, Human
ugaaagaaacagguauauuggg

SEQ ID NO: 303192 - RNA, 22 nt, Human
cugauuccagagucuguguucu

SEQ ID NO: 303193 - RNA, 22 nt, Human
cuggauguucuucugcaauuau

SEQ ID NO: 303194 - RNA, 22 nt, Human
cuguuguauuauucaauauuau

SEQ ID NO: 303195 - RNA, 22 nt, Human
ccagacaguuccuugagguuca

SEQ ID NO: 303196 - RNA, 22 nt, Human
agacaggugcucgcccaagucc

SEQ ID NO: 303197 - RNA, 22 nt, Human
ccuuccuuugcaucauuucuag

SEQ ID NO: 303198 - RNA, 14 nt, Human
gcaggcagaucacc

SEQ ID NO: 303199 - RNA, 19 nt, Human
agcauuuggaauucuacac

SEQ ID NO: 303200 - RNA, 22 nt, Human
guguccugcauuggcucugccc

SEQ ID NO: 303201 - RNA, 22 nt, Human
ccuuuauucaauuaguccuaau

SEQ ID NO: 303202 - RNA, 22 nt, Human
cucagcaacccacacacggucu

SEQ ID NO: 303203 - RNA, 22 nt, Human
cuguccugcaguugggggcagg

SEQ ID NO: 303204 - RNA, 22 nt, Human
cuggcccuucucuugcuuccug

SEQ ID NO: 303205 - RNA, 22 nt, Human
ccacagaaaauaaagcacgauu

SEQ ID NO: 303206 - RNA, 21 nt, Human
uucuucaguuuaauauaaaau

SEQ ID NO: 303207 - RNA, 21 nt, Human
ucuuuucucagcuuugugguu

SEQ ID NO: 303208 - RNA, 22 nt, Human
aagggcagagggaaucccacau

SEQ ID NO: 303209 - RNA, 22 nt, Human
cacagacagugucccuuuguug

SEQ ID NO: 303210 - RNA, 22 nt, Human
gguaaaaaucacaaauacuuua

SEQ ID NO: 303211 - RNA, 21 nt, Human
uccagaccucccucuccuagc

SEQ ID NO: 303212 - RNA, 22 nt, Human
aaauguauugcauaggauauuu

SEQ ID NO: 303213 - RNA, 22 nt, Human
ggacagguucagcaguuuauaa

SEQ ID NO: 303214 - RNA, 17 nt, Human
uuucugcaugauuggac

SEQ ID NO: 303215 - RNA, 19 nt, Human
ccaggccuccugggagguc

SEQ ID NO: 303216 - RNA, 22 nt, Human
aguccggggucuggacaccugg

SEQ ID NO: 303217 - RNA, 22 nt, Human
gucauucuuaacaacucaguag

SEQ ID NO: 303218 - RNA, 22 nt, Human
uuaagacauucagauauuucua

SEQ ID NO: 303219 - RNA, 22 nt, Human
acagcuggcaggggggcaugaa

SEQ ID NO: 303220 - RNA, 22 nt, Human
cucccuucaggagaggcucaca

SEQ ID NO: 303221 - RNA, 22 nt, Human
cagggcucugccuugagggaug

SEQ ID NO: 303222 - RNA, 22 nt, Human
agggcccuaaggaaggcacaca

SEQ ID NO: 303223 - RNA, 22 nt, Human
cuuuguugugccugagugcacc

SEQ ID NO: 303224 - RNA, 19 nt, Human
ggaagagaggaaaggugga

SEQ ID NO: 303225 - RNA, 22 nt, Human
gaugagguguguggccacuaga

SEQ ID NO: 303226 - RNA, 22 nt, Human
ccaggugucauggauaaugggu

SEQ ID NO: 303227 - RNA, 22 nt, Human
aaagcagacugauuugcaucac

SEQ ID NO: 303228 - RNA, 21 nt, Human
ugucagagcuuguaggacauu

SEQ ID NO: 303229 - RNA, 22 nt, Human
cacagguggcuucuuucaucuu

SEQ ID NO: 303230 - RNA, 22 nt, Human
uccugcagccauuagaggucaa

SEQ ID NO: 303231 - RNA, 22 nt, Human
uggagcaggugggaugucguga

SEQ ID NO: 303232 - RNA, 22 nt, Human
uucuguauauuguaaagacuca

SEQ ID NO: 303233 - RNA, 22 nt, Human
uaguuuguagaaaucuagaaau

SEQ ID NO: 303234 - RNA, 22 nt, Human
agugugagcuaauagcagagcc

SEQ ID NO: 303235 - RNA, 22 nt, Human
uuugaaugcaggacauacagaa

SEQ ID NO: 303236 - RNA, 22 nt, Human
acaggcaggcuucggccagagc

SEQ ID NO: 303237 - RNA, 22 nt, Human
auauugagaugaggauauuaac

SEQ ID NO: 303238 - RNA, 22 nt, Human
gacauaauccuccucaccuacu

SEQ ID NO: 303239 - RNA, 20 nt, Human
agugacugggagaauggauu

SEQ ID NO: 303240 - RNA, 22 nt, Human
auuucuguaguccacauucuuu

SEQ ID NO: 303241 - RNA, 22 nt, Human
accugcaggggugcucucuggg

SEQ ID NO: 303242 - RNA, 22 nt, Human
gugggggacccaggugcugucc

SEQ ID NO: 303243 - RNA, 19 nt, Human
uccuucuccggccaccccg

SEQ ID NO: 303244 - RNA, 22 nt, Human
auccuucuucaaagagggaaaa

SEQ ID NO: 303245 - RNA, 20 nt, Human
uuccagagaucugcauuuua

SEQ ID NO: 303246 - RNA, 22 nt, Human
ugcaugaaauauuuucuguagg

SEQ ID NO: 303247 - RNA, 22 nt, Human
caaauucucacccuguuugauu

SEQ ID NO: 303248 - RNA, 22 nt, Human
accugcaggcacaggugugcgc

SEQ ID NO: 303249 - RNA, 22 nt, Human
ucaugugucugccaguguuuau

SEQ ID NO: 303250 - RNA, 22 nt, Human
uuccaggaggagguacuagagg

SEQ ID NO: 303251 - RNA, 22 nt, Human
augacaggaggcagcugggcag

SEQ ID NO: 303252 - RNA, 21 nt, Human
uucuucuuggacuguuuuggc

SEQ ID NO: 303253 - RNA, 22 nt, Human
uugguuuguucaccaucaagca

SEQ ID NO: 303254 - RNA, 22 nt, Human
guuugaaugcaguaugcauuuu

SEQ ID NO: 303255 - RNA, 22 nt, Human
ugaaagcuuugggacaguguga

SEQ ID NO: 303256 - RNA, 20 nt, Human
gcagagugugagagggugaa

SEQ ID NO: 303257 - RNA, 22 nt, Human
ugcugauuuugccuacugaucc

SEQ ID NO: 303258 - RNA, 22 nt, Human
aggaccugaaauucuugcuuuu

SEQ ID NO: 303259 - RNA, 19 nt, Human
ugggugugaccaucucugc

SEQ ID NO: 303260 - RNA, 22 nt, Human
uggcaggguggcaacuuuuggu

SEQ ID NO: 303261 - RNA, 22 nt, Human
agcagggcuccugaaagccgcg

SEQ ID NO: 303262 - RNA, 22 nt, Human
ugcacuacugugauacacagcc

SEQ ID NO: 303263 - RNA, 22 nt, Human
guauuaggaggaacacaggccu

SEQ ID NO: 303264 - RNA, 22 nt, Human
auuugaagucuucaugauuucu

SEQ ID NO: 303265 - RNA, 22 nt, Human
ggcaggcacugugcuaggcgcu

SEQ ID NO: 303266 - RNA, 21 nt, Human
aggcugcaugcaugagugugg

SEQ ID NO: 303267 - RNA, 22 nt, Human
gucuucuuguguugccugucuu

SEQ ID NO: 303268 - RNA, 22 nt, Human
uuccuggguugugcauuguaca

SEQ ID NO: 303269 - RNA, 22 nt, Human
ccacagagacaggguccuugcu

SEQ ID NO: 303270 - RNA, 22 nt, Human
ugcuuuauggagcccaucucau

SEQ ID NO: 303271 - RNA, 21 nt, Human
uccugcagaaugccuuccuac

SEQ ID NO: 303272 - RNA, 22 nt, Human
cugaaggagaaggccacuguuc

SEQ ID NO: 303273 - RNA, 22 nt, Human
uccaggcauuccagccauucca

SEQ ID NO: 303274 - RNA, 22 nt, Human
aauauaauuuuauuccuagagu

SEQ ID NO: 303275 - RNA, 22 nt, Human
ggcagguggaaggucuccauuc

SEQ ID NO: 303276 - RNA, 22 nt, Human
gggacauggaggcgcgcaggca

SEQ ID NO: 303277 - RNA, 23 nt, Human
ucagggacaugaugugucauauc

SEQ ID NO: 303278 - RNA, 20 nt, Human
auggaggaagggcaagagaa

SEQ ID NO: 303279 - RNA, 22 nt, Human
aauuugauucccugcaccuguu

SEQ ID NO: 303280 - RNA, 22 nt, Human
aucauguguaauuucaagcuac

SEQ ID NO: 303281 - RNA, 23 nt, Human
uuucuucagaagccuugcgaggc

SEQ ID NO: 303282 - RNA, 22 nt, Human
uggcagggugggcuucagcccc

SEQ ID NO: 303283 - RNA, 22 nt, Human
uuuaauuuguauuucuagaggg

SEQ ID NO: 303284 - RNA, 22 nt, Human
cucagcaagauuaagcagcuug

SEQ ID NO: 303285 - RNA, 22 nt, Human
aauugcuuugaagaagggagcg

SEQ ID NO: 303286 - RNA, 22 nt, Human
gcagggcaggauuugaacccag

SEQ ID NO: 303287 - RNA, 22 nt, Human
uaauuucuagggacuaaggugc

SEQ ID NO: 303288 - RNA, 22 nt, Human
ccaguguucauaauuuuacacu

SEQ ID NO: 303289 - RNA, 22 nt, Human
uuuacuguguccaucugugacu

SEQ ID NO: 303290 - RNA, 20 nt, Human
uguaggaaggacccugucug

SEQ ID NO: 303291 - RNA, 22 nt, Human
cuagugagucugaaugaguugc

SEQ ID NO: 303292 - RNA, 22 nt, Human
uaaaucuccuguuuuucaucua

SEQ ID NO: 303293 - RNA, 22 nt, Human
ugcauaaacagauacuucaugu

SEQ ID NO: 303294 - RNA, 22 nt, Human
auaucaaacgaaguuauuuuaa

SEQ ID NO: 303295 - RNA, 22 nt, Human
cugcaggggcuggaguuggcuu

SEQ ID NO: 303296 - RNA, 23 nt, Human
ucuggaggggacacugcagaugc

SEQ ID NO: 303297 - RNA, 22 nt, Human
uuggagguuugaaaauaugugu

SEQ ID NO: 303298 - RNA, 22 nt, Human
auuucauugaaguuaauucuuc

SEQ ID NO: 303299 - RNA, 22 nt, Human
uauucaaaguaccuucauugcc

SEQ ID NO: 303300 - RNA, 22 nt, Human
ccagggcaacgcugucucagag

SEQ ID NO: 303301 - RNA, 22 nt, Human
cagacagaccugcaagggcaca

SEQ ID NO: 303302 - RNA, 20 nt, Human
agaaccuaaguuaaaacaca

SEQ ID NO: 303303 - RNA, 22 nt, Human
ugcuuuaucugacuuggcgcug

SEQ ID NO: 303304 - RNA, 22 nt, Human
ggcuccaggcuccuauuucacu

SEQ ID NO: 303305 - RNA, 22 nt, Human
agaagcacaccugaccucuagc

SEQ ID NO: 303306 - RNA, 22 nt, Human
accaggcaguauggugcugcaa

SEQ ID NO: 303307 - RNA, 22 nt, Human
agaagcugcguuuauuuaaauc

SEQ ID NO: 303308 - RNA, 22 nt, Human
agacaggcagggcauggaaaaa

SEQ ID NO: 303309 - RNA, 22 nt, Human
uguaaauaaugcauguaaauca

SEQ ID NO: 303310 - RNA, 22 nt, Human
uggcagguggcucuggcauucu

SEQ ID NO: 303311 - RNA, 22 nt, Human
acuuaaaaagaaucuuuucacg

SEQ ID NO: 303312 - RNA, 22 nt, Human
auguauuugcuuguuauggauu

SEQ ID NO: 303313 - RNA, 22 nt, Human
agcuggagaauguggaugaucc

SEQ ID NO: 303314 - RNA, 22 nt, Human
agacagacagagaauuuaaaua

SEQ ID NO: 303315 - RNA, 22 nt, Human
aauugcuuaucuuguugaauag

SEQ ID NO: 303316 - RNA, 22 nt, Human
aauuuccaaauuucugucacac

SEQ ID NO: 303317 - RNA, 22 nt, Human
aguguuagugaaagguguuuau

SEQ ID NO: 303318 - RNA, 22 nt, Human
ugcagggccuugggaugugucc

SEQ ID NO: 303319 - RNA, 22 nt, Human
uacaacauguaaagugguuuaa

SEQ ID NO: 303320 - RNA, 22 nt, Human
cagaaagaccugauuggcaguu

SEQ ID NO: 303321 - RNA, 20 nt, Human
uuucuggguacucucccucu

SEQ ID NO: 303322 - RNA, 22 nt, Human
uccauucuuuuuaccucucaga

SEQ ID NO: 303323 - RNA, 22 nt, Human
uuauuuacaacucuucucuucc

SEQ ID NO: 303324 - RNA, 18 nt, Human
cuguucuagaacuccugu

SEQ ID NO: 303325 - RNA, 20 nt, Human
uuucugugcccaggucuguu

SEQ ID NO: 303326 - RNA, 22 nt, Human
ugucuuuagccagcagucuucu

SEQ ID NO: 303327 - RNA, 22 nt, Human
aaugcuaacauugguuuauauc

SEQ ID NO: 303328 - RNA, 17 nt, Human
uccaggcauaucuccua

SEQ ID NO: 303329 - RNA, 22 nt, Human
gaggauggaggcaguuagggcc

SEQ ID NO: 303330 - RNA, 22 nt, Human
uaaacaucugucauguguuuau

SEQ ID NO: 303331 - RNA, 18 nt, Human
cuaaacugcaccuaauga

SEQ ID NO: 303332 - RNA, 22 nt, Human
gaaaacuaacggaaaaguuagg

SEQ ID NO: 303333 - RNA, 22 nt, Human
auguccuuccugagaucccugu

SEQ ID NO: 303334 - RNA, 22 nt, Human
aggaccauccuaagguaggcaa

SEQ ID NO: 303335 - RNA, 22 nt, Human
gaucuucuagcagaaguaauuu

SEQ ID NO: 303336 - RNA, 22 nt, Human
cagggccagcgcccaggcccag

SEQ ID NO: 303337 - RNA, 22 nt, Human
acagguguagguacauuugcau

SEQ ID NO: 303338 - RNA, 15 nt, Human
ggcagguggaucacu

SEQ ID NO: 303339 - RNA, 22 nt, Human
ugcuuuauaggggauugcaggc

SEQ ID NO: 303340 - RNA, 20 nt, Human
cugcugcccugucagccucu

SEQ ID NO: 303341 - RNA, 22 nt, Human
uauuagggaacugcaagacuaa

SEQ ID NO: 303342 - RNA, 22 nt, Human
aaggcuuuuguuccuauuuagu

SEQ ID NO: 303343 - RNA, 22 nt, Human
cagagcauugagggucugccaa

SEQ ID NO: 303344 - RNA, 22 nt, Human
acucugaaugugcauguaaauc

SEQ ID NO: 303345 - RNA, 22 nt, Human
uuugacauggaauaacucauuu

SEQ ID NO: 303346 - RNA, 22 nt, Human
caugaaggaccauuucacgguc

SEQ ID NO: 303347 - RNA, 22 nt, Human
cuugauugcuucuacgugacug

SEQ ID NO: 303348 - RNA, 23 nt, Human
uugcugccugagccuuccucugg

SEQ ID NO: 303349 - RNA, 22 nt, Human
gggcugacgaaggccaugugug

SEQ ID NO: 303350 - RNA, 22 nt, Human
gucuggaaauuuaagguaugag

SEQ ID NO: 303351 - RNA, 22 nt, Human
gguggggcugcaagcaguucgg

SEQ ID NO: 303352 - RNA, 22 nt, Human
aguguccuacagcuccugccug

SEQ ID NO: 303353 - RNA, 22 nt, Human
cagguggucaggcagaugggcu

SEQ ID NO: 303354 - RNA, 21 nt, Human
agacaggucagggagagguga

SEQ ID NO: 303355 - RNA, 23 nt, Human
gcagacagagcagacuaagacaa

SEQ ID NO: 303356 - RNA, 22 nt, Human
cuccagugagugagcaggcgac

SEQ ID NO: 303357 - RNA, 22 nt, Human
cugcccgucccuuugcucucgc

SEQ ID NO: 303358 - RNA, 22 nt, Human
gaaaacacuuugaucugaaagu

SEQ ID NO: 303359 - RNA, 22 nt, Human
agagguuguuagaauaguggag

SEQ ID NO: 303360 - RNA, 22 nt, Human
cacagguguaugaauaugucca

SEQ ID NO: 303361 - RNA, 22 nt, Human
uuccaggaggcacugacagagg

SEQ ID NO: 303362 - RNA, 22 nt, Human
aaugaaugaaccacauauaaca

SEQ ID NO: 303363 - RNA, 22 nt, Human
agauggucuucauaaguuuuaa

SEQ ID NO: 303364 - RNA, 21 nt, Human
uccuugcuauuuuccucagcu

SEQ ID NO: 303365 - RNA, 22 nt, Human
auugguauguauucugaaaacu

SEQ ID NO: 303366 - RNA, 22 nt, Human
gggcugacaccacccaggcgca

SEQ ID NO: 303367 - RNA, 22 nt, Human
guauacaugugguaaaaugcac

SEQ ID NO: 303368 - RNA, 19 nt, Human
uccugcagaccagaccugu

SEQ ID NO: 303369 - RNA, 22 nt, Human
aaauucuaaggucacaauguug

SEQ ID NO: 303370 - RNA, 22 nt, Human
ugcaggugugggcaggggagca

SEQ ID NO: 303371 - RNA, 17 nt, Human
uguuuucugcuaccuuu

SEQ ID NO: 303372 - RNA, 22 nt, Human
cauaauaucuccgauuacuugc

SEQ ID NO: 303373 - RNA, 23 nt, Human
cuuucauugugguuucacagagc

SEQ ID NO: 303374 - RNA, 22 nt, Human
ugucugggucaccccuccuggc

SEQ ID NO: 303375 - RNA, 22 nt, Human
ugggugggagcgcccugucugg

SEQ ID NO: 303376 - RNA, 22 nt, Human
auagaaacagaggucaggcauu

SEQ ID NO: 303377 - RNA, 22 nt, Human
auuucuuucuggccacgguuuu

SEQ ID NO: 303378 - RNA, 22 nt, Human
aaaacuaaauacgcuuugccuc

SEQ ID NO: 303379 - RNA, 22 nt, Human
aucaagaaaagugcuuucggcu

SEQ ID NO: 303380 - RNA, 22 nt, Human
gugcagggcuggcaccggaggc

SEQ ID NO: 303381 - RNA, 22 nt, Human
ucagggcaggacaguguaggcc

SEQ ID NO: 303382 - RNA, 21 nt, Human
uaaauaauaaguugcugagau

SEQ ID NO: 303383 - RNA, 23 nt, Human
cauaaaauauuaguaugguagca

SEQ ID NO: 303384 - RNA, 22 nt, Human
cagugagggaagaucucagcac

SEQ ID NO: 303385 - RNA, 22 nt, Human
auuuccaucaucauuaggccua

SEQ ID NO: 303386 - RNA, 22 nt, Human
agucaguguucuggguuguaau

SEQ ID NO: 303387 - RNA, 22 nt, Human
cuguccagcuuggcuccugggg

SEQ ID NO: 303388 - RNA, 22 nt, Human
accaugaucugcucugguguuu

SEQ ID NO: 303389 - RNA, 22 nt, Human
uguuuauugagugccuacuaua

SEQ ID NO: 303390 - RNA, 22 nt, Human
uacagacaguuuuucagauauu

SEQ ID NO: 303391 - RNA, 22 nt, Human
uccaguuuacaggguugcuuuu

SEQ ID NO: 303392 - RNA, 22 nt, Human
uauugguauaggcauugaaacu

SEQ ID NO: 303393 - RNA, 22 nt, Human
ggacagacuuuacagccccggg

SEQ ID NO: 303394 - RNA, 22 nt, Human
caggaaaggugugucaugaugg

SEQ ID NO: 303395 - RNA, 22 nt, Human
cagcuuuauuucacguguuugu

SEQ ID NO: 303396 - RNA, 22 nt, Human
auuaaauuggaucugcauaguu

SEQ ID NO: 303397 - RNA, 22 nt, Human
ccagcaugagacgaugaugaag

SEQ ID NO: 303398 - RNA, 22 nt, Human
cgugagcaaaauggacacuccc

SEQ ID NO: 303399 - RNA, 22 nt, Human
agggaccuugauggguuuggga

SEQ ID NO: 303400 - RNA, 22 nt, Human
uuuuucagccaugaauuacacu

SEQ ID NO: 303401 - RNA, 22 nt, Human
uuugcugaauagauuguaaacu

SEQ ID NO: 303402 - RNA, 22 nt, Human
cucagugugaaugcucaguaaa

SEQ ID NO: 303403 - RNA, 22 nt, Human
auucaagagcccauguuuccug

SEQ ID NO: 303404 - RNA, 22 nt, Human
aauauaaugcuguuuuaugcca

SEQ ID NO: 303405 - RNA, 22 nt, Human
uucacaguggcugugccauuug

SEQ ID NO: 303406 - RNA, 21 nt, Human
ugggaccuagcuuugcacagg

SEQ ID NO: 303407 - RNA, 22 nt, Human
ccuguucaaguugcagggcugg

SEQ ID NO: 303408 - RNA, 22 nt, Human
ugcagggauuguuggcauccau

SEQ ID NO: 303409 - RNA, 22 nt, Human
gagcuuuagcugagaccugcuu

SEQ ID NO: 303410 - RNA, 22 nt, Human
caggugguacuuaaagucagaa

SEQ ID NO: 303411 - RNA, 22 nt, Human
uuccuucuuccaaacccaucau

SEQ ID NO: 303412 - RNA, 22 nt, Human
acuuccuuguacugacuccauu

SEQ ID NO: 303413 - RNA, 22 nt, Human
cauuguuaccaucuuuuaccua

SEQ ID NO: 303414 - RNA, 22 nt, Human
aauguuuuagauuacugcuggg

SEQ ID NO: 303415 - RNA, 22 nt, Human
cugggugagcuggccagagggu

SEQ ID NO: 303416 - RNA, 22 nt, Human
caugugucacagccuuuuauug

SEQ ID NO: 303417 - RNA, 22 nt, Human
guguguccucuuaacuauuaug

SEQ ID NO: 303418 - RNA, 22 nt, Human
cuuccagaggaacucugcagug

SEQ ID NO: 303419 - RNA, 22 nt, Human
augugguugaagaauuacaucu

SEQ ID NO: 303420 - RNA, 22 nt, Human
ucuaauccuugcuaccugggug

SEQ ID NO: 303421 - RNA, 22 nt, Human
agacauguccacaaagcauuca

SEQ ID NO: 303422 - RNA, 22 nt, Human
gaaauuuauuaucuacaucauu

SEQ ID NO: 303423 - RNA, 22 nt, Human
ucuggagggguuuagagggaca

SEQ ID NO: 303424 - RNA, 22 nt, Human
uuauacauguguuuugagauga

SEQ ID NO: 303425 - RNA, 22 nt, Human
aauugcuuuuauuuagggccag

SEQ ID NO: 303426 - RNA, 22 nt, Human
uguguccuuccaguuuuuccug

SEQ ID NO: 303427 - RNA, 18 nt, Human
acuguuaucugauaaggc

SEQ ID NO: 303428 - RNA, 22 nt, Human
agaggugggagccuggucacau

SEQ ID NO: 303429 - RNA, 22 nt, Human
ugggguggauagaaagugaugu

SEQ ID NO: 303430 - RNA, 22 nt, Human
ggacauguuccuuuucaucuuu

SEQ ID NO: 303431 - RNA, 22 nt, Human
ggcagggcuugucucugugaug

SEQ ID NO: 303432 - RNA, 22 nt, Human
uuccaggaccaggaagagggga

SEQ ID NO: 303433 - RNA, 22 nt, Human
uagaaaugaauguuuaaaaguc

SEQ ID NO: 303434 - RNA, 22 nt, Human
uaauuacagguccaaaacaauc

SEQ ID NO: 303435 - RNA, 22 nt, Human
uugcuuuauauucaagagagga

SEQ ID NO: 303436 - RNA, 22 nt, Human
aagauucagccaaauuguucau

SEQ ID NO: 303437 - RNA, 22 nt, Human
agcaggugaauuccuggaugug

SEQ ID NO: 303438 - RNA, 22 nt, Human
auuuucagagacaucuggacuu

SEQ ID NO: 303439 - RNA, 22 nt, Human
uuuaacacuaguuucuuuaacu

SEQ ID NO: 303440 - RNA, 22 nt, Human
ucucucuuuuuaaucauguaau

SEQ ID NO: 303441 - RNA, 22 nt, Human
uuccaugaaagugaaauggagc

SEQ ID NO: 303442 - RNA, 22 nt, Human
uuauuugugaaucauuuaucua

SEQ ID NO: 303443 - RNA, 22 nt, Human
caggagcaaggagcagugggau

SEQ ID NO: 303444 - RNA, 22 nt, Human
auaacauuuugacaacugguga

SEQ ID NO: 303445 - RNA, 21 nt, Human
gcaggugugguaucagcuucc

SEQ ID NO: 303446 - RNA, 22 nt, Human
agcaggugagcacagccaggcu

SEQ ID NO: 303447 - RNA, 22 nt, Human
uggcucugugucucccagcagc

SEQ ID NO: 303448 - RNA, 22 nt, Human
uugcuuuaagguaucuggagaa

SEQ ID NO: 303449 - RNA, 22 nt, Human
aagagcaucaaugacucgcagu

SEQ ID NO: 303450 - RNA, 22 nt, Human
uaguuaggguucugcagagaca

SEQ ID NO: 303451 - RNA, 22 nt, Human
aagggcucuucuauuuauggcc

SEQ ID NO: 303452 - RNA, 22 nt, Human
aacuugguaaauugugucagau

SEQ ID NO: 303453 - RNA, 22 nt, Human
ccacagcugaccgcaggugagc

SEQ ID NO: 303454 - RNA, 22 nt, Human
gccugcagccucagagaauuuu

SEQ ID NO: 303455 - RNA, 22 nt, Human
aggcagguguuaccucugguuu

SEQ ID NO: 303456 - RNA, 22 nt, Human
ucugggugcccuuugcucuguu

SEQ ID NO: 303457 - RNA, 22 nt, Human
auguucuuggauguuguguaua

SEQ ID NO: 303458 - RNA, 20 nt, Human
cagggcucugggccuggccu

SEQ ID NO: 303459 - RNA, 22 nt, Human
ggcuccacugcugaccacucca

SEQ ID NO: 303460 - RNA, 22 nt, Human
ccuggacucaggcugugggcac

SEQ ID NO: 303461 - RNA, 22 nt, Human
ccaggcagagggaauagcaagu

SEQ ID NO: 303462 - RNA, 22 nt, Human
ggagagguguauucaguggguc

SEQ ID NO: 303463 - RNA, 22 nt, Human
aaaauucugucauuaaauugug

SEQ ID NO: 303464 - RNA, 22 nt, Human
aagggcucacccaacucacuuc

SEQ ID NO: 303465 - RNA, 22 nt, Human
cacagcauuaacugggacagcu

SEQ ID NO: 303466 - RNA, 22 nt, Human
acagcuuuaucucagggaucag

SEQ ID NO: 303467 - RNA, 22 nt, Human
uacagacaaagugcuauagggu

SEQ ID NO: 303468 - RNA, 22 nt, Human
ugggccagcacugggugcucau

SEQ ID NO: 303469 - RNA, 22 nt, Human
gaaagcacaguucugaccaugu

SEQ ID NO: 303470 - RNA, 22 nt, Human
aaggcauauauucuaaacagga

SEQ ID NO: 303471 - RNA, 22 nt, Human
acaggcacugucaagucaugaa

SEQ ID NO: 303472 - RNA, 23 nt, Human
ucuuuccuaaugaaacagugaaa

SEQ ID NO: 303473 - RNA, 22 nt, Human
gacagacaggaggcauucaggg

SEQ ID NO: 303474 - RNA, 22 nt, Human
ccaggcaggcuagaauguaaau

SEQ ID NO: 303475 - RNA, 22 nt, Human
acagauuuaggacuguagcgau

SEQ ID NO: 303476 - RNA, 22 nt, Human
aaagugguugcugucagccucu

SEQ ID NO: 303477 - RNA, 22 nt, Human
uuuuuagaauuggcugagaauu

SEQ ID NO: 303478 - RNA, 22 nt, Human
aaaggcuggggacugaggaagg

SEQ ID NO: 303479 - RNA, 22 nt, Human
guggaggagaggcgccuugcgg

SEQ ID NO: 303480 - RNA, 22 nt, Human
aagauguaaaggcaauauaaag

SEQ ID NO: 303481 - RNA, 22 nt, Human
gugcaaaaguaaaugugguuuu

SEQ ID NO: 303482 - RNA, 22 nt, Human
cagguguauaaacucagugacu

SEQ ID NO: 303483 - RNA, 22 nt, Human
cugggucuaaaaauucucagau

SEQ ID NO: 303484 - RNA, 22 nt, Human
ugcaggugcuccgggggugccc

SEQ ID NO: 303485 - RNA, 22 nt, Human
uucagcaaauggacuguucagg

SEQ ID NO: 303486 - RNA, 22 nt, Human
aauauguuccacuuaaagcugg

SEQ ID NO: 303487 - RNA, 22 nt, Human
uuagcucagaaaauuuaaacuu

SEQ ID NO: 303488 - RNA, 21 nt, Human
agaagggauugugguaaagau

SEQ ID NO: 303489 - RNA, 22 nt, Human
uacauguacaugcauagguaga

SEQ ID NO: 303490 - RNA, 18 nt, Human
aggcaggugcuaauauuu

SEQ ID NO: 303491 - RNA, 22 nt, Human
uauuauuaaauggcagaauuuu

SEQ ID NO: 303492 - RNA, 22 nt, Human
cacccagccuucacacaggagu

SEQ ID NO: 303493 - RNA, 22 nt, Human
agcaggugcguuacuucacucu

SEQ ID NO: 303494 - RNA, 22 nt, Human
ucuggaugaagacccagaggcu

SEQ ID NO: 303495 - RNA, 22 nt, Human
gcaccugccugggacugaagau

SEQ ID NO: 303496 - RNA, 22 nt, Human
ccagguguuuggccugcaugau

SEQ ID NO: 303497 - RNA, 22 nt, Human
ucaaauaccagcaauuucaugu

SEQ ID NO: 303498 - RNA, 22 nt, Human
auagauauuugaguuguuucca

SEQ ID NO: 303499 - RNA, 22 nt, Human
uugguggagucauuggcauaug

SEQ ID NO: 303500 - RNA, 22 nt, Human
aaggcauaugcuguguacaguu

SEQ ID NO: 303501 - RNA, 22 nt, Human
ugcauaaacuucucugguguga

SEQ ID NO: 303502 - RNA, 22 nt, Human
gaugugucuccguuucaaggca

SEQ ID NO: 303503 - RNA, 22 nt, Human
agggcuccuaugccccauggac

SEQ ID NO: 303504 - RNA, 22 nt, Human
uuaguuauacuacugaauggag

SEQ ID NO: 303505 - RNA, 22 nt, Human
agcuucuuggcucagcacuugg

SEQ ID NO: 303506 - RNA, 22 nt, Human
auguccaggaucuauccccaga

SEQ ID NO: 303507 - RNA, 22 nt, Human
caggcauaaguaauguuuuaug

SEQ ID NO: 303508 - RNA, 22 nt, Human
cuuucccuuagccccauucuau

SEQ ID NO: 303509 - RNA, 22 nt, Human
gcaugugucaucugccuuucgu

SEQ ID NO: 303510 - RNA, 23 nt, Human
cccugcagucagggugagauggu

SEQ ID NO: 303511 - RNA, 21 nt, Human
cuguggaagggaacuagaggg

SEQ ID NO: 303512 - RNA, 22 nt, Human
uuacauguacugguuugacuua

SEQ ID NO: 303513 - RNA, 22 nt, Human
cuccaguggcaaguccgggcgg

SEQ ID NO: 303514 - RNA, 22 nt, Human
cugugucccaguaccuugggua

SEQ ID NO: 303515 - RNA, 22 nt, Human
ggaccugaacauaaaacgaggc

SEQ ID NO: 303516 - RNA, 22 nt, Human
auaugaaaauguuuuagcugua

SEQ ID NO: 303517 - RNA, 20 nt, Human
cguguccuuggcgggagagc

SEQ ID NO: 303518 - RNA, 22 nt, Human
cauaauauacuacauugaugaa

SEQ ID NO: 303519 - RNA, 22 nt, Human
auaguuuuauagauauugugua

SEQ ID NO: 303520 - RNA, 22 nt, Human
aggcaauccccugaggauacuu

SEQ ID NO: 303521 - RNA, 22 nt, Human
gccagccuucuguggccugcaa

SEQ ID NO: 303522 - RNA, 22 nt, Human
gcaggugucugacugccuucuu

SEQ ID NO: 303523 - RNA, 22 nt, Human
aggugggguguuggauguuuau

SEQ ID NO: 303524 - RNA, 22 nt, Human
augcuucagugcuaccuucaaa

SEQ ID NO: 303525 - RNA, 22 nt, Human
ggcaggcaggagcgugcuuggg

SEQ ID NO: 303526 - RNA, 22 nt, Human
agcagggcagcugaugcgcacg

SEQ ID NO: 303527 - RNA, 22 nt, Human
ggggcuccagucuucacauuuu

SEQ ID NO: 303528 - RNA, 22 nt, Human
cugggucccaauagcuuuuguu

SEQ ID NO: 303529 - RNA, 22 nt, Human
uccugguaggcuaugucauguc

SEQ ID NO: 303530 - RNA, 22 nt, Human
aaugucaauaacuuuaucccuc

SEQ ID NO: 303531 - RNA, 22 nt, Human
cauauuuauagaucuggcauuu

SEQ ID NO: 303532 - RNA, 22 nt, Human
aaaucagugcucauuugaaagg

SEQ ID NO: 303533 - RNA, 22 nt, Human
aaaugucagaggaacauauuga

SEQ ID NO: 303534 - RNA, 22 nt, Human
cucuucuugaaagaggaauuca

SEQ ID NO: 303535 - RNA, 22 nt, Human
uuccaagagcuuuaauuguuga

SEQ ID NO: 303536 - RNA, 22 nt, Human
ugggcuccguugccuggggcag

SEQ ID NO: 303537 - RNA, 22 nt, Human
uuucuaggucuuccauacugcc

SEQ ID NO: 303538 - RNA, 22 nt, Human
aaauucuaugucaauguuuauu

SEQ ID NO: 303539 - RNA, 22 nt, Human
cauuugaaauucuuagaacaaa

SEQ ID NO: 303540 - RNA, 22 nt, Human
uuacaguaauguauuauuuaac

SEQ ID NO: 303541 - RNA, 22 nt, Human
uagaaaugugauaauagcuuaa

SEQ ID NO: 303542 - RNA, 22 nt, Human
uuauagaaggagcauucacuua

SEQ ID NO: 303543 - RNA, 22 nt, Human
uuuauucaucaucuguucauau

SEQ ID NO: 303544 - RNA, 22 nt, Human
uccuucaagaugccacagcuuu

SEQ ID NO: 303545 - RNA, 22 nt, Human
ucagugauuucuggggugaggg

SEQ ID NO: 303546 - RNA, 22 nt, Human
ugguaucguguuggcacucagu

SEQ ID NO: 303547 - RNA, 22 nt, Human
ugcuuaaacauacuauuuauau

SEQ ID NO: 303548 - RNA, 22 nt, Human
cuggauguuuaugaaggaccca

SEQ ID NO: 303549 - RNA, 22 nt, Human
cuucuucaguugcauguauugg

SEQ ID NO: 303550 - RNA, 22 nt, Human
cucuuccuuaagacuauaaaga

SEQ ID NO: 303551 - RNA, 22 nt, Human
gacccuguuucuacaaauaauu

SEQ ID NO: 303552 - RNA, 22 nt, Human
uugcuuuauucacaucuauauu

SEQ ID NO: 303553 - RNA, 22 nt, Human
cacaaaugugcagaaaugugag

SEQ ID NO: 303554 - RNA, 22 nt, Human
ggugggaggacuguuugaggca

SEQ ID NO: 303555 - RNA, 22 nt, Human
agcaugaaaggcgugccaacuu

SEQ ID NO: 303556 - RNA, 22 nt, Human
gagugaggcuggaaucauggcu

SEQ ID NO: 303557 - RNA, 22 nt, Human
ugcaugaacggaggguaagcug

SEQ ID NO: 303558 - RNA, 22 nt, Human
agcuuuaugggagcuuagauaa

SEQ ID NO: 303559 - RNA, 22 nt, Human
agcucccagcagagcuggccac

SEQ ID NO: 303560 - RNA, 22 nt, Human
uuuuauuggagugauaccaagc

SEQ ID NO: 303561 - RNA, 22 nt, Human
cuggaggagcaauaugguuagg

SEQ ID NO: 303562 - RNA, 22 nt, Human
aagugguugcuugugagucccc

SEQ ID NO: 303563 - RNA, 22 nt, Human
guuuccaaccccaccaaagugc

SEQ ID NO: 303564 - RNA, 22 nt, Human
agugugagccuacaggccaaag

SEQ ID NO: 303565 - RNA, 22 nt, Human
aggcagguuggugagaagacug

SEQ ID NO: 303566 - RNA, 22 nt, Human
cuuuccaagaaugcagauaccu

SEQ ID NO: 303567 - RNA, 18 nt, Human
uggcucugccacucaccg

SEQ ID NO: 303568 - RNA, 23 nt, Human
uugcacauuggagcuggucuucu

SEQ ID NO: 303569 - RNA, 22 nt, Human
acagacagggcaccugccuccu

SEQ ID NO: 303570 - RNA, 22 nt, Human
uguucaaaugaucuucuuaaau

SEQ ID NO: 303571 - RNA, 22 nt, Human
caggaaagccgagugccauagg

SEQ ID NO: 303572 - RNA, 22 nt, Human
aacaguaacgagauguccuaac

SEQ ID NO: 303573 - RNA, 22 nt, Human
acuaaagaagccaaaguuuucu

SEQ ID NO: 303574 - RNA, 22 nt, Human
ggcugaggcucaugccaucuug

SEQ ID NO: 303575 - RNA, 22 nt, Human
aaaaaucuaugacugcuucucc

SEQ ID NO: 303576 - RNA, 16 nt, Human
aauugcuucuugcugc

SEQ ID NO: 303577 - RNA, 22 nt, Human
ccaggcagggcucaaggaaccu

SEQ ID NO: 303578 - RNA, 22 nt, Human
ggcaggcaaggcagccugguga

SEQ ID NO: 303579 - RNA, 22 nt, Human
cugggugugggucaagcaacca

SEQ ID NO: 303580 - RNA, 22 nt, Human
uccucagcauggaaucuggacu

SEQ ID NO: 303581 - RNA, 19 nt, Human
gcaggcaguggcauucgga

SEQ ID NO: 303582 - RNA, 22 nt, Human
gggaccugccaaggccacccag

SEQ ID NO: 303583 - RNA, 22 nt, Human
uauuuagaaugcguguacgugu

SEQ ID NO: 303584 - RNA, 22 nt, Human
uagguauacagagauuucuggg

SEQ ID NO: 303585 - RNA, 22 nt, Human
uggaauguuuuccuaaaucaga

SEQ ID NO: 303586 - RNA, 22 nt, Human
uucuucuuuccuauaauuaauu

SEQ ID NO: 303587 - RNA, 22 nt, Human
caccugcagggggagucaagag

SEQ ID NO: 303588 - RNA, 22 nt, Human
uuccuucuaauauucugccugu

SEQ ID NO: 303589 - RNA, 22 nt, Human
aaacucuguagcuaaacauaau

SEQ ID NO: 303590 - RNA, 22 nt, Human
ucuguucauacagaguauagua

SEQ ID NO: 303591 - RNA, 22 nt, Human
agcuuuauauguuguuucucca

SEQ ID NO: 303592 - RNA, 22 nt, Human
ucaauguaauaaaauacucuau

SEQ ID NO: 303593 - RNA, 22 nt, Human
agggaagaggaccagagucucu

SEQ ID NO: 303594 - RNA, 22 nt, Human
auaguuugaaggcuguucuacu

SEQ ID NO: 303595 - RNA, 22 nt, Human
uccugcagucugcacucugccu

SEQ ID NO: 303596 - RNA, 22 nt, Human
gcagcuuuuuggaugucaguua

SEQ ID NO: 303597 - RNA, 22 nt, Human
uccaugcaaacaguggcuagcu

SEQ ID NO: 303598 - RNA, 22 nt, Human
ugggaccagauaaagggagguc

SEQ ID NO: 303599 - RNA, 22 nt, Human
uuuauugaauuguaacccuauu

SEQ ID NO: 303600 - RNA, 17 nt, Human
uguagcuucuccuucuc

SEQ ID NO: 303601 - RNA, 22 nt, Human
cuguucacacacuuguacucuc

SEQ ID NO: 303602 - RNA, 22 nt, Human
uuucauugaugggugauagaaa

SEQ ID NO: 303603 - RNA, 22 nt, Human
gacuuuauuuccuuauuuguga

SEQ ID NO: 303604 - RNA, 21 nt, Human
cccugcaggccagggcugagc

SEQ ID NO: 303605 - RNA, 22 nt, Human
ugcaaaaagagcgaggagcccu

SEQ ID NO: 303606 - RNA, 22 nt, Human
caguguuugcuuaaguuauaug

SEQ ID NO: 303607 - RNA, 22 nt, Human
auuuauugagccuuuccuaugu

SEQ ID NO: 303608 - RNA, 19 nt, Human
aaaaacuuaguccagaaag

SEQ ID NO: 303609 - RNA, 22 nt, Human
ugcagggcuuccucuuggaguu

SEQ ID NO: 303610 - RNA, 22 nt, Human
auuuccagcagcauauuugucu

SEQ ID NO: 303611 - RNA, 22 nt, Human
ggcaggugagagcucuuugaaa

SEQ ID NO: 303612 - RNA, 22 nt, Human
auauuaggaguuaaauguauua

SEQ ID NO: 303613 - RNA, 18 nt, Human
aaugugaauauuuacuuc

SEQ ID NO: 303614 - RNA, 22 nt, Human
cucuucuugccugaugaggcag

SEQ ID NO: 303615 - RNA, 22 nt, Human
uuguguccauuugagucaugug

SEQ ID NO: 303616 - RNA, 22 nt, Human
ucaguucuuuauuucacaguga

SEQ ID NO: 303617 - RNA, 22 nt, Human
ggagcugaugacgucaccaugg

SEQ ID NO: 303618 - RNA, 22 nt, Human
uugcucauauuugcauguguuu

SEQ ID NO: 303619 - RNA, 22 nt, Human
uaggugucuuguguaugguaca

SEQ ID NO: 303620 - RNA, 22 nt, Human
agcaggagcugugggaagaugg

SEQ ID NO: 303621 - RNA, 19 nt, Human
gaggugucuuuccugagua

SEQ ID NO: 303622 - RNA, 22 nt, Human
ccagagaggccaaggucguggu

SEQ ID NO: 303623 - RNA, 22 nt, Human
ucucugaagauauuuauuauua

SEQ ID NO: 303624 - RNA, 22 nt, Human
uugugucccccuuugagagcca

SEQ ID NO: 303625 - RNA, 22 nt, Human
cacagcauucacagaaagacau

SEQ ID NO: 303626 - RNA, 22 nt, Human
uugacaauguccuuugaauuuc

SEQ ID NO: 303627 - RNA, 22 nt, Human
ucucaguguguuuucucucaga

SEQ ID NO: 303628 - RNA, 22 nt, Human
cugcaaaaguaauugcagguuu

SEQ ID NO: 303629 - RNA, 22 nt, Human
gccaggcaguucaaguacacca

SEQ ID NO: 303630 - RNA, 22 nt, Human
acuucauuguaauauuauagca

SEQ ID NO: 303631 - RNA, 22 nt, Human
auuuaaaugcuuaagaggguuu

SEQ ID NO: 303632 - RNA, 22 nt, Human
augcuuuuaugucacaugguca

SEQ ID NO: 303633 - RNA, 22 nt, Human
uggaauuuaguuaauuccauuu

SEQ ID NO: 303634 - RNA, 22 nt, Human
agcagggcccacuaggggagau

SEQ ID NO: 303635 - RNA, 22 nt, Human
aguucaguaguccuucauugua

SEQ ID NO: 303636 - RNA, 22 nt, Human
agugugagugcucauguccauc

SEQ ID NO: 303637 - RNA, 23 nt, Human
agaccugcaucugauaggcccug

SEQ ID NO: 303638 - RNA, 20 nt, Human
aggguggcaaguuagugaca

SEQ ID NO: 303639 - RNA, 22 nt, Human
aucugaagaggucauggcugac

SEQ ID NO: 303640 - RNA, 22 nt, Human
gcugccacuuggucaugucaug

SEQ ID NO: 303641 - RNA, 22 nt, Human
cacuuauuaugggcuaggaacu

SEQ ID NO: 303642 - RNA, 21 nt, Human
acagcagggcuggcaugacag

SEQ ID NO: 303643 - RNA, 22 nt, Human
ucugggugugguaucuuagcca

SEQ ID NO: 303644 - RNA, 22 nt, Human
uuauugagaccguaagucaggu

SEQ ID NO: 303645 - RNA, 22 nt, Human
acaugugucuaagaaugaaaga

SEQ ID NO: 303646 - RNA, 22 nt, Human
guucuucaggcugugcucuaga

SEQ ID NO: 303647 - RNA, 22 nt, Human
uuggaggaaagaagguugauau

SEQ ID NO: 303648 - RNA, 22 nt, Human
gcuggcuugauaguuucugcuu

SEQ ID NO: 303649 - RNA, 22 nt, Human
auuucuguaacuuaugaaaguu

SEQ ID NO: 303650 - RNA, 22 nt, Human
ggcuuuugaauuccaaggcauu

SEQ ID NO: 303651 - RNA, 22 nt, Human
cauucauuuaugaaauaucuau

SEQ ID NO: 303652 - RNA, 19 nt, Human
ggacagacgcagagaucug

SEQ ID NO: 303653 - RNA, 22 nt, Human
gcaugcagacagucugagacca

SEQ ID NO: 303654 - RNA, 19 nt, Human
uucacaauuaugaaauuag

SEQ ID NO: 303655 - RNA, 22 nt, Human
auggaguucuuuaaauucacag

SEQ ID NO: 303656 - RNA, 22 nt, Human
gaggagggagcuggaagcucuu

SEQ ID NO: 303657 - RNA, 21 nt, Human
uagggcucucugugucaggug

SEQ ID NO: 303658 - RNA, 22 nt, Human
aguuguaagagacagauauaaa

SEQ ID NO: 303659 - RNA, 22 nt, Human
gucugcccucacaugcacucuu

SEQ ID NO: 303660 - RNA, 22 nt, Human
acagcuuuucugauagauccug

SEQ ID NO: 303661 - RNA, 19 nt, Human
uggcagggagaguuugaag

SEQ ID NO: 303662 - RNA, 21 nt, Human
ucagguggcagaguguuuaug

SEQ ID NO: 303663 - RNA, 22 nt, Human
uuauugaguuguaagagcucuu

SEQ ID NO: 303664 - RNA, 22 nt, Human
ucauguacauguaagucagaaa

SEQ ID NO: 303665 - RNA, 22 nt, Human
gggaggaaagagaaguggucca

SEQ ID NO: 303666 - RNA, 22 nt, Human
uccucuggggcgugguccugga

SEQ ID NO: 303667 - RNA, 22 nt, Human
gggaacagagugccagacugac

SEQ ID NO: 303668 - RNA, 22 nt, Human
ccauggcaauggucagucuauu

SEQ ID NO: 303669 - RNA, 22 nt, Human
ugcugggucaggcaucugcaga

SEQ ID NO: 303670 - RNA, 22 nt, Human
cugcugccggcgagccucccuu

SEQ ID NO: 303671 - RNA, 22 nt, Human
uuccaggacuggguguuugaag

SEQ ID NO: 303672 - RNA, 22 nt, Human
agagucagcuuaugacacaguc

SEQ ID NO: 303673 - RNA, 22 nt, Human
uggcaaagcuagacauucccuc

SEQ ID NO: 303674 - RNA, 17 nt, Human
cugaagaguccuggcua

SEQ ID NO: 303675 - RNA, 22 nt, Human
ugggcaggcaagugaauaccuu

SEQ ID NO: 303676 - RNA, 22 nt, Human
cuguugcucugaacaggucuug

SEQ ID NO: 303677 - RNA, 22 nt, Human
acauguguggccgcuguagaca

SEQ ID NO: 303678 - RNA, 22 nt, Human
ccuggaucagucacuguugcug

SEQ ID NO: 303679 - RNA, 22 nt, Human
aggcucagccugggccuagagc

SEQ ID NO: 303680 - RNA, 22 nt, Human
uugguggaccucaucagaaccg

SEQ ID NO: 303681 - RNA, 22 nt, Human
aaagcugcccuugugaaacaag

SEQ ID NO: 303682 - RNA, 19 nt, Human
ugcugggucauauggaaac

SEQ ID NO: 303683 - RNA, 22 nt, Human
uacuuuauauuguggcuggcca

SEQ ID NO: 303684 - RNA, 22 nt, Human
gacaggugcuaagggaccuggc

SEQ ID NO: 303685 - RNA, 22 nt, Human
ccagggcaauuauuuggagggu

SEQ ID NO: 303686 - RNA, 22 nt, Human
ugcuuuauaacuuaguuuaugg

SEQ ID NO: 303687 - RNA, 18 nt, Human
agcaggugugcagaaugu

SEQ ID NO: 303688 - RNA, 22 nt, Human
guguccugggcauuaggcuuag

SEQ ID NO: 303689 - RNA, 22 nt, Human
aaguauuucguucugaaaaagu

SEQ ID NO: 303690 - RNA, 22 nt, Human
gcagguggggcugcuaccagaa

SEQ ID NO: 303691 - RNA, 22 nt, Human
cacaggugucucuaguagcguu

SEQ ID NO: 303692 - RNA, 22 nt, Human
gcucagcacuuucuccaaccac

SEQ ID NO: 303693 - RNA, 22 nt, Human
uccaggcagagcaacaaaauau

SEQ ID NO: 303694 - RNA, 22 nt, Human
acaugauauuaaugucuuauuu

SEQ ID NO: 303695 - RNA, 22 nt, Human
aggcagugagaaauagcaagau

SEQ ID NO: 303696 - RNA, 17 nt, Human
aaaauucuguaaagagg

SEQ ID NO: 303697 - RNA, 22 nt, Human
cacagguguucuugcagugaaa

SEQ ID NO: 303698 - RNA, 22 nt, Human
cuggguggagccuggucaucug

SEQ ID NO: 303699 - RNA, 22 nt, Human
caggaugggauguagugggccc

SEQ ID NO: 303700 - RNA, 22 nt, Human
ggcaggcauuagagauucccag

SEQ ID NO: 303701 - RNA, 22 nt, Human
gccugggugaauuugauccuaa

SEQ ID NO: 303702 - RNA, 22 nt, Human
agcucccaauugacuugaacua

SEQ ID NO: 303703 - RNA, 22 nt, Human
aaucauucuuauuucacagcaa

SEQ ID NO: 303704 - RNA, 22 nt, Human
ucaagaaacugugcuacagagu

SEQ ID NO: 303705 - RNA, 22 nt, Human
ggcagaggaagcuggaaguggg

SEQ ID NO: 303706 - RNA, 22 nt, Human
aggcaggugggucacuugaguc

SEQ ID NO: 303707 - RNA, 22 nt, Human
agcuuuaccugccuuggggcac

SEQ ID NO: 303708 - RNA, 22 nt, Human
aaguaguuaguccgccugcucu

SEQ ID NO: 303709 - RNA, 22 nt, Human
auuugaagaaaguuuucuagau

SEQ ID NO: 303710 - RNA, 22 nt, Human
guccuucucaaauccuguguuu

SEQ ID NO: 303711 - RNA, 22 nt, Human
uaggugguuauaaauucaaggc

SEQ ID NO: 303712 - RNA, 22 nt, Human
gcacccagagggcagggucucc

SEQ ID NO: 303713 - RNA, 22 nt, Human
uccaggcaaagccuuguagacg

SEQ ID NO: 303714 - RNA, 22 nt, Human
ccuggagggcagcccauucugg

SEQ ID NO: 303715 - RNA, 22 nt, Human
uugcagggaaauagaaauaaac

SEQ ID NO: 303716 - RNA, 22 nt, Human
uaauuauucuagucacauagca

SEQ ID NO: 303717 - RNA, 22 nt, Human
ugcaugcaugugagcaugcaua

SEQ ID NO: 303718 - RNA, 22 nt, Human
ccagcuuuccugcgaguugauu

SEQ ID NO: 303719 - RNA, 22 nt, Human
auuuccaugccuuagcuuaagg

SEQ ID NO: 303720 - RNA, 22 nt, Human
uagcuuuacaaagugcugcacc

SEQ ID NO: 303721 - RNA, 22 nt, Human
gugugucccuccucuccugagu

SEQ ID NO: 303722 - RNA, 22 nt, Human
uggcaaaguaauuggguuucuc

SEQ ID NO: 303723 - RNA, 22 nt, Human
uuccuucuagcccaaguauugg

SEQ ID NO: 303724 - RNA, 22 nt, Human
aaaagucuacaagcuucaacaa

SEQ ID NO: 303725 - RNA, 22 nt, Human
ugaggaauguuuugagugccga

SEQ ID NO: 303726 - RNA, 22 nt, Human
uuaguuagucccugguaccuuu

SEQ ID NO: 303727 - RNA, 22 nt, Human
caaaagucuuccuauucucuua

SEQ ID NO: 303728 - RNA, 22 nt, Human
gacuuuauucguuaacuguuaa

SEQ ID NO: 303729 - RNA, 22 nt, Human
uaagaauuaucucauggauaau

SEQ ID NO: 303730 - RNA, 22 nt, Human
cacuuuauaugcauuaccucau

SEQ ID NO: 303731 - RNA, 22 nt, Human
uggcaaagacgcuagcuaagau

SEQ ID NO: 303732 - RNA, 22 nt, Human
cacacacaguuuuguauucugu

SEQ ID NO: 303733 - RNA, 22 nt, Human
ucuggaggcucugagggugagu

SEQ ID NO: 303734 - RNA, 22 nt, Human
caagaugugccuaaucagaccu

SEQ ID NO: 303735 - RNA, 22 nt, Human
aagugauuucugccugcauguu

SEQ ID NO: 303736 - RNA, 22 nt, Human
auucuuauuauaguaaaacagu

SEQ ID NO: 303737 - RNA, 19 nt, Human
ucuucccuggcugucaguc

SEQ ID NO: 303738 - RNA, 22 nt, Human
ucacauuuuuuacuggacuuaa

SEQ ID NO: 303739 - RNA, 22 nt, Human
aauugcuuagagaauccaggua

SEQ ID NO: 303740 - RNA, 22 nt, Human
uuucaaaauuuugcagugguaa

SEQ ID NO: 303741 - RNA, 22 nt, Human
ggcaggugaggcaugugccugg

SEQ ID NO: 303742 - RNA, 22 nt, Human
gcagggacaucuucagaucacu

SEQ ID NO: 303743 - RNA, 22 nt, Human
aauuagggagccaucauaaggu

SEQ ID NO: 303744 - RNA, 22 nt, Human
uaugauguguaccuaagucacc

SEQ ID NO: 303745 - RNA, 22 nt, Human
agguauauauucugguccuuau

SEQ ID NO: 303746 - RNA, 21 nt, Human
acagcuggugcagggcgggga

SEQ ID NO: 303747 - RNA, 22 nt, Human
caggauggucuucauuuggcuc

SEQ ID NO: 303748 - RNA, 22 nt, Human
uggcaaaggggaccauguugaa

SEQ ID NO: 303749 - RNA, 22 nt, Human
aggaggaaagaaggcccccagc

SEQ ID NO: 303750 - RNA, 22 nt, Human
auaaguaggaaaauuugaauau

SEQ ID NO: 303751 - RNA, 22 nt, Human
cccuuccuccucgccugucaga

SEQ ID NO: 303752 - RNA, 22 nt, Human
cuggggugucucgucugccauu

SEQ ID NO: 303753 - RNA, 22 nt, Human
aucuuguuaaaaugcagaaacu

SEQ ID NO: 303754 - RNA, 22 nt, Human
ccagggcagaaaaagagggaau

SEQ ID NO: 303755 - RNA, 22 nt, Human
agaugguccaucuauuuucuau

SEQ ID NO: 303756 - RNA, 22 nt, Human
caugucacuuuaacaaauuagu

SEQ ID NO: 303757 - RNA, 22 nt, Human
gcugcagugagccaagaucgug

SEQ ID NO: 303758 - RNA, 22 nt, Human
cuuauuagaaagaaaagacaug

SEQ ID NO: 303759 - RNA, 22 nt, Human
cuggguaaguuccuaaggcuca

SEQ ID NO: 303760 - RNA, 22 nt, Human
uucuauugggaagugugagagu

SEQ ID NO: 303761 - RNA, 22 nt, Human
acagcaugagagaugaacauuc

SEQ ID NO: 303762 - RNA, 22 nt, Human
acagacuggaggagaauaguuu

SEQ ID NO: 303763 - RNA, 22 nt, Human
cucuggaaauggccauagucau

SEQ ID NO: 303764 - RNA, 22 nt, Human
cagggcucuuccggagcaggga

SEQ ID NO: 303765 - RNA, 22 nt, Human
accuuauuaaaaugaugaugua

SEQ ID NO: 303766 - RNA, 22 nt, Human
uuguguccugauuugacacaau

SEQ ID NO: 303767 - RNA, 22 nt, Human
acagauuuguucuuuugggcua

SEQ ID NO: 303768 - RNA, 22 nt, Human
auugcuuuuccuuaacacaugc

SEQ ID NO: 303769 - RNA, 22 nt, Human
gugcaaagugcauggggaaggg

SEQ ID NO: 303770 - RNA, 22 nt, Human
uuucauaaacaguagaagacua

SEQ ID NO: 303771 - RNA, 22 nt, Human
aggccuuaccauagcuguagca

SEQ ID NO: 303772 - RNA, 22 nt, Human
auuuguaauuucuuaucugugu

SEQ ID NO: 303773 - RNA, 22 nt, Human
uuuaugaacuacagauauaacu

SEQ ID NO: 303774 - RNA, 18 nt, Human
aaaggcugaauauagaag

SEQ ID NO: 303775 - RNA, 22 nt, Human
aagagcauauuaauaguggaga

SEQ ID NO: 303776 - RNA, 22 nt, Human
ggcaggugcgcauguugcauua

SEQ ID NO: 303777 - RNA, 22 nt, Human
acauguguauagccuguauaga

SEQ ID NO: 303778 - RNA, 23 nt, Human
agcuuugugaaagcagacauggg

SEQ ID NO: 303779 - RNA, 22 nt, Human
uuccugcagcaaggagaagcug

SEQ ID NO: 303780 - RNA, 22 nt, Human
acaguaaaaagccuuagaauuu

SEQ ID NO: 303781 - RNA, 22 nt, Human
uuaaaauuuccccaccauguau

SEQ ID NO: 303782 - RNA, 22 nt, Human
agcagggcacuggaaggcacug

SEQ ID NO: 303783 - RNA, 22 nt, Human
ccuguucacuuugacuucucca

SEQ ID NO: 303784 - RNA, 22 nt, Human
aguuaacucauuuuauaaugcc

SEQ ID NO: 303785 - RNA, 22 nt, Human
acagugugguuugagcacuggg

SEQ ID NO: 303786 - RNA, 22 nt, Human
auccuucuccagucguauuuuu

SEQ ID NO: 303787 - RNA, 22 nt, Human
uuccauuuauucuuguccagau

SEQ ID NO: 303788 - RNA, 20 nt, Human
ggcagggcaucaacagcucu

SEQ ID NO: 303789 - RNA, 22 nt, Human
acagguguccaacauuuaccuu

SEQ ID NO: 303790 - RNA, 22 nt, Human
uguuccaauaaggaguugaaau

SEQ ID NO: 303791 - RNA, 22 nt, Human
ccuggguccaauucuggcuugu

SEQ ID NO: 303792 - RNA, 21 nt, Human
acagcauguuuguguguuugc

SEQ ID NO: 303793 - RNA, 20 nt, Human
augugucuguaaacaacucu

SEQ ID NO: 303794 - RNA, 20 nt, Human
auuccucagccccagccuca

SEQ ID NO: 303795 - RNA, 22 nt, Human
aguuuucacacucaccaaaagg

SEQ ID NO: 303796 - RNA, 20 nt, Human
ucccaggcugggcuccagcu

SEQ ID NO: 303797 - RNA, 20 nt, Human
gaacuugggcaaguggcuua

SEQ ID NO: 303798 - RNA, 22 nt, Human
ugggugugcccagauggugucc

SEQ ID NO: 303799 - RNA, 22 nt, Human
aucauuacuccuguaaaauugu

SEQ ID NO: 303800 - RNA, 22 nt, Human
uguuuuagcugacacauggagc

SEQ ID NO: 303801 - RNA, 22 nt, Human
ucuguacuuccuuuaaacuuua

SEQ ID NO: 303802 - RNA, 22 nt, Human
ugcagggccccucugcaugagu

SEQ ID NO: 303803 - RNA, 21 nt, Human
aagugguuuacauccagcugu

SEQ ID NO: 303804 - RNA, 20 nt, Human
cuguggugagcaggagagua

SEQ ID NO: 303805 - RNA, 22 nt, Human
acccagcuggaugcauggaggc

SEQ ID NO: 303806 - RNA, 22 nt, Human
ccugggucuucagucugcuggu

SEQ ID NO: 303807 - RNA, 22 nt, Human
acaguuaucuuugaaauagaga

SEQ ID NO: 303808 - RNA, 22 nt, Human
caucacagggggcuagaagucu

SEQ ID NO: 303809 - RNA, 22 nt, Human
gcagggcaugggcccugucugc

SEQ ID NO: 303810 - RNA, 22 nt, Human
cagcuucugcuaucgaacaucu

SEQ ID NO: 303811 - RNA, 22 nt, Human
ugcauggaggaagaugaaugca

SEQ ID NO: 303812 - RNA, 22 nt, Human
gcagacagcauguugggcuauu

SEQ ID NO: 303813 - RNA, 22 nt, Human
auuuccaugucgguauuuuaua

SEQ ID NO: 303814 - RNA, 22 nt, Human
ggcagggcagcgcugauuaggg

SEQ ID NO: 303815 - RNA, 22 nt, Human
acauguguuaaaauucucacca

SEQ ID NO: 303816 - RNA, 22 nt, Human
cuggaggagaacuugaggaagg

SEQ ID NO: 303817 - RNA, 22 nt, Human
ucaccagggcuccagccagccu

SEQ ID NO: 303818 - RNA, 18 nt, Human
agcagggcauuuugccau

SEQ ID NO: 303819 - RNA, 22 nt, Human
aaauuauuacaagcuaguuggc

SEQ ID NO: 303820 - RNA, 19 nt, Human
uuagggacaugaauucuag

SEQ ID NO: 303821 - RNA, 22 nt, Human
gacuuuauuauaguggcaauag

SEQ ID NO: 303822 - RNA, 22 nt, Human
aaagcugcugccaaucaggcuu

SEQ ID NO: 303823 - RNA, 22 nt, Human
gaaauuauugcuagagacugca

SEQ ID NO: 303824 - RNA, 22 nt, Human
ccaugagcuucaacugacacag

SEQ ID NO: 303825 - RNA, 22 nt, Human
cagggcaguuugugccuaugag

SEQ ID NO: 303826 - RNA, 22 nt, Human
acccagcaaagauaaacuuaug

SEQ ID NO: 303827 - RNA, 22 nt, Human
cacugaaauauuaauaucuuau

SEQ ID NO: 303828 - RNA, 22 nt, Human
cauuguaagaggcuuugcagca

SEQ ID NO: 303829 - RNA, 21 nt, Human
agaugaggauacugaggccua

SEQ ID NO: 303830 - RNA, 22 nt, Human
aaagcagagcagggcacuuaug

SEQ ID NO: 303831 - RNA, 20 nt, Human
uauuggaucuaagaaauggg

SEQ ID NO: 303832 - RNA, 22 nt, Human
auuuaaauuuucugauggagag

SEQ ID NO: 303833 - RNA, 22 nt, Human
uuucaaagaguuguaaauuacu

SEQ ID NO: 303834 - RNA, 22 nt, Human
cuguccugagauaaagaugagg

SEQ ID NO: 303835 - RNA, 22 nt, Human
ggggaccuggccacccauccuu

SEQ ID NO: 303836 - RNA, 22 nt, Human
uccuucuggaggcuguaaagga

SEQ ID NO: 303837 - RNA, 22 nt, Human
aagcgccaugguuccugcgcag

SEQ ID NO: 303838 - RNA, 22 nt, Human
uugcugaucugugaaucagcca

SEQ ID NO: 303839 - RNA, 22 nt, Human
gaggugucccgcaguccccaag

SEQ ID NO: 303840 - RNA, 22 nt, Human
aucagagaaauggagggcgcuu

SEQ ID NO: 303841 - RNA, 22 nt, Human
ccuccuucuggggccuucugcu

SEQ ID NO: 303842 - RNA, 20 nt, Human
auguaaaauuauaaggcuga

SEQ ID NO: 303843 - RNA, 22 nt, Human
ugcuucaaguugaaauauucuu

SEQ ID NO: 303844 - RNA, 22 nt, Human
cuggaggaaaacaacugcagac

SEQ ID NO: 303845 - RNA, 22 nt, Human
cugucuuuaguacaaaaaaugu

SEQ ID NO: 303846 - RNA, 22 nt, Human
cuggguguagcccaguaugagg

SEQ ID NO: 303847 - RNA, 21 nt, Human
caguguggugaccagggucuc

SEQ ID NO: 303848 - RNA, 22 nt, Human
guuucgucaggcuuauucuauc

SEQ ID NO: 303849 - RNA, 22 nt, Human
auauugagauaagaacugacau

SEQ ID NO: 303850 - RNA, 22 nt, Human
uagaaacagauguuuuugaaga

SEQ ID NO: 303851 - RNA, 22 nt, Human
uuugacuccacuccuaacuccu

SEQ ID NO: 303852 - RNA, 22 nt, Human
aagcugcaaggaagugugccag

SEQ ID NO: 303853 - RNA, 22 nt, Human
agagggugggcacgugauggau

SEQ ID NO: 303854 - RNA, 22 nt, Human
ggucaaaguugaagaagggcau

SEQ ID NO: 303855 - RNA, 22 nt, Human
uccaugcagaggagcugguggc

SEQ ID NO: 303856 - RNA, 19 nt, Human
aaggaauggcuuuaaguag

SEQ ID NO: 303857 - RNA, 22 nt, Human
ucuuagauggcagcuagagcuc

SEQ ID NO: 303858 - RNA, 22 nt, Human
acagacagacagagaacuauuc

SEQ ID NO: 303859 - RNA, 22 nt, Human
aacccgggaggcagagguugug

SEQ ID NO: 303860 - RNA, 22 nt, Human
ucugcagguaagcguucuugga

SEQ ID NO: 303861 - RNA, 22 nt, Human
cacagguguccaauaccugcuu

SEQ ID NO: 303862 - RNA, 22 nt, Human
cagacaggcuagccagacucac

SEQ ID NO: 303863 - RNA, 22 nt, Human
ggagcugaugguagaagaauga

SEQ ID NO: 303864 - RNA, 22 nt, Human
ucagcaaaggaccagcacaggc

SEQ ID NO: 303865 - RNA, 22 nt, Human
gacccagcuuaagucacauguu

SEQ ID NO: 303866 - RNA, 22 nt, Human
ucucuuaaaagauuuuaaugac

SEQ ID NO: 303867 - RNA, 22 nt, Human
gcauguguuauuuuauguauga

SEQ ID NO: 303868 - RNA, 22 nt, Human
uauuuauucuuuguacugccuu

SEQ ID NO: 303869 - RNA, 23 nt, Human
uccuggguuugaauucuagucuu

SEQ ID NO: 303870 - RNA, 22 nt, Human
guuuuucuagaaaucuccuccu

SEQ ID NO: 303871 - RNA, 22 nt, Human
uccaugcagagaacugaaguac

SEQ ID NO: 303872 - RNA, 22 nt, Human
uagggcucuggugggcucuguu

SEQ ID NO: 303873 - RNA, 22 nt, Human
acagagcaugcucaguguguga

SEQ ID NO: 303874 - RNA, 22 nt, Human
aaguccagcucuaaauaucuga

SEQ ID NO: 303875 - RNA, 17 nt, Human
ugaaacaccaagacugu

SEQ ID NO: 303876 - RNA, 22 nt, Human
guauuaggagguggagccuuug

SEQ ID NO: 303877 - RNA, 22 nt, Human
uuuacuucugcauuuccccuag

SEQ ID NO: 303878 - RNA, 22 nt, Human
acaguguguuggaggagacugu

SEQ ID NO: 303879 - RNA, 22 nt, Human
uaacuuuaggaauagguaaucu

SEQ ID NO: 303880 - RNA, 22 nt, Human
ucuuucaaugagcauucuuucc

SEQ ID NO: 303881 - RNA, 22 nt, Human
augcaacaaaugcuacgaaucg

SEQ ID NO: 303882 - RNA, 22 nt, Human
acuaucaacaucauugcucuag

SEQ ID NO: 303883 - RNA, 22 nt, Human
uccaggaggccucauuuccugu

SEQ ID NO: 303884 - RNA, 14 nt, Human
agcugcaagcaucc

SEQ ID NO: 303885 - RNA, 22 nt, Human
ucauacaucuguccuggagcuc

SEQ ID NO: 303886 - RNA, 22 nt, Human
cccuccucaacucuggcuucca

SEQ ID NO: 303887 - RNA, 22 nt, Human
uucuaucauacuugaauacauu

SEQ ID NO: 303888 - RNA, 22 nt, Human
gcuuggccagcagccgggaugc

SEQ ID NO: 303889 - RNA, 22 nt, Human
cucuuagaaagaaacacacugg

SEQ ID NO: 303890 - RNA, 22 nt, Human
agucaaaggguauuuggauuga

SEQ ID NO: 303891 - RNA, 22 nt, Human
cagcaaucgggugauaugcaau

SEQ ID NO: 303892 - RNA, 22 nt, Human
auuaaauuuucacuaggcuccc

SEQ ID NO: 303893 - RNA, 22 nt, Human
uuugacuccugccuucuccugu

SEQ ID NO: 303894 - RNA, 22 nt, Human
ccuuccuuucagggcuaugccu

SEQ ID NO: 303895 - RNA, 22 nt, Human
caaagagcuguucagugucgcu

SEQ ID NO: 303896 - RNA, 22 nt, Human
cuucauuaaccaaaaugcaaua

SEQ ID NO: 303897 - RNA, 22 nt, Human
uuaucacuuaugagcuuuuugc

SEQ ID NO: 303898 - RNA, 17 nt, Human
uuauugcuauaagcuga

SEQ ID NO: 303899 - RNA, 22 nt, Human
gacagcagccacagggagaggg

SEQ ID NO: 303900 - RNA, 22 nt, Human
ucuucagaggaagucagucuuu

SEQ ID NO: 303901 - RNA, 22 nt, Human
ggcaggugaguucauuaucugc

SEQ ID NO: 303902 - RNA, 22 nt, Human
gauguguccuuuucuccaucca

SEQ ID NO: 303903 - RNA, 22 nt, Human
uguccauggauagagcugcucg

SEQ ID NO: 303904 - RNA, 22 nt, Human
ucagagagugcaaaauauagcu

SEQ ID NO: 303905 - RNA, 21 nt, Human
cuacuuaaguaggggauuagg

SEQ ID NO: 303906 - RNA, 22 nt, Human
ucuguucagaaauggaagugcc

SEQ ID NO: 303907 - RNA, 22 nt, Human
ggugggcagcucuuggcaggca

SEQ ID NO: 303908 - RNA, 19 nt, Human
agcagguggguaagaaaau

SEQ ID NO: 303909 - RNA, 22 nt, Human
uaugcauacaaugagauauucc

SEQ ID NO: 303910 - RNA, 21 nt, Human
ucagggcagcugcucuucaga

SEQ ID NO: 303911 - RNA, 22 nt, Human
uauaauuuuaagugguaaauua

SEQ ID NO: 303912 - RNA, 22 nt, Human
uuuuucaugagacuagaaguca

SEQ ID NO: 303913 - RNA, 22 nt, Human
acagcuuuaguguggguggugc

SEQ ID NO: 303914 - RNA, 22 nt, Human
cguuuauuuugaagauuccacu

SEQ ID NO: 303915 - RNA, 22 nt, Human
uuagcuuuuaagugugcuacau

SEQ ID NO: 303916 - RNA, 22 nt, Human
auguaauuugcccucaaguuaa

SEQ ID NO: 303917 - RNA, 22 nt, Human
auggaaugugaacaugauggca

SEQ ID NO: 303918 - RNA, 22 nt, Human
cuuuuccacugagccucacaaa

SEQ ID NO: 303919 - RNA, 22 nt, Human
gcagcuuugaagacuuauuugc

SEQ ID NO: 303920 - RNA, 22 nt, Human
auuagggaaggauuuggccuga

SEQ ID NO: 303921 - RNA, 22 nt, Human
aaacuucauggauaauauaaag

SEQ ID NO: 303922 - RNA, 22 nt, Human
gggugggaacaggaugccagga

SEQ ID NO: 303923 - RNA, 22 nt, Human
ucuuuccauggccacacagucu

SEQ ID NO: 303924 - RNA, 22 nt, Human
cagcaugaucccaguugauugc

SEQ ID NO: 303925 - RNA, 22 nt, Human
uuauuguuagugagacuguaga

SEQ ID NO: 303926 - RNA, 22 nt, Human
auagaagaggaaacugagguug

SEQ ID NO: 303927 - RNA, 22 nt, Human
uucuucaaccaucuacauaaac

SEQ ID NO: 303928 - RNA, 22 nt, Human
gcuuuuggccagauggggaaac

SEQ ID NO: 303929 - RNA, 19 nt, Human
ccagagacauuggcaucuu

SEQ ID NO: 303930 - RNA, 22 nt, Human
acaugauuuuaguaucauaaua

SEQ ID NO: 303931 - RNA, 22 nt, Human
gaaccauuucugaauaguuugu

SEQ ID NO: 303932 - RNA, 22 nt, Human
aaagacuuggcuuaugauuugc

SEQ ID NO: 303933 - RNA, 22 nt, Human
aggugucuucagggugagacag

SEQ ID NO: 303934 - RNA, 20 nt, Human
aaaggaauauaugaaguaua

SEQ ID NO: 303935 - RNA, 21 nt, Human
auucagaaagggaauaaacuc

SEQ ID NO: 303936 - RNA, 20 nt, Human
caccacagaauuggggacag

SEQ ID NO: 303937 - RNA, 22 nt, Human
ccugggucuauagacuucaaga

SEQ ID NO: 303938 - RNA, 22 nt, Human
ggcaggcacugugauagauucu

SEQ ID NO: 303939 - RNA, 22 nt, Human
uccugcagagucccacugauuu

SEQ ID NO: 303940 - RNA, 22 nt, Human
agggaagaaaauccaucgcugc

SEQ ID NO: 303941 - RNA, 22 nt, Human
gacccagccugguuuuuauagg

SEQ ID NO: 303942 - RNA, 22 nt, Human
uucaugaauggaaucaaugcuc

SEQ ID NO: 303943 - RNA, 22 nt, Human
uggcagggaguucguucacaac

SEQ ID NO: 303944 - RNA, 22 nt, Human
gcaaagaaaugucagugagagg

SEQ ID NO: 303945 - RNA, 19 nt, Human
uuugacuccucauuuuuau

SEQ ID NO: 303946 - RNA, 22 nt, Human
uagggcagagcuuguacacgau

SEQ ID NO: 303947 - RNA, 22 nt, Human
ugucagagagcaggcaguagaa

SEQ ID NO: 303948 - RNA, 19 nt, Human
gggcaaagugaucguccug

SEQ ID NO: 303949 - RNA, 22 nt, Human
cagcaugaaaaguguugcuauc

SEQ ID NO: 303950 - RNA, 22 nt, Human
ccuguucaauauucuuccuugu

SEQ ID NO: 303951 - RNA, 22 nt, Human
gggcugaccaaugccuugcuuu

SEQ ID NO: 303952 - RNA, 21 nt, Human
aagagcuggaucaaggauaag

SEQ ID NO: 303953 - RNA, 22 nt, Human
uuuuugcuaauccccagccacu

SEQ ID NO: 303954 - RNA, 22 nt, Human
uguccucuuccagugcuccuuc

SEQ ID NO: 303955 - RNA, 22 nt, Human
gagaggcugaaaucacaggagc

SEQ ID NO: 303956 - RNA, 22 nt, Human
cauauaaauacaacauguguua

SEQ ID NO: 303957 - RNA, 22 nt, Human
uagcuuuaaugaguugguaaga

SEQ ID NO: 303958 - RNA, 22 nt, Human
uaaaauagcaugugcagugaaa

SEQ ID NO: 303959 - RNA, 22 nt, Human
gugggugugauaagaccaaggg

SEQ ID NO: 303960 - RNA, 22 nt, Human
gggcuggacaucuaagguagcu

SEQ ID NO: 303961 - RNA, 22 nt, Human
caggcauagguaggauguuucu

SEQ ID NO: 303962 - RNA, 22 nt, Human
cauggaaugguugaaugacgaa

SEQ ID NO: 303963 - RNA, 22 nt, Human
accugcagcugagaaaaugacu

SEQ ID NO: 303964 - RNA, 22 nt, Human
ugaauaugugacuuugauuuca

SEQ ID NO: 303965 - RNA, 16 nt, Human
ccagguggggcuguga

SEQ ID NO: 303966 - RNA, 22 nt, Human
auacacuuuagaaaaacgcugc

SEQ ID NO: 303967 - RNA, 22 nt, Human
gucugccccacaggcucaguug

SEQ ID NO: 303968 - RNA, 22 nt, Human
agcagguguagggcucuuugua

SEQ ID NO: 303969 - RNA, 22 nt, Human
ccuggcaggcuggggacagugc

SEQ ID NO: 303970 - RNA, 22 nt, Human
cacuuuaugggaagcaaaaauu

SEQ ID NO: 303971 - RNA, 22 nt, Human
acccaggccugagagacaggag

SEQ ID NO: 303972 - RNA, 22 nt, Human
ccaugcugugacacaguaguua

SEQ ID NO: 303973 - RNA, 20 nt, Human
ccagacagcaccugccuggu

SEQ ID NO: 303974 - RNA, 22 nt, Human
caggcugccgugaagcaggccu

SEQ ID NO: 303975 - RNA, 22 nt, Human
ucuggaggccauagggaaggau

SEQ ID NO: 303976 - RNA, 22 nt, Human
agauguuuguguuaucuccauu

SEQ ID NO: 303977 - RNA, 22 nt, Human
uuccugaauauaaagacacuag

SEQ ID NO: 303978 - RNA, 22 nt, Human
aguguggcugcguagggcucuc

SEQ ID NO: 303979 - RNA, 22 nt, Human
gacuuuauccugccugaccacg

SEQ ID NO: 303980 - RNA, 22 nt, Human
ccagacaggaacacacaucucc

SEQ ID NO: 303981 - RNA, 22 nt, Human
uggcagggccuaccccaauauc

SEQ ID NO: 303982 - RNA, 22 nt, Human
gagauggagucuuuuucuguca

SEQ ID NO: 303983 - RNA, 22 nt, Human
acuuucugcaguguuggaaaug

SEQ ID NO: 303984 - RNA, 22 nt, Human
uuccucaguuagugccugaggc

SEQ ID NO: 303985 - RNA, 22 nt, Human
cacuuuauauucuaagacggcc

SEQ ID NO: 303986 - RNA, 22 nt, Human
aguugcuggcaccugugaguau

SEQ ID NO: 303987 - RNA, 20 nt, Human
agguguccuguagcuugagu

SEQ ID NO: 303988 - RNA, 22 nt, Human
cagggcaggacagauacauuac

SEQ ID NO: 303989 - RNA, 22 nt, Human
ucuucagauggccaguuguccc

SEQ ID NO: 303990 - RNA, 22 nt, Human
acuguucacuagugaggguuga

SEQ ID NO: 303991 - RNA, 19 nt, Human
gggaccugacuaauuggca

SEQ ID NO: 303992 - RNA, 22 nt, Human
aucuguaauuuugaaugcaaau

SEQ ID NO: 303993 - RNA, 22 nt, Human
uauuuccagcaguaagaagaca

SEQ ID NO: 303994 - RNA, 22 nt, Human
gcagggcaaacccagguguuca

SEQ ID NO: 303995 - RNA, 22 nt, Human
uguggggcuuacaaaggcagau

SEQ ID NO: 303996 - RNA, 22 nt, Human
agcucccagcuccuuugagaga

SEQ ID NO: 303997 - RNA, 22 nt, Human
aucagagaaguuucacuggcau

SEQ ID NO: 303998 - RNA, 22 nt, Human
caaaaguucucacccagacaug

SEQ ID NO: 303999 - RNA, 22 nt, Human
agcacugauuuaaacuggauuu

SEQ ID NO: 304000 - RNA, 22 nt, Human
uuuauuuggcauccagggagaa

SEQ ID NO: 304001 - RNA, 21 nt, Human
uuccuuuuuauggcuuagugg

SEQ ID NO: 304002 - RNA, 22 nt, Human
aaggugucaggcuugggaaagu

SEQ ID NO: 304003 - RNA, 22 nt, Human
uguguccugugcaaggggauga

SEQ ID NO: 304004 - RNA, 22 nt, Human
ugcagggaaucuguggcuggac

SEQ ID NO: 304005 - RNA, 22 nt, Human
uauuugauagagauaaaugaua

SEQ ID NO: 304006 - RNA, 16 nt, Human
guuccuucccacaccu

SEQ ID NO: 304007 - RNA, 22 nt, Human
ucuuaguuguuugcugucuaac

SEQ ID NO: 304008 - RNA, 23 nt, Human
uggcucuguggaucccucaggag

SEQ ID NO: 304009 - RNA, 22 nt, Human
ucucuuaggagaaauucauaaa

SEQ ID NO: 304010 - RNA, 22 nt, Human
auguacuaugcagucaacuguu

SEQ ID NO: 304011 - RNA, 22 nt, Human
acagguggcuuauuggcugauu

SEQ ID NO: 304012 - RNA, 22 nt, Human
uuauccuggauuauauauguga

SEQ ID NO: 304013 - RNA, 22 nt, Human
caguuuauaugucagagcugua

SEQ ID NO: 304014 - RNA, 22 nt, Human
ucagacaguuugcagugugccu

SEQ ID NO: 304015 - RNA, 22 nt, Human
cugcagagcagccaguccccca

SEQ ID NO: 304016 - RNA, 22 nt, Human
gggcagguauuuaucuucuauu

SEQ ID NO: 304017 - RNA, 22 nt, Human
aaagucuuuauuuuguaucuuu

SEQ ID NO: 304018 - RNA, 22 nt, Human
cugcaaaauuguucuuugcucc

SEQ ID NO: 304019 - RNA, 22 nt, Human
guguaaaaacauacuauuucua

SEQ ID NO: 304020 - RNA, 22 nt, Human
aaggugucaccagauuggcagg

SEQ ID NO: 304021 - RNA, 22 nt, Human
cagguggcuucucccuaggcca

SEQ ID NO: 304022 - RNA, 22 nt, Human
uuacauaacgguaugaaaaaug

SEQ ID NO: 304023 - RNA, 22 nt, Human
uacuacaaggccgaagcucuca

SEQ ID NO: 304024 - RNA, 22 nt, Human
uccaggcaucuguauuuuuuaa

SEQ ID NO: 304025 - RNA, 22 nt, Human
gcagggcacacaagaaugauaa

SEQ ID NO: 304026 - RNA, 22 nt, Human
guccugucccccaaggcugugg

SEQ ID NO: 304027 - RNA, 22 nt, Human
agcuuuauauaaaagaguacau

SEQ ID NO: 304028 - RNA, 22 nt, Human
ucaacuuugaaaccauagugaa

SEQ ID NO: 304029 - RNA, 22 nt, Human
ugggacacaaaccagaccagga

SEQ ID NO: 304030 - RNA, 22 nt, Human
aagggcagcugacagaugcuua

SEQ ID NO: 304031 - RNA, 22 nt, Human
ucagcuuuggucacauugaguu

SEQ ID NO: 304032 - RNA, 22 nt, Human
augcaugaaagaauccaagccu

SEQ ID NO: 304033 - RNA, 22 nt, Human
uguccuggccaaggccuugcuu

SEQ ID NO: 304034 - RNA, 22 nt, Human
cucuggaaaaccacuagcagga

SEQ ID NO: 304035 - RNA, 22 nt, Human
aaguccuuuaauaucacauagu

SEQ ID NO: 304036 - RNA, 22 nt, Human
uuuugcuguguccuugagccgg

SEQ ID NO: 304037 - RNA, 22 nt, Human
agguggcuguauucagcuguaa

SEQ ID NO: 304038 - RNA, 22 nt, Human
uuugcugucagccgcuauuuuc

SEQ ID NO: 304039 - RNA, 22 nt, Human
auucauaacggcaaaugucacc

SEQ ID NO: 304040 - RNA, 21 nt, Human
uucugggaaaugagcuggggc

SEQ ID NO: 304041 - RNA, 22 nt, Human
gauuuaaaguagaccuuuguuu

SEQ ID NO: 304042 - RNA, 22 nt, Human
aggaggaaaaaggccacagcaa

SEQ ID NO: 304043 - RNA, 22 nt, Human
ccaggugggcgugucuucaccu

SEQ ID NO: 304044 - RNA, 22 nt, Human
cuucuucauaggcaguccuguu

SEQ ID NO: 304045 - RNA, 22 nt, Human
gggcagguggagggcccagcca

SEQ ID NO: 304046 - RNA, 22 nt, Human
accaugaugggaagcucagggc

SEQ ID NO: 304047 - RNA, 23 nt, Human
gcaggugguucgaacagaaguuu

SEQ ID NO: 304048 - RNA, 22 nt, Human
cucagagaaaugucacaacaau

SEQ ID NO: 304049 - RNA, 22 nt, Human
uuugcaguagacaucuuauuuu

SEQ ID NO: 304050 - RNA, 22 nt, Human
uuuauugaacacuugcacuggc

SEQ ID NO: 304051 - RNA, 22 nt, Human
gggguuaacaguauugcucaug

SEQ ID NO: 304052 - RNA, 23 nt, Human
ucucuuucaagagcuuaaugugc

SEQ ID NO: 304053 - RNA, 22 nt, Human
uuauuccaauuucuccuacaaa

SEQ ID NO: 304054 - RNA, 22 nt, Human
auuucucagugaaaugacaggc

SEQ ID NO: 304055 - RNA, 22 nt, Human
uuauuuaggagaaggaacccug

SEQ ID NO: 304056 - RNA, 22 nt, Human
ugcagggcauaggguccaguuu

SEQ ID NO: 304057 - RNA, 22 nt, Human
uacauguggccagaaauuugag

SEQ ID NO: 304058 - RNA, 22 nt, Human
acagguguccucacagggggug

SEQ ID NO: 304059 - RNA, 22 nt, Human
ucuucagauaaagggagaguau

SEQ ID NO: 304060 - RNA, 22 nt, Human
gugucccaggccucuggaauua

SEQ ID NO: 304061 - RNA, 22 nt, Human
acuugguucuaacuaguguaua

SEQ ID NO: 304062 - RNA, 20 nt, Human
ucuguucaaaucuuaguucc

SEQ ID NO: 304063 - RNA, 22 nt, Human
gcaggggcuaaggacacagaga

SEQ ID NO: 304064 - RNA, 22 nt, Human
gccugcagccccucugcaguag

SEQ ID NO: 304065 - RNA, 19 nt, Human
cgcagguggaaggagccgc

SEQ ID NO: 304066 - RNA, 16 nt, Human
ugggaccuguggccaa

SEQ ID NO: 304067 - RNA, 22 nt, Human
cacauaauacauguuccacuua

SEQ ID NO: 304068 - RNA, 22 nt, Human
aaaaucuggcaacacuaaguuu

SEQ ID NO: 304069 - RNA, 22 nt, Human
uauguacucaucaacuauugaa

SEQ ID NO: 304070 - RNA, 22 nt, Human
gcugggcucauuugugugucug

SEQ ID NO: 304071 - RNA, 22 nt, Human
ugacagacuacugccucuauug

SEQ ID NO: 304072 - RNA, 22 nt, Human
uccaugagaacccuuggagaua

SEQ ID NO: 304073 - RNA, 22 nt, Human
gggaccugaggagggguuucag

SEQ ID NO: 304074 - RNA, 22 nt, Human
uccaggcaagggaggagcaugg

SEQ ID NO: 304075 - RNA, 22 nt, Human
uuuaaauuuagaagaaacacug

SEQ ID NO: 304076 - RNA, 22 nt, Human
cagucuggaggucagcuggcuu

SEQ ID NO: 304077 - RNA, 23 nt, Human
agcagggccagaauacuugcugu

SEQ ID NO: 304078 - RNA, 23 nt, Human
ucauaaauauuagcacaguagga

SEQ ID NO: 304079 - RNA, 22 nt, Human
cauaugaaauaugaguugaaca

SEQ ID NO: 304080 - RNA, 23 nt, Human
acagacuguauucaaaguaggac

SEQ ID NO: 304081 - RNA, 22 nt, Human
aaguuuaacuugaauucuuucu

SEQ ID NO: 304082 - RNA, 22 nt, Human
uggugggggaggcugucuagca

SEQ ID NO: 304083 - RNA, 22 nt, Human
uauuuagaugcauuuggauugc

SEQ ID NO: 304084 - RNA, 16 nt, Human
ugguggggaggacagc

SEQ ID NO: 304085 - RNA, 22 nt, Human
agcugcaauuaaagacugugaa

SEQ ID NO: 304086 - RNA, 22 nt, Human
uuugaaaauuagacacaggcua

SEQ ID NO: 304087 - RNA, 22 nt, Human
aguggggcggacaggaccagga

SEQ ID NO: 304088 - RNA, 22 nt, Human
agauuccagaucccaaaaauga

SEQ ID NO: 304089 - RNA, 22 nt, Human
gccugggugagggucuccuuca

SEQ ID NO: 304090 - RNA, 22 nt, Human
gagaagcaaucaguggccaccc

SEQ ID NO: 304091 - RNA, 22 nt, Human
auucuucauuuacuguuacuug

SEQ ID NO: 304092 - RNA, 22 nt, Human
gcagcuuucuugcccuaaucuu

SEQ ID NO: 304093 - RNA, 23 nt, Human
acucaaaauuuggcauuugagga

SEQ ID NO: 304094 - RNA, 22 nt, Human
guguccauguuguucaggguga

SEQ ID NO: 304095 - RNA, 18 nt, Human
uggaggaaaaaucucaug

SEQ ID NO: 304096 - RNA, 22 nt, Human
uuucacauaaauauuaugccua

SEQ ID NO: 304097 - RNA, 22 nt, Human
uucacauaaugauacaaagcuu

SEQ ID NO: 304098 - RNA, 22 nt, Human
ccaggccuggaccaugccaggg

SEQ ID NO: 304099 - RNA, 22 nt, Human
ucagcuuugggggucucaggag

SEQ ID NO: 304100 - RNA, 22 nt, Human
acacaaugcauauuuuuccaga

SEQ ID NO: 304101 - RNA, 22 nt, Human
guucuucaucuuaaccaucugu

SEQ ID NO: 304102 - RNA, 22 nt, Human
ucagcauaucuugagcuucaug

SEQ ID NO: 304103 - RNA, 22 nt, Human
auuauuauauagggaaaguccc

SEQ ID NO: 304104 - RNA, 22 nt, Human
ccugcuccugcuauucuucugg

SEQ ID NO: 304105 - RNA, 22 nt, Human
ugugugucagagucuccauggu

SEQ ID NO: 304106 - RNA, 22 nt, Human
cauauucuuuaagcaaugcucu

SEQ ID NO: 304107 - RNA, 22 nt, Human
gcugcuuuauaaucucggcaga

SEQ ID NO: 304108 - RNA, 22 nt, Human
ugaacaugcuguugauggccug

SEQ ID NO: 304109 - RNA, 22 nt, Human
cccagugugguucuuuggagaa

SEQ ID NO: 304110 - RNA, 22 nt, Human
auuagggcuggaugcaaggaaa

SEQ ID NO: 304111 - RNA, 22 nt, Human
gguccugggaagaugcucauga

SEQ ID NO: 304112 - RNA, 22 nt, Human
ccugcaggcugcaggccaguuc

SEQ ID NO: 304113 - RNA, 22 nt, Human
uagguguccauauaugugugua

SEQ ID NO: 304114 - RNA, 22 nt, Human
auuuccaggagaaaggauuuua

SEQ ID NO: 304115 - RNA, 21 nt, Human
gaguccuuccaauguccucag

SEQ ID NO: 304116 - RNA, 19 nt, Human
guccaguguuuuccaguca

SEQ ID NO: 304117 - RNA, 22 nt, Human
aguccagucucacucuuggcag

SEQ ID NO: 304118 - RNA, 22 nt, Human
cuucuuaacuguauauacuaug

SEQ ID NO: 304119 - RNA, 22 nt, Human
ucuguucagaauuguaacacuc

SEQ ID NO: 304120 - RNA, 22 nt, Human
ggucuggauuucugcuucuuuc

SEQ ID NO: 304121 - RNA, 22 nt, Human
auucagcaaacauuuauuaucu

SEQ ID NO: 304122 - RNA, 22 nt, Human
ucucugaaggggagcuguuuaa

SEQ ID NO: 304123 - RNA, 22 nt, Human
auucuucaguauguguggauug

SEQ ID NO: 304124 - RNA, 22 nt, Human
uccugcagcauccgucgucugu

SEQ ID NO: 304125 - RNA, 22 nt, Human
uuugcaaauaccaugaaacuug

SEQ ID NO: 304126 - RNA, 22 nt, Human
guauuaggugguggaauuguag

SEQ ID NO: 304127 - RNA, 22 nt, Human
ugacaggugaaauguccuuauu

SEQ ID NO: 304128 - RNA, 22 nt, Human
gucugcccuggggcaucaguuu

SEQ ID NO: 304129 - RNA, 22 nt, Human
uauugcuguucuuuaaaugaag

SEQ ID NO: 304130 - RNA, 22 nt, Human
cuguuauuugagaguguugaau

SEQ ID NO: 304131 - RNA, 22 nt, Human
aagggcauugaggcugagagac

SEQ ID NO: 304132 - RNA, 18 nt, Human
ccauggcucccuccugcc

SEQ ID NO: 304133 - RNA, 22 nt, Human
auuauaaagaacaugugugugg

SEQ ID NO: 304134 - RNA, 22 nt, Human
uuucuuagcgaugcuugauaaa

SEQ ID NO: 304135 - RNA, 22 nt, Human
ucacaaaagcuuuugaauuugg

SEQ ID NO: 304136 - RNA, 22 nt, Human
uguccuuuuggcugucuauggu

SEQ ID NO: 304137 - RNA, 19 nt, Human
aguuuauuauaggugauuc

SEQ ID NO: 304138 - RNA, 22 nt, Human
uuaagcauaauuaaagugaaau

SEQ ID NO: 304139 - RNA, 22 nt, Human
uucauaguguuuccuuccagug

SEQ ID NO: 304140 - RNA, 22 nt, Human
uuuccuuccuugcuagccugag

SEQ ID NO: 304141 - RNA, 22 nt, Human
auuucccagcuuugaucaguuu

SEQ ID NO: 304142 - RNA, 22 nt, Human
ugucaaaaauaagagagauugu

SEQ ID NO: 304143 - RNA, 22 nt, Human
gguggggccugcuccagcggcc

SEQ ID NO: 304144 - RNA, 22 nt, Human
acauguguaaggucucucaguc

SEQ ID NO: 304145 - RNA, 23 nt, Human
guaaaauacgcagugcaguguga

SEQ ID NO: 304146 - RNA, 22 nt, Human
uguccucagauaugucuacucu

SEQ ID NO: 304147 - RNA, 22 nt, Human
ugguuugacaaugaggacuggu

SEQ ID NO: 304148 - RNA, 22 nt, Human
ucuaggguggagcugggaaucc

SEQ ID NO: 304149 - RNA, 22 nt, Human
aggcagcaauugaaaucauugu

SEQ ID NO: 304150 - RNA, 22 nt, Human
acuuuacucuucauaugugaca

SEQ ID NO: 304151 - RNA, 22 nt, Human
gaugggcguggcgcguuuggug

SEQ ID NO: 304152 - RNA, 22 nt, Human
cuaaaugacuuccagugguuau

SEQ ID NO: 304153 - RNA, 22 nt, Human
uuuuuucagccugucugugcca

SEQ ID NO: 304154 - RNA, 22 nt, Human
acagacagacagauugcauaug

SEQ ID NO: 304155 - RNA, 22 nt, Human
uugggcucaggaguuugagacc

SEQ ID NO: 304156 - RNA, 22 nt, Human
gccaggcauuuguuaggugcug

SEQ ID NO: 304157 - RNA, 22 nt, Human
aucuucaaagggauguccaugg

SEQ ID NO: 304158 - RNA, 20 nt, Human
ucuggccccuuccuguccug

SEQ ID NO: 304159 - RNA, 22 nt, Human
ugcagggcagcuagggagcuuu

SEQ ID NO: 304160 - RNA, 22 nt, Human
ucugaacauccagcaaugcaca

SEQ ID NO: 304161 - RNA, 22 nt, Human
ucuacccagagcuaugaccuga

SEQ ID NO: 304162 - RNA, 22 nt, Human
cuagaugccaauuuuuauggau

SEQ ID NO: 304163 - RNA, 22 nt, Human
uaacauuagguagacauaagcc

SEQ ID NO: 304164 - RNA, 22 nt, Human
ggaccugcucucccaguucucu

SEQ ID NO: 304165 - RNA, 22 nt, Human
guaaacaucgacccaacagggg

SEQ ID NO: 304166 - RNA, 22 nt, Human
uagggcuccacucccagagauu

SEQ ID NO: 304167 - RNA, 22 nt, Human
acaguguucacuuaacaaugga

SEQ ID NO: 304168 - RNA, 22 nt, Human
guuggcaaguguuccuuccucu

SEQ ID NO: 304169 - RNA, 21 nt, Human
aagaaagauaauuaaggaccc

SEQ ID NO: 304170 - RNA, 22 nt, Human
ugggcaggauaauaucucaugu

SEQ ID NO: 304171 - RNA, 22 nt, Human
uggcagguccacucacagaucu

SEQ ID NO: 304172 - RNA, 22 nt, Human
gucccaggugggcuccaccucu

SEQ ID NO: 304173 - RNA, 17 nt, Human
auuuacauugucaccga

SEQ ID NO: 304174 - RNA, 22 nt, Human
gacccggcuccaggcccagcag

SEQ ID NO: 304175 - RNA, 22 nt, Human
uuccaagaguaaauucaaauug

SEQ ID NO: 304176 - RNA, 22 nt, Human
auugauaucaguuugcugauug

SEQ ID NO: 304177 - RNA, 23 nt, Human
acauacauggagauaaagugaug

SEQ ID NO: 304178 - RNA, 22 nt, Human
uccaggcaaagggacuagcagg

SEQ ID NO: 304179 - RNA, 22 nt, Human
ccagagcccagggucaugcagg

SEQ ID NO: 304180 - RNA, 21 nt, Human
aaaugaaugugguagugcaag

SEQ ID NO: 304181 - RNA, 16 nt, Human
uaugugucucaucuac

SEQ ID NO: 304182 - RNA, 22 nt, Human
aaagauaauguuuccuuauucu

SEQ ID NO: 304183 - RNA, 22 nt, Human
uuauugcuauggugagagggau

SEQ ID NO: 304184 - RNA, 22 nt, Human
uggcaggguacaccuuaacacc

SEQ ID NO: 304185 - RNA, 22 nt, Human
ucauguuauugacucauaauau

SEQ ID NO: 304186 - RNA, 22 nt, Human
ugcagguggccaucuucguucu

SEQ ID NO: 304187 - RNA, 22 nt, Human
ggagaggguagggguccugccc

SEQ ID NO: 304188 - RNA, 23 nt, Human
gcaugaagugcuacgucuacagc

SEQ ID NO: 304189 - RNA, 22 nt, Human
cuguccugaaagggagauuggg

SEQ ID NO: 304190 - RNA, 22 nt, Human
auggagggugguaagacagaga

SEQ ID NO: 304191 - RNA, 22 nt, Human
gacuuuauaaaugagaggcgga

SEQ ID NO: 304192 - RNA, 20 nt, Human
gccaggcacuguucucaaua

SEQ ID NO: 304193 - RNA, 23 nt, Human
auguuauuauuagcagucuugcc

SEQ ID NO: 304194 - RNA, 22 nt, Human
auaauucagguuuucuggcaca

SEQ ID NO: 304195 - RNA, 22 nt, Human
agacagcuagggcugcagggac

SEQ ID NO: 304196 - RNA, 22 nt, Human
cauuugcagagggugacacucu

SEQ ID NO: 304197 - RNA, 22 nt, Human
ucacauaaauuauacaauuuca

SEQ ID NO: 304198 - RNA, 22 nt, Human
gugaccauccugguaaugaauc

SEQ ID NO: 304199 - RNA, 22 nt, Human
aggcagguccccuggaaggcac

SEQ ID NO: 304200 - RNA, 22 nt, Human
uuccucagcuguguccuggcga

SEQ ID NO: 304201 - RNA, 22 nt, Human
aaaacaggugucagcaaacuau

SEQ ID NO: 304202 - RNA, 21 nt, Human
uucaaaguuugccuaaagauu

SEQ ID NO: 304203 - RNA, 22 nt, Human
cuaaagcucaacaggcacuauu

SEQ ID NO: 304204 - RNA, 22 nt, Human
cuggaggaaucacagaaggcuu

SEQ ID NO: 304205 - RNA, 22 nt, Human
gcaugcagaaaaugaacaacga

SEQ ID NO: 304206 - RNA, 22 nt, Human
uggucugggcaaauccuucuga

SEQ ID NO: 304207 - RNA, 22 nt, Human
gagggcagagucuaaugaugca

SEQ ID NO: 304208 - RNA, 22 nt, Human
ucccaggcugggggccugaagu

SEQ ID NO: 304209 - RNA, 22 nt, Human
cagcuuuguggccuugaccucg

SEQ ID NO: 304210 - RNA, 22 nt, Human
acagguggcagaagcauuuacu

SEQ ID NO: 304211 - RNA, 22 nt, Human
agcuuuaucagaggagucucua

SEQ ID NO: 304212 - RNA, 22 nt, Human
gagugcaggccugagcaccauc

SEQ ID NO: 304213 - RNA, 22 nt, Human
acuuccagcuagguucugcuaa

SEQ ID NO: 304214 - RNA, 22 nt, Human
ucagacagaggagcucgugcag

SEQ ID NO: 304215 - RNA, 22 nt, Human
cagacaggcaggugagagcucc

SEQ ID NO: 304216 - RNA, 22 nt, Human
cuguccuguagcuccaucaguc

SEQ ID NO: 304217 - RNA, 22 nt, Human
ccagguggauaagguuucugga

SEQ ID NO: 304218 - RNA, 22 nt, Human
agagggcugccucagucagcua

SEQ ID NO: 304219 - RNA, 22 nt, Human
uuguguccccuguucuaccugu

SEQ ID NO: 304220 - RNA, 22 nt, Human
auugcuuuagaaagaaaaauau

SEQ ID NO: 304221 - RNA, 22 nt, Human
uggcuggagcauuccuugucuu

SEQ ID NO: 304222 - RNA, 22 nt, Human
aguuuacaaaguuucacuguuc

SEQ ID NO: 304223 - RNA, 20 nt, Human
cuggaguguagcaguggcug

SEQ ID NO: 304224 - RNA, 22 nt, Human
gcuuccagacgaucauguaaga

SEQ ID NO: 304225 - RNA, 22 nt, Human
acagagagaggcccgaggcugc

SEQ ID NO: 304226 - RNA, 22 nt, Human
ggcuggguacagggcagugugc

SEQ ID NO: 304227 - RNA, 22 nt, Human
gcagggacaaggcagguguucu

SEQ ID NO: 304228 - RNA, 22 nt, Human
uccauguguuuuccuguccaca

SEQ ID NO: 304229 - RNA, 22 nt, Human
ugauggucaacaauuuugagug

SEQ ID NO: 304230 - RNA, 22 nt, Human
uggaagcuguggcauaacugag

SEQ ID NO: 304231 - RNA, 22 nt, Human
gugccaaaagcuauaauuuggu

SEQ ID NO: 304232 - RNA, 22 nt, Human
uugcuguagcucauuucacucu

SEQ ID NO: 304233 - RNA, 22 nt, Human
agcuuuauucaugauuucaggg

SEQ ID NO: 304234 - RNA, 21 nt, Human
uucaaaaugguguguuugucu

SEQ ID NO: 304235 - RNA, 22 nt, Human
cuggaggaccccugccuggaag

SEQ ID NO: 304236 - RNA, 22 nt, Human
acaggugugggcugggcucuga

SEQ ID NO: 304237 - RNA, 22 nt, Human
auguccuuuuauuuaaagcagg

SEQ ID NO: 304238 - RNA, 22 nt, Human
auguuucaccagcaaauuaccu

SEQ ID NO: 304239 - RNA, 22 nt, Human
guagggacaugccauuaucuca

SEQ ID NO: 304240 - RNA, 22 nt, Human
gcagggcagccacaggcccccu

SEQ ID NO: 304241 - RNA, 22 nt, Human
aauugcuuaguugcaacuaugc

SEQ ID NO: 304242 - RNA, 22 nt, Human
gcugggugauucauuuccauaa

SEQ ID NO: 304243 - RNA, 22 nt, Human
gaaugaauagguguccagaugg

SEQ ID NO: 304244 - RNA, 22 nt, Human
agugugagaacggacuaauaaa

SEQ ID NO: 304245 - RNA, 22 nt, Human
acuguccaagcaugccuggcuu

SEQ ID NO: 304246 - RNA, 22 nt, Human
agcagggcaugaauaaggguuu

SEQ ID NO: 304247 - RNA, 21 nt, Human
auaagcaugcugauuacauuu

SEQ ID NO: 304248 - RNA, 22 nt, Human
cugaaagaauaagauguuuaca

SEQ ID NO: 304249 - RNA, 22 nt, Human
acaaguaccaaaugcucaagua

SEQ ID NO: 304250 - RNA, 22 nt, Human
uucauagugauuguucagauag

SEQ ID NO: 304251 - RNA, 22 nt, Human
cauucuuauauuuacucauuca

SEQ ID NO: 304252 - RNA, 22 nt, Human
gaagcacauggcugugagcaac

SEQ ID NO: 304253 - RNA, 22 nt, Human
aaggaccuauauugucagagga

SEQ ID NO: 304254 - RNA, 22 nt, Human
aggguggcaccuggaagggaug

SEQ ID NO: 304255 - RNA, 22 nt, Human
aaagcuuuucaguauguucaug

SEQ ID NO: 304256 - RNA, 22 nt, Human
uuccuucuauucagcuccaaga

SEQ ID NO: 304257 - RNA, 22 nt, Human
guacuaagucaggagaagaauu

SEQ ID NO: 304258 - RNA, 22 nt, Human
auccugaagcaugaaugucaaa

SEQ ID NO: 304259 - RNA, 22 nt, Human
cccugcagcauucucuaacugg

SEQ ID NO: 304260 - RNA, 22 nt, Human
ucagagaguuuucacuagggug

SEQ ID NO: 304261 - RNA, 19 nt, Human
cuggguccuguucuuuuac

SEQ ID NO: 304262 - RNA, 22 nt, Human
cagggcucuucaucacacagua

SEQ ID NO: 304263 - RNA, 22 nt, Human
gaggcuggaggucaaagaugaa

SEQ ID NO: 304264 - RNA, 20 nt, Human
agcugcaacagacuguaugg

SEQ ID NO: 304265 - RNA, 22 nt, Human
cuggguguucacccgaggcgcu

SEQ ID NO: 304266 - RNA, 22 nt, Human
uccaggcagucauuaaucucua

SEQ ID NO: 304267 - RNA, 22 nt, Human
uuuauauguuuguacaauuaag

SEQ ID NO: 304268 - RNA, 22 nt, Human
cauagcuuagggguuaaacuca

SEQ ID NO: 304269 - RNA, 22 nt, Human
ucuugccucuuccccuuuccau

SEQ ID NO: 304270 - RNA, 22 nt, Human
acagaaagauaggcacaagguc

SEQ ID NO: 304271 - RNA, 22 nt, Human
agguggggaggagugucucuuu

SEQ ID NO: 304272 - RNA, 22 nt, Human
uucccagaaugaauggauggag

SEQ ID NO: 304273 - RNA, 22 nt, Human
acaggugucugcaaguuacugg

SEQ ID NO: 304274 - RNA, 22 nt, Human
aguggaggcacuaauuggauuu

SEQ ID NO: 304275 - RNA, 22 nt, Human
gacagaggagaagaugcugugg

SEQ ID NO: 304276 - RNA, 22 nt, Human
uuuaucuuuaggacuuugcaga

SEQ ID NO: 304277 - RNA, 22 nt, Human
uuuccuuccuaaggugaagcaa

SEQ ID NO: 304278 - RNA, 22 nt, Human
ucauuuguugcuguuaccugag

SEQ ID NO: 304279 - RNA, 21 nt, Human
ucagagagucacagugaacug

SEQ ID NO: 304280 - RNA, 22 nt, Human
caaauagugucacauugugagg

SEQ ID NO: 304281 - RNA, 22 nt, Human
acagguguaugaauauguucca

SEQ ID NO: 304282 - RNA, 22 nt, Human
auuugcuugugcuaugaaaguu

SEQ ID NO: 304283 - RNA, 22 nt, Human
agggcucccgugaggugacugc

SEQ ID NO: 304284 - RNA, 22 nt, Human
uuucaguuuccagcuuugucau

SEQ ID NO: 304285 - RNA, 22 nt, Human
uacaucauaauaauacuuagaa

SEQ ID NO: 304286 - RNA, 22 nt, Human
auucuucaccauggauaauuug

SEQ ID NO: 304287 - RNA, 22 nt, Human
gacuuuggcaucuagacauugu

SEQ ID NO: 304288 - RNA, 22 nt, Human
auccuucuucugcuagugucua

SEQ ID NO: 304289 - RNA, 22 nt, Human
uauuuaaaauaagccccagugg

SEQ ID NO: 304290 - RNA, 22 nt, Human
cagggcagagggaaacuccuuu

SEQ ID NO: 304291 - RNA, 18 nt, Human
uaugugucuguuacaacu

SEQ ID NO: 304292 - RNA, 22 nt, Human
uugaacauuggcaauuucauau

SEQ ID NO: 304293 - RNA, 22 nt, Human
aguguccuggggcccuaaggcc

SEQ ID NO: 304294 - RNA, 22 nt, Human
ugcaaaaacugcaauugcuuuu

SEQ ID NO: 304295 - RNA, 22 nt, Human
cuguccucaccuuggcaggggg

SEQ ID NO: 304296 - RNA, 22 nt, Human
caugcagcagaauaaugacuau

SEQ ID NO: 304297 - RNA, 22 nt, Human
aagggcagcuauuaucgucauc

SEQ ID NO: 304298 - RNA, 23 nt, Human
uacuauaacgcugugucagcucc

SEQ ID NO: 304299 - RNA, 22 nt, Human
agauugaauauagagauucuug

SEQ ID NO: 304300 - RNA, 22 nt, Human
cuugaagaaaguauguugggau

SEQ ID NO: 304301 - RNA, 23 nt, Human
auaguuuucccugguucuugcca

SEQ ID NO: 304302 - RNA, 18 nt, Human
aauuuccauaugaauugc

SEQ ID NO: 304303 - RNA, 22 nt, Human
ccucccucccucuuaugguuua

SEQ ID NO: 304304 - RNA, 20 nt, Human
ugcagggccuaaaaagggaa

SEQ ID NO: 304305 - RNA, 22 nt, Human
agauggucuaguugaaccauau

SEQ ID NO: 304306 - RNA, 22 nt, Human
ucagguguuuaaggauagugau

SEQ ID NO: 304307 - RNA, 22 nt, Human
aauacuuaugugaccucauuuu

SEQ ID NO: 304308 - RNA, 22 nt, Human
aagggcucucugcauugaaauu

SEQ ID NO: 304309 - RNA, 22 nt, Human
gaggugucacuauuuugcuuau

SEQ ID NO: 304310 - RNA, 22 nt, Human
caaauucucaagguuuauccca

SEQ ID NO: 304311 - RNA, 22 nt, Human
aauauuuguuaguguuuuaaug

SEQ ID NO: 304312 - RNA, 19 nt, Human
guuucauuaagauaggaaa

SEQ ID NO: 304313 - RNA, 22 nt, Human
ucagggcaggcgagcagcugcu

SEQ ID NO: 304314 - RNA, 22 nt, Human
uccuccuucgggacugcuugac

SEQ ID NO: 304315 - RNA, 22 nt, Human
ccagagaguaggaggcauuauu

SEQ ID NO: 304316 - RNA, 22 nt, Human
acagguguuuuggaggaugauu

SEQ ID NO: 304317 - RNA, 22 nt, Human
ggcaggcauggccacucccuag

SEQ ID NO: 304318 - RNA, 22 nt, Human
uuucacauaugguuguugauug

SEQ ID NO: 304319 - RNA, 19 nt, Human
uuuacucuccaaggugagu

SEQ ID NO: 304320 - RNA, 22 nt, Human
accaggcaugauguggagcaca

SEQ ID NO: 304321 - RNA, 22 nt, Human
cuggaggaccacagaagcuggu

SEQ ID NO: 304322 - RNA, 21 nt, Human
cuguccucagauguggacgag

SEQ ID NO: 304323 - RNA, 22 nt, Human
gcuggccugggcagccugucgg

SEQ ID NO: 304324 - RNA, 22 nt, Human
ugucaaagacagaaggaaaugg

SEQ ID NO: 304325 - RNA, 23 nt, Human
gguuccaggaacacagccugaug

SEQ ID NO: 304326 - RNA, 22 nt, Human
ucuguagcauucaccagcccug

SEQ ID NO: 304327 - RNA, 22 nt, Human
aggccagaacagcucugcacca

SEQ ID NO: 304328 - RNA, 22 nt, Human
acagggagucugaggggauagu

SEQ ID NO: 304329 - RNA, 22 nt, Human
uggaaauaguugugagucaggc

SEQ ID NO: 304330 - RNA, 22 nt, Human
gggcugagggguaucucauggg

SEQ ID NO: 304331 - RNA, 22 nt, Human
ccagcagcucccucaggguccg

SEQ ID NO: 304332 - RNA, 22 nt, Human
agggggcuccuuggugugcaga

SEQ ID NO: 304333 - RNA, 22 nt, Human
ucaggagaguguucaguggagg

SEQ ID NO: 304334 - RNA, 22 nt, Human
uaguggggaaggaggacaagaa

SEQ ID NO: 304335 - RNA, 22 nt, Human
agcaccagcucaaggugcaccu

SEQ ID NO: 304336 - RNA, 18 nt, Human
aguaaauguuaaauauug

SEQ ID NO: 304337 - RNA, 22 nt, Human
aggcaguggcuuuuguuguguu

SEQ ID NO: 304338 - RNA, 22 nt, Human
agacaagagcugaggacauauu

SEQ ID NO: 304339 - RNA, 22 nt, Human
agcggcgccggagggaggugcg

SEQ ID NO: 304340 - RNA, 22 nt, Human
ggcaguggugggaggcucgcuc

SEQ ID NO: 304341 - RNA, 22 nt, Human
gggcuggagagucccacguggg

SEQ ID NO: 304342 - RNA, 21 nt, Human
uuucaagggacccuggggauc

SEQ ID NO: 304343 - RNA, 22 nt, Human
aacccaggguggagguugcagu

SEQ ID NO: 304344 - RNA, 20 nt, Human
ggccugagcauggcuggcag

SEQ ID NO: 304345 - RNA, 22 nt, Human
aagaagguugaaugacuacuuu

SEQ ID NO: 304346 - RNA, 22 nt, Human
uggcggugacggcggcgccugg

SEQ ID NO: 304347 - RNA, 22 nt, Human
ugaggagcaggguggcuuacuc

SEQ ID NO: 304348 - RNA, 22 nt, Human
acuuggucguggugcagcaugg

SEQ ID NO: 304349 - RNA, 20 nt, Human
acuagaaagucacugggggg

SEQ ID NO: 304350 - RNA, 22 nt, Human
aauuagaagcuguuagcaaaau

SEQ ID NO: 304351 - RNA, 22 nt, Human
cuucagggaggagcauggguuc

SEQ ID NO: 304352 - RNA, 22 nt, Human
gggagcugagcuggaagagaau

SEQ ID NO: 304353 - RNA, 22 nt, Human
ucugggccggagccgacggcag

SEQ ID NO: 304354 - RNA, 22 nt, Human
gccagaggggcucgaaggcgcg

SEQ ID NO: 304355 - RNA, 22 nt, Human
gacggggcagccagcugguggc

SEQ ID NO: 304356 - RNA, 22 nt, Human
guggccuccuccguccgccucu

SEQ ID NO: 304357 - RNA, 22 nt, Human
cagcgguggcaaggugacugug

SEQ ID NO: 304358 - RNA, 22 nt, Human
uggcugaguuacgaacagagca

SEQ ID NO: 304359 - RNA, 22 nt, Human
aacacauggcaagagcaggaaa

SEQ ID NO: 304360 - RNA, 22 nt, Human
gcccagcaccucucucaggguu

SEQ ID NO: 304361 - RNA, 18 nt, Human
uggggggcuugucugaag

SEQ ID NO: 304362 - RNA, 22 nt, Human
gacggagcugguugcugcggcu

SEQ ID NO: 304363 - RNA, 22 nt, Human
uagggggcuuugcugcuugaca

SEQ ID NO: 304364 - RNA, 22 nt, Human
uagaaagagcuuugcuuccuuu

SEQ ID NO: 304365 - RNA, 22 nt, Human
aaagcagaacugagagagcugg

SEQ ID NO: 304366 - RNA, 22 nt, Human
gaaagcagaugaaauugcaaca

SEQ ID NO: 304367 - RNA, 22 nt, Human
auugagaaaauucgagcaaguu

SEQ ID NO: 304368 - RNA, 22 nt, Human
aggggagguguccccaaaucuc

SEQ ID NO: 304369 - RNA, 22 nt, Human
aguggcugugaaauacauggga

SEQ ID NO: 304370 - RNA, 22 nt, Human
aaggcacauauuuuagagucac

SEQ ID NO: 304371 - RNA, 21 nt, Human
uacaucaguuuucuuggcuca

SEQ ID NO: 304372 - RNA, 23 nt, Human
ggucccaguggagaggccucacc

SEQ ID NO: 304373 - RNA, 22 nt, Human
gagggcugccacguugggcgag

SEQ ID NO: 304374 - RNA, 22 nt, Human
uggcagaaugaagacuggggcc

SEQ ID NO: 304375 - RNA, 22 nt, Human
ucagaagcauguggggagccug

SEQ ID NO: 304376 - RNA, 22 nt, Human
aaagcacauuacaagcucaguc

SEQ ID NO: 304377 - RNA, 23 nt, Human
aaacuacauuuauaguuuuucuc

SEQ ID NO: 304378 - RNA, 22 nt, Human
aggcaguguggagggcuguugc

SEQ ID NO: 304379 - RNA, 22 nt, Human
aggcugagccugggcguggugg

SEQ ID NO: 304380 - RNA, 22 nt, Human
uuucgagggauuagcuaggacu

SEQ ID NO: 304381 - RNA, 22 nt, Human
uguggccaccagagcugcuauu

SEQ ID NO: 304382 - RNA, 22 nt, Human
ugagaagcaguuucaguaagaa

SEQ ID NO: 304383 - RNA, 22 nt, Human
aggcggcuccgggagugugggc

SEQ ID NO: 304384 - RNA, 22 nt, Human
gugcuggggagauaggaagaga

SEQ ID NO: 304385 - RNA, 22 nt, Human
gugcugagugcagagugcagag

SEQ ID NO: 304386 - RNA, 22 nt, Human
uagaaaagccccagcuggaggg

SEQ ID NO: 304387 - RNA, 22 nt, Human
agcucagaacugcagacaugug

SEQ ID NO: 304388 - RNA, 22 nt, Human
ggaaggggagcuggaaagggua

SEQ ID NO: 304389 - RNA, 22 nt, Human
cagguuagcaacaugguuagag

SEQ ID NO: 304390 - RNA, 22 nt, Human
uccaaggucagcgagagucacu

SEQ ID NO: 304391 - RNA, 22 nt, Human
gaacugcauugugguauauguu

SEQ ID NO: 304392 - RNA, 22 nt, Human
gggcagcaaaucugagucuggu

SEQ ID NO: 304393 - RNA, 22 nt, Human
ugggugguugcugaggcuccuu

SEQ ID NO: 304394 - RNA, 22 nt, Human
ggcggcgcguagccggagacuu

SEQ ID NO: 304395 - RNA, 22 nt, Human
auuaguagcacacagagaucag

SEQ ID NO: 304396 - RNA, 22 nt, Human
aggucacguccugugaugucau

SEQ ID NO: 304397 - RNA, 22 nt, Human
auggucacuucacccaugagcu

SEQ ID NO: 304398 - RNA, 22 nt, Human
agacagcgaggacagaggggug

SEQ ID NO: 304399 - RNA, 22 nt, Human
ggcucagaggagcuggaacggu

SEQ ID NO: 304400 - RNA, 22 nt, Human
gggcagcaggcuccacguuccu

SEQ ID NO: 304401 - RNA, 22 nt, Human
cgggcagugcccagcggggcag

SEQ ID NO: 304402 - RNA, 22 nt, Human
aggagucaccugcccaaaguca

SEQ ID NO: 304403 - RNA, 22 nt, Human
uuagaaaucaccucugaagauc

SEQ ID NO: 304404 - RNA, 22 nt, Human
gguagccaauuuaaacauuucc

SEQ ID NO: 304405 - RNA, 22 nt, Human
gcugggcccugggugcccuagc

SEQ ID NO: 304406 - RNA, 22 nt, Human
uggcugaggcacagcugccgcc

SEQ ID NO: 304407 - RNA, 22 nt, Human
caaagaagagauuuacagagcu

SEQ ID NO: 304408 - RNA, 22 nt, Human
aagcaacuaaggcaaggaaaug

SEQ ID NO: 304409 - RNA, 22 nt, Human
ggcacuggcaaagcaaagucug

SEQ ID NO: 304410 - RNA, 22 nt, Human
gcaggguaggugacagguaguc

SEQ ID NO: 304411 - RNA, 22 nt, Human
aacagaaaucauuuagggcucu

SEQ ID NO: 304412 - RNA, 22 nt, Human
agaguggagagaaacaacucug

SEQ ID NO: 304413 - RNA, 18 nt, Human
uaaguggacacaggucac

SEQ ID NO: 304414 - RNA, 22 nt, Human
acucgcggcggacggcggccag

SEQ ID NO: 304415 - RNA, 22 nt, Human
gggagggcuuggacccagaugu

SEQ ID NO: 304416 - RNA, 22 nt, Human
gcacagagagcagugggggaca

SEQ ID NO: 304417 - RNA, 22 nt, Human
uggcugaggcuuuucuuaaaga

SEQ ID NO: 304418 - RNA, 20 nt, Human
gaacagucuucugagccaca

SEQ ID NO: 304419 - RNA, 22 nt, Human
cccaggucgucagcaguguggu

SEQ ID NO: 304420 - RNA, 22 nt, Human
uuggaggaagcucaugggggau

SEQ ID NO: 304421 - RNA, 22 nt, Human
aaggggggcaccugcaugcccg

SEQ ID NO: 304422 - RNA, 22 nt, Human
ucaggggacagccagcuggagg

SEQ ID NO: 304423 - RNA, 22 nt, Human
ucagaggagcaaaagaggggau

SEQ ID NO: 304424 - RNA, 22 nt, Human
cggcagcgguuggagguuguag

SEQ ID NO: 304425 - RNA, 22 nt, Human
cggcgcaggcagaccgcgggcu

SEQ ID NO: 304426 - RNA, 22 nt, Human
cagcccaggacugcagguguuu

SEQ ID NO: 304427 - RNA, 22 nt, Human
acugggccaggugugggugagu

SEQ ID NO: 304428 - RNA, 22 nt, Human
cagcaguguacaaggugucaga

SEQ ID NO: 304429 - RNA, 22 nt, Human
gggaggugauuaggaccaugua

SEQ ID NO: 304430 - RNA, 22 nt, Human
cuugaggcugcacuccagggcc

SEQ ID NO: 304431 - RNA, 22 nt, Human
gccuggagcucggcugagggcg

SEQ ID NO: 304432 - RNA, 22 nt, Human
ugagacaaagcagcugacagaa

SEQ ID NO: 304433 - RNA, 22 nt, Human
acauucucuuuuagaaagcugu

SEQ ID NO: 304434 - RNA, 23 nt, Human
uacugggcagcugcucugacacc

SEQ ID NO: 304435 - RNA, 22 nt, Human
gcaggaguguggugggacaucc

SEQ ID NO: 304436 - RNA, 22 nt, Human
gcagauggauguggacggcgcc

SEQ ID NO: 304437 - RNA, 22 nt, Human
aggccgugugagcaugugugag

SEQ ID NO: 304438 - RNA, 22 nt, Human
ggcuguggucauuaggagguug

SEQ ID NO: 304439 - RNA, 22 nt, Human
cuggagggcugcagcgaggcug

SEQ ID NO: 304440 - RNA, 22 nt, Human
gcagcagaaggccaaggggagc

SEQ ID NO: 304441 - RNA, 23 nt, Human
augcaacauugccaguaugggca

SEQ ID NO: 304442 - RNA, 20 nt, Human
gggugugugcagggccuggu

SEQ ID NO: 304443 - RNA, 22 nt, Human
cugcaccgugucucgggcugcc

SEQ ID NO: 304444 - RNA, 22 nt, Human
ugaaagaagccucccuuuggag

SEQ ID NO: 304445 - RNA, 22 nt, Human
gggcggggcuuccguccuccac

SEQ ID NO: 304446 - RNA, 22 nt, Human
accuggaggcagagguugcagu

SEQ ID NO: 304447 - RNA, 22 nt, Human
aaauacaguggcagcagauaau

SEQ ID NO: 304448 - RNA, 22 nt, Human
gaagcgcggcgucggcgugggu

SEQ ID NO: 304449 - RNA, 19 nt, Human
gcagcugugggaagagcca

SEQ ID NO: 304450 - RNA, 18 nt, Human
gcugaaauucuaaacaaa

SEQ ID NO: 304451 - RNA, 22 nt, Human
agccccaguucccuggaagucu

SEQ ID NO: 304452 - RNA, 22 nt, Human
uaaccaagcaaacuuucauugu

SEQ ID NO: 304453 - RNA, 20 nt, Human
ugcuggaggcgccggcgcuc

SEQ ID NO: 304454 - RNA, 22 nt, Human
gcugaagagagaugcguccagc

SEQ ID NO: 304455 - RNA, 22 nt, Human
guggcgcagaggguggcagaga

SEQ ID NO: 304456 - RNA, 22 nt, Human
uagcaccggcagugguaggugc

SEQ ID NO: 304457 - RNA, 22 nt, Human
aggggcuuguggaguugcuggu

SEQ ID NO: 304458 - RNA, 22 nt, Human
aggcugagguaggaggaucgcu

SEQ ID NO: 304459 - RNA, 22 nt, Human
gggggcgccgccgcucaucuca

SEQ ID NO: 304460 - RNA, 22 nt, Human
caggcgggcaggugcggccccu

SEQ ID NO: 304461 - RNA, 18 nt, Human
acagggagggcgcugggg

SEQ ID NO: 304462 - RNA, 20 nt, Human
aggggcaccugcgacggggc

SEQ ID NO: 304463 - RNA, 22 nt, Human
ggccgcggauuuucccgcuggc

SEQ ID NO: 304464 - RNA, 22 nt, Human
aagcgcagacacagagagugga

SEQ ID NO: 304465 - RNA, 21 nt, Human
gcaaccagaccacagggcagu

SEQ ID NO: 304466 - RNA, 22 nt, Human
aaggggaguuagugauaaaacc

SEQ ID NO: 304467 - RNA, 23 nt, Human
ggaggcacuuaggcagagcagag

SEQ ID NO: 304468 - RNA, 22 nt, Human
uggcugggagcuggaacugggc

SEQ ID NO: 304469 - RNA, 22 nt, Human
agccaccaccacugaaagguua

SEQ ID NO: 304470 - RNA, 23 nt, Human
guguggccccagggccuccucgc

SEQ ID NO: 304471 - RNA, 20 nt, Human
gcagcagacagacaggggac

SEQ ID NO: 304472 - RNA, 18 nt, Human
uucggcagauacgcuugg

SEQ ID NO: 304473 - RNA, 15 nt, Human
uggugguguugagac

SEQ ID NO: 304474 - RNA, 22 nt, Human
agaaaagaggcuuucuaagcau

SEQ ID NO: 304475 - RNA, 22 nt, Human
ggaaugcacuagacugugaaac

SEQ ID NO: 304476 - RNA, 22 nt, Human
ggcacugggugagggucacugg

SEQ ID NO: 304477 - RNA, 22 nt, Human
gaggugaguggggucuccaggg

SEQ ID NO: 304478 - RNA, 22 nt, Human
ccaagaggggaagggccgcagc

SEQ ID NO: 304479 - RNA, 22 nt, Human
ggcggugguugagaggacggcg

SEQ ID NO: 304480 - RNA, 22 nt, Human
ccugugguuuacucuguggcua

SEQ ID NO: 304481 - RNA, 19 nt, Human
cccuggaggaguguuggcu

SEQ ID NO: 304482 - RNA, 22 nt, Human
ggugggugagcccugggagcug

SEQ ID NO: 304483 - RNA, 22 nt, Human
ggcuggccuguguggccgccac

SEQ ID NO: 304484 - RNA, 22 nt, Human
acugagaacuuggggacagagg

SEQ ID NO: 304485 - RNA, 22 nt, Human
gagcaacacauugaaugaggau

SEQ ID NO: 304486 - RNA, 22 nt, Human
gagucgagcagaaagccgucgg

SEQ ID NO: 304487 - RNA, 22 nt, Human
guggaaauuuuaggaucaucuu

SEQ ID NO: 304488 - RNA, 22 nt, Human
aggggagccagggcugcgaguu

SEQ ID NO: 304489 - RNA, 22 nt, Human
agcaccaggucgcuggcacgcu

SEQ ID NO: 304490 - RNA, 22 nt, Human
acagcugggaacucacacagca

SEQ ID NO: 304491 - RNA, 22 nt, Human
ucggagcgucacuggcuggagg

SEQ ID NO: 304492 - RNA, 17 nt, Human
uaagggggaaacggagc

SEQ ID NO: 304493 - RNA, 22 nt, Human
cuucagggguguuaguuuugug

SEQ ID NO: 304494 - RNA, 22 nt, Human
gcccagcgagcagagguggacg

SEQ ID NO: 304495 - RNA, 22 nt, Human
acaugggcaucuaugaggcucu

SEQ ID NO: 304496 - RNA, 22 nt, Human
gcggggccauguccaacggccu

SEQ ID NO: 304497 - RNA, 22 nt, Human
ccagagacaaggagcuggaguc

SEQ ID NO: 304498 - RNA, 22 nt, Human
aggcaguguguagcuggaagag

SEQ ID NO: 304499 - RNA, 22 nt, Human
auggugguagaagcacuaugug

SEQ ID NO: 304500 - RNA, 22 nt, Human
cagagguagccgagugcaaucg

SEQ ID NO: 304501 - RNA, 22 nt, Human
uacugcugagcuggguagaagg

SEQ ID NO: 304502 - RNA, 23 nt, Human
agcaacagugggugaguguugcu

SEQ ID NO: 304503 - RNA, 21 nt, Human
ccuguggugccagaucgccag

SEQ ID NO: 304504 - RNA, 22 nt, Human
aaugagaauguaagugaagaga

SEQ ID NO: 304505 - RNA, 22 nt, Human
gaaaauaguucaucacaaugau

SEQ ID NO: 304506 - RNA, 22 nt, Human
uggaaauacaagaaguauguca

SEQ ID NO: 304507 - RNA, 22 nt, Human
cagggagcuggugccagccgac

SEQ ID NO: 304508 - RNA, 22 nt, Human
uggcugagugaacauguccauu

SEQ ID NO: 304509 - RNA, 22 nt, Human
ccaagcuggacagcagcaagga

SEQ ID NO: 304510 - RNA, 22 nt, Human
agcagcaggugaccucgaugcc

SEQ ID NO: 304511 - RNA, 22 nt, Human
ucaaagcacuggggaaagccug

SEQ ID NO: 304512 - RNA, 22 nt, Human
cagggagccccaauuccaugcc

SEQ ID NO: 304513 - RNA, 22 nt, Human
gcaguggccacauggaggagga

SEQ ID NO: 304514 - RNA, 22 nt, Human
ugagaacaaaguugaaaguuug

SEQ ID NO: 304515 - RNA, 22 nt, Human
cagaaccaggaacugauggaga

SEQ ID NO: 304516 - RNA, 22 nt, Human
ugguuugcccacucgagugauu

SEQ ID NO: 304517 - RNA, 21 nt, Human
uuucaauguguucuuuguagu

SEQ ID NO: 304518 - RNA, 22 nt, Human
uaaugcuuaacagcuggcuuuu

SEQ ID NO: 304519 - RNA, 22 nt, Human
acugucucucuagcaguucagg

SEQ ID NO: 304520 - RNA, 22 nt, Human
gcuggccuugugucugaggaag

SEQ ID NO: 304521 - RNA, 22 nt, Human
uuggccuucccuaccugggcca

SEQ ID NO: 304522 - RNA, 22 nt, Human
ccugggagagucuguggucucc

SEQ ID NO: 304523 - RNA, 22 nt, Human
gucauuucuguuucuucagugc

SEQ ID NO: 304524 - RNA, 22 nt, Human
ccaccagcuucagcagccgcgg

SEQ ID NO: 304525 - RNA, 22 nt, Human
gcuggaggcaguucagacacca

SEQ ID NO: 304526 - RNA, 22 nt, Human
ugcugaggcccaggagcacuuu

SEQ ID NO: 304527 - RNA, 22 nt, Human
augaacugcaguauaaacuugg

SEQ ID NO: 304528 - RNA, 22 nt, Human
auagucuuagucuauaguuuug

SEQ ID NO: 304529 - RNA, 22 nt, Human
acuuucucaaaucagacuuuaa

SEQ ID NO: 304530 - RNA, 22 nt, Human
uauuuccaaaagccuauuauga

SEQ ID NO: 304531 - RNA, 22 nt, Human
uguuagaaauuauuaguaauau

SEQ ID NO: 304532 - RNA, 22 nt, Human
aggggagccccugguccuggug

SEQ ID NO: 304533 - RNA, 22 nt, Human
gagccaggucgggccgcggcga

SEQ ID NO: 304534 - RNA, 22 nt, Human
guugacagcuggugagcugcua

SEQ ID NO: 304535 - RNA, 22 nt, Human
acucuugucucaacuuuuguau

SEQ ID NO: 304536 - RNA, 21 nt, Human
cagaggcugagagggcaaucu

SEQ ID NO: 304537 - RNA, 22 nt, Human
uugcauugauguuccuucuugc

SEQ ID NO: 304538 - RNA, 18 nt, Human
cugaggcuggcaggagcc

SEQ ID NO: 304539 - RNA, 22 nt, Human
cauuuacuguugaaucccuagc

SEQ ID NO: 304540 - RNA, 22 nt, Human
uaaauuaugucacaugacucug

SEQ ID NO: 304541 - RNA, 22 nt, Human
ucuggggguuaagugaggacaa

SEQ ID NO: 304542 - RNA, 22 nt, Human
cauuaucugccauugacaccau

SEQ ID NO: 304543 - RNA, 22 nt, Human
ucaaggaggugcuuggcuucac

SEQ ID NO: 304544 - RNA, 22 nt, Human
gggacaggccccucgcuagcuu

SEQ ID NO: 304545 - RNA, 22 nt, Human
cucaguuucugacauuaaaauc

SEQ ID NO: 304546 - RNA, 22 nt, Human
cagagcugucauuugccaguga

SEQ ID NO: 304547 - RNA, 22 nt, Human
gaggcagcuuggggcugugggu

SEQ ID NO: 304548 - RNA, 17 nt, Human
ccuguguuugcuccuuc

SEQ ID NO: 304549 - RNA, 22 nt, Human
caggccucaggggcucaggcug

SEQ ID NO: 304550 - RNA, 22 nt, Human
cugagaggcacaaggcauuucg

SEQ ID NO: 304551 - RNA, 22 nt, Human
ucagagugcagcgggaggcugg

SEQ ID NO: 304552 - RNA, 22 nt, Human
aaggacagaaacagauugcugg

SEQ ID NO: 304553 - RNA, 22 nt, Human
gugguguaggucacaguuagga

SEQ ID NO: 304554 - RNA, 22 nt, Human
guggcucuaggugagcauggag

SEQ ID NO: 304555 - RNA, 22 nt, Human
accaggcuggagugcaguggcg

SEQ ID NO: 304556 - RNA, 22 nt, Human
acagcucucccucagagaaaug

SEQ ID NO: 304557 - RNA, 21 nt, Human
gcagacugcccugcugucccc

SEQ ID NO: 304558 - RNA, 22 nt, Human
cugaaggaagcagguggccugu

SEQ ID NO: 304559 - RNA, 22 nt, Human
cugagggccuuggcuccugccc

SEQ ID NO: 304560 - RNA, 22 nt, Human
aggugaguuacaggaggagguc

SEQ ID NO: 304561 - RNA, 22 nt, Human
acagcagccugcagcccugugu

SEQ ID NO: 304562 - RNA, 22 nt, Human
ggccuuggugcucuguguugca

SEQ ID NO: 304563 - RNA, 22 nt, Human
cuuggcagagggcugggcucag

SEQ ID NO: 304564 - RNA, 22 nt, Human
gcuuuggagccuguguucugcc

SEQ ID NO: 304565 - RNA, 22 nt, Human
aggcacugacagauucuguguc

SEQ ID NO: 304566 - RNA, 22 nt, Human
agggggugaucaaggugcggcg

SEQ ID NO: 304567 - RNA, 22 nt, Human
auugagaauccauuugagauga

SEQ ID NO: 304568 - RNA, 22 nt, Human
uucuuauagaagcaaccauugu

SEQ ID NO: 304569 - RNA, 22 nt, Human
guucuugccagcauccucaggu

SEQ ID NO: 304570 - RNA, 18 nt, Human
uggguggcuagggaguuu

SEQ ID NO: 304571 - RNA, 19 nt, Human
uacuuuuucaggacagagu

SEQ ID NO: 304572 - RNA, 22 nt, Human
ucacguuuuacugagugagaua

SEQ ID NO: 304573 - RNA, 22 nt, Human
uucuugauuucaugcaguuaag

SEQ ID NO: 304574 - RNA, 22 nt, Human
uauuccaguucaccuuuucauc

SEQ ID NO: 304575 - RNA, 22 nt, Human
agcucccagucuccucuccaug

SEQ ID NO: 304576 - RNA, 22 nt, Human
ugggagaacccagggucaggcu

SEQ ID NO: 304577 - RNA, 22 nt, Human
cagggccuuuuagcaucuucuc

SEQ ID NO: 304578 - RNA, 22 nt, Human
uuccaagaguaaauucaaauug

SEQ ID NO: 304579 - RNA, 21 nt, Human
ccuguucacagaucuguaacu

SEQ ID NO: 304580 - RNA, 22 nt, Human
uaaaguuuggcagacaauaaca

SEQ ID NO: 304581 - RNA, 22 nt, Human
agaauaaaucaaauguccugag

SEQ ID NO: 304582 - RNA, 22 nt, Human
ccaggacuuuaaguccagcacu

SEQ ID NO: 304583 - RNA, 22 nt, Human
cagagcucuauguucauggagg

SEQ ID NO: 304584 - RNA, 22 nt, Human
agaggcugaaugaugucaucau

SEQ ID NO: 304585 - RNA, 22 nt, Human
uguauaaaccauggacagcuuu

SEQ ID NO: 304586 - RNA, 22 nt, Human
uacuuacacagcuguagaaggu

SEQ ID NO: 304587 - RNA, 22 nt, Human
uggagccaugccuggccuuucc

SEQ ID NO: 304588 - RNA, 23 nt, Human
caugggagugagaaugccagcuc

SEQ ID NO: 304589 - RNA, 22 nt, Human
gaggcagcaucuauggugggaa

SEQ ID NO: 304590 - RNA, 22 nt, Human
ucaguguuaaucagugguaccu

SEQ ID NO: 304591 - RNA, 22 nt, Human
uuucuucugagaucagggagaa

SEQ ID NO: 304592 - RNA, 22 nt, Human
cagcuuugauucuuucugccau

SEQ ID NO: 304593 - RNA, 23 nt, Human
ugcucugugaauaguuggugacu

SEQ ID NO: 304594 - RNA, 20 nt, Human
uacauucaaaacaaacucug

SEQ ID NO: 304595 - RNA, 18 nt, Human
uccuccuuuggccuuuuc

SEQ ID NO: 304596 - RNA, 23 nt, Human
ugagcugguauuguccaucucca

SEQ ID NO: 304597 - RNA, 22 nt, Human
agggcagcuagcuguagaaaga

SEQ ID NO: 304598 - RNA, 22 nt, Human
uccagugguuugaaaggggugu

SEQ ID NO: 304599 - RNA, 23 nt, Human
gcucugagggcuuaucccuccca

SEQ ID NO: 304600 - RNA, 22 nt, Human
auuuuucucuuuccacugagau

SEQ ID NO: 304601 - RNA, 22 nt, Human
ugaagccaucaggaagccagca

SEQ ID NO: 304602 - RNA, 22 nt, Human
gccuucugauaucucuuggcau

SEQ ID NO: 304603 - RNA, 22 nt, Human
ugcugggcuugaaagcugcuaa

SEQ ID NO: 304604 - RNA, 22 nt, Human
ugcuccuuccucauccugugca

SEQ ID NO: 304605 - RNA, 22 nt, Human
aaagccuucaaguagauguaag

SEQ ID NO: 304606 - RNA, 22 nt, Human
accugccuaguugguucugccc

SEQ ID NO: 304607 - RNA, 22 nt, Human
uagugcacacgcauguagcagu

SEQ ID NO: 304608 - RNA, 23 nt, Human
gccuucagcucgggaaggcuccc

SEQ ID NO: 304609 - RNA, 22 nt, Human
acaaaggugcgucccuucagcu

SEQ ID NO: 304610 - RNA, 22 nt, Human
ugggcugcugagaaugagagag

SEQ ID NO: 304611 - RNA, 22 nt, Human
cagcagggaagcugugcuguuu

SEQ ID NO: 304612 - RNA, 22 nt, Human
agaggaugauuuuaaggacacu

SEQ ID NO: 304613 - RNA, 22 nt, Human
gaauaguucuauggcugcaggg

SEQ ID NO: 304614 - RNA, 22 nt, Human
aggaaaaagaguugcugccuuc

SEQ ID NO: 304615 - RNA, 22 nt, Human
cacuggaauauggcguugaacc

SEQ ID NO: 304616 - RNA, 22 nt, Human
gucagugucuuaacagagauua

SEQ ID NO: 304617 - RNA, 22 nt, Human
aaggaagguucauagucaaaga

SEQ ID NO: 304618 - RNA, 22 nt, Human
ggcuggcacugaggagagcucu

SEQ ID NO: 304619 - RNA, 22 nt, Human
cccucugccugcgcccuggugu

SEQ ID NO: 304620 - RNA, 22 nt, Human
aggcaaaauuacaaaguuauua

SEQ ID NO: 304621 - RNA, 22 nt, Human
aaaauucugucauuaaauugug

SEQ ID NO: 304622 - RNA, 22 nt, Human
uccucugccaaagggaguugcc

SEQ ID NO: 304623 - RNA, 22 nt, Human
uuuaacuuagaagagauauccu

SEQ ID NO: 304624 - RNA, 22 nt, Human
uucccaugccuggccccuaucc

SEQ ID NO: 304625 - RNA, 23 nt, Human
gaagcagaugucugaguaggcag

SEQ ID NO: 304626 - RNA, 22 nt, Human
uuguuuugcuaaagggucauca

SEQ ID NO: 304627 - RNA, 22 nt, Human
cuggagcuggcuuccuuccacu

SEQ ID NO: 304628 - RNA, 22 nt, Human
agagcacagaaguuauauguua

SEQ ID NO: 304629 - RNA, 22 nt, Human
cacauuugaaggaauuagcauu

SEQ ID NO: 304630 - RNA, 22 nt, Human
gaggaccacagaugagccugca

SEQ ID NO: 304631 - RNA, 22 nt, Human
acacagggcugcgccugacccc

SEQ ID NO: 304632 - RNA, 22 nt, Human
uggagcugaacuuugaggccag

SEQ ID NO: 304633 - RNA, 22 nt, Human
gcacugcagccucagauggugg

SEQ ID NO: 304634 - RNA, 22 nt, Human
uuacauuagacccacuuucaug

SEQ ID NO: 304635 - RNA, 22 nt, Human
caagaaaugggauuugacugcc

SEQ ID NO: 304636 - RNA, 22 nt, Human
agggccugcaucaggagcuugg

SEQ ID NO: 304637 - RNA, 22 nt, Human
cugccugcuucugagccagagg

SEQ ID NO: 304638 - RNA, 22 nt, Human
acguuuucagugacugugcuuc

SEQ ID NO: 304639 - RNA, 22 nt, Human
accugagccuagggagguugag

SEQ ID NO: 304640 - RNA, 22 nt, Human
gggcagauggggcacaggcuga

SEQ ID NO: 304641 - RNA, 20 nt, Human
uccagcccagguccugccug

SEQ ID NO: 304642 - RNA, 22 nt, Human
gcugcccuaauaucacauguua

SEQ ID NO: 304643 - RNA, 22 nt, Human
agggaugguggagguugcaagu

SEQ ID NO: 304644 - RNA, 22 nt, Human
cugcuguguuccuccugcaucu

SEQ ID NO: 304645 - RNA, 22 nt, Human
ggcucugcuggauugaggccag

SEQ ID NO: 304646 - RNA, 22 nt, Human
cuccagugcuucuagaaaauac

SEQ ID NO: 304647 - RNA, 20 nt, Human
aaaauauguauaacucuucu

SEQ ID NO: 304648 - RNA, 22 nt, Human
cuggcaggcggcagagcccagg

SEQ ID NO: 304649 - RNA, 21 nt, Human
gugcugggacacagccaggcu

SEQ ID NO: 304650 - RNA, 22 nt, Human
gggcugacucugcacugagcca

SEQ ID NO: 304651 - RNA, 22 nt, Human
aggagugcaaauaguccagaga

SEQ ID NO: 304652 - RNA, 22 nt, Human
cugggcugucaauggcccucug

SEQ ID NO: 304653 - RNA, 22 nt, Human
aaauguguuccuuugcuacaga

SEQ ID NO: 304654 - RNA, 21 nt, Human
guggcccugccgcagugucca

SEQ ID NO: 304655 - RNA, 22 nt, Human
ggagacaguauggcuuguagcu

SEQ ID NO: 304656 - RNA, 22 nt, Human
uugacaagaaucguugccuugg

SEQ ID NO: 304657 - RNA, 22 nt, Human
cugugucucuccuuacaagacu

SEQ ID NO: 304658 - RNA, 22 nt, Human
aauucaugaguagaaucuauau

SEQ ID NO: 304659 - RNA, 22 nt, Human
ggguccagaguugaagagguua

SEQ ID NO: 304660 - RNA, 22 nt, Human
ugccugggggacuaaggccaaa

SEQ ID NO: 304661 - RNA, 22 nt, Human
auuauuauuguugauguuaggg

SEQ ID NO: 304662 - RNA, 22 nt, Human
gccugggugaauuugauccuaa

SEQ ID NO: 304663 - RNA, 22 nt, Human
cugcagggcccgccugagcccu

SEQ ID NO: 304664 - RNA, 22 nt, Human
aaaaaugaaacggcugguuggc

SEQ ID NO: 304665 - RNA, 22 nt, Human
uaugcacauucacacaaaaaug

SEQ ID NO: 304666 - RNA, 22 nt, Human
gacagacauuuccugauccaau

SEQ ID NO: 304667 - RNA, 22 nt, Human
cauucauuuacuuucaacagcu

SEQ ID NO: 304668 - RNA, 22 nt, Human
gaaauguuguccugucucuuga

SEQ ID NO: 304669 - RNA, 22 nt, Human
gcagaugaaguuuacaggaaac

SEQ ID NO: 304670 - RNA, 22 nt, Human
gcacagccagcaucugagggau

SEQ ID NO: 304671 - RNA, 22 nt, Human
augacacaauuuuagagcugaa

SEQ ID NO: 304672 - RNA, 22 nt, Human
cugggagcggcugucacugguu

SEQ ID NO: 304673 - RNA, 22 nt, Human
cccuguggcaggaggaggagca

SEQ ID NO: 304674 - RNA, 22 nt, Human
ucccagagcugauaagccuuua

SEQ ID NO: 304675 - RNA, 22 nt, Human
uucucuagguuuuagaugaaga

SEQ ID NO: 304676 - RNA, 22 nt, Human
auuuucaaaacaucugcugugu

SEQ ID NO: 304677 - RNA, 22 nt, Human
aaugaacaaaauaugcuuugca

SEQ ID NO: 304678 - RNA, 22 nt, Human
uccucugcucagcauuccucac

SEQ ID NO: 304679 - RNA, 22 nt, Human
ugccuguguugauuacuuuguc

SEQ ID NO: 304680 - RNA, 22 nt, Human
cugugucccccucagccaggug

SEQ ID NO: 304681 - RNA, 22 nt, Human
guuguuuuuguucucuauagcu

SEQ ID NO: 304682 - RNA, 22 nt, Human
cauggccuugagugacugcacu

SEQ ID NO: 304683 - RNA, 22 nt, Human
ggcucccugccuguccucaguc

SEQ ID NO: 304684 - RNA, 22 nt, Human
agauggagaccuuggaugaacu

SEQ ID NO: 304685 - RNA, 22 nt, Human
uguggaaaagaauaagggagau

SEQ ID NO: 304686 - RNA, 22 nt, Human
cacaagacuuauuuguguagaa

SEQ ID NO: 304687 - RNA, 22 nt, Human
ucaaagagcuauucaguugugg

SEQ ID NO: 304688 - RNA, 22 nt, Human
ugggcccugacuucaagcaucc

SEQ ID NO: 304689 - RNA, 22 nt, Human
caccuggcuggaagugcuccgg

SEQ ID NO: 304690 - RNA, 22 nt, Human
uuugaaucugauauggcagcau

SEQ ID NO: 304691 - RNA, 22 nt, Human
ucugccugagggagcugaggaa

SEQ ID NO: 304692 - RNA, 20 nt, Human
uggagccaaggugugucugg

SEQ ID NO: 304693 - RNA, 18 nt, Human
aaacuggcuuggccugug

SEQ ID NO: 304694 - RNA, 22 nt, Human
ccugagaggcccucucacuguc

SEQ ID NO: 304695 - RNA, 22 nt, Human
caggccugggcuucggggcuga

SEQ ID NO: 304696 - RNA, 22 nt, Human
ugcagaagaauguaggcauaag

SEQ ID NO: 304697 - RNA, 22 nt, Human
ucccuggaacagagagacaacg

SEQ ID NO: 304698 - RNA, 22 nt, Human
ugagagugguucagcucagaag

SEQ ID NO: 304699 - RNA, 23 nt, Human
uuuauccaacucuguaaucucuc

SEQ ID NO: 304700 - RNA, 22 nt, Human
uucuucaaacaaaaguggcaug

SEQ ID NO: 304701 - RNA, 22 nt, Human
agagcuggcugugggugacuuu

SEQ ID NO: 304702 - RNA, 22 nt, Human
cacucaggcugugucaggagga

SEQ ID NO: 304703 - RNA, 22 nt, Human
uuucacaaguuucaggauucug

SEQ ID NO: 304704 - RNA, 22 nt, Human
ugagcccagagcccuuguaggg

SEQ ID NO: 304705 - RNA, 22 nt, Human
uuuccucuucuucccaugucau

SEQ ID NO: 304706 - RNA, 22 nt, Human
uaacuacauuucacugcaauua

SEQ ID NO: 304707 - RNA, 22 nt, Human
uuucaaacauaucuucauuacu

SEQ ID NO: 304708 - RNA, 22 nt, Human
uaggccaguggcagguugugug

SEQ ID NO: 304709 - RNA, 22 nt, Human
aguugcagacgcagagauguug

SEQ ID NO: 304710 - RNA, 22 nt, Human
aagaugauagaucugucaaugu

SEQ ID NO: 304711 - RNA, 22 nt, Human
gcagauggugccaugucuugug

SEQ ID NO: 304712 - RNA, 22 nt, Human
cugcccugcuugaugacagcga

SEQ ID NO: 304713 - RNA, 22 nt, Human
cugaggcucaagggcagguggg

SEQ ID NO: 304714 - RNA, 23 nt, Human
uucucaguccugcccagggaggc

SEQ ID NO: 304715 - RNA, 22 nt, Human
caggggcagucugugugcgugg

SEQ ID NO: 304716 - RNA, 22 nt, Human
ccugccugcguccucugagggc

SEQ ID NO: 304717 - RNA, 22 nt, Human
auccagggauaaaaguaagguu

SEQ ID NO: 304718 - RNA, 23 nt, Human
ucacacagcuggucagguacaga

SEQ ID NO: 304719 - RNA, 22 nt, Human
ucaagagacaggacguguuuca

SEQ ID NO: 304720 - RNA, 22 nt, Human
uuuaaauuauaguuaaugucug

SEQ ID NO: 304721 - RNA, 22 nt, Human
cagcaucuaaucuucaugccgg

SEQ ID NO: 304722 - RNA, 22 nt, Human
aggucaaggccaaaagaguggu

SEQ ID NO: 304723 - RNA, 22 nt, Human
cugggcaguuuuacaucauugc

SEQ ID NO: 304724 - RNA, 22 nt, Human
uggaggcaguaacugagcaaca

SEQ ID NO: 304725 - RNA, 22 nt, Human
uuugucagucaugucugcuuuu

SEQ ID NO: 304726 - RNA, 21 nt, Human
auccauccaucuuggccuaac

SEQ ID NO: 304727 - RNA, 22 nt, Human
ccacagagacagagcccagggu

SEQ ID NO: 304728 - RNA, 22 nt, Human
cugggccuuggauugacacugu

SEQ ID NO: 304729 - RNA, 22 nt, Human
cugaggcuuggaggggucuggu

SEQ ID NO: 304730 - RNA, 22 nt, Human
aaaguuguaauggaagaaaugc

SEQ ID NO: 304731 - RNA, 22 nt, Human
gcacacaggcaguuuccagcca

SEQ ID NO: 304732 - RNA, 22 nt, Human
uggaguucauccaugacagcuu

SEQ ID NO: 304733 - RNA, 22 nt, Human
ggggauggugggaaggcaaucu

SEQ ID NO: 304734 - RNA, 22 nt, Human
cucuccagaucugcugagccag

SEQ ID NO: 304735 - RNA, 22 nt, Human
uuguccuuaccucaaucuggaa

SEQ ID NO: 304736 - RNA, 22 nt, Human
cccagcccugaccuauuggaaa

SEQ ID NO: 304737 - RNA, 22 nt, Human
aaauauguuuuccaguugucau

SEQ ID NO: 304738 - RNA, 23 nt, Human
ugggggugcacgggccacaucuu

SEQ ID NO: 304739 - RNA, 22 nt, Human
auuuggaaaugcaucucuugag

SEQ ID NO: 304740 - RNA, 22 nt, Human
ugccagccagguucugaggcua

SEQ ID NO: 304741 - RNA, 22 nt, Human
uggcucuguucgccaucaggag

SEQ ID NO: 304742 - RNA, 22 nt, Human
aagucagagcaacugagacauu

SEQ ID NO: 304743 - RNA, 22 nt, Human
ucuguaucuaauuuuacaguag

SEQ ID NO: 304744 - RNA, 22 nt, Human
ugaaggaagaauaggcaguguu

SEQ ID NO: 304745 - RNA, 22 nt, Human
uaaaguucuggugagagguaag

SEQ ID NO: 304746 - RNA, 22 nt, Human
cagcucuggguaggaggaaucu

SEQ ID NO: 304747 - RNA, 22 nt, Human
uuccucagccaaggcugggauc

SEQ ID NO: 304748 - RNA, 22 nt, Human
ugggcucugugccagguuggug

SEQ ID NO: 304749 - RNA, 22 nt, Human
cagcccugagcaaggcuuuuaa

SEQ ID NO: 304750 - RNA, 22 nt, Human
ucugagccaauuucugugucca

SEQ ID NO: 304751 - RNA, 22 nt, Human
uuccagggcuaauuccugugga

SEQ ID NO: 304752 - RNA, 22 nt, Human
ggcugccauaacugauaccaua

SEQ ID NO: 304753 - RNA, 22 nt, Human
cucuuucugauucgcugggacc

SEQ ID NO: 304754 - RNA, 22 nt, Human
gcaaggcugcugccacccaucu

SEQ ID NO: 304755 - RNA, 18 nt, Human
ucauuuguuuugcaugaa

SEQ ID NO: 304756 - RNA, 22 nt, Human
cacagcagaaauaugaaggcag

SEQ ID NO: 304757 - RNA, 22 nt, Human
aucauacagccuuuguuagugu

SEQ ID NO: 304758 - RNA, 22 nt, Human
cagggacauugguggccagguu

SEQ ID NO: 304759 - RNA, 22 nt, Human
uugauagguuuuauguauaguu

SEQ ID NO: 304760 - RNA, 22 nt, Human
ccucacuggccagccaggggug

SEQ ID NO: 304761 - RNA, 22 nt, Human
ugagccugaguucaaggcugca

SEQ ID NO: 304762 - RNA, 22 nt, Human
gaaguucugguguaugugauaa

SEQ ID NO: 304763 - RNA, 21 nt, Human
ugucuuuggccucauucccag

SEQ ID NO: 304764 - RNA, 18 nt, Human
acucaggaaaugaugaca

SEQ ID NO: 304765 - RNA, 22 nt, Human
uauuucagcaagaagaaugugg

SEQ ID NO: 304766 - RNA, 22 nt, Human
cucagagcccaggguacacccg

SEQ ID NO: 304767 - RNA, 22 nt, Human
gagagaagggggauaugagccu

SEQ ID NO: 304768 - RNA, 22 nt, Human
cugccgaguacagccauagaaa

SEQ ID NO: 304769 - RNA, 22 nt, Human
uaauaucuacuucauagaguuu

SEQ ID NO: 304770 - RNA, 22 nt, Human
gaaggaggucugauacaauaug

SEQ ID NO: 304771 - RNA, 22 nt, Human
cuuguggcccauggcuuccugc

SEQ ID NO: 304772 - RNA, 22 nt, Human
cuggcagguggauggggacucc

SEQ ID NO: 304773 - RNA, 22 nt, Human
cauuuagacauuugauuugggg

SEQ ID NO: 304774 - RNA, 22 nt, Human
uuggagguuugaaaauaugugu

SEQ ID NO: 304775 - RNA, 21 nt, Human
aggaaguggccagauugggaa

SEQ ID NO: 304776 - RNA, 22 nt, Human
ccaguguuuccgucaguacacg

SEQ ID NO: 304777 - RNA, 16 nt, Human
cagaguguaaacagga

SEQ ID NO: 304778 - RNA, 22 nt, Human
cucucccccacagcagccuucu

SEQ ID NO: 304779 - RNA, 20 nt, Human
uacagaaacaggacuuuugg

SEQ ID NO: 304780 - RNA, 22 nt, Human
gugacagucaaagacaugacuu

SEQ ID NO: 304781 - RNA, 22 nt, Human
ccugugcccucagccuggcucu

SEQ ID NO: 304782 - RNA, 22 nt, Human
uuagaacuuaaacuucagaaag

SEQ ID NO: 304783 - RNA, 22 nt, Human
ugucauaacuuagugacaaauc

SEQ ID NO: 304784 - RNA, 23 nt, Human
ccucccaccuauuucacuuucuu

SEQ ID NO: 304785 - RNA, 22 nt, Human
auccuuggaugugucuuuuugu

SEQ ID NO: 304786 - RNA, 22 nt, Human
ccugggcaacauagugagaccu

SEQ ID NO: 304787 - RNA, 22 nt, Human
ucaguguuuuccagggucuacu

SEQ ID NO: 304788 - RNA, 22 nt, Human
ucacugaagacugggcucuaaa

SEQ ID NO: 304789 - RNA, 22 nt, Human
agcagccaagguaaccugugcu

SEQ ID NO: 304790 - RNA, 22 nt, Human
acaguguuuuagaaaagcuuga

SEQ ID NO: 304791 - RNA, 22 nt, Human
uauauagaaaagcagauguugg

SEQ ID NO: 304792 - RNA, 22 nt, Human
auauguguauuugguuagccua

SEQ ID NO: 304793 - RNA, 22 nt, Human
gcuggccauauauuuugcuguu

SEQ ID NO: 304794 - RNA, 22 nt, Human
gccuggcaaggcccuguugacu

SEQ ID NO: 304795 - RNA, 22 nt, Human
aucacuguguauguauaugcag

SEQ ID NO: 304796 - RNA, 22 nt, Human
ggagaugguggaagcuggugca

SEQ ID NO: 304797 - RNA, 22 nt, Human
aaguugagaugucauaggagac

SEQ ID NO: 304798 - RNA, 22 nt, Human
gagcugucucuauaugaaugcu

SEQ ID NO: 304799 - RNA, 22 nt, Human
uucacagacuuuccauagauug

SEQ ID NO: 304800 - RNA, 22 nt, Human
ugcucugucaagaaaagaugcc

SEQ ID NO: 304801 - RNA, 22 nt, Human
gucugcccucacgccagcuggg

SEQ ID NO: 304802 - RNA, 22 nt, Human
caguccugugucccuugguggg

SEQ ID NO: 304803 - RNA, 22 nt, Human
gaagagcuuagacagaaucaaa

SEQ ID NO: 304804 - RNA, 22 nt, Human
gagcugaacaucauggaaaggc

SEQ ID NO: 304805 - RNA, 22 nt, Human
cuucagaaugggacuguguuug

SEQ ID NO: 304806 - RNA, 21 nt, Human
aggugccaaggagaagcaggc

SEQ ID NO: 304807 - RNA, 21 nt, Human
aggcccagagucuugggggga

SEQ ID NO: 304808 - RNA, 22 nt, Human
cagagugaaauaggggaucaag

SEQ ID NO: 304809 - RNA, 22 nt, Human
uugaacaguuuugucagguuca

SEQ ID NO: 304810 - RNA, 17 nt, Human
cugucugcgcaugaggu

SEQ ID NO: 304811 - RNA, 22 nt, Human
gcucugagaggugcagcaguaa

SEQ ID NO: 304812 - RNA, 22 nt, Human
ccagggugcucuguggcgucgc

SEQ ID NO: 304813 - RNA, 22 nt, Human
cagcaggcagccauuucacugu

SEQ ID NO: 304814 - RNA, 22 nt, Human
auguguaaaaagugcuuaauau

SEQ ID NO: 304815 - RNA, 22 nt, Human
ugaaaugacagucuuaagcucu

SEQ ID NO: 304816 - RNA, 22 nt, Human
agccucucuuucugguggcuaa

SEQ ID NO: 304817 - RNA, 22 nt, Human
aggcccagcugggccaggaaca

SEQ ID NO: 304818 - RNA, 22 nt, Human
cugggaggcccacguugggaag

SEQ ID NO: 304819 - RNA, 22 nt, Human
cauaacuagagugaaauguuga

SEQ ID NO: 304820 - RNA, 22 nt, Human
ccaggcuggagugcaauggugc

SEQ ID NO: 304821 - RNA, 16 nt, Human
uguaugaacgucucca

SEQ ID NO: 304822 - RNA, 22 nt, Human
cagagccagcaguggggacagg

SEQ ID NO: 304823 - RNA, 22 nt, Human
uauuuguauguguguacauaua

SEQ ID NO: 304824 - RNA, 22 nt, Human
ucauacauaacuuguacaguga

SEQ ID NO: 304825 - RNA, 22 nt, Human
ggagcugcacgcucugaagccu

SEQ ID NO: 304826 - RNA, 22 nt, Human
ucuggcucccagccugcucuca

SEQ ID NO: 304827 - RNA, 22 nt, Human
gcacagccacugagugagaacc

SEQ ID NO: 304828 - RNA, 22 nt, Human
cugccuugaggagguuguggga

SEQ ID NO: 304829 - RNA, 22 nt, Human
guuuacaaauauuuuaaauggu

SEQ ID NO: 304830 - RNA, 22 nt, Human
agucuacaaagaaaaguuauug

SEQ ID NO: 304831 - RNA, 22 nt, Human
cuugaaagcuuugcgucuucua

SEQ ID NO: 304832 - RNA, 22 nt, Human
aauucuuguuguuaguauauuu

SEQ ID NO: 304833 - RNA, 22 nt, Human
cuggagccagccagggcccucu

SEQ ID NO: 304834 - RNA, 22 nt, Human
gucuucaauagagccucaauuu

SEQ ID NO: 304835 - RNA, 22 nt, Human
uuauacauguguuuugagauga

SEQ ID NO: 304836 - RNA, 22 nt, Human
uuucauaaugucacagucaaaa

SEQ ID NO: 304837 - RNA, 16 nt, Human
agcagccagcacugga

SEQ ID NO: 304838 - RNA, 22 nt, Human
aggggacacggcuucuccaggg

SEQ ID NO: 304839 - RNA, 22 nt, Human
augcugugucaccuuaggauuu

SEQ ID NO: 304840 - RNA, 22 nt, Human
uuccaggacuggguguuugaag

SEQ ID NO: 304841 - RNA, 22 nt, Human
aaaugcauugguuucuacuugu

SEQ ID NO: 304842 - RNA, 22 nt, Human
acacaggggaaaguggagcuga

SEQ ID NO: 304843 - RNA, 22 nt, Human
caaguaaagaaucacauuucuu

SEQ ID NO: 304844 - RNA, 22 nt, Human
gccaggugggagacagacagca

SEQ ID NO: 304845 - RNA, 22 nt, Human
ugucucugugacuccuuccgcc

SEQ ID NO: 304846 - RNA, 22 nt, Human
gccuaauaacuagcuguguaac

SEQ ID NO: 304847 - RNA, 22 nt, Human
cacaggcugcccgcagcuggga

SEQ ID NO: 304848 - RNA, 19 nt, Human
ugucuuaauuaacucagag

SEQ ID NO: 304849 - RNA, 22 nt, Human
aucuacaggauuuuacagaguu

SEQ ID NO: 304850 - RNA, 22 nt, Human
uggcagagcccagacuccaguc

SEQ ID NO: 304851 - RNA, 22 nt, Human
ccagaagucaggaaugagucuu

SEQ ID NO: 304852 - RNA, 22 nt, Human
agagaagagcaaugauaaauuu

SEQ ID NO: 304853 - RNA, 22 nt, Human
aguggcaggcggagauguagga

SEQ ID NO: 304854 - RNA, 22 nt, Human
gaggccaggagugcuguaaguu

SEQ ID NO: 304855 - RNA, 22 nt, Human
ccacagggugucaucagcuuga

SEQ ID NO: 304856 - RNA, 22 nt, Human
caguagcacucugucagugaag

SEQ ID NO: 304857 - RNA, 22 nt, Human
ucuuuccauggccacacagucu

SEQ ID NO: 304858 - RNA, 22 nt, Human
ucuuagaaauuccccaguggcu

SEQ ID NO: 304859 - RNA, 22 nt, Human
cagggcagggauguugcggcag

SEQ ID NO: 304860 - RNA, 22 nt, Human
ccugggcuggaguacagcagug

SEQ ID NO: 304861 - RNA, 22 nt, Human
ucacaugcccuguauuuaccag

SEQ ID NO: 304862 - RNA, 22 nt, Human
agagcuggaaaaguuguuuuaa

SEQ ID NO: 304863 - RNA, 22 nt, Human
gaugguuuaugauagaugggaa

SEQ ID NO: 304864 - RNA, 18 nt, Human
uggcagggaggaaauaua

SEQ ID NO: 304865 - RNA, 22 nt, Human
gaggccuguagucauggaugua

SEQ ID NO: 304866 - RNA, 22 nt, Human
ucucacuuuccagacuuuucaa

SEQ ID NO: 304867 - RNA, 22 nt, Human
gaauucuuuucuuucugaaagu

SEQ ID NO: 304868 - RNA, 22 nt, Human
cagaccagaaggaagccgacaa

SEQ ID NO: 304869 - RNA, 22 nt, Human
ggcaucccuucuuccaguguca

SEQ ID NO: 304870 - RNA, 22 nt, Human
gagccugaugaaacaggcagac

SEQ ID NO: 304871 - RNA, 22 nt, Human
cacagcuggugcacuagcucug

SEQ ID NO: 304872 - RNA, 22 nt, Human
cuccaggagcugugucuuucuu

SEQ ID NO: 304873 - RNA, 22 nt, Human
gaaaugugggucaugacccauu

SEQ ID NO: 304874 - RNA, 22 nt, Human
ugucccagauacuggacauaga

SEQ ID NO: 304875 - RNA, 22 nt, Human
guucuucaucauuuuagauagg

SEQ ID NO: 304876 - RNA, 22 nt, Human
acugcaucugaaacauggguca

SEQ ID NO: 304877 - RNA, 22 nt, Human
ugcauccuuaaccagcaucacu

SEQ ID NO: 304878 - RNA, 22 nt, Human
aggcugcaggucugggucaugu

SEQ ID NO: 304879 - RNA, 22 nt, Human
cagcucugggugacaggagggc

SEQ ID NO: 304880 - RNA, 22 nt, Human
uaacacugauuuguucucaggg

SEQ ID NO: 304881 - RNA, 19 nt, Human
gcucugugaugcugagggg

SEQ ID NO: 304882 - RNA, 22 nt, Human
ucuccuugcuacccaguauguc

SEQ ID NO: 304883 - RNA, 22 nt, Human
gcaagcugcucuuauguggagg

SEQ ID NO: 304884 - RNA, 22 nt, Human
ggagaguggauuccagcuguau

SEQ ID NO: 304885 - RNA, 22 nt, Human
guuuucaauuauaagauggcuu

SEQ ID NO: 304886 - RNA, 22 nt, Human
ucacaaaagcuuuugaauuugg

SEQ ID NO: 304887 - RNA, 22 nt, Human
cguggccuuugagugagcuccc

SEQ ID NO: 304888 - RNA, 22 nt, Human
uuauccuggauuauauauguga

SEQ ID NO: 304889 - RNA, 22 nt, Human
ugcuucaggagaugucaccaug

SEQ ID NO: 304890 - RNA, 22 nt, Human
gcacugaacuuuaaucauuucu

SEQ ID NO: 304891 - RNA, 22 nt, Human
aucuggcuuaccuagggugccu

SEQ ID NO: 304892 - RNA, 22 nt, Human
cugcuuuguaaaauagacauaa

SEQ ID NO: 304893 - RNA, 21 nt, Human
auaagcaugcugauuacauuu

SEQ ID NO: 304894 - RNA, 22 nt, Human
gucaggaugcuauuguuauuaa

SEQ ID NO: 304895 - RNA, 22 nt, Human
cuuauguaaacuacagauaaua

SEQ ID NO: 304896 - RNA, 22 nt, Human
uguaucaaaccaaauuaauucu

SEQ ID NO: 304897 - RNA, 22 nt, Human
ucuggcuccacuuucuucauuu

SEQ ID NO: 304898 - RNA, 22 nt, Human
uauauuuaaauccagguugaaa

SEQ ID NO: 304899 - RNA, 23 nt, Human
ggauggagccacuuugaaaccac

SEQ ID NO: 304900 - RNA, 22 nt, Human
gcagccagccccucugaccucu

SEQ ID NO: 304901 - RNA, 22 nt, Human
ccacagcuagggcaaucugauu

SEQ ID NO: 304902 - RNA, 22 nt, Human
ccacuugugaaauaaucaaaua

SEQ ID NO: 304903 - RNA, 22 nt, Human
ugcacuuugcaggcauggaaac

SEQ ID NO: 304904 - RNA, 22 nt, Human
cagagagcuuagugugcugcau

SEQ ID NO: 304905 - RNA, 20 nt, Human
ggcagagcuaugucuguugc

SEQ ID NO: 304906 - RNA, 22 nt, Human
cccucugccucugaguaggaca

SEQ ID NO: 304907 - RNA, 20 nt, Human
uucacagaggacucagguca

SEQ ID NO: 304908 - RNA, 22 nt, Human
cagcugccccgcuggcugacca

SEQ ID NO: 304909 - RNA, 21 nt, Human
agagaauugccuuagauguuc

SEQ ID NO: 304910 - RNA, 22 nt, Human
acagccuggacuggcucucugc

SEQ ID NO: 304911 - RNA, 22 nt, Human
cagaaguaagauuacugugagu

SEQ ID NO: 304912 - RNA, 19 nt, Human
uggggcuguguuuugaccc

SEQ ID NO: 304913 - RNA, 22 nt, Human
gaugagaauguuuaucaaaugc

SEQ ID NO: 304914 - RNA, 22 nt, Human
aacuaaaacugguuuguucucu

SEQ ID NO: 304915 - RNA, 22 nt, Human
cugugcccuggccaggccucuc

SEQ ID NO: 304916 - RNA, 22 nt, Human
guucauuuaugauguaacaugu

SEQ ID NO: 304917 - RNA, 22 nt, Human
ugcguugcgcuccugcagcagg

SEQ ID NO: 304918 - RNA, 22 nt, Human
ucucagcugacugcuuuccucg

SEQ ID NO: 304919 - RNA, 22 nt, Human
uagcagugccaggauuuugcug

SEQ ID NO: 304920 - RNA, 22 nt, Human
aaaugucuguuagucauaucau

SEQ ID NO: 304921 - RNA, 22 nt, Human
uaauguguugaauauuuguaca

SEQ ID NO: 304922 - RNA, 22 nt, Human
aaugacaagacauagucucuga

SEQ ID NO: 304923 - RNA, 22 nt, Human
gccucaguguccuccuccaugu

SEQ ID NO: 304924 - RNA, 22 nt, Human
acagaugagguguuuggagagc

SEQ ID NO: 304925 - RNA, 22 nt, Human
gcucccagggaccgcagggcag

SEQ ID NO: 304926 - RNA, 22 nt, Human
cagagguaccagcagccucugg

SEQ ID NO: 304927 - RNA, 22 nt, Human
cugccagcucgccacaaugaca

SEQ ID NO: 304928 - RNA, 22 nt, Human
cuuccucaugugcaaugcaagc

SEQ ID NO: 304929 - RNA, 22 nt, Human
ugcaggagcaccagcucacccu

SEQ ID NO: 304930 - RNA, 20 nt, Human
ucccugccuuuuacugcugg

SEQ ID NO: 304931 - RNA, 17 nt, Human
aaggccauuuccaccca

SEQ ID NO: 304932 - RNA, 22 nt, Human
gggcagcucuggcugugggaag

SEQ ID NO: 304933 - RNA, 22 nt, Human
aaggcacuugcccagagcugca

SEQ ID NO: 304934 - RNA, 21 nt, Human
uccacaaguuagaaggaaauu

SEQ ID NO: 304935 - RNA, 22 nt, Human
gcauuuagcuuuaaaauauuuc

SEQ ID NO: 304936 - RNA, 22 nt, Human
aaugcauauguaggcaagcagu

SEQ ID NO: 304937 - RNA, 22 nt, Human
acuucuucuucagcugggggau

SEQ ID NO: 304938 - RNA, 22 nt, Human
cuggccuggagccucugggugg

SEQ ID NO: 304939 - RNA, 22 nt, Human
ggcucuggcaaggggaggcuac

SEQ ID NO: 304940 - RNA, 22 nt, Human
agaaauguauagugaauuuuuc

SEQ ID NO: 304941 - RNA, 22 nt, Human
caguacuuuucuggcuuucuac

SEQ ID NO: 304942 - RNA, 22 nt, Human
guuacacaggaaaacauuagca

SEQ ID NO: 304943 - RNA, 22 nt, Human
auacaaguugugauaauguaaa

SEQ ID NO: 304944 - RNA, 20 nt, Human
caucaucacaugagccaauu

SEQ ID NO: 304945 - RNA, 19 nt, Human
uucuccagccugaccugag

SEQ ID NO: 304946 - RNA, 22 nt, Human
uuuauguacauauccacaagga

SEQ ID NO: 304947 - RNA, 22 nt, Human
gcagccuguuguaccagccugu

SEQ ID NO: 304948 - RNA, 22 nt, Human
ccucacagggccaggccccuca

SEQ ID NO: 304949 - RNA, 22 nt, Human
cuggagcugcuguccuugggug

SEQ ID NO: 304950 - RNA, 22 nt, Human
ugucccaggcugaaguacagug

SEQ ID NO: 304951 - RNA, 22 nt, Human
acagccagggcauugucgccga

SEQ ID NO: 304952 - RNA, 22 nt, Human
ggaagagagggcugggccucaa

SEQ ID NO: 304953 - RNA, 22 nt, Human
gcugcugugccuggcguccugu

SEQ ID NO: 304954 - RNA, 22 nt, Human
cugcugugugcuuacuuggguu

SEQ ID NO: 304955 - RNA, 22 nt, Human
acagaauuaaaguguuugugga

SEQ ID NO: 304956 - RNA, 22 nt, Human
ccuuuuucccuggagggacagc

SEQ ID NO: 304957 - RNA, 22 nt, Human
ugucucugaacagcuuacuaaa

SEQ ID NO: 304958 - RNA, 22 nt, Human
acuggcagcuguaggaugcaug

SEQ ID NO: 304959 - RNA, 22 nt, Human
gcaagcaguuguggcuucugag

SEQ ID NO: 304960 - RNA, 22 nt, Human
agagugaaaagcuagagcagua

SEQ ID NO: 304961 - RNA, 22 nt, Human
augugcaugcacuuacaugugu

SEQ ID NO: 304962 - RNA, 22 nt, Human
gaugagcauuguuucauguguu

SEQ ID NO: 304963 - RNA, 22 nt, Human
ccaucagcuccaguaucuucug

SEQ ID NO: 304964 - RNA, 23 nt, Human
aggaagaggcaauuucucuuaga

SEQ ID NO: 304965 - RNA, 21 nt, Human
ggagcugcaggagccgaaggc

SEQ ID NO: 304966 - RNA, 22 nt, Human
ggccuggcauggggacuaaggg

SEQ ID NO: 304967 - RNA, 22 nt, Human
gggcugcacguauucugcucac

SEQ ID NO: 304968 - RNA, 22 nt, Human
ucccagauuguugauggcuuaa

SEQ ID NO: 304969 - RNA, 22 nt, Human
gucaaaaaguagucauuucugu

SEQ ID NO: 304970 - RNA, 22 nt, Human
aaauuuucagagcacuagagaa

SEQ ID NO: 304971 - RNA, 22 nt, Human
cagugcuguuguaagcucauug

SEQ ID NO: 304972 - RNA, 22 nt, Human
auucugucuuuuuauacaucua

SEQ ID NO: 304973 - RNA, 21 nt, Human
cagugcucaaucugacagugg

SEQ ID NO: 304974 - RNA, 22 nt, Human
gauuuagagaauguuuuguaag

SEQ ID NO: 304975 - RNA, 22 nt, Human
gagagcaggcucucgggggcca

SEQ ID NO: 304976 - RNA, 22 nt, Human
ucuccuccuuuuuucaacauag

SEQ ID NO: 304977 - RNA, 22 nt, Human
agcugguaugaacaggauagga

SEQ ID NO: 304978 - RNA, 22 nt, Human
acauuucucagggaguuuugcu

SEQ ID NO: 304979 - RNA, 22 nt, Human
gcagggacagggcagggccuuu

SEQ ID NO: 304980 - RNA, 22 nt, Human
uugcauugaaaauauauuuuaa

SEQ ID NO: 304981 - RNA, 22 nt, Human
cacagggcagugauuguccaca

SEQ ID NO: 304982 - RNA, 22 nt, Human
gggcucugggaugcucuuagag

SEQ ID NO: 304983 - RNA, 22 nt, Human
auacagugaauacuuacagugu

SEQ ID NO: 304984 - RNA, 22 nt, Human
cccaguccagaccaugaccuca

SEQ ID NO: 304985 - RNA, 22 nt, Human
uugggcaaaguguuucuggagc

SEQ ID NO: 304986 - RNA, 22 nt, Human
uuugggaaacuuaggggucaga

SEQ ID NO: 304987 - RNA, 22 nt, Human
acauuucuuccuaauuaucccu

SEQ ID NO: 304988 - RNA, 22 nt, Human
ugggcagauguggcucuccuug

SEQ ID NO: 304989 - RNA, 22 nt, Human
ucccagcagucagagcuaugug

SEQ ID NO: 304990 - RNA, 22 nt, Human
agcaccaucagaugcaauaucu

SEQ ID NO: 304991 - RNA, 22 nt, Human
cgcaccacugaauuccagccug

SEQ ID NO: 304992 - RNA, 22 nt, Human
cacauuucucuaccucacacaa

SEQ ID NO: 304993 - RNA, 22 nt, Human
aaguaugacauuuaagacaauu

SEQ ID NO: 304994 - RNA, 22 nt, Human
agagcccucucauuggcuuauu

SEQ ID NO: 304995 - RNA, 22 nt, Human
cugcaucaguggauaugauggu

SEQ ID NO: 304996 - RNA, 22 nt, Human
uagacauuuggcaugguuuuca

SEQ ID NO: 304997 - RNA, 22 nt, Human
uggcccuguguccugcugccag

SEQ ID NO: 304998 - RNA, 22 nt, Human
gacagaggcaagaccagaagcc

SEQ ID NO: 304999 - RNA, 22 nt, Human
ugugugucagagucuccauggu

SEQ ID NO: 305000 - RNA, 17 nt, Human
ucaggauccaggguucu

SEQ ID NO: 305001 - RNA, 21 nt, Human
uggcucugaaagagugcugca

SEQ ID NO: 305002 - RNA, 22 nt, Human
acauuaucccuggcacaacugc

SEQ ID NO: 305003 - RNA, 22 nt, Human
acacacaacucauuguguaaua

SEQ ID NO: 305004 - RNA, 22 nt, Human
ucagagaguuggaaagaauuaa

SEQ ID NO: 305005 - RNA, 22 nt, Human
gucagcugucuccccagagugg

SEQ ID NO: 305006 - RNA, 22 nt, Human
gaggccugcuuuggcacucugg

SEQ ID NO: 305007 - RNA, 22 nt, Human
uuuuaauacugcuauuguagga

SEQ ID NO: 305008 - RNA, 22 nt, Human
ccagcaugagacgaugaugaag

SEQ ID NO: 305009 - RNA, 17 nt, Human
gcagugaaaagagauca

SEQ ID NO: 305010 - RNA, 22 nt, Human
acuguucacuagugaggguuga

SEQ ID NO: 305011 - RNA, 22 nt, Human
uucugucagcgucagaaauucu

SEQ ID NO: 305012 - RNA, 17 nt, Human
uggacccuugggccucc

SEQ ID NO: 305013 - RNA, 22 nt, Human
agaggccagggacacugcucaa

SEQ ID NO: 305014 - RNA, 22 nt, Human
ucauccuuuugcaugggaaggc

SEQ ID NO: 305015 - RNA, 22 nt, Human
auguucuguuuuguaauucaua

SEQ ID NO: 305016 - RNA, 22 nt, Human
ucauuucucccggccaaaaacu

SEQ ID NO: 305017 - RNA, 22 nt, Human
cccaggcagucuggcucuaaag

SEQ ID NO: 305018 - RNA, 21 nt, Human
ccuucucuugcuucagcuuca

SEQ ID NO: 305019 - RNA, 22 nt, Human
uuugagauggagucuugcucug

SEQ ID NO: 305020 - RNA, 22 nt, Human
aauuuccagaccccauccacag

SEQ ID NO: 305021 - RNA, 22 nt, Human
aggccagaugucgggcuagaag

SEQ ID NO: 305022 - RNA, 22 nt, Human
ggcugccugcuccuccugcacg

SEQ ID NO: 305023 - RNA, 20 nt, Human
cuuccacacaagaagcacag

SEQ ID NO: 305024 - RNA, 23 nt, Human
uggccugcagaguuucugcuggg

SEQ ID NO: 305025 - RNA, 22 nt, Human
ugcugcucucagccaccaggaa

SEQ ID NO: 305026 - RNA, 22 nt, Human
ccucuuugugccugcaggcugc

SEQ ID NO: 305027 - RNA, 22 nt, Human
ggaggccaggaaggcucggaga

SEQ ID NO: 305028 - RNA, 22 nt, Human
cucugaagggagggccaagccc

SEQ ID NO: 305029 - RNA, 22 nt, Human
caggaggccaacugugggacuu

SEQ ID NO: 305030 - RNA, 20 nt, Human
cuguggaauuuuaccaugcg

SEQ ID NO: 305031 - RNA, 22 nt, Human
uagugcuugagucucuccguac

SEQ ID NO: 305032 - RNA, 22 nt, Human
auacaucucauguaagagauaa

SEQ ID NO: 305033 - RNA, 22 nt, Human
cacaguguuccagagcaguggu

SEQ ID NO: 305034 - RNA, 22 nt, Human
auccugggcagugugucacucu

SEQ ID NO: 305035 - RNA, 22 nt, Human
aaguaacaaugcuguugaauug

SEQ ID NO: 305036 - RNA, 22 nt, Human
ugggcugcuguuacaggggcug

SEQ ID NO: 305037 - RNA, 22 nt, Human
auucuucaccugagucagucua

SEQ ID NO: 305038 - RNA, 22 nt, Human
gucccagaaacauauugcuggu

SEQ ID NO: 305039 - RNA, 22 nt, Human
aucaaaguccaucagaagguag

SEQ ID NO: 305040 - RNA, 21 nt, Human
aguccaggaggaggccagguu

SEQ ID NO: 305041 - RNA, 22 nt, Human
ccuguucaccauggucacgugc

SEQ ID NO: 305042 - RNA, 23 nt, Human
uuuuaauuuggacauaagaagau

SEQ ID NO: 305043 - RNA, 22 nt, Human
ccucucccgggugccgcugggc

SEQ ID NO: 305044 - RNA, 22 nt, Human
gggacagacccaugggccaggu

SEQ ID NO: 305045 - RNA, 22 nt, Human
gagagcugcauucucagacaca

SEQ ID NO: 305046 - RNA, 22 nt, Human
ucacaggaaccaucagagaaau

SEQ ID NO: 305047 - RNA, 22 nt, Human
uucaagguaugguagcugguca

SEQ ID NO: 305048 - RNA, 22 nt, Human
aauuuuaaucaguggugcugag

SEQ ID NO: 305049 - RNA, 22 nt, Human
gggaaauugucaacacucucaa

SEQ ID NO: 305050 - RNA, 22 nt, Human
cauuauguucaguagcuuaaaa

SEQ ID NO: 305051 - RNA, 22 nt, Human
caaaugcaugagaaauaagagg

SEQ ID NO: 305052 - RNA, 22 nt, Human
gccccagcucugccacaacuag

SEQ ID NO: 305053 - RNA, 22 nt, Human
cuuugaagagauuacugugcuc

SEQ ID NO: 305054 - RNA, 22 nt, Human
ucagggacuuacaaaccagaag

SEQ ID NO: 305055 - RNA, 22 nt, Human
agcaggagagcagugcgugguc

SEQ ID NO: 305056 - RNA, 22 nt, Human
cugaagcacagcauauaaauaa

SEQ ID NO: 305057 - RNA, 22 nt, Human
caagagcuacccugugccauau

SEQ ID NO: 305058 - RNA, 22 nt, Human
cagguggguguaugaaugcaaa

SEQ ID NO: 305059 - RNA, 22 nt, Human
gaggccuggucuaugagauguu

SEQ ID NO: 305060 - RNA, 22 nt, Human
ugcaguggaaucuggagagcag

SEQ ID NO: 305061 - RNA, 22 nt, Human
gaaggcuggcuuucugagagca

SEQ ID NO: 305062 - RNA, 22 nt, Human
caggccagguggcaggcaaaac

SEQ ID NO: 305063 - RNA, 17 nt, Human
ucagagggaugagcagg

SEQ ID NO: 305064 - RNA, 22 nt, Human
cagaauuugaaguaauauucca

SEQ ID NO: 305065 - RNA, 22 nt, Human
uaaagguaguuuuaaaggugcu

SEQ ID NO: 305066 - RNA, 22 nt, Human
aauaauguugacgauagucuua

SEQ ID NO: 305067 - RNA, 22 nt, Human
aaaaugugaucuacaaaugcaa

SEQ ID NO: 305068 - RNA, 22 nt, Human
ccagcucugcauguuucccuug

SEQ ID NO: 305069 - RNA, 22 nt, Human
cuaugaaaggauuuggaguugu

SEQ ID NO: 305070 - RNA, 22 nt, Human
cauuuguagcuauuuacuguau

SEQ ID NO: 305071 - RNA, 22 nt, Human
gcccagcugucuggcagggaug

SEQ ID NO: 305072 - RNA, 22 nt, Human
auuuggaaacaauuauauucuu

SEQ ID NO: 305073 - RNA, 22 nt, Human
uggguagagcaggcuggggcuu

SEQ ID NO: 305074 - RNA, 22 nt, Human
agcucucugauaaauugauaaa

SEQ ID NO: 305075 - RNA, 22 nt, Human
uucauuccugagcccauauuua

SEQ ID NO: 305076 - RNA, 22 nt, Human
uuugacauuggcuuauucuguu

SEQ ID NO: 305077 - RNA, 22 nt, Human
uggcucugggcaccguguccac

SEQ ID NO: 305078 - RNA, 22 nt, Human
cagcauuggguuaccuuuguuu

SEQ ID NO: 305079 - RNA, 17 nt, Human
aggccucccuccaggcc

SEQ ID NO: 305080 - RNA, 22 nt, Human
uuagcugcauuaucaaaguuau

SEQ ID NO: 305081 - RNA, 22 nt, Human
gccagggaggcuguaggguccu

SEQ ID NO: 305082 - RNA, 22 nt, Human
agggcccauagaucgucagcuu

SEQ ID NO: 305083 - RNA, 22 nt, Human
aaguucaauggaaaagcuuuag

SEQ ID NO: 305084 - RNA, 22 nt, Human
cuucucucugcauaggcauggg

SEQ ID NO: 305085 - RNA, 17 nt, Human
ugguggcuggagucagg

SEQ ID NO: 305086 - RNA, 22 nt, Human
gcugaagagagaugcguccagc

SEQ ID NO: 305087 - RNA, 23 nt, Human
uccuucagagccucccuccaagc

SEQ ID NO: 305088 - RNA, 22 nt, Human
aagaacaguguccugggacucg

SEQ ID NO: 305089 - RNA, 22 nt, Human
ccaaaguccauaguuuacauaa

SEQ ID NO: 305090 - RNA, 22 nt, Human
gagggcagaaaauuaugcggug

SEQ ID NO: 305091 - RNA, 22 nt, Human
cagcuggcauaccugggcccgg

SEQ ID NO: 305092 - RNA, 22 nt, Human
ugcugaugaguccuucuaucgc

SEQ ID NO: 305093 - RNA, 22 nt, Human
gggagggaaagcuugaucuguc

SEQ ID NO: 305094 - RNA, 22 nt, Human
ccuggcucucugcagauccugg

SEQ ID NO: 305095 - RNA, 23 nt, Human
agcagccauagggaagcaauaca

SEQ ID NO: 305096 - RNA, 22 nt, Human
cauuuguacagaacagcuuuau

SEQ ID NO: 305097 - RNA, 22 nt, Human
gcagagguggcaucugggcucu

SEQ ID NO: 305098 - RNA, 22 nt, Human
uggcuggcuuguucacugacug

SEQ ID NO: 305099 - RNA, 23 nt, Human
cuuuuaacuagaguaucagcugc

SEQ ID NO: 305100 - RNA, 19 nt, Human
cagcucaguuugauucucu

SEQ ID NO: 305101 - RNA, 22 nt, Human
ggaggcccagagaggugaagug

SEQ ID NO: 305102 - RNA, 22 nt, Human
aguaugaaucucuuuauucugc

SEQ ID NO: 305103 - RNA, 20 nt, Human
cagcuuggaugagaggcuga

SEQ ID NO: 305104 - RNA, 22 nt, Human
cacugcuuauaaauucuaggca

SEQ ID NO: 305105 - RNA, 22 nt, Human
aguuuuguaauucucaaaaaua

SEQ ID NO: 305106 - RNA, 22 nt, Human
gagccagccgcaagagcuguga

SEQ ID NO: 305107 - RNA, 23 nt, Human
cuuuuaacuugaucugagaccag

SEQ ID NO: 305108 - RNA, 19 nt, Human
ccucugcgcuguccugcuc

SEQ ID NO: 305109 - RNA, 22 nt, Human
aaggugucacugggacaggaaa

SEQ ID NO: 305110 - RNA, 22 nt, Human
uguacauacauagauauacaca

SEQ ID NO: 305111 - RNA, 22 nt, Human
ucuggcucaucucuccagguaa

SEQ ID NO: 305112 - RNA, 19 nt, Human
auaaggcaggaggaaauuu

SEQ ID NO: 305113 - RNA, 22 nt, Human
cagccuccugggacacucaccg

SEQ ID NO: 305114 - RNA, 22 nt, Human
caggagacuauggcccaaggcc

SEQ ID NO: 305115 - RNA, 22 nt, Human
ugggcuggugagggaucauuua

SEQ ID NO: 305116 - RNA, 22 nt, Human
cuggagccgcauggagcaggga

SEQ ID NO: 305117 - RNA, 22 nt, Human
gcaguguuucaaaucaaaggca

SEQ ID NO: 305118 - RNA, 22 nt, Human
cuggccuggcagggagggcaug

SEQ ID NO: 305119 - RNA, 22 nt, Human
uggccaggggaguuccccucca

SEQ ID NO: 305120 - RNA, 22 nt, Human
aauuucaauuacuuuugcacca

SEQ ID NO: 305121 - RNA, 22 nt, Human
gcccuugggagguuccacuggg

SEQ ID NO: 305122 - RNA, 22 nt, Human
gcaggaaagguugagacuuugc

SEQ ID NO: 305123 - RNA, 22 nt, Human
gcaggagcccuggcauguucuu

SEQ ID NO: 305124 - RNA, 22 nt, Human
gggagggaggugaugcuuggcu

SEQ ID NO: 305125 - RNA, 22 nt, Human
cacauugaaaugacccaauaau

SEQ ID NO: 305126 - RNA, 22 nt, Human
auuucccagcuuugaucaguuu

SEQ ID NO: 305127 - RNA, 22 nt, Human
ugauuuuuagcuauucugaaga

SEQ ID NO: 305128 - RNA, 22 nt, Human
ggcagcaguggcugcuauuguc

SEQ ID NO: 305129 - RNA, 22 nt, Human
uucacaggaauguaggggucuu

SEQ ID NO: 305130 - RNA, 22 nt, Human
ucagagcccugcuccuccccaa

SEQ ID NO: 305131 - RNA, 22 nt, Human
uccuuccuggggucucugcugc

SEQ ID NO: 305132 - RNA, 21 nt, Human
accucaagcaacaaccaaggu

SEQ ID NO: 305133 - RNA, 22 nt, Human
gccucugcgccucagccgaccu

SEQ ID NO: 305134 - RNA, 22 nt, Human
uacuuuuuagcacagugugugc

SEQ ID NO: 305135 - RNA, 22 nt, Human
agaaaugaagagagucaagguu

SEQ ID NO: 305136 - RNA, 22 nt, Human
gcagaagggaauaaggagcuuu

SEQ ID NO: 305137 - RNA, 22 nt, Human
gcugagguggagauugcaguga

SEQ ID NO: 305138 - RNA, 22 nt, Human
uucaagauccagcacaacagug

SEQ ID NO: 305139 - RNA, 22 nt, Human
aaguuucaaauguugauuaugc

SEQ ID NO: 305140 - RNA, 22 nt, Human
auggggcuguucucugcccugc

SEQ ID NO: 305141 - RNA, 23 nt, Human
agcagccagagauccucggcccu

SEQ ID NO: 305142 - RNA, 21 nt, Human
uuacuuuugcagcaaccuaau

SEQ ID NO: 305143 - RNA, 22 nt, Human
uuucugaacaaagccauuauca

SEQ ID NO: 305144 - RNA, 19 nt, Human
auacacauacguaaacuga

SEQ ID NO: 305145 - RNA, 22 nt, Human
agggcacaagacucugagcccc

SEQ ID NO: 305146 - RNA, 22 nt, Human
uguaggacauguacuuguaaca

SEQ ID NO: 305147 - RNA, 22 nt, Human
cucaaauauaagcuaaaugugg

SEQ ID NO: 305148 - RNA, 22 nt, Human
aacuuucaggcaaugaauauuu

SEQ ID NO: 305149 - RNA, 21 nt, Human
cagugcugccuaauagggagu

SEQ ID NO: 305150 - RNA, 22 nt, Human
gaggggcaaugagggaaagagu

SEQ ID NO: 305151 - RNA, 22 nt, Human
cuuuccaaugucacuaugaauc

SEQ ID NO: 305152 - RNA, 22 nt, Human
uggcugccuagugucugagcag

SEQ ID NO: 305153 - RNA, 22 nt, Human
ggcugcuggaagacugaacaag

SEQ ID NO: 305154 - RNA, 22 nt, Human
caguacuugggaaugcugggga

SEQ ID NO: 305155 - RNA, 22 nt, Human
uggcucuguuuuaugaguacca

SEQ ID NO: 305156 - RNA, 22 nt, Human
ggcucugccugcccagcagcac

SEQ ID NO: 305157 - RNA, 22 nt, Human
ucagagaggcaauacuguuuaa

SEQ ID NO: 305158 - RNA, 18 nt, Human
gaugggagcaagagaaga

SEQ ID NO: 305159 - RNA, 22 nt, Human
aucugccugcaguggagguggg

SEQ ID NO: 305160 - RNA, 22 nt, Human
gccagcucagugccaggccccu

SEQ ID NO: 305161 - RNA, 22 nt, Human
guaggcagauaggagugcagcc

SEQ ID NO: 305162 - RNA, 22 nt, Human
uuucuuguaagauguuuauuaa

SEQ ID NO: 305163 - RNA, 22 nt, Human
guguccacggcugagaaugauu

SEQ ID NO: 305164 - RNA, 22 nt, Human
aagcaccucuaugauugcuuuu

SEQ ID NO: 305165 - RNA, 23 nt, Human
aguguuccaguugguugagagug

SEQ ID NO: 305166 - RNA, 22 nt, Human
cagggcugcuggccgugcccuc

SEQ ID NO: 305167 - RNA, 22 nt, Human
cucagugcuucuagcuugauga

SEQ ID NO: 305168 - RNA, 22 nt, Human
uuuuccuaguaggccuauuaga

SEQ ID NO: 305169 - RNA, 17 nt, Human
aggugcuggagcaucag

SEQ ID NO: 305170 - RNA, 20 nt, Human
ugcagcugguuucacaggga

SEQ ID NO: 305171 - RNA, 22 nt, Human
caugugguucaaguacuccaca

SEQ ID NO: 305172 - RNA, 22 nt, Human
agcuucucaggagucugaggca

SEQ ID NO: 305173 - RNA, 22 nt, Human
aaagcucuuuuccaaguauuga

SEQ ID NO: 305174 - RNA, 22 nt, Human
acucccagguugccuggcaggc

SEQ ID NO: 305175 - RNA, 22 nt, Human
ggagcagccgcgucucagggca

SEQ ID NO: 305176 - RNA, 22 nt, Human
uccaugagcuagggauucauca

SEQ ID NO: 305177 - RNA, 22 nt, Human
ggagccugacagugcccagcau

SEQ ID NO: 305178 - RNA, 22 nt, Human
ugcuggguagaaguauuagucu

SEQ ID NO: 305179 - RNA, 17 nt, Human
agguggguggaucaccu

SEQ ID NO: 305180 - RNA, 22 nt, Human
caguauguuugggagacaugac

SEQ ID NO: 305181 - RNA, 22 nt, Human
agugggcaugaucuggugucug

SEQ ID NO: 305182 - RNA, 22 nt, Human
gaaggccuagggaugcucugcg

SEQ ID NO: 305183 - RNA, 22 nt, Human
cucccugguguccccuccagga

SEQ ID NO: 305184 - RNA, 23 nt, Human
auaugucaugcaccagcacuuua

SEQ ID NO: 305185 - RNA, 22 nt, Human
aggagaaagacuggacagccaa

SEQ ID NO: 305186 - RNA, 22 nt, Human
acuuccuuuugggaaacuguuu

SEQ ID NO: 305187 - RNA, 22 nt, Human
auaaaugauucagcaggaaaua

SEQ ID NO: 305188 - RNA, 22 nt, Human
uaacacauauuucaagaguagu

SEQ ID NO: 305189 - RNA, 22 nt, Human
agggaagaaaauccaucgcugc

SEQ ID NO: 305190 - RNA, 22 nt, Human
aggaggccccuccuggguugcu

SEQ ID NO: 305191 - RNA, 20 nt, Human
gauuucaaagcagaguggcc

SEQ ID NO: 305192 - RNA, 22 nt, Human
gcucagagaaucagcagacacc

SEQ ID NO: 305193 - RNA, 22 nt, Human
uauuucugucagccagauaugg

SEQ ID NO: 305194 - RNA, 22 nt, Human
agauuccagaucccaaaaauga

SEQ ID NO: 305195 - RNA, 22 nt, Human
agggcugccugcucugcauuga

SEQ ID NO: 305196 - RNA, 22 nt, Human
cccuggcagaaugucucugggc

SEQ ID NO: 305197 - RNA, 22 nt, Human
uucaugugaauauauuugucuu

SEQ ID NO: 305198 - RNA, 22 nt, Human
gcucuggagauggagccuugag

SEQ ID NO: 305199 - RNA, 22 nt, Human
uuuuucuugugcuggaucuaau

SEQ ID NO: 305200 - RNA, 22 nt, Human
ccucacugaagaggugacauuu

SEQ ID NO: 305201 - RNA, 22 nt, Human
agagccugaggccaggaaaaug

SEQ ID NO: 305202 - RNA, 22 nt, Human
ugcugcuguauccuuaguguca

SEQ ID NO: 305203 - RNA, 22 nt, Human
cccuggcauaaaacuucuccag

SEQ ID NO: 305204 - RNA, 22 nt, Human
ggcugccugaggcugaggcccg

SEQ ID NO: 305205 - RNA, 22 nt, Human
ggcucacgcaauuaucccggcc

SEQ ID NO: 305206 - RNA, 22 nt, Human
ugacccugcuucuuggugcagg

SEQ ID NO: 305207 - RNA, 22 nt, Human
aucaguuuggugcuuucaguga

SEQ ID NO: 305208 - RNA, 22 nt, Human
aggcaugugacccuggacucag

SEQ ID NO: 305209 - RNA, 21 nt, Human
ugggagagggcucagcuaccc

SEQ ID NO: 305210 - RNA, 22 nt, Human
uacauugcuuucuaauacaucu

SEQ ID NO: 305211 - RNA, 22 nt, Human
gcuggccauucucuuugagaug

SEQ ID NO: 305212 - RNA, 22 nt, Human
aaaugccucugcuguacacaau

SEQ ID NO: 305213 - RNA, 22 nt, Human
gcugccuuccaaagaguuuuau

SEQ ID NO: 305214 - RNA, 21 nt, Human
ggugacacguggccccgcucu

SEQ ID NO: 305215 - RNA, 22 nt, Human
gagacagcagggccagggccug

SEQ ID NO: 305216 - RNA, 22 nt, Human
uuagaaaucaccucugaagauc

SEQ ID NO: 305217 - RNA, 22 nt, Human
guggccaggccgacugccaggc

SEQ ID NO: 305218 - RNA, 22 nt, Human
uccauuuuucaugacuccucaa

SEQ ID NO: 305219 - RNA, 22 nt, Human
ucagagccaaucauggugcauu

SEQ ID NO: 305220 - RNA, 22 nt, Human
aacaugauggggaagaacaaga

SEQ ID NO: 305221 - RNA, 22 nt, Human
acaaugcaccagcaucuucacc

SEQ ID NO: 305222 - RNA, 22 nt, Human
cuuugcaauagaggcacacaug

SEQ ID NO: 305223 - RNA, 19 nt, Human
ccaggccucuggggccugu

SEQ ID NO: 305224 - RNA, 22 nt, Human
ggcucuggucagugaggggccu

SEQ ID NO: 305225 - RNA, 22 nt, Human
acacauuucuaaauuuuuaccg

SEQ ID NO: 305226 - RNA, 22 nt, Human
cagagugagggccugcaccugc

SEQ ID NO: 305227 - RNA, 22 nt, Human
aagagaaggcccugacccaccc

SEQ ID NO: 305228 - RNA, 22 nt, Human
gcagaggcaaucagguaugugg

SEQ ID NO: 305229 - RNA, 23 nt, Human
aaacugcuuccaauuccugccau

SEQ ID NO: 305230 - RNA, 22 nt, Human
auuuccaguccuaaugaucugg

SEQ ID NO: 305231 - RNA, 22 nt, Human
uggaaggcaugggaacuguucu

SEQ ID NO: 305232 - RNA, 22 nt, Human
ugcucuucggggccacugcuug

SEQ ID NO: 305233 - RNA, 22 nt, Human
uggccuggcccugaggcccugu

SEQ ID NO: 305234 - RNA, 22 nt, Human
gucaggauguuuauucuccagu

SEQ ID NO: 305235 - RNA, 22 nt, Human
ugauuuccugugcgcccuuagg

SEQ ID NO: 305236 - RNA, 22 nt, Human
aggccagcaagaaagagagucu

SEQ ID NO: 305237 - RNA, 22 nt, Human
ugcugccuuugggaccuggccu

SEQ ID NO: 305238 - RNA, 22 nt, Human
ggcacugaaguggguguugggu

SEQ ID NO: 305239 - RNA, 22 nt, Human
uagacauuggccauuccugugg

SEQ ID NO: 305240 - RNA, 22 nt, Human
cccagcucucgcacuuacuagc

SEQ ID NO: 305241 - RNA, 22 nt, Human
uuccucuguaugcuuugcugcu

SEQ ID NO: 305242 - RNA, 22 nt, Human
cauaauuucccaagagauugaa

SEQ ID NO: 305243 - RNA, 22 nt, Human
acugaaggaagcgggcaggggu

SEQ ID NO: 305244 - RNA, 22 nt, Human
ucagucucuggggcuucuguuu

SEQ ID NO: 305245 - RNA, 22 nt, Human
acauuucuccuacuuguuauuu

SEQ ID NO: 305246 - RNA, 22 nt, Human
uuuugaauaauucagaaacagc

SEQ ID NO: 305247 - RNA, 22 nt, Human
ugcucagggacaauggagaggg

SEQ ID NO: 305248 - RNA, 22 nt, Human
uguucuuucaguuagacacagu

SEQ ID NO: 305249 - RNA, 22 nt, Human
gagggaagaaagaauugaugcg

SEQ ID NO: 305250 - RNA, 22 nt, Human
ccagggcaggggcuggaguuca

SEQ ID NO: 305251 - RNA, 22 nt, Human
cuuccagguccuucuugagaag

SEQ ID NO: 305252 - RNA, 22 nt, Human
gggagggaggugcugguucacg

SEQ ID NO: 305253 - RNA, 22 nt, Human
cuuccugguuugaagcucgccg

SEQ ID NO: 305254 - RNA, 22 nt, Human
ccugucugcaugagugagcaua

SEQ ID NO: 305255 - RNA, 20 nt, Human
ccuggcugcauucaggacgg

SEQ ID NO: 305256 - RNA, 22 nt, Human
guagcccaccuggggagggcga

SEQ ID NO: 305257 - RNA, 22 nt, Human
agagugagggggcacugagacg

SEQ ID NO: 305258 - RNA, 22 nt, Human
ccagggcagggaccacgugucu

SEQ ID NO: 305259 - RNA, 22 nt, Human
uucucuuugacauuauucaggu

SEQ ID NO: 305260 - RNA, 22 nt, Human
cagggcaguaacgggaacaucu

SEQ ID NO: 305261 - RNA, 22 nt, Human
cccaaggcugcagugagcauga

SEQ ID NO: 305262 - RNA, 22 nt, Human
uggcucugucaaacugcacaca

SEQ ID NO: 305263 - RNA, 22 nt, Human
gcugucugucuucacaucucgc

SEQ ID NO: 305264 - RNA, 22 nt, Human
gaacccaggcuuuugaggcugu

SEQ ID NO: 305265 - RNA, 20 nt, Human
gugcagccaagcugagccgc

SEQ ID NO: 305266 - RNA, 22 nt, Human
caaaugcagucccuuuguugcu

SEQ ID NO: 305267 - RNA, 22 nt, Human
cacagggcuuugauggcugagu

SEQ ID NO: 305268 - RNA, 22 nt, Human
gcaggcaguugcaguuuucuag

SEQ ID NO: 305269 - RNA, 22 nt, Human
aaaucacuaaguuauagugugg

SEQ ID NO: 305270 - RNA, 20 nt, Human
uuccuguauacaaagaguuc

SEQ ID NO: 305271 - RNA, 21 nt, Human
ggccuuggcgggggccgaauu

SEQ ID NO: 305272 - RNA, 22 nt, Human
uuuuccuguccaggcaauuauu

SEQ ID NO: 305273 - RNA, 22 nt, Human
auuuugaaaagcauuugaguaa

SEQ ID NO: 305274 - RNA, 22 nt, Human
aucuggcucccuuggaauccgu

SEQ ID NO: 305275 - RNA, 22 nt, Human
ucaauucugguccucaggaacu

SEQ ID NO: 305276 - RNA, 22 nt, Human
agggccagcccauaaugccaaa

SEQ ID NO: 305277 - RNA, 18 nt, Human
uggugaaggguggaggag

SEQ ID NO: 305278 - RNA, 22 nt, Human
agagaugucgccuugcccaggg

SEQ ID NO: 305279 - RNA, 21 nt, Human
agcugcuccagggagcucagg

SEQ ID NO: 305280 - RNA, 22 nt, Human
cacccugggcugggccuguuaa

SEQ ID NO: 305281 - RNA, 22 nt, Human
cucagucucuugggcugugaag

SEQ ID NO: 305282 - RNA, 21 nt, Human
ucacagacuggucagugaggc

SEQ ID NO: 305283 - RNA, 22 nt, Human
gacagcauggugucuguucagg

SEQ ID NO: 305284 - RNA, 22 nt, Human
agccaagcugaucuccugcuga

SEQ ID NO: 305285 - RNA, 22 nt, Human
aucuacauaaaacgaauacaua

SEQ ID NO: 305286 - RNA, 22 nt, Human
ugucacuucaggaaugcaggga

SEQ ID NO: 305287 - RNA, 19 nt, Human
accucugcagagauguuua

SEQ ID NO: 305288 - RNA, 22 nt, Human
gucaggauuggggucaugaguc

SEQ ID NO: 305289 - RNA, 22 nt, Human
aaagguaguacuucuagaaggg

SEQ ID NO: 305290 - RNA, 22 nt, Human
aaggcccuggccccagcuucuu

SEQ ID NO: 305291 - RNA, 22 nt, Human
ugaaaucaauugcaauguuuau

SEQ ID NO: 305292 - RNA, 22 nt, Human
ugggauaguggccaggaccccc

SEQ ID NO: 305293 - RNA, 22 nt, Human
ccacugucugcaggccucagca

SEQ ID NO: 305294 - RNA, 22 nt, Human
cuggcccagagagcagagcuua

SEQ ID NO: 305295 - RNA, 22 nt, Human
ccacugggggcugcaggcacuc

SEQ ID NO: 305296 - RNA, 22 nt, Human
cccagggacagcuagguggggc

SEQ ID NO: 305297 - RNA, 22 nt, Human
uuguaugaggauagcaagaagc

SEQ ID NO: 305298 - RNA, 22 nt, Human
gcagcugagcgugaggaagagu

SEQ ID NO: 305299 - RNA, 22 nt, Human
gguucacacuaagcuuaagugg

SEQ ID NO: 305300 - RNA, 22 nt, Human
cacugaaggaaggacuacugca

SEQ ID NO: 305301 - RNA, 22 nt, Human
agcagcucacaggauuccugaa

SEQ ID NO: 305302 - RNA, 22 nt, Human
ucuuuguaacugucuauugaga

SEQ ID NO: 305303 - RNA, 22 nt, Human
gccuccugagaagccacaggcu

SEQ ID NO: 305304 - RNA, 22 nt, Human
cccauuuaucccaagguuacuc

SEQ ID NO: 305305 - RNA, 22 nt, Human
gugcaugugcauccauguguac

SEQ ID NO: 305306 - RNA, 22 nt, Human
cugucuguuucugauucaaccu

SEQ ID NO: 305307 - RNA, 20 nt, Human
ugccagggccagcagaggcu

SEQ ID NO: 305308 - RNA, 22 nt, Human
aguacuuugcacuuugcucaga

SEQ ID NO: 305309 - RNA, 22 nt, Human
cauuaugugggaaaauguucuu

SEQ ID NO: 305310 - RNA, 22 nt, Human
ucaguuuucucauuuaugagau

SEQ ID NO: 305311 - RNA, 22 nt, Human
ccagggcauguaacuaauggug

SEQ ID NO: 305312 - RNA, 22 nt, Human
cuauuacauuucuggacauuca

SEQ ID NO: 305313 - RNA, 22 nt, Human
cuaaaugacuuccagugguuau

SEQ ID NO: 305314 - RNA, 22 nt, Human
augcagagacagauguggcaug

SEQ ID NO: 305315 - RNA, 22 nt, Human
cugggggcaauggucagagugu

SEQ ID NO: 305316 - RNA, 22 nt, Human
caaggccugccucuggcagaaa

SEQ ID NO: 305317 - RNA, 22 nt, Human
aggaaaugcugaugcuccugga

SEQ ID NO: 305318 - RNA, 22 nt, Human
ugccagaagugcuuuauaagug

SEQ ID NO: 305319 - RNA, 22 nt, Human
aguuuauguaaaauuaguaaug

SEQ ID NO: 305320 - RNA, 22 nt, Human
cagagcagguaucuuuggugaa

SEQ ID NO: 305321 - RNA, 22 nt, Human
gcaggcuccaggccggccccuu

SEQ ID NO: 305322 - RNA, 22 nt, Human
gguuugaacagcuuuggagaag

SEQ ID NO: 305323 - RNA, 22 nt, Human
augcacgccccacacuggugug

SEQ ID NO: 305324 - RNA, 22 nt, Human
ggaggguuagcaaaggcacaga

SEQ ID NO: 305325 - RNA, 22 nt, Human
augcugugucaggaauuugaua

SEQ ID NO: 305326 - RNA, 22 nt, Human
cugcuuugaggggcucuguaua

SEQ ID NO: 305327 - RNA, 20 nt, Human
ucagaggcugccagcugggg

SEQ ID NO: 305328 - RNA, 20 nt, Human
auaaaauaacugccacaaga

SEQ ID NO: 305329 - RNA, 22 nt, Human
ggggcuguuuuuggaauggcug

SEQ ID NO: 305330 - RNA, 22 nt, Human
caguuucuacgaaggucaaccc

SEQ ID NO: 305331 - RNA, 21 nt, Human
uaaauaauaaguugcugagau

SEQ ID NO: 305332 - RNA, 20 nt, Human
cacaggccuugugagcagac

SEQ ID NO: 305333 - RNA, 22 nt, Human
auguagaacagguuaaugacag

SEQ ID NO: 305334 - RNA, 22 nt, Human
ggcagcugugaagugccucaca

SEQ ID NO: 305335 - RNA, 22 nt, Human
gucucaguuguaucaccugguu

SEQ ID NO: 305336 - RNA, 22 nt, Human
aauuaguauugcgauucauuag

SEQ ID NO: 305337 - RNA, 22 nt, Human
ucugagaggauuccugucccga

SEQ ID NO: 305338 - RNA, 22 nt, Human
gggaaauugugugagaucuuug

SEQ ID NO: 305339 - RNA, 22 nt, Human
gugaaacacccuccaaugcaca

SEQ ID NO: 305340 - RNA, 23 nt, Human
ugauuuccagugagucaguggga

SEQ ID NO: 305341 - RNA, 20 nt, Human
uucugucagauuauauggga

SEQ ID NO: 305342 - RNA, 22 nt, Human
gcucaggagcucuugguggcgc

SEQ ID NO: 305343 - RNA, 22 nt, Human
ugucacaaacauacauuauaga

SEQ ID NO: 305344 - RNA, 22 nt, Human
cagagcuguugcggggcuuggc

SEQ ID NO: 305345 - RNA, 22 nt, Human
cagucccaucucccagguggcu

SEQ ID NO: 305346 - RNA, 22 nt, Human
agaaggccuaacuugggggcaa

SEQ ID NO: 305347 - RNA, 19 nt, Human
agaggcugucaccuguagc

SEQ ID NO: 305348 - RNA, 22 nt, Human
uaaauuauguuccauguccuuu

SEQ ID NO: 305349 - RNA, 22 nt, Human
agcagaugaaucccagauaaag

SEQ ID NO: 305350 - RNA, 22 nt, Human
gaaaggccauuucugaggguuu

SEQ ID NO: 305351 - RNA, 22 nt, Human
cccaggcucccaggugggacaa

SEQ ID NO: 305352 - RNA, 22 nt, Human
ugggagaagcagugggacagua

SEQ ID NO: 305353 - RNA, 22 nt, Human
aguccagggcucucugugggau

SEQ ID NO: 305354 - RNA, 22 nt, Human
cuguccuugcuggccagguaug

SEQ ID NO: 305355 - RNA, 22 nt, Human
ggggugggcgugcagggacacc

SEQ ID NO: 305356 - RNA, 22 nt, Human
agcagccagagaaugaugcagu

SEQ ID NO: 305357 - RNA, 22 nt, Human
gggcuguggagccgcgagggcu

SEQ ID NO: 305358 - RNA, 22 nt, Human
guuugcauuucuugaacuauau

SEQ ID NO: 305359 - RNA, 22 nt, Human
aaguucaaggugauaguggcag

SEQ ID NO: 305360 - RNA, 22 nt, Human
ucaggagggugacaggcccugg

SEQ ID NO: 305361 - RNA, 22 nt, Human
cagggccaguucucgcagcagu

SEQ ID NO: 305362 - RNA, 22 nt, Human
uaugucaaaguuaagaaauagg

SEQ ID NO: 305363 - RNA, 20 nt, Human
gccugagcuauugccaggau

SEQ ID NO: 305364 - RNA, 22 nt, Human
caugcuguguguuuuagcucca

SEQ ID NO: 305365 - RNA, 22 nt, Human
aggagucauaaaugugaacaaa

SEQ ID NO: 305366 - RNA, 22 nt, Human
uuuucagaggccuaagagguuu

SEQ ID NO: 305367 - RNA, 21 nt, Human
agacagaacaacugcucucca

SEQ ID NO: 305368 - RNA, 17 nt, Human
ucaggcugugccuggua

SEQ ID NO: 305369 - RNA, 22 nt, Human
gaagcccuauccucuccuggga

SEQ ID NO: 305370 - RNA, 22 nt, Human
cauucuuauauuuacucauuca

SEQ ID NO: 305371 - RNA, 22 nt, Human
gaggcagcaaaauauaucauaa

SEQ ID NO: 305372 - RNA, 22 nt, Human
caaggccaguuucuccuaguca

SEQ ID NO: 305373 - RNA, 15 nt, Human
aaucuggcggcaagu

SEQ ID NO: 305374 - RNA, 22 nt, Human
gaaucucaaggcuugugaggau

SEQ ID NO: 305375 - RNA, 22 nt, Human
agagugaucagauaucaggugu

SEQ ID NO: 305376 - RNA, 22 nt, Human
uguacauagaucuugaaaauua

SEQ ID NO: 305377 - RNA, 22 nt, Human
guuugcauggaagacagugagu

SEQ ID NO: 305378 - RNA, 22 nt, Human
gacacuccagcuuuuggcucaa

SEQ ID NO: 305379 - RNA, 22 nt, Human
uauguacauggagagcaauuga

SEQ ID NO: 305380 - RNA, 22 nt, Human
ugcagcugcuggcccaggugcu

SEQ ID NO: 305381 - RNA, 22 nt, Human
agccugcaggaugggcagcacc

SEQ ID NO: 305382 - RNA, 22 nt, Human
guucagggagggacagaugaag

SEQ ID NO: 305383 - RNA, 22 nt, Human
cugggcacagcguugggcucuu

SEQ ID NO: 305384 - RNA, 22 nt, Human
gcagagcuguuaauggagcuga

SEQ ID NO: 305385 - RNA, 22 nt, Human
auguguccacaggugugagaga

SEQ ID NO: 305386 - RNA, 22 nt, Human
agggccagcugaugagaaugag

SEQ ID NO: 305387 - RNA, 22 nt, Human
agggcagagaaauguaguugag

SEQ ID NO: 305388 - RNA, 22 nt, Human
ugccugugucacagugauguuu

SEQ ID NO: 305389 - RNA, 22 nt, Human
cagcaggguagguuguaucagu

SEQ ID NO: 305390 - RNA, 22 nt, Human
gcugagcugcuguucauccugc

SEQ ID NO: 305391 - RNA, 22 nt, Human
uuccuuguuuguagcucuggga

SEQ ID NO: 305392 - RNA, 22 nt, Human
gcucugcuugcaucaugacugc

SEQ ID NO: 305393 - RNA, 22 nt, Human
guauuuauaggggaaugagagu

SEQ ID NO: 305394 - RNA, 22 nt, Human
gcucagugugcacgaguacucu

SEQ ID NO: 305395 - RNA, 22 nt, Human
ugaaguuauauauguugaaaau

SEQ ID NO: 305396 - RNA, 19 nt, Human
ccagucccauacaggagau

SEQ ID NO: 305397 - RNA, 23 nt, Human
cugcagucgccggccugggugcc

SEQ ID NO: 305398 - RNA, 22 nt, Human
ccugggagugugccaucucugu

SEQ ID NO: 305399 - RNA, 22 nt, Human
uuucaaacuuuacucuugaauc

SEQ ID NO: 305400 - RNA, 22 nt, Human
cugccuuggaaaaugugguaau

SEQ ID NO: 305401 - RNA, 22 nt, Human
ucaggcugcccguucagggcuc

SEQ ID NO: 305402 - RNA, 22 nt, Human
cagggugccuguccucagcaaa

SEQ ID NO: 305403 - RNA, 19 nt, Human
gagaggccugugcuugaag

SEQ ID NO: 305404 - RNA, 22 nt, Human
ucaaagagcucuaucuucaaaa

SEQ ID NO: 305405 - RNA, 22 nt, Human
ugggcugcccaagguggccaug

SEQ ID NO: 305406 - RNA, 22 nt, Human
ggaguaaggcucagaggaaaug

SEQ ID NO: 305407 - RNA, 22 nt, Human
aggcucaguuugguuuccauug

SEQ ID NO: 305408 - RNA, 22 nt, Human
augccuggacugacaugcacug

SEQ ID NO: 305409 - RNA, 22 nt, Human
agagccaggugcugcuguuuga

SEQ ID NO: 305410 - RNA, 22 nt, Human
aucaggauccaccuugagccug

SEQ ID NO: 305411 - RNA, 22 nt, Human
uugcugaauugaauccuuuggu

SEQ ID NO: 305412 - RNA, 22 nt, Human
gcugcagcuuuaggauccagug

SEQ ID NO: 305413 - RNA, 22 nt, Human
caaaagcaguucuaucugaguu

SEQ ID NO: 305414 - RNA, 23 nt, Human
aucuguucaucugacacagauuc

SEQ ID NO: 305415 - RNA, 21 nt, Human
ccuauugaauauaggaagauu

SEQ ID NO: 305416 - RNA, 22 nt, Human
agcaaagucaguggaaccaucc

SEQ ID NO: 305417 - RNA, 22 nt, Human
ccugggugacccgugagcgucc

SEQ ID NO: 305418 - RNA, 22 nt, Human
gcccccucuuuggagccagcca

SEQ ID NO: 305419 - RNA, 22 nt, Human
gguucacacuuucaugauuuca

SEQ ID NO: 305420 - RNA, 21 nt, Human
uuguucuuccagaagcaaagu

SEQ ID NO: 305421 - RNA, 22 nt, Human
aucaggaucacagaaacuuuua

SEQ ID NO: 305422 - RNA, 22 nt, Human
auggggugaccaugagcauuua

SEQ ID NO: 305423 - RNA, 22 nt, Human
auucuuauuuaaauagagucug

SEQ ID NO: 305424 - RNA, 22 nt, Human
gaaacccaaacuaagacaguag

SEQ ID NO: 305425 - RNA, 22 nt, Human
uagccgcuuaauuauuugguga

SEQ ID NO: 305426 - RNA, 22 nt, Human
cugcaggcugagcgccugccgg

SEQ ID NO: 305427 - RNA, 22 nt, Human
auuguucaaagugcuuugcaug

SEQ ID NO: 305428 - RNA, 22 nt, Human
aagccagccagugccagucuua

SEQ ID NO: 305429 - RNA, 22 nt, Human
augcaucuauucccaagggcag

SEQ ID NO: 305430 - RNA, 23 nt, Human
uggcagagacccagaaucuacau

SEQ ID NO: 305431 - RNA, 22 nt, Human
ugucacauaggcaaaauguuuu

SEQ ID NO: 305432 - RNA, 19 nt, Human
gcugggagcagacccuccc

SEQ ID NO: 305433 - RNA, 22 nt, Human
uacaugcuccacuuucuccugu

SEQ ID NO: 305434 - RNA, 22 nt, Human
cacugcagcaccaugcagggcu

SEQ ID NO: 305435 - RNA, 22 nt, Human
aagagguugucugugaugaguu

SEQ ID NO: 305436 - RNA, 22 nt, Human
ccugucuguaucgguucagagu

SEQ ID NO: 305437 - RNA, 22 nt, Human
aaauauagugacacuuauaguc

SEQ ID NO: 305438 - RNA, 22 nt, Human
gacagaagaggaacuuggacag

SEQ ID NO: 305439 - RNA, 22 nt, Human
gccugggagagggauagugcag

SEQ ID NO: 305440 - RNA, 22 nt, Human
cagggcccaggccacuggguug

SEQ ID NO: 305441 - RNA, 22 nt, Human
ucaggugggaccugcuaggaca

SEQ ID NO: 305442 - RNA, 22 nt, Human
ggaggccauaguuugggaguca

SEQ ID NO: 305443 - RNA, 22 nt, Human
ugcuuggcuuucugagcuucug

SEQ ID NO: 305444 - RNA, 22 nt, Human
uuugaacugauaaucuucuguu

SEQ ID NO: 305445 - RNA, 22 nt, Human
augcagcuucaggauuaugaug

SEQ ID NO: 305446 - RNA, 22 nt, Human
aaagaaggaccuggaggaggau

SEQ ID NO: 305447 - RNA, 21 nt, Human
ccugagccuguuuauccagaa

SEQ ID NO: 305448 - RNA, 22 nt, Human
aaauaguucagccacggugacu

SEQ ID NO: 305449 - RNA, 22 nt, Human
ccccagcucagugcagggacau

SEQ ID NO: 305450 - RNA, 22 nt, Human
gagaggagguggcuaugacagc

SEQ ID NO: 305451 - RNA, 22 nt, Human
ggugaggcagguggcugcugag

SEQ ID NO: 305452 - RNA, 22 nt, Human
gcuuuccuggcccugucccugc

SEQ ID NO: 305453 - RNA, 22 nt, Human
guggccuggauagacuccaucu

SEQ ID NO: 305454 - RNA, 19 nt, Human
ugcuagaaauucugugacu

SEQ ID NO: 305455 - RNA, 22 nt, Human
uugaauuauaagugugucuacu

SEQ ID NO: 305456 - RNA, 22 nt, Human
aggccuguuggcgugggcucua

SEQ ID NO: 305457 - RNA, 22 nt, Human
gaaaggucaguuccacuuccau

SEQ ID NO: 305458 - RNA, 22 nt, Human
ccuggagcaaaaaucuaaggag

SEQ ID NO: 305459 - RNA, 22 nt, Human
acucaagauagggaaaguacaa

SEQ ID NO: 305460 - RNA, 22 nt, Human
cagcugggagcuccauuagaua

SEQ ID NO: 305461 - RNA, 22 nt, Human
aaaguguaaggaauuuaaguaa

SEQ ID NO: 305462 - RNA, 22 nt, Human
guuugcauuccaauuuagggga

SEQ ID NO: 305463 - RNA, 18 nt, Human
gcccagaggucugggccc

SEQ ID NO: 305464 - RNA, 22 nt, Human
uguuuuaaucucccauugcucu

SEQ ID NO: 305465 - RNA, 22 nt, Human
ugcugcacgauaaauaauuucu

SEQ ID NO: 305466 - RNA, 22 nt, Human
ugcauguguuugccacagugag

SEQ ID NO: 305467 - RNA, 22 nt, Human
uggaaagucucuuuugacugua

SEQ ID NO: 305468 - RNA, 22 nt, Human
ggccuaguuuuuucugguaggu

SEQ ID NO: 305469 - RNA, 21 nt, Human
agccuggcccagggggaggcu

SEQ ID NO: 305470 - RNA, 22 nt, Human
uuucuguagggauuucacaguu

SEQ ID NO: 305471 - RNA, 22 nt, Human
uuccuaauggcaaaacauguuu

SEQ ID NO: 305472 - RNA, 21 nt, Human
cccuguguuccacagcagaca

SEQ ID NO: 305473 - RNA, 22 nt, Human
ugcagcuccucuggcugccuga

SEQ ID NO: 305474 - RNA, 22 nt, Human
ggcuucauggaggaggugaguc

SEQ ID NO: 305475 - RNA, 22 nt, Human
uuucucugaggcuggccucccu

SEQ ID NO: 305476 - RNA, 22 nt, Human
uuccaugaagggcagccucuca

SEQ ID NO: 305477 - RNA, 21 nt, Human
guggcccugguguggcugcac

SEQ ID NO: 305478 - RNA, 22 nt, Human
uggaggaugagugugggcucug

SEQ ID NO: 305479 - RNA, 19 nt, Human
ggaaacaggggccagagga

SEQ ID NO: 305480 - RNA, 22 nt, Human
gguuauauaauucagugcuuuc

SEQ ID NO: 305481 - RNA, 22 nt, Human
aaagauuucacaucccaagccu

SEQ ID NO: 305482 - RNA, 22 nt, Human
guggugcauccuugaguaagcu

SEQ ID NO: 305483 - RNA, 18 nt, Human
aaaaugcaggcgacaugg

SEQ ID NO: 305484 - RNA, 20 nt, Human
gcugucuggauuagaagccu

SEQ ID NO: 305485 - RNA, 22 nt, Human
ucuucacaggagccugccugcc

SEQ ID NO: 305486 - RNA, 22 nt, Human
ggaugcaggaguugaagaagga

SEQ ID NO: 305487 - RNA, 22 nt, Human
uucuucuucaagugcugcauuc

SEQ ID NO: 305488 - RNA, 22 nt, Human
ccagggcaugggaagaacugaa

SEQ ID NO: 305489 - RNA, 22 nt, Human
cccugggcaagcccuauuuucc

SEQ ID NO: 305490 - RNA, 22 nt, Human
augcugugguagacagcauucc

SEQ ID NO: 305491 - RNA, 22 nt, Human
uuguggaaauacagacuccaag

SEQ ID NO: 305492 - RNA, 22 nt, Human
ggaaaagacagaauucuagaau

SEQ ID NO: 305493 - RNA, 22 nt, Human
cacagugcaugaugggcagaag

SEQ ID NO: 305494 - RNA, 22 nt, Human
ggaaaguggugguggaaagagg

SEQ ID NO: 305495 - RNA, 19 nt, Human
ggcagagcuccugcuuucu

SEQ ID NO: 305496 - RNA, 22 nt, Human
guuugcauguguacuuaauugg

SEQ ID NO: 305497 - RNA, 22 nt, Human
gcuuccucccugcugcucacua

SEQ ID NO: 305498 - RNA, 22 nt, Human
ucaguguuuccuagagcauaua

SEQ ID NO: 305499 - RNA, 22 nt, Human
uuugcauucuagaaaaauuucu

SEQ ID NO: 305500 - RNA, 22 nt, Human
uggagcagccaugaugacagag

SEQ ID NO: 305501 - RNA, 22 nt, Human
uacauugugauguuucaauaca

SEQ ID NO: 305502 - RNA, 22 nt, Human
aggcccaguguggcuuccugga

SEQ ID NO: 305503 - RNA, 22 nt, Human
cugccucucaggucccugagau

SEQ ID NO: 305504 - RNA, 22 nt, Human
aaguucaagaucaagguuccag

SEQ ID NO: 305505 - RNA, 22 nt, Human
gaucucuguggacucuuagcac

SEQ ID NO: 305506 - RNA, 22 nt, Human
gaaaucugaacaacagcuguca

SEQ ID NO: 305507 - RNA, 22 nt, Human
cagggcaguuuuacuucucucu

SEQ ID NO: 305508 - RNA, 22 nt, Human
gugccaggugcuaagcugugcu

SEQ ID NO: 305509 - RNA, 22 nt, Human
guucgcaucuugaucauggacu

SEQ ID NO: 305510 - RNA, 22 nt, Human
uccuggagauaauugcagugaa

SEQ ID NO: 305511 - RNA, 22 nt, Human
ggagcaaaugccaagugggagg

SEQ ID NO: 305512 - RNA, 22 nt, Human
cagcucccuauggugaggcgac

SEQ ID NO: 305513 - RNA, 22 nt, Human
gcuuucucuucacugauguuca

SEQ ID NO: 305514 - RNA, 22 nt, Human
acaguguuccuuuguugugacu

SEQ ID NO: 305515 - RNA, 22 nt, Human
gaaacauacgauuuaggagaaa

SEQ ID NO: 305516 - RNA, 22 nt, Human
auuuugaaaccaaguuauuucc

SEQ ID NO: 305517 - RNA, 22 nt, Human
gcuggccucgcaggcaggaugu

SEQ ID NO: 305518 - RNA, 21 nt, Human
cacucaggguaugugccaggc

SEQ ID NO: 305519 - RNA, 23 nt, Human
aucaagauaauccagaugaccua

SEQ ID NO: 305520 - RNA, 22 nt, Human
gaagcagcucagauugacugaa

SEQ ID NO: 305521 - RNA, 21 nt, Human
gcagccacagccaccaagcua

SEQ ID NO: 305522 - RNA, 22 nt, Human
ugagagugauugguucgaaugu

SEQ ID NO: 305523 - RNA, 22 nt, Human
uaugaaaagguggccaauguag

SEQ ID NO: 305524 - RNA, 22 nt, Human
gagggcugaugcuuacuuauuu

SEQ ID NO: 305525 - RNA, 22 nt, Human
augggugugaaaauggucaucu

SEQ ID NO: 305526 - RNA, 22 nt, Human
caucuucagguucauggucaua

SEQ ID NO: 305527 - RNA, 22 nt, Human
auccugucaucauaguacuuga

SEQ ID NO: 305528 - RNA, 22 nt, Human
ucaugacaacuauauuauucca

SEQ ID NO: 305529 - RNA, 22 nt, Human
ggcugcugcccaccccugcaug

SEQ ID NO: 305530 - RNA, 22 nt, Human
ggcaggagaauggcgugaacuc

SEQ ID NO: 305531 - RNA, 22 nt, Human
gagagucuagugcaccuaguuu

SEQ ID NO: 305532 - RNA, 22 nt, Human
ucagccagguaauguggagaug

SEQ ID NO: 305533 - RNA, 22 nt, Human
uuccaggggcagcagugauggu

SEQ ID NO: 305534 - RNA, 22 nt, Human
uuuacauuucccucugucaguu

SEQ ID NO: 305535 - RNA, 22 nt, Human
aggagcccugcgggaggcagag

SEQ ID NO: 305536 - RNA, 20 nt, Human
ucucagcauaagaacccuuc

SEQ ID NO: 305537 - RNA, 22 nt, Human
cuguuucaagugaagucagaca

SEQ ID NO: 305538 - RNA, 22 nt, Human
aggggagaauuucaacucaggu

SEQ ID NO: 305539 - RNA, 22 nt, Human
acauuugaggauguuaagaaug

SEQ ID NO: 305540 - RNA, 22 nt, Human
guuugaaaaaagcaguauguaa

SEQ ID NO: 305541 - RNA, 22 nt, Human
gugcucuccuggcugcccugac

SEQ ID NO: 305542 - RNA, 22 nt, Human
ucugggaacucugucauuuccc

SEQ ID NO: 305543 - RNA, 22 nt, Human
ugugccuggaucucugugacaa

SEQ ID NO: 305544 - RNA, 22 nt, Human
ucauuacagagauauaaucuac

SEQ ID NO: 305545 - RNA, 22 nt, Human
uguacaguaggaacuuguuauu

SEQ ID NO: 305546 - RNA, 22 nt, Human
gagcaagacucacugcaucuug

SEQ ID NO: 305547 - RNA, 22 nt, Human
cugagucucccggcaguggagg

SEQ ID NO: 305548 - RNA, 22 nt, Human
gaauauuuguaauuacuguuga

SEQ ID NO: 305549 - RNA, 22 nt, Human
gugucaugggguuuguuauaca

SEQ ID NO: 305550 - RNA, 17 nt, Human
ggccuguguggcugcag

SEQ ID NO: 305551 - RNA, 22 nt, Human
uagacagauuucuuguuagaca

SEQ ID NO: 305552 - RNA, 21 nt, Human
caauaaacugcacauugagac

SEQ ID NO: 305553 - RNA, 19 nt, Human
uuacuuggcaaagucaguc

SEQ ID NO: 305554 - RNA, 22 nt, Human
gagcagaugugugccaggaugc

SEQ ID NO: 305555 - RNA, 22 nt, Human
gugauuuucuccuccuagaagu

SEQ ID NO: 305556 - RNA, 22 nt, Human
aaaucuaggcucauccuggucc

SEQ ID NO: 305557 - RNA, 22 nt, Human
uugaauucauuucucauugagu

SEQ ID NO: 305558 - RNA, 22 nt, Human
cuuaacagauacaucugugguu

SEQ ID NO: 305559 - RNA, 23 nt, Human
acaaaugcccauacaucuaguuc

SEQ ID NO: 305560 - RNA, 22 nt, Human
gcugccugccuugccuggagga

SEQ ID NO: 305561 - RNA, 22 nt, Human
gggagcugagggaccucugugg

SEQ ID NO: 305562 - RNA, 22 nt, Human
cauugaaauauggaaacugaug

SEQ ID NO: 305563 - RNA, 16 nt, Human
ggcaccagugaacaca

SEQ ID NO: 305564 - RNA, 22 nt, Human
ccugagugaauucccucacugu

SEQ ID NO: 305565 - RNA, 22 nt, Human
uacauauguaaacauguauaaa

SEQ ID NO: 305566 - RNA, 22 nt, Human
cauguuuucuaggcuuucacaa

SEQ ID NO: 305567 - RNA, 22 nt, Human
ggcagcugagcauggcuaccuu

SEQ ID NO: 305568 - RNA, 22 nt, Human
augugaaaauccaauggcagca

SEQ ID NO: 305569 - RNA, 22 nt, Human
ccagcucucugcagaaaggacu

SEQ ID NO: 305570 - RNA, 22 nt, Human
ccuccagggcagacggggagca

SEQ ID NO: 305571 - RNA, 22 nt, Human
uggaggccagagguacugggac

SEQ ID NO: 305572 - RNA, 22 nt, Human
caacauuucaaggucuuuagga

SEQ ID NO: 305573 - RNA, 22 nt, Human
cugaggccuaagacaugaauga

SEQ ID NO: 305574 - RNA, 22 nt, Human
ggcccaguguggguggauguug

SEQ ID NO: 305575 - RNA, 22 nt, Human
ugcagaagcugcaggucagugg

SEQ ID NO: 305576 - RNA, 22 nt, Human
gcaggcugaugacuggaguugg

SEQ ID NO: 305577 - RNA, 18 nt, Human
gggcccuggcguccgccc

SEQ ID NO: 305578 - RNA, 17 nt, Human
cauguguaugugggagu

SEQ ID NO: 305579 - RNA, 22 nt, Human
aggccugacuugaauuuagggc

SEQ ID NO: 305580 - RNA, 22 nt, Human
aaugaacaggugaaugucagau

SEQ ID NO: 305581 - RNA, 22 nt, Human
uggcagcaauuagcuagagcug

SEQ ID NO: 305582 - RNA, 22 nt, Human
uaacaucuuuagcagcucgaac

SEQ ID NO: 305583 - RNA, 22 nt, Human
aagcagcacaguaauauuggug

SEQ ID NO: 305584 - RNA, 22 nt, Human
gaggggcucuuuaauaguaaca

SEQ ID NO: 305585 - RNA, 19 nt, Human
gggcuucugggaucaagag

SEQ ID NO: 305586 - RNA, 22 nt, Human
uucugucacuugcaaucaagag

SEQ ID NO: 305587 - RNA, 22 nt, Human
cagcuggaugggagaccauguu

SEQ ID NO: 305588 - RNA, 22 nt, Human
ugucugagugugccugggcauu

SEQ ID NO: 305589 - RNA, 22 nt, Human
gacagggcaagacucugucuaa

SEQ ID NO: 305590 - RNA, 22 nt, Human
uagugcuuuaaguuuacagaga

SEQ ID NO: 305591 - RNA, 22 nt, Human
ugcauggaggaagaugaaugca

SEQ ID NO: 305592 - RNA, 22 nt, Human
uagaaacugauagucuugugcu

SEQ ID NO: 305593 - RNA, 22 nt, Human
aaaagagucuuaggcagucaua

SEQ ID NO: 305594 - RNA, 22 nt, Human
agucauaugacccuucacaaac

SEQ ID NO: 305595 - RNA, 22 nt, Human
ccucccacauugaggacaugcu

SEQ ID NO: 305596 - RNA, 22 nt, Human
agccagggacgcugcaggcuac

SEQ ID NO: 305597 - RNA, 22 nt, Human
cugcugcugagagcucagccug

SEQ ID NO: 305598 - RNA, 22 nt, Human
uaguguucuaagaacauccaug

SEQ ID NO: 305599 - RNA, 22 nt, Human
uucucuucuguucagugcccaa

SEQ ID NO: 305600 - RNA, 22 nt, Human
uaaggccaaggggccauagucu

SEQ ID NO: 305601 - RNA, 22 nt, Human
uccagcagaccaucaaggcuca

SEQ ID NO: 305602 - RNA, 22 nt, Human
aaaaacuguaauuacuuuugca

SEQ ID NO: 305603 - RNA, 22 nt, Human
gcaaguuauuuccauuuaaagc

SEQ ID NO: 305604 - RNA, 22 nt, Human
uggaagcaucacuucuugccug

SEQ ID NO: 305605 - RNA, 22 nt, Human
ucccagagugugggcaucaagg

SEQ ID NO: 305606 - RNA, 22 nt, Human
agcucccugagaugccacagca

SEQ ID NO: 305607 - RNA, 22 nt, Human
gagcccuccauggagccaggca

SEQ ID NO: 305608 - RNA, 22 nt, Human
ugucuucagcaaaugccuuucu

SEQ ID NO: 305609 - RNA, 22 nt, Human
gaggggcagaaugugaucaggg

SEQ ID NO: 305610 - RNA, 22 nt, Human
agugccuggaccccaugacaua

SEQ ID NO: 305611 - RNA, 22 nt, Human
ccagcccugucaccaacuggag

SEQ ID NO: 305612 - RNA, 22 nt, Human
ggggcagaaagcccacagagug

SEQ ID NO: 305613 - RNA, 21 nt, Human
uggcacugcuuagcagguucc

SEQ ID NO: 305614 - RNA, 22 nt, Human
gcugucuugcucacucuugcag

SEQ ID NO: 305615 - RNA, 22 nt, Human
gagcucuggcagggcaggucug

SEQ ID NO: 305616 - RNA, 22 nt, Human
ggucagagggugggcugccugu

SEQ ID NO: 305617 - RNA, 22 nt, Human
ugcuucuggaaacaguggcugu

SEQ ID NO: 305618 - RNA, 23 nt, Human
uggcucagcuaguuuuccauuuc

SEQ ID NO: 305619 - RNA, 22 nt, Human
uuugaauagaggccccucagaa

SEQ ID NO: 305620 - RNA, 22 nt, Human
guuggccugaauggucaagagg

SEQ ID NO: 305621 - RNA, 22 nt, Human
gcacuaaaccaacauguaauaa

SEQ ID NO: 305622 - RNA, 22 nt, Human
uuuggaauauuaaaaugucuca

SEQ ID NO: 305623 - RNA, 18 nt, Human
uuuccuuguaugaacaua

SEQ ID NO: 305624 - RNA, 22 nt, Human
augacaugaccugguagagaca

SEQ ID NO: 305625 - RNA, 22 nt, Human
ucaaauaaugccauucaucauc

SEQ ID NO: 305626 - RNA, 22 nt, Human
aacucagucauaaagcgaaugc

SEQ ID NO: 305627 - RNA, 22 nt, Human
ucucaggacuuugggaagcuca

SEQ ID NO: 305628 - RNA, 22 nt, Human
uggagcaagcuggagagaacau

SEQ ID NO: 305629 - RNA, 22 nt, Human
ugcagcccuuccuuccucuggg

SEQ ID NO: 305630 - RNA, 22 nt, Human
aagcagccagccaucaugcccg

SEQ ID NO: 305631 - RNA, 22 nt, Human
aaccaggacaauuugaauagaa

SEQ ID NO: 305632 - RNA, 22 nt, Human
uuucagaugguauauacaguag

SEQ ID NO: 305633 - RNA, 22 nt, Human
uaugaagauauaucugaucucu

SEQ ID NO: 305634 - RNA, 22 nt, Human
ucucugaguaagugacaguuca

SEQ ID NO: 305635 - RNA, 22 nt, Human
aaucaguuguucacucugaaaa

SEQ ID NO: 305636 - RNA, 22 nt, Human
uccagcucuaacaugcugggcc

SEQ ID NO: 305637 - RNA, 22 nt, Human
gugcauuucucauacacuaaau

SEQ ID NO: 305638 - RNA, 22 nt, Human
uuucacauguggaaugccaggu

SEQ ID NO: 305639 - RNA, 22 nt, Human
cagcucugcugggaggaugcag

SEQ ID NO: 305640 - RNA, 22 nt, Human
cugcugcucagugucaucaugu

SEQ ID NO: 305641 - RNA, 22 nt, Human
agagugucugguagcugcucug

SEQ ID NO: 305642 - RNA, 22 nt, Human
uuagaaaugauuucaccucuuu

SEQ ID NO: 305643 - RNA, 22 nt, Human
gccugagauucugcauuucuaa

SEQ ID NO: 305644 - RNA, 22 nt, Human
cagcaaaauuugaggauugccu

SEQ ID NO: 305645 - RNA, 21 nt, Human
cuccugggcuaagauauagug

SEQ ID NO: 305646 - RNA, 20 nt, Human
uuucagugguuugugccuag

SEQ ID NO: 305647 - RNA, 22 nt, Human
cugcagaguggagccucggcug

SEQ ID NO: 305648 - RNA, 22 nt, Human
acugaaauacugcucuuggauu

SEQ ID NO: 305649 - RNA, 22 nt, Human
aaagguuaguucuuagaagugc

SEQ ID NO: 305650 - RNA, 22 nt, Human
uuuccucuuugugacacagcug

SEQ ID NO: 305651 - RNA, 22 nt, Human
cagguggggagaguguggagca

SEQ ID NO: 305652 - RNA, 22 nt, Human
aaaugaacaguugcauucucug

SEQ ID NO: 305653 - RNA, 22 nt, Human
gggugggccacugagcagcgug

SEQ ID NO: 305654 - RNA, 22 nt, Human
ugaaacauugcacuguaugaau

SEQ ID NO: 305655 - RNA, 21 nt, Human
cagaggcagguccugggacgg

SEQ ID NO: 305656 - RNA, 22 nt, Human
ucucaggagccacagcgggagu

SEQ ID NO: 305657 - RNA, 22 nt, Human
agugauggagcuuccucugcua

SEQ ID NO: 305658 - RNA, 22 nt, Human
uggagcagcuaagccucugaga

SEQ ID NO: 305659 - RNA, 22 nt, Human
gcagugggaagguuggcacaug

SEQ ID NO: 305660 - RNA, 22 nt, Human
augcugugcuggcuaaccaugg

SEQ ID NO: 305661 - RNA, 22 nt, Human
agcaggagcugugggaagaugg

SEQ ID NO: 305662 - RNA, 22 nt, Human
ugucaugccaccguuucccaga

SEQ ID NO: 305663 - RNA, 22 nt, Human
agaugagggguagaaaggacuu

SEQ ID NO: 305664 - RNA, 22 nt, Human
cccugugggaacuccugaguug

SEQ ID NO: 305665 - RNA, 22 nt, Human
uuggaaaaacacgauagugguu

SEQ ID NO: 305666 - RNA, 23 nt, Human
agcccagcagagaaccuaggucc

SEQ ID NO: 305667 - RNA, 22 nt, Human
ugucucaggggcauugaaauaa

SEQ ID NO: 305668 - RNA, 22 nt, Human
acagcagagacacucaggaggc

SEQ ID NO: 305669 - RNA, 22 nt, Human
gagccauacaaccuauaaagug

SEQ ID NO: 305670 - RNA, 22 nt, Human
gagcagaacaggccggguggga

SEQ ID NO: 305671 - RNA, 22 nt, Human
aacagaauugcugcugccaaug

SEQ ID NO: 305672 - RNA, 22 nt, Human
cagagccccccuucugaucaca

SEQ ID NO: 305673 - RNA, 22 nt, Human
cacugcucgcugcagcauggcc

SEQ ID NO: 305674 - RNA, 22 nt, Human
gauuucuugauaauucaaaucc

SEQ ID NO: 305675 - RNA, 22 nt, Human
ggggcagaguagcuggggugug

SEQ ID NO: 305676 - RNA, 22 nt, Human
gggcuggggcucaauaauuugu

SEQ ID NO: 305677 - RNA, 22 nt, Human
uugggcuggcagagguggucuu

SEQ ID NO: 305678 - RNA, 22 nt, Human
ucagccagugccuugaucuugc

SEQ ID NO: 305679 - RNA, 22 nt, Human
cccugggacccgcugcagaggc

SEQ ID NO: 305680 - RNA, 22 nt, Human
agaguguaauaagggcaagggc

SEQ ID NO: 305681 - RNA, 19 nt, Human
ugacaggcuguugccuuga

SEQ ID NO: 305682 - RNA, 22 nt, Human
cagagggcucaguccugcugga

SEQ ID NO: 305683 - RNA, 22 nt, Human
auacaguauuaccuguucagga

SEQ ID NO: 305684 - RNA, 22 nt, Human
gcuguucaagacuaggaaauuu

SEQ ID NO: 305685 - RNA, 22 nt, Human
gaauuguacgcuuuacauaggu

SEQ ID NO: 305686 - RNA, 22 nt, Human
caggccugugaguugaggcccc

SEQ ID NO: 305687 - RNA, 22 nt, Human
aauguguguucggggcccagag

SEQ ID NO: 305688 - RNA, 22 nt, Human
ucugggaaaugcuguuccuugu

SEQ ID NO: 305689 - RNA, 22 nt, Human
cugcuguguggauucaauggcu

SEQ ID NO: 305690 - RNA, 22 nt, Human
cccucugccugggaccaagucc

SEQ ID NO: 305691 - RNA, 22 nt, Human
uaacagaagaugaaacuucuuu

SEQ ID NO: 305692 - RNA, 22 nt, Human
auuugucuuuggaccugugaga

SEQ ID NO: 305693 - RNA, 22 nt, Human
acaggcugcugggcuccgugcu

SEQ ID NO: 305694 - RNA, 22 nt, Human
ugcacacacgcggcacaucugu

SEQ ID NO: 305695 - RNA, 22 nt, Human
gcucccacugcagcccugagcc

SEQ ID NO: 305696 - RNA, 22 nt, Human
agauggagaaugacaauuaagg

SEQ ID NO: 305697 - RNA, 20 nt, Human
ugcagaagaacguucugguu

SEQ ID NO: 305698 - RNA, 22 nt, Human
gaggccugucgcuaggccucug

SEQ ID NO: 305699 - RNA, 22 nt, Human
acuguguggaccacucugaggc

SEQ ID NO: 305700 - RNA, 22 nt, Human
ucugcucuaguugcuuccugcc

SEQ ID NO: 305701 - RNA, 22 nt, Human
augggaugcauggcuguggcca

SEQ ID NO: 305702 - RNA, 22 nt, Human
ggggccugcgagguucaacuuc

SEQ ID NO: 305703 - RNA, 22 nt, Human
gugcugcagagucucgugccgc

SEQ ID NO: 305704 - RNA, 22 nt, Human
gaugugaggugguaaacaggga

SEQ ID NO: 305705 - RNA, 17 nt, Human
gccuuccuuccuccaca

SEQ ID NO: 305706 - RNA, 22 nt, Human
ucagccucucugaguccagacc

SEQ ID NO: 305707 - RNA, 22 nt, Human
gcuguucugcgucccaggcugg

SEQ ID NO: 305708 - RNA, 22 nt, Human
gagcuggggcagcuuaggagug

SEQ ID NO: 305709 - RNA, 22 nt, Human
cucugagcugaaacaugagcau

SEQ ID NO: 305710 - RNA, 22 nt, Human
aagcuguucucuaaguuucaug

SEQ ID NO: 305711 - RNA, 22 nt, Human
ucagggcauucaagaggccugg

SEQ ID NO: 305712 - RNA, 22 nt, Human
uuucaggauuaguuuaagcagg

SEQ ID NO: 305713 - RNA, 18 nt, Human
cugagggcaacagaggcu

SEQ ID NO: 305714 - RNA, 22 nt, Human
gcccucuggcagccuuggcugg

SEQ ID NO: 305715 - RNA, 22 nt, Human
acauuucucaucuaguagagua

SEQ ID NO: 305716 - RNA, 22 nt, Human
cauuuguuaaccaguguggauu

SEQ ID NO: 305717 - RNA, 22 nt, Human
gagaaaugcaugcaugucauca

SEQ ID NO: 305718 - RNA, 22 nt, Human
acaugaaaagacuaucugauua

SEQ ID NO: 305719 - RNA, 22 nt, Human
ucaaaugcaggucuggucuugg

SEQ ID NO: 305720 - RNA, 22 nt, Human
ccagggcauccucacaucgcag

SEQ ID NO: 305721 - RNA, 22 nt, Human
uugaaagacuucuccugugaaa

SEQ ID NO: 305722 - RNA, 22 nt, Human
cugcugcaaucuggcuuccaug

SEQ ID NO: 305723 - RNA, 22 nt, Human
gugcaugugucuuuauaguagc

SEQ ID NO: 305724 - RNA, 22 nt, Human
gccaggcuguuuuuauuacugu

SEQ ID NO: 305725 - RNA, 22 nt, Human
gcagagcucuguucuuaucucc

SEQ ID NO: 305726 - RNA, 22 nt, Human
aagugguagacaaagauaauug

SEQ ID NO: 305727 - RNA, 22 nt, Human
cagaugagcaugggcacaagca

SEQ ID NO: 305728 - RNA, 22 nt, Human
uugugguuaaccgcacauuuuu

SEQ ID NO: 305729 - RNA, 22 nt, Human
aguucucuuuagcucauauggu

SEQ ID NO: 305730 - RNA, 22 nt, Human
aagcacauuguacauuugugcu

SEQ ID NO: 305731 - RNA, 22 nt, Human
cauugaaaccuaacauaggcug

SEQ ID NO: 305732 - RNA, 22 nt, Human
caguuucucucaauaagcaucg

SEQ ID NO: 305733 - RNA, 22 nt, Human
uuucacaucagagguagauuag

SEQ ID NO: 305734 - RNA, 22 nt, Human
agagccugcaucaggcuugggg

SEQ ID NO: 305735 - RNA, 22 nt, Human
ugugcccaucccucuggagugu

SEQ ID NO: 305736 - RNA, 22 nt, Human
uccucaggcugccuggaagacu

SEQ ID NO: 305737 - RNA, 22 nt, Human
ucuguucaguugauguaguuuu

SEQ ID NO: 305738 - RNA, 18 nt, Human
ucuuuggacaacuacugg

SEQ ID NO: 305739 - RNA, 22 nt, Human
gguguccaucaggcugugcuuc

SEQ ID NO: 305740 - RNA, 19 nt, Human
agagaaagaauugagucua

SEQ ID NO: 305741 - RNA, 22 nt, Human
caacagcugaucuuugaugaag

SEQ ID NO: 305742 - RNA, 22 nt, Human
uucaaucauuagaaucucaggc

SEQ ID NO: 305743 - RNA, 17 nt, Human
gguggccugcaguggcu

SEQ ID NO: 305744 - RNA, 22 nt, Human
cauugcacgggcgucugucugu

SEQ ID NO: 305745 - RNA, 22 nt, Human
ccagcagcccacaggcgucccu

SEQ ID NO: 305746 - RNA, 22 nt, Human
uauguacuacacuagaacauuu

SEQ ID NO: 305747 - RNA, 22 nt, Human
uccuucagucuucugagccaua

SEQ ID NO: 305748 - RNA, 23 nt, Human
ggaaagagaggaguugugcauag

SEQ ID NO: 305749 - RNA, 22 nt, Human
agcacagaguugcagagagcgu

SEQ ID NO: 305750 - RNA, 22 nt, Human
gugcuucucuucacacccaacu

SEQ ID NO: 305751 - RNA, 22 nt, Human
uugcugaaaacaguggguauug

SEQ ID NO: 305752 - RNA, 22 nt, Human
gccaggcuggucuugaacuccu

SEQ ID NO: 305753 - RNA, 22 nt, Human
cauuuacagugagaguuuuuac

SEQ ID NO: 305754 - RNA, 22 nt, Human
acaccauacucauguugguucc

SEQ ID NO: 305755 - RNA, 22 nt, Human
uuguggcucgugagauguuagg

SEQ ID NO: 305756 - RNA, 22 nt, Human
agcccuguagauuuaggagagu

SEQ ID NO: 305757 - RNA, 22 nt, Human
cccuggagguggagguugcagg

SEQ ID NO: 305758 - RNA, 22 nt, Human
aggccagagaggggaccagccu

SEQ ID NO: 305759 - RNA, 22 nt, Human
acagcugggugcugcucagagc

SEQ ID NO: 305760 - RNA, 22 nt, Human
acauuucuauagugcaucuguu

SEQ ID NO: 305761 - RNA, 17 nt, Human
gcuuccugugcugggga

SEQ ID NO: 305762 - RNA, 22 nt, Human
ucaguguuagacaaguuuggaa

SEQ ID NO: 305763 - RNA, 22 nt, Human
ucugggugcccuuugcucuguu

SEQ ID NO: 305764 - RNA, 22 nt, Human
ugccugucucugacugccauua

SEQ ID NO: 305765 - RNA, 22 nt, Human
ucauuuguugaacuuuagugcg

SEQ ID NO: 305766 - RNA, 22 nt, Human
uggcagcacaagguggcccaug

SEQ ID NO: 305767 - RNA, 19 nt, Human
ugcaagcuuuuucuuguua

SEQ ID NO: 305768 - RNA, 22 nt, Human
ccucugcucugguccaugugcu

SEQ ID NO: 305769 - RNA, 20 nt, Human
aggcucagagcaguaguaca

SEQ ID NO: 305770 - RNA, 22 nt, Human
augcuguguauuuuacucuuuc

SEQ ID NO: 305771 - RNA, 22 nt, Human
ggaaaugacuuggugcuucguu

SEQ ID NO: 305772 - RNA, 22 nt, Human
guguggcugauugacaugguca

SEQ ID NO: 305773 - RNA, 22 nt, Human
uccucagucacgguagcacauu

SEQ ID NO: 305774 - RNA, 22 nt, Human
ggcaccagcacuugggauggcu

SEQ ID NO: 305775 - RNA, 22 nt, Human
cuuggggcugucacucuggcau

SEQ ID NO: 305776 - RNA, 22 nt, Human
ugaaggugucuuugugaacauc

SEQ ID NO: 305777 - RNA, 22 nt, Human
gcucccaggaagagaagggcca

SEQ ID NO: 305778 - RNA, 23 nt, Human
cuggggcuuucaaaucugggcag

SEQ ID NO: 305779 - RNA, 22 nt, Human
cccagggcuuuucucacuagac

SEQ ID NO: 305780 - RNA, 22 nt, Human
aaaucugggagcagcucggcca

SEQ ID NO: 305781 - RNA, 22 nt, Human
uccuucaggccucauucucaua

SEQ ID NO: 305782 - RNA, 20 nt, Human
uccucagaagacauuugggg

SEQ ID NO: 305783 - RNA, 22 nt, Human
uggggaagggcacccuggagac

SEQ ID NO: 305784 - RNA, 22 nt, Human
agugugugcaugcauucgugca

SEQ ID NO: 305785 - RNA, 22 nt, Human
aguacauauaguaauuuagcca

SEQ ID NO: 305786 - RNA, 22 nt, Human
gcauuucuuccuggugugagcc

SEQ ID NO: 305787 - RNA, 22 nt, Human
caugcugugcaucuugaugacc

SEQ ID NO: 305788 - RNA, 22 nt, Human
aguuggagugaacaugagauug

SEQ ID NO: 305789 - RNA, 22 nt, Human
ugcaauaaguuguguuaucacu

SEQ ID NO: 305790 - RNA, 20 nt, Human
agcauuugaaauaugacuau

SEQ ID NO: 305791 - RNA, 22 nt, Human
uccagggcugacuugggagagg

SEQ ID NO: 305792 - RNA, 23 nt, Human
ucuuuccucagcacacaccaaga

SEQ ID NO: 305793 - RNA, 22 nt, Human
ggguacuuaauauuuacggggu

SEQ ID NO: 305794 - RNA, 22 nt, Human
gcugcccaggguggagccggcu

SEQ ID NO: 305795 - RNA, 22 nt, Human
gcaggaugagugaguacauuua

SEQ ID NO: 305796 - RNA, 22 nt, Human
uccugggcugugugccacucug

SEQ ID NO: 305797 - RNA, 22 nt, Human
ucaggugguccuaagugccauc

SEQ ID NO: 305798 - RNA, 22 nt, Human
uuccaggaggagguacuagagg

SEQ ID NO: 305799 - RNA, 22 nt, Human
cagugggaagggcagaggcuuu

SEQ ID NO: 305800 - RNA, 22 nt, Human
ucugcucuguggcuucagcuaa

SEQ ID NO: 305801 - RNA, 22 nt, Human
acaagagacaagagguucuucu

SEQ ID NO: 305802 - RNA, 22 nt, Human
gacccugaggauucccugcuga

SEQ ID NO: 305803 - RNA, 22 nt, Human
aguaaugucccuuaaauguggu

SEQ ID NO: 305804 - RNA, 22 nt, Human
aucaguuucugugaagaacaca

SEQ ID NO: 305805 - RNA, 22 nt, Human
agcagccagaaagggcagucga

SEQ ID NO: 305806 - RNA, 22 nt, Human
gaugcacaugugaguauagaag

SEQ ID NO: 305807 - RNA, 22 nt, Human
ggaugcaggggcagcagagccu

SEQ ID NO: 305808 - RNA, 22 nt, Human
gccucugcaugcucagcaccca

SEQ ID NO: 305809 - RNA, 19 nt, Human
ccuuggaguuccaggugga

SEQ ID NO: 305810 - RNA, 22 nt, Human
aagacuuucucccaaauccuca

SEQ ID NO: 305811 - RNA, 22 nt, Human
gcagggcugggugggagacaga

SEQ ID NO: 305812 - RNA, 22 nt, Human
agcugggucuugggccaggaga

SEQ ID NO: 305813 - RNA, 22 nt, Human
auaaaaaugagggcgguagcua

SEQ ID NO: 305814 - RNA, 22 nt, Human
ucugucugcucauuuaccucag

SEQ ID NO: 305815 - RNA, 22 nt, Human
caguggcaugguugacugcagu

SEQ ID NO: 305816 - RNA, 22 nt, Human
agcagggguaacagaaggaaag

SEQ ID NO: 305817 - RNA, 22 nt, Human
gccucugcggagcuguacauca

SEQ ID NO: 305818 - RNA, 22 nt, Human
augcaguggcagcuccuggugu

SEQ ID NO: 305819 - RNA, 22 nt, Human
agugucugccagcugccaggug

SEQ ID NO: 305820 - RNA, 23 nt, Human
cugcuguguuggucucgauggga

SEQ ID NO: 305821 - RNA, 22 nt, Human
ugggcucucuggcaggaaggcu

SEQ ID NO: 305822 - RNA, 19 nt, Human
gagcugccuuuugaagacc

SEQ ID NO: 305823 - RNA, 22 nt, Human
agcucccaauugacuugaacua

SEQ ID NO: 305824 - RNA, 22 nt, Human
cugccagcucucuggaggcucu

SEQ ID NO: 305825 - RNA, 18 nt, Human
cccagcuccacuucccuc

SEQ ID NO: 305826 - RNA, 22 nt, Human
caacacauugaagcuaugauga

SEQ ID NO: 305827 - RNA, 22 nt, Human
ugcuggcuggccuggccuggac

SEQ ID NO: 305828 - RNA, 21 nt, Human
gccugcagaccccaccaggcu

SEQ ID NO: 305829 - RNA, 22 nt, Human
uggcuggcgccgggcuagccac

SEQ ID NO: 305830 - RNA, 23 nt, Human
gguggcaggaguggaugcugagc

SEQ ID NO: 305831 - RNA, 17 nt, Human
gauuuccugaaguucuu

SEQ ID NO: 305832 - RNA, 22 nt, Human
ccugucucuuucaaucugagag

SEQ ID NO: 305833 - RNA, 21 nt, Human
gugucaugguugacuuuggca

SEQ ID NO: 305834 - RNA, 22 nt, Human
acauguguggacaugaaucuac

SEQ ID NO: 305835 - RNA, 22 nt, Human
aaggaaccuggaguagagggag

SEQ ID NO: 305836 - RNA, 23 nt, Human
caggcaggaugaggacuacacuc

SEQ ID NO: 305837 - RNA, 22 nt, Human
gauuucuuuaugaaguacagaa

SEQ ID NO: 305838 - RNA, 22 nt, Human
ucugccuggauuuuggaaagcu

SEQ ID NO: 305839 - RNA, 22 nt, Human
agcagagucugugugcacuuua

SEQ ID NO: 305840 - RNA, 22 nt, Human
uauguagaagcugcucaaagaa

SEQ ID NO: 305841 - RNA, 22 nt, Human
uccagccacucagcagggauug

SEQ ID NO: 305842 - RNA, 22 nt, Human
auucuggauuaucaguccacca

SEQ ID NO: 305843 - RNA, 22 nt, Human
agccacagagagggagcugcaa

SEQ ID NO: 305844 - RNA, 22 nt, Human
agcaggcuuguuaugucugaga

SEQ ID NO: 305845 - RNA, 17 nt, Human
ugaaggaaggaugaugu

SEQ ID NO: 305846 - RNA, 22 nt, Human
aaggcaguuugggccaccaucu

SEQ ID NO: 305847 - RNA, 22 nt, Human
ccagcccuuagauaaaccuggc

SEQ ID NO: 305848 - RNA, 22 nt, Human
augaagauaagaccaggcugga

SEQ ID NO: 305849 - RNA, 22 nt, Human
gcaggcucuucuuucugcccag

SEQ ID NO: 305850 - RNA, 22 nt, Human
agagccugugauugucaucacc

SEQ ID NO: 305851 - RNA, 22 nt, Human
accucugccacuuucuaacucu

SEQ ID NO: 305852 - RNA, 22 nt, Human
gcuguggccaacaaaccacuuu

SEQ ID NO: 305853 - RNA, 22 nt, Human
ggccucucuggcauggcugccc

SEQ ID NO: 305854 - RNA, 22 nt, Human
ucagacaguuugcagugugccu

SEQ ID NO: 305855 - RNA, 22 nt, Human
caggggcuuuuccucuauaagg

SEQ ID NO: 305856 - RNA, 22 nt, Human
uacaaaguaauguauaauaucg

SEQ ID NO: 305857 - RNA, 22 nt, Human
caguuuuugccauuaagaguaa

SEQ ID NO: 305858 - RNA, 22 nt, Human
aggccugaggaccuucuggagg

SEQ ID NO: 305859 - RNA, 22 nt, Human
ccagcucuagccccauguggcu

SEQ ID NO: 305860 - RNA, 22 nt, Human
ucauaaagcuugccugcagugu

SEQ ID NO: 305861 - RNA, 22 nt, Human
agcagccacccagcugcucauu

SEQ ID NO: 305862 - RNA, 22 nt, Human
acauucuuggacuccacucuag

SEQ ID NO: 305863 - RNA, 22 nt, Human
gaccauuuguugaaaagauuau

SEQ ID NO: 305864 - RNA, 22 nt, Human
caguuucuacgacuuaagcaca

SEQ ID NO: 305865 - RNA, 22 nt, Human
gcagggcaugggcccugucugc

SEQ ID NO: 305866 - RNA, 22 nt, Human
agaaaugcucuuccugaccaga

SEQ ID NO: 305867 - RNA, 22 nt, Human
ucacugcucucuaagcaucgcc

SEQ ID NO: 305868 - RNA, 22 nt, Human
acaguguuuaagagauggcauu

SEQ ID NO: 305869 - RNA, 22 nt, Human
cagagcugugauaaauagauau

SEQ ID NO: 305870 - RNA, 22 nt, Human
gcucaagagagaugcaguucuu

SEQ ID NO: 305871 - RNA, 22 nt, Human
uuuccuugggucucuuaguggc

SEQ ID NO: 305872 - RNA, 22 nt, Human
gccucuggucccucaugcugug

SEQ ID NO: 305873 - RNA, 22 nt, Human
aggccucacauugggcuucaag

SEQ ID NO: 305874 - RNA, 22 nt, Human
accuggcaugaagcaugccuua

SEQ ID NO: 305875 - RNA, 22 nt, Human
auugaaaggcaaaguaggaagc

SEQ ID NO: 305876 - RNA, 22 nt, Human
cugggcuggagugcaauggcgc

SEQ ID NO: 305877 - RNA, 18 nt, Human
uggagcaggaagccuggc

SEQ ID NO: 305878 - RNA, 22 nt, Human
acauuuaaccaaacuguuuaau

SEQ ID NO: 305879 - RNA, 22 nt, Human
ucacuguauuugcugaugcaua

SEQ ID NO: 305880 - RNA, 22 nt, Human
agauacauuaguaguuacuugu

SEQ ID NO: 305881 - RNA, 22 nt, Human
gcuuccuagaucugugguacuc

SEQ ID NO: 305882 - RNA, 20 nt, Human
caggccucugggggcccugg

SEQ ID NO: 305883 - RNA, 21 nt, Human
acagaugggaugagcacacug

SEQ ID NO: 305884 - RNA, 22 nt, Human
ucccaaggcacagggcagggac

SEQ ID NO: 305885 - RNA, 22 nt, Human
agggcucuguccccagaggccc

SEQ ID NO: 305886 - RNA, 22 nt, Human
uagaaacauguucuguucuguu

SEQ ID NO: 305887 - RNA, 22 nt, Human
cggggcuguagcacagcugagc

SEQ ID NO: 305888 - RNA, 20 nt, Human
ugcuuccuggccacugcggg

SEQ ID NO: 305889 - RNA, 22 nt, Human
ggugggcacccgagacuggauc

SEQ ID NO: 305890 - RNA, 22 nt, Human
accacuguaucuccagcacauu

SEQ ID NO: 305891 - RNA, 21 nt, Human
agcagcagaucuggugagggc

SEQ ID NO: 305892 - RNA, 22 nt, Human
ugcccucaagcaacagagagga

SEQ ID NO: 305893 - RNA, 22 nt, Human
ucaggcagagcuguggagcucu

SEQ ID NO: 305894 - RNA, 22 nt, Human
acaguguuuugucuggcagggc

SEQ ID NO: 305895 - RNA, 23 nt, Human
uccaccccagcugaggcuuagcc

SEQ ID NO: 305896 - RNA, 22 nt, Human
aguauacauauauuagccuucg

SEQ ID NO: 305897 - RNA, 22 nt, Human
gcccaggcuagcguagagugca

SEQ ID NO: 305898 - RNA, 21 nt, Human
guuuuaagggagaaaaccuag

SEQ ID NO: 305899 - RNA, 22 nt, Human
gagcucugacugcugggugaca

SEQ ID NO: 305900 - RNA, 20 nt, Human
guggccucucacauucugag

SEQ ID NO: 305901 - RNA, 22 nt, Human
aaagaggaaccaagagcacgug

SEQ ID NO: 305902 - RNA, 22 nt, Human
gcucucugggugugucuagaua

SEQ ID NO: 305903 - RNA, 22 nt, Human
gaguuauuggguggaaagguag

SEQ ID NO: 305904 - RNA, 22 nt, Human
ugagaagauugggcagagugga

SEQ ID NO: 305905 - RNA, 22 nt, Human
aaggaagacacagaugaaguga

SEQ ID NO: 305906 - RNA, 22 nt, Human
aucuacaggcugaggugggagg

SEQ ID NO: 305907 - RNA, 22 nt, Human
ugcuguagcccugcacagugca

SEQ ID NO: 305908 - RNA, 22 nt, Human
aucuaagauguauugagcacuu

SEQ ID NO: 305909 - RNA, 22 nt, Human
caaagguauucucauuuuggaa

SEQ ID NO: 305910 - RNA, 22 nt, Human
ugcagcaggcacaggacggaag

SEQ ID NO: 305911 - RNA, 17 nt, Human
cccguucucuucgcugg

SEQ ID NO: 305912 - RNA, 22 nt, Human
gccaaagcagucuugccucugc

SEQ ID NO: 305913 - RNA, 22 nt, Human
aaguuauuuccucgugacugaa

SEQ ID NO: 305914 - RNA, 22 nt, Human
agcaaggcagucagcuggcugg

SEQ ID NO: 305915 - RNA, 22 nt, Human
cagcagagcugugugggaaggg

SEQ ID NO: 305916 - RNA, 22 nt, Human
guggcagcggcccaggccgucu

SEQ ID NO: 305917 - RNA, 22 nt, Human
guggcugcagagccagcaagcu

SEQ ID NO: 305918 - RNA, 22 nt, Human
uggcucagaaggcugccuucac

SEQ ID NO: 305919 - RNA, 22 nt, Human
uaaaagauuuuauaggaacaag

SEQ ID NO: 305920 - RNA, 22 nt, Human
aaaguucuggggguguuucugg

SEQ ID NO: 305921 - RNA, 22 nt, Human
aaguaugucaaucauacuucaa

SEQ ID NO: 305922 - RNA, 22 nt, Human
ucuagaauuuugccauauagcu

SEQ ID NO: 305923 - RNA, 22 nt, Human
acucagugaauuuucaucaaau

SEQ ID NO: 305924 - RNA, 22 nt, Human
gaacagcccuguuaagucuguu

SEQ ID NO: 305925 - RNA, 22 nt, Human
cugaaggauuagagagcacuua

SEQ ID NO: 305926 - RNA, 22 nt, Human
aaaagucugcucucauuucaga

SEQ ID NO: 305927 - RNA, 17 nt, Human
uuagcaaaauagcacuu

SEQ ID NO: 305928 - RNA, 22 nt, Human
acaggugauucaggcucuggga

SEQ ID NO: 305929 - RNA, 22 nt, Human
cagcuggcguggagugauugca

SEQ ID NO: 305930 - RNA, 22 nt, Human
cauggcaggaggcugcuggcag

SEQ ID NO: 305931 - RNA, 22 nt, Human
agucucugccagcuuguccucu

SEQ ID NO: 305932 - RNA, 19 nt, Human
uucauucuuucuacuuacc

SEQ ID NO: 305933 - RNA, 21 nt, Human
aggcucagagaucaaacagua

SEQ ID NO: 305934 - RNA, 22 nt, Human
uugauuaaacaggcauauucaa

SEQ ID NO: 305935 - RNA, 22 nt, Human
acucagcuuccuacagcuagaa

SEQ ID NO: 305936 - RNA, 22 nt, Human
ggcagcuuuuaucccugacaga

SEQ ID NO: 305937 - RNA, 22 nt, Human
auugucuguacuuuaaaaaugu

SEQ ID NO: 305938 - RNA, 22 nt, Human
gcucucagguacaaagcugugu

SEQ ID NO: 305939 - RNA, 22 nt, Human
uagcuggggcuuucauucuugc

SEQ ID NO: 305940 - RNA, 22 nt, Human
ucugcagcuugcacaggcaggc

SEQ ID NO: 305941 - RNA, 20 nt, Human
ggguggaguugcggucugug

SEQ ID NO: 305942 - RNA, 22 nt, Human
gcagcugaaagggaucucuaca

SEQ ID NO: 305943 - RNA, 22 nt, Human
ccagggcaauaggaacacuuuu

SEQ ID NO: 305944 - RNA, 22 nt, Human
augggagugacagggccacugg

SEQ ID NO: 305945 - RNA, 23 nt, Human
cauuucugggagauuuauaaaau

SEQ ID NO: 305946 - RNA, 20 nt, Human
caggaggcaaggucaagguc

SEQ ID NO: 305947 - RNA, 22 nt, Human
aggcacugguccauuuucugca

SEQ ID NO: 305948 - RNA, 22 nt, Human
cccuggagggauuucucaauca

SEQ ID NO: 305949 - RNA, 22 nt, Human
gcagcugaagcugcaguuccag

SEQ ID NO: 305950 - RNA, 22 nt, Human
ucauuuguucucauucucuacu

SEQ ID NO: 305951 - RNA, 22 nt, Human
aaggcaggaugcggacccaucu

SEQ ID NO: 305952 - RNA, 22 nt, Human
gcaaaaaaugcuuguugcuuag

SEQ ID NO: 305953 - RNA, 22 nt, Human
uacucaaacucacuaagacaga

SEQ ID NO: 305954 - RNA, 22 nt, Human
gccagggcaggggagcaucugc

SEQ ID NO: 305955 - RNA, 22 nt, Human
gagaagggauauggcuucuuga

SEQ ID NO: 305956 - RNA, 22 nt, Human
ggaggccaucagggagggcauu

SEQ ID NO: 305957 - RNA, 22 nt, Human
gguagcacauugcauuaggaga

SEQ ID NO: 305958 - RNA, 22 nt, Human
gcaggggcugcugggaacucgg

SEQ ID NO: 305959 - RNA, 22 nt, Human
ggccucugguucguggugaccu

SEQ ID NO: 305960 - RNA, 22 nt, Human
gcucugcucuaacauuccugac

SEQ ID NO: 305961 - RNA, 22 nt, Human
gccaccucggcuuucucugcuc

SEQ ID NO: 305962 - RNA, 22 nt, Human
cacuguaauagcauuauaagug

SEQ ID NO: 305963 - RNA, 22 nt, Human
caggggcucuaaugcaugauca

SEQ ID NO: 305964 - RNA, 22 nt, Human
ggugggugagcccugggagcug

SEQ ID NO: 305965 - RNA, 22 nt, Human
cagacagcugcuuucuugcugu

SEQ ID NO: 305966 - RNA, 22 nt, Human
cauggacucugguuuggggagc

SEQ ID NO: 305967 - RNA, 22 nt, Human
cugcucugacccuuucaccuuc

SEQ ID NO: 305968 - RNA, 22 nt, Human
ucagaagacuacuaggacacau

SEQ ID NO: 305969 - RNA, 22 nt, Human
uccucaggugacuagguaucuu

SEQ ID NO: 305970 - RNA, 22 nt, Human
agccaaggcagcuagagcucug

SEQ ID NO: 305971 - RNA, 22 nt, Human
gugccugugcggacucagggaa

SEQ ID NO: 305972 - RNA, 22 nt, Human
cugccagccaggccagguaggc

SEQ ID NO: 305973 - RNA, 20 nt, Human
acaguguuagguuuuuccuu

SEQ ID NO: 305974 - RNA, 22 nt, Human
accuggcacuacaggcaccugu

SEQ ID NO: 305975 - RNA, 21 nt, Human
uaucuacuggugucuuucaga

SEQ ID NO: 305976 - RNA, 22 nt, Human
agaaguuaccacauacuucucu

SEQ ID NO: 305977 - RNA, 22 nt, Human
ucccagccugacagugcaucaa

SEQ ID NO: 305978 - RNA, 22 nt, Human
aggauccuuuggccacuucuua

SEQ ID NO: 305979 - RNA, 22 nt, Human
gcaugucaugucauguaggaau

SEQ ID NO: 305980 - RNA, 22 nt, Human
gagcacagccaaaguaagaagg

SEQ ID NO: 305981 - RNA, 22 nt, Human
gcauuguccugcuucugagugu

SEQ ID NO: 305982 - RNA, 22 nt, Human
ucuuuuggaaaugaugugcagg

SEQ ID NO: 305983 - RNA, 22 nt, Human
aggcagaggaaggguggauuug

SEQ ID NO: 305984 - RNA, 21 nt, Human
uuacuuuugcaccaaccuaau

SEQ ID NO: 305985 - RNA, 22 nt, Human
uaugcacauugguuuccucauu

SEQ ID NO: 305986 - RNA, 22 nt, Human
cagcagccuacaaugcacagaa

SEQ ID NO: 305987 - RNA, 18 nt, Human
ugcucuguuuaaugauuu

SEQ ID NO: 305988 - RNA, 22 nt, Human
cuguuaaucugcuugcaugaug

SEQ ID NO: 305989 - RNA, 22 nt, Human
gcugcucugugacagccuccgg

SEQ ID NO: 305990 - RNA, 22 nt, Human
agaccuggaugugagggaagua

SEQ ID NO: 305991 - RNA, 22 nt, Human
aggcucagagagcuguguccau

SEQ ID NO: 305992 - RNA, 22 nt, Human
aaauaaguaguuuaguguugug

SEQ ID NO: 305993 - RNA, 22 nt, Human
cugcccgcugcuagagaggccg

SEQ ID NO: 305994 - RNA, 22 nt, Human
ccaaagucuggagcagcagagc

SEQ ID NO: 305995 - RNA, 22 nt, Human
ucucaggccccugaguuucucu

SEQ ID NO: 305996 - RNA, 22 nt, Human
ugcuggcccaugaagacgcagu

SEQ ID NO: 305997 - RNA, 22 nt, Human
ccagcccugaacccugcugcau

SEQ ID NO: 305998 - RNA, 22 nt, Human
uaauagaaagguauuuuuugca

SEQ ID NO: 305999 - RNA, 22 nt, Human
gcacugaaauuauaugcauuug

SEQ ID NO: 306000 - RNA, 22 nt, Human
gaaugcacucacccaucacuca

SEQ ID NO: 306001 - RNA, 22 nt, Human
gagcugggucuccaccuuggca

SEQ ID NO: 306002 - RNA, 22 nt, Human
ucaguguuuacaugcauccuug

SEQ ID NO: 306003 - RNA, 17 nt, Human
uucaaagcuuaucaagg

SEQ ID NO: 306004 - RNA, 21 nt, Human
cugcaucucauagaacauguc

SEQ ID NO: 306005 - RNA, 22 nt, Human
agcugcaggccucuccugggga

SEQ ID NO: 306006 - RNA, 22 nt, Human
uaaugcacauagaaguacuuag

SEQ ID NO: 306007 - RNA, 17 nt, Human
ucuguucaagugagagg

SEQ ID NO: 306008 - RNA, 22 nt, Human
agggcagagaucugagugggca

SEQ ID NO: 306009 - RNA, 22 nt, Human
gugugccaacaaaagacagugc

SEQ ID NO: 306010 - RNA, 22 nt, Human
uuacacaacaucuguauuauua

SEQ ID NO: 306011 - RNA, 22 nt, Human
aauaauuuccagccaacuggaa

SEQ ID NO: 306012 - RNA, 22 nt, Human
aaauucagcagugaaaugcccc

SEQ ID NO: 306013 - RNA, 22 nt, Human
cugcugugcuuguggccacccg

SEQ ID NO: 306014 - RNA, 22 nt, Human
ucaggaguccugccugcagccu

SEQ ID NO: 306015 - RNA, 22 nt, Human
ugaacaacugcaaaaaucucca

SEQ ID NO: 306016 - RNA, 22 nt, Human
gagaggagucccuaucacaguu

SEQ ID NO: 306017 - RNA, 22 nt, Human
augcucuggaguacgugaaauu

SEQ ID NO: 306018 - RNA, 22 nt, Human
ccagcuggugacauccccaacc

SEQ ID NO: 306019 - RNA, 22 nt, Human
augggaggcagacacuaaguuc

SEQ ID NO: 306020 - RNA, 22 nt, Human
gagcccuggcagucugggaugg

SEQ ID NO: 306021 - RNA, 22 nt, Human
aauugugcuaugauuaugaaag

SEQ ID NO: 306022 - RNA, 22 nt, Human
uggccugccccgagauccuggc

SEQ ID NO: 306023 - RNA, 22 nt, Human
gcuguguccucacacagccuuu

SEQ ID NO: 306024 - RNA, 22 nt, Human
ugaaaguugcacauaagagaau

SEQ ID NO: 306025 - RNA, 21 nt, Human
acagacagggccagugucccc

SEQ ID NO: 306026 - RNA, 22 nt, Human
ucuucuuaugugccauuaucuc

SEQ ID NO: 306027 - RNA, 22 nt, Human
gauaugaaguggcauugugaag

SEQ ID NO: 306028 - RNA, 22 nt, Human
ccugccagcccgcguucaugcc

SEQ ID NO: 306029 - RNA, 22 nt, Human
agagcugguuuacucaggaauu

SEQ ID NO: 306030 - RNA, 22 nt, Human
ucaagagaaggggaaauagacu

SEQ ID NO: 306031 - RNA, 21 nt, Human
uccagggaacuucucaggaau

SEQ ID NO: 306032 - RNA, 19 nt, Human
ucccuuccugucgggcucc

SEQ ID NO: 306033 - RNA, 22 nt, Human
gcaggggaguggaugauggauu

SEQ ID NO: 306034 - RNA, 22 nt, Human
uucaucaauguguuuaauaaug

SEQ ID NO: 306035 - RNA, 22 nt, Human
aguuuuuccguggcuacgauaa

SEQ ID NO: 306036 - RNA, 22 nt, Human
ggugaaggucuacugugugcca

SEQ ID NO: 306037 - RNA, 19 nt, Human
auccuggguccuccagcug

SEQ ID NO: 306038 - RNA, 22 nt, Human
cagggccuuauccugccauuga

SEQ ID NO: 306039 - RNA, 22 nt, Human
gugccuggagcuaauguguaua

SEQ ID NO: 306040 - RNA, 22 nt, Human
uugagaagaaauaguuugcaau

SEQ ID NO: 306041 - RNA, 22 nt, Human
gccuuccuuuuaccaccagcca

SEQ ID NO: 306042 - RNA, 22 nt, Human
ccuuucucuuggauaccgauug

SEQ ID NO: 306043 - RNA, 22 nt, Human
agcagcugguaggaguggccac

SEQ ID NO: 306044 - RNA, 22 nt, Human
ucaggaucggccuuuuuuuaag

SEQ ID NO: 306045 - RNA, 23 nt, Human
uggcucugugucacauacaggau

SEQ ID NO: 306046 - RNA, 22 nt, Human
cugggagagaagcgaagcuggg

SEQ ID NO: 306047 - RNA, 20 nt, Human
aggagaugauccagagucag

SEQ ID NO: 306048 - RNA, 22 nt, Human
auggaaagccaguguuccauca

SEQ ID NO: 306049 - RNA, 22 nt, Human
uggcugaaggaagauucuucua

SEQ ID NO: 306050 - RNA, 22 nt, Human
ucauacaucuuguauaucuauc

SEQ ID NO: 306051 - RNA, 22 nt, Human
ucagaagcaaacaucacucuag

SEQ ID NO: 306052 - RNA, 22 nt, Human
uauucacaugaaaacaaauuuu

SEQ ID NO: 306053 - RNA, 22 nt, Human
uuuaccaagcuuuaauuacaua

SEQ ID NO: 306054 - RNA, 22 nt, Human
cagcuuggcuuccgcuuuacug

SEQ ID NO: 306055 - RNA, 22 nt, Human
caguuucuguuuuaaauagcag

SEQ ID NO: 306056 - RNA, 17 nt, Human
uuucuccuuccaucuca

SEQ ID NO: 306057 - RNA, 22 nt, Human
aacaucagaauauccauguugg

SEQ ID NO: 306058 - RNA, 22 nt, Human
accaaggaagagauucucaguu

SEQ ID NO: 306059 - RNA, 22 nt, Human
guuagaauaaaaggucagagag

SEQ ID NO: 306060 - RNA, 22 nt, Human
gggcaugagagggcagcuggca

SEQ ID NO: 306061 - RNA, 22 nt, Human
caguccugcccaggcugacaga

SEQ ID NO: 306062 - RNA, 22 nt, Human
uaaaugugcacuuuacuuuuca

SEQ ID NO: 306063 - RNA, 22 nt, Human
ugcuggggguucagaugaguaa

SEQ ID NO: 306064 - RNA, 22 nt, Human
aggagcugcaaauauuaguaau

SEQ ID NO: 306065 - RNA, 22 nt, Human
uacucagagucauugcccuucu

SEQ ID NO: 306066 - RNA, 22 nt, Human
cuggcagcuggaggcuagaggc

SEQ ID NO: 306067 - RNA, 23 nt, Human
gcagaggagcaagcuggacacca

SEQ ID NO: 306068 - RNA, 22 nt, Human
uuugcaauuugugcugcaaaug

SEQ ID NO: 306069 - RNA, 22 nt, Human
agggagagguugaaaccucagu

SEQ ID NO: 306070 - RNA, 22 nt, Human
cugcuuuguggaaucacacugg

SEQ ID NO: 306071 - RNA, 22 nt, Human
accauuuuggguauuuucagag

SEQ ID NO: 306072 - RNA, 22 nt, Human
gggcugcugcugccagcgacac

SEQ ID NO: 306073 - RNA, 22 nt, Human
aggaggccgauuucagaggucg

SEQ ID NO: 306074 - RNA, 19 nt, Human
ccugugugggguagagauc

SEQ ID NO: 306075 - RNA, 22 nt, Human
agccacagcccacaggacucuu

SEQ ID NO: 306076 - RNA, 22 nt, Human
agggcagcagcuccuccuagcu

SEQ ID NO: 306077 - RNA, 22 nt, Human
cuauugaaaguguacaauucaa

SEQ ID NO: 306078 - RNA, 22 nt, Human
uagcacaucuggcgcuuauagg

SEQ ID NO: 306079 - RNA, 22 nt, Human
agggcaaguugagugugcgugg

SEQ ID NO: 306080 - RNA, 22 nt, Human
aaugagaaaacacagaggaggu

SEQ ID NO: 306081 - RNA, 22 nt, Human
uggaagcacuuggguuuuguug

SEQ ID NO: 306082 - RNA, 22 nt, Human
agccuucagcaguucaggugcc

SEQ ID NO: 306083 - RNA, 22 nt, Human
uuuuccagagcugucucuugca

SEQ ID NO: 306084 - RNA, 17 nt, Human
agagagagcaugccacc

SEQ ID NO: 306085 - RNA, 22 nt, Human
agccacagcuccuugguggaga

SEQ ID NO: 306086 - RNA, 22 nt, Human
aucuggcugagcgaggcccaca

SEQ ID NO: 306087 - RNA, 22 nt, Human
uuucuaggcacagugucuuccc

SEQ ID NO: 306088 - RNA, 22 nt, Human
cuacuuuaauuuucugcagaga

SEQ ID NO: 306089 - RNA, 22 nt, Human
cagcuuucaucagugacacuca

SEQ ID NO: 306090 - RNA, 21 nt, Human
gacaggggaagaagcaaggag

SEQ ID NO: 306091 - RNA, 22 nt, Human
acagucauuagauacaaugucu

SEQ ID NO: 306092 - RNA, 22 nt, Human
gcuguauuccugcacuguauag

SEQ ID NO: 306093 - RNA, 22 nt, Human
ggcucuggguucugcaaugcgu

SEQ ID NO: 306094 - RNA, 22 nt, Human
cccagccagccucuucccauau

SEQ ID NO: 306095 - RNA, 22 nt, Human
guguguuucagaagccaggugu

SEQ ID NO: 306096 - RNA, 19 nt, Human
cugagagaugcuucacaca

SEQ ID NO: 306097 - RNA, 22 nt, Human
uaagaacuucggacauguuauc

SEQ ID NO: 306098 - RNA, 22 nt, Human
uuggcagugucugcaaaaugga

SEQ ID NO: 306099 - RNA, 22 nt, Human
caaagucccagcugcuuagaga

SEQ ID NO: 306100 - RNA, 22 nt, Human
ggguggcuccuaugggcauagc

SEQ ID NO: 306101 - RNA, 19 nt, Human
uggcuccugccugccuucu

SEQ ID NO: 306102 - RNA, 22 nt, Human
aaucuucagugucuaaaaagca

SEQ ID NO: 306103 - RNA, 17 nt, Human
aggugcagaggcagagc

SEQ ID NO: 306104 - RNA, 22 nt, Human
cugaaugucgaucagcuugggu

SEQ ID NO: 306105 - RNA, 22 nt, Human
cuguacaggugaggagggggcu

SEQ ID NO: 306106 - RNA, 20 nt, Human
aggcacuggauuucuuauau

SEQ ID NO: 306107 - RNA, 23 nt, Human
gaaguucuuucuucucaugcugu

SEQ ID NO: 306108 - RNA, 22 nt, Human
uccuugaauugugccacuuacc

SEQ ID NO: 306109 - RNA, 22 nt, Human
gcagggcaaugaucccgagagg

SEQ ID NO: 306110 - RNA, 22 nt, Human
cagcuccugccugggcagcugu

SEQ ID NO: 306111 - RNA, 22 nt, Human
aaaauugaagugaucaggaacu

SEQ ID NO: 306112 - RNA, 22 nt, Human
guccucaguaagagggccucug

SEQ ID NO: 306113 - RNA, 17 nt, Human
cugaggcccagggccca

SEQ ID NO: 306114 - RNA, 23 nt, Human
uuuggacuugugacucuucuccu

SEQ ID NO: 306115 - RNA, 22 nt, Human
ggauguugauugaauggccauu

SEQ ID NO: 306116 - RNA, 22 nt, Human
aaaagacaucuauuucaggcag

SEQ ID NO: 306117 - RNA, 22 nt, Human
ccagggcagcagaauuggggca

SEQ ID NO: 306118 - RNA, 19 nt, Human
ccucugccagcccgccucu

SEQ ID NO: 306119 - RNA, 22 nt, Human
uauguacaugauuucauuugcu

SEQ ID NO: 306120 - RNA, 22 nt, Human
uaccugagcccagugcagcaua

SEQ ID NO: 306121 - RNA, 22 nt, Human
uguggcacuucucuccuuguaa

SEQ ID NO: 306122 - RNA, 22 nt, Human
cuggcucuaucuccaaggcugg

SEQ ID NO: 306123 - RNA, 22 nt, Human
augagacaugacuucaggccuu

SEQ ID NO: 306124 - RNA, 22 nt, Human
aagagggcugcaaucuuauugc

SEQ ID NO: 306125 - RNA, 22 nt, Human
caaaguccuagaacagugcuug

SEQ ID NO: 306126 - RNA, 22 nt, Human
ucaguuuuguauguuguaaguc

SEQ ID NO: 306127 - RNA, 22 nt, Human
gaagagcugugauucaggcuua

SEQ ID NO: 306128 - RNA, 23 nt, Human
ucugcucugaaguucggcugagc

SEQ ID NO: 306129 - RNA, 22 nt, Human
ugccuguguccccuucuuggca

SEQ ID NO: 306130 - RNA, 22 nt, Human
agccaggaaccagcuacagucu

SEQ ID NO: 306131 - RNA, 20 nt, Human
agcugguuaucuuaauucuu

SEQ ID NO: 306132 - RNA, 19 nt, Human
gccacuccugaugcugccc

SEQ ID NO: 306133 - RNA, 22 nt, Human
uaauaguugugacuuuguaaag

SEQ ID NO: 306134 - RNA, 22 nt, Human
cuccuguauguugggcuucaca

SEQ ID NO: 306135 - RNA, 22 nt, Human
ggaggaugagcuacgaggagcu

SEQ ID NO: 306136 - RNA, 22 nt, Human
agaugcugugaggaagcuagga

SEQ ID NO: 306137 - RNA, 22 nt, Human
acagaugaggaaacagggucag

SEQ ID NO: 306138 - RNA, 20 nt, Human
gccagcacagggagcaguuc

SEQ ID NO: 306139 - RNA, 22 nt, Human
cugcauccuggaaauagcuaag

SEQ ID NO: 306140 - RNA, 22 nt, Human
acauuucugucuuagggacugu

SEQ ID NO: 306141 - RNA, 22 nt, Human
cagagccaaaugcugugguuau

SEQ ID NO: 306142 - RNA, 22 nt, Human
gcucugggcugcccucuggaca

SEQ ID NO: 306143 - RNA, 22 nt, Human
agagccuggaccugagcuacaa

SEQ ID NO: 306144 - RNA, 19 nt, Human
ccucccacggauuccuucc

SEQ ID NO: 306145 - RNA, 22 nt, Human
gcucccugaaaagaacaaaguc

SEQ ID NO: 306146 - RNA, 22 nt, Human
gcaaagucucaagacccaagug

SEQ ID NO: 306147 - RNA, 22 nt, Human
uagcuuuacaaagugcugcacc

SEQ ID NO: 306148 - RNA, 22 nt, Human
caggaagagaacauggaggcug

SEQ ID NO: 306149 - RNA, 22 nt, Human
acacagaaccucauagccucuc

SEQ ID NO: 306150 - RNA, 22 nt, Human
uucugucaaauuugccauaugg

SEQ ID NO: 306151 - RNA, 22 nt, Human
ccagguggacggcgaguacagg

SEQ ID NO: 306152 - RNA, 22 nt, Human
agcugcucucacuggacgccug

SEQ ID NO: 306153 - RNA, 22 nt, Human
uaaaauagcaugugcagugaaa

SEQ ID NO: 306154 - RNA, 22 nt, Human
ccucucuguaagggucccuccc

SEQ ID NO: 306155 - RNA, 22 nt, Human
uugguuuagagagugugguuac

SEQ ID NO: 306156 - RNA, 22 nt, Human
agccaagcaccacuggcacucg

SEQ ID NO: 306157 - RNA, 22 nt, Human
ucauacauucagcagauauuug

SEQ ID NO: 306158 - RNA, 22 nt, Human
uguguuauugccacugaagacc

SEQ ID NO: 306159 - RNA, 22 nt, Human
ucucaguguguugagaggucug

SEQ ID NO: 306160 - RNA, 22 nt, Human
aggcuggagggcaauggcaaga

SEQ ID NO: 306161 - RNA, 22 nt, Human
gaggcugccccuuccucagcug

SEQ ID NO: 306162 - RNA, 19 nt, Human
ggcagcuggacgcuguuca

SEQ ID NO: 306163 - RNA, 22 nt, Human
aaaggccaauaaagacaagcug

SEQ ID NO: 306164 - RNA, 21 nt, Human
cucacaggaugcaguguuacu

SEQ ID NO: 306165 - RNA, 20 nt, Human
ggcucuggaaucuggugggc

SEQ ID NO: 306166 - RNA, 22 nt, Human
cccaggcugauguucagcgggu

SEQ ID NO: 306167 - RNA, 22 nt, Human
gcagagcugggauaugaaccca

SEQ ID NO: 306168 - RNA, 22 nt, Human
cagggccagccauccugcuggg

SEQ ID NO: 306169 - RNA, 22 nt, Human
ggcagauggagaagcagcaggu

SEQ ID NO: 306170 - RNA, 22 nt, Human
ugacagaaugugacucucagau

SEQ ID NO: 306171 - RNA, 22 nt, Human
caagagcuuuagaaaugcucau

SEQ ID NO: 306172 - RNA, 22 nt, Human
uggcccuguggaggucagugag

SEQ ID NO: 306173 - RNA, 22 nt, Human
aauggagacccuaaggaagagg

SEQ ID NO: 306174 - RNA, 22 nt, Human
gucccaggcagagucaggaggg

SEQ ID NO: 306175 - RNA, 22 nt, Human
gggcagggguagcauuccaagu

SEQ ID NO: 306176 - RNA, 22 nt, Human
ugggacaguuguccuccacucu

SEQ ID NO: 306177 - RNA, 22 nt, Human
acucaggaaaugagaggcucuc

SEQ ID NO: 306178 - RNA, 22 nt, Human
uucugggacaucuggacaguuu

SEQ ID NO: 306179 - RNA, 22 nt, Human
ugcagcaggagccaggccuggu

SEQ ID NO: 306180 - RNA, 22 nt, Human
gucucuggguuaagcagugcau

SEQ ID NO: 306181 - RNA, 22 nt, Human
auuucugugcaguaaaugguga

SEQ ID NO: 306182 - RNA, 17 nt, Human
ugcauguccuuuguucc

SEQ ID NO: 306183 - RNA, 22 nt, Human
gcucaggagcugacagccucaa

SEQ ID NO: 306184 - RNA, 22 nt, Human
gagaggcugaaaucacaggagc

SEQ ID NO: 306185 - RNA, 22 nt, Human
uucaagaugacccagucacacg

SEQ ID NO: 306186 - RNA, 22 nt, Human
acaaagucacaauaauuaaccu

SEQ ID NO: 306187 - RNA, 22 nt, Human
uuaucauugucgcagucuaauu

SEQ ID NO: 306188 - RNA, 22 nt, Human
gccugucugcgucacgcuuauu

SEQ ID NO: 306189 - RNA, 22 nt, Human
cagggccagccgcagcauccac

SEQ ID NO: 306190 - RNA, 22 nt, Human
cuacauuuuucaccgagccucu

SEQ ID NO: 306191 - RNA, 22 nt, Human
cauuucugugacacuuccaucu

SEQ ID NO: 306192 - RNA, 22 nt, Human
cuggcucaccuccgcuccagca

SEQ ID NO: 306193 - RNA, 22 nt, Human
ugggccugggagggcagacgcu

SEQ ID NO: 306194 - RNA, 22 nt, Human
gcugcagcagaaguucucagag

SEQ ID NO: 306195 - RNA, 22 nt, Human
cuggguggcgucuggggccagu

SEQ ID NO: 306196 - RNA, 18 nt, Human
ugcuuggagcauuuacca

SEQ ID NO: 306197 - RNA, 22 nt, Human
ugaggcagcaauuguauuguau

SEQ ID NO: 306198 - RNA, 22 nt, Human
gggagacacgcugcaggcauaa

SEQ ID NO: 306199 - RNA, 22 nt, Human
gcugagguaggagguugcagug

SEQ ID NO: 306200 - RNA, 22 nt, Human
cucagagaagucuuugcuaaac

SEQ ID NO: 306201 - RNA, 22 nt, Human
ccagggagccuggugugucagc

SEQ ID NO: 306202 - RNA, 21 nt, Human
ggcagcugaccgcgcggugca

SEQ ID NO: 306203 - RNA, 22 nt, Human
gcuggagcugaguucccugggc

SEQ ID NO: 306204 - RNA, 22 nt, Human
uaaguucauuagacuacagaua

SEQ ID NO: 306205 - RNA, 22 nt, Human
gcaguggauccaaugguaucuu

SEQ ID NO: 306206 - RNA, 22 nt, Human
auugaaucugcacuaguauuuu

SEQ ID NO: 306207 - RNA, 20 nt, Human
gagggcaggcacccauuuca

SEQ ID NO: 306208 - RNA, 17 nt, Human
gagaguguauuggaugc

SEQ ID NO: 306209 - RNA, 19 nt, Human
uugaaagauuagcuuucua

SEQ ID NO: 306210 - RNA, 22 nt, Human
agaaaugacaagacugaucagg

SEQ ID NO: 306211 - RNA, 22 nt, Human
ucuacugugguccuuguaacca

SEQ ID NO: 306212 - RNA, 22 nt, Human
caguggguccuaaguacaguuc

SEQ ID NO: 306213 - RNA, 22 nt, Human
aaauaauuauagcgagucuauc

SEQ ID NO: 306214 - RNA, 22 nt, Human
agggggugcccagaugaaggau

SEQ ID NO: 306215 - RNA, 22 nt, Human
gugcgccagcucaaggggaggc

SEQ ID NO: 306216 - RNA, 20 nt, Human
ccagagcagccacugaaguu

SEQ ID NO: 306217 - RNA, 22 nt, Human
auucucaauggcuacuuucaua

SEQ ID NO: 306218 - RNA, 22 nt, Human
uucauucuuugaaucugaggua

SEQ ID NO: 306219 - RNA, 22 nt, Human
gugcuuucugcaugguuccuac

SEQ ID NO: 306220 - RNA, 22 nt, Human
agagcugcaauuucauguggug

SEQ ID NO: 306221 - RNA, 22 nt, Human
ccugccaggccagugagcuucc

SEQ ID NO: 306222 - RNA, 22 nt, Human
gaaggcuugcagcucuguggca

SEQ ID NO: 306223 - RNA, 22 nt, Human
aagcuggagaguuaggugaaua

SEQ ID NO: 306224 - RNA, 22 nt, Human
acaaaugccauauauaaauucu

SEQ ID NO: 306225 - RNA, 22 nt, Human
ugggcucugaagucagucugcu

SEQ ID NO: 306226 - RNA, 22 nt, Human
agaaaguucugugaguuguuca

SEQ ID NO: 306227 - RNA, 22 nt, Human
cagaggaggccaccgcauaggc

SEQ ID NO: 306228 - RNA, 20 nt, Human
aguguuccggaagacuggca

SEQ ID NO: 306229 - RNA, 22 nt, Human
ggcacugagcugccuuggggca

SEQ ID NO: 306230 - RNA, 22 nt, Human
agccuggaggccaggagacagu

SEQ ID NO: 306231 - RNA, 19 nt, Human
ugcugcuguccuugcaggg

SEQ ID NO: 306232 - RNA, 22 nt, Human
aggauccuccuuagaaaagacc

SEQ ID NO: 306233 - RNA, 22 nt, Human
augacucuuagcuaaagguaag

SEQ ID NO: 306234 - RNA, 22 nt, Human
aaaauaguuaacguucagagua

SEQ ID NO: 306235 - RNA, 22 nt, Human
guggccuggaaaggcuggucug

SEQ ID NO: 306236 - RNA, 22 nt, Human
gagcccucucuguaggcaagua

SEQ ID NO: 306237 - RNA, 22 nt, Human
uaagcuauuccugaagaagguu

SEQ ID NO: 306238 - RNA, 22 nt, Human
agcagggcagguaaggaucaga

SEQ ID NO: 306239 - RNA, 22 nt, Human
cuggcucagugccuucagaagu

SEQ ID NO: 306240 - RNA, 22 nt, Human
ccuguguguaggccaggggagu

SEQ ID NO: 306241 - RNA, 22 nt, Human
uauuuugacuauuaaaccaaca

SEQ ID NO: 306242 - RNA, 22 nt, Human
agaggccacuuugccugugaug

SEQ ID NO: 306243 - RNA, 22 nt, Human
ccaaggcuggagugcaguggcg

SEQ ID NO: 306244 - RNA, 22 nt, Human
ugucacauguguggcauuuuuc

SEQ ID NO: 306245 - RNA, 22 nt, Human
ucaguguuuccugugguacagc

SEQ ID NO: 306246 - RNA, 22 nt, Human
aguaugaauacagauuuucucu

SEQ ID NO: 306247 - RNA, 22 nt, Human
caugaagcacagcucucuuuuu

SEQ ID NO: 306248 - RNA, 22 nt, Human
uugcauuugacaaauuauuuaa

SEQ ID NO: 306249 - RNA, 22 nt, Human
ccagcuccugggucuuagucag

SEQ ID NO: 306250 - RNA, 22 nt, Human
gugucauggaaaauugcaaugg

SEQ ID NO: 306251 - RNA, 22 nt, Human
uauuucuuguuauucucguuga

SEQ ID NO: 306252 - RNA, 22 nt, Human
gcuggugcauuagcugcaguuc

SEQ ID NO: 306253 - RNA, 22 nt, Human
uggcagcugucuguggggucuc

SEQ ID NO: 306254 - RNA, 22 nt, Human
ccacugaggcaggcaguaucua

SEQ ID NO: 306255 - RNA, 22 nt, Human
uucacagggcagcagcugagcc

SEQ ID NO: 306256 - RNA, 22 nt, Human
aaaaacugcaauuacuuuuguc

SEQ ID NO: 306257 - RNA, 22 nt, Human
ggagccuguggcugcuugaagc

SEQ ID NO: 306258 - RNA, 20 nt, Human
caguagcaauaauuagaagc

SEQ ID NO: 306259 - RNA, 22 nt, Human
aucauuucccuuuagaucacaa

SEQ ID NO: 306260 - RNA, 22 nt, Human
aauaugcauguauacaugugua

SEQ ID NO: 306261 - RNA, 22 nt, Human
agagacaggguuuugccauguu

SEQ ID NO: 306262 - RNA, 22 nt, Human
aggccuggccccaguugcuagg

SEQ ID NO: 306263 - RNA, 22 nt, Human
aacaaauguguuuuguaauuaa

SEQ ID NO: 306264 - RNA, 22 nt, Human
guccuggggauacagaagugaa

SEQ ID NO: 306265 - RNA, 22 nt, Human
ugcaccauacccauuccccucu

SEQ ID NO: 306266 - RNA, 19 nt, Human
uccugcccaccagccaggg

SEQ ID NO: 306267 - RNA, 22 nt, Human
ucuggaaguuagaggaggaaag

SEQ ID NO: 306268 - RNA, 22 nt, Human
acaggugaccugcucauaugaa

SEQ ID NO: 306269 - RNA, 20 nt, Human
cuguagggugcagcaggcuc

SEQ ID NO: 306270 - RNA, 22 nt, Human
acaggugggcuuaagagucggc

SEQ ID NO: 306271 - RNA, 22 nt, Human
gcaggaguguauuugcauguaa

SEQ ID NO: 306272 - RNA, 22 nt, Human
aaagcucacaguaauacaaggc

SEQ ID NO: 306273 - RNA, 22 nt, Human
cuggcaggucucgcugacgugu

SEQ ID NO: 306274 - RNA, 22 nt, Human
ccuggugcuuaccagagcuuuu

SEQ ID NO: 306275 - RNA, 22 nt, Human
uagauuuuacuucugucauuac

SEQ ID NO: 306276 - RNA, 22 nt, Human
uaaguuuaaauguacaugaagc

SEQ ID NO: 306277 - RNA, 22 nt, Human
auggcccaggccuccuguggcu

SEQ ID NO: 306278 - RNA, 22 nt, Human
agcuggcaguaugacuggugac

SEQ ID NO: 306279 - RNA, 22 nt, Human
cagcccucagguccucagcagc

SEQ ID NO: 306280 - RNA, 22 nt, Human
uguccucaaggagcuucagucu

SEQ ID NO: 306281 - RNA, 22 nt, Human
gcugagcuagcuaucucagucu

SEQ ID NO: 306282 - RNA, 22 nt, Human
gccccucccagucaggagcacu

SEQ ID NO: 306283 - RNA, 23 nt, Human
uucaaaacuggaaaaucagaugc

SEQ ID NO: 306284 - RNA, 22 nt, Human
uugaacauuaacuucagucuau

SEQ ID NO: 306285 - RNA, 22 nt, Human
ucuggcucccuggagcuccaca

SEQ ID NO: 306286 - RNA, 22 nt, Human
uguggccuccuguuccugggua

SEQ ID NO: 306287 - RNA, 22 nt, Human
gcagagccgugaauggauuuca

SEQ ID NO: 306288 - RNA, 21 nt, Human
acagcauguuuguguguuugc

SEQ ID NO: 306289 - RNA, 22 nt, Human
ggcacugacugugcagcgcacc

SEQ ID NO: 306290 - RNA, 22 nt, Human
uggcccugcuggccaaaggcua

SEQ ID NO: 306291 - RNA, 22 nt, Human
ucugaggcuaagagacagaggc

SEQ ID NO: 306292 - RNA, 22 nt, Human
agcuuguuagaaauguagacuc

SEQ ID NO: 306293 - RNA, 22 nt, Human
agacagcaugauacaugaugcu

SEQ ID NO: 306294 - RNA, 22 nt, Human
aguaaaaucaccaucucuuugu

SEQ ID NO: 306295 - RNA, 22 nt, Human
uugcauuugaucuuggguucuc

SEQ ID NO: 306296 - RNA, 22 nt, Human
gggccccuuguaucucuggcuc

SEQ ID NO: 306297 - RNA, 22 nt, Human
agaauucuuggugguuagaaua

SEQ ID NO: 306298 - RNA, 23 nt, Human
cugcagccgcguggggacgugga

SEQ ID NO: 306299 - RNA, 22 nt, Human
ucuagaaaaaaacugcugugga

SEQ ID NO: 306300 - RNA, 22 nt, Human
agcaggguauguuagagcugua

SEQ ID NO: 306301 - RNA, 22 nt, Human
gcagauggcucagacacugggg

SEQ ID NO: 306302 - RNA, 22 nt, Human
gauuuccuagacauggggcaga

SEQ ID NO: 306303 - RNA, 22 nt, Human
ugucauuuucuaaucuguuguc

SEQ ID NO: 306304 - RNA, 22 nt, Human
uaucaauugggccaaaugguac

SEQ ID NO: 306305 - RNA, 22 nt, Human
gaagggagaagguugggugacg

SEQ ID NO: 306306 - RNA, 22 nt, Human
gggugggaucuguggagccuca

SEQ ID NO: 306307 - RNA, 20 nt, Human
uccuggccuucucgggcagu

SEQ ID NO: 306308 - RNA, 22 nt, Human
auauucaucguguagaaauacu

SEQ ID NO: 306309 - RNA, 22 nt, Human
aaggcacuuaacgugggaggau

SEQ ID NO: 306310 - RNA, 20 nt, Human
gcagagccucacugcaaggg

SEQ ID NO: 306311 - RNA, 22 nt, Human
uggguagaggaauugggcuacc

SEQ ID NO: 306312 - RNA, 22 nt, Human
ucaggcaguagaauugcuugaa

SEQ ID NO: 306313 - RNA, 19 nt, Human
gggcagaauggcaucucag

SEQ ID NO: 306314 - RNA, 22 nt, Human
ugaagcccugugucagcuucca

SEQ ID NO: 306315 - RNA, 22 nt, Human
ggcccagccggcgagucucgcg

SEQ ID NO: 306316 - RNA, 22 nt, Human
auacuguuucucuucuacauga

SEQ ID NO: 306317 - RNA, 22 nt, Human
uaaagaacacagggaauagcac

SEQ ID NO: 306318 - RNA, 22 nt, Human
uccaaauucuagggccuugguu

SEQ ID NO: 306319 - RNA, 22 nt, Human
aggugccagcucucaggcagga

SEQ ID NO: 306320 - RNA, 22 nt, Human
cccaaggcauggcaugguggca

SEQ ID NO: 306321 - RNA, 22 nt, Human
gaggccuggcugucagucccca

SEQ ID NO: 306322 - RNA, 22 nt, Human
gcccugugcuuggauggcagau

SEQ ID NO: 306323 - RNA, 19 nt, Human
ugaguucugugguucucaa

SEQ ID NO: 306324 - RNA, 22 nt, Human
ugacuagaccuauaucuuuuug

SEQ ID NO: 306325 - RNA, 22 nt, Human
ucagggcacaggccuguggguu

SEQ ID NO: 306326 - RNA, 22 nt, Human
ccccuucucugcaagccugcuc

SEQ ID NO: 306327 - RNA, 22 nt, Human
uagccggguguugugucaugca

SEQ ID NO: 306328 - RNA, 22 nt, Human
auaugcaagcacauagaauacu

SEQ ID NO: 306329 - RNA, 22 nt, Human
gccucaguugaucugugugagc

SEQ ID NO: 306330 - RNA, 22 nt, Human
gcuguauuuauuuucuaggguu

SEQ ID NO: 306331 - RNA, 22 nt, Human
cuggaggcacccuuagagaggc

SEQ ID NO: 306332 - RNA, 22 nt, Human
gggccccugggaauucugugau

SEQ ID NO: 306333 - RNA, 22 nt, Human
aucaggaucagggcuagcagag

SEQ ID NO: 306334 - RNA, 22 nt, Human
gcuggccugggcagccugucgg

SEQ ID NO: 306335 - RNA, 22 nt, Human
gaaacugugaggaucuuaacuu

SEQ ID NO: 306336 - RNA, 19 nt, Human
ucuggagcugaugcaggug

SEQ ID NO: 306337 - RNA, 22 nt, Human
cucucccagucaggcucaggau

SEQ ID NO: 306338 - RNA, 22 nt, Human
ccucagagguuuucauucugua

SEQ ID NO: 306339 - RNA, 22 nt, Human
cuuaagauuugagauaccuaau

SEQ ID NO: 306340 - RNA, 22 nt, Human
auguacauuuguaguaauauca

SEQ ID NO: 306341 - RNA, 22 nt, Human
uccuugaacagagggccugggu

SEQ ID NO: 306342 - RNA, 22 nt, Human
ccucagagccuccagaaggaau

SEQ ID NO: 306343 - RNA, 22 nt, Human
gguggguauaguuagggccucu

SEQ ID NO: 306344 - RNA, 22 nt, Human
ucacaugaguauuauuuuccaa

SEQ ID NO: 306345 - RNA, 22 nt, Human
ccagcauggcaccugagaugag

SEQ ID NO: 306346 - RNA, 22 nt, Human
ggugcagugguguggcaaaggg

SEQ ID NO: 306347 - RNA, 22 nt, Human
gaaccucagugaaacuggaggu

SEQ ID NO: 306348 - RNA, 22 nt, Human
uucagcaaauggacuguucagg

SEQ ID NO: 306349 - RNA, 22 nt, Human
caagaauuguacaaacugggug

SEQ ID NO: 306350 - RNA, 22 nt, Human
gagcugccugugugccaugaug

SEQ ID NO: 306351 - RNA, 22 nt, Human
ccaugagcuucaacugacacag

SEQ ID NO: 306352 - RNA, 22 nt, Human
ucucuggguuuuuguccuguac

SEQ ID NO: 306353 - RNA, 22 nt, Human
gccuaauaugcaaaauugauac

SEQ ID NO: 306354 - RNA, 22 nt, Human
guggccuggaguuugauguagg

SEQ ID NO: 306355 - RNA, 19 nt, Human
ccagcagacacagcugccc

SEQ ID NO: 306356 - RNA, 22 nt, Human
gcccagccuccaagcuccaagg

SEQ ID NO: 306357 - RNA, 22 nt, Human
gugcaccccggggcccugcucc

SEQ ID NO: 306358 - RNA, 22 nt, Human
ugaaaucuccucuuuauauauc

SEQ ID NO: 306359 - RNA, 22 nt, Human
ucagaaaccagcucucucaauu

SEQ ID NO: 306360 - RNA, 22 nt, Human
uucaagauggccccagugagcc

SEQ ID NO: 306361 - RNA, 22 nt, Human
gcucccugcacucugcagcccu

SEQ ID NO: 306362 - RNA, 22 nt, Human
ugccagcuuuugacuaucuuag

SEQ ID NO: 306363 - RNA, 22 nt, Human
uagaauugggccuaacuuccau

SEQ ID NO: 306364 - RNA, 22 nt, Human
uguggaggauucugaugccagc

SEQ ID NO: 306365 - RNA, 22 nt, Human
aguggcagaagucacuggguag

SEQ ID NO: 306366 - RNA, 22 nt, Human
gcacagagggcagugagccucu

SEQ ID NO: 306367 - RNA, 20 nt, Human
cugcugugguccuuuauuuu

SEQ ID NO: 306368 - RNA, 22 nt, Human
gggcccuggauuuaagcaugga

SEQ ID NO: 306369 - RNA, 22 nt, Human
gaauacauuggaaaucagaaua

SEQ ID NO: 306370 - RNA, 22 nt, Human
cucagucugucuugucuguguu

SEQ ID NO: 306371 - RNA, 22 nt, Human
gcugggcugagcuagacuuggc

SEQ ID NO: 306372 - RNA, 22 nt, Human
uaugaacuguacuguacuaagc

SEQ ID NO: 306373 - RNA, 22 nt, Human
uuuagaaguucacacauuuaaa

SEQ ID NO: 306374 - RNA, 22 nt, Human
cugcugugucagaguccagggg

SEQ ID NO: 306375 - RNA, 20 nt, Human
auacacauauucuugcaacu

SEQ ID NO: 306376 - RNA, 22 nt, Human
aaaugugucauauucaaaguca

SEQ ID NO: 306377 - RNA, 22 nt, Human
gaaggaaaaauacucuguaagg

SEQ ID NO: 306378 - RNA, 22 nt, Human
aaugcacagcuaaagugguucc

SEQ ID NO: 306379 - RNA, 22 nt, Human
gugauugcccagcaccauuguu

SEQ ID NO: 306380 - RNA, 22 nt, Human
aaguuauugcagcaauccaagu

SEQ ID NO: 306381 - RNA, 22 nt, Human
gggccugggaacuugcauuuag

SEQ ID NO: 306382 - RNA, 21 nt, Human
cucaggaucuuauauauuagu

SEQ ID NO: 306383 - RNA, 22 nt, Human
augaacacauguacacauuucu

SEQ ID NO: 306384 - RNA, 22 nt, Human
aaguggacuaauacaaggacua

SEQ ID NO: 306385 - RNA, 22 nt, Human
ccugccaggcuuugggcuucug

SEQ ID NO: 306386 - RNA, 23 nt, Human
ucugagagaacaaugccuccuau

SEQ ID NO: 306387 - RNA, 22 nt, Human
uccuccagugucuggggccuug

SEQ ID NO: 306388 - RNA, 22 nt, Human
ugcauuugucuugucucaugaa

SEQ ID NO: 306389 - RNA, 22 nt, Human
aggagccccucuucaguccugg

SEQ ID NO: 306390 - RNA, 21 nt, Human
ucuuguccuugcucucccacu

SEQ ID NO: 306391 - RNA, 22 nt, Human
aagggcuggccacauucugggu

SEQ ID NO: 306392 - RNA, 22 nt, Human
acacugcagaugaaagcauaag

SEQ ID NO: 306393 - RNA, 22 nt, Human
ucaaaguaaaaguauagaguuu

SEQ ID NO: 306394 - RNA, 22 nt, Human
gcaaauucuuaacuggacugug

SEQ ID NO: 306395 - RNA, 22 nt, Human
uucaugaaaguguaucuugugg

SEQ ID NO: 306396 - RNA, 21 nt, Human
ucucuacaaauuauguuaggu

SEQ ID NO: 306397 - RNA, 22 nt, Human
ugucucugguauuaggugaaaa

SEQ ID NO: 306398 - RNA, 22 nt, Human
guguguccucaguaguggcaug

SEQ ID NO: 306399 - RNA, 22 nt, Human
ccaggcccugccugugguuccu

SEQ ID NO: 306400 - RNA, 22 nt, Human
gauugaaacauaggcagucgag

SEQ ID NO: 306401 - RNA, 22 nt, Human
cuuugaauugccguuucaucug

SEQ ID NO: 306402 - RNA, 20 nt, Human
aguaccuuuuguauguuacc

SEQ ID NO: 306403 - RNA, 22 nt, Human
cucccaggcacagggaggagcc

SEQ ID NO: 306404 - RNA, 22 nt, Human
augcuguguuugagaaccuagg

SEQ ID NO: 306405 - RNA, 22 nt, Human
ggcaggagggcggacaaugacc

SEQ ID NO: 306406 - RNA, 22 nt, Human
cuacauuuggagaguauaggaa

SEQ ID NO: 306407 - RNA, 22 nt, Human
gucucagagagcuacucucuua

SEQ ID NO: 306408 - RNA, 19 nt, Human
ccaguagagacagcugcag

SEQ ID NO: 306409 - RNA, 22 nt, Human
acagcugugaaaauccacagga

SEQ ID NO: 306410 - RNA, 22 nt, Human
agcugcugugugcucaggcagg

SEQ ID NO: 306411 - RNA, 22 nt, Human
ggagcagagcugggcuuggcug

SEQ ID NO: 306412 - RNA, 22 nt, Human
gcaucuaaacuugcaucauugu

SEQ ID NO: 306413 - RNA, 22 nt, Human
ugcccaagcagaggagugauuc

SEQ ID NO: 306414 - RNA, 22 nt, Human
agcuccuguucugagagcagga

SEQ ID NO: 306415 - RNA, 22 nt, Human
gagcauuuuugucugcauuuua

SEQ ID NO: 306416 - RNA, 22 nt, Human
cugcaguguucuggaaugcauu

SEQ ID NO: 306417 - RNA, 22 nt, Human
cccuggcaugcaugucccuggc

SEQ ID NO: 306418 - RNA, 22 nt, Human
uucuccaacacaagcaugaugu

SEQ ID NO: 306419 - RNA, 22 nt, Human
uaucuguuaugggcugaauugc

SEQ ID NO: 306420 - RNA, 22 nt, Human
uuguguuucccuugcauauucc

SEQ ID NO: 306421 - RNA, 22 nt, Human
augaacuuauuucugaacuuuu

SEQ ID NO: 306422 - RNA, 22 nt, Human
gcagcagcccagggcucucaga

SEQ ID NO: 306423 - RNA, 22 nt, Human
ccucuggcuguaccacuggcac

SEQ ID NO: 306424 - RNA, 22 nt, Human
ggccucugcaacuggcuguggc

SEQ ID NO: 306425 - RNA, 19 nt, Human
cagagccucagagcuagaa

SEQ ID NO: 306426 - RNA, 22 nt, Human
gugugccaggaacuggcugcug

SEQ ID NO: 306427 - RNA, 21 nt, Human
agaugcugugcuccaggagca

SEQ ID NO: 306428 - RNA, 22 nt, Human
gaacagaauuaccgaagaucug

SEQ ID NO: 306429 - RNA, 22 nt, Human
aggggcugggacagagccaagc

SEQ ID NO: 306430 - RNA, 22 nt, Human
cacaaugugguuugucaucuuu

SEQ ID NO: 306431 - RNA, 22 nt, Human
ggggaaaggccauggcaagaac

SEQ ID NO: 306432 - RNA, 22 nt, Human
ugugaaagcaagucuaguucuc

SEQ ID NO: 306433 - RNA, 22 nt, Human
ugcuggggauccguaccaaccc

SEQ ID NO: 306434 - RNA, 22 nt, Human
acugcagcaaagcccgugucuu

SEQ ID NO: 306435 - RNA, 18 nt, Human
ggcaggagcaagaauagg

SEQ ID NO: 306436 - RNA, 22 nt, Human
uuucauuuugguuaugccauaa

SEQ ID NO: 306437 - RNA, 22 nt, Human
ccugguggccuucagcccacaa

SEQ ID NO: 306438 - RNA, 19 nt, Human
uuugaauccagcugguaac

SEQ ID NO: 306439 - RNA, 19 nt, Human
agacagagcucaguggguu

SEQ ID NO: 306440 - RNA, 22 nt, Human
uuccaugugaguacacugugau

SEQ ID NO: 306441 - RNA, 22 nt, Human
caggcagccaggggaccugucc

SEQ ID NO: 306442 - RNA, 22 nt, Human
cucaaggacuuauucaugccug

SEQ ID NO: 306443 - RNA, 22 nt, Human
gugaggugguacaauauuaacu

SEQ ID NO: 306444 - RNA, 22 nt, Human
cagcauuuaaugcagugcuucc

SEQ ID NO: 306445 - RNA, 22 nt, Human
auguacaguuucuagacucaaa

SEQ ID NO: 306446 - RNA, 22 nt, Human
cagaagcagugagagaugugca

SEQ ID NO: 306447 - RNA, 22 nt, Human
acuguucacccagcacuagcag

SEQ ID NO: 306448 - RNA, 22 nt, Human
uuuuacuuaauucuuggucaug

SEQ ID NO: 306449 - RNA, 22 nt, Human
ccuggagccccucuggccagcc

SEQ ID NO: 306450 - RNA, 22 nt, Human
acagaugaguuagaauaggcag

SEQ ID NO: 306451 - RNA, 22 nt, Human
gcagccaccucccauggcgggg

SEQ ID NO: 306452 - RNA, 22 nt, Human
uuucuaggucuuccauacugcc

SEQ ID NO: 306453 - RNA, 22 nt, Human
ccaaaguccauaguuuacuuua

SEQ ID NO: 306454 - RNA, 22 nt, Human
ugagcuuacgugggaacagacu

SEQ ID NO: 306455 - RNA, 22 nt, Human
caucaaauggcaagugaaagcu

SEQ ID NO: 306456 - RNA, 22 nt, Human
ugagccugcaauaagcacagcc

SEQ ID NO: 306457 - RNA, 22 nt, Human
ggucccaggaagugcggcggcg

SEQ ID NO: 306458 - RNA, 22 nt, Human
agggcugcuauguugauucaga

SEQ ID NO: 306459 - RNA, 22 nt, Human
agcucccagggcugggcaaguu

SEQ ID NO: 306460 - RNA, 22 nt, Human
uguggucucguuauguugccca

SEQ ID NO: 306461 - RNA, 22 nt, Human
cuggcucaguucuugguuuuca

SEQ ID NO: 306462 - RNA, 22 nt, Human
aaugauuuccccuacacagaag

SEQ ID NO: 306463 - RNA, 22 nt, Human
gccaggaacacaaugccaagcu

SEQ ID NO: 306464 - RNA, 22 nt, Human
aaaguuugcaauuuauguuaau

SEQ ID NO: 306465 - RNA, 22 nt, Human
gcucaguguguucaagggcuca

SEQ ID NO: 306466 - RNA, 22 nt, Human
aucuggcuuucuuaaugacuua

SEQ ID NO: 306467 - RNA, 22 nt, Human
agcccaagcauaggagggaggc

SEQ ID NO: 306468 - RNA, 22 nt, Human
gauucugagcugguguuuuacg

SEQ ID NO: 306469 - RNA, 22 nt, Human
cccagcaguuguuggugcacau

SEQ ID NO: 306470 - RNA, 22 nt, Human
ucauuuaauagcuuuugucuuu

SEQ ID NO: 306471 - RNA, 22 nt, Human
agcuggggguagugagaaauaa

SEQ ID NO: 306472 - RNA, 21 nt, Human
auacacauacacauaaaugug

SEQ ID NO: 306473 - RNA, 22 nt, Human
aucaggauucaccccagagcug

SEQ ID NO: 306474 - RNA, 22 nt, Human
uggcagggugggcuucagcccc

SEQ ID NO: 306475 - RNA, 22 nt, Human
gcuugcuggugccugcaggcuc

SEQ ID NO: 306476 - RNA, 22 nt, Human
ggcacagggaggcccuggugug

SEQ ID NO: 306477 - RNA, 22 nt, Human
cagggagggacaauugucaccu

SEQ ID NO: 306478 - RNA, 22 nt, Human
gcuggcccagggucaccuagga

SEQ ID NO: 306479 - RNA, 21 nt, Human
gcugcagggcccagggcaccc

SEQ ID NO: 306480 - RNA, 22 nt, Human
uggcacuggcgcaggauggcgg

SEQ ID NO: 306481 - RNA, 22 nt, Human
uuguuuuggaagaacuuacucu

SEQ ID NO: 306482 - RNA, 22 nt, Human
gcuggggagcuagaccucagca

SEQ ID NO: 306483 - RNA, 22 nt, Human
aaacauuugcaacucgguuugg

SEQ ID NO: 306484 - RNA, 22 nt, Human
agcugcccuucucuugcccuug

SEQ ID NO: 306485 - RNA, 21 nt, Human
aacugcuggucuuuucugucu

SEQ ID NO: 306486 - RNA, 22 nt, Human
uggcagccacaucucguggauu

SEQ ID NO: 306487 - RNA, 22 nt, Human
uuucucaguuacuagcuguggu

SEQ ID NO: 306488 - RNA, 22 nt, Human
cucaggagaugacagaagguau

SEQ ID NO: 306489 - RNA, 22 nt, Human
cuagagggauguuaggauagca

SEQ ID NO: 306490 - RNA, 22 nt, Human
ccucuuccacugggccccaucc

SEQ ID NO: 306491 - RNA, 22 nt, Human
gagcagugaagacagaaguaca

SEQ ID NO: 306492 - RNA, 22 nt, Human
auugaaagaguuuucugcugca

SEQ ID NO: 306493 - RNA, 22 nt, Human
ucccagagcucuggagguugga

SEQ ID NO: 306494 - RNA, 22 nt, Human
ugugggcaggcccgggucugag

SEQ ID NO: 306495 - RNA, 22 nt, Human
guuguauucuucaauaucagag

SEQ ID NO: 306496 - RNA, 17 nt, Human
ucaggcugggugcagug

SEQ ID NO: 306497 - RNA, 22 nt, Human
cugugucccuugucccagagcc

SEQ ID NO: 306498 - RNA, 22 nt, Human
ucucugguuauuaacuaacucc

SEQ ID NO: 306499 - RNA, 22 nt, Human
gaaagggaguggacaacaggca

SEQ ID NO: 306500 - RNA, 22 nt, Human
agucucugcaugaugcagcaca

SEQ ID NO: 306501 - RNA, 22 nt, Human
uggccucaagucugagggccuu

SEQ ID NO: 306502 - RNA, 22 nt, Human
caggcagagugagguggucuaa

SEQ ID NO: 306503 - RNA, 22 nt, Human
ccagaccacccuggccaugcac

SEQ ID NO: 306504 - RNA, 22 nt, Human
agaggccagguccagaguuugu

SEQ ID NO: 306505 - RNA, 22 nt, Human
uggcugggagcuggaacugggc

SEQ ID NO: 306506 - RNA, 22 nt, Human
uauugaaaugaaugacagugau

SEQ ID NO: 306507 - RNA, 23 nt, Human
gccuggagaaaagcugcaguuca

SEQ ID NO: 306508 - RNA, 22 nt, Human
cucagcucugacaggaggcauc

SEQ ID NO: 306509 - RNA, 20 nt, Human
uuguuucugcuauuuucuaa

SEQ ID NO: 306510 - RNA, 22 nt, Human
aaaguguaaaagcauguuaggg

SEQ ID NO: 306511 - RNA, 22 nt, Human
cugguuuagcuguaagguuccc

SEQ ID NO: 306512 - RNA, 22 nt, Human
ucccagaguuuccuguguccca

SEQ ID NO: 306513 - RNA, 19 nt, Human
uagucuuuauucuuaauuu

SEQ ID NO: 306514 - RNA, 22 nt, Human
aaauaucauuuauaacuuuuaa

SEQ ID NO: 306515 - RNA, 22 nt, Human
agagccugcuguguaagucaca

SEQ ID NO: 306516 - RNA, 23 nt, Human
cagcccuuccugcauguuuuugu

SEQ ID NO: 306517 - RNA, 22 nt, Human
cauucacaucuuguuccaucac

SEQ ID NO: 306518 - RNA, 22 nt, Human
agcugucuuucugccuccugau

SEQ ID NO: 306519 - RNA, 22 nt, Human
uuguaaauaguaguaagaugcc

SEQ ID NO: 306520 - RNA, 22 nt, Human
gcacagggagcaggucucuggu

SEQ ID NO: 306521 - RNA, 22 nt, Human
uccucuggggcgugguccugga

SEQ ID NO: 306522 - RNA, 22 nt, Human
cucugagagcggucuguggcuu

SEQ ID NO: 306523 - RNA, 22 nt, Human
auggacagugugaagcagauag

SEQ ID NO: 306524 - RNA, 22 nt, Human
caguugcuggaugugcagcucu

SEQ ID NO: 306525 - RNA, 22 nt, Human
uucuccucuguuggccuucccu

SEQ ID NO: 306526 - RNA, 22 nt, Human
aagaauguggguggauaugaug

SEQ ID NO: 306527 - RNA, 22 nt, Human
ugucucagauacgccaucaagg

SEQ ID NO: 306528 - RNA, 22 nt, Human
cccagcucuaggagugguggca

SEQ ID NO: 306529 - RNA, 22 nt, Human
gcuugcucaacccccgucucuc

SEQ ID NO: 306530 - RNA, 20 nt, Human
uccaugaguuagagacuaua

SEQ ID NO: 306531 - RNA, 22 nt, Human
gcuggcagguccaagauagagc

SEQ ID NO: 306532 - RNA, 21 nt, Human
gcagcuggucucagagcuugc

SEQ ID NO: 306533 - RNA, 22 nt, Human
agaacagcaguuaugguucauu

SEQ ID NO: 306534 - RNA, 22 nt, Human
cugaaggagguagagugacaua

SEQ ID NO: 306535 - RNA, 22 nt, Human
ugcuuggccuacuuguccuuug

SEQ ID NO: 306536 - RNA, 22 nt, Human
aaauuauuaugccccucuauaa

SEQ ID NO: 306537 - RNA, 22 nt, Human
acagagccaaaaggacauagua

SEQ ID NO: 306538 - RNA, 22 nt, Human
agugagggaugaagaacugcgg

SEQ ID NO: 306539 - RNA, 22 nt, Human
cauucacaaagcugauugaugg

SEQ ID NO: 306540 - RNA, 22 nt, Human
gcagggucgcucuaggagauca

SEQ ID NO: 306541 - RNA, 22 nt, Human
aaaauggucucagcuggcacca

SEQ ID NO: 306542 - RNA, 22 nt, Human
gccuguccuggaugcucugcaa

SEQ ID NO: 306543 - RNA, 20 nt, Human
acaggagaucugaggaaagg

SEQ ID NO: 306544 - RNA, 22 nt, Human
ugcaggugcguuuucaagccuc

SEQ ID NO: 306545 - RNA, 22 nt, Human
ucugcaggaaaaaagugccugg

SEQ ID NO: 306546 - RNA, 22 nt, Human
uuauguacucugcaauguuuga

SEQ ID NO: 306547 - RNA, 22 nt, Human
augucccagcugagagacaacu

SEQ ID NO: 306548 - RNA, 22 nt, Human
caguccugggcaggucaggcca

SEQ ID NO: 306549 - RNA, 22 nt, Human
agcaauauuucagcuagcaggu

SEQ ID NO: 306550 - RNA, 22 nt, Human
uggaguuccuuugaaaggcucu

SEQ ID NO: 306551 - RNA, 22 nt, Human
ccugccaggagcuggugcugca

SEQ ID NO: 306552 - RNA, 22 nt, Human
uacaguucacaguaucauaaau

SEQ ID NO: 306553 - RNA, 22 nt, Human
agaaaugugaauuucauuuccu

SEQ ID NO: 306554 - RNA, 22 nt, Human
aaggcaguuaauuuggcuagaa

SEQ ID NO: 306555 - RNA, 22 nt, Human
aagugaaacauguaucucuuua

SEQ ID NO: 306556 - RNA, 22 nt, Human
cagugcaugaaacaauaugcag

SEQ ID NO: 306557 - RNA, 17 nt, Human
cccaugagcccacuccc

SEQ ID NO: 306558 - RNA, 22 nt, Human
aaaagacauaugugggcauucu

SEQ ID NO: 306559 - RNA, 22 nt, Human
gggauggcucaaaggagucagg

SEQ ID NO: 306560 - RNA, 22 nt, Human
agaaaacauuacauaggugugu

SEQ ID NO: 306561 - RNA, 22 nt, Human
augaaaacuuuagccucauuag

SEQ ID NO: 306562 - RNA, 22 nt, Human
aggccugaaguguggagugggg

SEQ ID NO: 306563 - RNA, 22 nt, Human
gggagcaggagccugccugcca

SEQ ID NO: 306564 - RNA, 22 nt, Human
cuccagggagcuguggagguuu

SEQ ID NO: 306565 - RNA, 22 nt, Human
auugucugaauccaaagcucug

SEQ ID NO: 306566 - RNA, 23 nt, Human
ugcaggggaggcuuaaagcaggu

SEQ ID NO: 306567 - RNA, 22 nt, Human
cagagccacugucugccaggca

SEQ ID NO: 306568 - RNA, 22 nt, Human
gaucaaaagcuggguucuaaaa

SEQ ID NO: 306569 - RNA, 22 nt, Human
agacaguguguguauauauggu

SEQ ID NO: 306570 - RNA, 18 nt, Human
ccgggcuuuggugacaca

SEQ ID NO: 306571 - RNA, 22 nt, Human
aagggcuggaucucucugagca

SEQ ID NO: 306572 - RNA, 22 nt, Human
uaucuuguaauagguccacuug

SEQ ID NO: 306573 - RNA, 22 nt, Human
acaugauuggacuccuuccccu

SEQ ID NO: 306574 - RNA, 22 nt, Human
ggaggcaggaaagacagguuca

SEQ ID NO: 306575 - RNA, 19 nt, Human
cagaacagaggucauggcc

SEQ ID NO: 306576 - RNA, 22 nt, Human
ucaggccuuucuucagagcuuc

SEQ ID NO: 306577 - RNA, 22 nt, Human
acagccugagaguggagcuggc

SEQ ID NO: 306578 - RNA, 22 nt, Human
uucuuaaaacuuauggacaggu

SEQ ID NO: 306579 - RNA, 22 nt, Human
cugugcuggagaugggccagag

SEQ ID NO: 306580 - RNA, 22 nt, Human
agcugagcugcagaugacugua

SEQ ID NO: 306581 - RNA, 22 nt, Human
acagcuguauccccagagcuca

SEQ ID NO: 306582 - RNA, 22 nt, Human
auccuugagccuuaucuuuugu

SEQ ID NO: 306583 - RNA, 22 nt, Human
uacaugaacaaaauagcagaaa

SEQ ID NO: 306584 - RNA, 22 nt, Human
cagaguguaucuguguaagcau

SEQ ID NO: 306585 - RNA, 22 nt, Human
uggcugcugagaaggcagcugu

SEQ ID NO: 306586 - RNA, 22 nt, Human
ccacagagagugucagccuuug

SEQ ID NO: 306587 - RNA, 22 nt, Human
guaggaagcucugaggcuaguu

SEQ ID NO: 306588 - RNA, 22 nt, Human
auguagcaucuauccugauaaa

SEQ ID NO: 306589 - RNA, 22 nt, Human
auucuccacacauccagaccuu

SEQ ID NO: 306590 - RNA, 22 nt, Human
cagggguggcugcagcagaggu

SEQ ID NO: 306591 - RNA, 22 nt, Human
auuucuguaguccacauucuuu

SEQ ID NO: 306592 - RNA, 22 nt, Human
ggccagggccuggggacugucc

SEQ ID NO: 306593 - RNA, 22 nt, Human
ugcuauaagaauuauauuacuc

SEQ ID NO: 306594 - RNA, 19 nt, Human
uggagacugagagugagca

SEQ ID NO: 306595 - RNA, 22 nt, Human
aaugcugcucucauaauuauag

SEQ ID NO: 306596 - RNA, 19 nt, Human
ggaaggagagaaaugcaug

SEQ ID NO: 306597 - RNA, 22 nt, Human
aggguggagggagucccugagc

SEQ ID NO: 306598 - RNA, 22 nt, Human
ugaagcugugggcaguggagcc

SEQ ID NO: 306599 - RNA, 22 nt, Human
cucaggaugucggugacuauug

SEQ ID NO: 306600 - RNA, 22 nt, Human
gcagcguggggcugagucagcu

SEQ ID NO: 306601 - RNA, 22 nt, Human
uuuaaauuuagaagaaacacug

SEQ ID NO: 306602 - RNA, 19 nt, Human
ccagguggaacugagguag

SEQ ID NO: 306603 - RNA, 19 nt, Human
gccucugcuggggacaggc

SEQ ID NO: 306604 - RNA, 17 nt, Human
aagacagaagccaugag

SEQ ID NO: 306605 - RNA, 22 nt, Human
gcucucuuuuuccagugguggu

SEQ ID NO: 306606 - RNA, 22 nt, Human
ggcacugaaccaggacacaagc

SEQ ID NO: 306607 - RNA, 22 nt, Human
ggucagggcucuuccaguggcu

SEQ ID NO: 306608 - RNA, 22 nt, Human
ugaggcucaaggucugguggag

SEQ ID NO: 306609 - RNA, 22 nt, Human
auuuccucaugaucauaaugca

SEQ ID NO: 306610 - RNA, 22 nt, Human
uaugugaauacagcaguggaug

SEQ ID NO: 306611 - RNA, 22 nt, Human
auuuccauacacccauuucuga

SEQ ID NO: 306612 - RNA, 22 nt, Human
auguaauaggguaacauaacau

SEQ ID NO: 306613 - RNA, 22 nt, Human
uggcagcagacaaaaggccauu

SEQ ID NO: 306614 - RNA, 22 nt, Human
ccacagagcauuagauuucaga

SEQ ID NO: 306615 - RNA, 22 nt, Human
aagucauugguagcuugauagg

SEQ ID NO: 306616 - RNA, 22 nt, Human
cacccaggcagguggcugagaa

SEQ ID NO: 306617 - RNA, 22 nt, Human
caccaggcugcccaggacaggg

SEQ ID NO: 306618 - RNA, 22 nt, Human
ccuccugggccuugcucuguga

SEQ ID NO: 306619 - RNA, 22 nt, Human
uuccaugaaauguguuaugcuu

SEQ ID NO: 306620 - RNA, 22 nt, Human
uucaaugagcccggggccauag

SEQ ID NO: 306621 - RNA, 22 nt, Human
uagugcuuuaggccugaguguc

SEQ ID NO: 306622 - RNA, 22 nt, Human
ggcagcagggucuagauugaug

SEQ ID NO: 306623 - RNA, 22 nt, Human
cugggguuggccagggcccuag

SEQ ID NO: 306624 - RNA, 22 nt, Human
ggucccaggcucccucuugucc

SEQ ID NO: 306625 - RNA, 22 nt, Human
gguggcagcgucuaucugacau

SEQ ID NO: 306626 - RNA, 17 nt, Human
gcugagugcagggaguc

SEQ ID NO: 306627 - RNA, 22 nt, Human
caguugaugggacucauguggg

SEQ ID NO: 306628 - RNA, 22 nt, Human
acagagcugggugcccccugga

SEQ ID NO: 306629 - RNA, 22 nt, Human
ucaucaaagucaaagaaugacu

SEQ ID NO: 306630 - RNA, 22 nt, Human
cauucauuuaugaaauaucuau

SEQ ID NO: 306631 - RNA, 22 nt, Human
agagcuggcacugacccucacc

SEQ ID NO: 306632 - RNA, 22 nt, Human
gaaacaauuuuuguugucuaag

SEQ ID NO: 306633 - RNA, 22 nt, Human
uggaaagagguagaggaucugg

SEQ ID NO: 306634 - RNA, 22 nt, Human
aagcaauaagccagauuuggau

SEQ ID NO: 306635 - RNA, 20 nt, Human
cccagcccgggccgcgcucg

SEQ ID NO: 306636 - RNA, 22 nt, Human
agccuucacugggaccuuggau

SEQ ID NO: 306637 - RNA, 16 nt, Human
uggaggcaucuggccc

SEQ ID NO: 306638 - RNA, 22 nt, Human
uuuguuugaaagucucuacagc

SEQ ID NO: 306639 - RNA, 19 nt, Human
agggaaggauucugucauu

SEQ ID NO: 306640 - RNA, 23 nt, Human
agucucagcuggaaacauguguc

SEQ ID NO: 306641 - RNA, 22 nt, Human
cuucuuuacuuucuagaaauaa

SEQ ID NO: 306642 - RNA, 22 nt, Human
uggagcaggccggaaguggcuu

SEQ ID NO: 306643 - RNA, 22 nt, Human
ugggagcucagaaagggagguc

SEQ ID NO: 306644 - RNA, 22 nt, Human
auguaguguagagauuagucuc

SEQ ID NO: 306645 - RNA, 22 nt, Human
uggggccuggucagagcugcac

SEQ ID NO: 306646 - RNA, 22 nt, Human
acagauguacacucauauauaa

SEQ ID NO: 306647 - RNA, 22 nt, Human
ggagggugcauuuuacccugug

SEQ ID NO: 306648 - RNA, 22 nt, Human
ggccuggaaugcuuuccuacca

SEQ ID NO: 306649 - RNA, 22 nt, Human
uacagugugacauuucuacaaa

SEQ ID NO: 306650 - RNA, 22 nt, Human
uuagaaaggagcuuauuucuuu

SEQ ID NO: 306651 - RNA, 22 nt, Human
auucuucacuguuucagaauga

SEQ ID NO: 306652 - RNA, 22 nt, Human
uuugaaagggaaauaaacuccu

SEQ ID NO: 306653 - RNA, 22 nt, Human
acagaugaauuuauggauggaa

SEQ ID NO: 306654 - RNA, 22 nt, Human
uauuuauaaucugccaaagaga

SEQ ID NO: 306655 - RNA, 22 nt, Human
guacucucuugaaggccuuucu

SEQ ID NO: 306656 - RNA, 22 nt, Human
ccccagccuuccaugggaauug

SEQ ID NO: 306657 - RNA, 22 nt, Human
ugggccuggguuccuccugggc

SEQ ID NO: 306658 - RNA, 22 nt, Human
ucaggauguccaaaauccagcc

SEQ ID NO: 306659 - RNA, 22 nt, Human
ggaggccaaggagggcggauca

SEQ ID NO: 306660 - RNA, 22 nt, Human
aggucauuccuugucuucuugc

SEQ ID NO: 306661 - RNA, 22 nt, Human
uuuuuccuagugcuuucuggua

SEQ ID NO: 306662 - RNA, 22 nt, Human
uuuccuugcacauugguuucca

SEQ ID NO: 306663 - RNA, 22 nt, Human
gaaaaugugccuuuggguauug

SEQ ID NO: 306664 - RNA, 22 nt, Human
uucugucacuuaggaggucaua

SEQ ID NO: 306665 - RNA, 22 nt, Human
cagaaagaccugggcucaagag

SEQ ID NO: 306666 - RNA, 22 nt, Human
gcuccaggagagggaagcagau

SEQ ID NO: 306667 - RNA, 22 nt, Human
gcuggcagagacaagaagacua

SEQ ID NO: 306668 - RNA, 18 nt, Human
uccagucccagcucugcc

SEQ ID NO: 306669 - RNA, 20 nt, Human
cugagcgucuaagaggugag

SEQ ID NO: 306670 - RNA, 22 nt, Human
uauugaauuagacccuaaaaug

SEQ ID NO: 306671 - RNA, 22 nt, Human
auaucaguaucuauguauuugu

SEQ ID NO: 306672 - RNA, 22 nt, Human
gcaggagccacuucagggaugc

SEQ ID NO: 306673 - RNA, 23 nt, Human
acuuaaaugguucuuuaucucag

SEQ ID NO: 306674 - RNA, 22 nt, Human
gggguggauuccuacaggucca

SEQ ID NO: 306675 - RNA, 22 nt, Human
uauuugcaacauaaaacucuga

SEQ ID NO: 306676 - RNA, 22 nt, Human
cuucugugcuucacaguugcca

SEQ ID NO: 306677 - RNA, 22 nt, Human
ugggccuggaguuuguccagag

SEQ ID NO: 306678 - RNA, 22 nt, Human
ccagcucugcagggccuggggu

SEQ ID NO: 306679 - RNA, 22 nt, Human
aaaggccaccaacaugaagcau

SEQ ID NO: 306680 - RNA, 21 nt, Human
aaugcauuaacauaaagcuga

SEQ ID NO: 306681 - RNA, 22 nt, Human
ggcugugccucaaggcuacuca

SEQ ID NO: 306682 - RNA, 22 nt, Human
acagagaugcaaguguguauuu

SEQ ID NO: 306683 - RNA, 21 nt, Human
ugcuccuuagcugccccugcc

SEQ ID NO: 306684 - RNA, 22 nt, Human
agaaauguuguggguuuuguua

SEQ ID NO: 306685 - RNA, 22 nt, Human
agaaaucaauaucuauauguug

SEQ ID NO: 306686 - RNA, 22 nt, Human
gagcagcuaaaauucucaugca

SEQ ID NO: 306687 - RNA, 22 nt, Human
caggcagccugcggucugcaca

SEQ ID NO: 306688 - RNA, 22 nt, Human
cuggggugugcucagagcaggg

SEQ ID NO: 306689 - RNA, 22 nt, Human
ucccagaggucucugcugguuc

SEQ ID NO: 306690 - RNA, 22 nt, Human
cagcagcugauggggaagugau

SEQ ID NO: 306691 - RNA, 22 nt, Human
ucccugaggaagggguguggug

SEQ ID NO: 306692 - RNA, 22 nt, Human
cuggugugauugagcccaggug

SEQ ID NO: 306693 - RNA, 22 nt, Human
cccacucccugcacgccugccg

SEQ ID NO: 306694 - RNA, 22 nt, Human
gagcaggcucugccuguguguc

SEQ ID NO: 306695 - RNA, 22 nt, Human
uguaugcaccauuguauuaccu

SEQ ID NO: 306696 - RNA, 22 nt, Human
cacuggcaugugaggcgguggc

SEQ ID NO: 306697 - RNA, 20 nt, Human
agcuccugguauaggugccu

SEQ ID NO: 306698 - RNA, 22 nt, Human
auacauuagaaucugguacuca

SEQ ID NO: 306699 - RNA, 22 nt, Human
caggguggggaaauagcgcccu

SEQ ID NO: 306700 - RNA, 22 nt, Human
acaggcugacuuccugccaugu

SEQ ID NO: 306701 - RNA, 22 nt, Human
ccugagggcgccgagcucccag

SEQ ID NO: 306702 - RNA, 22 nt, Human
ccagagcugauuccugggacuu

SEQ ID NO: 306703 - RNA, 22 nt, Human
aguguucauuuauucauucacu

SEQ ID NO: 306704 - RNA, 19 nt, Human
uguguguuuauauauguau

SEQ ID NO: 306705 - RNA, 22 nt, Human
acagugucaugucguguucccc

SEQ ID NO: 306706 - RNA, 21 nt, Human
ucacuuauaauguauuugcug

SEQ ID NO: 306707 - RNA, 22 nt, Human
uucuucuccgaggagggcuggu

SEQ ID NO: 306708 - RNA, 22 nt, Human
aaggccaggacaccaggggacu

SEQ ID NO: 306709 - RNA, 22 nt, Human
acuguucauuuguccuguaucu

SEQ ID NO: 306710 - RNA, 18 nt, Human
cagaugagaugcaaucuc

SEQ ID NO: 306711 - RNA, 22 nt, Human
cagcccagccgagggccuggcu

SEQ ID NO: 306712 - RNA, 22 nt, Human
cagcugccccauaaaucacagu

SEQ ID NO: 306713 - RNA, 22 nt, Human
cauuuccacuucugaaaacugg

SEQ ID NO: 306714 - RNA, 22 nt, Human
uaagaacaguguuucaucucua

SEQ ID NO: 306715 - RNA, 22 nt, Human
ccucaggggugcccacagcugc

SEQ ID NO: 306716 - RNA, 22 nt, Human
uucuuuggggaauauucugguu

SEQ ID NO: 306717 - RNA, 22 nt, Human
ucucagugacugcugggucccc

SEQ ID NO: 306718 - RNA, 22 nt, Human
uaugcacacaucgcagcaggaa

SEQ ID NO: 306719 - RNA, 22 nt, Human
uuuuucaugagacuagaaguca

SEQ ID NO: 306720 - RNA, 22 nt, Human
guuugcauauuugcacaggaau

SEQ ID NO: 306721 - RNA, 22 nt, Human
ugucugugaccucuuaggcaag

SEQ ID NO: 306722 - RNA, 22 nt, Human
ugauugaagaggugaggaaguu

SEQ ID NO: 306723 - RNA, 22 nt, Human
cucaguuucuucauauuguagg

SEQ ID NO: 306724 - RNA, 18 nt, Human
cuuuaugugcagagcuuu

SEQ ID NO: 306725 - RNA, 22 nt, Human
ucuucucuccugcuuggcagaa

SEQ ID NO: 306726 - RNA, 21 nt, Human
uucuucaugaugauuaauggc

SEQ ID NO: 306727 - RNA, 22 nt, Human
ccugcugugaccggggagcagg

SEQ ID NO: 306728 - RNA, 22 nt, Human
aaugcacaugucuuggccucac

SEQ ID NO: 306729 - RNA, 22 nt, Human
cucaggccauucuuccagcugc

SEQ ID NO: 306730 - RNA, 22 nt, Human
cagccagcugucccaagugccu

SEQ ID NO: 306731 - RNA, 22 nt, Human
cacccaggcuggagugcagggg

SEQ ID NO: 306732 - RNA, 22 nt, Human
cacugugucaguuugguuagac

SEQ ID NO: 306733 - RNA, 22 nt, Human
agacagcaggggagucugguuu

SEQ ID NO: 306734 - RNA, 22 nt, Human
uccagggccaagucauggaacc

SEQ ID NO: 306735 - RNA, 22 nt, Human
gugcagagaaaugagaagucga

SEQ ID NO: 306736 - RNA, 22 nt, Human
uaaucuguauuccuacuuugca

SEQ ID NO: 306737 - RNA, 17 nt, Human
ccucccacaccgcccug

SEQ ID NO: 306738 - RNA, 22 nt, Human
aacuagaaaacaagaugcugau

SEQ ID NO: 306739 - RNA, 22 nt, Human
auguuauuaaaguacagauucu

SEQ ID NO: 306740 - RNA, 22 nt, Human
gagaaggggugauguggguaau

SEQ ID NO: 306741 - RNA, 22 nt, Human
aacagcagggggaccugcuggu

SEQ ID NO: 306742 - RNA, 22 nt, Human
augauacaagcaaaacuaauca

SEQ ID NO: 306743 - RNA, 22 nt, Human
caggagcucuuaaggaugugau

SEQ ID NO: 306744 - RNA, 22 nt, Human
uugucuuaaauggauggacaau

SEQ ID NO: 306745 - RNA, 22 nt, Human
aguaugaagcugaaugauuuua

SEQ ID NO: 306746 - RNA, 22 nt, Human
cuggagagauccuccugaaaaa

SEQ ID NO: 306747 - RNA, 22 nt, Human
auucagcauaaucaguagcuug

SEQ ID NO: 306748 - RNA, 22 nt, Human
ucagggcaggcgagcagcugcu

SEQ ID NO: 306749 - RNA, 20 nt, Human
gcagcugcccccagucccug

SEQ ID NO: 306750 - RNA, 22 nt, Human
uggcacugaccccaggccugug

SEQ ID NO: 306751 - RNA, 20 nt, Human
uucauucauuccacaacuuc

SEQ ID NO: 306752 - RNA, 22 nt, Human
augcuguguccuagugaaagaa

SEQ ID NO: 306753 - RNA, 20 nt, Human
gaagcagcuucauguagaca

SEQ ID NO: 306754 - RNA, 20 nt, Human
aggaaaaauggaaacuggag

SEQ ID NO: 306755 - RNA, 22 nt, Human
cuggggugagcagaaacagggg

SEQ ID NO: 306756 - RNA, 22 nt, Human
uugcucugacuggagugcagug

SEQ ID NO: 306757 - RNA, 22 nt, Human
auugacaagacaauggcucuua

SEQ ID NO: 306758 - RNA, 22 nt, Human
cagcuucugcuaucgaacaucu

SEQ ID NO: 306759 - RNA, 22 nt, Human
ccuggcaggcuggggacagugc

SEQ ID NO: 306760 - RNA, 22 nt, Human
ccagagacgucggucagggcgc

SEQ ID NO: 306761 - RNA, 22 nt, Human
aauaauuuugagagccuggaaa

SEQ ID NO: 306762 - RNA, 22 nt, Human
agggcuggcuccguuaccuuga

SEQ ID NO: 306763 - RNA, 18 nt, Human
cagggcuguggggucacu

SEQ ID NO: 306764 - RNA, 22 nt, Human
aagcuuccugaaugcucauuua

SEQ ID NO: 306765 - RNA, 23 nt, Human
uuucaaauuacucugcagaugac

SEQ ID NO: 306766 - RNA, 22 nt, Human
gcuggcuccucuguccucacgg

SEQ ID NO: 306767 - RNA, 22 nt, Human
ggccaggaagggaagaucagca

SEQ ID NO: 306768 - RNA, 22 nt, Human
gaccaggcuuccccagaccuca

SEQ ID NO: 306769 - RNA, 22 nt, Human
cugucaucacaguugagcagcc

SEQ ID NO: 306770 - RNA, 22 nt, Human
cauuuuaaaugauuuaagccaa

SEQ ID NO: 306771 - RNA, 18 nt, Human
gccugggaggaggaaaug

SEQ ID NO: 306772 - RNA, 22 nt, Human
cucuucucugcagccuuugaag

SEQ ID NO: 306773 - RNA, 22 nt, Human
ggagauaauccagggagggacu

SEQ ID NO: 306774 - RNA, 22 nt, Human
ugggagcugggguuggacgucu

SEQ ID NO: 306775 - RNA, 22 nt, Human
auuccuuggcauucuggacuug

SEQ ID NO: 306776 - RNA, 22 nt, Human
gugggccucuugaggguggcua

SEQ ID NO: 306777 - RNA, 22 nt, Human
ucccuggcugggggcugccuug

SEQ ID NO: 306778 - RNA, 22 nt, Human
cauacauugcucauucaguauc

SEQ ID NO: 306779 - RNA, 18 nt, Human
agcuggggccucuggucc

SEQ ID NO: 306780 - RNA, 22 nt, Human
ucuguagcaagugagaggcauu

SEQ ID NO: 306781 - RNA, 22 nt, Human
augagacuaccuguaauguggc

SEQ ID NO: 306782 - RNA, 22 nt, Human
uucaggauuauacucucuuccc

SEQ ID NO: 306783 - RNA, 22 nt, Human
ccaggauggggagcagauagaa

SEQ ID NO: 306784 - RNA, 22 nt, Human
acaguguuguauuuaguuugau

SEQ ID NO: 306785 - RNA, 22 nt, Human
gcugccugaucauacaccaggg

SEQ ID NO: 306786 - RNA, 22 nt, Human
cccucccaagcacucugacaua

SEQ ID NO: 306787 - RNA, 20 nt, Human
ggaggguggaagaaagcaag

SEQ ID NO: 306788 - RNA, 22 nt, Human
guguuuccaguucagaaagcaa

SEQ ID NO: 306789 - RNA, 22 nt, Human
ucaguggauauuucuguggcug

SEQ ID NO: 306790 - RNA, 19 nt, Human
ggugaccaccuggucagug

SEQ ID NO: 306791 - RNA, 22 nt, Human
ccucuucugcuucaggagcacu

SEQ ID NO: 306792 - RNA, 22 nt, Human
ugcugccaaaugcgagcucugu

SEQ ID NO: 306793 - RNA, 22 nt, Human
uaugauaugcacuuuaucagaa

SEQ ID NO: 306794 - RNA, 22 nt, Human
ugaaggaauggaggaucagagc

SEQ ID NO: 306795 - RNA, 22 nt, Human
cugucucagcaggaagucauca

SEQ ID NO: 306796 - RNA, 22 nt, Human
cccaagaucuuucgugcacuaa

SEQ ID NO: 306797 - RNA, 22 nt, Human
cagagcaguccuugucaaucag

SEQ ID NO: 306798 - RNA, 22 nt, Human
aggcacugaaagguggccagag

SEQ ID NO: 306799 - RNA, 22 nt, Human
uucuaugccauguucagcuacu

SEQ ID NO: 306800 - RNA, 22 nt, Human
ggcaugggccgaggugccuccu

SEQ ID NO: 306801 - RNA, 22 nt, Human
gcagagcugggucuguauccaa

SEQ ID NO: 306802 - RNA, 22 nt, Human
acacugcucacuucuucccuug

SEQ ID NO: 306803 - RNA, 22 nt, Human
ccagcugcuugggaaaaugucu

SEQ ID NO: 306804 - RNA, 22 nt, Human
uagaaaucagcaggcauaugua

SEQ ID NO: 306805 - RNA, 22 nt, Human
cagcauuuaucuuguagcagga

SEQ ID NO: 306806 - RNA, 22 nt, Human
uuucaguguaagguuuccagga

SEQ ID NO: 306807 - RNA, 22 nt, Human
cuuugaaagcucccaggacuua

SEQ ID NO: 306808 - RNA, 22 nt, Human
uuugcauugcagugguuuacag

SEQ ID NO: 306809 - RNA, 22 nt, Human
uuuauucaucaucuguucauau

SEQ ID NO: 306810 - RNA, 22 nt, Human
agcuaccuggcuuaucacuguc

SEQ ID NO: 306811 - RNA, 20 nt, Human
uuugagaccagucugcccaa

SEQ ID NO: 306812 - RNA, 22 nt, Human
aagaauguucauuaaacuguug

SEQ ID NO: 306813 - RNA, 22 nt, Human
gcccugcugucuucagaguaua

SEQ ID NO: 306814 - RNA, 22 nt, Human
ugccaggaggaggugggacaga

SEQ ID NO: 306815 - RNA, 22 nt, Human
uucuucaauuuuccauauacug

SEQ ID NO: 306816 - RNA, 22 nt, Human
gaagccccaaacccucgccauc

SEQ ID NO: 306817 - RNA, 22 nt, Human
gucagaggggcagcugccaggc

SEQ ID NO: 306818 - RNA, 22 nt, Human
gggacugggagauccuccuggc

SEQ ID NO: 306819 - RNA, 22 nt, Human
cccaggcuggauuucgguggca

SEQ ID NO: 306820 - RNA, 22 nt, Human
uugauacauuuuuaggauaaac

SEQ ID NO: 306821 - RNA, 22 nt, Human
uaagaacauaaauucauacggg

SEQ ID NO: 306822 - RNA, 22 nt, Human
cccagcuccuuacagggccgaa

SEQ ID NO: 306823 - RNA, 22 nt, Human
auaacagaguugggaagugaaa

SEQ ID NO: 306824 - RNA, 22 nt, Human
ggaggccaaggcaggcggauca

SEQ ID NO: 306825 - RNA, 22 nt, Human
agggccugacacccuugccagc

SEQ ID NO: 306826 - RNA, 22 nt, Human
auggagggugucagagagcgaa

SEQ ID NO: 306827 - RNA, 22 nt, Human
uugaaaguccuucuugaguuac

SEQ ID NO: 306828 - RNA, 22 nt, Human
gccugagaaggauaggaagcga

SEQ ID NO: 306829 - RNA, 22 nt, Human
aucugccugagucuagguuuuc

SEQ ID NO: 306830 - RNA, 22 nt, Human
uaauuuacuugcaaauaacaau

SEQ ID NO: 306831 - RNA, 22 nt, Human
aacuagaacgucuaguugcugg

SEQ ID NO: 306832 - RNA, 22 nt, Human
auuaguguacaucucacacgca

SEQ ID NO: 306833 - RNA, 22 nt, Human
cugccuggucucaggcaugggg

SEQ ID NO: 306834 - RNA, 19 nt, Human
gaagaagcuugagaaguag

SEQ ID NO: 306835 - RNA, 22 nt, Human
ucagcugcucuguugagcugaa

SEQ ID NO: 306836 - RNA, 22 nt, Human
ugggcagagaucuggaucaaac

SEQ ID NO: 306837 - RNA, 22 nt, Human
aggcacagagaaugcccuccau

SEQ ID NO: 306838 - RNA, 22 nt, Human
uggcagggaauacagauguuua

SEQ ID NO: 306839 - RNA, 22 nt, Human
ucucuggagcugcagauccagg

SEQ ID NO: 306840 - RNA, 22 nt, Human
agccccaguaagggagggccug

SEQ ID NO: 306841 - RNA, 19 nt, Human
uggcagaggcaguuuguac

SEQ ID NO: 306842 - RNA, 22 nt, Human
ggauccuuaacuaucacaguga

SEQ ID NO: 306843 - RNA, 22 nt, Human
auaacagagagcuacugaacug

SEQ ID NO: 306844 - RNA, 22 nt, Human
uaacacugguauuucauuuagu

SEQ ID NO: 306845 - RNA, 17 nt, Human
aucuggcugcuucuaga

SEQ ID NO: 306846 - RNA, 22 nt, Human
caugcacuuaccugaaauucaa

SEQ ID NO: 306847 - RNA, 22 nt, Human
ucuuaacaagcuccucagugcu

SEQ ID NO: 306848 - RNA, 22 nt, Human
ugaaggagcucaaugaugaugc

SEQ ID NO: 306849 - RNA, 22 nt, Human
ucagaggucccuagcaggagug

SEQ ID NO: 306850 - RNA, 22 nt, Human
uauuucuguaugcauaaaagga

SEQ ID NO: 306851 - RNA, 22 nt, Human
ugcugcuuugauguguaaauca

SEQ ID NO: 306852 - RNA, 21 nt, Human
cagagguggccugaccucuga

SEQ ID NO: 306853 - RNA, 22 nt, Human
ccagggugggaggcugaaggcg

SEQ ID NO: 306854 - RNA, 22 nt, Human
uaagaauuguguugaauagagu

SEQ ID NO: 306855 - RNA, 22 nt, Human
cucugagggucuaaggagucac

SEQ ID NO: 306856 - RNA, 22 nt, Human
auaugagagaggaaagauuuua

SEQ ID NO: 306857 - RNA, 22 nt, Human
ccuuggcccuagccucaggcaa

SEQ ID NO: 306858 - RNA, 22 nt, Human
ucuugggauugcccugcaguuc

SEQ ID NO: 306859 - RNA, 22 nt, Human
gggcugcuuauacugaugauaa

SEQ ID NO: 306860 - RNA, 22 nt, Human
gacagggcgagacucagucuca

SEQ ID NO: 306861 - RNA, 22 nt, Human
cagcucugaagaaaggugucua

SEQ ID NO: 306862 - RNA, 22 nt, Human
auguuacauaguccuuauuugu

SEQ ID NO: 306863 - RNA, 22 nt, Human
cagaugagaguggccaggguuc

SEQ ID NO: 306864 - RNA, 22 nt, Human
ccucuggucccagcucugcugc

SEQ ID NO: 306865 - RNA, 22 nt, Human
ugugucccuuggaaccucagcu

SEQ ID NO: 306866 - RNA, 21 nt, Human
uugaccaagggugcgugcucc

SEQ ID NO: 306867 - RNA, 22 nt, Human
cuggagccccagacagggagag

SEQ ID NO: 306868 - RNA, 18 nt, Human
cagaaaucacaccagcac

SEQ ID NO: 306869 - RNA, 22 nt, Human
uggguggcacuucuggggucca

SEQ ID NO: 306870 - RNA, 22 nt, Human
ccugccugcggcccgcggggag

SEQ ID NO: 306871 - RNA, 22 nt, Human
cugcaagauuggaagaugcaau

SEQ ID NO: 306872 - RNA, 22 nt, Human
caggauccccaggucgccgucc

SEQ ID NO: 306873 - RNA, 22 nt, Human
guggcugguuuccugcaugcaa

SEQ ID NO: 306874 - RNA, 20 nt, Human
uaugaguauuacuuucagga

SEQ ID NO: 306875 - RNA, 22 nt, Human
gagcucauucauucauugccug

SEQ ID NO: 306876 - RNA, 22 nt, Human
uugugcauuucucugagugugu

SEQ ID NO: 306877 - RNA, 16 nt, Human
uguuagcugugcauua

SEQ ID NO: 306878 - RNA, 17 nt, Human
acacagccagguucucc

SEQ ID NO: 306879 - RNA, 22 nt, Human
ugggcagacauugaguuuguuc

SEQ ID NO: 306880 - RNA, 22 nt, Human
cagcugccuaugaccuagccuc

SEQ ID NO: 306881 - RNA, 22 nt, Human
ugaaggcccagccacagaaugg

SEQ ID NO: 306882 - RNA, 22 nt, Human
ugagcccaggaguuggagaccg

SEQ ID NO: 306883 - RNA, 22 nt, Human
gguggccucugcaggccucgac

SEQ ID NO: 306884 - RNA, 22 nt, Human
gcagccacuuugcaaccaagag

SEQ ID NO: 306885 - RNA, 22 nt, Human
uugaaaguuaucuagauucuga

SEQ ID NO: 306886 - RNA, 17 nt, Human
agaggcagauacuugga

SEQ ID NO: 306887 - RNA, 22 nt, Human
cugggcucaguggcucauggcu

SEQ ID NO: 306888 - RNA, 22 nt, Human
cugcauuagucaugcuuugcag

SEQ ID NO: 306889 - RNA, 22 nt, Human
uaugacauuggccaaguucugu

SEQ ID NO: 306890 - RNA, 22 nt, Human
acaauguuuuuguucaaagagu

SEQ ID NO: 306891 - RNA, 22 nt, Human
gcuggccacauugugccguccu

SEQ ID NO: 306892 - RNA, 22 nt, Human
cugggguggugcaggccucaug

SEQ ID NO: 306893 - RNA, 22 nt, Human
cagagacauuaagugccaugau

SEQ ID NO: 306894 - RNA, 21 nt, Human
ugauccuuucccccauguugc

SEQ ID NO: 306895 - RNA, 22 nt, Human
uacaaagucaccagcuucuugc

SEQ ID NO: 306896 - RNA, 19 nt, Human
ggcucucccuugagagagc

SEQ ID NO: 306897 - RNA, 22 nt, Human
uuaacacaucccugcucuaccc

SEQ ID NO: 306898 - RNA, 22 nt, Human
ucuuaaagagcgcaauuugagg

SEQ ID NO: 306899 - RNA, 22 nt, Human
gagagcuguccggcugagcagc

SEQ ID NO: 306900 - RNA, 22 nt, Human
ccuguggcugccacuuggguga

SEQ ID NO: 306901 - RNA, 22 nt, Human
ccugaggcccuggcugugcuga

SEQ ID NO: 306902 - RNA, 22 nt, Human
ugcagccaauucauucauucuu

SEQ ID NO: 306903 - RNA, 22 nt, Human
agcugagcuaguaguuccagug

SEQ ID NO: 306904 - RNA, 22 nt, Human
uauuucagggagaauaaauuug

SEQ ID NO: 306905 - RNA, 22 nt, Human
ucucagagcuucagaaagcacc

SEQ ID NO: 306906 - RNA, 22 nt, Human
accucuggccuucaggcaucau

SEQ ID NO: 306907 - RNA, 22 nt, Human
uuccucagaaaauacuguccaa

SEQ ID NO: 306908 - RNA, 22 nt, Human
aucuggcugcugugcuuaagcu

SEQ ID NO: 306909 - RNA, 22 nt, Human
auuugcuuuaagguauaaaagg

SEQ ID NO: 306910 - RNA, 22 nt, Human
acagcagcuaaccccugggcca

SEQ ID NO: 306911 - RNA, 22 nt, Human
aggcucugugacaaucaagcug

SEQ ID NO: 306912 - RNA, 22 nt, Human
ucccacugugaauccaaggccu

SEQ ID NO: 306913 - RNA, 22 nt, Human
ucucaccauggugcuugcuuau

SEQ ID NO: 306914 - RNA, 22 nt, Human
uuccuugaccacugcauaauga

SEQ ID NO: 306915 - RNA, 22 nt, Human
cagcugccagcuucucuccauc

SEQ ID NO: 306916 - RNA, 22 nt, Human
aggcagaauguuggaaaggaag

SEQ ID NO: 306917 - RNA, 22 nt, Human
uaugagaaagucguaugucucc

SEQ ID NO: 306918 - RNA, 22 nt, Human
ccugccucaucaacuugucgug

SEQ ID NO: 306919 - RNA, 22 nt, Human
ugcuagaaaucugaaacuagca

SEQ ID NO: 306920 - RNA, 22 nt, Human
cagcuugcaguacuuguuuuug

SEQ ID NO: 306921 - RNA, 22 nt, Human
aaacagcaggaacaucuugcca

SEQ ID NO: 306922 - RNA, 22 nt, Human
ugggccugauucuugaauccug

SEQ ID NO: 306923 - RNA, 22 nt, Human
cagcacuggggggauucggagc

SEQ ID NO: 306924 - RNA, 22 nt, Human
aaauauguaagauuagcacuag

SEQ ID NO: 306925 - RNA, 23 nt, Human
aggugcagcccuggaccugcccc

SEQ ID NO: 306926 - RNA, 22 nt, Human
cucagggacguuagaggacagg

SEQ ID NO: 306927 - RNA, 22 nt, Human
gcugcaggcauuuuccugggca

SEQ ID NO: 306928 - RNA, 22 nt, Human
ccaugagcuuccuauauagggu

SEQ ID NO: 306929 - RNA, 22 nt, Human
guggccuggcgagcuggcgcgg

SEQ ID NO: 306930 - RNA, 22 nt, Human
gugauuccuauuaguacaugca

SEQ ID NO: 306931 - RNA, 22 nt, Human
ugcagccaggaaauauuugcug

SEQ ID NO: 306932 - RNA, 22 nt, Human
aaucuggcauuugagaguagga

SEQ ID NO: 306933 - RNA, 22 nt, Human
uaaaauguuugcaagagaccag

SEQ ID NO: 306934 - RNA, 22 nt, Human
uuugaaagcaggugugggaggg

SEQ ID NO: 306935 - RNA, 22 nt, Human
aaacagaaggguagguaaacau

SEQ ID NO: 306936 - RNA, 22 nt, Human
caaaaguucucacccagacaug

SEQ ID NO: 306937 - RNA, 22 nt, Human
aggguccaucaaggacugcaca

SEQ ID NO: 306938 - RNA, 22 nt, Human
cucagaagaacaaaggcucuac

SEQ ID NO: 306939 - RNA, 22 nt, Human
ugccugggaaccaauccuggcu

SEQ ID NO: 306940 - RNA, 22 nt, Human
gaugcugaagugaagugaucuu

SEQ ID NO: 306941 - RNA, 22 nt, Human
aagucacagcuaaauagcuaag

SEQ ID NO: 306942 - RNA, 22 nt, Human
ucuuccagcaaugugaaaucac

SEQ ID NO: 306943 - RNA, 22 nt, Human
cuuccagagauagggccucaag

SEQ ID NO: 306944 - RNA, 21 nt, Human
uggcugcuggcccucucucca

SEQ ID NO: 306945 - RNA, 22 nt, Human
auuguuaugaaaauaagauguu

SEQ ID NO: 306946 - RNA, 22 nt, Human
acauuucuugaugccucuguga

SEQ ID NO: 306947 - RNA, 22 nt, Human
ccauaagguugaaaacuguaca

SEQ ID NO: 306948 - RNA, 22 nt, Human
caggggcuagcacuuaauguuu

SEQ ID NO: 306949 - RNA, 20 nt, Human
agcuggccuguccuaggccu

SEQ ID NO: 306950 - RNA, 22 nt, Human
cucuggagguggagguugcagu

SEQ ID NO: 306951 - RNA, 22 nt, Human
aggagcuguuuuguucagcaaa

SEQ ID NO: 306952 - RNA, 22 nt, Human
aucugucaggagcaaggacuac

SEQ ID NO: 306953 - RNA, 22 nt, Human
caagauggaguccgggaaugug

SEQ ID NO: 306954 - RNA, 21 nt, Human
ccuggcagaagccugauaugc

SEQ ID NO: 306955 - RNA, 20 nt, Human
cccucugcuacacugggagc

SEQ ID NO: 306956 - RNA, 22 nt, Human
cugucaccuguucacugcagca

SEQ ID NO: 306957 - RNA, 18 nt, Human
caaagcucacguuccauc

SEQ ID NO: 306958 - RNA, 22 nt, Human
gccuggcaggggccugggagug

SEQ ID NO: 306959 - RNA, 22 nt, Human
aggggagcuaacaccagagccc

SEQ ID NO: 306960 - RNA, 22 nt, Human
ggagggcugccagguggagcgg

SEQ ID NO: 306961 - RNA, 22 nt, Human
cuguaugaggaucagacuggac

SEQ ID NO: 306962 - RNA, 20 nt, Human
acccagcucugugcccuggg

SEQ ID NO: 306963 - RNA, 22 nt, Human
acuggcucagaguuccuagaga

SEQ ID NO: 306964 - RNA, 22 nt, Human
ucucagucagccuugauguccc

SEQ ID NO: 306965 - RNA, 22 nt, Human
agucugucuacuuaaagucugu

SEQ ID NO: 306966 - RNA, 22 nt, Human
acagcagcauaaacugacuaag

SEQ ID NO: 306967 - RNA, 22 nt, Human
cagcuugggaguuugguuuuau

SEQ ID NO: 306968 - RNA, 22 nt, Human
ugccucugcugcuguggcauca

SEQ ID NO: 306969 - RNA, 21 nt, Human
ucuugaaaauuguagcaguuu

SEQ ID NO: 306970 - RNA, 22 nt, Human
cugacuguaauucuguucuuaa

SEQ ID NO: 306971 - RNA, 22 nt, Human
acaugcuuucuagguccuucug

SEQ ID NO: 306972 - RNA, 22 nt, Human
aucuacccacugaacacaauau

SEQ ID NO: 306973 - RNA, 22 nt, Human
uagggcagccuuauagcuccca

SEQ ID NO: 306974 - RNA, 22 nt, Human
ugggcuggcugaggcauucacu

SEQ ID NO: 306975 - RNA, 22 nt, Human
uacauuaucuuguuaucuuuca

SEQ ID NO: 306976 - RNA, 22 nt, Human
gggcugugugcccacuucccau

SEQ ID NO: 306977 - RNA, 22 nt, Human
gaaaccucuuagccucucuuug

SEQ ID NO: 306978 - RNA, 22 nt, Human
cagaggccuauccaguguccau

SEQ ID NO: 306979 - RNA, 22 nt, Human
acaaagucaaauugcagccgcc

SEQ ID NO: 306980 - RNA, 22 nt, Human
aaugccaguguguugauuccag

SEQ ID NO: 306981 - RNA, 22 nt, Human
ccagagcaauucucacagaacu

SEQ ID NO: 306982 - RNA, 22 nt, Human
ugggggugcugagaagacagga

SEQ ID NO: 306983 - RNA, 22 nt, Human
augccuguaaucccagugcuuu

SEQ ID NO: 306984 - RNA, 22 nt, Human
ugcauugcaguuaacucaguau

SEQ ID NO: 306985 - RNA, 22 nt, Human
ugccugcugcuaagcucuuugu

SEQ ID NO: 306986 - RNA, 22 nt, Human
gcagagaaaguuuuguccucag

SEQ ID NO: 306987 - RNA, 22 nt, Human
ugggccuggcccuguggaggag

SEQ ID NO: 306988 - RNA, 22 nt, Human
caugucuggguauaugcauaug

SEQ ID NO: 306989 - RNA, 22 nt, Human
agaacagcagcacgucaagcug

SEQ ID NO: 306990 - RNA, 20 nt, Human
uggcaucucucaauuguagg

SEQ ID NO: 306991 - RNA, 22 nt, Human
aagauuuagggccaguuuacau

SEQ ID NO: 306992 - RNA, 22 nt, Human
uaauaucuggcauucaaacaug

SEQ ID NO: 306993 - RNA, 22 nt, Human
uuccucaucugugcaccucacu

SEQ ID NO: 306994 - RNA, 22 nt, Human
auaauuuaauuuucacaguggu

SEQ ID NO: 306995 - RNA, 22 nt, Human
augcugggaaguccuaaccaca

SEQ ID NO: 306996 - RNA, 22 nt, Human
agggaucaaaaaauguacaugc

SEQ ID NO: 306997 - RNA, 22 nt, Human
uccagccaagggagguuacuag

SEQ ID NO: 306998 - RNA, 22 nt, Human
ggcucagagaccugcgaucuga

SEQ ID NO: 306999 - RNA, 22 nt, Human
cagagccuuccuagcagacucu

SEQ ID NO: 307000 - RNA, 22 nt, Human
ggccacuccgcugcuacuggaa

SEQ ID NO: 307001 - RNA, 22 nt, Human
ugcagcuguaacagaggccuca

SEQ ID NO: 307002 - RNA, 22 nt, Human
agcaguggaccucagugcuauu

SEQ ID NO: 307003 - RNA, 22 nt, Human
agauaugacuagaagcucauuu

SEQ ID NO: 307004 - RNA, 20 nt, Human
aagcaauauagugcaaaugu

SEQ ID NO: 307005 - RNA, 22 nt, Human
cuggccuuggaagggagcccgu

SEQ ID NO: 307006 - RNA, 22 nt, Human
uggcuccuucauucuccugcca

SEQ ID NO: 307007 - RNA, 22 nt, Human
aacaacugaaaagcuuuuucug

SEQ ID NO: 307008 - RNA, 20 nt, Human
uagauuucauacuucucuuu

SEQ ID NO: 307009 - RNA, 22 nt, Human
ucccagccuuccagucugguuu

SEQ ID NO: 307010 - RNA, 22 nt, Human
ggcugggcugcugggucagagc

SEQ ID NO: 307011 - RNA, 22 nt, Human
auucuuaauugccaugcuguau

SEQ ID NO: 307012 - RNA, 23 nt, Human
gugcugugagccccuuggccucc

SEQ ID NO: 307013 - RNA, 22 nt, Human
agggcucugagugggaaagagg

SEQ ID NO: 307014 - RNA, 22 nt, Human
ccagugcacagccaggcaggug

SEQ ID NO: 307015 - RNA, 22 nt, Human
ugacagaacagguugggagcaa

SEQ ID NO: 307016 - RNA, 22 nt, Human
uggucaggcugcucugcggcgu

SEQ ID NO: 307017 - RNA, 22 nt, Human
caguucuuaauaccaugugguu

SEQ ID NO: 307018 - RNA, 22 nt, Human
cugggugguuuugaugugaauu

SEQ ID NO: 307019 - RNA, 22 nt, Human
cuggccugagcacagcggcugc

SEQ ID NO: 307020 - RNA, 22 nt, Human
acaaaguccugguguauggcca

SEQ ID NO: 307021 - RNA, 22 nt, Human
agagccagccuucucagcuuac

SEQ ID NO: 307022 - RNA, 22 nt, Human
gcauguguuauuuuauguauga

SEQ ID NO: 307023 - RNA, 22 nt, Human
uucauauauaugcacuacguac

SEQ ID NO: 307024 - RNA, 22 nt, Human
ucucucuucaacccuuaacuag

SEQ ID NO: 307025 - RNA, 21 nt, Human
ugcugccaucaugcagagaug

SEQ ID NO: 307026 - RNA, 21 nt, Human
uguaaguuucaucugaauugg

SEQ ID NO: 307027 - RNA, 22 nt, Human
gugguaaucggauucuuaccgg

SEQ ID NO: 307028 - RNA, 22 nt, Human
agucuucucauuucacaugcuu

SEQ ID NO: 307029 - RNA, 22 nt, Human
uaugacauuauaaaggauuauu

SEQ ID NO: 307030 - RNA, 22 nt, Human
ggggcagaaguagugccccuga

SEQ ID NO: 307031 - RNA, 22 nt, Human
cuuauaguaugauguugagaau

SEQ ID NO: 307032 - RNA, 22 nt, Human
cagaagcacuaggaggaaacgu

SEQ ID NO: 307033 - RNA, 22 nt, Human
ugcagaagcagagccgguggcc

SEQ ID NO: 307034 - RNA, 22 nt, Human
uuaaaaccaucagcuguaagau

SEQ ID NO: 307035 - RNA, 22 nt, Human
acagcuugcaauggcuuucaac

SEQ ID NO: 307036 - RNA, 22 nt, Human
aacugcauuugcauaaguccau

SEQ ID NO: 307037 - RNA, 22 nt, Human
cccugcaggggaccugcagccu

SEQ ID NO: 307038 - RNA, 22 nt, Human
caacugcugacaccaucacucc

SEQ ID NO: 307039 - RNA, 22 nt, Human
cacaggagagcugggaggugcc

SEQ ID NO: 307040 - RNA, 22 nt, Human
ccuccugguccagcaucucuuu

SEQ ID NO: 307041 - RNA, 22 nt, Human
ugaggcaggaguucaggcugcg

SEQ ID NO: 307042 - RNA, 22 nt, Human
agcagcugcagggagggucugc

SEQ ID NO: 307043 - RNA, 22 nt, Human
acagguggggaggcugagguuc

SEQ ID NO: 307044 - RNA, 22 nt, Human
cggggacacacuggcagcuccu

SEQ ID NO: 307045 - RNA, 22 nt, Human
acuuugugcccaacagaaagaa

SEQ ID NO: 307046 - RNA, 22 nt, Human
gcacagguugcaaaaguucaca

SEQ ID NO: 307047 - RNA, 22 nt, Human
uggcccugacagguccugggca

SEQ ID NO: 307048 - RNA, 22 nt, Human
ccaguguuugaugggauuuuca

SEQ ID NO: 307049 - RNA, 20 nt, Human
agagaauucccuuuggagau

SEQ ID NO: 307050 - RNA, 20 nt, Human
ugucagugccugaggcacag

SEQ ID NO: 307051 - RNA, 22 nt, Human
gaugaagaggcacugacauauu

SEQ ID NO: 307052 - RNA, 19 nt, Human
cagcugcaccgugaccauc

SEQ ID NO: 307053 - RNA, 22 nt, Human
ccacaguccgggcuggcaggac

SEQ ID NO: 307054 - RNA, 22 nt, Human
aaagaaauagauggcauuuaaa

SEQ ID NO: 307055 - RNA, 22 nt, Human
aaugagcugcugcuguuccacc

SEQ ID NO: 307056 - RNA, 22 nt, Human
uaucuguuggcuccuaguugua

SEQ ID NO: 307057 - RNA, 22 nt, Human
ugucauguguucuuaaauacau

SEQ ID NO: 307058 - RNA, 22 nt, Human
agggcugcugcuccgggcccag

SEQ ID NO: 307059 - RNA, 22 nt, Human
cuguaaauaugaagaauauaug

SEQ ID NO: 307060 - RNA, 18 nt, Human
uggagcugagugcugugc

SEQ ID NO: 307061 - RNA, 22 nt, Human
ggcuccugggaugggacugagc

SEQ ID NO: 307062 - RNA, 22 nt, Human
gugccugguuuggggaguguuc

SEQ ID NO: 307063 - RNA, 22 nt, Human
agccuccaguagcugaagagac

SEQ ID NO: 307064 - RNA, 22 nt, Human
ugacagggugauuaugagagcu

SEQ ID NO: 307065 - RNA, 22 nt, Human
uugaggagcacuagucagguau

SEQ ID NO: 307066 - RNA, 22 nt, Human
ucaugcacaugugucaccauca

SEQ ID NO: 307067 - RNA, 22 nt, Human
cagcaauaagccagguuagaca

SEQ ID NO: 307068 - RNA, 22 nt, Human
ucagccugcgucauggugacac

SEQ ID NO: 307069 - RNA, 22 nt, Human
uuauuuaaaagugguaagauuc

SEQ ID NO: 307070 - RNA, 22 nt, Human
agggaaagguagugaggucaca

SEQ ID NO: 307071 - RNA, 22 nt, Human
uccaugaguuugaggaaaagag

SEQ ID NO: 307072 - RNA, 22 nt, Human
agagccagagaccuggguucac

SEQ ID NO: 307073 - RNA, 22 nt, Human
gcugucuggguugagggcccug

SEQ ID NO: 307074 - RNA, 22 nt, Human
ugggacagugugccuugcuccu

SEQ ID NO: 307075 - RNA, 22 nt, Human
ucaguaacuuacuuauucaccu

SEQ ID NO: 307076 - RNA, 22 nt, Human
cuucuccucugaguccugggag

SEQ ID NO: 307077 - RNA, 22 nt, Human
uuacaugguuguuggaaaugcu

SEQ ID NO: 307078 - RNA, 22 nt, Human
ccacugggcguuucuguccaau

SEQ ID NO: 307079 - RNA, 22 nt, Human
aucuagaaguggcaugaauuac

SEQ ID NO: 307080 - RNA, 22 nt, Human
gcuguggucugugagcuccaaa

SEQ ID NO: 307081 - RNA, 22 nt, Human
aagccaagaguuaacuauuugu

SEQ ID NO: 307082 - RNA, 22 nt, Human
aagguagauucuggaucgaagg

SEQ ID NO: 307083 - RNA, 22 nt, Human
auguuucaccaguuuuauaaga

SEQ ID NO: 307084 - RNA, 22 nt, Human
auaugcacacucugcccacaga

SEQ ID NO: 307085 - RNA, 17 nt, Human
gcuuccucaugcaguuc

SEQ ID NO: 307086 - RNA, 22 nt, Human
ucuggcucuguguccucaccca

SEQ ID NO: 307087 - RNA, 22 nt, Human
guggaggagaggcgccuugcgg

SEQ ID NO: 307088 - RNA, 22 nt, Human
aguucuggugguuuggagaucu

SEQ ID NO: 307089 - RNA, 22 nt, Human
uaucuauuccaaauaucagcgu

SEQ ID NO: 307090 - RNA, 23 nt, Human
uugcacauuggagcuggucuucu

SEQ ID NO: 307091 - RNA, 22 nt, Human
cuguguccucccgcugcaccca

SEQ ID NO: 307092 - RNA, 22 nt, Human
acaauacuuaccaauguuuuug

SEQ ID NO: 307093 - RNA, 22 nt, Human
aguguucuucuucaaagcucug

SEQ ID NO: 307094 - RNA, 22 nt, Human
agaaugcaguuugaaauaaggu

SEQ ID NO: 307095 - RNA, 22 nt, Human
aggucacccguuugacuaucca

SEQ ID NO: 307096 - RNA, 22 nt, Human
agugaaauacugucguuuuuag

SEQ ID NO: 307097 - RNA, 22 nt, Human
cagcugucuaaguugagcagga

SEQ ID NO: 307098 - RNA, 22 nt, Human
aucaggaucugggagccugaaa

SEQ ID NO: 307099 - RNA, 22 nt, Human
aaggaugauugguaaugacacu

SEQ ID NO: 307100 - RNA, 22 nt, Human
cugggcugcagcgggagcgacg

SEQ ID NO: 307101 - RNA, 22 nt, Human
gguggggucacgacagagggaa

SEQ ID NO: 307102 - RNA, 22 nt, Human
guuuuaguggguggccacugau

SEQ ID NO: 307103 - RNA, 22 nt, Human
uccagcagaaaagagguaggga

SEQ ID NO: 307104 - RNA, 22 nt, Human
agggcuggcaucucuaaugcug

SEQ ID NO: 307105 - RNA, 22 nt, Human
agaaggaguguacaggucaugc

SEQ ID NO: 307106 - RNA, 22 nt, Human
acagggcagagaggcaggcuug

SEQ ID NO: 307107 - RNA, 22 nt, Human
aaggccugggaggccucucuuc

SEQ ID NO: 307108 - RNA, 22 nt, Human
aggcagcagggccacuggcuga

SEQ ID NO: 307109 - RNA, 22 nt, Human
guucuucaaagugacaacuaaa

SEQ ID NO: 307110 - RNA, 22 nt, Human
agagccugugggagaugcagcu

SEQ ID NO: 307111 - RNA, 22 nt, Human
ggccucaguuucuccauggguu

SEQ ID NO: 307112 - RNA, 22 nt, Human
guguauaacuaucuaucuagua

SEQ ID NO: 307113 - RNA, 22 nt, Human
ccuuggaggacugcugcuucuu

SEQ ID NO: 307114 - RNA, 22 nt, Human
cauagaaaucaggugagaaucu

SEQ ID NO: 307115 - RNA, 22 nt, Human
aucuuucagggccauuuguauu

SEQ ID NO: 307116 - RNA, 22 nt, Human
caggguggcccuguggucucau

SEQ ID NO: 307117 - RNA, 22 nt, Human
caagauggguguugugaugguu

SEQ ID NO: 307118 - RNA, 22 nt, Human
agagccaggaucuguuuugggg

SEQ ID NO: 307119 - RNA, 19 nt, Human
ugagugggccccugcagac

SEQ ID NO: 307120 - RNA, 22 nt, Human
caguacuuaguucucaugguuu

SEQ ID NO: 307121 - RNA, 22 nt, Human
cccaaggccucuccuuggcuug

SEQ ID NO: 307122 - RNA, 19 nt, Human
auaaggcagugacuuuuuu

SEQ ID NO: 307123 - RNA, 22 nt, Human
ugcauuaugcuugugcuguaua

SEQ ID NO: 307124 - RNA, 22 nt, Human
ccugucuggccuuccacggggg

SEQ ID NO: 307125 - RNA, 22 nt, Human
uggcuagcccuuguggggagag

SEQ ID NO: 307126 - RNA, 22 nt, Human
aacucaguucuuuccacaaugc

SEQ ID NO: 307127 - RNA, 22 nt, Human
gggcuuggcacaugggcucagc

SEQ ID NO: 307128 - RNA, 22 nt, Human
acagugacguuuauuugagacg

SEQ ID NO: 307129 - RNA, 22 nt, Human
gaaauacaggaaugccacacag

SEQ ID NO: 307130 - RNA, 23 nt, Human
acauacauggagauaaagugaug

SEQ ID NO: 307131 - RNA, 22 nt, Human
cugcacagagcagggcagacac

SEQ ID NO: 307132 - RNA, 22 nt, Human
uccucaguaaggcauggcuuug

SEQ ID NO: 307133 - RNA, 22 nt, Human
cuucuggggauggagcccagaa

SEQ ID NO: 307134 - RNA, 22 nt, Human
cccuugcaucccauguguggcc

SEQ ID NO: 307135 - RNA, 22 nt, Human
gaauauuuucaguacagauggu

SEQ ID NO: 307136 - RNA, 22 nt, Human
gcuggccugggcagaggcuaug

SEQ ID NO: 307137 - RNA, 22 nt, Human
uucauucuugggaucagagagu

SEQ ID NO: 307138 - RNA, 22 nt, Human
gacaggggucccucugggcugu

SEQ ID NO: 307139 - RNA, 22 nt, Human
cuggagcauccaugcccagggu

SEQ ID NO: 307140 - RNA, 22 nt, Human
agcuuguuaaggaugcauauua

SEQ ID NO: 307141 - RNA, 22 nt, Human
aagcugccuugcugaggagaaa

SEQ ID NO: 307142 - RNA, 22 nt, Human
gcuggcauuacaggagagaacc

SEQ ID NO: 307143 - RNA, 22 nt, Human
uggggcuccuccuggcaggagg

SEQ ID NO: 307144 - RNA, 22 nt, Human
uaaggccagcaugaaugcagca

SEQ ID NO: 307145 - RNA, 22 nt, Human
caggaaccuaaugaaggcucac

SEQ ID NO: 307146 - RNA, 22 nt, Human
gcagcuggacccacacggcuua

SEQ ID NO: 307147 - RNA, 22 nt, Human
ccaggaagccucagaugcugag

SEQ ID NO: 307148 - RNA, 22 nt, Human
gggccuccggggugagcugugg

SEQ ID NO: 307149 - RNA, 22 nt, Human
gaugcagggcuggcaggagcuu

SEQ ID NO: 307150 - RNA, 22 nt, Human
acagguggccccgagggagugg

SEQ ID NO: 307151 - RNA, 22 nt, Human
acagagaaagugggcugaagau

SEQ ID NO: 307152 - RNA, 22 nt, Human
cagggccaugaggcacaggguc

SEQ ID NO: 307153 - RNA, 22 nt, Human
gcugucuguggugucagcugac

SEQ ID NO: 307154 - RNA, 22 nt, Human
aaggcccuggcaggaagcagga

SEQ ID NO: 307155 - RNA, 21 nt, Human
acuguucauuugaugaacugg

SEQ ID NO: 307156 - RNA, 22 nt, Human
cagucucagaggugggaguggg

SEQ ID NO: 307157 - RNA, 22 nt, Human
cuaucauuuuacaugguuggug

SEQ ID NO: 307158 - RNA, 22 nt, Human
cuggggcugcggacgggagccc

SEQ ID NO: 307159 - RNA, 20 nt, Human
uacugggcaagcccacagac

SEQ ID NO: 307160 - RNA, 22 nt, Human
ccugggaguggcacucacagca

SEQ ID NO: 307161 - RNA, 22 nt, Human
uugucccaggacuugcauagau

SEQ ID NO: 307162 - RNA, 22 nt, Human
cagaaauggaauuuuccaucac

SEQ ID NO: 307163 - RNA, 22 nt, Human
agcuuaggaggaugaugaacau

SEQ ID NO: 307164 - RNA, 20 nt, Human
uguucacaguaguugcugcu

SEQ ID NO: 307165 - RNA, 22 nt, Human
aggcccuggcacugccugggag

SEQ ID NO: 307166 - RNA, 22 nt, Human
ucagccacuacccaccuuaaca

SEQ ID NO: 307167 - RNA, 22 nt, Human
cuggagagaaaugacaaagcua

SEQ ID NO: 307168 - RNA, 17 nt, Human
uccaugagacaugaaga

SEQ ID NO: 307169 - RNA, 22 nt, Human
cagaauuuagcacaauguaugg

SEQ ID NO: 307170 - RNA, 22 nt, Human
ccagcuugaagaugugcugguu

SEQ ID NO: 307171 - RNA, 22 nt, Human
gcugagugauugauauuuuagu

SEQ ID NO: 307172 - RNA, 22 nt, Human
uuuauucuugagagugagaaga

SEQ ID NO: 307173 - RNA, 22 nt, Human
cagaaauguacugacaugcagu

SEQ ID NO: 307174 - RNA, 22 nt, Human
uggcucuguugagguauggauu

SEQ ID NO: 307175 - RNA, 22 nt, Human
ggacacagauaaucacacagau

SEQ ID NO: 307176 - RNA, 22 nt, Human
gauaauauuagaagauacaaau

SEQ ID NO: 307177 - RNA, 22 nt, Human
gcugggagugggcaagaugaga

SEQ ID NO: 307178 - RNA, 22 nt, Human
ccagugcuaagguagccucugc

SEQ ID NO: 307179 - RNA, 22 nt, Human
aucaggauguuuggcugucaua

SEQ ID NO: 307180 - RNA, 22 nt, Human
aaguccaugaucaagauguggc

SEQ ID NO: 307181 - RNA, 21 nt, Human
agcagccauggaugguaugua

SEQ ID NO: 307182 - RNA, 22 nt, Human
ugcagcucugaacagucaugaa

SEQ ID NO: 307183 - RNA, 22 nt, Human
gcagugacagggcugcugccuu

SEQ ID NO: 307184 - RNA, 20 nt, Human
ucacaggggaccaggagcag

SEQ ID NO: 307185 - RNA, 22 nt, Human
aagaugaaucaguauguguccu

SEQ ID NO: 307186 - RNA, 22 nt, Human
gccaggugcuaucccugcgcug

SEQ ID NO: 307187 - RNA, 22 nt, Human
ucucaggggauucacuggcacc

SEQ ID NO: 307188 - RNA, 22 nt, Human
aauugcaauuuucuuaaggucu

SEQ ID NO: 307189 - RNA, 21 nt, Human
uccucagggccccagagcacu

SEQ ID NO: 307190 - RNA, 22 nt, Human
aaugggagguaguaugggaggu

SEQ ID NO: 307191 - RNA, 22 nt, Human
uuugaaguucccccauaucaga

SEQ ID NO: 307192 - RNA, 22 nt, Human
ugagccagaguggagugugccu

SEQ ID NO: 307193 - RNA, 22 nt, Human
gccuggugcuaugagggccagc

SEQ ID NO: 307194 - RNA, 22 nt, Human
ccucugggagacugcuacugag

SEQ ID NO: 307195 - RNA, 22 nt, Human
aguuauauaacuaucuagaugc

SEQ ID NO: 307196 - RNA, 22 nt, Human
ggcagcucaccucugguccagg

SEQ ID NO: 307197 - RNA, 22 nt, Human
ugccugggccucugaggaaggc

SEQ ID NO: 307198 - RNA, 22 nt, Human
gaggagagaugguagauugggu

SEQ ID NO: 307199 - RNA, 22 nt, Human
caggccucuccuuagucuggca

SEQ ID NO: 307200 - RNA, 22 nt, Human
ugcaauaacuacuuuaauguug

SEQ ID NO: 307201 - RNA, 22 nt, Human
gccuggaguagcauggcaagcc

SEQ ID NO: 307202 - RNA, 21 nt, Human
uuugaaagcccuauguuuuca

SEQ ID NO: 307203 - RNA, 22 nt, Human
cagcccuggugccaagguuccc

SEQ ID NO: 307204 - RNA, 19 nt, Human
uccagccccucugugugug

SEQ ID NO: 307205 - RNA, 22 nt, Human
ugcuggaggggccugaccagga

SEQ ID NO: 307206 - RNA, 22 nt, Human
ucucuuccaguaagagucuuua

SEQ ID NO: 307207 - RNA, 22 nt, Human
ggggagcaauaguugaggugug

SEQ ID NO: 307208 - RNA, 22 nt, Human
cagcuguucacauuuccaaaac

SEQ ID NO: 307209 - RNA, 22 nt, Human
ucauugcagacuaacaaucuca

SEQ ID NO: 307210 - RNA, 22 nt, Human
gugcaugugucuuuauaguaga

SEQ ID NO: 307211 - RNA, 22 nt, Human
uggggagaguuacaaggaaucu

SEQ ID NO: 307212 - RNA, 22 nt, Human
uagacacaucaaguauaguuaa

SEQ ID NO: 307213 - RNA, 22 nt, Human
ucaaagucacaacucucuaauu

SEQ ID NO: 307214 - RNA, 22 nt, Human
guucucucugcuuccaagaugg

SEQ ID NO: 307215 - RNA, 19 nt, Human
agucucaguguacagaggc

SEQ ID NO: 307216 - RNA, 22 nt, Human
uugcauugggagugaggagacc

SEQ ID NO: 307217 - RNA, 22 nt, Human
auucagcaguuccugcuucagu

SEQ ID NO: 307218 - RNA, 22 nt, Human
ggacagaggguugacagaguau

SEQ ID NO: 307219 - RNA, 22 nt, Human
uagcauuucacugaucuucacu

SEQ ID NO: 307220 - RNA, 22 nt, Human
agaauaugaucggaauacagau

SEQ ID NO: 307221 - RNA, 22 nt, Human
cugccugggccggccacccucu

SEQ ID NO: 307222 - RNA, 20 nt, Human
ucuguacacucaucuucugc

SEQ ID NO: 307223 - RNA, 22 nt, Human
auaacagauacucucugugagg

SEQ ID NO: 307224 - RNA, 22 nt, Human
uauguguaggaggaggacaggg

SEQ ID NO: 307225 - RNA, 22 nt, Human
ucauuucuccgaccugcugucc

SEQ ID NO: 307226 - RNA, 19 nt, Human
ucuuucauuucuagcucug

SEQ ID NO: 307227 - RNA, 22 nt, Human
cucacugacgaggaagcugaga

SEQ ID NO: 307228 - RNA, 22 nt, Human
gcagagcugcagcgaggccugg

SEQ ID NO: 307229 - RNA, 22 nt, Human
cauugcacugcagcccgggcaa

SEQ ID NO: 307230 - RNA, 22 nt, Human
gccugagccgccugagcggcgg

SEQ ID NO: 307231 - RNA, 22 nt, Human
uuuuccuauaugcaaagaaugc

SEQ ID NO: 307232 - RNA, 22 nt, Human
ucuguucagaagaggugaaagu

SEQ ID NO: 307233 - RNA, 20 nt, Human
uuucagauuuacagaaaugu

SEQ ID NO: 307234 - RNA, 22 nt, Human
aaaucuggccccuugccuauuu

SEQ ID NO: 307235 - RNA, 22 nt, Human
gccagaaacauacacaucacuu

SEQ ID NO: 307236 - RNA, 22 nt, Human
aggagaguaccauugggccgca

SEQ ID NO: 307237 - RNA, 22 nt, Human
gccaggcagauaugugagcuua

SEQ ID NO: 307238 - RNA, 22 nt, Human
gccuguggggcugaggcugccu

SEQ ID NO: 307239 - RNA, 22 nt, Human
caggaugggugucggccagcac

SEQ ID NO: 307240 - RNA, 22 nt, Human
aagcugccauagaacgagaggu

SEQ ID NO: 307241 - RNA, 22 nt, Human
gcugccaguaguuggagcucca

SEQ ID NO: 307242 - RNA, 20 nt, Human
ugaaaaggucaggagacaug

SEQ ID NO: 307243 - RNA, 22 nt, Human
caggaugugaggaggccauuug

SEQ ID NO: 307244 - RNA, 22 nt, Human
augaaggcuguguggagccccc

SEQ ID NO: 307245 - RNA, 22 nt, Human
uauacagaaccgccugaagucu

SEQ ID NO: 307246 - RNA, 22 nt, Human
gggagcaggacauaauagcaau

SEQ ID NO: 307247 - RNA, 22 nt, Human
gccagggaacccaagggccuca

SEQ ID NO: 307248 - RNA, 22 nt, Human
agggaaaggcugaugcuguggg

SEQ ID NO: 307249 - RNA, 22 nt, Human
ggcuucuccccuuugagucuuc

SEQ ID NO: 307250 - RNA, 21 nt, Human
cuggacugaggagacagucgc

SEQ ID NO: 307251 - RNA, 22 nt, Human
gaggggcugggcagucccugga

SEQ ID NO: 307252 - RNA, 22 nt, Human
uccugaggaaaguucaugaaug

SEQ ID NO: 307253 - RNA, 22 nt, Human
aggugcuggaguagaagaaaaa

SEQ ID NO: 307254 - RNA, 23 nt, Human
ggagugcaauggcgccaucucgg

SEQ ID NO: 307255 - RNA, 22 nt, Human
aucuucaacuugaucauuugaa

SEQ ID NO: 307256 - RNA, 22 nt, Human
caguguggagggagagagccug

SEQ ID NO: 307257 - RNA, 22 nt, Human
uccagggcuggguuggcucagc

SEQ ID NO: 307258 - RNA, 22 nt, Human
uccucagucucucaaaugaggc

SEQ ID NO: 307259 - RNA, 22 nt, Human
ugcucagacaagcugaacagua

SEQ ID NO: 307260 - RNA, 22 nt, Human
uguguuuugaacucaucuacug

SEQ ID NO: 307261 - RNA, 22 nt, Human
guggcugcucgggcuccggccc

SEQ ID NO: 307262 - RNA, 22 nt, Human
uucaaaacagcuagauauugga

SEQ ID NO: 307263 - RNA, 22 nt, Human
ccucagggaggccucuguggcu

SEQ ID NO: 307264 - RNA, 22 nt, Human
aucaaaguaggcauauguuuuu

SEQ ID NO: 307265 - RNA, 22 nt, Human
ggacaggaugcugaagaugaag

SEQ ID NO: 307266 - RNA, 22 nt, Human
ccucaggcuuacgggcaaugga

SEQ ID NO: 307267 - RNA, 22 nt, Human
uccuucagaaaaccucagucuu

SEQ ID NO: 307268 - RNA, 22 nt, Human
agccugugugcuuuggacaggg

SEQ ID NO: 307269 - RNA, 18 nt, Human
gccucaguuuccucaccu

SEQ ID NO: 307270 - RNA, 20 nt, Human
ggcccagugaaccaggacgg

SEQ ID NO: 307271 - RNA, 22 nt, Human
ucugcagaaguggcugggccac

SEQ ID NO: 307272 - RNA, 22 nt, Human
caggaacacaaguucagggaug

SEQ ID NO: 307273 - RNA, 22 nt, Human
uucaagaucuggguuuucagcu

SEQ ID NO: 307274 - RNA, 22 nt, Human
uaauacuuuugccuuguauuca

SEQ ID NO: 307275 - RNA, 23 nt, Human
aacaauagguuuuggcagaauag

SEQ ID NO: 307276 - RNA, 22 nt, Human
auaaagauuucuuuuucucuac

SEQ ID NO: 307277 - RNA, 22 nt, Human
aagauuucuuacuuauugaugc

SEQ ID NO: 307278 - RNA, 22 nt, Human
agccugagagccaagcugugca

SEQ ID NO: 307279 - RNA, 22 nt, Human
cagcagcuuugccaagucagcc

SEQ ID NO: 307280 - RNA, 22 nt, Human
uuucacuagaacguucuuguuu

SEQ ID NO: 307281 - RNA, 20 nt, Human
gucaggauuaguaaacucug

SEQ ID NO: 307282 - RNA, 22 nt, Human
ucuggcucauaggaaggccauu

SEQ ID NO: 307283 - RNA, 22 nt, Human
augaccccuaaaauuuacuguc

SEQ ID NO: 307284 - RNA, 22 nt, Human
uauuucuguaacucagggucug

SEQ ID NO: 307285 - RNA, 22 nt, Human
ugccuggguguaaagggccaac

SEQ ID NO: 307286 - RNA, 18 nt, Human
caguuuuuauaucuggca

SEQ ID NO: 307287 - RNA, 22 nt, Human
aucaggauuauuaaaucuggau

SEQ ID NO: 307288 - RNA, 22 nt, Human
aggauccuguauggagaagcug

SEQ ID NO: 307289 - RNA, 22 nt, Human
ucugagaguagagcugccucuu

SEQ ID NO: 307290 - RNA, 22 nt, Human
cauggaaggcaaaagacacaga

SEQ ID NO: 307291 - RNA, 22 nt, Human
cuggcuugcagcucaucauaaa

SEQ ID NO: 307292 - RNA, 22 nt, Human
ucagaggacgcacuaggguugu

SEQ ID NO: 307293 - RNA, 22 nt, Human
caugugucaaaugauguagcug

SEQ ID NO: 307294 - RNA, 22 nt, Human
acucugccccgaguucugggaa

SEQ ID NO: 307295 - RNA, 22 nt, Human
acagaauuaucaggaaauguua

SEQ ID NO: 307296 - RNA, 22 nt, Human
gccuggagugcaguggcgugau

SEQ ID NO: 307297 - RNA, 22 nt, Human
ggcagcagggcugucucccuac

SEQ ID NO: 307298 - RNA, 22 nt, Human
ggcuuccuaauacucccuacac

SEQ ID NO: 307299 - RNA, 22 nt, Human
ucuguuccauguuuuguuccau

SEQ ID NO: 307300 - RNA, 22 nt, Human
agagccagguguagucucggag

SEQ ID NO: 307301 - RNA, 22 nt, Human
cugccuguuuucugauagauuu

SEQ ID NO: 307302 - RNA, 22 nt, Human
ccagcugcgggcaucgagaguu

SEQ ID NO: 307303 - RNA, 22 nt, Human
ccagaaaaugcagaacauagaa

SEQ ID NO: 307304 - RNA, 22 nt, Human
gucauugcaguggcaaaucaca

SEQ ID NO: 307305 - RNA, 22 nt, Human
gaaaugugcagaauguguuaga

SEQ ID NO: 307306 - RNA, 22 nt, Human
ccugccagauccccugagcuga

SEQ ID NO: 307307 - RNA, 22 nt, Human
uggagcugagagccaggcuggc

SEQ ID NO: 307308 - RNA, 22 nt, Human
aggcugaggcagguggaucacc

SEQ ID NO: 307309 - RNA, 22 nt, Human
aagucucagaaaacuagugugg

SEQ ID NO: 307310 - RNA, 22 nt, Human
caaaugauacuguuuuuagucu

SEQ ID NO: 307311 - RNA, 22 nt, Human
ggccucugguucacagggagga

SEQ ID NO: 307312 - RNA, 22 nt, Human
guuguuuugcaggauccuuaca

SEQ ID NO: 307313 - RNA, 22 nt, Human
gucaccaggucugaugcagcca

SEQ ID NO: 307314 - RNA, 22 nt, Human
cacugcaggucugagauggggg

SEQ ID NO: 307315 - RNA, 22 nt, Human
ccacuguuuuucaguuaacuuu

SEQ ID NO: 307316 - RNA, 22 nt, Human
ugauuuccuagcugacaugaaa

SEQ ID NO: 307317 - RNA, 22 nt, Human
cuguccauuuucgugccuccuu

SEQ ID NO: 307318 - RNA, 22 nt, Human
gcaguguugcuaggugcgguga

SEQ ID NO: 307319 - RNA, 22 nt, Human
ucuguccagagguccuggagac

SEQ ID NO: 307320 - RNA, 22 nt, Human
ugcuggcugggcugcuggagac

SEQ ID NO: 307321 - RNA, 22 nt, Human
aaggccaacuaggaugagcuag

SEQ ID NO: 307322 - RNA, 22 nt, Human
cagccagggagcaaagaguuga

SEQ ID NO: 307323 - RNA, 22 nt, Human
auuggaaauacaguagaaaaau

SEQ ID NO: 307324 - RNA, 22 nt, Human
cuggcaguguccagcucgugau

SEQ ID NO: 307325 - RNA, 22 nt, Human
gauuuuauauggcauacugugg

SEQ ID NO: 307326 - RNA, 22 nt, Human
cagcuccagcccaggcagcucc

SEQ ID NO: 307327 - RNA, 22 nt, Human
uaaggccauuauggugggcccg

SEQ ID NO: 307328 - RNA, 21 nt, Human
uucaauacuauuucaauaguc

SEQ ID NO: 307329 - RNA, 22 nt, Human
accuuucacgguaucagacauc

SEQ ID NO: 307330 - RNA, 22 nt, Human
cacagaggacuguagcggggag

SEQ ID NO: 307331 - RNA, 22 nt, Human
caaagcaaggcucaguuugaac

SEQ ID NO: 307332 - RNA, 22 nt, Human
cagcucugccucuggggcugag

SEQ ID NO: 307333 - RNA, 22 nt, Human
aagaggccuuggucugaccuga

SEQ ID NO: 307334 - RNA, 22 nt, Human
uccugucugucuuuggucccuu

SEQ ID NO: 307335 - RNA, 22 nt, Human
guuuaagaaaauucauguuguu

SEQ ID NO: 307336 - RNA, 22 nt, Human
cagcugaacauguagagcaucu

SEQ ID NO: 307337 - RNA, 22 nt, Human
auaugccauuagcuagaaauaa

SEQ ID NO: 307338 - RNA, 22 nt, Human
ccugucugaggaggugcucuuu

SEQ ID NO: 307339 - RNA, 22 nt, Human
gccucccuggcccacagcagcg

SEQ ID NO: 307340 - RNA, 22 nt, Human
ucuuuccuuagaauaauucuuu

SEQ ID NO: 307341 - RNA, 22 nt, Human
agaaaugacacacaugagacau

SEQ ID NO: 307342 - RNA, 22 nt, Human
auaauaacaccugaauaggaaa

SEQ ID NO: 307343 - RNA, 17 nt, Human
uauauguaugccucucc

SEQ ID NO: 307344 - RNA, 22 nt, Human
ggacacaguggaagacagcuug

SEQ ID NO: 307345 - RNA, 18 nt, Human
ugacucacccugucagug

SEQ ID NO: 307346 - RNA, 22 nt, Human
guagccauuggcaaugaagccu

SEQ ID NO: 307347 - RNA, 22 nt, Human
gaacagcuucuugggagcuggg

SEQ ID NO: 307348 - RNA, 22 nt, Human
uuucaaauaccauaaaccuaau

SEQ ID NO: 307349 - RNA, 22 nt, Human
agaauuguaagcaauuugauua

SEQ ID NO: 307350 - RNA, 22 nt, Human
gcagggccagguacaagaagca

SEQ ID NO: 307351 - RNA, 22 nt, Human
agaugauggccauguccucucc

SEQ ID NO: 307352 - RNA, 22 nt, Human
gccagccugugcuuggccaggc

SEQ ID NO: 307353 - RNA, 22 nt, Human
auaaaaguuuccaaucaugccu

SEQ ID NO: 307354 - RNA, 22 nt, Human
gagcuucccucugcagucccug

SEQ ID NO: 307355 - RNA, 22 nt, Human
aguggggagguccaggccaccc

SEQ ID NO: 307356 - RNA, 22 nt, Human
uugauuccuugaaauauccuug

SEQ ID NO: 307357 - RNA, 22 nt, Human
gagugucugaauuagagcacaa

SEQ ID NO: 307358 - RNA, 22 nt, Human
aggugcuuggcucgugcacaca

SEQ ID NO: 307359 - RNA, 22 nt, Human
ugucucugcuuuccuugcaggg

SEQ ID NO: 307360 - RNA, 22 nt, Human
ugucucugauaaguaguucagu

SEQ ID NO: 307361 - RNA, 22 nt, Human
uaggccagcccuuaguccuguc

SEQ ID NO: 307362 - RNA, 22 nt, Human
uauuuucaccuucucuggauau

SEQ ID NO: 307363 - RNA, 22 nt, Human
cucaggauucucgacacucaca

SEQ ID NO: 307364 - RNA, 22 nt, Human
auuuagcaaaaaaugaugaagc

SEQ ID NO: 307365 - RNA, 21 nt, Human
aguguccuugaucuugccuug

SEQ ID NO: 307366 - RNA, 22 nt, Human
uagaaaugauuuugaugcuuca

SEQ ID NO: 307367 - RNA, 22 nt, Human
ggcuguccuuggccaaggcacu

SEQ ID NO: 307368 - RNA, 22 nt, Human
gggauggggucaacauguaccu

SEQ ID NO: 307369 - RNA, 22 nt, Human
aaaugguaagacaacacauuau

SEQ ID NO: 307370 - RNA, 20 nt, Human
cagaaggucuaagcuuuaga

SEQ ID NO: 307371 - RNA, 22 nt, Human
gucucagugucaccuccagcug

SEQ ID NO: 307372 - RNA, 22 nt, Human
agggccuggcgcguggccgccg

SEQ ID NO: 307373 - RNA, 22 nt, Human
guggauggauuuugaggaaugg

SEQ ID NO: 307374 - RNA, 22 nt, Human
ugcauaguucuccuuccuccuc

SEQ ID NO: 307375 - RNA, 20 nt, Human
aggagaaauucgggacaccu

SEQ ID NO: 307376 - RNA, 22 nt, Human
ugcucacugaacucuugcuguc

SEQ ID NO: 307377 - RNA, 22 nt, Human
cgcugggggaacagcgagggug

SEQ ID NO: 307378 - RNA, 22 nt, Human
ccggggacuuaaagugaaggaa

SEQ ID NO: 307379 - RNA, 22 nt, Human
uacacauguuuggcaaguaugu

SEQ ID NO: 307380 - RNA, 22 nt, Human
gcaggguccauggaggcagccc

SEQ ID NO: 307381 - RNA, 22 nt, Human
cuuauguaaaacggaaagggaa

SEQ ID NO: 307382 - RNA, 22 nt, Human
aggcuauuuccacucuucucau

SEQ ID NO: 307383 - RNA, 22 nt, Human
gugccugugccaggggugugcu

SEQ ID NO: 307384 - RNA, 22 nt, Human
acuguucauccuuuuugaacaa

SEQ ID NO: 307385 - RNA, 22 nt, Human
ggcuggaaguccaagaucaagg

SEQ ID NO: 307386 - RNA, 22 nt, Human
aguguuccugcucucaggaagc

SEQ ID NO: 307387 - RNA, 22 nt, Human
auuuaucaccaguuagcugacu

SEQ ID NO: 307388 - RNA, 22 nt, Human
agcaucuggugagggccuaguu

SEQ ID NO: 307389 - RNA, 19 nt, Human
uggcagcauugguaccuug

SEQ ID NO: 307390 - RNA, 22 nt, Human
cugggcuguucugccccugggu

SEQ ID NO: 307391 - RNA, 22 nt, Human
caaauguguagagcuuuugggg

SEQ ID NO: 307392 - RNA, 22 nt, Human
cauuuguauagugcuuagacca

SEQ ID NO: 307393 - RNA, 22 nt, Human
cuaucuuucgauucuagcuuaa

SEQ ID NO: 307394 - RNA, 22 nt, Human
cugcagagcauaaaucugaaua

SEQ ID NO: 307395 - RNA, 22 nt, Human
uugcagcuucuaccacuguuuc

SEQ ID NO: 307396 - RNA, 22 nt, Human
uauucacaaaaugagguccuca

SEQ ID NO: 307397 - RNA, 22 nt, Human
acaauucucucauaucuuauua

SEQ ID NO: 307398 - RNA, 22 nt, Human
ggaggggcagccauggaacucc

SEQ ID NO: 307399 - RNA, 22 nt, Human
gcuggccugaccugaggcuggg

SEQ ID NO: 307400 - RNA, 23 nt, Human
cugaggccugcugcguucagguu

SEQ ID NO: 307401 - RNA, 22 nt, Human
agcagagaagacacaggcuuca

SEQ ID NO: 307402 - RNA, 22 nt, Human
ucagcccuagccucaguccagg

SEQ ID NO: 307403 - RNA, 22 nt, Human
cuuccuguugucacagucugcg

SEQ ID NO: 307404 - RNA, 22 nt, Human
agucccagugagaugaaccagg

SEQ ID NO: 307405 - RNA, 22 nt, Human
cuggcugcuggccugaggaugc

SEQ ID NO: 307406 - RNA, 22 nt, Human
agaauuguugggguaauaaaag

SEQ ID NO: 307407 - RNA, 22 nt, Human
agugcuuuccuucuugugacau

SEQ ID NO: 307408 - RNA, 22 nt, Human
ucagcuggagaugagaaccgaa

SEQ ID NO: 307409 - RNA, 22 nt, Human
uaugagaacaagaacaaucucc

SEQ ID NO: 307410 - RNA, 22 nt, Human
gugcuuuuaaaggcaauuagua

SEQ ID NO: 307411 - RNA, 22 nt, Human
cugggcugucccaaccccaucc

SEQ ID NO: 307412 - RNA, 22 nt, Human
uggcccugacacgugguacugg

SEQ ID NO: 307413 - RNA, 22 nt, Human
cugggcuuguguuagcugacaa

SEQ ID NO: 307414 - RNA, 22 nt, Human
ggccugccucacagucagcacc

SEQ ID NO: 307415 - RNA, 22 nt, Human
gccuucaguaguauccucauga

SEQ ID NO: 307416 - RNA, 22 nt, Human
cagcuggcuccaccucugggcu

SEQ ID NO: 307417 - RNA, 22 nt, Human
aaggcugaggagggccugcagg

SEQ ID NO: 307418 - RNA, 22 nt, Human
ugcacauucacuuagguauugu

SEQ ID NO: 307419 - RNA, 17 nt, Human
caggucugaggccaggc

SEQ ID NO: 307420 - RNA, 22 nt, Human
aaagguuugcauggaauuuacc

SEQ ID NO: 307421 - RNA, 22 nt, Human
ugggcacuggaagccugcugug

SEQ ID NO: 307422 - RNA, 22 nt, Human
cucugugccucaguuuucuucu

SEQ ID NO: 307423 - RNA, 22 nt, Human
agaagucauuuauguuagauga

SEQ ID NO: 307424 - RNA, 22 nt, Human
uggagccaggagccugggaguc

SEQ ID NO: 307425 - RNA, 22 nt, Human
uuugaacaagagcuucacauua

SEQ ID NO: 307426 - RNA, 22 nt, Human
ugcuguguucuccugacucacc

SEQ ID NO: 307427 - RNA, 22 nt, Human
cagcaggcugcgauugcucauu

SEQ ID NO: 307428 - RNA, 22 nt, Human
cuccucugucuggcccugagcc

SEQ ID NO: 307429 - RNA, 22 nt, Human
ucucuggaauuggcugaggcaa

SEQ ID NO: 307430 - RNA, 22 nt, Human
gccugccuagaauugcagcuuu

SEQ ID NO: 307431 - RNA, 22 nt, Human
uuauuccauucaguucaacaag

SEQ ID NO: 307432 - RNA, 22 nt, Human
agcugccaccucugccuuuggg

SEQ ID NO: 307433 - RNA, 22 nt, Human
auucuucauguugaagcuguca

SEQ ID NO: 307434 - RNA, 22 nt, Human
ugggcuggagcuuguugcuucc

SEQ ID NO: 307435 - RNA, 22 nt, Human
cucaugauguagcgaaugagaa

SEQ ID NO: 307436 - RNA, 22 nt, Human
auuccuugggcugccuuauuau

SEQ ID NO: 307437 - RNA, 22 nt, Human
uaagaacagugucugucucaca

SEQ ID NO: 307438 - RNA, 22 nt, Human
cacuuaagcaguuaauuuaucu

SEQ ID NO: 307439 - RNA, 22 nt, Human
ccucauggaccucagacugucc

SEQ ID NO: 307440 - RNA, 22 nt, Human
ugagccagccuugcagcugugc

SEQ ID NO: 307441 - RNA, 22 nt, Human
ucaucacuguaucauugauaga

SEQ ID NO: 307442 - RNA, 22 nt, Human
uccagccuaauguucuucccac

SEQ ID NO: 307443 - RNA, 22 nt, Human
gagccugaauuugaccugcuua

SEQ ID NO: 307444 - RNA, 22 nt, Human
ccaggcugcuguugguguccgc

SEQ ID NO: 307445 - RNA, 22 nt, Human
augcuguguuuuaaauggaaau

SEQ ID NO: 307446 - RNA, 22 nt, Human
ccaggccugcaucugcugcgca

SEQ ID NO: 307447 - RNA, 22 nt, Human
agcuggcagcucucagggguac

SEQ ID NO: 307448 - RNA, 22 nt, Human
aaacaaguguaaacuagucugu

SEQ ID NO: 307449 - RNA, 22 nt, Human
ccuggugccacuagagaauguc

SEQ ID NO: 307450 - RNA, 22 nt, Human
uuccuguauuuugcgaauuuuc

SEQ ID NO: 307451 - RNA, 22 nt, Human
acuuuacuccccaacauaaaug

SEQ ID NO: 307452 - RNA, 22 nt, Human
gugccuuccccgguggucuguu

SEQ ID NO: 307453 - RNA, 22 nt, Human
gugggcaaggucccugccagcu

SEQ ID NO: 307454 - RNA, 22 nt, Human
uggcagaguaggauggcccugu

SEQ ID NO: 307455 - RNA, 22 nt, Human
accuguggaucagauucuugua

SEQ ID NO: 307456 - RNA, 22 nt, Human
aggugagugugacugcaagaga

SEQ ID NO: 307457 - RNA, 22 nt, Human
uuucuucagagagagcuuuccc

SEQ ID NO: 307458 - RNA, 22 nt, Human
uugaaaggugacauuguuagag

SEQ ID NO: 307459 - RNA, 22 nt, Human
cuggagggauguaggguguauu

SEQ ID NO: 307460 - RNA, 22 nt, Human
uguggcucucaugcacucccag

SEQ ID NO: 307461 - RNA, 22 nt, Human
cuaaaaauccacacuaggugaa

SEQ ID NO: 307462 - RNA, 22 nt, Human
ccagggucucugcugccugaga

SEQ ID NO: 307463 - RNA, 22 nt, Human
aggcacaguuucauccccgggc

SEQ ID NO: 307464 - RNA, 22 nt, Human
aaggcacuuuucuaaagaccuu

SEQ ID NO: 307465 - RNA, 22 nt, Human
aaaaguauuuauggcuauguaa

SEQ ID NO: 307466 - RNA, 22 nt, Human
cugcagaggccucgccuccucu

SEQ ID NO: 307467 - RNA, 22 nt, Human
auuaaaauuccaagguaugcca

SEQ ID NO: 307468 - RNA, 22 nt, Human
ccuggagauuauuugguccaau

SEQ ID NO: 307469 - RNA, 22 nt, Human
aacccagccguguagcugccgc

SEQ ID NO: 307470 - RNA, 22 nt, Human
cauugcuuugugcauauuuaaa

SEQ ID NO: 307471 - RNA, 22 nt, Human
cccagccucagcuuuacuucca

SEQ ID NO: 307472 - RNA, 22 nt, Human
aggagcugggcugcugcuggga

SEQ ID NO: 307473 - RNA, 22 nt, Human
uuagaaaggaaucuucauuuca

SEQ ID NO: 307474 - RNA, 22 nt, Human
ugaaacagucuccagacuugga

SEQ ID NO: 307475 - RNA, 22 nt, Human
uugcaaaagccgaggcacucca

SEQ ID NO: 307476 - RNA, 20 nt, Human
uagaaaucuuauaaaagacu

SEQ ID NO: 307477 - RNA, 22 nt, Human
ugggcagacgcuguuggaaggc

SEQ ID NO: 307478 - RNA, 22 nt, Human
cuggugccauucuguggccuag

SEQ ID NO: 307479 - RNA, 22 nt, Human
agaagaaacugucggggauauu

SEQ ID NO: 307480 - RNA, 22 nt, Human
gagguggguguaucacagguca

SEQ ID NO: 307481 - RNA, 21 nt, Human
ucuuccuccacagcgugccac

SEQ ID NO: 307482 - RNA, 20 nt, Human
uuucacaaugaacaugucuc

SEQ ID NO: 307483 - RNA, 22 nt, Human
auagauacauuagguaacuugu

SEQ ID NO: 307484 - RNA, 22 nt, Human
gaggcccuccagcugucagcug

SEQ ID NO: 307485 - RNA, 22 nt, Human
uacauuccacuagugacuggcg

SEQ ID NO: 307486 - RNA, 22 nt, Human
ccaguuuuuccagugcuuucug

SEQ ID NO: 307487 - RNA, 22 nt, Human
ggucucagacuggcaggcagug

SEQ ID NO: 307488 - RNA, 22 nt, Human
gccucugcucggacuuugccuc

SEQ ID NO: 307489 - RNA, 22 nt, Human
ggaggagcacuucugagcucag

SEQ ID NO: 307490 - RNA, 22 nt, Human
uuccaugacaccgagggaaguc

SEQ ID NO: 307491 - RNA, 22 nt, Human
gcaggagagccagcaggcuucc

SEQ ID NO: 307492 - RNA, 22 nt, Human
agggcugcuccuccuucaggcc

SEQ ID NO: 307493 - RNA, 22 nt, Human
cugggaugucuauagaacacuu

SEQ ID NO: 307494 - RNA, 22 nt, Human
aucccaugagaccacguuggcu

SEQ ID NO: 307495 - RNA, 22 nt, Human
gagcucuguguagccugagggu

SEQ ID NO: 307496 - RNA, 22 nt, Human
caggggaagaugccaagggaga

SEQ ID NO: 307497 - RNA, 23 nt, Human
ugcugggguaguuuguggcacag

SEQ ID NO: 307498 - RNA, 22 nt, Human
uggaggagaauuuauggucgaa

SEQ ID NO: 307499 - RNA, 22 nt, Human
cagcagugcuucagugugagau

SEQ ID NO: 307500 - RNA, 22 nt, Human
uguuuugucuaaucuaaauucu

SEQ ID NO: 307501 - RNA, 22 nt, Human
ccagagccggauugugaagugc

SEQ ID NO: 307502 - RNA, 21 nt, Human
gcagggacaaagcuucaggag

SEQ ID NO: 307503 - RNA, 22 nt, Human
ggcaccuggauguagcagugaa

SEQ ID NO: 307504 - RNA, 19 nt, Human
acuggcaguuucugcaugg

SEQ ID NO: 307505 - RNA, 22 nt, Human
gaaugugugacucuauugagca

SEQ ID NO: 307506 - RNA, 22 nt, Human
aaguuugagaagcuuauagaua

SEQ ID NO: 307507 - RNA, 22 nt, Human
ccuguccagggacugagggaga

SEQ ID NO: 307508 - RNA, 22 nt, Human
cagugcuggaggcuggagggaa

SEQ ID NO: 307509 - RNA, 23 nt, Human
cccagagcacagccuccagaugc

SEQ ID NO: 307510 - RNA, 22 nt, Human
gcucagagggaacaaggggcug

SEQ ID NO: 307511 - RNA, 22 nt, Human
ccuuucucauuuuaagcauuag

SEQ ID NO: 307512 - RNA, 22 nt, Human
ggccuugggcuggcugcaguau

SEQ ID NO: 307513 - RNA, 22 nt, Human
agugggcagcccaggaggucuu

SEQ ID NO: 307514 - RNA, 22 nt, Human
ucuuugcaggccaaauuguuaa

SEQ ID NO: 307515 - RNA, 22 nt, Human
gcucagagcuugaaguuccacu

SEQ ID NO: 307516 - RNA, 22 nt, Human
uucuucaaaacaacacuggccu

SEQ ID NO: 307517 - RNA, 22 nt, Human
ugcaggugugguuccucagcca

SEQ ID NO: 307518 - RNA, 23 nt, Human
ucguugaauagcaauagcacaac

SEQ ID NO: 307519 - RNA, 21 nt, Human
ccuggcuucagggugcacugg

SEQ ID NO: 307520 - RNA, 22 nt, Human
agcccuccucacaucagcgucc

SEQ ID NO: 307521 - RNA, 22 nt, Human
ugggcugcccugaugguccuca

SEQ ID NO: 307522 - RNA, 22 nt, Human
cagagacagaaaauggaucuag

SEQ ID NO: 307523 - RNA, 22 nt, Human
caugcuuucuguccaaauguua

SEQ ID NO: 307524 - RNA, 21 nt, Human
cagggcacacagaggauggua

SEQ ID NO: 307525 - RNA, 23 nt, Human
uugcauagacauccucauagauu

SEQ ID NO: 307526 - RNA, 22 nt, Human
auaugugugccauuucagcagu

SEQ ID NO: 307527 - RNA, 22 nt, Human
cauuuguuggucagauuguagu

SEQ ID NO: 307528 - RNA, 22 nt, Human
ccagccaggcuggcuguggagg

SEQ ID NO: 307529 - RNA, 22 nt, Human
augccagucaaagaagaugaca

SEQ ID NO: 307530 - RNA, 22 nt, Human
cuggaugcuuccucucugcuag

SEQ ID NO: 307531 - RNA, 22 nt, Human
aucugucaucagcaccacaggu

SEQ ID NO: 307532 - RNA, 22 nt, Human
uuuaaaauuuagaccucuccac

SEQ ID NO: 307533 - RNA, 22 nt, Human
ucucagagcucacaccuccugg

SEQ ID NO: 307534 - RNA, 22 nt, Human
uuucuucacaggguauugggug

SEQ ID NO: 307535 - RNA, 22 nt, Human
cuugaaguugcaaaacauuaau

SEQ ID NO: 307536 - RNA, 22 nt, Human
gucucccaaccccugugcccag

SEQ ID NO: 307537 - RNA, 22 nt, Human
agcagauggugucaugggaugg

SEQ ID NO: 307538 - RNA, 22 nt, Human
cucacagaugcugugggucagg

SEQ ID NO: 307539 - RNA, 22 nt, Human
acagaguacauucagagacuau

SEQ ID NO: 307540 - RNA, 22 nt, Human
uuuucaggugcaguaaucauau

SEQ ID NO: 307541 - RNA, 22 nt, Human
gaggagcuggcagcgucuccgc

SEQ ID NO: 307542 - RNA, 22 nt, Human
aucaguuugauaauaaggcuug

SEQ ID NO: 307543 - RNA, 19 nt, Human
agucuuucccacucgucuu

SEQ ID NO: 307544 - RNA, 22 nt, Human
ucuucuguuuuagauugcauac

SEQ ID NO: 307545 - RNA, 22 nt, Human
aauggacaggagagcauaguca

SEQ ID NO: 307546 - RNA, 22 nt, Human
cuagaaauacaggcacgugcca

SEQ ID NO: 307547 - RNA, 22 nt, Human
gggcagugguuacacagcugag

SEQ ID NO: 307548 - RNA, 22 nt, Human
cugggaggugaacagaaaaacu

SEQ ID NO: 307549 - RNA, 18 nt, Human
aguccuggagaucaccaa

SEQ ID NO: 307550 - RNA, 22 nt, Human
caagccugucucaccagugcua

SEQ ID NO: 307551 - RNA, 22 nt, Human
caguugcuacaguucaagugug

SEQ ID NO: 307552 - RNA, 22 nt, Human
uggccucagauuucaggggugg

SEQ ID NO: 307553 - RNA, 20 nt, Human
ucaggaugugcugagugaag

SEQ ID NO: 307554 - RNA, 22 nt, Human
gguggcagaggugcaucagccc

SEQ ID NO: 307555 - RNA, 22 nt, Human
ucugccugcuaacuccugcacc

SEQ ID NO: 307556 - RNA, 22 nt, Human
uuaaacaccugucuaguguagc

SEQ ID NO: 307557 - RNA, 22 nt, Human
agugaaaugauucugagcaaga

SEQ ID NO: 307558 - RNA, 22 nt, Human
gucaggauuauaauccccaugg

SEQ ID NO: 307559 - RNA, 22 nt, Human
ugggagaagcagcagccaagug

SEQ ID NO: 307560 - RNA, 22 nt, Human
uuccucagacccucauugugag

SEQ ID NO: 307561 - RNA, 22 nt, Human
ugccucagaguugucccuacca

SEQ ID NO: 307562 - RNA, 22 nt, Human
uccagggaugguaaugagcagu

SEQ ID NO: 307563 - RNA, 22 nt, Human
gugcuuaauacaugucaauaac

SEQ ID NO: 307564 - RNA, 22 nt, Human
agugcugaacauagaauggaca

SEQ ID NO: 307565 - RNA, 22 nt, Human
uuucagauggagguuuaggaca

SEQ ID NO: 307566 - RNA, 22 nt, Human
aauacugccugugagguaacuc

SEQ ID NO: 307567 - RNA, 22 nt, Human
aauguguauacuggcaauuaag

SEQ ID NO: 307568 - RNA, 22 nt, Human
gcaggcaggcuuccuugaacug

SEQ ID NO: 307569 - RNA, 22 nt, Human
agggaagaagcugguaguaggu

SEQ ID NO: 307570 - RNA, 22 nt, Human
ccagucugcugugguaggaaga

SEQ ID NO: 307571 - RNA, 22 nt, Human
cagaggcugggaccucaggcau

SEQ ID NO: 307572 - RNA, 22 nt, Human
uucaauucaauucuaaauauau

SEQ ID NO: 307573 - RNA, 22 nt, Human
gaagccaguacugugcucugca

SEQ ID NO: 307574 - RNA, 22 nt, Human
uccugaggcucacuuugaaugu

SEQ ID NO: 307575 - RNA, 22 nt, Human
cugagccagcuggcaugugcua

SEQ ID NO: 307576 - RNA, 23 nt, Human
uuugaaaguaucaacucgccuga

SEQ ID NO: 307577 - RNA, 20 nt, Human
aagcagaagcugcucucagc

SEQ ID NO: 307578 - RNA, 19 nt, Human
guggccagggcaggggcug

SEQ ID NO: 307579 - RNA, 22 nt, Human
cagcagggcccccgggugcgcc

SEQ ID NO: 307580 - RNA, 22 nt, Human
ggccugagucacaucaggagag

SEQ ID NO: 307581 - RNA, 22 nt, Human
ggagaaagcuguaguggaaugu

SEQ ID NO: 307582 - RNA, 22 nt, Human
uggcagcaauuugugauguuga

SEQ ID NO: 307583 - RNA, 22 nt, Human
ugaugggacugccagcugcuga

SEQ ID NO: 307584 - RNA, 22 nt, Human
uuuuaaguuaauauaauugagg

SEQ ID NO: 307585 - RNA, 18 nt, Human
acagaggcagacauguau

SEQ ID NO: 307586 - RNA, 22 nt, Human
ccucugcaccauagccuucagc

SEQ ID NO: 307587 - RNA, 22 nt, Human
ucccuggacagccuugccuggg

SEQ ID NO: 307588 - RNA, 22 nt, Human
uaaugagacucaauugugugug

SEQ ID NO: 307589 - RNA, 22 nt, Human
aggacaggauugagcugaacug

SEQ ID NO: 307590 - RNA, 18 nt, Human
ucucagaggccauccuag

SEQ ID NO: 307591 - RNA, 22 nt, Human
gaaggagagagacaucgucccu

SEQ ID NO: 307592 - RNA, 22 nt, Human
gaggucaauaauaugugcuuua

SEQ ID NO: 307593 - RNA, 22 nt, Human
uggaacaaauuacaauuaacuu

SEQ ID NO: 307594 - RNA, 22 nt, Human
ugucccagggaaggcccagcac

SEQ ID NO: 307595 - RNA, 22 nt, Human
gagaccaggaaguacagcagcc

SEQ ID NO: 307596 - RNA, 22 nt, Human
agcugcccugggucuugcugcu

SEQ ID NO: 307597 - RNA, 22 nt, Human
cucuccuccaacagcccugccg

SEQ ID NO: 307598 - RNA, 22 nt, Human
gggugaggagcugccagucaug

SEQ ID NO: 307599 - RNA, 22 nt, Human
cagccaggagcucccccugcuc

SEQ ID NO: 307600 - RNA, 22 nt, Human
cagggcagcuuccuuuguuagg

SEQ ID NO: 307601 - RNA, 22 nt, Human
cugggagucuggccucuggucc

SEQ ID NO: 307602 - RNA, 22 nt, Human
ucccccacucuaaaggagccuu

SEQ ID NO: 307603 - RNA, 22 nt, Human
cuauuucaaggcccagauauga

SEQ ID NO: 307604 - RNA, 22 nt, Human
cugagagcagggacuugagcca

SEQ ID NO: 307605 - RNA, 22 nt, Human
agccaggaaugcaugcucugcu

SEQ ID NO: 307606 - RNA, 22 nt, Human
acagaauucuaguauguggcuu

SEQ ID NO: 307607 - RNA, 22 nt, Human
aucaaauauaauaauuuucgcu

SEQ ID NO: 307608 - RNA, 22 nt, Human
caggcaggagccagggauucca

SEQ ID NO: 307609 - RNA, 22 nt, Human
caaaugcaaaauauaacccugu

SEQ ID NO: 307610 - RNA, 22 nt, Human
cagugguggaaugaggaauugu

SEQ ID NO: 307611 - RNA, 21 nt, Human
aggcuguccuuugccagcccu

SEQ ID NO: 307612 - RNA, 22 nt, Human
cuggcucagacagcugugcagu

SEQ ID NO: 307613 - RNA, 22 nt, Human
aaaaaugcugugguagcugugu

SEQ ID NO: 307614 - RNA, 22 nt, Human
uaaaaugaucucucauguucuu

SEQ ID NO: 307615 - RNA, 22 nt, Human
accauuuaauaaguauuuccau

SEQ ID NO: 307616 - RNA, 22 nt, Human
caugcuuugggucagaaaugcc

SEQ ID NO: 307617 - RNA, 22 nt, Human
aguuuguaucaauuugcuuuau

SEQ ID NO: 307618 - RNA, 17 nt, Human
ggccuuggggccucagu

SEQ ID NO: 307619 - RNA, 22 nt, Human
ucugucacugagcucaggauuc

SEQ ID NO: 307620 - RNA, 22 nt, Human
gccuucagcccugacuggccag

SEQ ID NO: 307621 - RNA, 22 nt, Human
cuggcccauggugagcucuggg

SEQ ID NO: 307622 - RNA, 22 nt, Human
ggugggcaggucacucugccuc

SEQ ID NO: 307623 - RNA, 22 nt, Human
aagaugcagcuuccacuuuugc

SEQ ID NO: 307624 - RNA, 22 nt, Human
cugggcagagcuaacaccugag

SEQ ID NO: 307625 - RNA, 22 nt, Human
aguucacauuccgagguacugg

SEQ ID NO: 307626 - RNA, 22 nt, Human
gcucugaggcugggagcacucu

SEQ ID NO: 307627 - RNA, 22 nt, Human
uuucaaagucaauaucauuacc

SEQ ID NO: 307628 - RNA, 22 nt, Human
gcuccucuucucccacugaaug

SEQ ID NO: 307629 - RNA, 19 nt, Human
caugagcugcucacuuccc

SEQ ID NO: 307630 - RNA, 18 nt, Human
uccagagcuacuguggug

SEQ ID NO: 307631 - RNA, 22 nt, Human
gcagauggacuguaugaccuga

SEQ ID NO: 307632 - RNA, 20 nt, Human
caccacagaauuggggacag

SEQ ID NO: 307633 - RNA, 22 nt, Human
guuagaaagugucugcuugggu

SEQ ID NO: 307634 - RNA, 22 nt, Human
gaugagaaauggacaggagugg

SEQ ID NO: 307635 - RNA, 22 nt, Human
acuuguucauugaguacauaug

SEQ ID NO: 307636 - RNA, 22 nt, Human
aauuuucacagugcugugagau

SEQ ID NO: 307637 - RNA, 22 nt, Human
caaagguauaaguuaauauaca

SEQ ID NO: 307638 - RNA, 22 nt, Human
uccauuggucucugugcccagg

SEQ ID NO: 307639 - RNA, 22 nt, Human
gcagccacuaguuuuccuguuu

SEQ ID NO: 307640 - RNA, 22 nt, Human
auguuuccauuuucuuguauca

SEQ ID NO: 307641 - RNA, 22 nt, Human
cuucucaaaguugugaaucagg

SEQ ID NO: 307642 - RNA, 22 nt, Human
ggcaaaaaccgcaauaacuucu

SEQ ID NO: 307643 - RNA, 22 nt, Human
aaguugaaugcguacgugacau

SEQ ID NO: 307644 - RNA, 22 nt, Human
uggguggcggccugguucugag

SEQ ID NO: 307645 - RNA, 22 nt, Human
ccuggagcuuuuccauccugga

SEQ ID NO: 307646 - RNA, 22 nt, Human
uucaggaugaaagugugcaaca

SEQ ID NO: 307647 - RNA, 18 nt, Human
cauuaugugguuauagaa

SEQ ID NO: 307648 - RNA, 22 nt, Human
ucuggcagggguucugcacuug

SEQ ID NO: 307649 - RNA, 22 nt, Human
ugcaggagcagagauggcugga

SEQ ID NO: 307650 - RNA, 21 nt, Human
agggagcuauuuauaguaagc

SEQ ID NO: 307651 - RNA, 20 nt, Human
gcauugaguauagacagaug

SEQ ID NO: 307652 - RNA, 22 nt, Human
aacuuucagcaaguaauucugg

SEQ ID NO: 307653 - RNA, 22 nt, Human
ugcagcauuauucacaguagcc

SEQ ID NO: 307654 - RNA, 22 nt, Human
aauaaucucccuuuuuguaugu

SEQ ID NO: 307655 - RNA, 22 nt, Human
aagaguuaagcaacagauacca

SEQ ID NO: 307656 - RNA, 20 nt, Human
ugugaaagcaguagaaugac

SEQ ID NO: 307657 - RNA, 22 nt, Human
uauucacauucucaggccuggu

SEQ ID NO: 307658 - RNA, 22 nt, Human
uuugcauuaucucacuuauaua

SEQ ID NO: 307659 - RNA, 22 nt, Human
uggcucugugucucccagcagc

SEQ ID NO: 307660 - RNA, 22 nt, Human
uuuuuuaguuaggucagaaugu

SEQ ID NO: 307661 - RNA, 17 nt, Human
agcugccagggagugug

SEQ ID NO: 307662 - RNA, 19 nt, Human
gaguuauugccagggcaug

SEQ ID NO: 307663 - RNA, 22 nt, Human
cucugucccagacccaccucuc

SEQ ID NO: 307664 - RNA, 22 nt, Human
guggcugcuacagagcuggagg

SEQ ID NO: 307665 - RNA, 22 nt, Human
aggccagaaaugucagggagug

SEQ ID NO: 307666 - RNA, 21 nt, Human
ucccacucuaaauggacugaa

SEQ ID NO: 307667 - RNA, 22 nt, Human
ucaguguuucaguuuggaaaug

SEQ ID NO: 307668 - RNA, 22 nt, Human
aaaggaagaugccaggacucug

SEQ ID NO: 307669 - RNA, 22 nt, Human
gugccagcaguuauggugauuu

SEQ ID NO: 307670 - RNA, 22 nt, Human
aauccugugugacucuggggag

SEQ ID NO: 307671 - RNA, 22 nt, Human
cucugucaggcugcagaugcuc

SEQ ID NO: 307672 - RNA, 23 nt, Human
ucagagagcuguugagagcugcc

SEQ ID NO: 307673 - RNA, 22 nt, Human
agucuugcauuuucugaagaug

SEQ ID NO: 307674 - RNA, 22 nt, Human
acagagcugggaucugaaccca

SEQ ID NO: 307675 - RNA, 22 nt, Human
aggcuggguaccugucauaugc

SEQ ID NO: 307676 - RNA, 22 nt, Human
gucccagagagcacuaguccau

SEQ ID NO: 307677 - RNA, 22 nt, Human
uccugcaggggcugaggaacca

SEQ ID NO: 307678 - RNA, 22 nt, Human
cuuagaaauuguuacucauuca

SEQ ID NO: 307679 - RNA, 22 nt, Human
caaauccagaucccagucguag

SEQ ID NO: 307680 - RNA, 22 nt, Human
aagaacugugcuccaggcucca

SEQ ID NO: 307681 - RNA, 22 nt, Human
cugggccagggaggugucugua

SEQ ID NO: 307682 - RNA, 22 nt, Human
ugcccagcacugugccagucac

SEQ ID NO: 307683 - RNA, 22 nt, Human
uuggcucaggaccccugugacu

SEQ ID NO: 307684 - RNA, 22 nt, Human
ucucaggaauagaguggcagca

SEQ ID NO: 307685 - RNA, 22 nt, Human
aucagcaagacuaggggaauac

SEQ ID NO: 307686 - RNA, 22 nt, Human
cacagcagagggagccauugaa

SEQ ID NO: 307687 - RNA, 22 nt, Human
auacaugucaucauauguuugu

SEQ ID NO: 307688 - RNA, 22 nt, Human
ugagaggccccagcucuuggcc

SEQ ID NO: 307689 - RNA, 23 nt, Human
uggccuggagagaaaagaugagu

SEQ ID NO: 307690 - RNA, 22 nt, Human
aauguguauaugaacauacagg

SEQ ID NO: 307691 - RNA, 22 nt, Human
auauaaaguguuuagaaagcug

SEQ ID NO: 307692 - RNA, 22 nt, Human
aaggaagggaaauagugauguc

SEQ ID NO: 307693 - RNA, 22 nt, Human
gccuggaggggccaggguggua

SEQ ID NO: 307694 - RNA, 22 nt, Human
agcaguggcugaagauguuccu

SEQ ID NO: 307695 - RNA, 22 nt, Human
gucuccugagccuugacugcaa

SEQ ID NO: 307696 - RNA, 22 nt, Human
gcccacagcucguuccucuccu

SEQ ID NO: 307697 - RNA, 22 nt, Human
agcaccuucacaggcucucagg

SEQ ID NO: 307698 - RNA, 23 nt, Human
uccaugagaugugggcuucuagu

SEQ ID NO: 307699 - RNA, 22 nt, Human
ugaggccucauaaugagauuuc

SEQ ID NO: 307700 - RNA, 22 nt, Human
gccaggggacgcggagcgacga

SEQ ID NO: 307701 - RNA, 22 nt, Human
aggagcugcauggauaccuggu

SEQ ID NO: 307702 - RNA, 22 nt, Human
ucacagggauggaauagaaaua

SEQ ID NO: 307703 - RNA, 22 nt, Human
ugcuugaaagggguuucccagu

SEQ ID NO: 307704 - RNA, 22 nt, Human
guggagcccugguagggacccc

SEQ ID NO: 307705 - RNA, 22 nt, Human
cugccucaugcugccugcagcc

SEQ ID NO: 307706 - RNA, 22 nt, Human
uccaccccugggaaugucaaua

SEQ ID NO: 307707 - RNA, 22 nt, Human
ugccaggcccugugcuggaugc

SEQ ID NO: 307708 - RNA, 20 nt, Human
cuguaucagguuacaaagua

SEQ ID NO: 307709 - RNA, 22 nt, Human
gcagugcuuuagucuguccuuu

SEQ ID NO: 307710 - RNA, 22 nt, Human
auccaugaucaauuuauuacua

SEQ ID NO: 307711 - RNA, 22 nt, Human
cagggcuguggcuuugugcugu

SEQ ID NO: 307712 - RNA, 22 nt, Human
acaagagauuaucuacagauga

SEQ ID NO: 307713 - RNA, 22 nt, Human
agcccugucucucacuccaggu

SEQ ID NO: 307714 - RNA, 23 nt, Human
agcaauaagaagggauacaugug

SEQ ID NO: 307715 - RNA, 22 nt, Human
cugggccagauccagccucaca

SEQ ID NO: 307716 - RNA, 22 nt, Human
guaaaugugcuucuuuuaacuu

SEQ ID NO: 307717 - RNA, 22 nt, Human
cuuccucaggcauuagcuggac

SEQ ID NO: 307718 - RNA, 22 nt, Human
agcuccugucucaagggagccu

SEQ ID NO: 307719 - RNA, 22 nt, Human
uuugaagugggcauuagaaccu

SEQ ID NO: 307720 - RNA, 22 nt, Human
ucacagaauagcacuguaagcg

SEQ ID NO: 307721 - RNA, 22 nt, Human
ucccuggacaacagacuucacu

SEQ ID NO: 307722 - RNA, 22 nt, Human
uucagagcaucucuaaagccag

SEQ ID NO: 307723 - RNA, 22 nt, Human
ccagcccuugcugaaggguggc

SEQ ID NO: 307724 - RNA, 23 nt, Human
acaguuauagcugugaauaacau

SEQ ID NO: 307725 - RNA, 22 nt, Human
cagcccuguccagcagagggug

SEQ ID NO: 307726 - RNA, 22 nt, Human
gcagggacaucuuugucuagua

SEQ ID NO: 307727 - RNA, 22 nt, Human
ggcuccuguccccucagcugcu

SEQ ID NO: 307728 - RNA, 16 nt, Human
ggagagugucugcaaa

SEQ ID NO: 307729 - RNA, 22 nt, Human
ugagaguauuuuggcauuauca

SEQ ID NO: 307730 - RNA, 19 nt, Human
ccagcccugucacuucuug

SEQ ID NO: 307731 - RNA, 22 nt, Human
cagcagcucccauccgcugagc

SEQ ID NO: 307732 - RNA, 22 nt, Human
uggcucugagacacaggcucuc

SEQ ID NO: 307733 - RNA, 22 nt, Human
gcccagcagaucucagugucuc

SEQ ID NO: 307734 - RNA, 22 nt, Human
caggggcaagaaugcugucagc

SEQ ID NO: 307735 - RNA, 19 nt, Human
cucuggagcagacacugga

SEQ ID NO: 307736 - RNA, 22 nt, Human
ccuccaggaacuugagagacac

SEQ ID NO: 307737 - RNA, 22 nt, Human
ucugguaaccuuuaucccuccu

SEQ ID NO: 307738 - RNA, 22 nt, Human
cccagagccucauucuguuggg

SEQ ID NO: 307739 - RNA, 22 nt, Human
cccuucagcugagugggacagc

SEQ ID NO: 307740 - RNA, 22 nt, Human
ucuaaccuuugaaacugcuuuc

SEQ ID NO: 307741 - RNA, 22 nt, Human
ccagucccaucucugucgcuua

SEQ ID NO: 307742 - RNA, 23 nt, Human
cagaccuggcagucauccucaac

SEQ ID NO: 307743 - RNA, 20 nt, Human
augugaaagaucaguugucu

SEQ ID NO: 307744 - RNA, 22 nt, Human
uuauuauagauuaugcaagauu

SEQ ID NO: 307745 - RNA, 22 nt, Human
gcuuugaagacuuuuccagggu

SEQ ID NO: 307746 - RNA, 22 nt, Human
agcauccaacaggagggaaggg

SEQ ID NO: 307747 - RNA, 22 nt, Human
gcugagagcggccagcugggaa

SEQ ID NO: 307748 - RNA, 22 nt, Human
gccugucugcagggcugucauu

SEQ ID NO: 307749 - RNA, 22 nt, Human
uccaggaggaggaaggcugcca

SEQ ID NO: 307750 - RNA, 23 nt, Human
acucacaaagcaggaucauguug

SEQ ID NO: 307751 - RNA, 22 nt, Human
uaaauuuacccaaggaacaugu

SEQ ID NO: 307752 - RNA, 22 nt, Human
ccagcucuguaagcugugaaau

SEQ ID NO: 307753 - RNA, 21 nt, Human
gauugaaaccauggcagugag

SEQ ID NO: 307754 - RNA, 22 nt, Human
ugcugccugguuucuucuugcu

SEQ ID NO: 307755 - RNA, 22 nt, Human
ggcacugaauuucuuggcaucu

SEQ ID NO: 307756 - RNA, 22 nt, Human
uggagcugggguuugaaucugg

SEQ ID NO: 307757 - RNA, 22 nt, Human
gaggccugcagcguggucccug

SEQ ID NO: 307758 - RNA, 22 nt, Human
ucacauuuuauaucucugguuu

SEQ ID NO: 307759 - RNA, 22 nt, Human
gcugagugagguccagagcuug

SEQ ID NO: 307760 - RNA, 19 nt, Human
ucagugugugggagguggu

SEQ ID NO: 307761 - RNA, 19 nt, Human
gggcucuggccucaguggg

SEQ ID NO: 307762 - RNA, 22 nt, Human
cugucccaggagcuguaagaca

SEQ ID NO: 307763 - RNA, 22 nt, Human
gaugccuccaaaugagggcaga

SEQ ID NO: 307764 - RNA, 22 nt, Human
ugggacagggaaucugaucccc

SEQ ID NO: 307765 - RNA, 22 nt, Human
cagggguguuuuuggccaggag

SEQ ID NO: 307766 - RNA, 22 nt, Human
gcugucacucaccaggccugca

SEQ ID NO: 307767 - RNA, 22 nt, Human
uauauucaaugauuaguaucag

SEQ ID NO: 307768 - RNA, 22 nt, Human
aagaaagugcuuuguaaauuau

SEQ ID NO: 307769 - RNA, 23 nt, Human
gccuggccaccccagggcugcuu

SEQ ID NO: 307770 - RNA, 22 nt, Human
acaaaugugucuaauugugccu

SEQ ID NO: 307771 - RNA, 22 nt, Human
cucucugggggccaugccaaga

SEQ ID NO: 307772 - RNA, 22 nt, Human
agcuucuuggcucagcacuugg

SEQ ID NO: 307773 - RNA, 16 nt, Human
ucaguguuccagaaua

SEQ ID NO: 307774 - RNA, 22 nt, Human
uggaggcaccacuggcugcccg

SEQ ID NO: 307775 - RNA, 22 nt, Human
ucagaguguuuuacuaaacaag

SEQ ID NO: 307776 - RNA, 22 nt, Human
cagccugcauuuguaucuguau

SEQ ID NO: 307777 - RNA, 22 nt, Human
ugggcugcagggguugagagcu

SEQ ID NO: 307778 - RNA, 22 nt, Human
gcaggccuuggcaaugagccug

SEQ ID NO: 307779 - RNA, 22 nt, Human
cugggagcccugacuagccugg

SEQ ID NO: 307780 - RNA, 22 nt, Human
uggcucagauuuuuguaggcuu

SEQ ID NO: 307781 - RNA, 22 nt, Human
gccuggagggauagaaugcaag

SEQ ID NO: 307782 - RNA, 22 nt, Human
aguauguauuuuauacuuacag

SEQ ID NO: 307783 - RNA, 22 nt, Human
ugcccugucuaagcugucagua

SEQ ID NO: 307784 - RNA, 22 nt, Human
caguggggaggccaggauagaa

SEQ ID NO: 307785 - RNA, 22 nt, Human
acauuuguaugcguuuuuacug

SEQ ID NO: 307786 - RNA, 22 nt, Human
auuucaguagaaaaucuugauu

SEQ ID NO: 307787 - RNA, 22 nt, Human
cuuuggcaugguccucacuaua

SEQ ID NO: 307788 - RNA, 22 nt, Human
gacccugacucuaaugcuuggc

SEQ ID NO: 307789 - RNA, 22 nt, Human
cagcugagucugagguucuuug

SEQ ID NO: 307790 - RNA, 22 nt, Human
uugugcucuguguuauuuaagg

SEQ ID NO: 307791 - RNA, 22 nt, Human
uucaugaaacuuaacuguuggg

SEQ ID NO: 307792 - RNA, 22 nt, Human
uccucagucagcuccguucuug

SEQ ID NO: 307793 - RNA, 22 nt, Human
cuuggccucuucucaggguggg

SEQ ID NO: 307794 - RNA, 17 nt, Human
agguggcugcugcgccu

SEQ ID NO: 307795 - RNA, 22 nt, Human
cuggccacaugugugcugagca

SEQ ID NO: 307796 - RNA, 22 nt, Human
uugauacagcagccugugaucc

SEQ ID NO: 307797 - RNA, 22 nt, Human
cuuccccaaguagagaggggag

SEQ ID NO: 307798 - RNA, 22 nt, Human
agcucucaagauaagaaagaac

SEQ ID NO: 307799 - RNA, 22 nt, Human
agaaaucuuuccugaaguguuu

SEQ ID NO: 307800 - RNA, 22 nt, Human
caggucccgccccgggcugacc

SEQ ID NO: 307801 - RNA, 22 nt, Human
agccucugucaagcuuuucaaa

SEQ ID NO: 307802 - RNA, 22 nt, Human
ggagagaaauugagguagcaag

SEQ ID NO: 307803 - RNA, 22 nt, Human
ccugucagaugaaguaauugug

SEQ ID NO: 307804 - RNA, 22 nt, Human
cuggcccagucucagaguguca

SEQ ID NO: 307805 - RNA, 22 nt, Human
cucagcccagcccaggaccagg

SEQ ID NO: 307806 - RNA, 22 nt, Human
cugaaggauguguggugggagu

SEQ ID NO: 307807 - RNA, 22 nt, Human
cuggagcuccagggucuccucu

SEQ ID NO: 307808 - RNA, 22 nt, Human
aauacuauguagccaaaauaau

SEQ ID NO: 307809 - RNA, 22 nt, Human
cugaaugaggaaaagagugagg

SEQ ID NO: 307810 - RNA, 22 nt, Human
uuauggcauauuccucauugua

SEQ ID NO: 307811 - RNA, 22 nt, Human
aagggcugaaagaccuugggca

SEQ ID NO: 307812 - RNA, 22 nt, Human
aaaagagguuaaccaggugugu

SEQ ID NO: 307813 - RNA, 22 nt, Human
ugagcccaggaguaugaggcug

SEQ ID NO: 307814 - RNA, 22 nt, Human
agggaagagcuugcaagaaacc

SEQ ID NO: 307815 - RNA, 22 nt, Human
augcuguguggucaaguuaauu

SEQ ID NO: 307816 - RNA, 22 nt, Human
gcaggagcugcucuccugacga

SEQ ID NO: 307817 - RNA, 22 nt, Human
uuugaaauuaagauauugucca

SEQ ID NO: 307818 - RNA, 22 nt, Human
aagggaugcaggaaagaagguu

SEQ ID NO: 307819 - RNA, 22 nt, Human
agacucaagacugcagaagacg

SEQ ID NO: 307820 - RNA, 22 nt, Human
uucuucuccuaaggagaguccu

SEQ ID NO: 307821 - RNA, 22 nt, Human
aaugacaaauauggaagccuga

SEQ ID NO: 307822 - RNA, 22 nt, Human
auuuauuaugggauuuggcaca

SEQ ID NO: 307823 - RNA, 22 nt, Human
agaggccaucugcucugugggg

SEQ ID NO: 307824 - RNA, 22 nt, Human
ggaggcuccacugcucuuccug

SEQ ID NO: 307825 - RNA, 22 nt, Human
gggaaaaauaaugcacagauau

SEQ ID NO: 307826 - RNA, 22 nt, Human
cagugguuauacuuacuguuuc

SEQ ID NO: 307827 - RNA, 22 nt, Human
guucuguacuccaagcucuucc

SEQ ID NO: 307828 - RNA, 22 nt, Human
ccuggaaggcaggcauggauug

SEQ ID NO: 307829 - RNA, 22 nt, Human
ccaguguuggaggauggcuugc

SEQ ID NO: 307830 - RNA, 22 nt, Human
caguacuuggucaaggaagcag

SEQ ID NO: 307831 - RNA, 22 nt, Human
acuucaugcagaagagagcugu

SEQ ID NO: 307832 - RNA, 22 nt, Human
ugagcuggucacuccuucugaa

SEQ ID NO: 307833 - RNA, 22 nt, Human
ccuggccucuccgaguaaccug

SEQ ID NO: 307834 - RNA, 22 nt, Human
aucagcaagcaugguuaggugu

SEQ ID NO: 307835 - RNA, 22 nt, Human
gcaagauguuaacauagggaga

SEQ ID NO: 307836 - RNA, 22 nt, Human
aaggcugagggcuguaccuggc

SEQ ID NO: 307837 - RNA, 22 nt, Human
agggcagccugagugcuggccc

SEQ ID NO: 307838 - RNA, 22 nt, Human
guguaaggugaaaucaacaaau

SEQ ID NO: 307839 - RNA, 17 nt, Human
agaugcuggccacaugu

SEQ ID NO: 307840 - RNA, 23 nt, Human
auggagcugguacuagcuaccuc

SEQ ID NO: 307841 - RNA, 22 nt, Human
uucaaugaggauagaacuggau

SEQ ID NO: 307842 - RNA, 22 nt, Human
caagagcuagaaauugguuaga

SEQ ID NO: 307843 - RNA, 22 nt, Human
guccagcugcagcugggcagaa

SEQ ID NO: 307844 - RNA, 22 nt, Human
ugugacaucgcugugucuguuu

SEQ ID NO: 307845 - RNA, 22 nt, Human
uagcugccuagacagcuauagc

SEQ ID NO: 307846 - RNA, 22 nt, Human
acauuucuaguuguucaucucc

SEQ ID NO: 307847 - RNA, 18 nt, Human
caggagcaggaguugaac

SEQ ID NO: 307848 - RNA, 22 nt, Human
aguggcagagcaggugcuggaa

SEQ ID NO: 307849 - RNA, 22 nt, Human
uuuucaguuugcacugcagugc

SEQ ID NO: 307850 - RNA, 22 nt, Human
guuccuuggaagaacuugaggu

SEQ ID NO: 307851 - RNA, 22 nt, Human
gcaggcugugaggcucagaugg

SEQ ID NO: 307852 - RNA, 22 nt, Human
acucacauuucaucaggccaag

SEQ ID NO: 307853 - RNA, 22 nt, Human
uaacacaugaaagcaccuucuu

SEQ ID NO: 307854 - RNA, 22 nt, Human
gucuuuauuugagauugucauu

SEQ ID NO: 307855 - RNA, 22 nt, Human
gggccacacagaaccuccuggu

SEQ ID NO: 307856 - RNA, 22 nt, Human
cugggcagugguggcccuuccc

SEQ ID NO: 307857 - RNA, 22 nt, Human
gcccacacaccagcucaggagg

SEQ ID NO: 307858 - RNA, 22 nt, Human
augaugguaaauucaguauccg

SEQ ID NO: 307859 - RNA, 22 nt, Human
agcaccugccugcauuggcuau

SEQ ID NO: 307860 - RNA, 22 nt, Human
uagcuaucuguguccagaucca

SEQ ID NO: 307861 - RNA, 22 nt, Human
agccugguguggggcugcagag

SEQ ID NO: 307862 - RNA, 22 nt, Human
ccagggcacguugggacaguac

SEQ ID NO: 307863 - RNA, 22 nt, Human
gccugagauucccggagccgug

SEQ ID NO: 307864 - RNA, 22 nt, Human
uggcucaguagcagugugguca

SEQ ID NO: 307865 - RNA, 22 nt, Human
auguuauaguuauaaaaugagg

SEQ ID NO: 307866 - RNA, 22 nt, Human
ggagaaggugcuggucacugug

SEQ ID NO: 307867 - RNA, 21 nt, Human
gcaaggcuuuuguguuuccca

SEQ ID NO: 307868 - RNA, 22 nt, Human
uaauaaaugaaagugcuggcau

SEQ ID NO: 307869 - RNA, 22 nt, Human
cagucccaguuugagacucugg

SEQ ID NO: 307870 - RNA, 23 nt, Human
gccucuggagccccagugcucag

SEQ ID NO: 307871 - RNA, 22 nt, Human
ccccuucuggucuucaauggug

SEQ ID NO: 307872 - RNA, 22 nt, Human
agaaaugugagccccuuaucaa

SEQ ID NO: 307873 - RNA, 22 nt, Human
acuucucuucauagguggcaau

SEQ ID NO: 307874 - RNA, 22 nt, Human
aggagccaugagugacaucaca

SEQ ID NO: 307875 - RNA, 22 nt, Human
cuuagcaugugguguccuugua

SEQ ID NO: 307876 - RNA, 22 nt, Human
uagggcagauucgguggaguuu

SEQ ID NO: 307877 - RNA, 22 nt, Human
ugauuuaaaagaaacauugucu

SEQ ID NO: 307878 - RNA, 22 nt, Human
gcccucucggcauagcaggggc

SEQ ID NO: 307879 - RNA, 22 nt, Human
caugagaaugaagaagacuuaa

SEQ ID NO: 307880 - RNA, 22 nt, Human
cagggugccucccgcucgccgg

SEQ ID NO: 307881 - RNA, 18 nt, Human
cucugcuaaugggcagcu

SEQ ID NO: 307882 - RNA, 23 nt, Human
agaauuguaaauagaauauaccu

SEQ ID NO: 307883 - RNA, 22 nt, Human
uguuugaauuuugcuaacgugu

SEQ ID NO: 307884 - RNA, 22 nt, Human
ugggcugccggcaggcucugcc

SEQ ID NO: 307885 - RNA, 22 nt, Human
agcagggcaaagucaggcuaac

SEQ ID NO: 307886 - RNA, 22 nt, Human
gcuggcaccugcaccaagcagg

SEQ ID NO: 307887 - RNA, 18 nt, Human
guaggucaguaccaagca

SEQ ID NO: 307888 - RNA, 22 nt, Human
cucucagacugaagggccugug

SEQ ID NO: 307889 - RNA, 22 nt, Human
gcugggaggaauuuggggaaua

SEQ ID NO: 307890 - RNA, 22 nt, Human
gaaaugugaccuacuuccuugu

SEQ ID NO: 307891 - RNA, 22 nt, Human
accaggggugucaacagcauuu

SEQ ID NO: 307892 - RNA, 22 nt, Human
gcaggaugaaggcagaggcuga

SEQ ID NO: 307893 - RNA, 21 nt, Human
aggcugcuggcucaggguccu

SEQ ID NO: 307894 - RNA, 22 nt, Human
acauuaacaccauaaguguguu

SEQ ID NO: 307895 - RNA, 22 nt, Human
aaaugcacaaaguaaguguaau

SEQ ID NO: 307896 - RNA, 22 nt, Human
aaaggccaagcaugagguggac

SEQ ID NO: 307897 - RNA, 22 nt, Human
acugucugcaaaacucauacuc

SEQ ID NO: 307898 - RNA, 22 nt, Human
cuggugucugcucccucacagc

SEQ ID NO: 307899 - RNA, 22 nt, Human
gggcggggggagcuggaaugaa

SEQ ID NO: 307900 - RNA, 22 nt, Human
agcagugggggaguguuaguuu

SEQ ID NO: 307901 - RNA, 22 nt, Human
ucugucaauauaugugcugcag

SEQ ID NO: 307902 - RNA, 22 nt, Human
gcauacagagaggauguggcau

SEQ ID NO: 307903 - RNA, 22 nt, Human
augacagaggagugcaggugau

SEQ ID NO: 307904 - RNA, 22 nt, Human
acagcagccuuguugguuucga

SEQ ID NO: 307905 - RNA, 22 nt, Human
ucacugcaaccucugccuuccg

SEQ ID NO: 307906 - RNA, 18 nt, Human
gcagcugcaguuguagcu

SEQ ID NO: 307907 - RNA, 22 nt, Human
gagcuggguauauggcuuuaug

SEQ ID NO: 307908 - RNA, 22 nt, Human
gcagcuggggaggucgugggga

SEQ ID NO: 307909 - RNA, 22 nt, Human
aaguucaagucuccugaguaua

SEQ ID NO: 307910 - RNA, 22 nt, Human
aaacucuguagcuaaacauaau

SEQ ID NO: 307911 - RNA, 23 nt, Human
aagcuuccuucacgucuccuggg

SEQ ID NO: 307912 - RNA, 22 nt, Human
gcaccuggcugcccagguggag

SEQ ID NO: 307913 - RNA, 22 nt, Human
ccuggagcccaaggcagugaga

SEQ ID NO: 307914 - RNA, 22 nt, Human
caucaguguggcaguucacugu

SEQ ID NO: 307915 - RNA, 22 nt, Human
uuucacauuuuauacuuaagcc

SEQ ID NO: 307916 - RNA, 23 nt, Human
ugccagaggcagucacaguggug

SEQ ID NO: 307917 - RNA, 22 nt, Human
aucagagauuguaguaugugca

SEQ ID NO: 307918 - RNA, 21 nt, Human
gggugcuguggucaugcagga

SEQ ID NO: 307919 - RNA, 22 nt, Human
uacaaagccugguagauaucug

SEQ ID NO: 307920 - RNA, 22 nt, Human
cugagagccuccuguuggcuag

SEQ ID NO: 307921 - RNA, 22 nt, Human
augaguaaaaccacuauuuaca

SEQ ID NO: 307922 - RNA, 22 nt, Human
aguguugucaaacggcucagca

SEQ ID NO: 307923 - RNA, 22 nt, Human
ucagaaacacucuucuucuguc

SEQ ID NO: 307924 - RNA, 22 nt, Human
ugcagcugcuugauucaucuug

SEQ ID NO: 307925 - RNA, 22 nt, Human
ccaguguucugguguucauuuc

SEQ ID NO: 307926 - RNA, 23 nt, Human
uccucaguauauaaaggcagaug

SEQ ID NO: 307927 - RNA, 22 nt, Human
uucugggagagaaagggccuug

SEQ ID NO: 307928 - RNA, 22 nt, Human
agcugguggauuaugcuguaca

SEQ ID NO: 307929 - RNA, 22 nt, Human
gccugaggaaugcuccugacuu

SEQ ID NO: 307930 - RNA, 22 nt, Human
gcugggcagccuggccgcugcc

SEQ ID NO: 307931 - RNA, 23 nt, Human
ucugucaccuauggcugcucuuc

SEQ ID NO: 307932 - RNA, 22 nt, Human
cagcugccugucuggaggcaau

SEQ ID NO: 307933 - RNA, 22 nt, Human
agaggggcucaagcaguggucu

SEQ ID NO: 307934 - RNA, 22 nt, Human
cuggagcccugaaugggcagga

SEQ ID NO: 307935 - RNA, 22 nt, Human
uuccucucgcucuccggggccc

SEQ ID NO: 307936 - RNA, 17 nt, Human
uccuggcucugccacug

SEQ ID NO: 307937 - RNA, 22 nt, Human
aaauaguuagcccugcauauau

SEQ ID NO: 307938 - RNA, 19 nt, Human
caguggagauuggaggagg

SEQ ID NO: 307939 - RNA, 22 nt, Human
cucccaggggaacuaucaagua

SEQ ID NO: 307940 - RNA, 22 nt, Human
cuggcuccauccuugagcucug

SEQ ID NO: 307941 - RNA, 22 nt, Human
ugucucugccagcuagcagaau

SEQ ID NO: 307942 - RNA, 22 nt, Human
gagguucacaggcuaucacagu

SEQ ID NO: 307943 - RNA, 22 nt, Human
ucugccuuuucacugccacuaa

SEQ ID NO: 307944 - RNA, 22 nt, Human
caagggcucuuuugaggaaugu

SEQ ID NO: 307945 - RNA, 22 nt, Human
uguagcucuccagccagcaagg

SEQ ID NO: 307946 - RNA, 22 nt, Human
augcagcaguuuacaaagcaau

SEQ ID NO: 307947 - RNA, 17 nt, Human
ccagguggaaucgugga

SEQ ID NO: 307948 - RNA, 22 nt, Human
uguguauucagcaagcgaaaca

SEQ ID NO: 307949 - RNA, 22 nt, Human
cucuggaggccuaaggaagugg

SEQ ID NO: 307950 - RNA, 21 nt, Human
uuucuuaggcucuaaaaugac

SEQ ID NO: 307951 - RNA, 22 nt, Human
ccuggaugauccaugucaugga

SEQ ID NO: 307952 - RNA, 21 nt, Human
cucuugugucagagccagagg

SEQ ID NO: 307953 - RNA, 22 nt, Human
uuugcagucaaauuugcuaaau

SEQ ID NO: 307954 - RNA, 22 nt, Human
ccaguguuagagacugauacag

SEQ ID NO: 307955 - RNA, 22 nt, Human
ccuuccaggagucucugcaggu

SEQ ID NO: 307956 - RNA, 22 nt, Human
uugcagagaucagcagguuuga

SEQ ID NO: 307957 - RNA, 17 nt, Human
acacagggagagggagc

SEQ ID NO: 307958 - RNA, 22 nt, Human
aggaaucccgcaccagcugcug

SEQ ID NO: 307959 - RNA, 22 nt, Human
acagcagcaauagcagugacau

SEQ ID NO: 307960 - RNA, 22 nt, Human
cagcuccccucuguggggcagu

SEQ ID NO: 307961 - RNA, 22 nt, Human
cagcugaggucaaagaagcagg

SEQ ID NO: 307962 - RNA, 22 nt, Human
ccuucucuacuccugaugcaug

SEQ ID NO: 307963 - RNA, 22 nt, Human
ccuggcagcgccgaagcuggcc

SEQ ID NO: 307964 - RNA, 22 nt, Human
ucaguuuuuaaaugauauaauu

SEQ ID NO: 307965 - RNA, 22 nt, Human
aaugcacauguuguaauaaaua

SEQ ID NO: 307966 - RNA, 22 nt, Human
ccacucugauuuuggcuccacu

SEQ ID NO: 307967 - RNA, 23 nt, Human
auggaagucacuguuuucuuguc

SEQ ID NO: 307968 - RNA, 22 nt, Human
cuugcuucauuagugucuuagu

SEQ ID NO: 307969 - RNA, 22 nt, Human
gcauuuaaauuugaacuucaga

SEQ ID NO: 307970 - RNA, 19 nt, Human
gguaaaagugagcuucagg

SEQ ID NO: 307971 - RNA, 19 nt, Human
cagcugccuuuucuuugca

SEQ ID NO: 307972 - RNA, 22 nt, Human
uaggcagcugcaaacuucgguc

SEQ ID NO: 307973 - RNA, 23 nt, Human
ugcucugggaggcccuggagagc

SEQ ID NO: 307974 - RNA, 22 nt, Human
ucugagagagggucagaugcua

SEQ ID NO: 307975 - RNA, 22 nt, Human
aggagucagauaugggaaaguu

SEQ ID NO: 307976 - RNA, 22 nt, Human
uucuaguguccuuggacuugcu

SEQ ID NO: 307977 - RNA, 22 nt, Human
gcucugugcaguucagggacac

SEQ ID NO: 307978 - RNA, 22 nt, Human
ugcagaagugagucaugaggaa

SEQ ID NO: 307979 - RNA, 22 nt, Human
cccuggagugugacgaggcauu

SEQ ID NO: 307980 - RNA, 22 nt, Human
uuuugaaagccagguuuguaug

SEQ ID NO: 307981 - RNA, 22 nt, Human
acguguucaauuuccaucugac

SEQ ID NO: 307982 - RNA, 22 nt, Human
cuggacagaaaaggccacugga

SEQ ID NO: 307983 - RNA, 22 nt, Human
uagcugcugcagcacagggagg

SEQ ID NO: 307984 - RNA, 22 nt, Human
uucauguaauuccauaagguaa

SEQ ID NO: 307985 - RNA, 22 nt, Human
aggagacauaacuaugaugaga

SEQ ID NO: 307986 - RNA, 22 nt, Human
uucaggauucugugucugacaa

SEQ ID NO: 307987 - RNA, 22 nt, Human
uauuuucauucugugugacugu

SEQ ID NO: 307988 - RNA, 22 nt, Human
gucuucuuuucagucugcuugu

SEQ ID NO: 307989 - RNA, 22 nt, Human
gugugcaguagagaaagagcag

SEQ ID NO: 307990 - RNA, 22 nt, Human
acaaauaugguacucggagaaa

SEQ ID NO: 307991 - RNA, 22 nt, Human
gugcauuugacgaauacucacu

SEQ ID NO: 307992 - RNA, 22 nt, Human
gagcugcuucugugugccgggu

SEQ ID NO: 307993 - RNA, 22 nt, Human
agacagcauggagcugauaaca

SEQ ID NO: 307994 - RNA, 22 nt, Human
gaaaugcaaauucucucucgcu

SEQ ID NO: 307995 - RNA, 22 nt, Human
gaagagcuauguccagggagca

SEQ ID NO: 307996 - RNA, 22 nt, Human
cagggaguuuuuguuccucuag

SEQ ID NO: 307997 - RNA, 21 nt, Human
uucuccccagcgaauccucgg

SEQ ID NO: 307998 - RNA, 18 nt, Human
ugggauggagaguaacug

SEQ ID NO: 307999 - RNA, 22 nt, Human
gacuguguccaugugcuggauu

SEQ ID NO: 308000 - RNA, 22 nt, Human
uuggaaauacagcaguuacuuu

SEQ ID NO: 308001 - RNA, 22 nt, Human
cuuuauguuggggugucuuagu

SEQ ID NO: 308002 - RNA, 22 nt, Human
agccuggcacugaggcagggcg

SEQ ID NO: 308003 - RNA, 22 nt, Human
gaugagaaggcucagauccaaa

SEQ ID NO: 308004 - RNA, 22 nt, Human
uggcuucugcuuucaguggagg

SEQ ID NO: 308005 - RNA, 22 nt, Human
ucucagugcuauccauauucca

SEQ ID NO: 308006 - RNA, 22 nt, Human
uugaggaguguuuagggugagg

SEQ ID NO: 308007 - RNA, 20 nt, Human
gccucagucacauggccuac

SEQ ID NO: 308008 - RNA, 21 nt, Human
ggagucagggucuggcugggg

SEQ ID NO: 308009 - RNA, 22 nt, Human
guuugcauaucugugaaaugga

SEQ ID NO: 308010 - RNA, 22 nt, Human
aaagaacaucggagugggcggg

SEQ ID NO: 308011 - RNA, 22 nt, Human
gagggaugugccugaaggcagg

SEQ ID NO: 308012 - RNA, 22 nt, Human
uucauuccuucuguaccuugcc

SEQ ID NO: 308013 - RNA, 22 nt, Human
ccugugugcugaugacgacaga

SEQ ID NO: 308014 - RNA, 22 nt, Human
cuggcucccagcuuucagggag

SEQ ID NO: 308015 - RNA, 22 nt, Human
aucauucuauuguugagcugcc

SEQ ID NO: 308016 - RNA, 18 nt, Human
cugcugcaggcacucagg

SEQ ID NO: 308017 - RNA, 22 nt, Human
acaggugugagaacaugccuug

SEQ ID NO: 308018 - RNA, 22 nt, Human
cauaugaaauaugaguugaaca

SEQ ID NO: 308019 - RNA, 22 nt, Human
aaucuuucccuauuaaaugugg

SEQ ID NO: 308020 - RNA, 22 nt, Human
ccuuuggguucaaucucggucu

SEQ ID NO: 308021 - RNA, 21 nt, Human
aaugaaguggcuauuuugagg

SEQ ID NO: 308022 - RNA, 22 nt, Human
aggacccugagcgggcaugccg

SEQ ID NO: 308023 - RNA, 23 nt, Human
uaagaacagacaagcauuuacau

SEQ ID NO: 308024 - RNA, 22 nt, Human
ggcccagcacagugcuuggggg

SEQ ID NO: 308025 - RNA, 22 nt, Human
cugccagcaaugugaccaugcu

SEQ ID NO: 308026 - RNA, 22 nt, Human
cccagcuccaagggacagcgaa

SEQ ID NO: 308027 - RNA, 22 nt, Human
aggagagucuugagucacuggu

SEQ ID NO: 308028 - RNA, 22 nt, Human
auguaugagagauucuuuuauu

SEQ ID NO: 308029 - RNA, 22 nt, Human
ugugccauuucuauucugcagc

SEQ ID NO: 308030 - RNA, 19 nt, Human
uccaaaggacccaccucca

SEQ ID NO: 308031 - RNA, 22 nt, Human
caggcacuggggaugcugggau

SEQ ID NO: 308032 - RNA, 22 nt, Human
ccacucccuuccgguccagggc

SEQ ID NO: 308033 - RNA, 22 nt, Human
gagcuguccgccccugggccga

SEQ ID NO: 308034 - RNA, 22 nt, Human
ggcggggguccaggagccugca

SEQ ID NO: 308035 - RNA, 22 nt, Human
cuucacauguuggaguccuuug

SEQ ID NO: 308036 - RNA, 22 nt, Human
cagcagagcuuauguuggguca

SEQ ID NO: 308037 - RNA, 22 nt, Human
aaguguguugacugaauugggg

SEQ ID NO: 308038 - RNA, 22 nt, Human
cucugcuuggaacuggacagaa

SEQ ID NO: 308039 - RNA, 22 nt, Human
gggaggugauggcaagcagcgg

SEQ ID NO: 308040 - RNA, 22 nt, Human
cauggccugccuccuccuggug

SEQ ID NO: 308041 - RNA, 22 nt, Human
uccuuagagauacugucuugaa

SEQ ID NO: 308042 - RNA, 22 nt, Human
ucuuggaacuuauuauuguaga

SEQ ID NO: 308043 - RNA, 22 nt, Human
cugggccuagcaacagaggagu

SEQ ID NO: 308044 - RNA, 21 nt, Human
auuucagagcacacaaguaaa

SEQ ID NO: 308045 - RNA, 22 nt, Human
aagccagguuccauggaggagc

SEQ ID NO: 308046 - RNA, 18 nt, Human
cugaaggauccaggugua

SEQ ID NO: 308047 - RNA, 20 nt, Human
ggcugugcccuuccguggcc

SEQ ID NO: 308048 - RNA, 22 nt, Human
agcuccuggcuuuccucucacc

SEQ ID NO: 308049 - RNA, 20 nt, Human
aggaggggauagaaucaaag

SEQ ID NO: 308050 - RNA, 22 nt, Human
ucaaggugcugugcugugcuag

SEQ ID NO: 308051 - RNA, 22 nt, Human
aauccagguggcggagguugug

SEQ ID NO: 308052 - RNA, 22 nt, Human
aguuauucauuuauucuguaca

SEQ ID NO: 308053 - RNA, 22 nt, Human
uguacaguguagucaugagguu

SEQ ID NO: 308054 - RNA, 20 nt, Human
auaauuuacccugcaccacu

SEQ ID NO: 308055 - RNA, 22 nt, Human
ucccagcauuaaugccugucag

SEQ ID NO: 308056 - RNA, 22 nt, Human
aagcugccuuccaugugaggaa

SEQ ID NO: 308057 - RNA, 19 nt, Human
gagcacagcggcauuuggu

SEQ ID NO: 308058 - RNA, 22 nt, Human
auuaaagacagcagauggaugg

SEQ ID NO: 308059 - RNA, 21 nt, Human
agugaaauugcaucagaggga

SEQ ID NO: 308060 - RNA, 16 nt, Human
gagggcagaggcggaa

SEQ ID NO: 308061 - RNA, 22 nt, Human
gacccugccaugagugacaggg

SEQ ID NO: 308062 - RNA, 22 nt, Human
gaccauuucuaggaaucagacu

SEQ ID NO: 308063 - RNA, 22 nt, Human
uuuaaauucugucugccgcuua

SEQ ID NO: 308064 - RNA, 22 nt, Human
ucagcugccccaguggccccag

SEQ ID NO: 308065 - RNA, 19 nt, Human
aggcugcaagguggugggc

SEQ ID NO: 308066 - RNA, 22 nt, Human
aaaugucuuucaauagagaaau

SEQ ID NO: 308067 - RNA, 19 nt, Human
uggcagggagaguuugaag

SEQ ID NO: 308068 - RNA, 22 nt, Human
cugcuuuguguggucccuccag

SEQ ID NO: 308069 - RNA, 22 nt, Human
acaguguucucuuccuguauag

SEQ ID NO: 308070 - RNA, 22 nt, Human
uuauguaccugaauuaguaaag

SEQ ID NO: 308071 - RNA, 22 nt, Human
uucuguuuuagaaauaaguagu

SEQ ID NO: 308072 - RNA, 22 nt, Human
aggcccuguuaugagccacugu

SEQ ID NO: 308073 - RNA, 22 nt, Human
gugccucagcaccgccugcagc

SEQ ID NO: 308074 - RNA, 21 nt, Human
uaaaagaugacaagacagcuc

SEQ ID NO: 308075 - RNA, 22 nt, Human
caggcacuguguuaggcacugu

SEQ ID NO: 308076 - RNA, 22 nt, Human
auaguauuuaauaguuagcuca

SEQ ID NO: 308077 - RNA, 22 nt, Human
auuucugauaaacguaagcugc

SEQ ID NO: 308078 - RNA, 22 nt, Human
cucaggccuugaagucuuuucu

SEQ ID NO: 308079 - RNA, 22 nt, Human
caggcagcaucagucugcugua

SEQ ID NO: 308080 - RNA, 22 nt, Human
agagacaggauaucugcucaug

SEQ ID NO: 308081 - RNA, 22 nt, Human
auucuucaccauggauaauuug

SEQ ID NO: 308082 - RNA, 22 nt, Human
ccuguucacgguguguuguuag

SEQ ID NO: 308083 - RNA, 22 nt, Human
caaauguauaaauguacuuucu

SEQ ID NO: 308084 - RNA, 22 nt, Human
ugguuucccauuaucugcagga

SEQ ID NO: 308085 - RNA, 22 nt, Human
ucucuuucuauaugugagucuu

SEQ ID NO: 308086 - RNA, 22 nt, Human
ugaaaugagcauuuauucuuua

SEQ ID NO: 308087 - RNA, 22 nt, Human
guccucugggcagcugccccac

SEQ ID NO: 308088 - RNA, 22 nt, Human
guggaggacaaaagaagccuuu

SEQ ID NO: 308089 - RNA, 22 nt, Human
ugcauguguguguauuuauaaa

SEQ ID NO: 308090 - RNA, 22 nt, Human
ucucucuuuuuaaucauguaau

SEQ ID NO: 308091 - RNA, 22 nt, Human
uccagccuuucuacucacugag

SEQ ID NO: 308092 - RNA, 22 nt, Human
ccuguucacuuugacuucucca

SEQ ID NO: 308093 - RNA, 22 nt, Human
agagccagcauuugacacuggc

SEQ ID NO: 308094 - RNA, 22 nt, Human
ugcauugcauuugucaugaaga

SEQ ID NO: 308095 - RNA, 22 nt, Human
ccugcuggccaguggagggcug

SEQ ID NO: 308096 - RNA, 22 nt, Human
aacaggagaguaaauauaugau

SEQ ID NO: 308097 - RNA, 22 nt, Human
gucuucuuguguugccugucuu

SEQ ID NO: 308098 - RNA, 22 nt, Human
ccugcuggccacugcuccaccu

SEQ ID NO: 308099 - RNA, 23 nt, Human
acagagguccaaacaguauaagc

SEQ ID NO: 308100 - RNA, 22 nt, Human
gggcuggucuggcuuagucagg

SEQ ID NO: 308101 - RNA, 22 nt, Human
agauaaaaugguucaaaggcua

SEQ ID NO: 308102 - RNA, 22 nt, Human
agccacagucugaugccugaga

SEQ ID NO: 308103 - RNA, 22 nt, Human
aguuugaauugaaaugcagaug

SEQ ID NO: 308104 - RNA, 22 nt, Human
agugaaauccuggucaacaggu

SEQ ID NO: 308105 - RNA, 22 nt, Human
ggaggccaaggcagguggauca

SEQ ID NO: 308106 - RNA, 22 nt, Human
ucagggcauacucuucaagguc

SEQ ID NO: 308107 - RNA, 22 nt, Human
uggcccugaggggcugugcccc

SEQ ID NO: 308108 - RNA, 22 nt, Human
auuugaagucuucaugauuucu

SEQ ID NO: 308109 - RNA, 22 nt, Human
auuucccaugugaaucaauugg

SEQ ID NO: 308110 - RNA, 23 nt, Human
acagaaaucauuuguaagguacc

SEQ ID NO: 308111 - RNA, 22 nt, Human
ugucuucaucucagacacaguu

SEQ ID NO: 308112 - RNA, 19 nt, Human
ugccuggacaaaugugggg

SEQ ID NO: 308113 - RNA, 22 nt, Human
gggugggguucaggaaucuuca

SEQ ID NO: 308114 - RNA, 22 nt, Human
cuggccuuuagccccagugucu

SEQ ID NO: 308115 - RNA, 22 nt, Human
augagcugugggauuccagagg

SEQ ID NO: 308116 - RNA, 22 nt, Human
uauuccagugugaucuuuguag

SEQ ID NO: 308117 - RNA, 22 nt, Human
agggagcugcucugcuuccgug

SEQ ID NO: 308118 - RNA, 22 nt, Human
auaaggcauauagucacuuuuu

SEQ ID NO: 308119 - RNA, 22 nt, Human
ugaaaugaucaguuugguuacu

SEQ ID NO: 308120 - RNA, 22 nt, Human
gagaaccucuccacaagucugg

SEQ ID NO: 308121 - RNA, 22 nt, Human
ucaaugauaguacaaucagccu

SEQ ID NO: 308122 - RNA, 22 nt, Human
gcauguguugguuuaugcaugu

SEQ ID NO: 308123 - RNA, 22 nt, Human
cugagagugcucuuugauguca

SEQ ID NO: 308124 - RNA, 22 nt, Human
cugcccagaaucacucacucga

SEQ ID NO: 308125 - RNA, 22 nt, Human
uacaaaaguaauuacgguuuuu

SEQ ID NO: 308126 - RNA, 22 nt, Human
gaccuggaggauccucuucuug

SEQ ID NO: 308127 - RNA, 22 nt, Human
ccuuuugcucucccauccagaa

SEQ ID NO: 308128 - RNA, 22 nt, Human
caggauggucuucauuuggcuc

SEQ ID NO: 308129 - RNA, 21 nt, Human
auggagccuaagaguggaggu

SEQ ID NO: 308130 - RNA, 22 nt, Human
ucacaguaaaagcauggaagag

SEQ ID NO: 308131 - RNA, 22 nt, Human
aucauuacuccuguaaaauugu

SEQ ID NO: 308132 - RNA, 22 nt, Human
cugggcacacagugacucugca

SEQ ID NO: 308133 - RNA, 18 nt, Human
uuucacaaccuccagagg

SEQ ID NO: 308134 - RNA, 22 nt, Human
agggcugccugacuccagagcc

SEQ ID NO: 308135 - RNA, 22 nt, Human
agagccagcauuugggcccugc

SEQ ID NO: 308136 - RNA, 22 nt, Human
ugaaggaaugaguauacuguuu

SEQ ID NO: 308137 - RNA, 22 nt, Human
aggguggcaguuacuggagcaa

SEQ ID NO: 308138 - RNA, 18 nt, Human
cuguucuagaacuccugu

SEQ ID NO: 308139 - RNA, 22 nt, Human
aaaugcacaauaaaguaaaggc

SEQ ID NO: 308140 - RNA, 22 nt, Human
uauuuaguuaucuuucauaaaa

SEQ ID NO: 308141 - RNA, 22 nt, Human
uuuucaguuccaucucugcucu

SEQ ID NO: 308142 - RNA, 22 nt, Human
cugcugugcaggugccuaugau

SEQ ID NO: 308143 - RNA, 22 nt, Human
ugaagccaucccucagauggcc

SEQ ID NO: 308144 - RNA, 22 nt, Human
gccuggagcuacuggacacuga

SEQ ID NO: 308145 - RNA, 22 nt, Human
ggccugagcagacagcaugaug

SEQ ID NO: 308146 - RNA, 21 nt, Human
ugccagggauuuacagagccu

SEQ ID NO: 308147 - RNA, 22 nt, Human
uccucuggcccagcugccucug

SEQ ID NO: 308148 - RNA, 22 nt, Human
uccucaggagagcuccuaugcc

SEQ ID NO: 308149 - RNA, 22 nt, Human
agauuuccaucuuuuucaugug

SEQ ID NO: 308150 - RNA, 22 nt, Human
ugggcaaguaucggacucugag

SEQ ID NO: 308151 - RNA, 22 nt, Human
ccaaagugcugagauuacaggu

SEQ ID NO: 308152 - RNA, 22 nt, Human
cuggggaggcagggcugccccu

SEQ ID NO: 308153 - RNA, 22 nt, Human
uggcucaguuaggucagaaaca

SEQ ID NO: 308154 - RNA, 22 nt, Human
gggcuacagacaugcucuaagc

SEQ ID NO: 308155 - RNA, 22 nt, Human
ucucaggaucuaauacauggua

SEQ ID NO: 308156 - RNA, 22 nt, Human
cuggagccacugggucuuguau

SEQ ID NO: 308157 - RNA, 20 nt, Human
cacugaagacuucuugcuca

SEQ ID NO: 308158 - RNA, 21 nt, Human
agcagaggcagaauguaugca

SEQ ID NO: 308159 - RNA, 17 nt, Human
ugagcaguagaagaugc

SEQ ID NO: 308160 - RNA, 22 nt, Human
ugccuuccuggagcugaaggcu

SEQ ID NO: 308161 - RNA, 22 nt, Human
aagggcaggagaagacggauau

SEQ ID NO: 308162 - RNA, 22 nt, Human
agguggagaagagaugggcagu

SEQ ID NO: 308163 - RNA, 22 nt, Human
uuucaucuaacacuacauaggg

SEQ ID NO: 308164 - RNA, 22 nt, Human
acucugaggagugacuagaggu

SEQ ID NO: 308165 - RNA, 22 nt, Human
aggccagaaauuuggaguaugu

SEQ ID NO: 308166 - RNA, 22 nt, Human
caugggcuacagaagcaugcug

SEQ ID NO: 308167 - RNA, 22 nt, Human
gaaggaagucauuagugcagac

SEQ ID NO: 308168 - RNA, 22 nt, Human
ucuuaaaaguaugccaauugga

SEQ ID NO: 308169 - RNA, 22 nt, Human
acagccauagaugcuuauguaa

SEQ ID NO: 308170 - RNA, 22 nt, Human
uuggcuucucuuaacccuaaag

SEQ ID NO: 308171 - RNA, 22 nt, Human
aagauggcuuagaguccuggug

SEQ ID NO: 308172 - RNA, 21 nt, Human
uuccagagauuguuucaccug

SEQ ID NO: 308173 - RNA, 22 nt, Human
gcaguguuuggauccauagcga

SEQ ID NO: 308174 - RNA, 22 nt, Human
aggcugggcuccgcccaacucc

SEQ ID NO: 308175 - RNA, 22 nt, Human
caggacagguguucuagaucag

SEQ ID NO: 308176 - RNA, 22 nt, Human
ccaggccuccugugaguggacc

SEQ ID NO: 308177 - RNA, 22 nt, Human
gggagggauuaguucugccugg

SEQ ID NO: 308178 - RNA, 22 nt, Human
aaauguguuucgaaaacuggug

SEQ ID NO: 308179 - RNA, 22 nt, Human
cacucccucuaguugcauucug

SEQ ID NO: 308180 - RNA, 22 nt, Human
ggcucugcuucagaaggcucau

SEQ ID NO: 308181 - RNA, 22 nt, Human
ugacagggcuagaggcaaugca

SEQ ID NO: 308182 - RNA, 22 nt, Human
agagcagccugugaugaugcac

SEQ ID NO: 308183 - RNA, 22 nt, Human
gcagcugggccccagccucucc

SEQ ID NO: 308184 - RNA, 22 nt, Human
acugagcugcuugaagugaacu

SEQ ID NO: 308185 - RNA, 22 nt, Human
auguguauacuugugcuuacuc

SEQ ID NO: 308186 - RNA, 22 nt, Human
uuugauaguugauuaaauucca

SEQ ID NO: 308187 - RNA, 22 nt, Human
ugacauaauaauccaaacauac

SEQ ID NO: 308188 - RNA, 22 nt, Human
cugaggccucucuccugggcuu

SEQ ID NO: 308189 - RNA, 20 nt, Human
ugcucaggauggagaggugu

SEQ ID NO: 308190 - RNA, 22 nt, Human
uuuaagacuuagauuuauuggg

SEQ ID NO: 308191 - RNA, 22 nt, Human
augugaaacugaagcauccaua

SEQ ID NO: 308192 - RNA, 22 nt, Human
cuggugggagcagcaggcagcu

SEQ ID NO: 308193 - RNA, 22 nt, Human
aagggagcuuaggagaucaggc

SEQ ID NO: 308194 - RNA, 22 nt, Human
uagggcaguuauaacauuagug

SEQ ID NO: 308195 - RNA, 22 nt, Human
agugaaaugacugaaucagaua

SEQ ID NO: 308196 - RNA, 22 nt, Human
ugucaccagcugcuccucagga

SEQ ID NO: 308197 - RNA, 22 nt, Human
ucagcuuggacagcuugguuga

SEQ ID NO: 308198 - RNA, 22 nt, Human
aguggcagagccaaguagagcc

SEQ ID NO: 308199 - RNA, 19 nt, Human
uagcagcugccaaaggaga

SEQ ID NO: 308200 - RNA, 22 nt, Human
uauauguaagcuauguaagagu

SEQ ID NO: 308201 - RNA, 22 nt, Human
ucagcaauccucccacaggugg

SEQ ID NO: 308202 - RNA, 22 nt, Human
auuuaagacugacuucaccagu

SEQ ID NO: 308203 - RNA, 22 nt, Human
aaugcacagcguuccaugcuug

SEQ ID NO: 308204 - RNA, 22 nt, Human
ugcuguuauacuuagcugguua

SEQ ID NO: 308205 - RNA, 22 nt, Human
gccuucccacccugcgaggcug

SEQ ID NO: 308206 - RNA, 22 nt, Human
auuaucuauguagaaugauuuu

SEQ ID NO: 308207 - RNA, 22 nt, Human
cccucuggcucuucucaggccg

SEQ ID NO: 308208 - RNA, 21 nt, Human
agaaauguaucauucuuuucc

SEQ ID NO: 308209 - RNA, 22 nt, Human
uuuuaucaaucauuaagacauu

SEQ ID NO: 308210 - RNA, 20 nt, Human
cuuuggcaaugagaacaggg

SEQ ID NO: 308211 - RNA, 22 nt, Human
cugccuggcuaaacucaagucg

SEQ ID NO: 308212 - RNA, 22 nt, Human
ugcuggcucaguuugcagacuc

SEQ ID NO: 308213 - RNA, 22 nt, Human
cugugccaggcccagcugacuu

SEQ ID NO: 308214 - RNA, 22 nt, Human
auuccaguucuccucucuaaag

SEQ ID NO: 308215 - RNA, 22 nt, Human
ugaguaauaaacugucuugcuc

SEQ ID NO: 308216 - RNA, 22 nt, Human
caguuuuuagauuaguuggugg

SEQ ID NO: 308217 - RNA, 22 nt, Human
auguacaaaaugccacugaauu

SEQ ID NO: 308218 - RNA, 22 nt, Human
uagcauuucccaaaugcauuug

SEQ ID NO: 308219 - RNA, 17 nt, Human
aggcuggcucacaggga

SEQ ID NO: 308220 - RNA, 22 nt, Human
ccucagccuuggccccaggcag

SEQ ID NO: 308221 - RNA, 22 nt, Human
ggagacacuggaaaguauuaca

SEQ ID NO: 308222 - RNA, 22 nt, Human
acauaccauacauggugagaug

SEQ ID NO: 308223 - RNA, 22 nt, Human
ggcagccagagggcagcuggau

SEQ ID NO: 308224 - RNA, 22 nt, Human
gcccuuggaacagccuccugcu

SEQ ID NO: 308225 - RNA, 22 nt, Human
ugcaggccucacaccuggcacc

SEQ ID NO: 308226 - RNA, 22 nt, Human
agugcugaagacuggcuaggga

SEQ ID NO: 308227 - RNA, 22 nt, Human
aaggagaguacaggaguuggua

SEQ ID NO: 308228 - RNA, 22 nt, Human
gcugcccucccagggcaagcuu

SEQ ID NO: 308229 - RNA, 22 nt, Human
aagcagcuuaaauuagagccug

SEQ ID NO: 308230 - RNA, 22 nt, Human
ccuggcagcauugguagagauu

SEQ ID NO: 308231 - RNA, 22 nt, Human
cucugggcaccaaagagcagcu

SEQ ID NO: 308232 - RNA, 19 nt, Human
cuuccuugcuccccaugug

SEQ ID NO: 308233 - RNA, 22 nt, Human
cagccagguaugggcgugcggg

SEQ ID NO: 308234 - RNA, 22 nt, Human
aaugaacacagcccucuacuuu

SEQ ID NO: 308235 - RNA, 22 nt, Human
agcauuuauuucuuagaaauug

SEQ ID NO: 308236 - RNA, 18 nt, Human
aagccagagaccacugcc

SEQ ID NO: 308237 - RNA, 22 nt, Human
cugggcuccuaaccauccaggu

SEQ ID NO: 308238 - RNA, 22 nt, Human
uuccagugaugggcaauuuggu

SEQ ID NO: 308239 - RNA, 22 nt, Human
uugcaaaggggaauaaagcaau

SEQ ID NO: 308240 - RNA, 18 nt, Human
agcuggcccuggcugccg

SEQ ID NO: 308241 - RNA, 22 nt, Human
aaggagcuuguucgccuuccuc

SEQ ID NO: 308242 - RNA, 22 nt, Human
cauacuuuugcccugacauucu

SEQ ID NO: 308243 - RNA, 22 nt, Human
uaacagaaaggggacagaaaua

SEQ ID NO: 308244 - RNA, 22 nt, Human
gccaagagaaugugagagaaau

SEQ ID NO: 308245 - RNA, 21 nt, Human
ugcagcagaguaagcagggga

SEQ ID NO: 308246 - RNA, 22 nt, Human
ugcagccaucuuucuuggagga

SEQ ID NO: 308247 - RNA, 22 nt, Human
cauuuacuuaaaucuuuacaag

SEQ ID NO: 308248 - RNA, 22 nt, Human
caaauucucacccuguuugauu

SEQ ID NO: 308249 - RNA, 22 nt, Human
aaacuuuaagacaguccucaag

SEQ ID NO: 308250 - RNA, 20 nt, Human
gagauggacagaugaagggg

SEQ ID NO: 308251 - RNA, 22 nt, Human
cugaagaugucugagaugcuca

SEQ ID NO: 308252 - RNA, 22 nt, Human
ugccugccaugcagaaagcuga

SEQ ID NO: 308253 - RNA, 21 nt, Human
gcucccuggcugugugaccug

SEQ ID NO: 308254 - RNA, 22 nt, Human
ucuggccuauuucugucagauc

SEQ ID NO: 308255 - RNA, 22 nt, Human
ccuggcugggguagaagugagg

SEQ ID NO: 308256 - RNA, 22 nt, Human
ucagggcugcagaagaggcagg

SEQ ID NO: 308257 - RNA, 22 nt, Human
aggcccaguuauccuacuuguu

SEQ ID NO: 308258 - RNA, 22 nt, Human
ugcagcugguuuagaacuagau

SEQ ID NO: 308259 - RNA, 22 nt, Human
agcuguguguuuccacugagcu

SEQ ID NO: 308260 - RNA, 22 nt, Human
augcuuuacaguuuuccaaaca

SEQ ID NO: 308261 - RNA, 22 nt, Human
ucuggaguccagauccauuugg

SEQ ID NO: 308262 - RNA, 22 nt, Human
cagcuucucagaaagcugaggu

SEQ ID NO: 308263 - RNA, 22 nt, Human
gcaguggggaaugcuggggaga

SEQ ID NO: 308264 - RNA, 22 nt, Human
ucagagugguagccuauuuucu

SEQ ID NO: 308265 - RNA, 22 nt, Human
uggcagcauuuuuuccagaaca

SEQ ID NO: 308266 - RNA, 22 nt, Human
gcuuuauguaaguccaaaggca

SEQ ID NO: 308267 - RNA, 22 nt, Human
ugggugggagcgcccugucugg

SEQ ID NO: 308268 - RNA, 22 nt, Human
ugcuuuuaagaacaaugcugcu

SEQ ID NO: 308269 - RNA, 22 nt, Human
uuguaaaugaccuuuucuaauu

SEQ ID NO: 308270 - RNA, 22 nt, Human
cuaauacacccuauugcuuguu

SEQ ID NO: 308271 - RNA, 22 nt, Human
caagaaauguuuacugagcauc

SEQ ID NO: 308272 - RNA, 23 nt, Human
ggcagcucucaucugaugacuga

SEQ ID NO: 308273 - RNA, 22 nt, Human
gcuggccacacugcugauggag

SEQ ID NO: 308274 - RNA, 22 nt, Human
agggacuuguguccuauguaug

SEQ ID NO: 308275 - RNA, 22 nt, Human
uggcugaacuaaugugcuguuu

SEQ ID NO: 308276 - RNA, 22 nt, Human
ucaggauccauagacucccaaa

SEQ ID NO: 308277 - RNA, 21 nt, Human
ugagccaggcugacggcugug

SEQ ID NO: 308278 - RNA, 19 nt, Human
ugucccagacuccgugucu

SEQ ID NO: 308279 - RNA, 22 nt, Human
ccuguguggccaggcuggaguc

SEQ ID NO: 308280 - RNA, 21 nt, Human
aagagcuggaucaaggauaag

SEQ ID NO: 308281 - RNA, 22 nt, Human
acacagggaggaggugcugugc

SEQ ID NO: 308282 - RNA, 22 nt, Human
ugugaggagaggcccagcuccc

SEQ ID NO: 308283 - RNA, 22 nt, Human
uucagcaagaccaccauguacc

SEQ ID NO: 308284 - RNA, 19 nt, Human
ucugucacuggggguauuc

SEQ ID NO: 308285 - RNA, 22 nt, Human
caggaacagcaccaggagcuag

SEQ ID NO: 308286 - RNA, 22 nt, Human
ggguggaguagaaagaugaauu

SEQ ID NO: 308287 - RNA, 22 nt, Human
gucccagggaugcagacaugag

SEQ ID NO: 308288 - RNA, 22 nt, Human
uccacccccagacagcugguga

SEQ ID NO: 308289 - RNA, 22 nt, Human
caggcagcgcucguggccuggc

SEQ ID NO: 308290 - RNA, 22 nt, Human
uggcucucagcucccagcagcc

SEQ ID NO: 308291 - RNA, 22 nt, Human
aauucauccaugaacaauucca

SEQ ID NO: 308292 - RNA, 22 nt, Human
gcuggugccuuguuguuguuac

SEQ ID NO: 308293 - RNA, 19 nt, Human
aagcagcccuggcaagagc

SEQ ID NO: 308294 - RNA, 22 nt, Human
cugcuguggccagccaggucaa

SEQ ID NO: 308295 - RNA, 20 nt, Human
ugacucugcaaccgucucuc

SEQ ID NO: 308296 - RNA, 22 nt, Human
aaaugucuuucuucugcuacgu

SEQ ID NO: 308297 - RNA, 22 nt, Human
aggagcugcagauucugccuug

SEQ ID NO: 308298 - RNA, 22 nt, Human
gaaauauuguacuggagauguu

SEQ ID NO: 308299 - RNA, 22 nt, Human
uggccugaauuauggcagaucu

SEQ ID NO: 308300 - RNA, 22 nt, Human
ugcagagguguugcugagauaa

SEQ ID NO: 308301 - RNA, 22 nt, Human
caguguguggauccucccagga

SEQ ID NO: 308302 - RNA, 22 nt, Human
agguaagggucacaguucauau

SEQ ID NO: 308303 - RNA, 22 nt, Human
gggcaguggguggcugcagccu

SEQ ID NO: 308304 - RNA, 22 nt, Human
gcagcugccccgacugugaguc

SEQ ID NO: 308305 - RNA, 22 nt, Human
acucagaaugacugaugcugug

SEQ ID NO: 308306 - RNA, 22 nt, Human
ugagaaagguauuucaugcacu

SEQ ID NO: 308307 - RNA, 22 nt, Human
ccaggacuuauuacaguauaac

SEQ ID NO: 308308 - RNA, 23 nt, Human
ccuucagaagaaguaacaggggc

SEQ ID NO: 308309 - RNA, 22 nt, Human
acagaaugcguagugcauguug

SEQ ID NO: 308310 - RNA, 22 nt, Human
ugccucugugugcaggugagca

SEQ ID NO: 308311 - RNA, 22 nt, Human
agggacacaugugauuauuuau

SEQ ID NO: 308312 - RNA, 22 nt, Human
ccugaggcuuaaucugucccaa

SEQ ID NO: 308313 - RNA, 22 nt, Human
gggccuggggacaccaccauga

SEQ ID NO: 308314 - RNA, 22 nt, Human
ccuccuggcccugggccuggaa

SEQ ID NO: 308315 - RNA, 22 nt, Human
ugccugugguuccaguuuuuuc

SEQ ID NO: 308316 - RNA, 22 nt, Human
aggcaguguguagcuggaagag

SEQ ID NO: 308317 - RNA, 21 nt, Human
augugaaauaucaucagagca

SEQ ID NO: 308318 - RNA, 22 nt, Human
gucugcugcagagcauggcuuu

SEQ ID NO: 308319 - RNA, 22 nt, Human
agagcuuagaauuucagaugau

SEQ ID NO: 308320 - RNA, 22 nt, Human
agggucugacuccucuggcaag

SEQ ID NO: 308321 - RNA, 18 nt, Human
uuccaugauuccuuucac

SEQ ID NO: 308322 - RNA, 21 nt, Human
ucucugguuggaguugugcca

SEQ ID NO: 308323 - RNA, 22 nt, Human
acauuucugcaucucagagcua

SEQ ID NO: 308324 - RNA, 22 nt, Human
cagcagggggcagcgcagauca

SEQ ID NO: 308325 - RNA, 22 nt, Human
ucaguuuucucaucugugaaau

SEQ ID NO: 308326 - RNA, 22 nt, Human
cugcuucuaagaaccugcagcu

SEQ ID NO: 308327 - RNA, 22 nt, Human
auggccugggcccgcuucagau

SEQ ID NO: 308328 - RNA, 22 nt, Human
agugccuggcacauggaaggug

SEQ ID NO: 308329 - RNA, 22 nt, Human
acuagauaauuauaaaagguag

SEQ ID NO: 308330 - RNA, 22 nt, Human
guggccucuguuggcuccuagg

SEQ ID NO: 308331 - RNA, 22 nt, Human
uguuccaugucuuuguaggacu

SEQ ID NO: 308332 - RNA, 22 nt, Human
agagaagacuuacagccacagu

SEQ ID NO: 308333 - RNA, 22 nt, Human
uuccucuguaguugcugaugaa

SEQ ID NO: 308334 - RNA, 22 nt, Human
uuguauuagcuguaaauuuucu

SEQ ID NO: 308335 - RNA, 22 nt, Human
aucaggauucaguaucuccagc

SEQ ID NO: 308336 - RNA, 22 nt, Human
ucauaaaugcagugucauaaau

SEQ ID NO: 308337 - RNA, 22 nt, Human
caugcugugugguuagaacugu

SEQ ID NO: 308338 - RNA, 22 nt, Human
gggagggaaggaggcgccgugu

SEQ ID NO: 308339 - RNA, 22 nt, Human
gcugccaugccacagcacucac

SEQ ID NO: 308340 - RNA, 22 nt, Human
ccaguguucaguaugcauuaag

SEQ ID NO: 308341 - RNA, 22 nt, Human
ugccugaggagucagggcaggu

SEQ ID NO: 308342 - RNA, 22 nt, Human
uaggaaauggcucaguuacugc

SEQ ID NO: 308343 - RNA, 22 nt, Human
cugucacacugauaucaggcuu

SEQ ID NO: 308344 - RNA, 23 nt, Human
cucccuggaguuucuggaagaug

SEQ ID NO: 308345 - RNA, 22 nt, Human
uucuuuucuuuaggcauugugu

SEQ ID NO: 308346 - RNA, 22 nt, Human
uauguacagggauagaacuuga

SEQ ID NO: 308347 - RNA, 22 nt, Human
cagcccuggcccaggugccuua

SEQ ID NO: 308348 - RNA, 22 nt, Human
gcaguccucucauuggccuccu

SEQ ID NO: 308349 - RNA, 22 nt, Human
aggcuuccucgugccuuagaua

SEQ ID NO: 308350 - RNA, 22 nt, Human
ucucaagaucucaagauggccc

SEQ ID NO: 308351 - RNA, 22 nt, Human
gaaggccacaaaaaaugucaua

SEQ ID NO: 308352 - RNA, 22 nt, Human
agccaggcugcaguuggcuggc

SEQ ID NO: 308353 - RNA, 22 nt, Human
caggcugcagaggccuuucaug

SEQ ID NO: 308354 - RNA, 22 nt, Human
ccagcugcaggggagcagugga

SEQ ID NO: 308355 - RNA, 22 nt, Human
cccagccugaucucggccagcu

SEQ ID NO: 308356 - RNA, 22 nt, Human
ggcaaggccuugcccagcauuc

SEQ ID NO: 308357 - RNA, 22 nt, Human
aggccagcccucaccuguguuc

SEQ ID NO: 308358 - RNA, 20 nt, Human
uguuaaaggacacuugcuuu

SEQ ID NO: 308359 - RNA, 22 nt, Human
ucagagcuuaucucuugcugga

SEQ ID NO: 308360 - RNA, 22 nt, Human
agaccauggccauccuaggaaa

SEQ ID NO: 308361 - RNA, 22 nt, Human
caaggaaaacagaugaucaaca

SEQ ID NO: 308362 - RNA, 22 nt, Human
auucauaacggcaaaugucacc

SEQ ID NO: 308363 - RNA, 22 nt, Human
gccagcaguccugcugugugcc

SEQ ID NO: 308364 - RNA, 19 nt, Human
gagcccucuccauggccac

SEQ ID NO: 308365 - RNA, 22 nt, Human
auguuacacauaggcauaaaug

SEQ ID NO: 308366 - RNA, 22 nt, Human
gacugucauucuagugcccaug

SEQ ID NO: 308367 - RNA, 22 nt, Human
aggggaggagcuuuucuugccu

SEQ ID NO: 308368 - RNA, 20 nt, Human
agucucuguagugccugaga

SEQ ID NO: 308369 - RNA, 22 nt, Human
gugucccaauguucaggacggc

SEQ ID NO: 308370 - RNA, 22 nt, Human
ugcuauugugaacagugccaca

SEQ ID NO: 308371 - RNA, 22 nt, Human
cauuuguaguuaaaaaugucuc

SEQ ID NO: 308372 - RNA, 22 nt, Human
gccaggcauuuguuaggugcug

SEQ ID NO: 308373 - RNA, 22 nt, Human
aguguccccuccaagggccugg

SEQ ID NO: 308374 - RNA, 22 nt, Human
uaacagaagaaaacauauugga

SEQ ID NO: 308375 - RNA, 22 nt, Human
ccaguguugcauaggaugggga

SEQ ID NO: 308376 - RNA, 22 nt, Human
ugcugccauggucgcugguguc

SEQ ID NO: 308377 - RNA, 22 nt, Human
uuuuucaagacaaccugcaugu

SEQ ID NO: 308378 - RNA, 22 nt, Human
gcugucccaugguugcaagaug

SEQ ID NO: 308379 - RNA, 22 nt, Human
cccaggcuggagugcaauggug

SEQ ID NO: 308380 - RNA, 22 nt, Human
ccaggagcaacuugaaggcaag

SEQ ID NO: 308381 - RNA, 21 nt, Human
ccagagccugcugagcccccu

SEQ ID NO: 308382 - RNA, 22 nt, Human
ggccccagauucugggcugggu

SEQ ID NO: 308383 - RNA, 22 nt, Human
ccagcagcucccucaggguccg

SEQ ID NO: 308384 - RNA, 22 nt, Human
gcucagggaacuuuuugcaggc

SEQ ID NO: 308385 - RNA, 22 nt, Human
gagagugaggccugggaaucua

SEQ ID NO: 308386 - RNA, 22 nt, Human
gaagagcugcucagaacaugau

SEQ ID NO: 308387 - RNA, 22 nt, Human
gcagcaggcuuuucauaccuug

SEQ ID NO: 308388 - RNA, 22 nt, Human
aagcugccagauucagucugcu

SEQ ID NO: 308389 - RNA, 17 nt, Human
auccccagcaucuagaa

SEQ ID NO: 308390 - RNA, 22 nt, Human
agggacugagcuaggaucuagu

SEQ ID NO: 308391 - RNA, 20 nt, Human
agcuucuucugucuaauuuu

SEQ ID NO: 308392 - RNA, 22 nt, Human
gcaggggaguggcaggcccgga

SEQ ID NO: 308393 - RNA, 22 nt, Human
caggggcaggugugagaucauc

SEQ ID NO: 308394 - RNA, 17 nt, Human
ccagggaggggccgcgc

SEQ ID NO: 308395 - RNA, 22 nt, Human
gcauguguggaggagaugugcu

SEQ ID NO: 308396 - RNA, 22 nt, Human
uacauauuugucuuuguacugu

SEQ ID NO: 308397 - RNA, 22 nt, Human
cccagcucuuccugggagcuaa

SEQ ID NO: 308398 - RNA, 22 nt, Human
ucuuccaagguugcacacuauc

SEQ ID NO: 308399 - RNA, 22 nt, Human
agaaauuccuaagguacacaag

SEQ ID NO: 308400 - RNA, 22 nt, Human
ggugccagccuagugcaguggu

SEQ ID NO: 308401 - RNA, 22 nt, Human
uggccugauuuugcuaagagaa

SEQ ID NO: 308402 - RNA, 22 nt, Human
cuuagaaaucgaacucagguua

SEQ ID NO: 308403 - RNA, 22 nt, Human
uugcuuccucgaggccagcgug

SEQ ID NO: 308404 - RNA, 22 nt, Human
acagcacaaucugagucccaga

SEQ ID NO: 308405 - RNA, 19 nt, Human
ucugugcugggaggcagca

SEQ ID NO: 308406 - RNA, 21 nt, Human
acagucuccccagaucucucc

SEQ ID NO: 308407 - RNA, 21 nt, Human
caggaaaagcggaagucuagc

SEQ ID NO: 308408 - RNA, 22 nt, Human
uacaugcaugucacagaaugaa

SEQ ID NO: 308409 - RNA, 22 nt, Human
aaaguauucuugacuguuuuuc

SEQ ID NO: 308410 - RNA, 23 nt, Human
uggggcugauggagacggaccag

SEQ ID NO: 308411 - RNA, 22 nt, Human
augaaauugaucuugaacuuuu

SEQ ID NO: 308412 - RNA, 22 nt, Human
uggaccugcuggaugggcaggu

SEQ ID NO: 308413 - RNA, 22 nt, Human
ccagcugcugugaggaccacag

SEQ ID NO: 308414 - RNA, 22 nt, Human
ucucagccucaccucuauggag

SEQ ID NO: 308415 - RNA, 21 nt, Human
agcagagugcuuugacuuugu

SEQ ID NO: 308416 - RNA, 22 nt, Human
ccaggccuuccaguacgcagaa

SEQ ID NO: 308417 - RNA, 22 nt, Human
uccucagaaaccccugugaggu

SEQ ID NO: 308418 - RNA, 22 nt, Human
gcagggcuguucaggagggugg

SEQ ID NO: 308419 - RNA, 22 nt, Human
ggcagccauggacacuggcuag

SEQ ID NO: 308420 - RNA, 22 nt, Human
ugcuuuauguuaucagaagggu

SEQ ID NO: 308421 - RNA, 22 nt, Human
ucacugcucuccaauguggagu

SEQ ID NO: 308422 - RNA, 22 nt, Human
aucagcaaucucguguauuagg

SEQ ID NO: 308423 - RNA, 22 nt, Human
uucuacagacuauaacugugau

SEQ ID NO: 308424 - RNA, 22 nt, Human
ugugccaggcacuugcccaggc

SEQ ID NO: 308425 - RNA, 19 nt, Human
ugcucauggggacuucucc

SEQ ID NO: 308426 - RNA, 18 nt, Human
aggcacuggaauuaaggg

SEQ ID NO: 308427 - RNA, 22 nt, Human
uccaagggcagccauagaacuu

SEQ ID NO: 308428 - RNA, 18 nt, Human
ucugagggugcgggagcu

SEQ ID NO: 308429 - RNA, 22 nt, Human
cugucccucaguucugggcaaa

SEQ ID NO: 308430 - RNA, 22 nt, Human
uccugccuaccuugcggaggug

SEQ ID NO: 308431 - RNA, 22 nt, Human
ugcagcuucuccaucuccuugu

SEQ ID NO: 308432 - RNA, 22 nt, Human
ggucccugaagaggccuggggu

SEQ ID NO: 308433 - RNA, 22 nt, Human
ucccagggacaccaagcuguuu

SEQ ID NO: 308434 - RNA, 22 nt, Human
acugcuuuucagagucugccug

SEQ ID NO: 308435 - RNA, 22 nt, Human
acuauaaaaggauaaaccagaa

SEQ ID NO: 308436 - RNA, 23 nt, Human
ccagccucugggucuucauccag

SEQ ID NO: 308437 - RNA, 22 nt, Human
uucucaguaugugacgaggacc

SEQ ID NO: 308438 - RNA, 22 nt, Human
ugacuuccugcacucaggugau

SEQ ID NO: 308439 - RNA, 22 nt, Human
agccacccauucccgagcccua

SEQ ID NO: 308440 - RNA, 22 nt, Human
gagaacucagacgcaggucaug

SEQ ID NO: 308441 - RNA, 19 nt, Human
aaaguuuuauucucauuug

SEQ ID NO: 308442 - RNA, 23 nt, Human
gugcucugcggucugcuagucug

SEQ ID NO: 308443 - RNA, 22 nt, Human
acagaggccccgugggagagcc

SEQ ID NO: 308444 - RNA, 22 nt, Human
guguugaugacauuuuagaaac

SEQ ID NO: 308445 - RNA, 23 nt, Human
gagcugggauacaggcuuacugc

SEQ ID NO: 308446 - RNA, 21 nt, Human
aaaguucaugcuuuaauauuc

SEQ ID NO: 308447 - RNA, 22 nt, Human
ucuucauuuuauagcaucugug

SEQ ID NO: 308448 - RNA, 22 nt, Human
ugcuuuggccacuagaauucag

SEQ ID NO: 308449 - RNA, 22 nt, Human
aaacucuguauuugcugugggu

SEQ ID NO: 308450 - RNA, 22 nt, Human
uuugcauuucuaaugagcuccg

SEQ ID NO: 308451 - RNA, 22 nt, Human
uucuucaacaaggacacuguua

SEQ ID NO: 308452 - RNA, 22 nt, Human
gccaugccugugucuccaggcc

SEQ ID NO: 308453 - RNA, 23 nt, Human
uccuggugacaugccugagcauc

SEQ ID NO: 308454 - RNA, 22 nt, Human
agaaaucuauguuuugguuaga

SEQ ID NO: 308455 - RNA, 22 nt, Human
cuucagaacuauaaaaaguacu

SEQ ID NO: 308456 - RNA, 22 nt, Human
ccagucacuggaaaaugggaau

SEQ ID NO: 308457 - RNA, 22 nt, Human
auaaaacuuauuagaauugugu

SEQ ID NO: 308458 - RNA, 22 nt, Human
ggcagagcuugcagugagccga

SEQ ID NO: 308459 - RNA, 22 nt, Human
auuuaaauuuucugauggagag

SEQ ID NO: 308460 - RNA, 22 nt, Human
caaaggcaguuacugaaugaag

SEQ ID NO: 308461 - RNA, 22 nt, Human
uagccuucucaagacaaaguug

SEQ ID NO: 308462 - RNA, 19 nt, Human
uguuuuguuaaagcagucc

SEQ ID NO: 308463 - RNA, 22 nt, Human
cuuccugcaggacagccaucug

SEQ ID NO: 308464 - RNA, 22 nt, Human
uucagcaaacacgaugcuuguu

SEQ ID NO: 308465 - RNA, 22 nt, Human
ucuggagaacuugcaagaggau

SEQ ID NO: 308466 - RNA, 22 nt, Human
agggcugggcugcuuguuguca

SEQ ID NO: 308467 - RNA, 22 nt, Human
ggucacugcucuaaacaaaagu

SEQ ID NO: 308468 - RNA, 17 nt, Human
aguggcaggcagauggg

SEQ ID NO: 308469 - RNA, 22 nt, Human
uagaaagcuugggguguuuaaa

SEQ ID NO: 308470 - RNA, 22 nt, Human
auaucuuuuagagcaagcuugu

SEQ ID NO: 308471 - RNA, 19 nt, Human
uuagaaacuguugacacug

SEQ ID NO: 308472 - RNA, 22 nt, Human
gcaugggcaagaggacuggggg

SEQ ID NO: 308473 - RNA, 22 nt, Human
uaagcauucaaugcuuagcacu

SEQ ID NO: 308474 - RNA, 22 nt, Human
aaaggucagacuuaggcugggc

SEQ ID NO: 308475 - RNA, 22 nt, Human
agcugguuagcaaucuaaguga

SEQ ID NO: 308476 - RNA, 22 nt, Human
cagcauggugccagugagucca

SEQ ID NO: 308477 - RNA, 21 nt, Human
ucagaguggaagacaguuuga

SEQ ID NO: 308478 - RNA, 22 nt, Human
ugagccuguccugugcauguga

SEQ ID NO: 308479 - RNA, 22 nt, Human
uagaacagaggguugcccagau

SEQ ID NO: 308480 - RNA, 22 nt, Human
caagaugacaaggcuggaggcu

SEQ ID NO: 308481 - RNA, 22 nt, Human
ggccuuggugccauggccaguu

SEQ ID NO: 308482 - RNA, 22 nt, Human
ggacucagcagccaggaguggc

SEQ ID NO: 308483 - RNA, 22 nt, Human
uaaugcacagaauugacauggg

SEQ ID NO: 308484 - RNA, 22 nt, Human
gcacacccucucaccagcacug

SEQ ID NO: 308485 - RNA, 22 nt, Human
aagcacagaaaaggagcaugga

SEQ ID NO: 308486 - RNA, 22 nt, Human
cagaacauuccaugugcccugc

SEQ ID NO: 308487 - RNA, 22 nt, Human
cagccuucugaaugaacguacu

SEQ ID NO: 308488 - RNA, 22 nt, Human
gccacccccaaguagguggucu

SEQ ID NO: 308489 - RNA, 22 nt, Human
augacagaaggccucccugaca

SEQ ID NO: 308490 - RNA, 22 nt, Human
uagccgggugugguggaacucc

SEQ ID NO: 308491 - RNA, 22 nt, Human
gcugucagaaggugaaggguaa

SEQ ID NO: 308492 - RNA, 18 nt, Human
ccucaggggaccuggcag

SEQ ID NO: 308493 - RNA, 22 nt, Human
acugagcugugacaaugcuuaa

SEQ ID NO: 308494 - RNA, 22 nt, Human
uaggaaaagucuagauugauga

SEQ ID NO: 308495 - RNA, 23 nt, Human
ccuggcuggauucucugcauuca

SEQ ID NO: 308496 - RNA, 22 nt, Human
gacagggcgcccagccuguuuc

SEQ ID NO: 308497 - RNA, 22 nt, Human
acaugaaaguuauucugaguug

SEQ ID NO: 308498 - RNA, 22 nt, Human
cuggaggggcuggcaugguagc

SEQ ID NO: 308499 - RNA, 22 nt, Human
ccauggcauuuuaugugucuua

SEQ ID NO: 308500 - RNA, 22 nt, Human
gggcguggauggucagugcagg

SEQ ID NO: 308501 - RNA, 23 nt, Human
gggagccauggguggucauggag

SEQ ID NO: 308502 - RNA, 22 nt, Human
uaugacauugcuuuuuagaacu

SEQ ID NO: 308503 - RNA, 22 nt, Human
uuuucaguuacuguuuauguga

SEQ ID NO: 308504 - RNA, 22 nt, Human
aacagugagaagguggacagga

SEQ ID NO: 308505 - RNA, 23 nt, Human
cccagcgcugagcccugcaggca

SEQ ID NO: 308506 - RNA, 22 nt, Human
cauauuuauagaucuggcauuu

SEQ ID NO: 308507 - RNA, 22 nt, Human
cagcaggcguugggagaaagac

SEQ ID NO: 308508 - RNA, 22 nt, Human
aggcucagcugguggugaucgc

SEQ ID NO: 308509 - RNA, 20 nt, Human
gccagcccugacacaggagc

SEQ ID NO: 308510 - RNA, 22 nt, Human
gcaggaguuaggcgucguggau

SEQ ID NO: 308511 - RNA, 22 nt, Human
cucaacagcucugccauacucc

SEQ ID NO: 308512 - RNA, 22 nt, Human
uuucaguuuccagcuuugucau

SEQ ID NO: 308513 - RNA, 17 nt, Human
gcaaucucagucuccuu

SEQ ID NO: 308514 - RNA, 22 nt, Human
agggggcaucagguccuggcuc

SEQ ID NO: 308515 - RNA, 22 nt, Human
uccucagcuuuuauuucacuug

SEQ ID NO: 308516 - RNA, 22 nt, Human
ucaguguuggucaagaaucagu

SEQ ID NO: 308517 - RNA, 22 nt, Human
ucucagagaccugaacucccug

SEQ ID NO: 308518 - RNA, 22 nt, Human
cacagaauaaauugguaucaga

SEQ ID NO: 308519 - RNA, 22 nt, Human
ucaaaguuuguggcaauuuauu

SEQ ID NO: 308520 - RNA, 22 nt, Human
acugucaccaucagagcgggaa

SEQ ID NO: 308521 - RNA, 22 nt, Human
ucagaaauguaagcugaugacu

SEQ ID NO: 308522 - RNA, 22 nt, Human
ugucccagaucacaggagggga

SEQ ID NO: 308523 - RNA, 22 nt, Human
cuccagggaggucugcaggacu

SEQ ID NO: 308524 - RNA, 22 nt, Human
uguauuuugugaggaucacucu

SEQ ID NO: 308525 - RNA, 22 nt, Human
gccuucaggaaaucaguccuug

SEQ ID NO: 308526 - RNA, 22 nt, Human
ugccaggccucaggagucucca

SEQ ID NO: 308527 - RNA, 22 nt, Human
ggccagaaaguuaagcuguggc

SEQ ID NO: 308528 - RNA, 19 nt, Human
ugcaggaggacugagcaga

SEQ ID NO: 308529 - RNA, 22 nt, Human
aaucagaaagaggucauguugc

SEQ ID NO: 308530 - RNA, 22 nt, Human
ucaaaugcggucauggcuuuua

SEQ ID NO: 308531 - RNA, 22 nt, Human
uggggacacagagguucguugg

SEQ ID NO: 308532 - RNA, 22 nt, Human
gugccugggcaugagcuuguug

SEQ ID NO: 308533 - RNA, 22 nt, Human
cagccuguagaauacaguaaau

SEQ ID NO: 308534 - RNA, 22 nt, Human
cucccuggaggugagcuggcac

SEQ ID NO: 308535 - RNA, 22 nt, Human
ccaccuccaccuauugccagcc

SEQ ID NO: 308536 - RNA, 22 nt, Human
cugggcuacguguugacagcau

SEQ ID NO: 308537 - RNA, 22 nt, Human
gauggcagucaaccaggugagg

SEQ ID NO: 308538 - RNA, 17 nt, Human
uauguaguacuuauaaa

SEQ ID NO: 308539 - RNA, 22 nt, Human
cuuaagauuugcgauaccuaau

SEQ ID NO: 308540 - RNA, 22 nt, Human
gagagugaggcaucaggggcag

SEQ ID NO: 308541 - RNA, 22 nt, Human
gacccugauaggaguagaagaa

SEQ ID NO: 308542 - RNA, 22 nt, Human
aaaugguauuuacucuguauua

SEQ ID NO: 308543 - RNA, 22 nt, Human
ucucagagaaaugugucaccau

SEQ ID NO: 308544 - RNA, 22 nt, Human
gcagcacauauaaacaaagaga

SEQ ID NO: 308545 - RNA, 22 nt, Human
agcugcaggcccaugcucaguc

SEQ ID NO: 308546 - RNA, 22 nt, Human
ucaguccuccucucauagagag

SEQ ID NO: 308547 - RNA, 22 nt, Human
uaugcuuuacuuuucauuguga

SEQ ID NO: 308548 - RNA, 22 nt, Human
uuuccagguauuaauacuguau

SEQ ID NO: 308549 - RNA, 22 nt, Human
aaacacauuagcccuguggaaa

SEQ ID NO: 308550 - RNA, 21 nt, Human
uuuauguacuucauagaguag

SEQ ID NO: 308551 - RNA, 22 nt, Human
ugaacaaacugcauucuucacu

SEQ ID NO: 308552 - RNA, 22 nt, Human
aaauaguuguuuggaucaauaa

SEQ ID NO: 308553 - RNA, 21 nt, Human
cccaccccauaaggcagaacc

SEQ ID NO: 308554 - RNA, 22 nt, Human
ugcagcucauugguguccuggu

SEQ ID NO: 308555 - RNA, 22 nt, Human
gcucagugagauauugacucca

SEQ ID NO: 308556 - RNA, 22 nt, Human
gcagggucuugagaggcagcca

SEQ ID NO: 308557 - RNA, 22 nt, Human
ccuggcagacugugagggcagg

SEQ ID NO: 308558 - RNA, 22 nt, Human
ugccucagcugaggccgcucca

SEQ ID NO: 308559 - RNA, 22 nt, Human
guccaugauucugugacacccu

SEQ ID NO: 308560 - RNA, 22 nt, Human
agcuggcuccagaaggagucgu

SEQ ID NO: 308561 - RNA, 22 nt, Human
agcagaugcgucugagugggag

SEQ ID NO: 308562 - RNA, 22 nt, Human
acagggcaugugcaagagacau

SEQ ID NO: 308563 - RNA, 22 nt, Human
acagagcaguucuggagcuggc

SEQ ID NO: 308564 - RNA, 22 nt, Human
caggccagugugcuucccaggc

SEQ ID NO: 308565 - RNA, 20 nt, Human
acuugcugggcuuuguuacc

SEQ ID NO: 308566 - RNA, 22 nt, Human
agcaccuggucuccuggcgcug

SEQ ID NO: 308567 - RNA, 22 nt, Human
acuaagugauucuaagcaucuu

SEQ ID NO: 308568 - RNA, 22 nt, Human
agauggggcucaguguggaggc

SEQ ID NO: 308569 - RNA, 18 nt, Human
ggagccagucugucucug

SEQ ID NO: 308570 - RNA, 22 nt, Human
gcagaaggucuggcacuucagg

SEQ ID NO: 308571 - RNA, 22 nt, Human
uagaaacaaugacaugcuugua

SEQ ID NO: 308572 - RNA, 22 nt, Human
aaguuugcauagauuaagcauu

SEQ ID NO: 308573 - RNA, 22 nt, Human
cagcaggcucugaguggcugcc

SEQ ID NO: 308574 - RNA, 22 nt, Human
uaugaguacaaggacucugucu

SEQ ID NO: 308575 - RNA, 22 nt, Human
caggaaagagcugccaggcagg

SEQ ID NO: 308576 - RNA, 19 nt, Human
aaaaacuuaguccagaaag

SEQ ID NO: 308577 - RNA, 22 nt, Human
cccaggcagggacgugcucugg

SEQ ID NO: 308578 - RNA, 21 nt, Human
agaagccuggguggagguggg

SEQ ID NO: 308579 - RNA, 22 nt, Human
aggugagguuugggagguguca

SEQ ID NO: 308580 - RNA, 22 nt, Human
aggcacugugcagucccaagca

SEQ ID NO: 308581 - RNA, 22 nt, Human
cagcagcugcgugcccaggccg

SEQ ID NO: 308582 - RNA, 22 nt, Human
ccaagaugaucuuuacaguguu

SEQ ID NO: 308583 - RNA, 22 nt, Human
cuacaaugacagaauugaguag

SEQ ID NO: 308584 - RNA, 22 nt, Human
uucuucuugaaacuuuagguug

SEQ ID NO: 308585 - RNA, 22 nt, Human
gcucaggaccgaggggugggaa

SEQ ID NO: 308586 - RNA, 22 nt, Human
agucuucacucuucacuacuau

SEQ ID NO: 308587 - RNA, 22 nt, Human
gaacaucagucauaauuuaacg

SEQ ID NO: 308588 - RNA, 22 nt, Human
ggacacaagcuccggggcugca

SEQ ID NO: 308589 - RNA, 22 nt, Human
cauauuugguauaacuuaagca

SEQ ID NO: 308590 - RNA, 22 nt, Human
cucuguagaaacagggcagaag

SEQ ID NO: 308591 - RNA, 22 nt, Human
uguccauggauagagcugcucg

SEQ ID NO: 308592 - RNA, 22 nt, Human
uggagcccagacacuggcauug

SEQ ID NO: 308593 - RNA, 23 nt, Human
ucucaagaggaagcagggcucau

SEQ ID NO: 308594 - RNA, 22 nt, Human
aggcacuguggguguggccgga

SEQ ID NO: 308595 - RNA, 18 nt, Human
cagaaguccuucaaggcc

SEQ ID NO: 308596 - RNA, 22 nt, Human
acagaacugcaggaggaaaagc

SEQ ID NO: 308597 - RNA, 22 nt, Human
cuggcagccaagugggauacuc

SEQ ID NO: 308598 - RNA, 23 nt, Human
ugagacacucauucauggaguau

SEQ ID NO: 308599 - RNA, 22 nt, Human
gguggcuggaggagcugaugga

SEQ ID NO: 308600 - RNA, 20 nt, Human
cuucaggacccauccucccc

SEQ ID NO: 308601 - RNA, 22 nt, Human
ggccucuguucugcauuccucc

SEQ ID NO: 308602 - RNA, 22 nt, Human
ccucccaccguaucucaguggc

SEQ ID NO: 308603 - RNA, 20 nt, Human
ccucucugaagaggucaucu

SEQ ID NO: 308604 - RNA, 22 nt, Human
cagcccugcucuuagugucucc

SEQ ID NO: 308605 - RNA, 20 nt, Human
caggugagcagaucugggug

SEQ ID NO: 308606 - RNA, 22 nt, Human
ccagcagaagcucccgcugggu

SEQ ID NO: 308607 - RNA, 22 nt, Human
uggcucuggggacaguaagucc

SEQ ID NO: 308608 - RNA, 22 nt, Human
gagagcuguguucauucuacca

SEQ ID NO: 308609 - RNA, 22 nt, Human
uaauacuuaccuugcagagucu

SEQ ID NO: 308610 - RNA, 22 nt, Human
ucucagagauguuagggaagag

SEQ ID NO: 308611 - RNA, 20 nt, Human
ugagaaaguagagacucagg

SEQ ID NO: 308612 - RNA, 22 nt, Human
cucccucugucuuguccagaaa

SEQ ID NO: 308613 - RNA, 22 nt, Human
gggugacauuucccaaugagcc

SEQ ID NO: 308614 - RNA, 21 nt, Human
uagggcaggcauuggaagaga

SEQ ID NO: 308615 - RNA, 22 nt, Human
caguccugucuuuaugacuuca

SEQ ID NO: 308616 - RNA, 22 nt, Human
aucucauaacucauuugaagac

SEQ ID NO: 308617 - RNA, 22 nt, Human
acucagcugaugaagcacaagu

SEQ ID NO: 308618 - RNA, 22 nt, Human
ucagggcaucaucaugaauaua

SEQ ID NO: 308619 - RNA, 22 nt, Human
uacaaaugaaccaacuuugaug

SEQ ID NO: 308620 - RNA, 22 nt, Human
auugcuuaucuaucuuuaaguc

SEQ ID NO: 308621 - RNA, 22 nt, Human
cuguuuucaaagagagagaaug

SEQ ID NO: 308622 - RNA, 22 nt, Human
aaaucucaggccucuauuuacu

SEQ ID NO: 308623 - RNA, 22 nt, Human
uuccaugagcucugaguucaca

SEQ ID NO: 308624 - RNA, 23 nt, Human
uuagagaugauuaaaaaaucuug

SEQ ID NO: 308625 - RNA, 22 nt, Human
gguccuggaaauugacggaaag

SEQ ID NO: 308626 - RNA, 22 nt, Human
uucuuaacuggaaaaugucaga

SEQ ID NO: 308627 - RNA, 22 nt, Human
gcagugaaucuggcaagaauuu

SEQ ID NO: 308628 - RNA, 22 nt, Human
agguacagcaauauaagagguc

SEQ ID NO: 308629 - RNA, 22 nt, Human
aggccugcagcaggagcaaacc

SEQ ID NO: 308630 - RNA, 22 nt, Human
gcuguuccugcuuagaggucgg

SEQ ID NO: 308631 - RNA, 22 nt, Human
ucuucagacccuuagcugugau

SEQ ID NO: 308632 - RNA, 22 nt, Human
ggugaggggagagugaaagaaa

SEQ ID NO: 308633 - RNA, 22 nt, Human
ccaggccucccuuuuccagcca

SEQ ID NO: 308634 - RNA, 23 nt, Human
uccuccuuuugcuugugcuuccc

SEQ ID NO: 308635 - RNA, 22 nt, Human
agagccagcaagugaauaguga

SEQ ID NO: 308636 - RNA, 22 nt, Human
cugucaggggcggguggagcgg

SEQ ID NO: 308637 - RNA, 22 nt, Human
augcccaaugucacaauuuuug

SEQ ID NO: 308638 - RNA, 22 nt, Human
guaguuuucugaaaauuacuuu

SEQ ID NO: 308639 - RNA, 22 nt, Human
cugcugugaguuuggaggucua

SEQ ID NO: 308640 - RNA, 22 nt, Human
aguguccaacucagcuugucaa

SEQ ID NO: 308641 - RNA, 22 nt, Human
uucuucucucauagauuaaggu

SEQ ID NO: 308642 - RNA, 22 nt, Human
gccagcucccaagugagccccu

SEQ ID NO: 308643 - RNA, 22 nt, Human
uauuuccaagcugaauccaaug

SEQ ID NO: 308644 - RNA, 22 nt, Human
ccacccugagccgcaagagcag

SEQ ID NO: 308645 - RNA, 22 nt, Human
uauuauuaaauggcagaauuuu

SEQ ID NO: 308646 - RNA, 22 nt, Human
guggcuugaccaucccugcuac

SEQ ID NO: 308647 - RNA, 22 nt, Human
uguuucagucccuguguucaau

SEQ ID NO: 308648 - RNA, 22 nt, Human
gagagugauucccucccauaga

SEQ ID NO: 308649 - RNA, 22 nt, Human
uuucuggcagcgggacaggggu

SEQ ID NO: 308650 - RNA, 22 nt, Human
ccucagggaaugggaggcuggg

SEQ ID NO: 308651 - RNA, 22 nt, Human
gccugguggacacugggcauca

SEQ ID NO: 308652 - RNA, 22 nt, Human
uuuacagaucuguugauuuguu

SEQ ID NO: 308653 - RNA, 22 nt, Human
aucaggaucacugggagucuug

SEQ ID NO: 308654 - RNA, 22 nt, Human
aggaugaauaacugaaauggug

SEQ ID NO: 308655 - RNA, 23 nt, Human
ggcugagacuacaggcgcuugcc

SEQ ID NO: 308656 - RNA, 19 nt, Human
gugauuucuuuccacaagc

SEQ ID NO: 308657 - RNA, 20 nt, Human
gcugccuguuucuguaagua

SEQ ID NO: 308658 - RNA, 22 nt, Human
acaugugucuaagaaugaaaga

SEQ ID NO: 308659 - RNA, 22 nt, Human
caggggcugagaaggaacgucc

SEQ ID NO: 308660 - RNA, 22 nt, Human
ucugccugccagucugguccuc

SEQ ID NO: 308661 - RNA, 22 nt, Human
cacagcauaaugaaauauacuu

SEQ ID NO: 308662 - RNA, 20 nt, Human
accuuucaaaugauucagca

SEQ ID NO: 308663 - RNA, 18 nt, Human
ccuggcagccaugcgcgc

SEQ ID NO: 308664 - RNA, 22 nt, Human
cucuggaguuagugaucugggc

SEQ ID NO: 308665 - RNA, 22 nt, Human
gcaguguuaccuugggcugguu

SEQ ID NO: 308666 - RNA, 22 nt, Human
aggggccauuguucugcccgcu

SEQ ID NO: 308667 - RNA, 22 nt, Human
ccugggagguggagguugcagu

SEQ ID NO: 308668 - RNA, 22 nt, Human
uguaugaaccuuuaauauagug

SEQ ID NO: 308669 - RNA, 22 nt, Human
agagugaaggccagguuacagu

SEQ ID NO: 308670 - RNA, 22 nt, Human
aggagucacucagggcuucauc

SEQ ID NO: 308671 - RNA, 22 nt, Human
ucuggagcaacagagcaggaca

SEQ ID NO: 308672 - RNA, 22 nt, Human
uuccaaagucauguugcugaua

SEQ ID NO: 308673 - RNA, 20 nt, Human
uccugggguaagccaugguc

SEQ ID NO: 308674 - RNA, 17 nt, Human
uuugaaaggaugucagu

SEQ ID NO: 308675 - RNA, 22 nt, Human
cugggacuuuacccuguggccc

SEQ ID NO: 308676 - RNA, 22 nt, Human
cacugaagaugcgacuagugcu

SEQ ID NO: 308677 - RNA, 22 nt, Human
gugcuaaaggguuaugaacaag

SEQ ID NO: 308678 - RNA, 22 nt, Human
cuggagagggagcccuggcagu

SEQ ID NO: 308679 - RNA, 22 nt, Human
ggccuguguccuccuugcccug

SEQ ID NO: 308680 - RNA, 22 nt, Human
aacuagaaccacuuguauuucc

SEQ ID NO: 308681 - RNA, 22 nt, Human
aguauugugacucaaguauucu

SEQ ID NO: 308682 - RNA, 22 nt, Human
cugcugggucuaugcaagugga

SEQ ID NO: 308683 - RNA, 22 nt, Human
cuggcucacaggugagaugcau

SEQ ID NO: 308684 - RNA, 22 nt, Human
gcucccagacugaccagaggug

SEQ ID NO: 308685 - RNA, 20 nt, Human
uuucuugucggcuguugcug

SEQ ID NO: 308686 - RNA, 22 nt, Human
agaggccaugcuagaggccugg

SEQ ID NO: 308687 - RNA, 22 nt, Human
ccucaggaaccacauugcugcu

SEQ ID NO: 308688 - RNA, 22 nt, Human
cagcuccuagaucggcgaagug

SEQ ID NO: 308689 - RNA, 22 nt, Human
uacuuuuugucucuuugaaugu

SEQ ID NO: 308690 - RNA, 22 nt, Human
cauucuuacacaauauuuuaau

SEQ ID NO: 308691 - RNA, 22 nt, Human
cuggcaggaagaggaaagguca

SEQ ID NO: 308692 - RNA, 21 nt, Human
ucucugugucuuuaagcugga

SEQ ID NO: 308693 - RNA, 22 nt, Human
uuugcauugcauuaaguauucu

SEQ ID NO: 308694 - RNA, 22 nt, Human
ugcuuugggucucucuaguuuc

SEQ ID NO: 308695 - RNA, 22 nt, Human
uuucaguuuuugcucgauguau

SEQ ID NO: 308696 - RNA, 22 nt, Human
uuguugguggaauugaugcuag

SEQ ID NO: 308697 - RNA, 21 nt, Human
uggccucccacacuuccaugg

SEQ ID NO: 308698 - RNA, 22 nt, Human
auaucauuauguuaugagcaca

SEQ ID NO: 308699 - RNA, 22 nt, Human
ccugagguggcugcagcacugc

SEQ ID NO: 308700 - RNA, 22 nt, Human
gaggcugcccaacuggagugga

SEQ ID NO: 308701 - RNA, 22 nt, Human
cacaggcuugucagcaugaggc

SEQ ID NO: 308702 - RNA, 22 nt, Human
ggcucagguuaccagucccucc

SEQ ID NO: 308703 - RNA, 22 nt, Human
ugggcaccugaggccuggcagg

SEQ ID NO: 308704 - RNA, 22 nt, Human
cagagcuggagggaacccuggc

SEQ ID NO: 308705 - RNA, 22 nt, Human
ugccugucuuaauaucuggaaa

SEQ ID NO: 308706 - RNA, 22 nt, Human
agggccagaaucccucagucua

SEQ ID NO: 308707 - RNA, 22 nt, Human
caggccugucugcacaugaggc

SEQ ID NO: 308708 - RNA, 18 nt, Human
cccucuccugcuaguggg

SEQ ID NO: 308709 - RNA, 22 nt, Human
caaauguaaauucuuuugaagc

SEQ ID NO: 308710 - RNA, 22 nt, Human
ucaguauccacaaaugcucaaa

SEQ ID NO: 308711 - RNA, 22 nt, Human
auguaaggcugccuaugacacu

SEQ ID NO: 308712 - RNA, 22 nt, Human
aguacuuuacuucuuacaguuu

SEQ ID NO: 308713 - RNA, 20 nt, Human
acagaauaugcugguugugg

SEQ ID NO: 308714 - RNA, 22 nt, Human
cugggccuagaggaagcugaca

SEQ ID NO: 308715 - RNA, 22 nt, Human
ugcuucucccaaccagggccug

SEQ ID NO: 308716 - RNA, 22 nt, Human
gccugggagggcagcagugugg

SEQ ID NO: 308717 - RNA, 22 nt, Human
agaagccauguuuaguaggaug

SEQ ID NO: 308718 - RNA, 22 nt, Human
uauuuccaggccccacucuaga

SEQ ID NO: 308719 - RNA, 22 nt, Human
aaaagguaguugccaaauaagg

SEQ ID NO: 308720 - RNA, 22 nt, Human
gccuggaguacuccuugaagug

SEQ ID NO: 308721 - RNA, 22 nt, Human
ggccugugagcccuugcaugua

SEQ ID NO: 308722 - RNA, 22 nt, Human
cuggaaugccucccugucagag

SEQ ID NO: 308723 - RNA, 22 nt, Human
uuacaagauaaccugaugcugu

SEQ ID NO: 308724 - RNA, 22 nt, Human
uaugagaagaacaggugacuuu

SEQ ID NO: 308725 - RNA, 20 nt, Human
cugugcuuuggaaccuggaa

SEQ ID NO: 308726 - RNA, 22 nt, Human
aagccucuggggccucaucugu

SEQ ID NO: 308727 - RNA, 22 nt, Human
ugggccagcaauugcugcucag

SEQ ID NO: 308728 - RNA, 22 nt, Human
uuauguauggauggcugaaagu

SEQ ID NO: 308729 - RNA, 22 nt, Human
aagcagaaguugaucuaccaua

SEQ ID NO: 308730 - RNA, 22 nt, Human
ccagaaaguucagcugugaaug

SEQ ID NO: 308731 - RNA, 22 nt, Human
augaugugugcugaucaagcuu

SEQ ID NO: 308732 - RNA, 23 nt, Human
caguggagacucaugcuuccuua

SEQ ID NO: 308733 - RNA, 22 nt, Human
gugagggcaaauuagaaucaaa

SEQ ID NO: 308734 - RNA, 19 nt, Human
uccuucagucagaucuggg

SEQ ID NO: 308735 - RNA, 22 nt, Human
uccuggagagugggcgagcaca

SEQ ID NO: 308736 - RNA, 22 nt, Human
agcugcugagagucugccgggc

SEQ ID NO: 308737 - RNA, 22 nt, Human
acuggacagaggaaauauggag

SEQ ID NO: 308738 - RNA, 22 nt, Human
acagagccuccaggagugcugg

SEQ ID NO: 308739 - RNA, 22 nt, Human
gugauuucaaauauagagugag

SEQ ID NO: 308740 - RNA, 21 nt, Human
uggcccuggccacggcugcca

SEQ ID NO: 308741 - RNA, 22 nt, Human
aauguguguauuucuaggcgag

SEQ ID NO: 308742 - RNA, 19 nt, Human
aggacucuggaggcaugag

SEQ ID NO: 308743 - RNA, 22 nt, Human
ugggaggagcccucugggaagg

SEQ ID NO: 308744 - RNA, 21 nt, Human
cugcaggaugcugaagccagg

SEQ ID NO: 308745 - RNA, 22 nt, Human
gcugaguguaaugauggcagag

SEQ ID NO: 308746 - RNA, 22 nt, Human
auucuucaucacuaccuuguga

SEQ ID NO: 308747 - RNA, 22 nt, Human
uggcagcauguuauguaaggaa

SEQ ID NO: 308748 - RNA, 22 nt, Human
uccaaacacccuccaugcugca

SEQ ID NO: 308749 - RNA, 22 nt, Human
uggccucaccacuagcugggug

SEQ ID NO: 308750 - RNA, 22 nt, Human
uccucagggcggccuccgucuu

SEQ ID NO: 308751 - RNA, 22 nt, Human
cugggccucauccucagaguuu

SEQ ID NO: 308752 - RNA, 22 nt, Human
agcugcuccuuuccugcaggcg

SEQ ID NO: 308753 - RNA, 22 nt, Human
uggcagaaguucacuaguagcu

SEQ ID NO: 308754 - RNA, 22 nt, Human
cugagccagagggagucggguc

SEQ ID NO: 308755 - RNA, 19 nt, Human
aggcagaggcuuggcuagc

SEQ ID NO: 308756 - RNA, 22 nt, Human
ugggcagagucguggggaauag

SEQ ID NO: 308757 - RNA, 23 nt, Human
uagggcagcugggagggacaugc

SEQ ID NO: 308758 - RNA, 22 nt, Human
ugaacuuagugggaauaucucu

SEQ ID NO: 308759 - RNA, 22 nt, Human
cugagaggaugcugcaguggag

SEQ ID NO: 308760 - RNA, 22 nt, Human
gugucccacucuggaggugaag

SEQ ID NO: 308761 - RNA, 22 nt, Human
uaaguucucaauacauuguagc

SEQ ID NO: 308762 - RNA, 18 nt, Human
cucaccauucugcccaau

SEQ ID NO: 308763 - RNA, 22 nt, Human
agagcuggggcucuggguuuaa

SEQ ID NO: 308764 - RNA, 22 nt, Human
caggugcuguccugcacauguc

SEQ ID NO: 308765 - RNA, 22 nt, Human
cagaggccccagaacuagcucu

SEQ ID NO: 308766 - RNA, 22 nt, Human
uggccucuggcugaggacuaac

SEQ ID NO: 308767 - RNA, 22 nt, Human
uugaacaguccuaagagacccu

SEQ ID NO: 308768 - RNA, 22 nt, Human
gggccacauugaagggugggua

SEQ ID NO: 308769 - RNA, 22 nt, Human
ucccuggguccugcuugcucuc

SEQ ID NO: 308770 - RNA, 22 nt, Human
ugaaucaguauaaauucucaaa

SEQ ID NO: 308771 - RNA, 22 nt, Human
gagcugggccucagaacacagu

SEQ ID NO: 308772 - RNA, 22 nt, Human
agccuggaauuaaggaaaugca

SEQ ID NO: 308773 - RNA, 22 nt, Human
cauaauuucuguaucagcacca

SEQ ID NO: 308774 - RNA, 22 nt, Human
ucuuuccaaggacucuguagca

SEQ ID NO: 308775 - RNA, 22 nt, Human
uaucuaaaggauuuaauuuagu

SEQ ID NO: 308776 - RNA, 22 nt, Human
ucugucacccaggcuggagugc

SEQ ID NO: 308777 - RNA, 22 nt, Human
uuuccuaagguagugauaauuu

SEQ ID NO: 308778 - RNA, 22 nt, Human
augcaccugaacuccaucagcu

SEQ ID NO: 308779 - RNA, 22 nt, Human
ugucucugagaugacucccacc

SEQ ID NO: 308780 - RNA, 22 nt, Human
aaggagaaaugguagaugugca

SEQ ID NO: 308781 - RNA, 22 nt, Human
caguggucugugcuucuguaca

SEQ ID NO: 308782 - RNA, 20 nt, Human
aacuuguucuaccuguuuca

SEQ ID NO: 308783 - RNA, 19 nt, Human
agaaguuagacauugcaau

SEQ ID NO: 308784 - RNA, 22 nt, Human
acaguguuuaaaauaauaugcu

SEQ ID NO: 308785 - RNA, 22 nt, Human
ggagcugaugguagaagaauga

SEQ ID NO: 308786 - RNA, 17 nt, Human
agcagcuggcacaggag

SEQ ID NO: 308787 - RNA, 22 nt, Human
ccagcagcccucuuccaagacu

SEQ ID NO: 308788 - RNA, 22 nt, Human
gcugcccauuccacuggauggu

SEQ ID NO: 308789 - RNA, 22 nt, Human
aaaguucuuucucuuauuuggu

SEQ ID NO: 308790 - RNA, 22 nt, Human
cagugguugguagauacuugag

SEQ ID NO: 308791 - RNA, 22 nt, Human
ggagccugggcauuaguaauuu

SEQ ID NO: 308792 - RNA, 22 nt, Human
gccagcagcccagaaggacuuu

SEQ ID NO: 308793 - RNA, 22 nt, Human
guucuucaucauuaacacucug

SEQ ID NO: 308794 - RNA, 22 nt, Human
uggcagggccugaaucuuauac

SEQ ID NO: 308795 - RNA, 23 nt, Human
ucccuggaggcagguccagggcc

SEQ ID NO: 308796 - RNA, 22 nt, Human
caugggaggucugcaaggugcu

SEQ ID NO: 308797 - RNA, 22 nt, Human
aaugagaauguaagugaagaga

SEQ ID NO: 308798 - RNA, 22 nt, Human
cuuacagagaagaaaauguagu

SEQ ID NO: 308799 - RNA, 22 nt, Human
aucagcaagauugugucuugua

SEQ ID NO: 308800 - RNA, 22 nt, Human
ggugcuggacacguggcacucc

SEQ ID NO: 308801 - RNA, 17 nt, Human
ccugggaggaguuauga

SEQ ID NO: 308802 - RNA, 22 nt, Human
cagggccaaguuggugccuuuu

SEQ ID NO: 308803 - RNA, 22 nt, Human
uaugcacacaggcuuaauucau

SEQ ID NO: 308804 - RNA, 22 nt, Human
uguacauugucacucaucaagu

SEQ ID NO: 308805 - RNA, 22 nt, Human
gagcuuccugaugccgaccagu

SEQ ID NO: 308806 - RNA, 22 nt, Human
ucugcucagugcuuaucucuaa

SEQ ID NO: 308807 - RNA, 22 nt, Human
cacuggugacuucugagcugga

SEQ ID NO: 308808 - RNA, 22 nt, Human
gccuggaggggacagucucugg

SEQ ID NO: 308809 - RNA, 22 nt, Human
aauugcaacagguagacuuuuc

SEQ ID NO: 308810 - RNA, 22 nt, Human
acccuuucuuacucacacgcuc

SEQ ID NO: 308811 - RNA, 22 nt, Human
uggcccgaccucugcucaugca

SEQ ID NO: 308812 - RNA, 22 nt, Human
cuucuucagcacaauauugaug

SEQ ID NO: 308813 - RNA, 21 nt, Human
ggcagccugacccccagagag

SEQ ID NO: 308814 - RNA, 22 nt, Human
aguaccaugcuuccugacuggu

SEQ ID NO: 308815 - RNA, 22 nt, Human
gguacaaggagugaagguuugg

SEQ ID NO: 308816 - RNA, 22 nt, Human
uguguuccugccuggcucuggu

SEQ ID NO: 308817 - RNA, 22 nt, Human
ucauuguuucugcuuuucauga

SEQ ID NO: 308818 - RNA, 20 nt, Human
caguccugcaggcgggagaa

SEQ ID NO: 308819 - RNA, 20 nt, Human
gacaucauguacacauugcc

SEQ ID NO: 308820 - RNA, 22 nt, Human
cugccucuauaggaguccacca

SEQ ID NO: 308821 - RNA, 22 nt, Human
agaaagcacucugucuuuuacc

SEQ ID NO: 308822 - RNA, 23 nt, Human
aggaggaaaaguuaucugcugag

SEQ ID NO: 308823 - RNA, 20 nt, Human
cagcaguggaugagaguuuu

SEQ ID NO: 308824 - RNA, 21 nt, Human
aucacauuggcuguuauuauu

SEQ ID NO: 308825 - RNA, 22 nt, Human
ggcagaagauaggacagggaau

SEQ ID NO: 308826 - RNA, 22 nt, Human
acugugcacaauucuaaguccu

SEQ ID NO: 308827 - RNA, 22 nt, Human
ucccagccacagguguagcccu

SEQ ID NO: 308828 - RNA, 22 nt, Human
ggcugcuuuaucggcugcugaa

SEQ ID NO: 308829 - RNA, 22 nt, Human
auucuguauuucuaauaagauc

SEQ ID NO: 308830 - RNA, 19 nt, Human
ucaguuuuagucaucaguu

SEQ ID NO: 308831 - RNA, 22 nt, Human
accagagauggggcuucucugu

SEQ ID NO: 308832 - RNA, 22 nt, Human
gggcccugugauuucuugagga

SEQ ID NO: 308833 - RNA, 22 nt, Human
agcagcugucccuuaacaucag

SEQ ID NO: 308834 - RNA, 22 nt, Human
uauaguaaaauuuucauuuaug

SEQ ID NO: 308835 - RNA, 22 nt, Human
cuugggagacacaagaagacau

SEQ ID NO: 308836 - RNA, 22 nt, Human
aucuucaaagcacaucguuugu

SEQ ID NO: 308837 - RNA, 22 nt, Human
gcaaagguagccaaggagcuca

SEQ ID NO: 308838 - RNA, 23 nt, Human
aguacauucgaaaaauucuguga

SEQ ID NO: 308839 - RNA, 22 nt, Human
cugcuuccauaaauaaugugcu

SEQ ID NO: 308840 - RNA, 22 nt, Human
agggacacacuccaguguuauu

SEQ ID NO: 308841 - RNA, 22 nt, Human
ucaaaugcucuuugcagagagg

SEQ ID NO: 308842 - RNA, 22 nt, Human
ucaggcugccuaucagacugug

SEQ ID NO: 308843 - RNA, 22 nt, Human
uccaguggcacuggagacuaga

SEQ ID NO: 308844 - RNA, 22 nt, Human
ugggcagaguagcucagaagaa

SEQ ID NO: 308845 - RNA, 20 nt, Human
uuucacagucccuguuuccu

SEQ ID NO: 308846 - RNA, 22 nt, Human
cacacaugagucuccccauugg

SEQ ID NO: 308847 - RNA, 21 nt, Human
agagaagaggacuuucucaca

SEQ ID NO: 308848 - RNA, 22 nt, Human
acaaaugcaaguuuuaugucaa

SEQ ID NO: 308849 - RNA, 22 nt, Human
acaugucaauuuaguacucuua

SEQ ID NO: 308850 - RNA, 22 nt, Human
cuguggaaggccuguccugaaa

SEQ ID NO: 308851 - RNA, 22 nt, Human
acccuggguucccgcagcacca

SEQ ID NO: 308852 - RNA, 22 nt, Human
acaauauuguacccagaaguuu

SEQ ID NO: 308853 - RNA, 23 nt, Human
agcacagacuagaaaggucuuuc

SEQ ID NO: 308854 - RNA, 21 nt, Human
guauugcagaguuaugugcuc

SEQ ID NO: 308855 - RNA, 22 nt, Human
ucuggagcuuguuucagauggu

SEQ ID NO: 308856 - RNA, 22 nt, Human
ggccugcuuuccgagccugcag

SEQ ID NO: 308857 - RNA, 22 nt, Human
gguggccuccagggcauaggug

SEQ ID NO: 308858 - RNA, 22 nt, Human
cagcagcugggaaggaggcuga

SEQ ID NO: 308859 - RNA, 22 nt, Human
aucaaaguucguaacugauaac

SEQ ID NO: 308860 - RNA, 22 nt, Human
cauaauuugugguaguggggga

SEQ ID NO: 308861 - RNA, 22 nt, Human
aucacaaaggcugcuucaugau

SEQ ID NO: 308862 - RNA, 22 nt, Human
ucagaggucacacagcaaguuu

SEQ ID NO: 308863 - RNA, 22 nt, Human
ugggaggcuuccagaccuugcu

SEQ ID NO: 308864 - RNA, 22 nt, Human
agggccugagcuggcugaccuc

SEQ ID NO: 308865 - RNA, 22 nt, Human
augaaacagugaauuagucaag

SEQ ID NO: 308866 - RNA, 22 nt, Human
agggcugcccagugugagagcu

SEQ ID NO: 308867 - RNA, 17 nt, Human
ugcugccaagucccaac

SEQ ID NO: 308868 - RNA, 22 nt, Human
acuaaggaauaugacaaacuca

SEQ ID NO: 308869 - RNA, 22 nt, Human
ccugugucuuccccacuggugu

SEQ ID NO: 308870 - RNA, 22 nt, Human
auuugucugcuugcugccuucc

SEQ ID NO: 308871 - RNA, 22 nt, Human
uggcucagcauucacuggucuu

SEQ ID NO: 308872 - RNA, 22 nt, Human
uagugcuuaauaaauuucagaa

SEQ ID NO: 308873 - RNA, 22 nt, Human
gcauuuauuucuuuacugcauc

SEQ ID NO: 308874 - RNA, 22 nt, Human
gacuucuauuaauaccucuacu

SEQ ID NO: 308875 - RNA, 22 nt, Human
cugaagcaaaugaaacagcucu

SEQ ID NO: 308876 - RNA, 22 nt, Human
uuugacaucuaagaauucuuac

SEQ ID NO: 308877 - RNA, 22 nt, Human
gcacaauuauuuaugcaguaug

SEQ ID NO: 308878 - RNA, 22 nt, Human
uacauucagcaaaagaaugguu

SEQ ID NO: 308879 - RNA, 22 nt, Human
caggccuggguucaaaucccuu

SEQ ID NO: 308880 - RNA, 23 nt, Human
ugggccuggccucccaguccagc

SEQ ID NO: 308881 - RNA, 23 nt, Human
cuuuccuuucuuugacacccagc

SEQ ID NO: 308882 - RNA, 22 nt, Human
aaucuucacagagaaaauuagg

SEQ ID NO: 308883 - RNA, 22 nt, Human
augcaguaaaauaggagguaau

SEQ ID NO: 308884 - RNA, 22 nt, Human
gaacacauuucucugacuguag

SEQ ID NO: 308885 - RNA, 22 nt, Human
aaacucuggagauguuuaugca

SEQ ID NO: 308886 - RNA, 23 nt, Human
ccuccugggcacaggccugaugg

SEQ ID NO: 308887 - RNA, 22 nt, Human
gcugauguuuaguugauguuac

SEQ ID NO: 308888 - RNA, 22 nt, Human
cucagagcaaugaacaugcaaa

SEQ ID NO: 308889 - RNA, 22 nt, Human
ccacagcugaccgcaggugagc

SEQ ID NO: 308890 - RNA, 22 nt, Human
uuugaaaguucuucugacacua

SEQ ID NO: 308891 - RNA, 22 nt, Human
uacauaguauucacauuguuuu

SEQ ID NO: 308892 - RNA, 22 nt, Human
uuccaugaaagugaaauggagc

SEQ ID NO: 308893 - RNA, 22 nt, Human
cagagccaaaccucagggcccg

SEQ ID NO: 308894 - RNA, 22 nt, Human
gcugucugcaucucuagagcuu

SEQ ID NO: 308895 - RNA, 22 nt, Human
ugcuagaagauagcuagaagau

SEQ ID NO: 308896 - RNA, 22 nt, Human
caggaaagguagucacaaugua

SEQ ID NO: 308897 - RNA, 22 nt, Human
uuccauauuuguguggcaaaag

SEQ ID NO: 308898 - RNA, 18 nt, Human
auccuugaugagaggucu

SEQ ID NO: 308899 - RNA, 22 nt, Human
ccucccucuuucagucccacag

SEQ ID NO: 308900 - RNA, 18 nt, Human
agucucagcggaggagua

SEQ ID NO: 308901 - RNA, 22 nt, Human
cacugcuuucacaguuuguucc

SEQ ID NO: 308902 - RNA, 22 nt, Human
auaaacagcuccauuuagugcc

SEQ ID NO: 308903 - RNA, 22 nt, Human
uuucaguuguccuguuaauagc

SEQ ID NO: 308904 - RNA, 22 nt, Human
uuucucugcugccugugucgau

SEQ ID NO: 308905 - RNA, 22 nt, Human
aaauauagcaauuaugccuacu

SEQ ID NO: 308906 - RNA, 22 nt, Human
ucaaagucucugcuucuguaac

SEQ ID NO: 308907 - RNA, 21 nt, Human
ucagggcagcugcucuucaga

SEQ ID NO: 308908 - RNA, 22 nt, Human
auaagaaacauuauucuuucca

SEQ ID NO: 308909 - RNA, 22 nt, Human
uuuuccucugcaauaaaagcag

SEQ ID NO: 308910 - RNA, 22 nt, Human
auucaguucuaaggucagugcc

SEQ ID NO: 308911 - RNA, 20 nt, Human
caguccaggcuagaaaacaa

SEQ ID NO: 308912 - RNA, 22 nt, Human
aggagaaguaaggcuagaugau

SEQ ID NO: 308913 - RNA, 18 nt, Human
cuuucagauggauaugcu

SEQ ID NO: 308914 - RNA, 22 nt, Human
aacaaauguguggcaguguggg

SEQ ID NO: 308915 - RNA, 22 nt, Human
cugugugugucugcagcauacu

SEQ ID NO: 308916 - RNA, 22 nt, Human
agaauguagucuuggagauuua

SEQ ID NO: 308917 - RNA, 22 nt, Human
cuauacaucccaauuucagaga

SEQ ID NO: 308918 - RNA, 22 nt, Human
ggcagugacuguucagacgucc

SEQ ID NO: 308919 - RNA, 22 nt, Human
uucuucuugucugcccucacau

SEQ ID NO: 308920 - RNA, 22 nt, Human
gcuggcuuugcacugggugcau

SEQ ID NO: 308921 - RNA, 22 nt, Human
gagaagcaaucaguggccaccc

SEQ ID NO: 308922 - RNA, 22 nt, Human
uacaagagguauauagaaacag

SEQ ID NO: 308923 - RNA, 22 nt, Human
ucagugcuugacagcucuggga

SEQ ID NO: 308924 - RNA, 22 nt, Human
aaggcugauuagacugauagcu

SEQ ID NO: 308925 - RNA, 22 nt, Human
caagggcuucaaguggccaaga

SEQ ID NO: 308926 - RNA, 22 nt, Human
gggcugccaagccugccugccu

SEQ ID NO: 308927 - RNA, 22 nt, Human
agccugccuugggcugcuugag

SEQ ID NO: 308928 - RNA, 22 nt, Human
ccuggcugcuauagcagcaugu

SEQ ID NO: 308929 - RNA, 23 nt, Human
ugacacauuuccuuuccacugca

SEQ ID NO: 308930 - RNA, 22 nt, Human
ccuguguggaaaccgcaugacg

SEQ ID NO: 308931 - RNA, 22 nt, Human
aucuuucaaucaggaaaaaucu

SEQ ID NO: 308932 - RNA, 22 nt, Human
uucaagaugccagggacgcggc

SEQ ID NO: 308933 - RNA, 22 nt, Human
ggcugcucugccuuccagcugg

SEQ ID NO: 308934 - RNA, 22 nt, Human
ugcccacaggaagacaccagcg

SEQ ID NO: 308935 - RNA, 22 nt, Human
cuguccucuguccucagcagga

SEQ ID NO: 308936 - RNA, 22 nt, Human
acugggccuugccauggcagcc

SEQ ID NO: 308937 - RNA, 22 nt, Human
ggcaguggugggaggcucgcuc

SEQ ID NO: 308938 - RNA, 20 nt, Human
agucccuuuggucagguauu

SEQ ID NO: 308939 - RNA, 22 nt, Human
aaguauaagcuauucuucauga

SEQ ID NO: 308940 - RNA, 22 nt, Human
augcugggagugaagccccugg

SEQ ID NO: 308941 - RNA, 22 nt, Human
ugggcacaggggaauggaugaa

SEQ ID NO: 308942 - RNA, 22 nt, Human
acagcagcacuauugacauuuu

SEQ ID NO: 308943 - RNA, 22 nt, Human
cccucagcuucucccugcagcu

SEQ ID NO: 308944 - RNA, 21 nt, Human
acauucacaggauauuaucau

SEQ ID NO: 308945 - RNA, 22 nt, Human
aggcugaggcagguggaucacu

SEQ ID NO: 308946 - RNA, 22 nt, Human
cugugccuggggggcagagcug

SEQ ID NO: 308947 - RNA, 22 nt, Human
auuauucuuaugucaucauggc

SEQ ID NO: 308948 - RNA, 22 nt, Human
ucagagucauugcaaguagaag

SEQ ID NO: 308949 - RNA, 21 nt, Human
cauugucgacauuuuccccuc

SEQ ID NO: 308950 - RNA, 22 nt, Human
accugccuucucaaggacauga

SEQ ID NO: 308951 - RNA, 22 nt, Human
caguccugaggaagagcugcug

SEQ ID NO: 308952 - RNA, 22 nt, Human
cagacacagcaauucuguguug

SEQ ID NO: 308953 - RNA, 22 nt, Human
uagcuguguaagcuugguaaga

SEQ ID NO: 308954 - RNA, 22 nt, Human
gugccuggaacuggguaggcug

SEQ ID NO: 308955 - RNA, 22 nt, Human
augaguugaagcuacaagaggc

SEQ ID NO: 308956 - RNA, 19 nt, Human
ugagagugaggaaggcuuc

SEQ ID NO: 308957 - RNA, 22 nt, Human
uuuggacuuagccugcagaauu

SEQ ID NO: 308958 - RNA, 22 nt, Human
cccaugagauucugaauuuggc

SEQ ID NO: 308959 - RNA, 22 nt, Human
ucaguguugugcacauacaaaa

SEQ ID NO: 308960 - RNA, 22 nt, Human
aaauuucaagcaaaguagcuau

SEQ ID NO: 308961 - RNA, 22 nt, Human
gcucagaggcacgaccucuugg

SEQ ID NO: 308962 - RNA, 22 nt, Human
uccagggaaggugugaggcugg

SEQ ID NO: 308963 - RNA, 22 nt, Human
agagaaggaaagcugacauggg

SEQ ID NO: 308964 - RNA, 20 nt, Human
gcuuucuaugagauggacug

SEQ ID NO: 308965 - RNA, 22 nt, Human
aucugcuuccugggcuccauga

SEQ ID NO: 308966 - RNA, 22 nt, Human
uuauuaaugaguacaaguuauu

SEQ ID NO: 308967 - RNA, 22 nt, Human
ugcauuuccagauuucuggagu

SEQ ID NO: 308968 - RNA, 19 nt, Human
ggcugggucuggcagguuc

SEQ ID NO: 308969 - RNA, 20 nt, Human
caggccagagguuugauggc

SEQ ID NO: 308970 - RNA, 22 nt, Human
ggugcucaagagggcauccucu

SEQ ID NO: 308971 - RNA, 22 nt, Human
aggaagcucggagagggcaaau

SEQ ID NO: 308972 - RNA, 22 nt, Human
gagaagggcuugggagucaaca

SEQ ID NO: 308973 - RNA, 22 nt, Human
uguaauauuguagugacaguac

SEQ ID NO: 308974 - RNA, 22 nt, Human
uuagccauuaaauuacaaggug

SEQ ID NO: 308975 - RNA, 22 nt, Human
uguuagaauauuguaauauucg

SEQ ID NO: 308976 - RNA, 22 nt, Human
cuagccugggauuugaacuuau

SEQ ID NO: 308977 - RNA, 22 nt, Human
ucugcuguauuagguugaacug

SEQ ID NO: 308978 - RNA, 22 nt, Human
auuauaaagaacaugugugugg

SEQ ID NO: 308979 - RNA, 22 nt, Human
gauccuugcacuugacuuggca

SEQ ID NO: 308980 - RNA, 22 nt, Human
caggguggaauggaaugcuggc

SEQ ID NO: 308981 - RNA, 23 nt, Human
cauguacacacagcuguacagug

SEQ ID NO: 308982 - RNA, 22 nt, Human
uccugggguuuagagggaagug

SEQ ID NO: 308983 - RNA, 19 nt, Human
ccuggaggugaagguucuc

SEQ ID NO: 308984 - RNA, 22 nt, Human
uggcauuuaguugcguauugca

SEQ ID NO: 308985 - RNA, 22 nt, Human
ugguggccuugauggcaucugc

SEQ ID NO: 308986 - RNA, 22 nt, Human
ccagccagccuugaucugagua

SEQ ID NO: 308987 - RNA, 22 nt, Human
uuuacaaccucauauucugaug

SEQ ID NO: 308988 - RNA, 22 nt, Human
ucccagggacugggcuaggcuu

SEQ ID NO: 308989 - RNA, 22 nt, Human
acugugugacuguuauuacugu

SEQ ID NO: 308990 - RNA, 22 nt, Human
uggagcaggugggaugucguga

SEQ ID NO: 308991 - RNA, 22 nt, Human
acaaagguggaccauguggcuu

SEQ ID NO: 308992 - RNA, 22 nt, Human
gacagcagggacauguaggaag

SEQ ID NO: 308993 - RNA, 22 nt, Human
cacacuagucuauccauuagcu

SEQ ID NO: 308994 - RNA, 22 nt, Human
cuuugcauacaauuuuuagaaa

SEQ ID NO: 308995 - RNA, 22 nt, Human
cuguccccgcgaguccagagcu

SEQ ID NO: 308996 - RNA, 22 nt, Human
aucauucugauggucaaugcua

SEQ ID NO: 308997 - RNA, 22 nt, Human
cucucugcuguauccuuaggcu

SEQ ID NO: 308998 - RNA, 22 nt, Human
gaggugagaagggggucagaug

SEQ ID NO: 308999 - RNA, 22 nt, Human
aguuugaaauguuggcaauauu

SEQ ID NO: 309000 - RNA, 22 nt, Human
ccagugcuuccaggaauacggu

SEQ ID NO: 309001 - RNA, 22 nt, Human
gagcuggguguuuauuugccaa

SEQ ID NO: 309002 - RNA, 22 nt, Human
guugaaaguggagaaccugguu

SEQ ID NO: 309003 - RNA, 22 nt, Human
ccuggagcacauggcaggaggc

SEQ ID NO: 309004 - RNA, 22 nt, Human
ucugaggcccugcaggcagugu

SEQ ID NO: 309005 - RNA, 23 nt, Human
ugagcccaggaggucaaggcugc

SEQ ID NO: 309006 - RNA, 22 nt, Human
gggcaugguggcaggcaccugu

SEQ ID NO: 309007 - RNA, 22 nt, Human
auagaaaacagauguccuuaaa

SEQ ID NO: 309008 - RNA, 22 nt, Human
agcagccacagucugggacagg

SEQ ID NO: 309009 - RNA, 22 nt, Human
ugucucaggcccaagccaguaa

SEQ ID NO: 309010 - RNA, 22 nt, Human
caagggccuccaccuugcucgu

SEQ ID NO: 309011 - RNA, 22 nt, Human
uggagaugaauauguguaccug

SEQ ID NO: 309012 - RNA, 22 nt, Human
uugaagcacaaugucuuuuauc

SEQ ID NO: 309013 - RNA, 22 nt, Human
ugcauuucagaagaaaauucgg

SEQ ID NO: 309014 - RNA, 22 nt, Human
cuggguggcuguccagccagcc

SEQ ID NO: 309015 - RNA, 22 nt, Human
guggcugggcuccgagcggcuu

SEQ ID NO: 309016 - RNA, 22 nt, Human
ggcaguggcuccucucuacucc

SEQ ID NO: 309017 - RNA, 21 nt, Human
gagcucucaggcaagaagcag

SEQ ID NO: 309018 - RNA, 22 nt, Human
cucuggagcaccgggcuaucca

SEQ ID NO: 309019 - RNA, 22 nt, Human
ucuggcugcugcgugagugcuu

SEQ ID NO: 309020 - RNA, 21 nt, Human
uuugaaagcuacaucuauagc

SEQ ID NO: 309021 - RNA, 22 nt, Human
agcauuuaggagaauuugagaa

SEQ ID NO: 309022 - RNA, 22 nt, Human
gucauuccuauccauuugauac

SEQ ID NO: 309023 - RNA, 22 nt, Human
cucugcagaauuugagcugcuc

SEQ ID NO: 309024 - RNA, 19 nt, Human
auagucuuuccaauuauac

SEQ ID NO: 309025 - RNA, 22 nt, Human
acccaggagguggaggcugcag

SEQ ID NO: 309026 - RNA, 22 nt, Human
ugcuuuggaucuauuugcugag

SEQ ID NO: 309027 - RNA, 22 nt, Human
gcucacugcaaccucugcuucc

SEQ ID NO: 309028 - RNA, 22 nt, Human
cccauucccuuuacuguugcau

SEQ ID NO: 309029 - RNA, 22 nt, Human
gucccacaccuugaggggucuu

SEQ ID NO: 309030 - RNA, 22 nt, Human
auguacauuuagaucauuucug

SEQ ID NO: 309031 - RNA, 22 nt, Human
gcagugcugaucccauggcaga

SEQ ID NO: 309032 - RNA, 22 nt, Human
caaagaugucauugguaagaca

SEQ ID NO: 309033 - RNA, 20 nt, Human
gcuguucacauuauuaguag

SEQ ID NO: 309034 - RNA, 22 nt, Human
ucugggcugggagcguguggac

SEQ ID NO: 309035 - RNA, 22 nt, Human
gagguagccacagauagagacu

SEQ ID NO: 309036 - RNA, 22 nt, Human
uguguacagcaggauuucucaa

SEQ ID NO: 309037 - RNA, 22 nt, Human
aagguacaccaaaguucaaguu

SEQ ID NO: 309038 - RNA, 18 nt, Human
gguggccuugacuucucu

SEQ ID NO: 309039 - RNA, 22 nt, Human
gaaaagggcaagagagagggca

SEQ ID NO: 309040 - RNA, 18 nt, Human
ccucagggagagagacgc

SEQ ID NO: 309041 - RNA, 19 nt, Human
ucucuucucccugguuuua

SEQ ID NO: 309042 - RNA, 22 nt, Human
uggcucagauaauucaaggggc

SEQ ID NO: 309043 - RNA, 22 nt, Human
ggagaagguggcucagcaaagg

SEQ ID NO: 309044 - RNA, 17 nt, Human
agcagcuggguugaucu

SEQ ID NO: 309045 - RNA, 18 nt, Human
cauaauuuucuuucuuua

SEQ ID NO: 309046 - RNA, 21 nt, Human
ugucagaaauaagcaugugau

SEQ ID NO: 309047 - RNA, 22 nt, Human
ccuacucugagcgccuccgcau

SEQ ID NO: 309048 - RNA, 22 nt, Human
ggaguucacugugcaggcucug

SEQ ID NO: 309049 - RNA, 22 nt, Human
ggcuggccuguguggccgccac

SEQ ID NO: 309050 - RNA, 22 nt, Human
ugaugcuucacgcugaauaugc

SEQ ID NO: 309051 - RNA, 22 nt, Human
gcuggccaguguggugaccacc

SEQ ID NO: 309052 - RNA, 22 nt, Human
uggcacugggacagaugcucuc

SEQ ID NO: 309053 - RNA, 22 nt, Human
uagagcuggccgggacagcugg

SEQ ID NO: 309054 - RNA, 22 nt, Human
agagcagcacguuguccccaca

SEQ ID NO: 309055 - RNA, 22 nt, Human
cccugccccaggcggcuucacu

SEQ ID NO: 309056 - RNA, 18 nt, Human
aguggucuguuauaucau

SEQ ID NO: 309057 - RNA, 22 nt, Human
agcaccauugcaaauauggcag

SEQ ID NO: 309058 - RNA, 22 nt, Human
guggggcaguggccugggagca

SEQ ID NO: 309059 - RNA, 22 nt, Human
gugggugauguacuggaggcca

SEQ ID NO: 309060 - RNA, 22 nt, Human
ucuucucccaucuccaggcagg

SEQ ID NO: 309061 - RNA, 22 nt, Human
ggggcggggcucugagaagcau

SEQ ID NO: 309062 - RNA, 22 nt, Human
uggcucagaguucaucuuuuag

SEQ ID NO: 309063 - RNA, 22 nt, Human
uucugucaaagacuuuuucagg

SEQ ID NO: 309064 - RNA, 22 nt, Human
uuuaagagcuaguaugucauuu

SEQ ID NO: 309065 - RNA, 22 nt, Human
uuaucguacgcuucagaaauuu

SEQ ID NO: 309066 - RNA, 22 nt, Human
uuuuaaucaugcuucuaugucc

SEQ ID NO: 309067 - RNA, 22 nt, Human
uauuccuauuucuaaacauaug

SEQ ID NO: 309068 - RNA, 22 nt, Human
gagaaagggaacuuacagagug

SEQ ID NO: 309069 - RNA, 22 nt, Human
uuaugacauaugaguacaagua

SEQ ID NO: 309070 - RNA, 22 nt, Human
uauuuuguuaauaauccagucc

SEQ ID NO: 309071 - RNA, 22 nt, Human
gcugugcuugggaagaaucucu

SEQ ID NO: 309072 - RNA, 19 nt, Human
gcugugugaccuugggcaa

SEQ ID NO: 309073 - RNA, 22 nt, Human
gagagaagggacuucuacacuu

SEQ ID NO: 309074 - RNA, 22 nt, Human
augugaaaaauuucuuauuaca

SEQ ID NO: 309075 - RNA, 22 nt, Human
gcucaguguucaucuguaugca

SEQ ID NO: 309076 - RNA, 22 nt, Human
ugcugugcuggcggcagaggcc

SEQ ID NO: 309077 - RNA, 22 nt, Human
uucacagauguauuggaacucc

SEQ ID NO: 309078 - RNA, 21 nt, Human
ccugugugucugacugggcua

SEQ ID NO: 309079 - RNA, 22 nt, Human
uaguguuuaguacauaugcaua

SEQ ID NO: 309080 - RNA, 22 nt, Human
agcugucagugcugugccugua

SEQ ID NO: 309081 - RNA, 22 nt, Human
uuugaacaugcugcaugauaau

SEQ ID NO: 309082 - RNA, 22 nt, Human
gcauccagagguagccacugug

SEQ ID NO: 309083 - RNA, 22 nt, Human
acagggcagugucuugaaaaau

SEQ ID NO: 309084 - RNA, 21 nt, Human
acaguucaugauaacuccauc

SEQ ID NO: 309085 - RNA, 22 nt, Human
ccuuggagcggucagcacuggu

SEQ ID NO: 309086 - RNA, 20 nt, Human
ccugccuguguuugugauga

SEQ ID NO: 309087 - RNA, 19 nt, Human
gcagaugaugaggcugguc

SEQ ID NO: 309088 - RNA, 19 nt, Human
augucccaccgccccugag

SEQ ID NO: 309089 - RNA, 22 nt, Human
uugaaaggccuguuuauccagc

SEQ ID NO: 309090 - RNA, 22 nt, Human
guuugucuuaauuaggcaucga

SEQ ID NO: 309091 - RNA, 22 nt, Human
ucugggaacacacgucacuuca

SEQ ID NO: 309092 - RNA, 22 nt, Human
uggcagcagccauggaaggccc

SEQ ID NO: 309093 - RNA, 22 nt, Human
cacaugggcguaauguccaugg

SEQ ID NO: 309094 - RNA, 22 nt, Human
cugccugugcaugcagucagaa

SEQ ID NO: 309095 - RNA, 22 nt, Human
accaaggaguuugguauuuuag

SEQ ID NO: 309096 - RNA, 22 nt, Human
uggccugcuuucauuugaugcu

SEQ ID NO: 309097 - RNA, 22 nt, Human
cucugcaggggaggcaugcacu

SEQ ID NO: 309098 - RNA, 22 nt, Human
gcagagcucaugccugcaccuc

SEQ ID NO: 309099 - RNA, 22 nt, Human
gcucagaggagcaucauaagga

SEQ ID NO: 309100 - RNA, 22 nt, Human
gcaguguuaggaauaaaaauga

SEQ ID NO: 309101 - RNA, 22 nt, Human
agcuccugcuugacagaagagg

SEQ ID NO: 309102 - RNA, 23 nt, Human
ugaaacauuuaggguagaauuuc

SEQ ID NO: 309103 - RNA, 22 nt, Human
agcugccugggcuuguacaccu

SEQ ID NO: 309104 - RNA, 22 nt, Human
agggcccuccccgcucagggca

SEQ ID NO: 309105 - RNA, 22 nt, Human
gcucugcuguguuuguucagca

SEQ ID NO: 309106 - RNA, 22 nt, Human
agugaaauugcuguaagaggaa

SEQ ID NO: 309107 - RNA, 22 nt, Human
ccucuugccaaucagcuacaga

SEQ ID NO: 309108 - RNA, 22 nt, Human
auacauacguacauacguaugu

SEQ ID NO: 309109 - RNA, 22 nt, Human
ccuggccucagacagagggugg

SEQ ID NO: 309110 - RNA, 22 nt, Human
aacuuuaaggcuauaaauuaug

SEQ ID NO: 309111 - RNA, 22 nt, Human
gacagcaggagaucaugauaga

SEQ ID NO: 309112 - RNA, 22 nt, Human
ucuucagauaaagggagaguau

SEQ ID NO: 309113 - RNA, 22 nt, Human
cacauauuugaugaagcuuugu

SEQ ID NO: 309114 - RNA, 21 nt, Human
gcagagccugagguucuugag

SEQ ID NO: 309115 - RNA, 19 nt, Human
caagugaagccugggaugg

SEQ ID NO: 309116 - RNA, 22 nt, Human
aaaugaccagaauacaggcuuc

SEQ ID NO: 309117 - RNA, 22 nt, Human
uggcuggggagccccgacuccc

SEQ ID NO: 309118 - RNA, 21 nt, Human
uucuucuuggacuguuuuggc

SEQ ID NO: 309119 - RNA, 22 nt, Human
ucagggcauguauguuucuuua

SEQ ID NO: 309120 - RNA, 22 nt, Human
ugggccugggucuuugcugcca

SEQ ID NO: 309121 - RNA, 22 nt, Human
ucuguggauuuuaguguucaug

SEQ ID NO: 309122 - RNA, 22 nt, Human
auacuuuggggguuaguguaga

SEQ ID NO: 309123 - RNA, 22 nt, Human
aggucagaagugccagggaauu

SEQ ID NO: 309124 - RNA, 22 nt, Human
auuugcaaagucguaucuguga

SEQ ID NO: 309125 - RNA, 22 nt, Human
cuuucucuguguuucacaugcu

SEQ ID NO: 309126 - RNA, 22 nt, Human
ugucccauggacacaacuucuu

SEQ ID NO: 309127 - RNA, 22 nt, Human
aaaguguacuaugucaugaaca

SEQ ID NO: 309128 - RNA, 22 nt, Human
uaaugagaauucuuuuugggua

SEQ ID NO: 309129 - RNA, 22 nt, Human
acccucccauuuccauguagca

SEQ ID NO: 309130 - RNA, 22 nt, Human
cauucucaauaguagaugagua

SEQ ID NO: 309131 - RNA, 22 nt, Human
agccaaagaucagugugcaagu

SEQ ID NO: 309132 - RNA, 22 nt, Human
aggccagccucaggcagggacc

SEQ ID NO: 309133 - RNA, 22 nt, Human
aaaaaagauugaugguggaugc

SEQ ID NO: 309134 - RNA, 22 nt, Human
ucccagagcccaaguuggagag

SEQ ID NO: 309135 - RNA, 22 nt, Human
auucuucauuuacuguuacuug

SEQ ID NO: 309136 - RNA, 22 nt, Human
aagaggucauaccagauaaggg

SEQ ID NO: 309137 - RNA, 22 nt, Human
ugccagggugucaggagagcua

SEQ ID NO: 309138 - RNA, 22 nt, Human
uuccauaacugaccgaaugcau

SEQ ID NO: 309139 - RNA, 22 nt, Human
gaugcuggaagugcugaucuug

SEQ ID NO: 309140 - RNA, 22 nt, Human
cugagauggaguuucgcucuuc

SEQ ID NO: 309141 - RNA, 22 nt, Human
uuucuuccuuaccuuacuagag

SEQ ID NO: 309142 - RNA, 22 nt, Human
cuguuuauaaauagaggggagu

SEQ ID NO: 309143 - RNA, 22 nt, Human
gcugccugccuaguuccacagu

SEQ ID NO: 309144 - RNA, 21 nt, Human
auaaaguuuuacaggaaugca

SEQ ID NO: 309145 - RNA, 23 nt, Human
aggcagagccaaggucaaaaccc

SEQ ID NO: 309146 - RNA, 22 nt, Human
uaagaacagugacagccaacau

SEQ ID NO: 309147 - RNA, 22 nt, Human
cuggcugcgucugcucugacag

SEQ ID NO: 309148 - RNA, 19 nt, Human
acacagggaucagaggguu

SEQ ID NO: 309149 - RNA, 22 nt, Human
ccaguccacgucaagaagaggu

SEQ ID NO: 309150 - RNA, 22 nt, Human
agggugccugcugcagguucag

SEQ ID NO: 309151 - RNA, 19 nt, Human
ggcucucuuaaagcuguuu

SEQ ID NO: 309152 - RNA, 22 nt, Human
ggagaaggaagaaagcuacuau

SEQ ID NO: 309153 - RNA, 22 nt, Human
gccuggagaauuaaaaggaagg

SEQ ID NO: 309154 - RNA, 22 nt, Human
aaguugaagcaugaaccaaggu

SEQ ID NO: 309155 - RNA, 19 nt, Human
gcugcuggcucuggcugga

SEQ ID NO: 309156 - RNA, 22 nt, Human
aauaucagcacuuuugugguau

SEQ ID NO: 309157 - RNA, 22 nt, Human
agccuggaggaggaguugagca

SEQ ID NO: 309158 - RNA, 18 nt, Human
cugagggcagccccuggg

SEQ ID NO: 309159 - RNA, 22 nt, Human
gccuggcaggccuguuggggcu

SEQ ID NO: 309160 - RNA, 23 nt, Human
uggacgccgacuuuggaggcgcu

SEQ ID NO: 309161 - RNA, 22 nt, Human
uggccucucuaccaggcagccu

SEQ ID NO: 309162 - RNA, 22 nt, Human
uggcccugacuuggaggccuga

SEQ ID NO: 309163 - RNA, 22 nt, Human
agagcuguucagcagccagguu

SEQ ID NO: 309164 - RNA, 22 nt, Human
gaggggagacagggaaaucagu

SEQ ID NO: 309165 - RNA, 21 nt, Human
aaaggccauaaucacggagca

SEQ ID NO: 309166 - RNA, 22 nt, Human
aaaugcagguaguauuuauuuu

SEQ ID NO: 309167 - RNA, 20 nt, Human
gguagcagcugcugucaucc

SEQ ID NO: 309168 - RNA, 22 nt, Human
gcagccacucucauuccacgug

SEQ ID NO: 309169 - RNA, 22 nt, Human
caggcagggagcuggaaaggau

SEQ ID NO: 309170 - RNA, 22 nt, Human
ucuuuggauaucgcuagaccgu

SEQ ID NO: 309171 - RNA, 22 nt, Human
aagagguaaccauagcaaccac

SEQ ID NO: 309172 - RNA, 22 nt, Human
agccucugacugucagcaaggu

SEQ ID NO: 309173 - RNA, 22 nt, Human
gcugccagccaacuugcugugc

SEQ ID NO: 309174 - RNA, 22 nt, Human
cugucaguaggcucccaucauu

SEQ ID NO: 309175 - RNA, 22 nt, Human
uuagccaugcccuagaagagga

SEQ ID NO: 309176 - RNA, 22 nt, Human
caggaacaauguaagucucauu

SEQ ID NO: 309177 - RNA, 22 nt, Human
ugccuugcgggcguuucuguug

SEQ ID NO: 309178 - RNA, 19 nt, Human
agggaguuuauauuugcac

SEQ ID NO: 309179 - RNA, 22 nt, Human
cugccaaggcuggggaggacaa

SEQ ID NO: 309180 - RNA, 22 nt, Human
accacugggcgggcagccugcu

SEQ ID NO: 309181 - RNA, 22 nt, Human
acccagaggcggagguugcagu

SEQ ID NO: 309182 - RNA, 22 nt, Human
augaguaagaccauaauuuuug

SEQ ID NO: 309183 - RNA, 22 nt, Human
ccugggagguggagguugcagc

SEQ ID NO: 309184 - RNA, 22 nt, Human
acaacauucuuaaauacacuga

SEQ ID NO: 309185 - RNA, 22 nt, Human
ccucuccuugcacccgucccgc

SEQ ID NO: 309186 - RNA, 22 nt, Human
ggcugccucaaagcucaagcuc

SEQ ID NO: 309187 - RNA, 22 nt, Human
aagacugugucuauggcuacuc

SEQ ID NO: 309188 - RNA, 19 nt, Human
ggccuggauuuagggcucc

SEQ ID NO: 309189 - RNA, 21 nt, Human
gaaaggucuuaacuuacagag

SEQ ID NO: 309190 - RNA, 22 nt, Human
cagucucacccuggaggcccca

SEQ ID NO: 309191 - RNA, 22 nt, Human
cauuuccugucuggaggucaaa

SEQ ID NO: 309192 - RNA, 22 nt, Human
gugcucuguguauuaggauguc

SEQ ID NO: 309193 - RNA, 22 nt, Human
gcugugcagucuuuggugugcc

SEQ ID NO: 309194 - RNA, 21 nt, Human
ugcaugcuauguuuuuauuuc

SEQ ID NO: 309195 - RNA, 22 nt, Human
aucauuuuuaagagacucuucu

SEQ ID NO: 309196 - RNA, 22 nt, Human
cccuggagggcagacagaugcc

SEQ ID NO: 309197 - RNA, 22 nt, Human
cugagccacugcuuguucagug

SEQ ID NO: 309198 - RNA, 22 nt, Human
uuccagcaggcagacaggagau

SEQ ID NO: 309199 - RNA, 22 nt, Human
caagaaauuucuuaagaacuaa

SEQ ID NO: 309200 - RNA, 22 nt, Human
uuccuuaguugacugucuuagu

SEQ ID NO: 309201 - RNA, 22 nt, Human
cuguagcaaguuauucaauaaa

SEQ ID NO: 309202 - RNA, 22 nt, Human
agucauauguggcauuuucuaa

SEQ ID NO: 309203 - RNA, 22 nt, Human
cuggcagguccagcuggacuca

SEQ ID NO: 309204 - RNA, 22 nt, Human
aggccugggacgggagccguga

SEQ ID NO: 309205 - RNA, 22 nt, Human
agaccaagacuauaaugagagg

SEQ ID NO: 309206 - RNA, 22 nt, Human
auauuucuccaaauguuuucaa

SEQ ID NO: 309207 - RNA, 22 nt, Human
acacagggggcauucuaggagu

SEQ ID NO: 309208 - RNA, 22 nt, Human
cucugugauuuugugagccaga

SEQ ID NO: 309209 - RNA, 22 nt, Human
gcugucuccauagcuguguguc

SEQ ID NO: 309210 - RNA, 22 nt, Human
ucugggggcgaccagggacugc

SEQ ID NO: 309211 - RNA, 22 nt, Human
gacucguucauaguuccaauuu

SEQ ID NO: 309212 - RNA, 22 nt, Human
ugguggcuucugaggauggcga

SEQ ID NO: 309213 - RNA, 22 nt, Human
uaaaugugcacagguuagaagg

SEQ ID NO: 309214 - RNA, 22 nt, Human
cuucccugauaagagccucaga

SEQ ID NO: 309215 - RNA, 22 nt, Human
uggggugggcaugcgcuguccu

SEQ ID NO: 309216 - RNA, 22 nt, Human
gugccuggcacacagaaggcaa

SEQ ID NO: 309217 - RNA, 22 nt, Human
uccugggcuguggccccgggca

SEQ ID NO: 309218 - RNA, 22 nt, Human
cucuggagcgcugcuucccgcg

SEQ ID NO: 309219 - RNA, 22 nt, Human
uggccugcagcucucagggaag

SEQ ID NO: 309220 - RNA, 22 nt, Human
cagugauggauauggagaaguc

SEQ ID NO: 309221 - RNA, 22 nt, Human
ucugcaggccucgacaaggcca

SEQ ID NO: 309222 - RNA, 22 nt, Human
aauaguguuguucacucaggag

SEQ ID NO: 309223 - RNA, 22 nt, Human
ugucaccaugccagcuucugcc

SEQ ID NO: 309224 - RNA, 22 nt, Human
cuggggccacaacggcgcacgc

SEQ ID NO: 309225 - RNA, 22 nt, Human
cuucuugucaauuugccauugu

SEQ ID NO: 309226 - RNA, 22 nt, Human
aagguacaguuuuaagaauaag

SEQ ID NO: 309227 - RNA, 22 nt, Human
ggcucagguuuccuucccagcu

SEQ ID NO: 309228 - RNA, 20 nt, Human
cuuagaaauuuuuacccugg

SEQ ID NO: 309229 - RNA, 22 nt, Human
ucccagagacaucauuucuccg

SEQ ID NO: 309230 - RNA, 22 nt, Human
uuucaauguaugucuuucugag

SEQ ID NO: 309231 - RNA, 22 nt, Human
caaaugcuacuaauaggcaagu

SEQ ID NO: 309232 - RNA, 22 nt, Human
ugcugcacaauuggaaaguauc

SEQ ID NO: 309233 - RNA, 22 nt, Human
agugacucacuagcucucagug

SEQ ID NO: 309234 - RNA, 22 nt, Human
agagcuggguggacuuguaguu

SEQ ID NO: 309235 - RNA, 22 nt, Human
uuuccuucaucaucugagagcu

SEQ ID NO: 309236 - RNA, 22 nt, Human
ugccagaagauucucuaucaga

SEQ ID NO: 309237 - RNA, 22 nt, Human
cugggugguucuaacuguugau

SEQ ID NO: 309238 - RNA, 22 nt, Human
uuugaaaguccuaggagagucc

SEQ ID NO: 309239 - RNA, 22 nt, Human
aggugauguccacagcuugcag

SEQ ID NO: 309240 - RNA, 22 nt, Human
ucaccaggcuggaaugcagugg

SEQ ID NO: 309241 - RNA, 21 nt, Human
cgggcuggccgggcccucacc

SEQ ID NO: 309242 - RNA, 22 nt, Human
gggcagcucucacagcagccaa

SEQ ID NO: 309243 - RNA, 22 nt, Human
auuuugcacacuaugcagcuuu

SEQ ID NO: 309244 - RNA, 22 nt, Human
acacuaaugagaaaggaauuaa

SEQ ID NO: 309245 - RNA, 22 nt, Human
gcaaaugaguuguaacauaaaa

SEQ ID NO: 309246 - RNA, 22 nt, Human
acacugaagagcacuuucaaag

SEQ ID NO: 309247 - RNA, 22 nt, Human
agcagggccucuggcacugguc

SEQ ID NO: 309248 - RNA, 22 nt, Human
augucaaaucaguuuuaucaga

SEQ ID NO: 309249 - RNA, 20 nt, Human
gccuggaggcaaugggaaga

SEQ ID NO: 309250 - RNA, 22 nt, Human
ucugggcacugcugagccugua

SEQ ID NO: 309251 - RNA, 22 nt, Human
agaauccugaugaaaaggagag

SEQ ID NO: 309252 - RNA, 22 nt, Human
ugaaggcccuaucuccauauac

SEQ ID NO: 309253 - RNA, 22 nt, Human
aggaagccuggggcugcccucg

SEQ ID NO: 309254 - RNA, 22 nt, Human
ucuggcaggucaaucauucuuu

SEQ ID NO: 309255 - RNA, 22 nt, Human
ccuggguggcagagguugcagu

SEQ ID NO: 309256 - RNA, 22 nt, Human
cacagucacauaucuaugugug

SEQ ID NO: 309257 - RNA, 22 nt, Human
gccauuuucugucuuguuuauu

SEQ ID NO: 309258 - RNA, 22 nt, Human
gcaguggcaccgcuggcucugg

SEQ ID NO: 309259 - RNA, 22 nt, Human
ucaggccugcaggcuuccugga

SEQ ID NO: 309260 - RNA, 22 nt, Human
uguguuccuucgucuucccuuc

SEQ ID NO: 309261 - RNA, 22 nt, Human
gaggcagagucacaaagagucu

SEQ ID NO: 309262 - RNA, 22 nt, Human
ucucagucaguuuggacugugu

SEQ ID NO: 309263 - RNA, 22 nt, Human
agcagcuguacuuucaucuguu

SEQ ID NO: 309264 - RNA, 22 nt, Human
uccauugucuuugguccuagcc

SEQ ID NO: 309265 - RNA, 22 nt, Human
ucuggauggucagcucuuccug

SEQ ID NO: 309266 - RNA, 19 nt, Human
agccagggugagaaggagc

SEQ ID NO: 309267 - RNA, 22 nt, Human
uuucuagggcucuugucuucug

SEQ ID NO: 309268 - RNA, 22 nt, Human
uuccuuccauagcaaaacaugc

SEQ ID NO: 309269 - RNA, 22 nt, Human
aaauugcauuuuaaagguagau

SEQ ID NO: 309270 - RNA, 22 nt, Human
aaauauacuagaugaugaccca

SEQ ID NO: 309271 - RNA, 22 nt, Human
uaugcauagguaucuauacuca

SEQ ID NO: 309272 - RNA, 22 nt, Human
ucagagugaggcgucaacauga

SEQ ID NO: 309273 - RNA, 22 nt, Human
agagcuggacgucugagcccua

SEQ ID NO: 309274 - RNA, 22 nt, Human
agacaaagacagcaucucaggu

SEQ ID NO: 309275 - RNA, 22 nt, Human
agccaaggagugcagguggcuu

SEQ ID NO: 309276 - RNA, 22 nt, Human
ugagcuuccucccugcauccau

SEQ ID NO: 309277 - RNA, 22 nt, Human
ccacugaaggucaacauagagc

SEQ ID NO: 309278 - RNA, 22 nt, Human
ucaugcuuaaaagacacuugag

SEQ ID NO: 309279 - RNA, 22 nt, Human
agguaaggcuguaagcuaagcc

SEQ ID NO: 309280 - RNA, 22 nt, Human
ugggccuggagcccuggagagu

SEQ ID NO: 309281 - RNA, 20 nt, Human
ugcuccaucuaaagugauua

SEQ ID NO: 309282 - RNA, 22 nt, Human
aaugcacaaaaauuguauguaa

SEQ ID NO: 309283 - RNA, 22 nt, Human
aaaggagaaaacauacaggacu

SEQ ID NO: 309284 - RNA, 22 nt, Human
ggucauugucagagccuguacu

SEQ ID NO: 309285 - RNA, 22 nt, Human
gcugucaguuuuacccacagac

SEQ ID NO: 309286 - RNA, 22 nt, Human
acucucucacagcuuggcugau

SEQ ID NO: 309287 - RNA, 22 nt, Human
caguccuggagcccuucuuggc

SEQ ID NO: 309288 - RNA, 22 nt, Human
caggcacuucugcugcuugucu

SEQ ID NO: 309289 - RNA, 22 nt, Human
acucacuuuccauucaagcacc

SEQ ID NO: 309290 - RNA, 22 nt, Human
acagaggaaggcugagcugccc

SEQ ID NO: 309291 - RNA, 22 nt, Human
gacaaaggaucagagguuggga

SEQ ID NO: 309292 - RNA, 22 nt, Human
ucaggccacuucacaggugauu

SEQ ID NO: 309293 - RNA, 22 nt, Human
cagcagguauguuuguucagca

SEQ ID NO: 309294 - RNA, 22 nt, Human
auugaaagauauacuguucuca

SEQ ID NO: 309295 - RNA, 22 nt, Human
gucuucaacaauaacuaccacu

SEQ ID NO: 309296 - RNA, 22 nt, Human
ggccucugccucaucugggcac

SEQ ID NO: 309297 - RNA, 22 nt, Human
aggcagcaaagaaaugaugcug

SEQ ID NO: 309298 - RNA, 22 nt, Human
ucagcucucugggcucgaaccu

SEQ ID NO: 309299 - RNA, 22 nt, Human
ugaggaugacgauggcaauggc

SEQ ID NO: 309300 - RNA, 22 nt, Human
uggagccugagucagcggaggc

SEQ ID NO: 309301 - RNA, 22 nt, Human
caggguggcaggcaccauggcc

SEQ ID NO: 309302 - RNA, 22 nt, Human
uguguacucaauugagccauuu

SEQ ID NO: 309303 - RNA, 22 nt, Human
gagcuggcuaauacugacuuau

SEQ ID NO: 309304 - RNA, 22 nt, Human
agcugggguugcacacauuuug

SEQ ID NO: 309305 - RNA, 22 nt, Human
auauguguacgugcaguauaua

SEQ ID NO: 309306 - RNA, 22 nt, Human
uauccaaaguuucucagaaacu

SEQ ID NO: 309307 - RNA, 22 nt, Human
agggcaguucaacuucauagug

SEQ ID NO: 309308 - RNA, 22 nt, Human
augucaaacacaacaccagugg

SEQ ID NO: 309309 - RNA, 22 nt, Human
uguggcuguguccaccugcugc

SEQ ID NO: 309310 - RNA, 22 nt, Human
gagaggcuaugagguucugugu

SEQ ID NO: 309311 - RNA, 22 nt, Human
aucuagcaguguuauaauugga

SEQ ID NO: 309312 - RNA, 22 nt, Human
ugccugaguuuaacccucagag

SEQ ID NO: 309313 - RNA, 22 nt, Human
caggguccaucuuucaucacug

SEQ ID NO: 309314 - RNA, 22 nt, Human
gucucagugcccaaugccauaa

SEQ ID NO: 309315 - RNA, 22 nt, Human
agcacagauucugaagaguccu

SEQ ID NO: 309316 - RNA, 22 nt, Human
ggcugcagagcugggugggccu

SEQ ID NO: 309317 - RNA, 22 nt, Human
agcauugccugccuauugcuaa

SEQ ID NO: 309318 - RNA, 22 nt, Human
cuuuggcaaugaaacacaagaa

SEQ ID NO: 309319 - RNA, 22 nt, Human
ggagggagcauccccuugcuga

SEQ ID NO: 309320 - RNA, 22 nt, Human
cauaucccauuggccaggacau

SEQ ID NO: 309321 - RNA, 17 nt, Human
guccugggaggagagag

SEQ ID NO: 309322 - RNA, 22 nt, Human
cugcagggcagggccuccuggc

SEQ ID NO: 309323 - RNA, 22 nt, Human
caggugccgggaaugcagcaau

SEQ ID NO: 309324 - RNA, 22 nt, Human
aaggaggaauuucagggugaau

SEQ ID NO: 309325 - RNA, 22 nt, Human
ccaccagcuuugccacccugcu

SEQ ID NO: 309326 - RNA, 22 nt, Human
uuaaaguucauuaaaugagcca

SEQ ID NO: 309327 - RNA, 22 nt, Human
uucuucaaugugcccuguuuuc

SEQ ID NO: 309328 - RNA, 22 nt, Human
caggugggccgggguuuguucu

SEQ ID NO: 309329 - RNA, 22 nt, Human
uccuuuuuauaguuagagaaac

SEQ ID NO: 309330 - RNA, 22 nt, Human
caggcuugggagcagagccacu

SEQ ID NO: 309331 - RNA, 22 nt, Human
uggauaaacucacuguaaguug

SEQ ID NO: 309332 - RNA, 22 nt, Human
gggauggacuuggggacuccag

SEQ ID NO: 309333 - RNA, 20 nt, Human
uauaacaguguugggugugu

SEQ ID NO: 309334 - RNA, 22 nt, Human
auguuacagaaagcaaagauga

SEQ ID NO: 309335 - RNA, 23 nt, Human
uaguuauuuucucuguaauuugc

SEQ ID NO: 309336 - RNA, 22 nt, Human
cagaggcuaagaugagugggug

SEQ ID NO: 309337 - RNA, 22 nt, Human
cucaggauggaagccuacagga

SEQ ID NO: 309338 - RNA, 21 nt, Human
ugaaggagaggaccgagugcu

SEQ ID NO: 309339 - RNA, 22 nt, Human
cagagggagcccuccaggagca

SEQ ID NO: 309340 - RNA, 22 nt, Human
ccugucaggguuugccucagaa

SEQ ID NO: 309341 - RNA, 22 nt, Human
uauuccuauggccacugcuacu

SEQ ID NO: 309342 - RNA, 22 nt, Human
gagcugggaggacugggaacuu

SEQ ID NO: 309343 - RNA, 22 nt, Human
cagagcuggagcuugaauggag

SEQ ID NO: 309344 - RNA, 21 nt, Human
ucuguucaaggaacuacggau

SEQ ID NO: 309345 - RNA, 22 nt, Human
ugccugcucuuaccacucuccc

SEQ ID NO: 309346 - RNA, 22 nt, Human
ggcagugguuagaaacaugagc

SEQ ID NO: 309347 - RNA, 22 nt, Human
gccagagguucaacaacugucu

SEQ ID NO: 309348 - RNA, 22 nt, Human
cacaauuuguuuuaucaguauu

SEQ ID NO: 309349 - RNA, 23 nt, Human
aagcugccuucgcaguuggucug

SEQ ID NO: 309350 - RNA, 22 nt, Human
caaaggagguaaugggugugag

SEQ ID NO: 309351 - RNA, 22 nt, Human
agcuucuggaaggcaaggcuug

SEQ ID NO: 309352 - RNA, 22 nt, Human
gcugcucucucccuaaguuggg

SEQ ID NO: 309353 - RNA, 22 nt, Human
ucucccacuggccuuguaugau

SEQ ID NO: 309354 - RNA, 22 nt, Human
uggccucugugggagcugagca

SEQ ID NO: 309355 - RNA, 22 nt, Human
uggcuggggccugaauccugca

SEQ ID NO: 309356 - RNA, 22 nt, Human
agguaacacuacuuaguauacu

SEQ ID NO: 309357 - RNA, 22 nt, Human
cagggucuuauaaggccaauuu

SEQ ID NO: 309358 - RNA, 22 nt, Human
aaggcacugaaaaauugugugu

SEQ ID NO: 309359 - RNA, 22 nt, Human
cuuucacagcugugcuuaugau

SEQ ID NO: 309360 - RNA, 22 nt, Human
ccugcugugaaacuggcauaug

SEQ ID NO: 309361 - RNA, 22 nt, Human
agcugcucugauaaaccuacuu

SEQ ID NO: 309362 - RNA, 22 nt, Human
uucuggagaucugccuauggga

SEQ ID NO: 309363 - RNA, 22 nt, Human
uuuuagcacuaagugauaugcu

SEQ ID NO: 309364 - RNA, 22 nt, Human
gaggcaggcccugaaugaguca

SEQ ID NO: 309365 - RNA, 22 nt, Human
agucucugggcaugguugugac

SEQ ID NO: 309366 - RNA, 22 nt, Human
augcugugaaaaagaaggcuga

SEQ ID NO: 309367 - RNA, 22 nt, Human
cacacaugucucuccaugcucu

SEQ ID NO: 309368 - RNA, 22 nt, Human
ugcacuggggucccagcgcacg

SEQ ID NO: 309369 - RNA, 22 nt, Human
ugaaaaggguagaucccuaagu

SEQ ID NO: 309370 - RNA, 22 nt, Human
gaaaauguuuccuguuauuugc

SEQ ID NO: 309371 - RNA, 22 nt, Human
acaguacauaauccugagucug

SEQ ID NO: 309372 - RNA, 17 nt, Human
uuccucucacauuuuuu

SEQ ID NO: 309373 - RNA, 23 nt, Human
aaaugcagggucgcagguuacag

SEQ ID NO: 309374 - RNA, 22 nt, Human
ccauuuguucgcccagcuccaa

SEQ ID NO: 309375 - RNA, 22 nt, Human
ucccagagucuucuccuguaau

SEQ ID NO: 309376 - RNA, 22 nt, Human
ucccagggugcgccugcccucg

SEQ ID NO: 309377 - RNA, 22 nt, Human
uucauucaucucuaaaaugccu

SEQ ID NO: 309378 - RNA, 21 nt, Human
ucagaacaauuccaugccucc

SEQ ID NO: 309379 - RNA, 22 nt, Human
uuugaguugcuuauuuaauagg

SEQ ID NO: 309380 - RNA, 22 nt, Human
cuggagcucuccagagccccgu

SEQ ID NO: 309381 - RNA, 22 nt, Human
gggcucugggauucagagcaag

SEQ ID NO: 309382 - RNA, 22 nt, Human
uuucaaaauuuugcagugguaa

SEQ ID NO: 309383 - RNA, 22 nt, Human
acauuucuucccuuuagcagaa

SEQ ID NO: 309384 - RNA, 22 nt, Human
cagagcagagugauuguucugg

SEQ ID NO: 309385 - RNA, 22 nt, Human
guccagggaaauagcgacaggg

SEQ ID NO: 309386 - RNA, 22 nt, Human
auugucgcuuauuuaggugcuu

SEQ ID NO: 309387 - RNA, 22 nt, Human
ucucugggugauggcagggcac

SEQ ID NO: 309388 - RNA, 22 nt, Human
guuuucugauuagcaaaucuga

SEQ ID NO: 309389 - RNA, 22 nt, Human
cacaugaagagagucuaguaau

SEQ ID NO: 309390 - RNA, 22 nt, Human
cauugacaguucuuuaaguugc

SEQ ID NO: 309391 - RNA, 22 nt, Human
uuccggaagguucucuagaauu

SEQ ID NO: 309392 - RNA, 22 nt, Human
ugcccucauuauaagaggcuca

SEQ ID NO: 309393 - RNA, 17 nt, Human
uguagcuucuccuucuc

SEQ ID NO: 309394 - RNA, 22 nt, Human
acauuucacuguucacagcagg

SEQ ID NO: 309395 - RNA, 22 nt, Human
ccugggaggcggagguugcagu

SEQ ID NO: 309396 - RNA, 22 nt, Human
aaaaguaauugaugcaaucgua

SEQ ID NO: 309397 - RNA, 22 nt, Human
cccagggaaugacucuggccuu

SEQ ID NO: 309398 - RNA, 22 nt, Human
gccugccuggagcuugagguga

SEQ ID NO: 309399 - RNA, 22 nt, Human
acacaugcauaagccuucccuu

SEQ ID NO: 309400 - RNA, 22 nt, Human
ucagagugcagggaguagcagc

SEQ ID NO: 309401 - RNA, 22 nt, Human
uccuucaguucaauuaguccgu

SEQ ID NO: 309402 - RNA, 22 nt, Human
uucaacuauuaugaauaaaauu

SEQ ID NO: 309403 - RNA, 21 nt, Human
gcucccugcucagcuccuggg

SEQ ID NO: 309404 - RNA, 22 nt, Human
acagggcagaaauguugcaucu

SEQ ID NO: 309405 - RNA, 22 nt, Human
uacaguagaauuuuuaguaacu

SEQ ID NO: 309406 - RNA, 22 nt, Human
gggcucucaugaguguguggua

SEQ ID NO: 309407 - RNA, 20 nt, Human
gccuguccugagugucaugg

SEQ ID NO: 309408 - RNA, 22 nt, Human
cacauacaaugguguuauuugg

SEQ ID NO: 309409 - RNA, 22 nt, Human
ucucugaguauccugaacugcc

SEQ ID NO: 309410 - RNA, 22 nt, Human
acuauacauugaauguuaaggu

SEQ ID NO: 309411 - RNA, 22 nt, Human
uaacucugcuuguucucugagu

SEQ ID NO: 309412 - RNA, 22 nt, Human
ccuccagguguuacauaugacu

SEQ ID NO: 309413 - RNA, 22 nt, Human
gaagcuucguggcucuucaaau

SEQ ID NO: 309414 - RNA, 22 nt, Human
agauuuauguggucacacucag

SEQ ID NO: 309415 - RNA, 20 nt, Human
gcagaugagacucacagagg

SEQ ID NO: 309416 - RNA, 21 nt, Human
uucaagauauuuaaaaggugg

SEQ ID NO: 309417 - RNA, 22 nt, Human
uuuucauuguuacuaugagcua

SEQ ID NO: 309418 - RNA, 22 nt, Human
ccccuuccaggaagcagaaucg

SEQ ID NO: 309419 - RNA, 22 nt, Human
uauugacaauuugugaaacuau

SEQ ID NO: 309420 - RNA, 22 nt, Human
uaugauuuguagacauuugauu

SEQ ID NO: 309421 - RNA, 18 nt, Human
gccaggaagaggaaugug

SEQ ID NO: 309422 - RNA, 22 nt, Human
aagaaauuaaggaaugcaacga

SEQ ID NO: 309423 - RNA, 22 nt, Human
agagccagcaacucuagcccug

SEQ ID NO: 309424 - RNA, 19 nt, Human
gccugccuggguuucugag

SEQ ID NO: 309425 - RNA, 22 nt, Human
uauuauguagaguaaggguuaa

SEQ ID NO: 309426 - RNA, 22 nt, Human
gccuggcuccuaaggacuggcu

SEQ ID NO: 309427 - RNA, 22 nt, Human
aggucccaggcauagcuggucu

SEQ ID NO: 309428 - RNA, 22 nt, Human
cuugcaggauuuugcugcugua

SEQ ID NO: 309429 - RNA, 22 nt, Human
aggacuccauguguccuggaga

SEQ ID NO: 309430 - RNA, 22 nt, Human
ucccugagcucacauggcagga

SEQ ID NO: 309431 - RNA, 22 nt, Human
aggaggggcauagaaauguaau

SEQ ID NO: 309432 - RNA, 22 nt, Human
cucagggucugguccuuagauu

SEQ ID NO: 309433 - RNA, 22 nt, Human
uauucacauguacauaugcuca

SEQ ID NO: 309434 - RNA, 22 nt, Human
agaaguaggcagggcuguauca

SEQ ID NO: 309435 - RNA, 19 nt, Human
ugugaaagcuaguguucuu

SEQ ID NO: 309436 - RNA, 22 nt, Human
cugcucugcaaggcacagugau

SEQ ID NO: 309437 - RNA, 22 nt, Human
acucccacuccagaguagaagc

SEQ ID NO: 309438 - RNA, 22 nt, Human
gugguuuugccauuacaaguaa

SEQ ID NO: 309439 - RNA, 22 nt, Human
agaaucucuacucaaguacuug

SEQ ID NO: 309440 - RNA, 22 nt, Human
ucuuugcaucccuuccauaguu

SEQ ID NO: 309441 - RNA, 22 nt, Human
ggcugcuggcauugagguaggu

SEQ ID NO: 309442 - RNA, 22 nt, Human
ucagggcacauucugcaguggc

SEQ ID NO: 309443 - RNA, 22 nt, Human
ucaggucuuuugucuccuagaa

SEQ ID NO: 309444 - RNA, 22 nt, Human
cuggugggaggcaagguggaag

SEQ ID NO: 309445 - RNA, 22 nt, Human
ucucuucuaauuaggguccaug

SEQ ID NO: 309446 - RNA, 22 nt, Human
gcucucugccauaugaggauac

SEQ ID NO: 309447 - RNA, 21 nt, Human
gcagccacugccuucaacaau

SEQ ID NO: 309448 - RNA, 22 nt, Human
cagagaaaaaauccugcucuca

SEQ ID NO: 309449 - RNA, 22 nt, Human
aagagagaccaugggggacagg

SEQ ID NO: 309450 - RNA, 23 nt, Human
uggugccucagaagcagugggcu

SEQ ID NO: 309451 - RNA, 22 nt, Human
uugcugaagugaagguauguuu

SEQ ID NO: 309452 - RNA, 22 nt, Human
gcuuccucaccuucucuugcau

SEQ ID NO: 309453 - RNA, 22 nt, Human
uggaaagaauuccuaugguuca

SEQ ID NO: 309454 - RNA, 22 nt, Human
cugcugcugcuaucuacccagg

SEQ ID NO: 309455 - RNA, 22 nt, Human
cgcagcagccccgugguaggug

SEQ ID NO: 309456 - RNA, 22 nt, Human
agggccuggugaccuggguccu

SEQ ID NO: 309457 - RNA, 22 nt, Human
ugggcagaauugugguaguuaa

SEQ ID NO: 309458 - RNA, 22 nt, Human
caaauacuaaacauaagauuuu

SEQ ID NO: 309459 - RNA, 22 nt, Human
gaagcccagggcguggccgggc

SEQ ID NO: 309460 - RNA, 22 nt, Human
cugagccaaaaagcagagcuug

SEQ ID NO: 309461 - RNA, 22 nt, Human
uggccugggcaugaagcaucgu

SEQ ID NO: 309462 - RNA, 20 nt, Human
ucuguucaaaucuuaguucc

SEQ ID NO: 309463 - RNA, 19 nt, Human
ugccagcauuaggcugaag

SEQ ID NO: 309464 - RNA, 22 nt, Human
gaaaugcauaaucuuaguagau

SEQ ID NO: 309465 - RNA, 22 nt, Human
gcaggcaguuugcuuuucccuc

SEQ ID NO: 309466 - RNA, 22 nt, Human
augugucaauuuucaaaugcuu

SEQ ID NO: 309467 - RNA, 22 nt, Human
cuucagaagccugcagccuuug

SEQ ID NO: 309468 - RNA, 22 nt, Human
ccagagcugcauccagcagguu

SEQ ID NO: 309469 - RNA, 22 nt, Human
ccugccagugaagcugacgggc

SEQ ID NO: 309470 - RNA, 22 nt, Human
uaagaacauuuucggaaagaua

SEQ ID NO: 309471 - RNA, 22 nt, Human
cagguaagagacggauuggccc

SEQ ID NO: 309472 - RNA, 18 nt, Human
ccauuucaugauuauuac

SEQ ID NO: 309473 - RNA, 22 nt, Human
cagcccuggugagguuggcuau

SEQ ID NO: 309474 - RNA, 22 nt, Human
cagagguagaaggcaugcagug

SEQ ID NO: 309475 - RNA, 22 nt, Human
aggcacugugcugaugucuuau

SEQ ID NO: 309476 - RNA, 22 nt, Human
cuggcucaauuuguacugcugu

SEQ ID NO: 309477 - RNA, 22 nt, Human
agauggaguuaguaccagaguc

SEQ ID NO: 309478 - RNA, 22 nt, Human
uccauuuacuauucucauaucg

SEQ ID NO: 309479 - RNA, 22 nt, Human
caguggcugugaccagggaccu

SEQ ID NO: 309480 - RNA, 17 nt, Human
uggagcugcguguguuc

SEQ ID NO: 309481 - RNA, 22 nt, Human
uggugcaagucucugaggaggg

SEQ ID NO: 309482 - RNA, 22 nt, Human
gcuuuuucaaaugaaagcuggu

SEQ ID NO: 309483 - RNA, 22 nt, Human
ccuucugcuggucaucccagug

SEQ ID NO: 309484 - RNA, 22 nt, Human
guacacauuaugcuucucuaaa

SEQ ID NO: 309485 - RNA, 17 nt, Human
gcagccagugcagcagg

SEQ ID NO: 309486 - RNA, 22 nt, Human
gcucccaguucccaaagugacc

SEQ ID NO: 309487 - RNA, 22 nt, Human
ucacagacacagggagaagcau

SEQ ID NO: 309488 - RNA, 22 nt, Human
cccuugcacauuugucuuuaau

SEQ ID NO: 309489 - RNA, 22 nt, Human
ucugucacaauuugcuuacucu

SEQ ID NO: 309490 - RNA, 22 nt, Human
agucaguggcuccgagccuggu

SEQ ID NO: 309491 - RNA, 22 nt, Human
gagcuggggcggauacucagcu

SEQ ID NO: 309492 - RNA, 21 nt, Human
uccuucaguucugcacuuucu

SEQ ID NO: 309493 - RNA, 22 nt, Human
uuaaacaguguuucaugugggg

SEQ ID NO: 309494 - RNA, 17 nt, Human
uccuucagggccucaca

SEQ ID NO: 309495 - RNA, 22 nt, Human
agagggagugaaauggaauaga

SEQ ID NO: 309496 - RNA, 22 nt, Human
guuuacauauuuuaauugguga

SEQ ID NO: 309497 - RNA, 22 nt, Human
agccuccacagaugcaaagggc

SEQ ID NO: 309498 - RNA, 22 nt, Human
aaauguuucuacuugugagcau

SEQ ID NO: 309499 - RNA, 22 nt, Human
uugcaagauguuaccauuguua

SEQ ID NO: 309500 - RNA, 22 nt, Human
uggccuggggaagaccaugggc

SEQ ID NO: 309501 - RNA, 22 nt, Human
uaucuuugcaaauaucucuaag

SEQ ID NO: 309502 - RNA, 22 nt, Human
gacucugcuacaggccgagguu

SEQ ID NO: 309503 - RNA, 22 nt, Human
agaaaguucacugguauauuuu

SEQ ID NO: 309504 - RNA, 21 nt, Human
gcagcagaggcuugacagaca

SEQ ID NO: 309505 - RNA, 22 nt, Human
ccugacgaaaggcgugcuggag

SEQ ID NO: 309506 - RNA, 22 nt, Human
acucugugugaguagagccugu

SEQ ID NO: 309507 - RNA, 17 nt, Human
ccuuucucuuucaucuc

SEQ ID NO: 309508 - RNA, 22 nt, Human
ccuuucucuuugcugaucaugu

SEQ ID NO: 309509 - RNA, 22 nt, Human
uccucugcuggaagggcaagag

SEQ ID NO: 309510 - RNA, 22 nt, Human
uucaggagcuggcugcgaagga

SEQ ID NO: 309511 - RNA, 22 nt, Human
agggcagagcugucuaaauggc

SEQ ID NO: 309512 - RNA, 22 nt, Human
ggcucaggccuguaauccuagc

SEQ ID NO: 309513 - RNA, 22 nt, Human
aaguccaucucugccccacaca

SEQ ID NO: 309514 - RNA, 22 nt, Human
aauauaauuuuauuccuagagu

SEQ ID NO: 309515 - RNA, 19 nt, Human
gccugggaugggcagaacu

SEQ ID NO: 309516 - RNA, 22 nt, Human
cauuuagagucuugcaauuuua

SEQ ID NO: 309517 - RNA, 22 nt, Human
ugcagaggagcuggaaggcugg

SEQ ID NO: 309518 - RNA, 20 nt, Human
gcacugaaauucaauguuug

SEQ ID NO: 309519 - RNA, 22 nt, Human
acaggggauugauuggaagucu

SEQ ID NO: 309520 - RNA, 22 nt, Human
gggcuugcugauuugggcagga

SEQ ID NO: 309521 - RNA, 22 nt, Human
gauuucaaagguucugcaugcc

SEQ ID NO: 309522 - RNA, 22 nt, Human
aagcuggcaauuaucaaaacug

SEQ ID NO: 309523 - RNA, 22 nt, Human
ggcaccaggaucagucugucau

SEQ ID NO: 309524 - RNA, 22 nt, Human
acugugugcccugacgccaggg

SEQ ID NO: 309525 - RNA, 22 nt, Human
gaaucucaggaagaucucugca

SEQ ID NO: 309526 - RNA, 22 nt, Human
gcuguucacagacucugcucug

SEQ ID NO: 309527 - RNA, 21 nt, Human
ucagaguguguuacagcaagc

SEQ ID NO: 309528 - RNA, 22 nt, Human
uauugaugcuuggauugggcca

SEQ ID NO: 309529 - RNA, 22 nt, Human
aaguguguauuguuuaugcugc

SEQ ID NO: 309530 - RNA, 22 nt, Human
gcucugucauuuugcagacacu

SEQ ID NO: 309531 - RNA, 21 nt, Human
aagccucaagcagaagacaga

SEQ ID NO: 309532 - RNA, 22 nt, Human
aguggcaguagaugagcugguu

SEQ ID NO: 309533 - RNA, 22 nt, Human
ucccagcagggccgaccagccu

SEQ ID NO: 309534 - RNA, 22 nt, Human
ggcugaaacagauuucaagaca

SEQ ID NO: 309535 - RNA, 20 nt, Human
ggcaccaggcuaggauugga

SEQ ID NO: 309536 - RNA, 22 nt, Human
guggugcaggccagcaggggcg

SEQ ID NO: 309537 - RNA, 22 nt, Human
uccuugaaaggggcugcagggc

SEQ ID NO: 309538 - RNA, 22 nt, Human
agcaggcuccuuccuucucugg

SEQ ID NO: 309539 - RNA, 22 nt, Human
uguguuuuacaaauucucuuaa

SEQ ID NO: 309540 - RNA, 22 nt, Human
cacagggcagagaccugggugc

SEQ ID NO: 309541 - RNA, 22 nt, Human
ucccaggguccucuucuggaau

SEQ ID NO: 309542 - RNA, 22 nt, Human
ggugcugguucaggguggcugu

SEQ ID NO: 309543 - RNA, 22 nt, Human
auacauguucguguacauguuc

SEQ ID NO: 309544 - RNA, 22 nt, Human
ucucaguguuguucugcagaug

SEQ ID NO: 309545 - RNA, 22 nt, Human
gcuuccuuauuguugccauagu

SEQ ID NO: 309546 - RNA, 22 nt, Human
cugaaaauguuacacaggaaga

SEQ ID NO: 309547 - RNA, 22 nt, Human
guggccugucagaagccguggg

SEQ ID NO: 309548 - RNA, 22 nt, Human
gcacugcagguggguggagagg

SEQ ID NO: 309549 - RNA, 22 nt, Human
ucuacccagagcuaugaccuga

SEQ ID NO: 309550 - RNA, 22 nt, Human
ggcagcacugcagcuuguuggg

SEQ ID NO: 309551 - RNA, 22 nt, Human
auccuugaacuuagacacuagg

SEQ ID NO: 309552 - RNA, 22 nt, Human
aggaaagggguagguguggacg

SEQ ID NO: 309553 - RNA, 22 nt, Human
ugccacccagccaggaguggga

SEQ ID NO: 309554 - RNA, 22 nt, Human
gccucccuguucuuccacaaua

SEQ ID NO: 309555 - RNA, 22 nt, Human
ucaggcugaggucaucugcauc

SEQ ID NO: 309556 - RNA, 22 nt, Human
agcugcuacugcucugccagag

SEQ ID NO: 309557 - RNA, 22 nt, Human
gcagguggauuaucagaagugc

SEQ ID NO: 309558 - RNA, 22 nt, Human
gcaggccagcugugcagauggg

SEQ ID NO: 309559 - RNA, 22 nt, Human
uucacauuauaaucaguucugc

SEQ ID NO: 309560 - RNA, 22 nt, Human
cuuccucugcggcgccgggcgc

SEQ ID NO: 309561 - RNA, 22 nt, Human
gcuguccaugucuggccucagu

SEQ ID NO: 309562 - RNA, 22 nt, Human
aaaugcacagguuuuaaauccu

SEQ ID NO: 309563 - RNA, 22 nt, Human
cacauggggcgcugcauuggcc

SEQ ID NO: 309564 - RNA, 22 nt, Human
ccagcucuuggugcacuuacau

SEQ ID NO: 309565 - RNA, 22 nt, Human
gcccagaguucaaggcugcagu

SEQ ID NO: 309566 - RNA, 22 nt, Human
uggcagcacuugaacuugagcc

SEQ ID NO: 309567 - RNA, 22 nt, Human
ucugcaggacugaggccuguuu

SEQ ID NO: 309568 - RNA, 22 nt, Human
ccuggcuguggcggugcucuca

SEQ ID NO: 309569 - RNA, 22 nt, Human
gaggcagcaugguaccuuggag

SEQ ID NO: 309570 - RNA, 22 nt, Human
ggccccuggcaccaggcugauu

SEQ ID NO: 309571 - RNA, 22 nt, Human
agagaugaaaaguggagacugg

SEQ ID NO: 309572 - RNA, 22 nt, Human
aggcagcccacaggacacagga

SEQ ID NO: 309573 - RNA, 22 nt, Human
acagugucuccugguacccagu

SEQ ID NO: 309574 - RNA, 22 nt, Human
guguaugauuucaaauggcuag

SEQ ID NO: 309575 - RNA, 22 nt, Human
gaaaauguuagcuucauaguca

SEQ ID NO: 309576 - RNA, 22 nt, Human
ugcagaagaaaacagcugugug

SEQ ID NO: 309577 - RNA, 22 nt, Human
ucucugucugagccuggcagac

SEQ ID NO: 309578 - RNA, 22 nt, Human
uacauuuauaaggcuucucugu

SEQ ID NO: 309579 - RNA, 22 nt, Human
cuggcugcaggaugaggcugcc

SEQ ID NO: 309580 - RNA, 22 nt, Human
ugugugccugagccgugccugg

SEQ ID NO: 309581 - RNA, 22 nt, Human
caguagcagggauuauuuuagg

SEQ ID NO: 309582 - RNA, 22 nt, Human
gaaagggcaugggcaugacaac

SEQ ID NO: 309583 - RNA, 22 nt, Human
gagagugucgggggccccagga

SEQ ID NO: 309584 - RNA, 22 nt, Human
cuggaagguuccucccagcucc

SEQ ID NO: 309585 - RNA, 22 nt, Human
aggaaaaaccuguuaaugguag

SEQ ID NO: 309586 - RNA, 21 nt, Human
gccagggaagagaguuggcug

SEQ ID NO: 309587 - RNA, 17 nt, Human
uucucuuccuggauagu

SEQ ID NO: 309588 - RNA, 19 nt, Human
uggaacaaacugcaaugac

SEQ ID NO: 309589 - RNA, 22 nt, Human
accccagcccugcuucugggag

SEQ ID NO: 309590 - RNA, 22 nt, Human
gagcagcuuaugucaagccaga

SEQ ID NO: 309591 - RNA, 22 nt, Human
ucaggcagaggauggggagcgu

SEQ ID NO: 309592 - RNA, 22 nt, Human
cacaugcauaaggauaauuacu

SEQ ID NO: 309593 - RNA, 23 nt, Human
gaguguucauagcaggcucuugc

SEQ ID NO: 309594 - RNA, 22 nt, Human
uucucucauucaaauuaaagug

SEQ ID NO: 309595 - RNA, 22 nt, Human
agcuggggcauuuauccacuaa

SEQ ID NO: 309596 - RNA, 22 nt, Human
ggaaggaggggcaaagcaguuc

SEQ ID NO: 309597 - RNA, 17 nt, Human
ggugagaccucccacuc

SEQ ID NO: 309598 - RNA, 18 nt, Human
cucucugggugaggacaa

SEQ ID NO: 309599 - RNA, 22 nt, Human
cuggcagcuucaggacacucgg

SEQ ID NO: 309600 - RNA, 22 nt, Human
uaccuugggguuuuguugcucu

SEQ ID NO: 309601 - RNA, 22 nt, Human
uccagggaugccagccauguug

SEQ ID NO: 309602 - RNA, 15 nt, Human
uucaggauaugacuc

SEQ ID NO: 309603 - RNA, 21 nt, Human
cuguggaagggaacuagaggg

SEQ ID NO: 309604 - RNA, 22 nt, Human
guuauugcaguauagaggucua

SEQ ID NO: 309605 - RNA, 22 nt, Human
cucagaaguucagccuagagua

SEQ ID NO: 309606 - RNA, 22 nt, Human
agcugcugguuuaagggauggg

SEQ ID NO: 309607 - RNA, 22 nt, Human
uguguucuggaaagcucacuga

SEQ ID NO: 309608 - RNA, 22 nt, Human
agcagccaggaaucugcagagc

SEQ ID NO: 309609 - RNA, 22 nt, Human
uccuugaagcaacgugcagaca

SEQ ID NO: 309610 - RNA, 22 nt, Human
uggccuggaaaaaugcagaugg

SEQ ID NO: 309611 - RNA, 19 nt, Human
uucacaauuaugaaauuag

SEQ ID NO: 309612 - RNA, 22 nt, Human
cucaggggaccuggcuccgagu

SEQ ID NO: 309613 - RNA, 22 nt, Human
uuuucguuuauuugacauguaa

SEQ ID NO: 309614 - RNA, 22 nt, Human
gugcagcugugugagagcucca

SEQ ID NO: 309615 - RNA, 22 nt, Human
auucucuuuguauaacaucuug

SEQ ID NO: 309616 - RNA, 22 nt, Human
gccagggcucgcggucccucgu

SEQ ID NO: 309617 - RNA, 22 nt, Human
ccagagccucgcccggagccuc

SEQ ID NO: 309618 - RNA, 22 nt, Human
uuaguaauguguuaauaugaau

SEQ ID NO: 309619 - RNA, 22 nt, Human
gggagccuugggagugccagcc

SEQ ID NO: 309620 - RNA, 22 nt, Human
uucaaacaaaacuguucccaua

SEQ ID NO: 309621 - RNA, 22 nt, Human
acagaagagcacauuuaguaug

SEQ ID NO: 309622 - RNA, 22 nt, Human
cagggccuccuaaggcaucuaa

SEQ ID NO: 309623 - RNA, 20 nt, Human
cugccuggaggccucuaccu

SEQ ID NO: 309624 - RNA, 22 nt, Human
agccuauuccaggaugagcuca

SEQ ID NO: 309625 - RNA, 22 nt, Human
gagucaguaauggauaugucau

SEQ ID NO: 309626 - RNA, 22 nt, Human
agaugaagauaucugcaggggc

SEQ ID NO: 309627 - RNA, 23 nt, Human
cacaccaggagccgucugggcca

SEQ ID NO: 309628 - RNA, 22 nt, Human
uuccuggugguggugacagcac

SEQ ID NO: 309629 - RNA, 17 nt, Human
aggaaacauuuucuuuc

SEQ ID NO: 309630 - RNA, 22 nt, Human
ccuggaagauucaccacuacca

SEQ ID NO: 309631 - RNA, 22 nt, Human
ccagcuccaggacugggagcug

SEQ ID NO: 309632 - RNA, 22 nt, Human
agccuggaccaggggccucaga

SEQ ID NO: 309633 - RNA, 22 nt, Human
gucaggaugggcagccaaacua

SEQ ID NO: 309634 - RNA, 22 nt, Human
aaggccagaguacuagaggcug

SEQ ID NO: 309635 - RNA, 22 nt, Human
agccuucauaaucuugggcuuu

SEQ ID NO: 309636 - RNA, 22 nt, Human
acauacuuaugcuaaaaauaua

SEQ ID NO: 309637 - RNA, 22 nt, Human
gaugaagccugacuucucggug

SEQ ID NO: 309638 - RNA, 22 nt, Human
gcugccuucccaggccuuugcu

SEQ ID NO: 309639 - RNA, 22 nt, Human
ggaggagacccugugucaguuu

SEQ ID NO: 309640 - RNA, 20 nt, Human
ucccuggaggugguggcauc

SEQ ID NO: 309641 - RNA, 22 nt, Human
cuccaguaucuguaggaaaagg

SEQ ID NO: 309642 - RNA, 22 nt, Human
gagacacaggugguuccuguca

SEQ ID NO: 309643 - RNA, 22 nt, Human
ggaagaagggucauuggcagcc

SEQ ID NO: 309644 - RNA, 22 nt, Human
uguauacauuuaacuagauaga

SEQ ID NO: 309645 - RNA, 22 nt, Human
uuguuucagcuguaugcuaugu

SEQ ID NO: 309646 - RNA, 22 nt, Human
auauucuucuuguucagacuau

SEQ ID NO: 309647 - RNA, 22 nt, Human
aagaacuuccuaauauauuuuc

SEQ ID NO: 309648 - RNA, 22 nt, Human
accccagaggcggaggcugcag

SEQ ID NO: 309649 - RNA, 22 nt, Human
cuucucucccuggcacucagac

SEQ ID NO: 309650 - RNA, 22 nt, Human
agaggaugguugaggaagaccu

SEQ ID NO: 309651 - RNA, 22 nt, Human
cccagacauaacagcagagagg

SEQ ID NO: 309652 - RNA, 22 nt, Human
uguuuuuaaauaaugauagaaa

SEQ ID NO: 309653 - RNA, 22 nt, Human
uucauucauuacgugccaggca

SEQ ID NO: 309654 - RNA, 22 nt, Human
aagcccagcugaaagcauuuuu

SEQ ID NO: 309655 - RNA, 22 nt, Human
aaguucaaggaagccuccaguu

SEQ ID NO: 309656 - RNA, 20 nt, Human
uaacagaaguagaagugggu

SEQ ID NO: 309657 - RNA, 22 nt, Human
gagggacagcuaaagagaaauu

SEQ ID NO: 309658 - RNA, 22 nt, Human
uaacacauaucuacaacaugug

SEQ ID NO: 309659 - RNA, 23 nt, Human
gcccaugcuguugggcccgagca

SEQ ID NO: 309660 - RNA, 22 nt, Human
ucaaucacguguuccauguucu

SEQ ID NO: 309661 - RNA, 22 nt, Human
acaugauuuuuaaagagauaau

SEQ ID NO: 309662 - RNA, 22 nt, Human
ggcucagacucccaggcccucu

SEQ ID NO: 309663 - RNA, 22 nt, Human
aaaguguagagacuuuggaacc

SEQ ID NO: 309664 - RNA, 22 nt, Human
cugaagccaugugcucacuggu

SEQ ID NO: 309665 - RNA, 22 nt, Human
auuugagaugguaaauaacuuu

SEQ ID NO: 309666 - RNA, 20 nt, Human
aauguauauuuuaugccagg

SEQ ID NO: 309667 - RNA, 22 nt, Human
cagauggccagaggcagcugca

SEQ ID NO: 309668 - RNA, 22 nt, Human
agggccagagucuguguagaua

SEQ ID NO: 309669 - RNA, 22 nt, Human
gucccuggaucugggacagcug

SEQ ID NO: 309670 - RNA, 23 nt, Human
agagaaagggauaacacguugaa

SEQ ID NO: 309671 - RNA, 22 nt, Human
uauugacaauaggcaacugagg

SEQ ID NO: 309672 - RNA, 22 nt, Human
augacacuuggugauacuuugu

SEQ ID NO: 309673 - RNA, 22 nt, Human
cagaccuggaaaacaggcuugc

SEQ ID NO: 309674 - RNA, 22 nt, Human
cuguaugaacccauauacuuau

SEQ ID NO: 309675 - RNA, 23 nt, Human
gcugagguacauuuacaggaaga

SEQ ID NO: 309676 - RNA, 22 nt, Human
cagggcacaguuauggaggugg

SEQ ID NO: 309677 - RNA, 18 nt, Human
cucagggcaucagucugg

SEQ ID NO: 309678 - RNA, 22 nt, Human
gccacaugcaauugcagcacgu

SEQ ID NO: 309679 - RNA, 23 nt, Human
uucaagauacgguuuccaggcug

SEQ ID NO: 309680 - RNA, 19 nt, Human
gaaggggaagguggguacc

SEQ ID NO: 309681 - RNA, 22 nt, Human
ugcuugugagaguuuuuucaga

SEQ ID NO: 309682 - RNA, 22 nt, Human
ugucccagguccuagaugacca

SEQ ID NO: 309683 - RNA, 22 nt, Human
ggccugcuauuggugggcagac

SEQ ID NO: 309684 - RNA, 22 nt, Human
ccagccccgggaaccuggccgu

SEQ ID NO: 309685 - RNA, 22 nt, Human
auacaacuuuaucuguaaugag

SEQ ID NO: 309686 - RNA, 22 nt, Human
aggcucagcaucugauucauau

SEQ ID NO: 309687 - RNA, 22 nt, Human
cugggcacaggggagcagaguc

SEQ ID NO: 309688 - RNA, 22 nt, Human
gaggcugguaggaaaggaaaca

SEQ ID NO: 309689 - RNA, 22 nt, Human
acagaaauuagcagugaguuua

SEQ ID NO: 309690 - RNA, 22 nt, Human
uguguacuugaaagggcagguc

SEQ ID NO: 309691 - RNA, 22 nt, Human
ugggggugaaagucuggacagu

SEQ ID NO: 309692 - RNA, 22 nt, Human
agguaaaauagauaguauuucu

SEQ ID NO: 309693 - RNA, 23 nt, Human
guaaaauacgcagugcaguguga

SEQ ID NO: 309694 - RNA, 17 nt, Human
uugggagagaaagguau

SEQ ID NO: 309695 - RNA, 22 nt, Human
acagaccaaaaaaggauauugg

SEQ ID NO: 309696 - RNA, 22 nt, Human
ugagaaaagguugagaugauaa

SEQ ID NO: 309697 - RNA, 22 nt, Human
uuugcauuccugccugcauuca

SEQ ID NO: 309698 - RNA, 22 nt, Human
uaaguucaagucuuggauauaa

SEQ ID NO: 309699 - RNA, 22 nt, Human
uauuuguugaguuguuaugucu

SEQ ID NO: 309700 - RNA, 22 nt, Human
agcagcucaaagccugcaagga

SEQ ID NO: 309701 - RNA, 19 nt, Human
ugagaaggcaguggggagc

SEQ ID NO: 309702 - RNA, 22 nt, Human
uugggugcugucauggggcacg

SEQ ID NO: 309703 - RNA, 22 nt, Human
gagcagcuccagccgcaugacu

SEQ ID NO: 309704 - RNA, 22 nt, Human
agcuccugcccaggaaggcucu

SEQ ID NO: 309705 - RNA, 22 nt, Human
uugugucccccuuugagagcca

SEQ ID NO: 309706 - RNA, 22 nt, Human
aaauucuaugucaauguuuauu

SEQ ID NO: 309707 - RNA, 22 nt, Human
ucucaguguguuuucucucaga

SEQ ID NO: 309708 - RNA, 22 nt, Human
uagagaaauaagcuuugccuug

SEQ ID NO: 309709 - RNA, 22 nt, Human
ccaggacucaguggggaaaggg

SEQ ID NO: 309710 - RNA, 20 nt, Human
ucugugugccaucaccuaac

SEQ ID NO: 309711 - RNA, 22 nt, Human
uguccugggaaugggaugcagu

SEQ ID NO: 309712 - RNA, 22 nt, Human
aaugauugucauuccaaaaagu

SEQ ID NO: 309713 - RNA, 22 nt, Human
ugugccuuaugaauucuuucug

SEQ ID NO: 309714 - RNA, 22 nt, Human
ccucugagagaaggccuucagc

SEQ ID NO: 309715 - RNA, 22 nt, Human
auggcucauuuaucuugcagcc

SEQ ID NO: 309716 - RNA, 22 nt, Human
cuguggugagcaacugacugaa

SEQ ID NO: 309717 - RNA, 22 nt, Human
acagcucugagauauuacuauu

SEQ ID NO: 309718 - RNA, 21 nt, Human
ggcuccugcuuugugaggggc

SEQ ID NO: 309719 - RNA, 22 nt, Human
cccaugagaccugguuuaaggc

SEQ ID NO: 309720 - RNA, 17 nt, Human
ucugccgacugccagcu

SEQ ID NO: 309721 - RNA, 19 nt, Human
cagccucaaucccucgggc

SEQ ID NO: 309722 - RNA, 22 nt, Human
gaggacagcuuagggcuuccug

SEQ ID NO: 309723 - RNA, 18 nt, Human
acaaaugugucacaggaa

SEQ ID NO: 309724 - RNA, 22 nt, Human
cucacugugaccucagcagaca

SEQ ID NO: 309725 - RNA, 22 nt, Human
uaacagaauccuguuauugcca

SEQ ID NO: 309726 - RNA, 22 nt, Human
uugcauguguaauuuuucuaaa

SEQ ID NO: 309727 - RNA, 22 nt, Human
cuggcaggaaguuagaugguaa

SEQ ID NO: 309728 - RNA, 23 nt, Human
cauguacagaguuugauaaagug

SEQ ID NO: 309729 - RNA, 22 nt, Human
uggugccuugggccuacagcgc

SEQ ID NO: 309730 - RNA, 22 nt, Human
uuagcauuucaguacacauguu

SEQ ID NO: 309731 - RNA, 21 nt, Human
gcugcugccccuagugaggcc

SEQ ID NO: 309732 - RNA, 17 nt, Human
acagagguuauacagac

SEQ ID NO: 309733 - RNA, 22 nt, Human
aucuggcuuacgaagcacuggu

SEQ ID NO: 309734 - RNA, 22 nt, Human
gcagcagaggcccuacucuuug

SEQ ID NO: 309735 - RNA, 22 nt, Human
uuucacacugcagcaucagaga

SEQ ID NO: 309736 - RNA, 22 nt, Human
guaauugacucagcucuguuca

SEQ ID NO: 309737 - RNA, 20 nt, Human
cccaggagugagcagcuuua

SEQ ID NO: 309738 - RNA, 22 nt, Human
aaauuucuugaggcucucuagc

SEQ ID NO: 309739 - RNA, 22 nt, Human
aggagcugagggagcgcccuug

SEQ ID NO: 309740 - RNA, 22 nt, Human
agucccagccuaggcugugcug

SEQ ID NO: 309741 - RNA, 22 nt, Human
uugguuuacuaggauucaaauu

SEQ ID NO: 309742 - RNA, 22 nt, Human
acagggcauuuccucuaugugu

SEQ ID NO: 309743 - RNA, 22 nt, Human
caggauggucucgaucuccuga

SEQ ID NO: 309744 - RNA, 19 nt, Human
gucccugggcagaggcacc

SEQ ID NO: 309745 - RNA, 22 nt, Human
augcauuuuugaguaugaauga

SEQ ID NO: 309746 - RNA, 22 nt, Human
agcccaaggcuucccugcuggc

SEQ ID NO: 309747 - RNA, 21 nt, Human
uuucugaaggcaacaucuauc

SEQ ID NO: 309748 - RNA, 22 nt, Human
ccuguucacugcacaguuuccg

SEQ ID NO: 309749 - RNA, 22 nt, Human
ugggccacuugaaaguggaugu

SEQ ID NO: 309750 - RNA, 22 nt, Human
uucugaaagccaauucauugaa

SEQ ID NO: 309751 - RNA, 22 nt, Human
cccauuuaaacacaagcuuuca

SEQ ID NO: 309752 - RNA, 22 nt, Human
uguagaaagaauauguuucaua

SEQ ID NO: 309753 - RNA, 22 nt, Human
ccagcuggagcucgcagauagg

SEQ ID NO: 309754 - RNA, 21 nt, Human
ugcauaaagaaauacaaauac

SEQ ID NO: 309755 - RNA, 22 nt, Human
gcaaggcugagcacauuugcau

SEQ ID NO: 309756 - RNA, 22 nt, Human
uaugcuuugguagagaguugug

SEQ ID NO: 309757 - RNA, 22 nt, Human
ugagccuggguggucgaggcug

SEQ ID NO: 309758 - RNA, 22 nt, Human
agagauugugcuacucacccaa

SEQ ID NO: 309759 - RNA, 22 nt, Human
gcuccuucaggugguagcuguu

SEQ ID NO: 309760 - RNA, 22 nt, Human
gaugcugagagguggagggaac

SEQ ID NO: 309761 - RNA, 22 nt, Human
ugcugccagagagacagggacu

SEQ ID NO: 309762 - RNA, 22 nt, Human
uacauguauguguacgugcaug

SEQ ID NO: 309763 - RNA, 22 nt, Human
aguggcaggaaaguggaagaga

SEQ ID NO: 309764 - RNA, 22 nt, Human
ucacacgugagguucuauccug

SEQ ID NO: 309765 - RNA, 22 nt, Human
uggccuuggacagagcgcuccu

SEQ ID NO: 309766 - RNA, 22 nt, Human
gacagggcauggugcagaguuc

SEQ ID NO: 309767 - RNA, 22 nt, Human
agugcuuugaacgaaaggcuga

SEQ ID NO: 309768 - RNA, 22 nt, Human
caagagcucagaaacccuugcu

SEQ ID NO: 309769 - RNA, 22 nt, Human
auacuuacuuuucuucagacua

SEQ ID NO: 309770 - RNA, 22 nt, Human
ugaagcaggaaccagcagcauu

SEQ ID NO: 309771 - RNA, 22 nt, Human
ggguacaaagauuucauaagau

SEQ ID NO: 309772 - RNA, 22 nt, Human
ucugucugagggagugacauuu

SEQ ID NO: 309773 - RNA, 22 nt, Human
aggcccugaagucggccccuca

SEQ ID NO: 309774 - RNA, 22 nt, Human
ugggcuguccagcaccugggcu

SEQ ID NO: 309775 - RNA, 22 nt, Human
ugcaggccggcccuaggccuca

SEQ ID NO: 309776 - RNA, 22 nt, Human
ggcugccuucccugagccccgg

SEQ ID NO: 309777 - RNA, 20 nt, Human
gagauuuccaaucaugccca

SEQ ID NO: 309778 - RNA, 22 nt, Human
agaaauguuuauggcugccuau

SEQ ID NO: 309779 - RNA, 22 nt, Human
ugggggagauuagagcuucuua

SEQ ID NO: 309780 - RNA, 22 nt, Human
agggcugcaggcaagauauggc

SEQ ID NO: 309781 - RNA, 22 nt, Human
uggcuggggccacaguuuuccu

SEQ ID NO: 309782 - RNA, 22 nt, Human
cagaugugcaugaugggaaggg

SEQ ID NO: 309783 - RNA, 22 nt, Human
ggcagggaggaggugaaaguga

SEQ ID NO: 309784 - RNA, 22 nt, Human
auuuuucucuccacuccauuaa

SEQ ID NO: 309785 - RNA, 22 nt, Human
uggggcugaggagccucacucu

SEQ ID NO: 309786 - RNA, 22 nt, Human
cagcaguguggaagcugagggg

SEQ ID NO: 309787 - RNA, 22 nt, Human
guguaugagccuccagcugggc

SEQ ID NO: 309788 - RNA, 22 nt, Human
uggaacaacaugcuggaaaauu

SEQ ID NO: 309789 - RNA, 22 nt, Human
cagcugugcuguauuaagcucu

SEQ ID NO: 309790 - RNA, 17 nt, Human
cucagaguugcuuuguc

SEQ ID NO: 309791 - RNA, 23 nt, Human
uggagcugggcucagacccuggg

SEQ ID NO: 309792 - RNA, 22 nt, Human
gcucuggaagcaucugagagga

SEQ ID NO: 309793 - RNA, 21 nt, Human
ugagaaguaugucuucagcca

SEQ ID NO: 309794 - RNA, 22 nt, Human
guucuucagaggggaaagaacc

SEQ ID NO: 309795 - RNA, 22 nt, Human
ucaagugcuugugagguauuug

SEQ ID NO: 309796 - RNA, 22 nt, Human
acucugccuuucagcagaugaa

SEQ ID NO: 309797 - RNA, 22 nt, Human
gaaggaaaucugugauuuaugc

SEQ ID NO: 309798 - RNA, 22 nt, Human
uguaugaagguuuaccugcugu

SEQ ID NO: 309799 - RNA, 22 nt, Human
uccucugcuccaucuuuacugu

SEQ ID NO: 309800 - RNA, 22 nt, Human
ucagagaaguaagguggggugc

SEQ ID NO: 309801 - RNA, 22 nt, Human
ugucucugaggugagggucagc

SEQ ID NO: 309802 - RNA, 19 nt, Human
cuuugucagaacaugcuuc

SEQ ID NO: 309803 - RNA, 22 nt, Human
cugagcuuggccaggaaugaau

SEQ ID NO: 309804 - RNA, 22 nt, Human
uauggaaacuaauucauuuuuc

SEQ ID NO: 309805 - RNA, 22 nt, Human
gaugaaaaucuugagaugucga

SEQ ID NO: 309806 - RNA, 19 nt, Human
ucaaggcucccugagggau

SEQ ID NO: 309807 - RNA, 22 nt, Human
acagcuggaggucugugagcac

SEQ ID NO: 309808 - RNA, 22 nt, Human
cuuucagagguuacucaggaaa

SEQ ID NO: 309809 - RNA, 20 nt, Human
augauuuugcacuaacuuca

SEQ ID NO: 309810 - RNA, 22 nt, Human
uauuugagcgaagcaguguuuu

SEQ ID NO: 309811 - RNA, 21 nt, Human
ugcuggccucaagggugacuu

SEQ ID NO: 309812 - RNA, 22 nt, Human
ucugcaggucacgcuccagccu

SEQ ID NO: 309813 - RNA, 20 nt, Human
ccugucuggagacaaagaga

SEQ ID NO: 309814 - RNA, 22 nt, Human
auaugaagaauuccaauuugga

SEQ ID NO: 309815 - RNA, 22 nt, Human
acuggcagcagcagcccuuggg

SEQ ID NO: 309816 - RNA, 22 nt, Human
guuccuugggaacaacgcugaa

SEQ ID NO: 309817 - RNA, 22 nt, Human
agaaauaugcugauuagaugaa

SEQ ID NO: 309818 - RNA, 22 nt, Human
uagggaggcuacuucuuguagg

SEQ ID NO: 309819 - RNA, 22 nt, Human
agaaaggguucucugaggugcu

SEQ ID NO: 309820 - RNA, 22 nt, Human
aagagcugcccaaggugaacag

SEQ ID NO: 309821 - RNA, 22 nt, Human
aggcuggcccuacuggcugccu

SEQ ID NO: 309822 - RNA, 22 nt, Human
cagcagagacgguaagcagaac

SEQ ID NO: 309823 - RNA, 22 nt, Human
caggaugguggcaugaucagaa

SEQ ID NO: 309824 - RNA, 22 nt, Human
uagcugcccaucuuuccuuuag

SEQ ID NO: 309825 - RNA, 22 nt, Human
cagccucuaagcacagccucuc

SEQ ID NO: 309826 - RNA, 22 nt, Human
ggcugccugaggcagugagaga

SEQ ID NO: 309827 - RNA, 22 nt, Human
cuuuauguccuugaagaguugu

SEQ ID NO: 309828 - RNA, 22 nt, Human
aaagcugcugccaaucaggcuu

SEQ ID NO: 309829 - RNA, 17 nt, Human
cacaggugugguuugag

SEQ ID NO: 309830 - RNA, 22 nt, Human
ugggccugaaggagcugcgccc

SEQ ID NO: 309831 - RNA, 22 nt, Human
ugugcacauauacucauauucc

SEQ ID NO: 309832 - RNA, 22 nt, Human
ucugaggcauaaccuguucugc

SEQ ID NO: 309833 - RNA, 22 nt, Human
augcaguacauacaaacacuga

SEQ ID NO: 309834 - RNA, 22 nt, Human
ccuggccucagccuagggcuga

SEQ ID NO: 309835 - RNA, 17 nt, Human
uuuucucucuuggauuc

SEQ ID NO: 309836 - RNA, 22 nt, Human
gaggagaagggcacggagaaaa

SEQ ID NO: 309837 - RNA, 19 nt, Human
agagaggcugugugaggga

SEQ ID NO: 309838 - RNA, 22 nt, Human
cauugcccaguaggaucaccag

SEQ ID NO: 309839 - RNA, 22 nt, Human
uguuucaugauugcugucauuu

SEQ ID NO: 309840 - RNA, 22 nt, Human
gcugcagguugggcaacagagu

SEQ ID NO: 309841 - RNA, 22 nt, Human
accaccccagaauuuuucaagg

SEQ ID NO: 309842 - RNA, 22 nt, Human
cuuccugaacaaugccaucaau

SEQ ID NO: 309843 - RNA, 22 nt, Human
uguuucauuaguacugacaaua

SEQ ID NO: 309844 - RNA, 22 nt, Human
gcugccagcucacucuccugag

SEQ ID NO: 309845 - RNA, 23 nt, Human
aaggccagaauuucaauggugcc

SEQ ID NO: 309846 - RNA, 22 nt, Human
uguacaaagguacuuugauguu

SEQ ID NO: 309847 - RNA, 22 nt, Human
ucucuuuuauguacacccugac

SEQ ID NO: 309848 - RNA, 22 nt, Human
aggcacugaccugcuuccuuga

SEQ ID NO: 309849 - RNA, 22 nt, Human
ccagagccuaagaucugauccu

SEQ ID NO: 309850 - RNA, 22 nt, Human
uucaggauggcggauguugggg

SEQ ID NO: 309851 - RNA, 22 nt, Human
acaguguugaggugcuuguuuc

SEQ ID NO: 309852 - RNA, 22 nt, Human
ccucuucuaggacguccuugug

SEQ ID NO: 309853 - RNA, 22 nt, Human
agcugguguccuccuggagcug

SEQ ID NO: 309854 - RNA, 22 nt, Human
gucuggaguggggccugagaau

SEQ ID NO: 309855 - RNA, 22 nt, Human
gggcugagucugcugccuguca

SEQ ID NO: 309856 - RNA, 18 nt, Human
aagaggaggagcagguug

SEQ ID NO: 309857 - RNA, 22 nt, Human
cuugaaagucagcagaguggau

SEQ ID NO: 309858 - RNA, 22 nt, Human
auggagacgcaagggaccuagg

SEQ ID NO: 309859 - RNA, 20 nt, Human
ccagucccugagcaccaggg

SEQ ID NO: 309860 - RNA, 22 nt, Human
agcucagggcgaucugucucgg

SEQ ID NO: 309861 - RNA, 22 nt, Human
cagcaucaccgccauuucugau

SEQ ID NO: 309862 - RNA, 22 nt, Human
uguuuucagucauauagcaggu

SEQ ID NO: 309863 - RNA, 22 nt, Human
ggaugcugacuuuggagcaugg

SEQ ID NO: 309864 - RNA, 20 nt, Human
ggcucugcuugugagcagcc

SEQ ID NO: 309865 - RNA, 22 nt, Human
cucagggccaaggaugcuguug

SEQ ID NO: 309866 - RNA, 22 nt, Human
agaagcuuccuacauuguucuu

SEQ ID NO: 309867 - RNA, 22 nt, Human
gggaaggagccugcuugcuaga

SEQ ID NO: 309868 - RNA, 21 nt, Human
gcaaaugaguuaacuaacuca

SEQ ID NO: 309869 - RNA, 22 nt, Human
caguggaggccuugggaccuuu

SEQ ID NO: 309870 - RNA, 22 nt, Human
gggugggagucuggcccucaaa

SEQ ID NO: 309871 - RNA, 22 nt, Human
gauggggaugagaagugagcag

SEQ ID NO: 309872 - RNA, 22 nt, Human
cugccugcugccuguggagggu

SEQ ID NO: 309873 - RNA, 22 nt, Human
ccagcugguuaaaauagagaaa

SEQ ID NO: 309874 - RNA, 22 nt, Human
gcaccgagaaggaagcaugccu

SEQ ID NO: 309875 - RNA, 22 nt, Human
agugugagcccuggaguggugc

SEQ ID NO: 309876 - RNA, 22 nt, Human
uuuccagagcaugucugcucag

SEQ ID NO: 309877 - RNA, 22 nt, Human
uugaagcagcucaggaggcuua

SEQ ID NO: 309878 - RNA, 22 nt, Human
uuaaacagagucugaaauguaa

SEQ ID NO: 309879 - RNA, 22 nt, Human
gcucaggaucccaggggugugc

SEQ ID NO: 309880 - RNA, 22 nt, Human
cacagcuugggcucugacaaua

SEQ ID NO: 309881 - RNA, 22 nt, Human
ggagggcacaggaccagaaauc

SEQ ID NO: 309882 - RNA, 22 nt, Human
uggggaggacgggcgccuuccu

SEQ ID NO: 309883 - RNA, 22 nt, Human
ucacauuuguuccucugcacuu

SEQ ID NO: 309884 - RNA, 22 nt, Human
ggcucugguugaccaugauggc

SEQ ID NO: 309885 - RNA, 22 nt, Human
ucccugucuaauaugccaugaa

SEQ ID NO: 309886 - RNA, 22 nt, Human
acucaggaaaaauguagugaua

SEQ ID NO: 309887 - RNA, 21 nt, Human
agacagagugcagucuacaua

SEQ ID NO: 309888 - RNA, 22 nt, Human
gcugccaugguccaggcuccag

SEQ ID NO: 309889 - RNA, 21 nt, Human
uucugggaaaugagcuggggc

SEQ ID NO: 309890 - RNA, 22 nt, Human
aguaaaauuucugcugaggaga

SEQ ID NO: 309891 - RNA, 22 nt, Human
uagugcuuggcccuaccagaua

SEQ ID NO: 309892 - RNA, 22 nt, Human
cuggggcccaucgagggcugag

SEQ ID NO: 309893 - RNA, 20 nt, Human
uguauauuuucugguguaaa

SEQ ID NO: 309894 - RNA, 22 nt, Human
uagacacauccguggaagcuuc

SEQ ID NO: 309895 - RNA, 19 nt, Human
uucaggauugacccuacug

SEQ ID NO: 309896 - RNA, 22 nt, Human
gcauuccuacaggcugcuauga

SEQ ID NO: 309897 - RNA, 22 nt, Human
ccaggcugccgaggaaagaaag

SEQ ID NO: 309898 - RNA, 22 nt, Human
ggucccaggagaauaggugcaa

SEQ ID NO: 309899 - RNA, 18 nt, Human
aggcuucuuggcucaguc

SEQ ID NO: 309900 - RNA, 21 nt, Human
uugcaccaugauaaauucaga

SEQ ID NO: 309901 - RNA, 22 nt, Human
ggccucucuccuuggcuugcag

SEQ ID NO: 309902 - RNA, 22 nt, Human
ugacaaacccugcaaauagcuc

SEQ ID NO: 309903 - RNA, 22 nt, Human
cccacucuggcucccuucuagu

SEQ ID NO: 309904 - RNA, 22 nt, Human
ugagacaguuuuucuauuucca

SEQ ID NO: 309905 - RNA, 22 nt, Human
ccagggugagaaaaggcuggau

SEQ ID NO: 309906 - RNA, 22 nt, Human
agaacuuaggaacaacagcuua

SEQ ID NO: 309907 - RNA, 22 nt, Human
aagcacaaugaacaucuuagau

SEQ ID NO: 309908 - RNA, 22 nt, Human
gaagcagcugccagagaugucu

SEQ ID NO: 309909 - RNA, 22 nt, Human
ggugggcacauucagucucugu

SEQ ID NO: 309910 - RNA, 22 nt, Human
cucucugguacauagaguuugg

SEQ ID NO: 309911 - RNA, 22 nt, Human
acuuugcaaugggcagaaccca

SEQ ID NO: 309912 - RNA, 22 nt, Human
agaugacaaaucaggggacggg

SEQ ID NO: 309913 - RNA, 22 nt, Human
uucucauucugacucaguguag

SEQ ID NO: 309914 - RNA, 22 nt, Human
auacuucuuugauguucacagg

SEQ ID NO: 309915 - RNA, 22 nt, Human
ucccagaagugaaauuucuaga

SEQ ID NO: 309916 - RNA, 22 nt, Human
acauguuagaaaugcagaaucu

SEQ ID NO: 309917 - RNA, 22 nt, Human
cucugaggcuccaugcaggcuu

SEQ ID NO: 309918 - RNA, 22 nt, Human
augugucuuugagacucugcua

SEQ ID NO: 309919 - RNA, 22 nt, Human
gcucaggaaaacagucuaguaa

SEQ ID NO: 309920 - RNA, 22 nt, Human
aagggagcaaauggacagacgg

SEQ ID NO: 309921 - RNA, 22 nt, Human
aucugcuuuugagaauuuacuu

SEQ ID NO: 309922 - RNA, 22 nt, Human
cugaggucaauuaaucaacaac

SEQ ID NO: 309923 - RNA, 22 nt, Human
gcacagggccuggcacauaaga

SEQ ID NO: 309924 - RNA, 22 nt, Human
ucaguguuacauuauauagaac

SEQ ID NO: 309925 - RNA, 22 nt, Human
uagcacaucuucuuggccugca

SEQ ID NO: 309926 - RNA, 22 nt, Human
aagcaauagcaacaacuuuaca

SEQ ID NO: 309927 - RNA, 22 nt, Human
ccagcucuaaacggcucugugg

SEQ ID NO: 309928 - RNA, 22 nt, Human
guugaguggguuaggaugcuga

SEQ ID NO: 309929 - RNA, 22 nt, Human
ucccucuguguugggcaugccu

SEQ ID NO: 309930 - RNA, 22 nt, Human
cuggccagacuacacaugugug

SEQ ID NO: 309931 - RNA, 22 nt, Human
cugggccaucagaggggcugga

SEQ ID NO: 309932 - RNA, 22 nt, Human
agcccuguuuaugccacaucau

SEQ ID NO: 309933 - RNA, 22 nt, Human
gagagcugcaagguagggcggg

SEQ ID NO: 309934 - RNA, 22 nt, Human
cccagccucuguuugcuccucu

SEQ ID NO: 309935 - RNA, 22 nt, Human
ccagcuuuucuuaucauuauaa

SEQ ID NO: 309936 - RNA, 22 nt, Human
ucaagcaggguagcaagcuggu

SEQ ID NO: 309937 - RNA, 21 nt, Human
ucuguacaucauugagucccc

SEQ ID NO: 309938 - RNA, 22 nt, Human
ucaauuaugccauugcaauauu

SEQ ID NO: 309939 - RNA, 22 nt, Human
agcaauaacagaaaacuuuccu

SEQ ID NO: 309940 - RNA, 18 nt, Human
ugucauaauauaucaccu

SEQ ID NO: 309941 - RNA, 22 nt, Human
gaccauuuuuacagagcauuca

SEQ ID NO: 309942 - RNA, 22 nt, Human
ucacaugcuacugagccagacc

SEQ ID NO: 309943 - RNA, 23 nt, Human
ggagccuggcauaugagacgcau

SEQ ID NO: 309944 - RNA, 22 nt, Human
ggcuccugauaggagaaugcgg

SEQ ID NO: 309945 - RNA, 22 nt, Human
aaaggccacugcaagggaaggu

SEQ ID NO: 309946 - RNA, 22 nt, Human
ccuucuccugccuuggguucau

SEQ ID NO: 309947 - RNA, 22 nt, Human
auauaacauacauacagaaaag

SEQ ID NO: 309948 - RNA, 22 nt, Human
aaauguguuucuuugugaaugg

SEQ ID NO: 309949 - RNA, 22 nt, Human
uaugcauaauuggauaaguaga

SEQ ID NO: 309950 - RNA, 22 nt, Human
uggcagcaaaaccagaaucaga

SEQ ID NO: 309951 - RNA, 22 nt, Human
aaugucugagucucuguauccc

SEQ ID NO: 309952 - RNA, 22 nt, Human
accauguguuuuacacauggua

SEQ ID NO: 309953 - RNA, 22 nt, Human
auuauguauuugguauaguuug

SEQ ID NO: 309954 - RNA, 22 nt, Human
acacagggauauuucagguggu

SEQ ID NO: 309955 - RNA, 22 nt, Human
uugcaauagccuuauuuccaaa

SEQ ID NO: 309956 - RNA, 22 nt, Human
auccaguuuaugucauauucuu

SEQ ID NO: 309957 - RNA, 22 nt, Human
aucuuucuauuucuaaaaacua

SEQ ID NO: 309958 - RNA, 22 nt, Human
aaaguuagaaugauaucaacga

SEQ ID NO: 309959 - RNA, 22 nt, Human
uacaaacuuguuuuaaguaagu

SEQ ID NO: 309960 - RNA, 22 nt, Human
gucugucaucugagauggagug

SEQ ID NO: 309961 - RNA, 22 nt, Human
cagcucuggcuauugaggacca

SEQ ID NO: 309962 - RNA, 22 nt, Human
ugcauauugugaaaauguagau

SEQ ID NO: 309963 - RNA, 22 nt, Human
gugugcagugagcaaaagaucu

SEQ ID NO: 309964 - RNA, 22 nt, Human
ucucagagggaaaggccaauuu

SEQ ID NO: 309965 - RNA, 22 nt, Human
uuguuacacauaauaacauuuu

SEQ ID NO: 309966 - RNA, 21 nt, Human
guguuuccuguuuauggcuug

SEQ ID NO: 309967 - RNA, 22 nt, Human
auaaucuuucuuuuccagauag

SEQ ID NO: 309968 - RNA, 22 nt, Human
gcucugggugaacuuggagcaa

SEQ ID NO: 309969 - RNA, 22 nt, Human
uuugcuauaaaagggucacacg

SEQ ID NO: 309970 - RNA, 20 nt, Human
ucugcucagcccucaguggc

SEQ ID NO: 309971 - RNA, 22 nt, Human
acuacuuugggccauuuguuua

SEQ ID NO: 309972 - RNA, 22 nt, Human
uuugcauuuccagaguagcaga

SEQ ID NO: 309973 - RNA, 22 nt, Human
ccugagagagaagcgaccuggu

SEQ ID NO: 309974 - RNA, 23 nt, Human
cccuggccuuggggcacaggcug

SEQ ID NO: 309975 - RNA, 22 nt, Human
augaagcugaaaaaggcauaua

SEQ ID NO: 309976 - RNA, 22 nt, Human
ucccagagaaagucaaggucuu

SEQ ID NO: 309977 - RNA, 22 nt, Human
cugcagagcuaggcugagugaa

SEQ ID NO: 309978 - RNA, 18 nt, Human
aaagaaggauuggagagc

SEQ ID NO: 309979 - RNA, 22 nt, Human
ugagccaguggaagauggcagu

SEQ ID NO: 309980 - RNA, 21 nt, Human
aaauacagaaacuuguuuuca

SEQ ID NO: 309981 - RNA, 22 nt, Human
gcccaugcucucaggcgggccu

SEQ ID NO: 309982 - RNA, 23 nt, Human
gagguacagcaccagugaauagg

SEQ ID NO: 309983 - RNA, 22 nt, Human
acuguguggaaauuugugaggg

SEQ ID NO: 309984 - RNA, 22 nt, Human
uccagggagagccgcugcucca

SEQ ID NO: 309985 - RNA, 20 nt, Human
aucuucuuggccagcuugcu

SEQ ID NO: 309986 - RNA, 22 nt, Human
cagagcuggagaaguggauuua

SEQ ID NO: 309987 - RNA, 22 nt, Human
uacuuacagaaggaagcaauug

SEQ ID NO: 309988 - RNA, 22 nt, Human
gcagggcacagacagugccaag

SEQ ID NO: 309989 - RNA, 22 nt, Human
gaagaagacauggaacaauagu

SEQ ID NO: 309990 - RNA, 22 nt, Human
uuuccucuuuguaccuugacua

SEQ ID NO: 309991 - RNA, 22 nt, Human
cagagcugguaagugguagagg

SEQ ID NO: 309992 - RNA, 22 nt, Human
ucagaacauugacauucuuauu

SEQ ID NO: 309993 - RNA, 22 nt, Human
gagggcacaaaggcaacauuca

SEQ ID NO: 309994 - RNA, 22 nt, Human
aggaggugacagccugcaucug

SEQ ID NO: 309995 - RNA, 20 nt, Human
gagagcuggggaugaggcug

SEQ ID NO: 309996 - RNA, 22 nt, Human
aagauaauauucauuaacuaga

SEQ ID NO: 309997 - RNA, 20 nt, Human
aggagccauugacugcagca

SEQ ID NO: 309998 - RNA, 21 nt, Human
aucucgggcuucucgcccagc

SEQ ID NO: 309999 - RNA, 22 nt, Human
accaggggaugguuggcacugu

SEQ ID NO: 310000 - RNA, 22 nt, Human
aguccaggaguugggugacauu

SEQ ID NO: 310001 - RNA, 22 nt, Human
uaguaucuauuaguaacaagag

SEQ ID NO: 310002 - RNA, 22 nt, Human
gaacaggguugggugagagagg

SEQ ID NO: 310003 - RNA, 22 nt, Human
caucucaugggcaugccaagcu

SEQ ID NO: 310004 - RNA, 22 nt, Human
agagugauucuaguuagggaau

SEQ ID NO: 310005 - RNA, 22 nt, Human
auugcuguaaauuaucuuauua

SEQ ID NO: 310006 - RNA, 19 nt, Human
ugccugucaguagaucuca

SEQ ID NO: 310007 - RNA, 22 nt, Human
ugccaggagagugcaugcaggg

SEQ ID NO: 310008 - RNA, 22 nt, Human
gaaggagagggucaaggauaau

SEQ ID NO: 310009 - RNA, 22 nt, Human
uuaacagauguuuauggagcau

SEQ ID NO: 310010 - RNA, 22 nt, Human
cagaguguuagcgcugguuggg

SEQ ID NO: 310011 - RNA, 22 nt, Human
gcugggagccguaccugucacg

SEQ ID NO: 310012 - RNA, 22 nt, Human
cagggagaagucuggucagucc

SEQ ID NO: 310013 - RNA, 22 nt, Human
cuguagccaguuuggccucacc

SEQ ID NO: 310014 - RNA, 22 nt, Human
uccuggaggggacagcaugggc

SEQ ID NO: 310015 - RNA, 22 nt, Human
gcaccaggcuuagagccccagg

SEQ ID NO: 310016 - RNA, 22 nt, Human
gagcugggcgagccggggaagu

SEQ ID NO: 310017 - RNA, 22 nt, Human
gagccugaaauacaggucacug

SEQ ID NO: 310018 - RNA, 22 nt, Human
agccagcaggugagugcagccu

SEQ ID NO: 310019 - RNA, 22 nt, Human
cucucugguuucagcgaagggg

SEQ ID NO: 310020 - RNA, 22 nt, Human
agcuucuguucaucuuccaggc

SEQ ID NO: 310021 - RNA, 22 nt, Human
agucucaggcagaggaaggcua

SEQ ID NO: 310022 - RNA, 22 nt, Human
gcguaaggccucuggucucgga

SEQ ID NO: 310023 - RNA, 22 nt, Human
cuggcucacuagcccugcccug

SEQ ID NO: 310024 - RNA, 22 nt, Human
aaaugauugucaaaguucuguu

SEQ ID NO: 310025 - RNA, 22 nt, Human
aggccagggucccacacucgca

SEQ ID NO: 310026 - RNA, 22 nt, Human
ccaaggagaaaugcugugcuuu

SEQ ID NO: 310027 - RNA, 22 nt, Human
uauagccauuuccaguggcauc

SEQ ID NO: 310028 - RNA, 22 nt, Human
acuuccuguuaugugugccucu

SEQ ID NO: 310029 - RNA, 22 nt, Human
uuggaaggagucaaccagcuga

SEQ ID NO: 310030 - RNA, 21 nt, Human
gacaaagugaagcaggcagga

SEQ ID NO: 310031 - RNA, 22 nt, Human
auuuccuuugcaaagacugugc

SEQ ID NO: 310032 - RNA, 22 nt, Human
uuguuuaaaagaaaucauagaa

SEQ ID NO: 310033 - RNA, 22 nt, Human
ucagugcuugccucuggaggag

SEQ ID NO: 310034 - RNA, 22 nt, Human
aggccagcccugggcugagaga

SEQ ID NO: 310035 - RNA, 22 nt, Human
ugaacccaggagguugcaguga

SEQ ID NO: 310036 - RNA, 22 nt, Human
gcugggcuugguuucccugcuu

SEQ ID NO: 310037 - RNA, 22 nt, Human
cuucuggaggacacuggcccca

SEQ ID NO: 310038 - RNA, 22 nt, Human
uuugaaagccuggcuuuucucu

SEQ ID NO: 310039 - RNA, 22 nt, Human
augucuuucucacagccaguuc

SEQ ID NO: 310040 - RNA, 22 nt, Human
uggcagaguucgcuccuauuca

SEQ ID NO: 310041 - RNA, 22 nt, Human
auguacaaucuaucacaagaag

SEQ ID NO: 310042 - RNA, 20 nt, Human
gcucaguggagaaaugcacc

SEQ ID NO: 310043 - RNA, 22 nt, Human
ucuguuccaguagaaaggugca

SEQ ID NO: 310044 - RNA, 19 nt, Human
ucucuggggacacuuucac

SEQ ID NO: 310045 - RNA, 22 nt, Human
gcccagcugagaagcgcggggc

SEQ ID NO: 310046 - RNA, 22 nt, Human
aucuugcauuugcuaaaaugca

SEQ ID NO: 310047 - RNA, 22 nt, Human
guaacauaguuugugcuucauc

SEQ ID NO: 310048 - RNA, 17 nt, Human
cagugcagagcccuuuc

SEQ ID NO: 310049 - RNA, 22 nt, Human
ucauugucuugauaugauuguc

SEQ ID NO: 310050 - RNA, 22 nt, Human
cauuuacacuucuaaccacaag

SEQ ID NO: 310051 - RNA, 22 nt, Human
ucucaggggccuggaguccugg

SEQ ID NO: 310052 - RNA, 22 nt, Human
gccagcaguauguccuggcagu

SEQ ID NO: 310053 - RNA, 22 nt, Human
ucagaacagaagaaggaacacg

SEQ ID NO: 310054 - RNA, 22 nt, Human
ggcugggagcuggacaggccgg

SEQ ID NO: 310055 - RNA, 20 nt, Human
ugcagcugcaggaggguggg

SEQ ID NO: 310056 - RNA, 22 nt, Human
aguggaccagaagacugaagcu

SEQ ID NO: 310057 - RNA, 22 nt, Human
aaaaaaucagaucuuugguuaa

SEQ ID NO: 310058 - RNA, 22 nt, Human
cugagggcccugaagcuuggca

SEQ ID NO: 310059 - RNA, 22 nt, Human
cccagggucccugcucucugug

SEQ ID NO: 310060 - RNA, 19 nt, Human
augucuguugaauuucaua

SEQ ID NO: 310061 - RNA, 22 nt, Human
cucacugugccuuuucccaaac

SEQ ID NO: 310062 - RNA, 19 nt, Human
cugggagguguucagagaa

SEQ ID NO: 310063 - RNA, 22 nt, Human
ucagagaaaugaaguagggauu

SEQ ID NO: 310064 - RNA, 22 nt, Human
gcagugggagcuuaggcagugc

SEQ ID NO: 310065 - RNA, 22 nt, Human
ggagccaguuuagaccucaguu

SEQ ID NO: 310066 - RNA, 22 nt, Human
agggcagcagcccauggcucug

SEQ ID NO: 310067 - RNA, 22 nt, Human
uaugagaaaauaaauaucuguu

SEQ ID NO: 310068 - RNA, 22 nt, Human
ucucagagugacaaugagaauu

SEQ ID NO: 310069 - RNA, 22 nt, Human
aguguauugauuggaacagccu

SEQ ID NO: 310070 - RNA, 22 nt, Human
gccucugcccuccugggacugc

SEQ ID NO: 310071 - RNA, 22 nt, Human
auuauaggcuugagccaccgug

SEQ ID NO: 310072 - RNA, 22 nt, Human
ggccuguccagccugccuggcu

SEQ ID NO: 310073 - RNA, 22 nt, Human
ucaaauaccagcaauuucaugu

SEQ ID NO: 310074 - RNA, 22 nt, Human
uuuuaucuaccuaugcucauuu

SEQ ID NO: 310075 - RNA, 22 nt, Human
gcccagcuuuuugaggcaggca

SEQ ID NO: 310076 - RNA, 22 nt, Human
cacucaggguacaauggagggc

SEQ ID NO: 310077 - RNA, 22 nt, Human
ggcuggcuugccaagcucaggg

SEQ ID NO: 310078 - RNA, 22 nt, Human
cucuucagauaaaagggauauu

SEQ ID NO: 310079 - RNA, 22 nt, Human
uuggaaauggcuguaguuauga

SEQ ID NO: 310080 - RNA, 22 nt, Human
ggagagcaggguccugagauac

SEQ ID NO: 310081 - RNA, 22 nt, Human
caguagcauguaauaaagacag

SEQ ID NO: 310082 - RNA, 22 nt, Human
gagcagcugagcuggaaugaga

SEQ ID NO: 310083 - RNA, 22 nt, Human
cagucccagacccagaaggugg

SEQ ID NO: 310084 - RNA, 22 nt, Human
cccaggcagagagcuggugagc

SEQ ID NO: 310085 - RNA, 22 nt, Human
ggcacugagaggcucuuccuaa

SEQ ID NO: 310086 - RNA, 22 nt, Human
caggcugcagugcaguggcuau

SEQ ID NO: 310087 - RNA, 22 nt, Human
aggcaguuguugcugagcagcu

SEQ ID NO: 310088 - RNA, 18 nt, Human
gcagagugcgucucugug

SEQ ID NO: 310089 - RNA, 22 nt, Human
acucaggaagaaagcagcuggu

SEQ ID NO: 310090 - RNA, 21 nt, Human
gccaccucgucucggagcagc

SEQ ID NO: 310091 - RNA, 18 nt, Human
cccagcccaccauuucuc

SEQ ID NO: 310092 - RNA, 22 nt, Human
ucaugaauauugaaugcuucau

SEQ ID NO: 310093 - RNA, 22 nt, Human
cagucucucugaaguauuaaga

SEQ ID NO: 310094 - RNA, 22 nt, Human
cuggcucccguuguccuugaag

SEQ ID NO: 310095 - RNA, 22 nt, Human
aauguaugaagguuccaguuuc

SEQ ID NO: 310096 - RNA, 22 nt, Human
gcugccuguugaagggucugug

SEQ ID NO: 310097 - RNA, 22 nt, Human
auaauguagguauguguauuua

SEQ ID NO: 310098 - RNA, 22 nt, Human
gcuuugaagucugugucuuuug

SEQ ID NO: 310099 - RNA, 22 nt, Human
aggaaaaaagucugugauuaua

SEQ ID NO: 310100 - RNA, 22 nt, Human
agagcuguuuggacaucugagu

SEQ ID NO: 310101 - RNA, 22 nt, Human
auugcacaaacacagucagacu

SEQ ID NO: 310102 - RNA, 22 nt, Human
aaauuuaagaagugugugcgug

SEQ ID NO: 310103 - RNA, 22 nt, Human
ggaagagccuggggugucaggc

SEQ ID NO: 310104 - RNA, 20 nt, Human
agcugaggcaccugagguua

SEQ ID NO: 310105 - RNA, 22 nt, Human
uucaggauucucucccauuuac

SEQ ID NO: 310106 - RNA, 22 nt, Human
aggagggauagaaaaauacuug

SEQ ID NO: 310107 - RNA, 22 nt, Human
gaaugcagauggcugguguaug

SEQ ID NO: 310108 - RNA, 22 nt, Human
ucgugucagaucagagguuccu

SEQ ID NO: 310109 - RNA, 22 nt, Human
uggcucugggaaucuguugcuu

SEQ ID NO: 310110 - RNA, 22 nt, Human
cagagcugagaauguugaugcu

SEQ ID NO: 310111 - RNA, 19 nt, Human
gcucagagggcccugugcu

SEQ ID NO: 310112 - RNA, 22 nt, Human
guugaaugaaucauucuaugua

SEQ ID NO: 310113 - RNA, 22 nt, Human
caguacugcuugugggagcaga

SEQ ID NO: 310114 - RNA, 22 nt, Human
caggcagcauuuacucugauga

SEQ ID NO: 310115 - RNA, 22 nt, Human
aacaucuacuaagugccaggca

SEQ ID NO: 310116 - RNA, 22 nt, Human
agucucugcacaguaagaagca

SEQ ID NO: 310117 - RNA, 22 nt, Human
gggacuguaaauucauauggcc

SEQ ID NO: 310118 - RNA, 22 nt, Human
ggugggcaggcgaggcccaggu

SEQ ID NO: 310119 - RNA, 22 nt, Human
ggcacugauuccauucaugaag

SEQ ID NO: 310120 - RNA, 22 nt, Human
agaaauguggaucguuuuaaaa

SEQ ID NO: 310121 - RNA, 22 nt, Human
ucaggaugagcucauaacuaug

SEQ ID NO: 310122 - RNA, 22 nt, Human
aggugccaauuuucagugaaca

SEQ ID NO: 310123 - RNA, 20 nt, Human
ucugucucugagcuagacuu

SEQ ID NO: 310124 - RNA, 22 nt, Human
uguuugaacugaauaacauagu

SEQ ID NO: 310125 - RNA, 22 nt, Human
ucaguguuuuaacugucuuuua

SEQ ID NO: 310126 - RNA, 22 nt, Human
cagagcagaaaccugggugauu

SEQ ID NO: 310127 - RNA, 22 nt, Human
uagcagggucucaggagucagg

SEQ ID NO: 310128 - RNA, 22 nt, Human
uguuuuaugagccauauaaccu

SEQ ID NO: 310129 - RNA, 23 nt, Human
aggcccaacucugugagggcugc

SEQ ID NO: 310130 - RNA, 22 nt, Human
guuugaaugcaguaugcauuuu

SEQ ID NO: 310131 - RNA, 22 nt, Human
gcugggcucuuuaccccuguac

SEQ ID NO: 310132 - RNA, 22 nt, Human
acaugcauucucuaaaagcaaa

SEQ ID NO: 310133 - RNA, 22 nt, Human
agcugccuguccuaggccauca

SEQ ID NO: 310134 - RNA, 22 nt, Human
augcccgauaccuaguuaacuc

SEQ ID NO: 310135 - RNA, 19 nt, Human
gcaggcaguggcauucgga

SEQ ID NO: 310136 - RNA, 22 nt, Human
acagagcauuugggacagagag

SEQ ID NO: 310137 - RNA, 22 nt, Human
agcuggcauacuuugcuaggaa

SEQ ID NO: 310138 - RNA, 22 nt, Human
uuauccaaacuggugaaucauu

SEQ ID NO: 310139 - RNA, 22 nt, Human
agagcugaaaaagcugacccgg

SEQ ID NO: 310140 - RNA, 22 nt, Human
ucuuggagaauggcagagaagc

SEQ ID NO: 310141 - RNA, 22 nt, Human
caguuucuucaucaguuaagca

SEQ ID NO: 310142 - RNA, 22 nt, Human
auguuucagauacagaucaaau

SEQ ID NO: 310143 - RNA, 22 nt, Human
acacaggagauauguaauggcu

SEQ ID NO: 310144 - RNA, 22 nt, Human
aaucuggcauguaagcuuagag

SEQ ID NO: 310145 - RNA, 22 nt, Human
auaaacacuucuagggcacaca

SEQ ID NO: 310146 - RNA, 22 nt, Human
aaggagagagcuuugcuggaac

SEQ ID NO: 310147 - RNA, 22 nt, Human
cuugcugggguaagucugugcu

SEQ ID NO: 310148 - RNA, 22 nt, Human
gagccagcugagcugcacuguc

SEQ ID NO: 310149 - RNA, 22 nt, Human
ucucuucugaaaccugucuuua

SEQ ID NO: 310150 - RNA, 22 nt, Human
aagauuuacuagcauaauagcu

SEQ ID NO: 310151 - RNA, 22 nt, Human
gccuggagggucccucucugga

SEQ ID NO: 310152 - RNA, 22 nt, Human
ucagugugcacaugguagcagu

SEQ ID NO: 310153 - RNA, 22 nt, Human
uagaaacucaggauacucuucc

SEQ ID NO: 310154 - RNA, 22 nt, Human
caggacaguuugcuuugcccug

SEQ ID NO: 310155 - RNA, 22 nt, Human
caaauuacccucaacaucuaga

SEQ ID NO: 310156 - RNA, 22 nt, Human
gcauaauauacaugcuugaucc

SEQ ID NO: 310157 - RNA, 22 nt, Human
cagcccugucccugagggaccu

SEQ ID NO: 310158 - RNA, 21 nt, Human
ugagagccuccaaccggcuac

SEQ ID NO: 310159 - RNA, 19 nt, Human
agcuuccauauucucuagu

SEQ ID NO: 310160 - RNA, 22 nt, Human
gugccugcugcagagucgcugu

SEQ ID NO: 310161 - RNA, 22 nt, Human
cuggccaacuugcuuguuggca

SEQ ID NO: 310162 - RNA, 22 nt, Human
ucugagaggcagaccuuccuaa

SEQ ID NO: 310163 - RNA, 22 nt, Human
ggaagaaaucugguuaagagau

SEQ ID NO: 310164 - RNA, 22 nt, Human
acugaaggaaagccuuugcaug

SEQ ID NO: 310165 - RNA, 22 nt, Human
cauugcacuccaucuugggcaa

SEQ ID NO: 310166 - RNA, 22 nt, Human
cagggacaugacuggucucugu

SEQ ID NO: 310167 - RNA, 22 nt, Human
gcuguccucugaucucuggagg

SEQ ID NO: 310168 - RNA, 22 nt, Human
uuucuuaguccuagagugauuu

SEQ ID NO: 310169 - RNA, 22 nt, Human
uaguuuuacuugcgaugauaau

SEQ ID NO: 310170 - RNA, 22 nt, Human
cccucagucuggcugggaagac

SEQ ID NO: 310171 - RNA, 22 nt, Human
cugggcugcgggcgccccucca

SEQ ID NO: 310172 - RNA, 22 nt, Human
cauugcacaucugagaagagau

SEQ ID NO: 310173 - RNA, 22 nt, Human
ugccugucagggggagugggaa

SEQ ID NO: 310174 - RNA, 22 nt, Human
ggcccugggcagaggagugggc

SEQ ID NO: 310175 - RNA, 22 nt, Human
cacauuucuaggaaauuaaaug

SEQ ID NO: 310176 - RNA, 22 nt, Human
uacagggguaacaguggggaau

SEQ ID NO: 310177 - RNA, 22 nt, Human
gcaaauauucaagacuuuucca

SEQ ID NO: 310178 - RNA, 22 nt, Human
caggauggagggagggcuguua

SEQ ID NO: 310179 - RNA, 22 nt, Human
gccugagcccaggugugcagag

SEQ ID NO: 310180 - RNA, 20 nt, Human
uauuuagauucaaguaugga

SEQ ID NO: 310181 - RNA, 22 nt, Human
acucugagcaucccaagucuua

SEQ ID NO: 310182 - RNA, 22 nt, Human
cagcccuggcuagggcgagggc

SEQ ID NO: 310183 - RNA, 22 nt, Human
uucugaggcacuggcucuccca

SEQ ID NO: 310184 - RNA, 22 nt, Human
aaccaggacaauuuugaaagua

SEQ ID NO: 310185 - RNA, 22 nt, Human
gacaggaggcagagcucaggug

SEQ ID NO: 310186 - RNA, 22 nt, Human
cggcagagcuuccugcucagcg

SEQ ID NO: 310187 - RNA, 22 nt, Human
uauuccaaaaucccaaacugcc

SEQ ID NO: 310188 - RNA, 22 nt, Human
ugaaggagaauuaauaggcauu

SEQ ID NO: 310189 - RNA, 22 nt, Human
gccagagccggcuucacaggau

SEQ ID NO: 310190 - RNA, 22 nt, Human
aguagaaagaaggcacugggcc

SEQ ID NO: 310191 - RNA, 18 nt, Human
gccugccuagagcuugcc

SEQ ID NO: 310192 - RNA, 22 nt, Human
ggagacaugcagacugagauac

SEQ ID NO: 310193 - RNA, 22 nt, Human
gccuccuggccuuugcuccuca

SEQ ID NO: 310194 - RNA, 22 nt, Human
uaaauguguguagccaucugug

SEQ ID NO: 310195 - RNA, 22 nt, Human
agggcagaaaucgauuacaccu

SEQ ID NO: 310196 - RNA, 22 nt, Human
ugagagcagaggugggcagccu

SEQ ID NO: 310197 - RNA, 22 nt, Human
cuggccacuggagguggcaccc

SEQ ID NO: 310198 - RNA, 21 nt, Human
agggccugugcucuccagguc

SEQ ID NO: 310199 - RNA, 22 nt, Human
gcaggcaguuauuuaguagaau

SEQ ID NO: 310200 - RNA, 22 nt, Human
aguuagaauauaauuauguuaa

SEQ ID NO: 310201 - RNA, 22 nt, Human
gggcucuggaaggugcaccaug

SEQ ID NO: 310202 - RNA, 22 nt, Human
uauuucuucgggauucaagcua

SEQ ID NO: 310203 - RNA, 22 nt, Human
gauauuuugagaaauccuauga

SEQ ID NO: 310204 - RNA, 22 nt, Human
ucagugcacagagauuuuuguu

SEQ ID NO: 310205 - RNA, 22 nt, Human
ccuggcagacagcacugaagcu

SEQ ID NO: 310206 - RNA, 22 nt, Human
ugucagggcaugcgguccagcc

SEQ ID NO: 310207 - RNA, 21 nt, Human
ggugggcacaggagagcagag

SEQ ID NO: 310208 - RNA, 22 nt, Human
cccugccugugggcaucaacau

SEQ ID NO: 310209 - RNA, 22 nt, Human
cagcccagcagucuuagccugc

SEQ ID NO: 310210 - RNA, 22 nt, Human
caaaauguucuggcaccuuuaa

SEQ ID NO: 310211 - RNA, 22 nt, Human
guacauuucucuuguucuuauu

SEQ ID NO: 310212 - RNA, 22 nt, Human
uggcagcuccuggggccagcac

SEQ ID NO: 310213 - RNA, 22 nt, Human
ccagcagagggucuuggccauu

SEQ ID NO: 310214 - RNA, 22 nt, Human
aaaguuaguuucuuauaugucu

SEQ ID NO: 310215 - RNA, 22 nt, Human
ucucaguggacgugucugucuu

SEQ ID NO: 310216 - RNA, 22 nt, Human
ucuguaguagguuguaguucuu

SEQ ID NO: 310217 - RNA, 22 nt, Human
aagcccaguuucacacugagac

SEQ ID NO: 310218 - RNA, 22 nt, Human
cagcugccacaggacuuucuga

SEQ ID NO: 310219 - RNA, 22 nt, Human
aggccuccugcagggaugagug

SEQ ID NO: 310220 - RNA, 22 nt, Human
aaucuucuacuugacaguucuc

SEQ ID NO: 310221 - RNA, 22 nt, Human
cauuuguaucauauguaucuua

SEQ ID NO: 310222 - RNA, 22 nt, Human
uagacauuagguagguucaugg

SEQ ID NO: 310223 - RNA, 22 nt, Human
ggucacaggggagaagagugau

SEQ ID NO: 310224 - RNA, 22 nt, Human
caguccugggcacagcccuggg

SEQ ID NO: 310225 - RNA, 22 nt, Human
gucccuggggaaucagcuggag

SEQ ID NO: 310226 - RNA, 22 nt, Human
agugggcagugcgcucggaugc

SEQ ID NO: 310227 - RNA, 22 nt, Human
ggaggaggcaaguaccagaugc

SEQ ID NO: 310228 - RNA, 22 nt, Human
uguguauuucuggaacagacua

SEQ ID NO: 310229 - RNA, 22 nt, Human
ccagcugaggcagccacacagg

SEQ ID NO: 310230 - RNA, 19 nt, Human
caaggguugggucugucau

SEQ ID NO: 310231 - RNA, 18 nt, Human
acacugcagcagucugcu

SEQ ID NO: 310232 - RNA, 22 nt, Human
gccaccagggggcuccagugag

SEQ ID NO: 310233 - RNA, 22 nt, Human
gccugugcuuaacugacgugag

SEQ ID NO: 310234 - RNA, 22 nt, Human
ucaaaguagggguaagccaggc

SEQ ID NO: 310235 - RNA, 22 nt, Human
uuauuccauagaagucaaggaa

SEQ ID NO: 310236 - RNA, 22 nt, Human
uguggccucaaggcugcccuca

SEQ ID NO: 310237 - RNA, 22 nt, Human
aagcaaagaguuuaguggguga

SEQ ID NO: 310238 - RNA, 23 nt, Human
agucuucauuguauuuccagacc

SEQ ID NO: 310239 - RNA, 23 nt, Human
cuggcucauccugguugcagugg

SEQ ID NO: 310240 - RNA, 22 nt, Human
gccucugccaagggggcugcgg

SEQ ID NO: 310241 - RNA, 22 nt, Human
uuagaaagcuuuccauagucaa

SEQ ID NO: 310242 - RNA, 22 nt, Human
cuuaaaaucuggcaguuagcua

SEQ ID NO: 310243 - RNA, 22 nt, Human
uacuaucucuucuaacuucaga

SEQ ID NO: 310244 - RNA, 22 nt, Human
uucuccgcuaaguucucugcag

SEQ ID NO: 310245 - RNA, 22 nt, Human
cugcuuuggcucagugacauca

SEQ ID NO: 310246 - RNA, 22 nt, Human
gcugccucaggcaccuccuggc

SEQ ID NO: 310247 - RNA, 22 nt, Human
cugggcuagaaggaccaggaug

SEQ ID NO: 310248 - RNA, 22 nt, Human
ucugugcugucucagagaaagc

SEQ ID NO: 310249 - RNA, 22 nt, Human
gggcucuguccauuccuucaua

SEQ ID NO: 310250 - RNA, 22 nt, Human
gauuuccuaauguggaucucug

SEQ ID NO: 310251 - RNA, 20 nt, Human
uacuugaauguugcagcagu

SEQ ID NO: 310252 - RNA, 18 nt, Human
cucucuggucuggauccc

SEQ ID NO: 310253 - RNA, 22 nt, Human
ucauugaauuucacagcuuuau

SEQ ID NO: 310254 - RNA, 22 nt, Human
agggcagccaugagccuucagg

SEQ ID NO: 310255 - RNA, 22 nt, Human
ggagcagcuugcaugcucaggg

SEQ ID NO: 310256 - RNA, 22 nt, Human
uuccugaugcacacagucauuu

SEQ ID NO: 310257 - RNA, 22 nt, Human
uccucagucguuugagccaaaa

SEQ ID NO: 310258 - RNA, 22 nt, Human
uucuuucccagaagauauguuu

SEQ ID NO: 310259 - RNA, 22 nt, Human
cacaggguuguucugaggauuc

SEQ ID NO: 310260 - RNA, 22 nt, Human
ccaccagcagugugcaaggauu

SEQ ID NO: 310261 - RNA, 22 nt, Human
accccaagacaguagaagagaa

SEQ ID NO: 310262 - RNA, 22 nt, Human
ucccagagaagagcuggaugga

SEQ ID NO: 310263 - RNA, 22 nt, Human
auaugcauaugucaaaacuuau

SEQ ID NO: 310264 - RNA, 22 nt, Human
caccagcagaagacugagggug

SEQ ID NO: 310265 - RNA, 22 nt, Human
augaagcugguuuuggcuuggg

SEQ ID NO: 310266 - RNA, 22 nt, Human
aaauuguugaucuacaguaagg

SEQ ID NO: 310267 - RNA, 22 nt, Human
gugaaggacugaaugaaaaugu

SEQ ID NO: 310268 - RNA, 22 nt, Human
uccugagagcagaguccaggug

SEQ ID NO: 310269 - RNA, 21 nt, Human
gcaggcuggucaaaccucagu

SEQ ID NO: 310270 - RNA, 20 nt, Human
ucagugauuaucucugagug

SEQ ID NO: 310271 - RNA, 22 nt, Human
agagaugaagggcauuccccag

SEQ ID NO: 310272 - RNA, 22 nt, Human
cucagggcaguauggcugagag

SEQ ID NO: 310273 - RNA, 21 nt, Human
aaggagccuaggaggcucagg

SEQ ID NO: 310274 - RNA, 22 nt, Human
ccuagagcucugcuuuaucuaa

SEQ ID NO: 310275 - RNA, 22 nt, Human
agggaaaguaagcauuucauua

SEQ ID NO: 310276 - RNA, 20 nt, Human
cacagcuugccuuuuaugac

SEQ ID NO: 310277 - RNA, 22 nt, Human
uccagagcagguggucagaagg

SEQ ID NO: 310278 - RNA, 22 nt, Human
cuagucacucagcacugacaaa

SEQ ID NO: 310279 - RNA, 22 nt, Human
acaaagucugaaaccugaggca

SEQ ID NO: 310280 - RNA, 22 nt, Human
guguccagggccguguugucuu

SEQ ID NO: 310281 - RNA, 18 nt, Human
ucaguccuccauagagcu

SEQ ID NO: 310282 - RNA, 22 nt, Human
ucaucuaagagucuuacauuua

SEQ ID NO: 310283 - RNA, 22 nt, Human
ugaaagcucugucaucauuccu

SEQ ID NO: 310284 - RNA, 22 nt, Human
gaagcccaggcuuccuuggcuu

SEQ ID NO: 310285 - RNA, 22 nt, Human
uggcaggguggcaacuuuuggu

SEQ ID NO: 310286 - RNA, 22 nt, Human
ccuggcagguggcgcccucggc

SEQ ID NO: 310287 - RNA, 22 nt, Human
gucuuguuugggauguggaugg

SEQ ID NO: 310288 - RNA, 19 nt, Human
ggcugccuuuccuuaccag

SEQ ID NO: 310289 - RNA, 22 nt, Human
aagaaauuaaugugccauuacu

SEQ ID NO: 310290 - RNA, 22 nt, Human
cagcucugacacaguacaaaau

SEQ ID NO: 310291 - RNA, 22 nt, Human
auuacaaucgagagaaacaaau

SEQ ID NO: 310292 - RNA, 22 nt, Human
cacagaguggaggcuuggccug

SEQ ID NO: 310293 - RNA, 22 nt, Human
agacuuuaaugugcaaaugaaa

SEQ ID NO: 310294 - RNA, 22 nt, Human
cagagguauugcaaaagccuag

SEQ ID NO: 310295 - RNA, 22 nt, Human
gagcucagcacuaaaaucaugu

SEQ ID NO: 310296 - RNA, 22 nt, Human
cagcccacugccucugugguag

SEQ ID NO: 310297 - RNA, 18 nt, Human
uccucucuuuccccaggg

SEQ ID NO: 310298 - RNA, 22 nt, Human
uaauuuaauuccauggauucua

SEQ ID NO: 310299 - RNA, 23 nt, Human
uguaaaaugggguaguguuacca

SEQ ID NO: 310300 - RNA, 22 nt, Human
acucuucuugcugcucauuaau

SEQ ID NO: 310301 - RNA, 22 nt, Human
cagccccuuguccgguagccac

SEQ ID NO: 310302 - RNA, 22 nt, Human
cagugcaguggcugagcuggag

SEQ ID NO: 310303 - RNA, 22 nt, Human
uguugauuaguguuuagacuua

SEQ ID NO: 310304 - RNA, 22 nt, Human
cugggagaugacucagagcagg

SEQ ID NO: 310305 - RNA, 22 nt, Human
aauggccagcaacaggagugaa

SEQ ID NO: 310306 - RNA, 22 nt, Human
cggggcugcucguccuccugug

SEQ ID NO: 310307 - RNA, 22 nt, Human
gagcagugagugaauguugccu

SEQ ID NO: 310308 - RNA, 22 nt, Human
cugcagccuaggugcagcuggg

SEQ ID NO: 310309 - RNA, 22 nt, Human
uuugcauuucucguaaggaaac

SEQ ID NO: 310310 - RNA, 21 nt, Human
ccuccaggugauuccgugcuc

SEQ ID NO: 310311 - RNA, 22 nt, Human
ccauccuaucugaccuacuugu

SEQ ID NO: 310312 - RNA, 22 nt, Human
ccucugagaccagcucugcacc

SEQ ID NO: 310313 - RNA, 22 nt, Human
aggccuggccugggcggcauug

SEQ ID NO: 310314 - RNA, 22 nt, Human
cugauuccugauucaugcucuu

SEQ ID NO: 310315 - RNA, 22 nt, Human
ucacugcagacaaccucaguca

SEQ ID NO: 310316 - RNA, 22 nt, Human
uucuucaguguagcaacuguau

SEQ ID NO: 310317 - RNA, 22 nt, Human
gcugggagcccuggucugcucc

SEQ ID NO: 310318 - RNA, 22 nt, Human
gauguuuuaggucccuguagcu

SEQ ID NO: 310319 - RNA, 22 nt, Human
acaauacaggcuucuggacuua

SEQ ID NO: 310320 - RNA, 22 nt, Human
aucucuggccuuccuuuuccaa

SEQ ID NO: 310321 - RNA, 22 nt, Human
agucccaguucgguucuuccuc

SEQ ID NO: 310322 - RNA, 22 nt, Human
uggggacauagccagucuggcu

SEQ ID NO: 310323 - RNA, 22 nt, Human
uggcugcucaagggaggaggcu

SEQ ID NO: 310324 - RNA, 22 nt, Human
auacaucuugucagauucaugu

SEQ ID NO: 310325 - RNA, 22 nt, Human
cucagcagagaccagggaggaa

SEQ ID NO: 310326 - RNA, 22 nt, Human
gggccccaaaaugccaggcucu

SEQ ID NO: 310327 - RNA, 22 nt, Human
aagugguaggaagagagcacug

SEQ ID NO: 310328 - RNA, 22 nt, Human
uaugaacuagcugauuuaguuu

SEQ ID NO: 310329 - RNA, 22 nt, Human
uugaaagggauauaucuuucug

SEQ ID NO: 310330 - RNA, 22 nt, Human
uuuaucuuuggaucuucagaaa

SEQ ID NO: 310331 - RNA, 22 nt, Human
gaggucaggcuugcagcagggu

SEQ ID NO: 310332 - RNA, 20 nt, Human
uucaggauucuagaccacac

SEQ ID NO: 310333 - RNA, 22 nt, Human
cagcagagguuggaacaguucu

SEQ ID NO: 310334 - RNA, 22 nt, Human
uuucuucagccacuccaaacug

SEQ ID NO: 310335 - RNA, 22 nt, Human
agcugggaugauaaccucaguc

SEQ ID NO: 310336 - RNA, 22 nt, Human
ugucuucaucuccaugcacaga

SEQ ID NO: 310337 - RNA, 22 nt, Human
cucagaguggggcucccugagg

SEQ ID NO: 310338 - RNA, 22 nt, Human
agaaacauuuagauuauauguc

SEQ ID NO: 310339 - RNA, 22 nt, Human
uugccuugauucuucucaugug

SEQ ID NO: 310340 - RNA, 22 nt, Human
aucaguuuaaaugggcuguugg

SEQ ID NO: 310341 - RNA, 22 nt, Human
gugauuuugagaccuauauagu

SEQ ID NO: 310342 - RNA, 22 nt, Human
uuuucagugggcaaugauguga

SEQ ID NO: 310343 - RNA, 18 nt, Human
gcaggagauggguggggu

SEQ ID NO: 310344 - RNA, 22 nt, Human
cuucuugcaauuuucaucuuau

SEQ ID NO: 310345 - RNA, 22 nt, Human
cagggcaggacagauacauuac

SEQ ID NO: 310346 - RNA, 23 nt, Human
aaucuggcugauguuuuuucucu

SEQ ID NO: 310347 - RNA, 19 nt, Human
ccuggguccacucagacua

SEQ ID NO: 310348 - RNA, 22 nt, Human
cuucuucauaggcaguccuguu

SEQ ID NO: 310349 - RNA, 22 nt, Human
ggggacugccuuccacagacac

SEQ ID NO: 310350 - RNA, 22 nt, Human
uagaaaauagggccuguggagc

SEQ ID NO: 310351 - RNA, 22 nt, Human
cccuggaguagcacugggucgc

SEQ ID NO: 310352 - RNA, 22 nt, Human
ucagagucucccccaguuuggg

SEQ ID NO: 310353 - RNA, 22 nt, Human
ucaccagucuuucuuaccauug

SEQ ID NO: 310354 - RNA, 22 nt, Human
uccucagggaagaugagccuca

SEQ ID NO: 310355 - RNA, 22 nt, Human
cucuuccucucaugcggucaua

SEQ ID NO: 310356 - RNA, 22 nt, Human
gcuggccagggcugcucgcgga

SEQ ID NO: 310357 - RNA, 22 nt, Human
agaucaaagccaugagagauuu

SEQ ID NO: 310358 - RNA, 22 nt, Human
gcuccaguggacugggggaggc

SEQ ID NO: 310359 - RNA, 22 nt, Human
gcuggagccuucugcucuguug

SEQ ID NO: 310360 - RNA, 22 nt, Human
aauauuucuccuucguuauagc

SEQ ID NO: 310361 - RNA, 22 nt, Human
ugagccugguugcagugucugg

SEQ ID NO: 310362 - RNA, 22 nt, Human
acagaaagaagguguauuugag

SEQ ID NO: 310363 - RNA, 22 nt, Human
agagcugggugguggugacuca

SEQ ID NO: 310364 - RNA, 22 nt, Human
cuucucaguugcaagugucaga

SEQ ID NO: 310365 - RNA, 22 nt, Human
ggagccuguuaguugagugcuc

SEQ ID NO: 310366 - RNA, 17 nt, Human
ggcagcugugugcaugc

SEQ ID NO: 310367 - RNA, 22 nt, Human
cagucccacaagaucuccacaa

SEQ ID NO: 310368 - RNA, 22 nt, Human
uguguacaggccuugcuagacu

SEQ ID NO: 310369 - RNA, 22 nt, Human
accagagcuuacaugcuagaaa

SEQ ID NO: 310370 - RNA, 22 nt, Human
gaaaucugaacucuguauccuu

SEQ ID NO: 310371 - RNA, 22 nt, Human
ccgggccucgggacaccgggua

SEQ ID NO: 310372 - RNA, 22 nt, Human
aagagcuggauggaaucuggga

SEQ ID NO: 310373 - RNA, 22 nt, Human
aggaaaaauaaggcagcagggc

SEQ ID NO: 310374 - RNA, 22 nt, Human
uuucuucaauugcuaacaagga

SEQ ID NO: 310375 - RNA, 22 nt, Human
cagggacagccuugggguggcg

SEQ ID NO: 310376 - RNA, 22 nt, Human
auucauucugaccucaagagaa

SEQ ID NO: 310377 - RNA, 22 nt, Human
cugcccccaggcugcauggcug

SEQ ID NO: 310378 - RNA, 19 nt, Human
cauuuagaaguacauauua

SEQ ID NO: 310379 - RNA, 22 nt, Human
ucagcagggccuccuugugcag

SEQ ID NO: 310380 - RNA, 22 nt, Human
ccagccucacuggcaucaccua

SEQ ID NO: 310381 - RNA, 22 nt, Human
gcugucagcgcccaaggagcuc

SEQ ID NO: 310382 - RNA, 22 nt, Human
aguccuggccccaaggaaggau

SEQ ID NO: 310383 - RNA, 22 nt, Human
aggaaagcucccaguagggcuc

SEQ ID NO: 310384 - RNA, 22 nt, Human
agcaccuguggcucaugcucgu

SEQ ID NO: 310385 - RNA, 20 nt, Human
uuaagaaaagcacauccugc

SEQ ID NO: 310386 - RNA, 22 nt, Human
ugagaaagugggugccuagcaa

SEQ ID NO: 310387 - RNA, 22 nt, Human
ggcagcugaccuagcaccaucc

SEQ ID NO: 310388 - RNA, 22 nt, Human
cauggcccucuucuggagcaau

SEQ ID NO: 310389 - RNA, 22 nt, Human
uggagcagagaugggagcccaa

SEQ ID NO: 310390 - RNA, 22 nt, Human
ggaagaaagcacacaaacuuga

SEQ ID NO: 310391 - RNA, 22 nt, Human
acauuucucccugcaugccugc

SEQ ID NO: 310392 - RNA, 22 nt, Human
auguuuauguugggcuauauuu

SEQ ID NO: 310393 - RNA, 22 nt, Human
aggcugccaaagcuucugucuc

SEQ ID NO: 310394 - RNA, 22 nt, Human
agccugggcccugccucuucuc

SEQ ID NO: 310395 - RNA, 22 nt, Human
agccuggagcuugaguuaugag

SEQ ID NO: 310396 - RNA, 22 nt, Human
ggcccacacugacagcugagcu

SEQ ID NO: 310397 - RNA, 20 nt, Human
cucuccucacccgugucagg

SEQ ID NO: 310398 - RNA, 23 nt, Human
ucuggcucuaugugacagcucuc

SEQ ID NO: 310399 - RNA, 22 nt, Human
cugccuggagcauucugaaggu

SEQ ID NO: 310400 - RNA, 22 nt, Human
gauggcagguaguggucucauc

SEQ ID NO: 310401 - RNA, 20 nt, Human
auuuggcaugaaguauugau

SEQ ID NO: 310402 - RNA, 22 nt, Human
gcacccagaggucagcagugcu

SEQ ID NO: 310403 - RNA, 22 nt, Human
gaggggcagagguagagaacaa

SEQ ID NO: 310404 - RNA, 22 nt, Human
ggcuuccuuucacuacccucag

SEQ ID NO: 310405 - RNA, 22 nt, Human
agggggcaggagagaccugcug

SEQ ID NO: 310406 - RNA, 22 nt, Human
cagcucccaguggcagcuccuu

SEQ ID NO: 310407 - RNA, 22 nt, Human
gccuggagcagacgugucccgg

SEQ ID NO: 310408 - RNA, 22 nt, Human
guguccaucagcagccacugug

SEQ ID NO: 310409 - RNA, 22 nt, Human
aucuacagcugucugcacagua

SEQ ID NO: 310410 - RNA, 22 nt, Human
cuucaagauauuucuagaauca

SEQ ID NO: 310411 - RNA, 22 nt, Human
cuuauguaugcuacuuuguggu

SEQ ID NO: 310412 - RNA, 22 nt, Human
acuuagaacaggcagaauucca

SEQ ID NO: 310413 - RNA, 22 nt, Human
uggcacugggaugcuacuguua

SEQ ID NO: 310414 - RNA, 20 nt, Human
ccaagagcaugcaugaggaa

SEQ ID NO: 310415 - RNA, 17 nt, Human
uguggccuucugagcuu

SEQ ID NO: 310416 - RNA, 22 nt, Human
uugucuguccaggcaccccaag

SEQ ID NO: 310417 - RNA, 22 nt, Human
caguccugagccaaucaugaug

SEQ ID NO: 310418 - RNA, 22 nt, Human
cauguguuuugucauuucaaua

SEQ ID NO: 310419 - RNA, 22 nt, Human
uacaaagugagcaaccucuuuu

SEQ ID NO: 310420 - RNA, 17 nt, Human
ugaauucaaucugcacu

SEQ ID NO: 310421 - RNA, 22 nt, Human
cuccaggggccagaagccuggc

SEQ ID NO: 310422 - RNA, 22 nt, Human
agaggcugggaaggguccccgg

SEQ ID NO: 310423 - RNA, 22 nt, Human
ucuuuccucugagcuccuguag

SEQ ID NO: 310424 - RNA, 22 nt, Human
gguucacauauugagaguauuc

SEQ ID NO: 310425 - RNA, 22 nt, Human
agaccauagggaccucagguug

SEQ ID NO: 310426 - RNA, 22 nt, Human
ugcauuccuuugucuguuaaag

SEQ ID NO: 310427 - RNA, 22 nt, Human
ugccagcaguagcaguaggcca

SEQ ID NO: 310428 - RNA, 22 nt, Human
ucuguuuaggcaaaauagcuac

SEQ ID NO: 310429 - RNA, 22 nt, Human
gggaucagcaagccacugcacc

SEQ ID NO: 310430 - RNA, 22 nt, Human
gggccugacugagagcuccuca

SEQ ID NO: 310431 - RNA, 22 nt, Human
uaacagaaacagauaaguguaa

SEQ ID NO: 310432 - RNA, 22 nt, Human
gcuggcuguguuucaucucuga

SEQ ID NO: 310433 - RNA, 22 nt, Human
agagccuggcucccagcuaccg

SEQ ID NO: 310434 - RNA, 22 nt, Human
uggucucuucuuccaagauggc

SEQ ID NO: 310435 - RNA, 22 nt, Human
ucaaacuguuuacagugagaua

SEQ ID NO: 310436 - RNA, 22 nt, Human
gccucuggggcagcugagucau

SEQ ID NO: 310437 - RNA, 22 nt, Human
gcuggcuguaucaccuggccag

SEQ ID NO: 310438 - RNA, 22 nt, Human
ucaguucuuuauuucacaguga

SEQ ID NO: 310439 - RNA, 22 nt, Human
auuuagacuucccagcacugug

SEQ ID NO: 310440 - RNA, 22 nt, Human
augcacccagugucuggacuau

SEQ ID NO: 310441 - RNA, 18 nt, Human
gguggcucagucaugggg

SEQ ID NO: 310442 - RNA, 22 nt, Human
auauaauuguucugaaguguuu

SEQ ID NO: 310443 - RNA, 22 nt, Human
caguccagccaguagggugugg

SEQ ID NO: 310444 - RNA, 17 nt, Human
auguauauuaacucuga

SEQ ID NO: 310445 - RNA, 22 nt, Human
gccuggcccagggcuccgcagg

SEQ ID NO: 310446 - RNA, 22 nt, Human
gagaagccgagucagcugagcc

SEQ ID NO: 310447 - RNA, 22 nt, Human
guuccuauauagccuuaaggau

SEQ ID NO: 310448 - RNA, 22 nt, Human
auggacagugugucuguuucca

SEQ ID NO: 310449 - RNA, 22 nt, Human
ucucccacagccgugcuucaag

SEQ ID NO: 310450 - RNA, 22 nt, Human
cucuccagaauaugccgccgug

SEQ ID NO: 310451 - RNA, 22 nt, Human
ccagcuggaagagugcagaacu

SEQ ID NO: 310452 - RNA, 22 nt, Human
acucagaagauauaaugacuca

SEQ ID NO: 310453 - RNA, 22 nt, Human
gggugggccugucuggccaugu

SEQ ID NO: 310454 - RNA, 21 nt, Human
ccuccaggagcagagcccuga

SEQ ID NO: 310455 - RNA, 22 nt, Human
uggagcagggcaucacugugcg

SEQ ID NO: 310456 - RNA, 22 nt, Human
cacagaaucugugacuccaaga

SEQ ID NO: 310457 - RNA, 22 nt, Human
ggcccugggaugcucagcagug

SEQ ID NO: 310458 - RNA, 22 nt, Human
ugggcugcuucuauuggugguc

SEQ ID NO: 310459 - RNA, 22 nt, Human
ugcagaggagucagccugggca

SEQ ID NO: 310460 - RNA, 22 nt, Human
agaaaauaaauugaugguggaa

SEQ ID NO: 310461 - RNA, 22 nt, Human
cugagcuggucuauggacuugg

SEQ ID NO: 310462 - RNA, 19 nt, Human
aggugaugugacucuagaa

SEQ ID NO: 310463 - RNA, 22 nt, Human
aucuggcuuuuacugaauugcu

SEQ ID NO: 310464 - RNA, 22 nt, Human
uaaggccaggcuguggucggca

SEQ ID NO: 310465 - RNA, 22 nt, Human
ccaaaugugccuguuucaacaa

SEQ ID NO: 310466 - RNA, 22 nt, Human
cagcaaaagccagcauaagcuc

SEQ ID NO: 310467 - RNA, 22 nt, Human
cagucccaccaggaucgcucuu

SEQ ID NO: 310468 - RNA, 22 nt, Human
cuggaaggcucugcugccuguc

SEQ ID NO: 310469 - RNA, 22 nt, Human
auuugaagaaaguuuucuagau

SEQ ID NO: 310470 - RNA, 22 nt, Human
aaaaucugguaauuugaaugug

SEQ ID NO: 310471 - RNA, 22 nt, Human
ugcuggggcagaagagccaaga

SEQ ID NO: 310472 - RNA, 22 nt, Human
uguagaaccuguuuauuauaga

SEQ ID NO: 310473 - RNA, 22 nt, Human
uuaucacuuaugagcuuuuugc

SEQ ID NO: 310474 - RNA, 20 nt, Human
uccaguuuuggagacauucu

SEQ ID NO: 310475 - RNA, 19 nt, Human
ggcucagggcgcugccgcc

SEQ ID NO: 310476 - RNA, 22 nt, Human
cccugcugucaggugcugggag

SEQ ID NO: 310477 - RNA, 22 nt, Human
gcuggcugcgucaucacagggc

SEQ ID NO: 310478 - RNA, 22 nt, Human
agacccugcaccucucgugggc

SEQ ID NO: 310479 - RNA, 22 nt, Human
gccaggcugcuccagggaggcc

SEQ ID NO: 310480 - RNA, 22 nt, Human
ggcuggcuggcugguagacaag

SEQ ID NO: 310481 - RNA, 22 nt, Human
aucugcuugaaugagcaacagg

SEQ ID NO: 310482 - RNA, 22 nt, Human
auccaaagauggaaagaacuuu

SEQ ID NO: 310483 - RNA, 22 nt, Human
ugcucauuggcgaucugaggga

SEQ ID NO: 310484 - RNA, 22 nt, Human
uguaugaaucucauuuguuuaa

SEQ ID NO: 310485 - RNA, 22 nt, Human
aggagcagcccacuccuguccu

SEQ ID NO: 310486 - RNA, 18 nt, Human
uggccuggagacaacucu

SEQ ID NO: 310487 - RNA, 22 nt, Human
ugggccacaagccaugggacca

SEQ ID NO: 310488 - RNA, 22 nt, Human
uacaguaaccuuauuugucauu

SEQ ID NO: 310489 - RNA, 22 nt, Human
ucucccucuuugucugcuuugg

SEQ ID NO: 310490 - RNA, 22 nt, Human
uaaaucucacuggguauauugg

SEQ ID NO: 310491 - RNA, 22 nt, Human
caccagguuccgggcagagcug

SEQ ID NO: 310492 - RNA, 22 nt, Human
ucuacuuuucccuauacaguuu

SEQ ID NO: 310493 - RNA, 22 nt, Human
augaggcaguacacacaaagcc

SEQ ID NO: 310494 - RNA, 22 nt, Human
uuuuuccuuggaugugucucuc

SEQ ID NO: 310495 - RNA, 22 nt, Human
gccaggcucucagugacugccc

SEQ ID NO: 310496 - RNA, 22 nt, Human
ccagaagaccccguccaccucc

SEQ ID NO: 310497 - RNA, 22 nt, Human
auauauuuugcggucacguggc

SEQ ID NO: 310498 - RNA, 22 nt, Human
gggagggaagguaccuguguga

SEQ ID NO: 310499 - RNA, 22 nt, Human
cuucccagacgggguggcagcc

SEQ ID NO: 310500 - RNA, 22 nt, Human
aagaaaggauauaugggaggua

SEQ ID NO: 310501 - RNA, 22 nt, Human
agcuggaggggccagcaggugu

SEQ ID NO: 310502 - RNA, 22 nt, Human
gaagagcuuaguuguccuagaa

SEQ ID NO: 310503 - RNA, 22 nt, Human
aaagcucuuauagcagagugug

SEQ ID NO: 310504 - RNA, 22 nt, Human
ccugcagaccacacucaguccu

SEQ ID NO: 310505 - RNA, 22 nt, Human
uuuccucacuucaugagaguuu

SEQ ID NO: 310506 - RNA, 22 nt, Human
aacauacagugagcaguggacu

SEQ ID NO: 310507 - RNA, 20 nt, Human
ucuggcaggugaacgagcug

SEQ ID NO: 310508 - RNA, 22 nt, Human
auccccaggggcauucaagcuu

SEQ ID NO: 310509 - RNA, 22 nt, Human
ggcaaaaaccacaauuacuuuu

SEQ ID NO: 310510 - RNA, 22 nt, Human
uuuauguaauuucauaggugug

SEQ ID NO: 310511 - RNA, 20 nt, Human
aucugcuugccuguccucgg

SEQ ID NO: 310512 - RNA, 22 nt, Human
gggcauggugaugugcaccugu

SEQ ID NO: 310513 - RNA, 22 nt, Human
uuccagaaaucuuucagcucaa

SEQ ID NO: 310514 - RNA, 22 nt, Human
ucucagugguguuuugagucca

SEQ ID NO: 310515 - RNA, 22 nt, Human
cugggccagucucggccgcucu

SEQ ID NO: 310516 - RNA, 22 nt, Human
uccuguuuaucugugugacucg

SEQ ID NO: 310517 - RNA, 22 nt, Human
cugagccaaccacagcaggagc

SEQ ID NO: 310518 - RNA, 22 nt, Human
auuaaauuagcaaacugugaaa

SEQ ID NO: 310519 - RNA, 22 nt, Human
ucccaagugucuuggaccaggg

SEQ ID NO: 310520 - RNA, 22 nt, Human
ugcuggcccuggcucagggaac

SEQ ID NO: 310521 - RNA, 22 nt, Human
auuuucaucauggguuuaacau

SEQ ID NO: 310522 - RNA, 22 nt, Human
cuacauuucccagcugccuucc

SEQ ID NO: 310523 - RNA, 22 nt, Human
aucugguuuggggauccuugug

SEQ ID NO: 310524 - RNA, 22 nt, Human
uguauuagaucugagaacuucu

SEQ ID NO: 310525 - RNA, 22 nt, Human
gaaaggugccccauaggcagga

SEQ ID NO: 310526 - RNA, 22 nt, Human
gcaggaguguggugggacaucc

SEQ ID NO: 310527 - RNA, 22 nt, Human
guuuuuaucuaauagcaguuau

SEQ ID NO: 310528 - RNA, 22 nt, Human
aacaugcugccuuucuacgagu

SEQ ID NO: 310529 - RNA, 22 nt, Human
auuaguaaaacauuguauaugu

SEQ ID NO: 310530 - RNA, 22 nt, Human
ggccuugggauguggcugcagc

SEQ ID NO: 310531 - RNA, 22 nt, Human
ucacagugagccaugucagaga

SEQ ID NO: 310532 - RNA, 22 nt, Human
uuuaaaaucagaugggaguugg

SEQ ID NO: 310533 - RNA, 22 nt, Human
ugccaggcccagcuccagagcu

SEQ ID NO: 310534 - RNA, 22 nt, Human
cugaagccacgauagcuuccua

SEQ ID NO: 310535 - RNA, 22 nt, Human
agaauucugacaauagaauugg

SEQ ID NO: 310536 - RNA, 22 nt, Human
uuugcagugucagcuucugugu

SEQ ID NO: 310537 - RNA, 23 nt, Human
uggggccaagugaggaagggucu

SEQ ID NO: 310538 - RNA, 22 nt, Human
ccucagggucugaggagaccgu

SEQ ID NO: 310539 - RNA, 22 nt, Human
ucagggacauuuagacacugau

SEQ ID NO: 310540 - RNA, 22 nt, Human
gcuguguuuuauguuagguuaa

SEQ ID NO: 310541 - RNA, 22 nt, Human
ugcuucaaguugaaauauucuu

SEQ ID NO: 310542 - RNA, 22 nt, Human
cacaggcucuucucacuugauu

SEQ ID NO: 310543 - RNA, 22 nt, Human
cuggaagguucuuugugugccu

SEQ ID NO: 310544 - RNA, 22 nt, Human
guggccagaagacugcaaugcu

SEQ ID NO: 310545 - RNA, 22 nt, Human
uuugcaaagaaauuauugcugu

SEQ ID NO: 310546 - RNA, 22 nt, Human
augauggugggagaugacccag

SEQ ID NO: 310547 - RNA, 22 nt, Human
aaaguguugauaugugacaucc

SEQ ID NO: 310548 - RNA, 22 nt, Human
aaguucuuggaggaugaagagu

SEQ ID NO: 310549 - RNA, 22 nt, Human
agugcuuucccugaaaccuucc

SEQ ID NO: 310550 - RNA, 22 nt, Human
acagccaggaauucuggagaag

SEQ ID NO: 310551 - RNA, 22 nt, Human
ucugagcuggagcccaucaccu

SEQ ID NO: 310552 - RNA, 22 nt, Human
acagggcccuugccagcacaag

SEQ ID NO: 310553 - RNA, 23 nt, Human
cuugcagggcuggaggcuuagaa

SEQ ID NO: 310554 - RNA, 22 nt, Human
ggggugagugcucagccccgga

SEQ ID NO: 310555 - RNA, 22 nt, Human
caaagguaaagaucugcugugg

SEQ ID NO: 310556 - RNA, 22 nt, Human
aaaaugaugcuguaauuuggca

SEQ ID NO: 310557 - RNA, 22 nt, Human
cugucaguucuuccagauagag

SEQ ID NO: 310558 - RNA, 22 nt, Human
ggcaggagauaaaauauuaguu

SEQ ID NO: 310559 - RNA, 22 nt, Human
auuuucaguugaaaaaguuggu

SEQ ID NO: 310560 - RNA, 22 nt, Human
ccuggagcgcgggucaagcugg

SEQ ID NO: 310561 - RNA, 22 nt, Human
ggucucagcaguugcuuugacu

SEQ ID NO: 310562 - RNA, 22 nt, Human
caugggcucuucuggacugcac

SEQ ID NO: 310563 - RNA, 22 nt, Human
uucacaauggcaaaccauuaaa

SEQ ID NO: 310564 - RNA, 16 nt, Human
gagccaggugccuuga

SEQ ID NO: 310565 - RNA, 22 nt, Human
ucugaggccccugggcaggaug

SEQ ID NO: 310566 - RNA, 22 nt, Human
uggagagcuccuauuugcuguc

SEQ ID NO: 310567 - RNA, 22 nt, Human
agcugcuguggggcucggccug

SEQ ID NO: 310568 - RNA, 22 nt, Human
agacaacaccaaaugcuagugu

SEQ ID NO: 310569 - RNA, 22 nt, Human
uuacugaaaauucuucaggauu

SEQ ID NO: 310570 - RNA, 22 nt, Human
acauuucugagcagggagcugu

SEQ ID NO: 310571 - RNA, 22 nt, Human
aagccaguaaguuuuugucauu

SEQ ID NO: 310572 - RNA, 22 nt, Human
ccaggucugcgggcggcaggca

SEQ ID NO: 310573 - RNA, 20 nt, Human
cuucuucaguaguuuguucu

SEQ ID NO: 310574 - RNA, 20 nt, Human
aaucagaaagugugagcucu

SEQ ID NO: 310575 - RNA, 22 nt, Human
acugugugaaacaucaaugugu

SEQ ID NO: 310576 - RNA, 22 nt, Human
cugccucagcguuguggcccua

SEQ ID NO: 310577 - RNA, 22 nt, Human
agcccaugcaacaggccuagcg

SEQ ID NO: 310578 - RNA, 22 nt, Human
gaacagcugcuagagaucugug

SEQ ID NO: 310579 - RNA, 22 nt, Human
ccaggaguuugaggcugcagug

SEQ ID NO: 310580 - RNA, 22 nt, Human
ucucaggcuaccuugcacaagg

SEQ ID NO: 310581 - RNA, 22 nt, Human
ucuguucaguugauuagacaga

SEQ ID NO: 310582 - RNA, 22 nt, Human
caggauggucagaugcauuguc

SEQ ID NO: 310583 - RNA, 22 nt, Human
acauuuaaugauccuacuguga

SEQ ID NO: 310584 - RNA, 23 nt, Human
cccagcuuucccacugccgagag

SEQ ID NO: 310585 - RNA, 22 nt, Human
gaggcuggugguuaguuccauu

SEQ ID NO: 310586 - RNA, 22 nt, Human
uaggaaaugcuccauugcauaa

SEQ ID NO: 310587 - RNA, 22 nt, Human
uucaggauaguggugaguggca

SEQ ID NO: 310588 - RNA, 20 nt, Human
acaguguuuuugaguagagc

SEQ ID NO: 310589 - RNA, 19 nt, Human
ggcuccuguggcugcagcc

SEQ ID NO: 310590 - RNA, 22 nt, Human
uacauggguagguuaagucaua

SEQ ID NO: 310591 - RNA, 22 nt, Human
cuucuucaucuguaaaacuugg

SEQ ID NO: 310592 - RNA, 22 nt, Human
ggcuuccuggggccuccugcaa

SEQ ID NO: 310593 - RNA, 22 nt, Human
auugacaagugagcugggcugc

SEQ ID NO: 310594 - RNA, 22 nt, Human
uuggcagugaugcagcuuguuc

SEQ ID NO: 310595 - RNA, 22 nt, Human
agggugccuggaagccacucac

SEQ ID NO: 310596 - RNA, 22 nt, Human
gcugcccagcaggccccagggg

SEQ ID NO: 310597 - RNA, 22 nt, Human
aagcagggugucuugacccaug

SEQ ID NO: 310598 - RNA, 22 nt, Human
cauuuguaucugggcugcugug

SEQ ID NO: 310599 - RNA, 22 nt, Human
uccugagauaaaucucauguga

SEQ ID NO: 310600 - RNA, 22 nt, Human
ugaggaggucagagucuggcug

SEQ ID NO: 310601 - RNA, 22 nt, Human
ugcaggugccucuugagcuugu

SEQ ID NO: 310602 - RNA, 22 nt, Human
uaauaguuucauaaugugcuuc

SEQ ID NO: 310603 - RNA, 22 nt, Human
gcaccugggacccagaggcacc

SEQ ID NO: 310604 - RNA, 21 nt, Human
cacugcagccuugaccugggc

SEQ ID NO: 310605 - RNA, 22 nt, Human
ccacucugcugugcuccaugau

SEQ ID NO: 310606 - RNA, 20 nt, Human
gucaucgccggcagcaaaga

SEQ ID NO: 310607 - RNA, 22 nt, Human
caguauuuauggcuugaguauu

SEQ ID NO: 310608 - RNA, 22 nt, Human
gcugucacacauggccccagcu

SEQ ID NO: 310609 - RNA, 21 nt, Human
gggugggaggacacagcaggc

SEQ ID NO: 310610 - RNA, 22 nt, Human
aguggugcugcgcgcggagcuc

SEQ ID NO: 310611 - RNA, 22 nt, Human
aagcagcugauuucacagcuca

SEQ ID NO: 310612 - RNA, 22 nt, Human
uuguuuucuccacugcaucuua

SEQ ID NO: 310613 - RNA, 22 nt, Human
caagagagaugcagcucacuca

SEQ ID NO: 310614 - RNA, 22 nt, Human
caauaauauccugugcuguuug

SEQ ID NO: 310615 - RNA, 22 nt, Human
agaacuguccuuggaggagagu

SEQ ID NO: 310616 - RNA, 22 nt, Human
ccugacucuggccaggccagcu

SEQ ID NO: 310617 - RNA, 22 nt, Human
caggguacagaguuuucuaaac

SEQ ID NO: 310618 - RNA, 18 nt, Human
ugaauagggguuugcaga

SEQ ID NO: 310619 - RNA, 22 nt, Human
cuucagagugcagaagauuggg

SEQ ID NO: 310620 - RNA, 22 nt, Human
caguggcgugaucucugcucac

SEQ ID NO: 310621 - RNA, 22 nt, Human
cucuggaauuaaggaagccugu

SEQ ID NO: 310622 - RNA, 22 nt, Human
cuucugugauuugguuaggaua

SEQ ID NO: 310623 - RNA, 22 nt, Human
ucuggugucaguauucuuugaa

SEQ ID NO: 310624 - RNA, 22 nt, Human
uguuuauuacaguucuuggaau

SEQ ID NO: 310625 - RNA, 22 nt, Human
ccuucugcucccuggccagggc

SEQ ID NO: 310626 - RNA, 22 nt, Human
ucagaagcaggagugugcacaa

SEQ ID NO: 310627 - RNA, 22 nt, Human
ugauuucccucaucauaacaga

SEQ ID NO: 310628 - RNA, 22 nt, Human
ucaguguucuuauuuaauuagg

SEQ ID NO: 310629 - RNA, 22 nt, Human
auuuaaaugcuuaagaggguuu

SEQ ID NO: 310630 - RNA, 22 nt, Human
uggguaaacugggucuggagag

SEQ ID NO: 310631 - RNA, 22 nt, Human
gcugugugaaaacugggccugg

SEQ ID NO: 310632 - RNA, 22 nt, Human
cagggcuggauccuccagacuc

SEQ ID NO: 310633 - RNA, 22 nt, Human
guggcugcagcccagcggcacg

SEQ ID NO: 310634 - RNA, 22 nt, Human
cagccagcugaauguaccauga

SEQ ID NO: 310635 - RNA, 22 nt, Human
cccagacucaucccugggagcu

SEQ ID NO: 310636 - RNA, 22 nt, Human
agagaauuacagaagaauguca

SEQ ID NO: 310637 - RNA, 22 nt, Human
gggcugggauggcuugaagauu

SEQ ID NO: 310638 - RNA, 22 nt, Human
uucacaggugacuggggauaac

SEQ ID NO: 310639 - RNA, 22 nt, Human
agcugccagcaucccggaaggg

SEQ ID NO: 310640 - RNA, 22 nt, Human
agugugagaugauugaggagca

SEQ ID NO: 310641 - RNA, 22 nt, Human
cagcagugucuccagcaucaca

SEQ ID NO: 310642 - RNA, 22 nt, Human
uuguuuuggagaugagcuaaaa

SEQ ID NO: 310643 - RNA, 22 nt, Human
aaaauacuguggaguguugaaa

SEQ ID NO: 310644 - RNA, 22 nt, Human
ucucuucacaugcuugcuccaa

SEQ ID NO: 310645 - RNA, 22 nt, Human
cagggccagagagggcuggcug

SEQ ID NO: 310646 - RNA, 22 nt, Human
agagcccuuucuccaggcaccu

SEQ ID NO: 310647 - RNA, 22 nt, Human
ucuccucuauuucuguauguau

SEQ ID NO: 310648 - RNA, 22 nt, Human
acagccaggagccaugggcagg

SEQ ID NO: 310649 - RNA, 23 nt, Human
ccuggcagcaaacgaggagguua

SEQ ID NO: 310650 - RNA, 22 nt, Human
gaaauauugggacucagagcuu

SEQ ID NO: 310651 - RNA, 22 nt, Human
uuuauuugucuugccauuuagu

SEQ ID NO: 310652 - RNA, 22 nt, Human
aaguuucaugauguaauuauug

SEQ ID NO: 310653 - RNA, 22 nt, Human
cugcccugcccaggccuugggc

SEQ ID NO: 310654 - RNA, 22 nt, Human
ggcauguuucaucacaucaaga

SEQ ID NO: 310655 - RNA, 17 nt, Human
cuggagccuccaacucc

SEQ ID NO: 310656 - RNA, 22 nt, Human
acaguuucuccauuuacaccuu

SEQ ID NO: 310657 - RNA, 22 nt, Human
gccuaggagacaagcgugaaag

SEQ ID NO: 310658 - RNA, 22 nt, Human
uuugcauuuguuuagaaccuga

SEQ ID NO: 310659 - RNA, 22 nt, Human
cuuuauguucaguacaaugcuu

SEQ ID NO: 310660 - RNA, 22 nt, Human
gccagcugguaggcaccuagcc

SEQ ID NO: 310661 - RNA, 22 nt, Human
ccuugcguuuuacagcuucuag

SEQ ID NO: 310662 - RNA, 22 nt, Human
gcuggagguggugagaaaaggu

SEQ ID NO: 310663 - RNA, 22 nt, Human
auaaaguuuaaaagucaauagu

SEQ ID NO: 310664 - RNA, 22 nt, Human
gaggcugauucggggaacagca

SEQ ID NO: 310665 - RNA, 22 nt, Human
gccugugacucgucuugggcca

SEQ ID NO: 310666 - RNA, 22 nt, Human
auguuugaaauuguaaguauau

SEQ ID NO: 310667 - RNA, 22 nt, Human
gaucucaaagcaguguggguug

SEQ ID NO: 310668 - RNA, 23 nt, Human
uugugggcagauuccauggggag

SEQ ID NO: 310669 - RNA, 22 nt, Human
uauccaauucaccauugauggg

SEQ ID NO: 310670 - RNA, 22 nt, Human
ucuuuacacaagacaagaauaa

SEQ ID NO: 310671 - RNA, 22 nt, Human
ucucuucuugauuuucacugga

SEQ ID NO: 310672 - RNA, 22 nt, Human
ugagaaaugggucugcugaaga

SEQ ID NO: 310673 - RNA, 20 nt, Human
aaaguguaagcauauaauua

SEQ ID NO: 310674 - RNA, 22 nt, Human
ggucauugaaaucagaaggguu

SEQ ID NO: 310675 - RNA, 22 nt, Human
gggacuggaacuacuggugcag

SEQ ID NO: 310676 - RNA, 22 nt, Human
gaggggcuggcuguggucccau

SEQ ID NO: 310677 - RNA, 22 nt, Human
uugcugugaaaccaugggaagu

SEQ ID NO: 310678 - RNA, 22 nt, Human
uagagcuggaauuugcagcaag

SEQ ID NO: 310679 - RNA, 22 nt, Human
uccagggacacagaguccuucu

SEQ ID NO: 310680 - RNA, 22 nt, Human
aggcaguguauugcuagcggcu

SEQ ID NO: 310681 - RNA, 22 nt, Human
aaaauaucagcaaagggugaca

SEQ ID NO: 310682 - RNA, 22 nt, Human
gcagagugggagcccagggcug

SEQ ID NO: 310683 - RNA, 22 nt, Human
cccuggaggcggagcuugcagu

SEQ ID NO: 310684 - RNA, 22 nt, Human
agggcuggcuaggugcguuccc

SEQ ID NO: 310685 - RNA, 22 nt, Human
uugguuuaggaacuggcuugga

SEQ ID NO: 310686 - RNA, 22 nt, Human
agauguguuucuaguuccugca

SEQ ID NO: 310687 - RNA, 19 nt, Human
aucugccuuagugcugcug

SEQ ID NO: 310688 - RNA, 22 nt, Human
aaacucuggggguggagcccag

SEQ ID NO: 310689 - RNA, 22 nt, Human
gcacugaaaauguuggauucca

SEQ ID NO: 310690 - RNA, 22 nt, Human
gagagaagaaagccaugguccu

SEQ ID NO: 310691 - RNA, 22 nt, Human
augcuguagaucuuagccucua

SEQ ID NO: 310692 - RNA, 22 nt, Human
uuucagaaagcaucaucaaagu

SEQ ID NO: 310693 - RNA, 22 nt, Human
ucacuguaucauguugcacuua

SEQ ID NO: 310694 - RNA, 22 nt, Human
agucccagcuucccccaugcag

SEQ ID NO: 310695 - RNA, 22 nt, Human
ugaagcaggaucguuugcuuca

SEQ ID NO: 310696 - RNA, 17 nt, Human
cauuuguugaucaguug

SEQ ID NO: 310697 - RNA, 22 nt, Human
ccaaggagcaaggcucaacaag

SEQ ID NO: 310698 - RNA, 22 nt, Human
guccucugggcuuugagcaguc

SEQ ID NO: 310699 - RNA, 22 nt, Human
ucaguguuuauugcggugugua

SEQ ID NO: 310700 - RNA, 22 nt, Human
cucaccacagagccuguccagc

SEQ ID NO: 310701 - RNA, 22 nt, Human
auguuugacugaguuuggcaga

SEQ ID NO: 310702 - RNA, 22 nt, Human
cauaauauacuacauugaugaa

SEQ ID NO: 310703 - RNA, 22 nt, Human
cuguguggacugguugaggccc

SEQ ID NO: 310704 - RNA, 20 nt, Human
uuucugugagaaacacuguu

SEQ ID NO: 310705 - RNA, 22 nt, Human
augaaaauguacauguguauaa

SEQ ID NO: 310706 - RNA, 22 nt, Human
gcugagagaaaagugagguucu

SEQ ID NO: 310707 - RNA, 22 nt, Human
guucuucagauuccauuucagu

SEQ ID NO: 310708 - RNA, 20 nt, Human
uugagcuuuuaguacagaca

SEQ ID NO: 310709 - RNA, 22 nt, Human
uuuaaauaggacuccugggggu

SEQ ID NO: 310710 - RNA, 22 nt, Human
gucugucacucaggggcuggag

SEQ ID NO: 310711 - RNA, 22 nt, Human
uagcucuucaaucacugucucc

SEQ ID NO: 310712 - RNA, 20 nt, Human
uacagaaugcaauaaaaugg

SEQ ID NO: 310713 - RNA, 18 nt, Human
cagaagcaggcagugcag

SEQ ID NO: 310714 - RNA, 22 nt, Human
aucugucuugccuugcauauuu

SEQ ID NO: 310715 - RNA, 22 nt, Human
cauagcaacagcaucaagucaa

SEQ ID NO: 310716 - RNA, 22 nt, Human
ucauaaaucauacuccauuugc

SEQ ID NO: 310717 - RNA, 22 nt, Human
aggagcuggaguccaggcaagu

SEQ ID NO: 310718 - RNA, 22 nt, Human
aucuggcuuuuaccccacggcc

SEQ ID NO: 310719 - RNA, 21 nt, Human
gcaaauguucaggaaaaaaga

SEQ ID NO: 310720 - RNA, 21 nt, Human
aggagggcacaaggccaggaa

SEQ ID NO: 310721 - RNA, 22 nt, Human
ucagggcaaagggcagaguuug

SEQ ID NO: 310722 - RNA, 19 nt, Human
uagaaugcccacuuaaaaa

SEQ ID NO: 310723 - RNA, 22 nt, Human
agcuucuugggcuuuacacaaa

SEQ ID NO: 310724 - RNA, 22 nt, Human
ugggggcugaguaagaugagau

SEQ ID NO: 310725 - RNA, 22 nt, Human
aggucauuacaauuaucauuuu

SEQ ID NO: 310726 - RNA, 20 nt, Human
gggcaguggcgcuaucucag

SEQ ID NO: 310727 - RNA, 22 nt, Human
uuuuuccuaagcaguggagcug

SEQ ID NO: 310728 - RNA, 22 nt, Human
aaaugcauguagaauaauagag

SEQ ID NO: 310729 - RNA, 22 nt, Human
ccagccucaucgccugccuguc

SEQ ID NO: 310730 - RNA, 22 nt, Human
cagaggccucacuuccagccag

SEQ ID NO: 310731 - RNA, 22 nt, Human
ugggcagaggacagggaagauc

SEQ ID NO: 310732 - RNA, 22 nt, Human
uauaagaaacaaggcaaauuuu

SEQ ID NO: 310733 - RNA, 22 nt, Human
gaggcugcugagagcccuguuu

SEQ ID NO: 310734 - RNA, 22 nt, Human
agcugcccuggcggagcugcuc

SEQ ID NO: 310735 - RNA, 17 nt, Human
aagauuucauuagcuga

SEQ ID NO: 310736 - RNA, 22 nt, Human
ccucagaguaggucucagcugu

SEQ ID NO: 310737 - RNA, 22 nt, Human
ucuucagaggaagucagucuuu

SEQ ID NO: 310738 - RNA, 22 nt, Human
aaaguguugggaagaaagugca

SEQ ID NO: 310739 - RNA, 22 nt, Human
uugcucagcacuggagccagcu

SEQ ID NO: 310740 - RNA, 19 nt, Human
guucaaacacugauucagc

SEQ ID NO: 310741 - RNA, 22 nt, Human
gcucagucuuugugggguacgg

SEQ ID NO: 310742 - RNA, 22 nt, Human
gcagggcucauucuaguacaau

SEQ ID NO: 310743 - RNA, 22 nt, Human
ugaaggccucugguacaugcca

SEQ ID NO: 310744 - RNA, 22 nt, Human
aaaugaaaugagugccuggagg

SEQ ID NO: 310745 - RNA, 22 nt, Human
uggagcaggugcucaggguaau

SEQ ID NO: 310746 - RNA, 22 nt, Human
caggccuggcccccggcacacc

SEQ ID NO: 310747 - RNA, 22 nt, Human
uacauaugaacuuuauaacuug

SEQ ID NO: 310748 - RNA, 22 nt, Human
uauaguacauggaaucuucaua

SEQ ID NO: 310749 - RNA, 22 nt, Human
cucagugugaaugcucaguaaa

SEQ ID NO: 310750 - RNA, 22 nt, Human
cugagcugggaguggauagugg

SEQ ID NO: 310751 - RNA, 23 nt, Human
ucaggauauugugugccaaggug

SEQ ID NO: 310752 - RNA, 22 nt, Human
aggggauggagcuggaaggcag

SEQ ID NO: 310753 - RNA, 19 nt, Human
cugaggugcaguaagaggc

SEQ ID NO: 310754 - RNA, 22 nt, Human
aagcugccuagaguugaauguc

SEQ ID NO: 310755 - RNA, 19 nt, Human
gcugugccucucuccugcu

SEQ ID NO: 310756 - RNA, 22 nt, Human
agagcugugcuuugcaccacgu

SEQ ID NO: 310757 - RNA, 22 nt, Human
agggagguaggagcuucuagcu

SEQ ID NO: 310758 - RNA, 22 nt, Human
guccuggguccccgcaggucag

SEQ ID NO: 310759 - RNA, 22 nt, Human
uuaugcuaguauaguccuuaga

SEQ ID NO: 310760 - RNA, 22 nt, Human
auaucauucugauguauaucuu

SEQ ID NO: 310761 - RNA, 19 nt, Human
agcagagcccugaagaucc

SEQ ID NO: 310762 - RNA, 22 nt, Human
ucauaacagcuaagucccuuuc

SEQ ID NO: 310763 - RNA, 22 nt, Human
uggcucagaacuacuucuaguu

SEQ ID NO: 310764 - RNA, 22 nt, Human
ucuuugaauucaaacuguucaa

SEQ ID NO: 310765 - RNA, 22 nt, Human
aauucucaggaauuucaucugu

SEQ ID NO: 310766 - RNA, 22 nt, Human
ucaguccucucuggguuucuua

SEQ ID NO: 310767 - RNA, 22 nt, Human
uccucagaugcucuuggacgcc

SEQ ID NO: 310768 - RNA, 22 nt, Human
uguuuuauuucuccaagaggga

SEQ ID NO: 310769 - RNA, 23 nt, Human
gggggcugguugacucucugcag

SEQ ID NO: 310770 - RNA, 22 nt, Human
cuggaggcugaguugggucucc

SEQ ID NO: 310771 - RNA, 22 nt, Human
acaagaauuuacauguagugga

SEQ ID NO: 310772 - RNA, 22 nt, Human
cccugccuucuuggccuuuaaa

SEQ ID NO: 310773 - RNA, 22 nt, Human
agcaguggcuggauggugugcu

SEQ ID NO: 310774 - RNA, 22 nt, Human
cugcuuccaugcaauggcaguc

SEQ ID NO: 310775 - RNA, 22 nt, Human
aucugccucuucuucauugcga

SEQ ID NO: 310776 - RNA, 22 nt, Human
agccauggcgccacuagaggga

SEQ ID NO: 310777 - RNA, 22 nt, Human
cuuggcagcuuuuggaggagcc

SEQ ID NO: 310778 - RNA, 22 nt, Human
cuguggaaauaaacaaugcuaa

SEQ ID NO: 310779 - RNA, 22 nt, Human
uggccugguccuugucaaggca

SEQ ID NO: 310780 - RNA, 22 nt, Human
cucuggagggaggcugagcugg

SEQ ID NO: 310781 - RNA, 22 nt, Human
ccugggaggcggagguugcagg

SEQ ID NO: 310782 - RNA, 22 nt, Human
gccacagucaggacggggagag

SEQ ID NO: 310783 - RNA, 22 nt, Human
ugagaauuuucaguuucacuuu

SEQ ID NO: 310784 - RNA, 21 nt, Human
ugcaggaaagugcugcgaccc

SEQ ID NO: 310785 - RNA, 22 nt, Human
ugccaggcauauggccucuuug

SEQ ID NO: 310786 - RNA, 22 nt, Human
cccaggaggcagagcuugcagu

SEQ ID NO: 310787 - RNA, 22 nt, Human
gagugcugaaugcgagaacaga

SEQ ID NO: 310788 - RNA, 22 nt, Human
ggcacugagcgggcucugagcg

SEQ ID NO: 310789 - RNA, 22 nt, Human
ugcuauaaguagacauucaaca

SEQ ID NO: 310790 - RNA, 22 nt, Human
aggaggccgggauucuggagau

SEQ ID NO: 310791 - RNA, 22 nt, Human
agauacaucuugaacuucuaga

SEQ ID NO: 310792 - RNA, 22 nt, Human
aauaucuucuaaggauagaacu

SEQ ID NO: 310793 - RNA, 22 nt, Human
cugggcugcaucaaagaggcau

SEQ ID NO: 310794 - RNA, 22 nt, Human
uacauguauugauuucucuucu

SEQ ID NO: 310795 - RNA, 22 nt, Human
accucugcaaugcaaugucaug

SEQ ID NO: 310796 - RNA, 22 nt, Human
agguacaguagacagacaguua

SEQ ID NO: 310797 - RNA, 22 nt, Human
ucucauugguauauacaugugu

SEQ ID NO: 310798 - RNA, 22 nt, Human
cuagaaaaauacuuuauuguga

SEQ ID NO: 310799 - RNA, 19 nt, Human
ugcucaggccaaggagccc

SEQ ID NO: 310800 - RNA, 22 nt, Human
ugcagcagacugaguaugagaa

SEQ ID NO: 310801 - RNA, 22 nt, Human
gaagaagcaggaguguguagca

SEQ ID NO: 310802 - RNA, 20 nt, Human
gccugccucagcuagcugag

SEQ ID NO: 310803 - RNA, 22 nt, Human
ggagccugugcccaagcccaga

SEQ ID NO: 310804 - RNA, 22 nt, Human
gcccagcagcugguggagaagg

SEQ ID NO: 310805 - RNA, 22 nt, Human
caguaugagaguugaaucaagg

SEQ ID NO: 310806 - RNA, 22 nt, Human
uucacagggccacuggcaggag

SEQ ID NO: 310807 - RNA, 22 nt, Human
ccaggccccagggcuggcuuuc

SEQ ID NO: 310808 - RNA, 22 nt, Human
ccagaggugccacagaaagagc

SEQ ID NO: 310809 - RNA, 22 nt, Human
ucucacucauuuccuaggucuu

SEQ ID NO: 310810 - RNA, 22 nt, Human
cuguaguugaugauuucugaua

SEQ ID NO: 310811 - RNA, 22 nt, Human
gugucaugcacacucaguguug

SEQ ID NO: 310812 - RNA, 22 nt, Human
ggcacugauaauguccucucuc

SEQ ID NO: 310813 - RNA, 22 nt, Human
ggggaagaauggcagaaaacau

SEQ ID NO: 310814 - RNA, 22 nt, Human
caugcuccaaaaacaagagaau

SEQ ID NO: 310815 - RNA, 22 nt, Human
aaggucauuguugcauguucuc

SEQ ID NO: 310816 - RNA, 22 nt, Human
uugaagcaugguacuuguucaa

SEQ ID NO: 310817 - RNA, 22 nt, Human
ucaguccuccacacaggcaccc

SEQ ID NO: 310818 - RNA, 22 nt, Human
cagagacaguuucacagggucu

SEQ ID NO: 310819 - RNA, 22 nt, Human
cucuucaaaagucuaauccuua

SEQ ID NO: 310820 - RNA, 22 nt, Human
ucucagugauggcccauuugga

SEQ ID NO: 310821 - RNA, 22 nt, Human
gagagcccugcuccuaucccag

SEQ ID NO: 310822 - RNA, 22 nt, Human
acaaaugcagcauaaagugaac

SEQ ID NO: 310823 - RNA, 22 nt, Human
agccugucugucuccaaagcug

SEQ ID NO: 310824 - RNA, 22 nt, Human
ccagagccucuuaugaagaucg

SEQ ID NO: 310825 - RNA, 22 nt, Human
gagggcugaagauuguggcccc

SEQ ID NO: 310826 - RNA, 22 nt, Human
cacguuuuaugacagaagaagc

SEQ ID NO: 310827 - RNA, 22 nt, Human
cuuaacagagagaaguguugcu

SEQ ID NO: 310828 - RNA, 22 nt, Human
aggcuggcuuggcucuccugug

SEQ ID NO: 310829 - RNA, 22 nt, Human
ucuggcucugaauucacuucug

SEQ ID NO: 310830 - RNA, 22 nt, Human
augaagucuagcaagcauugaa

SEQ ID NO: 310831 - RNA, 22 nt, Human
gcccucagaguuccccacagug

SEQ ID NO: 310832 - RNA, 22 nt, Human
ugcugguggagaaaguggaggu

SEQ ID NO: 310833 - RNA, 22 nt, Human
auguuuuugagauacaaacaga

SEQ ID NO: 310834 - RNA, 22 nt, Human
uaagauguuuugguuugauaag

SEQ ID NO: 310835 - RNA, 22 nt, Human
agagaaaagaguucaggcuuug

SEQ ID NO: 310836 - RNA, 22 nt, Human
ggaggugacgaaaagaaauugu

SEQ ID NO: 310837 - RNA, 22 nt, Human
acuggcagagguuggacaccau

SEQ ID NO: 310838 - RNA, 22 nt, Human
cuguguuggcuuuucucuugua

SEQ ID NO: 310839 - RNA, 22 nt, Human
agccucucuuuauucccagcua

SEQ ID NO: 310840 - RNA, 20 nt, Human
cugcucugcuuugcaggugg

SEQ ID NO: 310841 - RNA, 22 nt, Human
gcugccuucaguucugauucau

SEQ ID NO: 310842 - RNA, 22 nt, Human
uggcaguccccugugccuggaa

SEQ ID NO: 310843 - RNA, 22 nt, Human
uuugggcaguagauguaucacu

SEQ ID NO: 310844 - RNA, 22 nt, Human
gccaccagugggggccugggca

SEQ ID NO: 310845 - RNA, 22 nt, Human
uagaacagaguuccagugauca

SEQ ID NO: 310846 - RNA, 22 nt, Human
gcucccagcuggagccucaaca

SEQ ID NO: 310847 - RNA, 22 nt, Human
gacaugcaacaauuuggcauuu

SEQ ID NO: 310848 - RNA, 22 nt, Human
gagcucugggaaacaaagugua

SEQ ID NO: 310849 - RNA, 22 nt, Human
gggucagcugcugggggcugac

SEQ ID NO: 310850 - RNA, 22 nt, Human
uggcucagccagcccuaggaac

SEQ ID NO: 310851 - RNA, 22 nt, Human
acauuugucuucuuucagauua

SEQ ID NO: 310852 - RNA, 22 nt, Human
uaggccagaggagcagcuuugg

SEQ ID NO: 310853 - RNA, 22 nt, Human
aaaggagacuucagaucuccuu

SEQ ID NO: 310854 - RNA, 22 nt, Human
gcugucugcugugcacugagca

SEQ ID NO: 310855 - RNA, 22 nt, Human
uagaaacaucagcuaaccaaaa

SEQ ID NO: 310856 - RNA, 22 nt, Human
agugcugucaguuuuauagaua

SEQ ID NO: 310857 - RNA, 21 nt, Human
ugggcaccaaaaccuaggagu

SEQ ID NO: 310858 - RNA, 20 nt, Human
uccagccacuuccgcugguc

SEQ ID NO: 310859 - RNA, 20 nt, Human
ccaggcacugucccaugcag

SEQ ID NO: 310860 - RNA, 22 nt, Human
uucucagaggagucgggagcug

SEQ ID NO: 310861 - RNA, 22 nt, Human
ccagagaccagaacauggggau

SEQ ID NO: 310862 - RNA, 20 nt, Human
uuuuccuucugaguauguug

SEQ ID NO: 310863 - RNA, 23 nt, Human
cccagcagagaugaggagggguc

SEQ ID NO: 310864 - RNA, 22 nt, Human
ucccaaagcuacucuucugacu

SEQ ID NO: 310865 - RNA, 22 nt, Human
aaaugauguuauaagaccagga

SEQ ID NO: 310866 - RNA, 22 nt, Human
cucaggauuuaaaggggcacuc

SEQ ID NO: 310867 - RNA, 22 nt, Human
agggcagaaauauugauacugu

SEQ ID NO: 310868 - RNA, 22 nt, Human
ggggcagagagaaggaagcuug

SEQ ID NO: 310869 - RNA, 22 nt, Human
uuucagaaagcugaacauauga

SEQ ID NO: 310870 - RNA, 22 nt, Human
gcucccagggcagcgcagaaga

SEQ ID NO: 310871 - RNA, 23 nt, Human
uggcagcagaucuuaaagugacc

SEQ ID NO: 310872 - RNA, 22 nt, Human
cuggcuuucucugugguguuca

SEQ ID NO: 310873 - RNA, 22 nt, Human
uccuuuuuaagucguuguggua

SEQ ID NO: 310874 - RNA, 22 nt, Human
ggagaggugaauggcugcucua

SEQ ID NO: 310875 - RNA, 22 nt, Human
acauagcuuaaaugagaagaua

SEQ ID NO: 310876 - RNA, 22 nt, Human
uuuggaaugguaccuucaguug

SEQ ID NO: 310877 - RNA, 22 nt, Human
auaauuuacaacugcuuuuaau

SEQ ID NO: 310878 - RNA, 22 nt, Human
ugcacacaaguuggagaaugaa

SEQ ID NO: 310879 - RNA, 22 nt, Human
uuagaaaucugcugccaugcaa

SEQ ID NO: 310880 - RNA, 22 nt, Human
ccagggcugcugugggacucca

SEQ ID NO: 310881 - RNA, 22 nt, Human
aggagagggguaggauuaauuu

SEQ ID NO: 310882 - RNA, 22 nt, Human
uuucuucauucaccuucacccc

SEQ ID NO: 310883 - RNA, 22 nt, Human
aggggcuguggaaaccaacucu

SEQ ID NO: 310884 - RNA, 17 nt, Human
ggaaaaggaugauacag

SEQ ID NO: 310885 - RNA, 17 nt, Human
ggugaguguccaggugg

SEQ ID NO: 310886 - RNA, 22 nt, Human
uacagcauauacagaaugaaca

SEQ ID NO: 310887 - RNA, 22 nt, Human
cuguuuaucccuuuggucagca

SEQ ID NO: 310888 - RNA, 22 nt, Human
ucaggcagaccaccgugggcag

SEQ ID NO: 310889 - RNA, 22 nt, Human
agaaaugggccuugggacacaa

SEQ ID NO: 310890 - RNA, 22 nt, Human
uauuuaauuagugauuguagag

SEQ ID NO: 310891 - RNA, 22 nt, Human
cuggccuggggccucagcugcu

SEQ ID NO: 310892 - RNA, 22 nt, Human
guccucuguagggcugggccac

SEQ ID NO: 310893 - RNA, 22 nt, Human
ugauagaaaaugcugucaagcu

SEQ ID NO: 310894 - RNA, 19 nt, Human
uuugaaaggauuguuauuu

SEQ ID NO: 310895 - RNA, 23 nt, Human
ggcucugugcugggccugcagga

SEQ ID NO: 310896 - RNA, 22 nt, Human
uucuuccucagcagggcugccu

SEQ ID NO: 310897 - RNA, 22 nt, Human
gguggccaggccagcucuggcc

SEQ ID NO: 310898 - RNA, 22 nt, Human
uucuucucggcugucagauagu

SEQ ID NO: 310899 - RNA, 22 nt, Human
uggcccagcucagggugggcgg

SEQ ID NO: 310900 - RNA, 22 nt, Human
uucacauugugcagauuauggu

SEQ ID NO: 310901 - RNA, 22 nt, Human
uuuuuaagagauucuccagucu

SEQ ID NO: 310902 - RNA, 22 nt, Human
aagcacuuagaagagugccugc

SEQ ID NO: 310903 - RNA, 22 nt, Human
aaaguuugagugauuugacaca

SEQ ID NO: 310904 - RNA, 22 nt, Human
gagcagggccacuucuguaccu

SEQ ID NO: 310905 - RNA, 22 nt, Human
uucccaggcugugcuaccagag

SEQ ID NO: 310906 - RNA, 21 nt, Human
ucugucugguuuuagaguggc

SEQ ID NO: 310907 - RNA, 22 nt, Human
agggagaacaguugcagcagac

SEQ ID NO: 310908 - RNA, 22 nt, Human
gggcuggaggagauccagaggc

SEQ ID NO: 310909 - RNA, 22 nt, Human
uccugagauucugcauuucuaa

SEQ ID NO: 310910 - RNA, 22 nt, Human
gccugagagucugcauuucuaa

SEQ ID NO: 310911 - RNA, 22 nt, Human
acauuaacacuggugcuggugu

SEQ ID NO: 310912 - RNA, 22 nt, Human
uggcuggcuagugggcaggauu

SEQ ID NO: 310913 - RNA, 22 nt, Human
cugcccugacugaccuuuugaa

SEQ ID NO: 310914 - RNA, 22 nt, Human
uguaggauuuucaccagaccuu

SEQ ID NO: 310915 - RNA, 22 nt, Human
acagaugaggcuggcgagggca

SEQ ID NO: 310916 - RNA, 22 nt, Human
gaaaggccagcucacagaugag

SEQ ID NO: 310917 - RNA, 22 nt, Human
ugucucaguacacuccgauguu

SEQ ID NO: 310918 - RNA, 22 nt, Human
aggacagaccuaggacuggagc

SEQ ID NO: 310919 - RNA, 22 nt, Human
guuucauacagauuauucaugg

SEQ ID NO: 310920 - RNA, 22 nt, Human
ccaggcugagcaugauuggagc

SEQ ID NO: 310921 - RNA, 22 nt, Human
ccucucccacguggcagaggcu

SEQ ID NO: 310922 - RNA, 22 nt, Human
ugaaagauugugauucaauaug

SEQ ID NO: 310923 - RNA, 22 nt, Human
caggaggaggugagguagaacu

SEQ ID NO: 310924 - RNA, 20 nt, Human
cuggcaggagcgagucuacc

SEQ ID NO: 310925 - RNA, 22 nt, Human
guggagacuucuacuagagacc

SEQ ID NO: 310926 - RNA, 22 nt, Human
uuuguaaaaggaggaagcaugg

SEQ ID NO: 310927 - RNA, 22 nt, Human
ucuuugcaugcauuuucccuua

SEQ ID NO: 310928 - RNA, 22 nt, Human
cagagcuguccaaacccugaca

SEQ ID NO: 310929 - RNA, 22 nt, Human
gccugagacagugugguccaau

SEQ ID NO: 310930 - RNA, 22 nt, Human
gcucaggacuggaggagcgggg

SEQ ID NO: 310931 - RNA, 22 nt, Human
gcugagguggcugccuuaguaa

SEQ ID NO: 310932 - RNA, 22 nt, Human
aaugcuagugugauauguaagg

SEQ ID NO: 310933 - RNA, 22 nt, Human
augggaggcaggcucagaaccg

SEQ ID NO: 310934 - RNA, 22 nt, Human
ccucugcugcuguugagcaccg

SEQ ID NO: 310935 - RNA, 22 nt, Human
uggcagagaaccugggcuuugu

SEQ ID NO: 310936 - RNA, 22 nt, Human
cacugaguucccugacauuuca

SEQ ID NO: 310937 - RNA, 22 nt, Human
agucaguguucuccggagaggc

SEQ ID NO: 310938 - RNA, 22 nt, Human
ggcaccaggacaugacucccag

SEQ ID NO: 310939 - RNA, 22 nt, Human
uuuuucagccaugaauuacacu

SEQ ID NO: 310940 - RNA, 23 nt, Human
gggagccaggaccucgcgcccca

SEQ ID NO: 310941 - RNA, 22 nt, Human
caagaacauugugaucacuuca

SEQ ID NO: 310942 - RNA, 22 nt, Human
aauacuuuccuauauaaggugc

SEQ ID NO: 310943 - RNA, 22 nt, Human
agugugagaacggacuaauaaa

SEQ ID NO: 310944 - RNA, 22 nt, Human
uguuuauaccuugguauaacca

SEQ ID NO: 310945 - RNA, 23 nt, Human
gccaggcuccggucuguggccac

SEQ ID NO: 310946 - RNA, 22 nt, Human
cucaggauuuacuaauuucaag

SEQ ID NO: 310947 - RNA, 22 nt, Human
caggguggaagcuguagagugg

SEQ ID NO: 310948 - RNA, 22 nt, Human
uacaucauaauaauacuuagaa

SEQ ID NO: 310949 - RNA, 22 nt, Human
ugucccaguuuugcagguuaga

SEQ ID NO: 310950 - RNA, 22 nt, Human
uuucugaaaucucuuuugagga

SEQ ID NO: 310951 - RNA, 22 nt, Human
agggcagcacaaggcauggacu

SEQ ID NO: 310952 - RNA, 22 nt, Human
auacauuagcucauaugauuaa

SEQ ID NO: 310953 - RNA, 22 nt, Human
ggccucagugggccgcugcagg

SEQ ID NO: 310954 - RNA, 20 nt, Human
ccagagcugauggcugcccg

SEQ ID NO: 310955 - RNA, 22 nt, Human
gcuguucacauuuugggccaaa

SEQ ID NO: 310956 - RNA, 22 nt, Human
ccaguguuccauggagugauua

SEQ ID NO: 310957 - RNA, 22 nt, Human
cccagcagccagaaugaggagc

SEQ ID NO: 310958 - RNA, 22 nt, Human
uuucauaaccucaagcuacagu

SEQ ID NO: 310959 - RNA, 22 nt, Human
cugcccugccuggccagugugg

SEQ ID NO: 310960 - RNA, 22 nt, Human
ucaucugucauccacaaagcug

SEQ ID NO: 310961 - RNA, 22 nt, Human
ggaggugguggcagugacaauu

SEQ ID NO: 310962 - RNA, 22 nt, Human
agaagcugccuacaugaccagc

SEQ ID NO: 310963 - RNA, 22 nt, Human
ugacacagaaauuaagcuguca

SEQ ID NO: 310964 - RNA, 22 nt, Human
cuacuucugugaugaaacuaca

SEQ ID NO: 310965 - RNA, 22 nt, Human
uggcagagaacacacaugauuc

SEQ ID NO: 310966 - RNA, 21 nt, Human
ugaggcuguuguaccagggag

SEQ ID NO: 310967 - RNA, 22 nt, Human
ccugggcagggagaccaggcuc

SEQ ID NO: 310968 - RNA, 22 nt, Human
uaauuucacugauaugaaguca

SEQ ID NO: 310969 - RNA, 22 nt, Human
agccagaggccagccugccuca

SEQ ID NO: 310970 - RNA, 22 nt, Human
uaacagaaaagaacugaguuug

SEQ ID NO: 310971 - RNA, 22 nt, Human
cagcaguguacaaggugucaga

SEQ ID NO: 310972 - RNA, 22 nt, Human
cagccagccucucaaccaugca

SEQ ID NO: 310973 - RNA, 22 nt, Human
uuucacaaugcaauccuacuuc

SEQ ID NO: 310974 - RNA, 22 nt, Human
acuguguguuugucuagcacag

SEQ ID NO: 310975 - RNA, 22 nt, Human
cuucagaagaaaagcagugugu

SEQ ID NO: 310976 - RNA, 22 nt, Human
uaaacaugugagugugcauaua

SEQ ID NO: 310977 - RNA, 22 nt, Human
ggcuuucuagaucuagcucugu

SEQ ID NO: 310978 - RNA, 22 nt, Human
agugggaggcggcugacgggcg

SEQ ID NO: 310979 - RNA, 22 nt, Human
agccuggagaagauguguauug

SEQ ID NO: 310980 - RNA, 22 nt, Human
ucacaacuugaagcugauuuaa

SEQ ID NO: 310981 - RNA, 22 nt, Human
acuggaagccaguugacaauca

SEQ ID NO: 310982 - RNA, 17 nt, Human
gcagcagagagacccuc

SEQ ID NO: 310983 - RNA, 22 nt, Human
ugugaagcuggauccuggagcu

SEQ ID NO: 310984 - RNA, 22 nt, Human
gacaccagcaaggcugugagga

SEQ ID NO: 310985 - RNA, 22 nt, Human
uuugaaguaccugguucugacu

SEQ ID NO: 310986 - RNA, 22 nt, Human
uuccuuccgggcaccaggcacu

SEQ ID NO: 310987 - RNA, 22 nt, Human
ggcugcugugaccucaggugau

SEQ ID NO: 310988 - RNA, 22 nt, Human
ucagcucugccuguggaggcac

SEQ ID NO: 310989 - RNA, 22 nt, Human
guuuuucuaggaccaugugauu

SEQ ID NO: 310990 - RNA, 22 nt, Human
acaguaauuaaaauggaucugc

SEQ ID NO: 310991 - RNA, 22 nt, Human
ggcagggagagcaugcugauaa

SEQ ID NO: 310992 - RNA, 22 nt, Human
ccuggcaguggugaagaagagg

SEQ ID NO: 310993 - RNA, 22 nt, Human
uaguaacccacacaacaguaga

SEQ ID NO: 310994 - RNA, 19 nt, Human
augauggucccauucaccu

SEQ ID NO: 310995 - RNA, 22 nt, Human
cccuccccacaaagcuucacac

SEQ ID NO: 310996 - RNA, 22 nt, Human
aguauucuggaauucuauguga

SEQ ID NO: 310997 - RNA, 22 nt, Human
gagcugccuguugcauagcaac

SEQ ID NO: 310998 - RNA, 22 nt, Human
uaaguucaaugaacucaguucu

SEQ ID NO: 310999 - RNA, 22 nt, Human
aucagcugaaaaacaggcagca

SEQ ID NO: 311000 - RNA, 22 nt, Human
acaaacagaguugaaaaauagg

SEQ ID NO: 311001 - RNA, 21 nt, Human
uucuuuccccagaggacuaaa

SEQ ID NO: 311002 - RNA, 22 nt, Human
uucauucuuauuugugaucugg

SEQ ID NO: 311003 - RNA, 22 nt, Human
uaacagaauuugcuaaacuccg

SEQ ID NO: 311004 - RNA, 22 nt, Human
gcagauggcagcccaggcuggg

SEQ ID NO: 311005 - RNA, 22 nt, Human
cuucuuuccuuccuccaguggc

SEQ ID NO: 311006 - RNA, 22 nt, Human
ugccagugggugugcagagacu

SEQ ID NO: 311007 - RNA, 22 nt, Human
ggcagcaggcgacuucccuauu

SEQ ID NO: 311008 - RNA, 22 nt, Human
gccuggagcucggcugagggcg

SEQ ID NO: 311009 - RNA, 17 nt, Human
acucaggaucugggagu

SEQ ID NO: 311010 - RNA, 22 nt, Human
uuucucuguucucuaacuguaa

SEQ ID NO: 311011 - RNA, 22 nt, Human
agccauugaauuuagugccuuu

SEQ ID NO: 311012 - RNA, 22 nt, Human
gcugucugucucugucccacca

SEQ ID NO: 311013 - RNA, 22 nt, Human
augggaggaucacuugaggcca

SEQ ID NO: 311014 - RNA, 22 nt, Human
aggcugggaaaccugaaguugu

SEQ ID NO: 311015 - RNA, 22 nt, Human
agacucaagcagauaggaauua

SEQ ID NO: 311016 - RNA, 22 nt, Human
cagagcagggugcaccuugggc

SEQ ID NO: 311017 - RNA, 22 nt, Human
guccaugacugugacucacaug

SEQ ID NO: 311018 - RNA, 22 nt, Human
caguguuccaggcggcagugaa

SEQ ID NO: 311019 - RNA, 22 nt, Human
ugauuuccuaggucuggagaag

SEQ ID NO: 311020 - RNA, 22 nt, Human
ccaggaguuggagguugcagug

SEQ ID NO: 311021 - RNA, 22 nt, Human
ugacacagauuagagacauacc

SEQ ID NO: 311022 - RNA, 19 nt, Human
cugguccugacugaggggu

SEQ ID NO: 311023 - RNA, 22 nt, Human
ugccagcuccgaggagcugcag

SEQ ID NO: 311024 - RNA, 22 nt, Human
ccugcccugucacuggcuaggg

SEQ ID NO: 311025 - RNA, 22 nt, Human
ccaggcccuugcaagucccacc

SEQ ID NO: 311026 - RNA, 22 nt, Human
cugcucugaguauuaacggagg

SEQ ID NO: 311027 - RNA, 22 nt, Human
uaggcaggugugcacugcccac

SEQ ID NO: 311028 - RNA, 22 nt, Human
agagccugaggaugucccagcu

SEQ ID NO: 311029 - RNA, 22 nt, Human
ugcugggcuggagcugccaggg

SEQ ID NO: 311030 - RNA, 22 nt, Human
uuuaaauggcauuuucccagau

SEQ ID NO: 311031 - RNA, 22 nt, Human
ggaugcaggacggcauggaugu

SEQ ID NO: 311032 - RNA, 22 nt, Human
uagugcuuaacacaaagugauu

SEQ ID NO: 311033 - RNA, 22 nt, Human
guguggcugugggagauguuca

SEQ ID NO: 311034 - RNA, 22 nt, Human
aggggagccgaggggcaucugu

SEQ ID NO: 311035 - RNA, 22 nt, Human
ggaggccaaggaggagcuugcc

SEQ ID NO: 311036 - RNA, 22 nt, Human
cugagcugguggaagcaugcag

SEQ ID NO: 311037 - RNA, 22 nt, Human
uucuuucagaacacaagugauu

SEQ ID NO: 311038 - RNA, 22 nt, Human
uuugcagcaaggagagagcauu

SEQ ID NO: 311039 - RNA, 22 nt, Human
uuuaagaaguuauguuauaaau

SEQ ID NO: 311040 - RNA, 22 nt, Human
uagaaaguaaaucaguuuuauu

SEQ ID NO: 311041 - RNA, 22 nt, Human
cucagggggaaucaggucacag

SEQ ID NO: 311042 - RNA, 22 nt, Human
gagcugaauugaagcaaggagc

SEQ ID NO: 311043 - RNA, 22 nt, Human
gcaggggcaggagaucucaggc

SEQ ID NO: 311044 - RNA, 22 nt, Human
ggcagcuccaaaaggaaacacu

SEQ ID NO: 311045 - RNA, 22 nt, Human
gagagcugggggacuguggaug

SEQ ID NO: 311046 - RNA, 22 nt, Human
cuucccagaccuuagagugcag

SEQ ID NO: 311047 - RNA, 23 nt, Human
cugcccugaucuugaucuauugu

SEQ ID NO: 311048 - RNA, 23 nt, Human
ccucagcauggcaggagcccagc

SEQ ID NO: 311049 - RNA, 20 nt, Human
aagagaagaagucuuugaaa

SEQ ID NO: 311050 - RNA, 22 nt, Human
agaggugacauaggagaggcuc

SEQ ID NO: 311051 - RNA, 19 nt, Human
uccucaggggcucacagac

SEQ ID NO: 311052 - RNA, 21 nt, Human
uccugccuuaguccagagcag

SEQ ID NO: 311053 - RNA, 22 nt, Human
ucucagggaccaugaugaugac

SEQ ID NO: 311054 - RNA, 22 nt, Human
caaaguuuuaguaaacauauau

SEQ ID NO: 311055 - RNA, 22 nt, Human
ggagcugcauuuagggagccuu

SEQ ID NO: 311056 - RNA, 22 nt, Human
ucuccugugcacccucccugug

SEQ ID NO: 311057 - RNA, 22 nt, Human
gacacagcacuguacaaggaau

SEQ ID NO: 311058 - RNA, 22 nt, Human
gccagcuggagacuggcagggg

SEQ ID NO: 311059 - RNA, 22 nt, Human
uguaugaaugggaaaaggaaac

SEQ ID NO: 311060 - RNA, 22 nt, Human
ggcgcuggccacgguggcucug

SEQ ID NO: 311061 - RNA, 22 nt, Human
uuagccauugucagcacauggc

SEQ ID NO: 311062 - RNA, 23 nt, Human
cagugcagggcaacucagacucc

SEQ ID NO: 311063 - RNA, 22 nt, Human
agccugagugcuuaggacuguu

SEQ ID NO: 311064 - RNA, 22 nt, Human
cucucaguccugcgcgccucug

SEQ ID NO: 311065 - RNA, 22 nt, Human
ucugagcuacgaugccugucac

SEQ ID NO: 311066 - RNA, 22 nt, Human
gcuggagauaguaggauccaua

SEQ ID NO: 311067 - RNA, 19 nt, Human
ggaugagggucaggcauag

SEQ ID NO: 311068 - RNA, 22 nt, Human
gagauuggccuggcuugccaac

SEQ ID NO: 311069 - RNA, 22 nt, Human
cagagccuaaaacgacuccacu

SEQ ID NO: 311070 - RNA, 22 nt, Human
aguccuggacuuggagucaggg

SEQ ID NO: 311071 - RNA, 22 nt, Human
aguguuucccaguaggaugaaa

SEQ ID NO: 311072 - RNA, 22 nt, Human
gcucugagagugggugauucug

SEQ ID NO: 311073 - RNA, 22 nt, Human
gaucuucuagcagaaguaauuu

SEQ ID NO: 311074 - RNA, 22 nt, Human
ggagcugggguuggcaucuucc

SEQ ID NO: 311075 - RNA, 22 nt, Human
agcuuuaugggagcuuagauaa

SEQ ID NO: 311076 - RNA, 22 nt, Human
uguaacaguaagccugugagcu

SEQ ID NO: 311077 - RNA, 22 nt, Human
cucugcugcccaggccugcuag

SEQ ID NO: 311078 - RNA, 22 nt, Human
ugggaccaagucauuucuuuag

SEQ ID NO: 311079 - RNA, 22 nt, Human
aaugaugguuaaacacuggagg

SEQ ID NO: 311080 - RNA, 22 nt, Human
acuguacuguguauuguagaau

SEQ ID NO: 311081 - RNA, 22 nt, Human
augcuacagaguuugaauaugu

SEQ ID NO: 311082 - RNA, 22 nt, Human
acuggaaaugagaugauaucag

SEQ ID NO: 311083 - RNA, 22 nt, Human
acaggagugaaucuggcacuua

SEQ ID NO: 311084 - RNA, 22 nt, Human
gggcuccuccucugacuguggc

SEQ ID NO: 311085 - RNA, 22 nt, Human
cucacuguuuaauagcuggauc

SEQ ID NO: 311086 - RNA, 22 nt, Human
aaagcaaugaugguagacacgu

SEQ ID NO: 311087 - RNA, 22 nt, Human
ucucucuugucaccccaucugc
